United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 77

SEQ ID NO: 2785802 - RNA, 16 nt, Leptospira interrogans serovar lai str. 56601
auaagguuuuauaaaa

SEQ ID NO: 2785803 - RNA, 20 nt, Leptospira interrogans serovar lai str. 56601
auaagguuuuauaaaaugaa

SEQ ID NO: 2785804 - RNA, 21 nt, Leptospira interrogans serovar lai str. 56601
auaaguaaguugagaauauaa

SEQ ID NO: 2785805 - RNA, 23 nt, Leptospira interrogans serovar lai str. 56601
auaaguaauuuguggaaacuauu

SEQ ID NO: 2785806 - RNA, 12 nt, Leptospira interrogans serovar lai str. 56601
auaaguauuaua

SEQ ID NO: 2785807 - RNA, 18 nt, Leptospira interrogans serovar lai str. 56601
auaagucgaucuacuaaa

SEQ ID NO: 2785808 - RNA, 15 nt, Leptospira interrogans serovar lai str. 56601
auaaguguaugaaaa

SEQ ID NO: 2785809 - RNA, 13 nt, Leptospira interrogans serovar lai str. 56601
auaaguuaaauuu

SEQ ID NO: 2785810 - RNA, 16 nt, Leptospira interrogans serovar lai str. 56601
auaaguuaagugaaaa

SEQ ID NO: 2785811 - RNA, 16 nt, Leptospira interrogans serovar lai str. 56601
auaaguuccuuaaaag

SEQ ID NO: 2785812 - RNA, 20 nt, Leptospira interrogans serovar lai str. 56601
auaaguucgguguaaaaaau

SEQ ID NO: 2785813 - RNA, 21 nt, Leptospira interrogans serovar lai str. 56601
auaaguucgucugagaaaaac

SEQ ID NO: 2785814 - RNA, 17 nt, Leptospira interrogans serovar lai str. 56601
auaaguuuacaucaacu

SEQ ID NO: 2785815 - RNA, 14 nt, Leptospira interrogans serovar lai str. 56601
auaauaaaauuauu

SEQ ID NO: 2785816 - RNA, 19 nt, Leptospira interrogans serovar lai str. 56601
auaauaaaauuauuaacua

SEQ ID NO: 2785817 - RNA, 13 nt, Leptospira interrogans serovar lai str. 56601
auaauaaaguacu

SEQ ID NO: 2785818 - RNA, 16 nt, Leptospira interrogans serovar lai str. 56601
auaauaaauuuuucug

SEQ ID NO: 2785819 - RNA, 23 nt, Leptospira interrogans serovar lai str. 56601
auaauaagagugcagauuaaaaa

SEQ ID NO: 2785820 - RNA, 22 nt, Leptospira interrogans serovar lai str. 56601
auaauaauuagaaaaauauuuu

SEQ ID NO: 2785821 - RNA, 22 nt, Leptospira interrogans serovar lai str. 56601
auaauaauuuuagaauauuaug

SEQ ID NO: 2785822 - RNA, 22 nt, Leptospira interrogans serovar lai str. 56601
auaauaccuauacaauucuuuc

SEQ ID NO: 2785823 - RNA, 19 nt, Leptospira interrogans serovar lai str. 56601
auaauacuaccaaagcuug

SEQ ID NO: 2785824 - RNA, 17 nt, Leptospira interrogans serovar lai str. 56601
auaauagaguuacagaa

SEQ ID NO: 2785825 - RNA, 22 nt, Leptospira interrogans serovar lai str. 56601
auaauagaguuacagaaaaaau

SEQ ID NO: 2785826 - RNA, 14 nt, Leptospira interrogans serovar lai str. 56601
auaauagauuucug

SEQ ID NO: 2785827 - RNA, 23 nt, Leptospira interrogans serovar lai str. 56601
auaauaguuacgacauuuuaaua

SEQ ID NO: 2785828 - RNA, 19 nt, Leptospira interrogans serovar lai str. 56601
auaauaugaauucauugua

SEQ ID NO: 2785829 - RNA, 13 nt, Leptospira interrogans serovar lai str. 56601
auaauauuauaaa

SEQ ID NO: 2785830 - RNA, 15 nt, Leptospira interrogans serovar lai str. 56601
auaauauuauaaaua

SEQ ID NO: 2785831 - RNA, 15 nt, Leptospira interrogans serovar lai str. 56601
auaauauucuaauuu

SEQ ID NO: 2785832 - RNA, 11 nt, Leptospira interrogans serovar lai str. 56601
auaauauuuau

SEQ ID NO: 2785833 - RNA, 21 nt, Leptospira interrogans serovar lai str. 56601
auacaccaugccauuuuuagu

SEQ ID NO: 2785834 - RNA, 17 nt, Leptospira interrogans serovar lai str. 56601
auacagaauaaauacau

SEQ ID NO: 2785835 - RNA, 18 nt, Leptospira interrogans serovar lai str. 56601
auacaggaaacauuauau

SEQ ID NO: 2785836 - RNA, 17 nt, Leptospira interrogans serovar lai str. 56601
auacaggcgguuuaaaa

SEQ ID NO: 2785837 - RNA, 18 nt, Leptospira interrogans serovar lai str. 56601
auacaggcgguuuaaaag

SEQ ID NO: 2785838 - RNA, 17 nt, Leptospira interrogans serovar lai str. 56601
auacagugucuugaaau

SEQ ID NO: 2785839 - RNA, 19 nt, Leptospira interrogans serovar lai str. 56601
auacaguuugaucuuuuug

SEQ ID NO: 2785840 - RNA, 21 nt, Leptospira interrogans serovar lai str. 56601
auacauaaacgauuauuuuuu

SEQ ID NO: 2785841 - RNA, 17 nt, Leptospira interrogans serovar lai str. 56601
auacauagauaaauccg

SEQ ID NO: 2785842 - RNA, 16 nt, Leptospira interrogans serovar lai str. 56601
auacauuaagauuaua

SEQ ID NO: 2785843 - RNA, 14 nt, Leptospira interrogans serovar lai str. 56601
auacauucuuauaa

SEQ ID NO: 2785844 - RNA, 13 nt, Leptospira interrogans serovar lai str. 56601
auacauuugcuuu

SEQ ID NO: 2785845 - RNA, 18 nt, Leptospira interrogans serovar lai str. 56601
auacauuugcuuugucau

SEQ ID NO: 2785846 - RNA, 13 nt, Leptospira interrogans serovar lai str. 56601
auacauuuuguau

SEQ ID NO: 2785847 - RNA, 14 nt, Leptospira interrogans serovar lai str. 56601
auacauuuuuagaa

SEQ ID NO: 2785848 - RNA, 17 nt, Leptospira interrogans serovar lai str. 56601
auacauuuuuagaauuu

SEQ ID NO: 2785849 - RNA, 12 nt, Leptospira interrogans serovar lai str. 56601
auaccaaaaaag

SEQ ID NO: 2785850 - RNA, 14 nt, Leptospira interrogans serovar lai str. 56601
auaccaaaaaagua

SEQ ID NO: 2785851 - RNA, 19 nt, Leptospira interrogans serovar lai str. 56601
auaccaaauaaauauuucc

SEQ ID NO: 2785852 - RNA, 22 nt, Leptospira interrogans serovar lai str. 56601
auaccaaguucgauuaaaauaa

SEQ ID NO: 2785853 - RNA, 15 nt, Leptospira interrogans serovar lai str. 56601
auaccaauaacuuaa

SEQ ID NO: 2785854 - RNA, 23 nt, Leptospira interrogans serovar lai str. 56601
auaccagccugccaaaagaacuu

SEQ ID NO: 2785855 - RNA, 14 nt, Leptospira interrogans serovar lai str. 56601
auaccauucauuuc

SEQ ID NO: 2785856 - RNA, 16 nt, Leptospira interrogans serovar lai str. 56601
auaccgggauuuuaaa

SEQ ID NO: 2785857 - RNA, 23 nt, Leptospira interrogans serovar lai str. 56601
auaccgggccuuuuuuauuucug

SEQ ID NO: 2785858 - RNA, 13 nt, Leptospira interrogans serovar lai str. 56601
auaccuguuuuag

SEQ ID NO: 2785859 - RNA, 21 nt, Leptospira interrogans serovar lai str. 56601
auaccuguuuuaguucaaaaa

SEQ ID NO: 2785860 - RNA, 21 nt, Leptospira interrogans serovar lai str. 56601
auaccuugggcugguaagccu

SEQ ID NO: 2785861 - RNA, 22 nt, Leptospira interrogans serovar lai str. 56601
auacgaauuuaacuaguuccuu

SEQ ID NO: 2785862 - RNA, 17 nt, Leptospira interrogans serovar lai str. 56601
auacgacagauucaauu

SEQ ID NO: 2785863 - RNA, 13 nt, Leptospira interrogans serovar lai str. 56601
auacgcuucucuu

SEQ ID NO: 2785864 - RNA, 18 nt, Leptospira interrogans serovar lai str. 56601
auacggaugugaauucuc

SEQ ID NO: 2785865 - RNA, 14 nt, Leptospira interrogans serovar lai str. 56601
auacggcacucaau

SEQ ID NO: 2785866 - RNA, 13 nt, Leptospira interrogans serovar lai str. 56601
auacguuauucua

SEQ ID NO: 2785867 - RNA, 22 nt, Leptospira interrogans serovar lai str. 56601
auacguuauucuauucguauuu

SEQ ID NO: 2785868 - RNA, 21 nt, Leptospira interrogans serovar lai str. 56601
auacguuccuucuacaauccu

SEQ ID NO: 2785869 - RNA, 20 nt, Leptospira interrogans serovar lai str. 56601
auacuaaaagaguaauucua

SEQ ID NO: 2785870 - RNA, 13 nt, Leptospira interrogans serovar lai str. 56601
auacuaaaauuau

SEQ ID NO: 2785871 - RNA, 20 nt, Leptospira interrogans serovar lai str. 56601
auacuaaaauuauucugaau

SEQ ID NO: 2785872 - RNA, 14 nt, Leptospira interrogans serovar lai str. 56601
auacuaaauuaagu

SEQ ID NO: 2785873 - RNA, 18 nt, Leptospira interrogans serovar lai str. 56601
auacuaaauuaaguuuau

SEQ ID NO: 2785874 - RNA, 23 nt, Leptospira interrogans serovar lai str. 56601
auacuaaauuauuuucaaguaaa

SEQ ID NO: 2785875 - RNA, 19 nt, Leptospira interrogans serovar lai str. 56601
auacuaauaguuuuacaaa

SEQ ID NO: 2785876 - RNA, 15 nt, Leptospira interrogans serovar lai str. 56601
auacuagaacaauaa

SEQ ID NO: 2785877 - RNA, 23 nt, Leptospira interrogans serovar lai str. 56601
auacuagggaaagaugauuuugu

SEQ ID NO: 2785878 - RNA, 20 nt, Leptospira interrogans serovar lai str. 56601
auacuauaacuuuaaaaaau

SEQ ID NO: 2785879 - RNA, 22 nt, Leptospira interrogans serovar lai str. 56601
auacuauacaacucaguuuuac

SEQ ID NO: 2785880 - RNA, 23 nt, Leptospira interrogans serovar lai str. 56601
auacucaauauuuuguuuugaaa

SEQ ID NO: 2785881 - RNA, 21 nt, Leptospira interrogans serovar lai str. 56601
auacucaauuugauaugaauc

SEQ ID NO: 2785882 - RNA, 18 nt, Leptospira interrogans serovar lai str. 56601
auacucauaaaauuugcu

SEQ ID NO: 2785883 - RNA, 15 nt, Leptospira interrogans serovar lai str. 56601
auacuuaaaaauacc

SEQ ID NO: 2785884 - RNA, 18 nt, Leptospira interrogans serovar lai str. 56601
auacuuaagcucuaauau

SEQ ID NO: 2785885 - RNA, 16 nt, Leptospira interrogans serovar lai str. 56601
auacuuacacuccuca

SEQ ID NO: 2785886 - RNA, 22 nt, Leptospira interrogans serovar lai str. 56601
auacuuagaauuuuuucguucc

SEQ ID NO: 2785887 - RNA, 17 nt, Leptospira interrogans serovar lai str. 56601
auacuuauaaagaauuu

SEQ ID NO: 2785888 - RNA, 14 nt, Leptospira interrogans serovar lai str. 56601
auacuucaaaauua

SEQ ID NO: 2785889 - RNA, 19 nt, Leptospira interrogans serovar lai str. 56601
auacuucuaaaaaauucuu

SEQ ID NO: 2785890 - RNA, 16 nt, Leptospira interrogans serovar lai str. 56601
auacuugauauuucug

SEQ ID NO: 2785891 - RNA, 18 nt, Leptospira interrogans serovar lai str. 56601
auacuugccauggaaauu

SEQ ID NO: 2785892 - RNA, 17 nt, Leptospira interrogans serovar lai str. 56601
auacuugccguuacaua

SEQ ID NO: 2785893 - RNA, 19 nt, Leptospira interrogans serovar lai str. 56601
auacuuuaauaauaugaau

SEQ ID NO: 2785894 - RNA, 17 nt, Leptospira interrogans serovar lai str. 56601
auacuuuagaaauuucu

SEQ ID NO: 2785895 - RNA, 17 nt, Leptospira interrogans serovar lai str. 56601
auacuuucaaaaaauau

SEQ ID NO: 2785896 - RNA, 12 nt, Leptospira interrogans serovar lai str. 56601
auacuuuuaaaa

SEQ ID NO: 2785897 - RNA, 14 nt, Leptospira interrogans serovar lai str. 56601
auacuuuuaaaaag

SEQ ID NO: 2785898 - RNA, 15 nt, Leptospira interrogans serovar lai str. 56601
auacuuuuaaaaagu

SEQ ID NO: 2785899 - RNA, 17 nt, Leptospira interrogans serovar lai str. 56601
auacuuuuaaaaaguuc

SEQ ID NO: 2785900 - RNA, 19 nt, Leptospira interrogans serovar lai str. 56601
auacuuuuagaagauuuuu

SEQ ID NO: 2785901 - RNA, 20 nt, Leptospira interrogans serovar lai str. 56601
auacuuuuagaagauuuuua

SEQ ID NO: 2785902 - RNA, 11 nt, Leptospira interrogans serovar lai str. 56601
auacuuuucuu

SEQ ID NO: 2785903 - RNA, 12 nt, Leptospira interrogans serovar lai str. 56601
auacuuuucuuc

SEQ ID NO: 2785904 - RNA, 22 nt, Leptospira interrogans serovar lai str. 56601
auacuuuuugcaaguaaaaaga

SEQ ID NO: 2785905 - RNA, 15 nt, Leptospira interrogans serovar lai str. 56601
auacuuuuuugauac

SEQ ID NO: 2785906 - RNA, 14 nt, Leptospira interrogans serovar lai str. 56601
auagaaaaaauaca

SEQ ID NO: 2785907 - RNA, 23 nt, Leptospira interrogans serovar lai str. 56601
auagaaaccaguaauaguuugua

SEQ ID NO: 2785908 - RNA, 21 nt, Leptospira interrogans serovar lai str. 56601
auagaaacggugcauuuaaaa

SEQ ID NO: 2785909 - RNA, 22 nt, Leptospira interrogans serovar lai str. 56601
auagaaacggugcauuuaaaaa

SEQ ID NO: 2785910 - RNA, 21 nt, Leptospira interrogans serovar lai str. 56601
auagaaagcccguucuguuga

SEQ ID NO: 2785911 - RNA, 12 nt, Leptospira interrogans serovar lai str. 56601
auagaaaguaaa

SEQ ID NO: 2785912 - RNA, 13 nt, Leptospira interrogans serovar lai str. 56601
auagaaauaccau

SEQ ID NO: 2785913 - RNA, 16 nt, Leptospira interrogans serovar lai str. 56601
auagaaauacuuaaaa

SEQ ID NO: 2785914 - RNA, 17 nt, Leptospira interrogans serovar lai str. 56601
auagaaauacuuaaaau

SEQ ID NO: 2785915 - RNA, 17 nt, Leptospira interrogans serovar lai str. 56601
auagaaauuuucaaaaa

SEQ ID NO: 2785916 - RNA, 19 nt, Leptospira interrogans serovar lai str. 56601
auaguucccacaaauuacu

SEQ ID NO: 2785917 - RNA, 20 nt, Leptospira interrogans serovar lai str. 56601
auaguucccacaaauugagu

SEQ ID NO: 2785918 - RNA, 13 nt, Leptospira interrogans serovar lai str. 56601
auaguucccacag

SEQ ID NO: 2785919 - RNA, 13 nt, Leptospira interrogans serovar lai str. 56601
auaguucccacau

SEQ ID NO: 2785920 - RNA, 14 nt, Leptospira interrogans serovar lai str. 56601
auaguugaaauuca

SEQ ID NO: 2785921 - RNA, 12 nt, Leptospira interrogans serovar lai str. 56601
auaguuuacaua

SEQ ID NO: 2785922 - RNA, 16 nt, Leptospira interrogans serovar lai str. 56601
auaguuuuaugugggu

SEQ ID NO: 2785923 - RNA, 16 nt, Leptospira interrogans serovar lai str. 56601
auaguuuugagauuac

SEQ ID NO: 2785924 - RNA, 21 nt, Leptospira interrogans serovar lai str. 56601
auaguuuugagauuacaaaaa

SEQ ID NO: 2785925 - RNA, 22 nt, Leptospira interrogans serovar lai str. 56601
auaguuuugagcauaaaaaaau

SEQ ID NO: 2785926 - RNA, 16 nt, Leptospira interrogans serovar lai str. 56601
auaguuuuuucaaaaa

SEQ ID NO: 2785927 - RNA, 20 nt, Leptospira interrogans serovar lai str. 56601
auaguuuuuucaaaaauucc

SEQ ID NO: 2785928 - RNA, 14 nt, Leptospira interrogans serovar lai str. 56601
auauaaaaaauaau

SEQ ID NO: 2785929 - RNA, 13 nt, Leptospira interrogans serovar lai str. 56601
auauaaaaaaugu

SEQ ID NO: 2785930 - RNA, 12 nt, Leptospira interrogans serovar lai str. 56601
auauaaaauuug

SEQ ID NO: 2785931 - RNA, 13 nt, Leptospira interrogans serovar lai str. 56601
auauaaaucaauc

SEQ ID NO: 2785932 - RNA, 15 nt, Leptospira interrogans serovar lai str. 56601
auauaaaucaaucau

SEQ ID NO: 2785933 - RNA, 20 nt, Leptospira interrogans serovar lai str. 56601
auauaaauucgccguaaaaa

SEQ ID NO: 2785934 - RNA, 12 nt, Leptospira interrogans serovar lai str. 56601
auauaaauuuau

SEQ ID NO: 2785935 - RNA, 19 nt, Leptospira interrogans serovar lai str. 56601
auauaacaaaguauuuaau

SEQ ID NO: 2785936 - RNA, 20 nt, Leptospira interrogans serovar lai str. 56601
auauaacaaaguauuuaauu

SEQ ID NO: 2785937 - RNA, 14 nt, Leptospira interrogans serovar lai str. 56601
auauaacuuagucu

SEQ ID NO: 2785938 - RNA, 14 nt, Leptospira interrogans serovar lai str. 56601
auauaacuuuuuca

SEQ ID NO: 2785939 - RNA, 14 nt, Leptospira interrogans serovar lai str. 56601
auauaaguuaaauu

SEQ ID NO: 2785940 - RNA, 16 nt, Leptospira interrogans serovar lai str. 56601
auauaaguuaaauuuu

SEQ ID NO: 2785941 - RNA, 18 nt, Leptospira interrogans serovar lai str. 56601
auauaaguuaaauuuuuu

SEQ ID NO: 2785942 - RNA, 13 nt, Leptospira interrogans serovar lai str. 56601
auauaauaaaauc

SEQ ID NO: 2785943 - RNA, 22 nt, Leptospira interrogans serovar lai str. 56601
auauaaucuaagauugaaugaa

SEQ ID NO: 2785944 - RNA, 21 nt, Leptospira interrogans serovar lai str. 56601
auauaaucugauugagaaaau

SEQ ID NO: 2785945 - RNA, 18 nt, Leptospira interrogans serovar lai str. 56601
auauaauucuguaaaaua

SEQ ID NO: 2785946 - RNA, 16 nt, Leptospira interrogans serovar lai str. 56601
auauaauuuacuucau

SEQ ID NO: 2785947 - RNA, 21 nt, Leptospira interrogans serovar lai str. 56601
auauaauuuuauccauaaauc

SEQ ID NO: 2785948 - RNA, 14 nt, Leptospira interrogans serovar lai str. 56601
auauaauuuuuaac

SEQ ID NO: 2785949 - RNA, 19 nt, Leptospira interrogans serovar lai str. 56601
auauacaauaaauagaaua

SEQ ID NO: 2785950 - RNA, 14 nt, Leptospira interrogans serovar lai str. 56601
auauacaauaaauc

SEQ ID NO: 2785951 - RNA, 21 nt, Leptospira interrogans serovar lai str. 56601
auauacggauuucuauaaaau

SEQ ID NO: 2785952 - RNA, 17 nt, Leptospira interrogans serovar lai str. 56601
auauacguaaaaauaau

SEQ ID NO: 2785953 - RNA, 18 nt, Leptospira interrogans serovar lai str. 56601
auauacguaaaaauaaua

SEQ ID NO: 2785954 - RNA, 13 nt, Leptospira interrogans serovar lai str. 56601
auauacuuauaaa

SEQ ID NO: 2785955 - RNA, 13 nt, Leptospira interrogans serovar lai str. 56601
auauacuugauau

SEQ ID NO: 2785956 - RNA, 15 nt, Leptospira interrogans serovar lai str. 56601
auauagaaauuuuca

SEQ ID NO: 2785957 - RNA, 22 nt, Leptospira interrogans serovar lai str. 56601
auauagaaauuuucaaaaaaua

SEQ ID NO: 2785958 - RNA, 18 nt, Leptospira interrogans serovar lai str. 56601
auauagaaccaucucaaa

SEQ ID NO: 2785959 - RNA, 14 nt, Leptospira interrogans serovar lai str. 56601
auauagcucuugaa

SEQ ID NO: 2785960 - RNA, 18 nt, Leptospira interrogans serovar lai str. 56601
auauagcucuugaauaaa

SEQ ID NO: 2785961 - RNA, 13 nt, Leptospira interrogans serovar lai str. 56601
auauaguuaaauu

SEQ ID NO: 2785962 - RNA, 16 nt, Leptospira interrogans serovar lai str. 56601
auauaguuaaauuuug

SEQ ID NO: 2785963 - RNA, 19 nt, Leptospira interrogans serovar lai str. 56601
auauaguuaugaauaaaaa

SEQ ID NO: 2785964 - RNA, 20 nt, Leptospira interrogans serovar lai str. 56601
auauaguuaugaauaaaaaa

SEQ ID NO: 2785965 - RNA, 11 nt, Leptospira interrogans serovar lai str. 56601
auauaguuccu

SEQ ID NO: 2785966 - RNA, 17 nt, Leptospira interrogans serovar lai str. 56601
auauaguuuugagauua

SEQ ID NO: 2785967 - RNA, 21 nt, Leptospira interrogans serovar lai str. 56601
auauaguuuugagauuacaaa

SEQ ID NO: 2785968 - RNA, 23 nt, Leptospira interrogans serovar lai str. 56601
auauaguuuugagcauaaaaaaa

SEQ ID NO: 2785969 - RNA, 17 nt, Leptospira interrogans serovar lai str. 56601
auauauauucacaaaaa

SEQ ID NO: 2785970 - RNA, 20 nt, Leptospira interrogans serovar lai str. 56601
auauauauucacaaaaaaau

SEQ ID NO: 2785971 - RNA, 23 nt, Leptospira interrogans serovar lai str. 56601
auauauauuuugaacaaguucua

SEQ ID NO: 2785972 - RNA, 14 nt, Leptospira interrogans serovar lai str. 56601
auauaucaguuuug

SEQ ID NO: 2785973 - RNA, 17 nt, Leptospira interrogans serovar lai str. 56601
auauauccuuaugaaag

SEQ ID NO: 2785974 - RNA, 15 nt, Leptospira interrogans serovar lai str. 56601
auauauuagaauaua

SEQ ID NO: 2785975 - RNA, 16 nt, Leptospira interrogans serovar lai str. 56601
auauauuagaauauac

SEQ ID NO: 2785976 - RNA, 12 nt, Leptospira interrogans serovar lai str. 56601
auauauuauaau

SEQ ID NO: 2785977 - RNA, 17 nt, Leptospira interrogans serovar lai str. 56601
auauauucaauuucuuu

SEQ ID NO: 2785978 - RNA, 17 nt, Leptospira interrogans serovar lai str. 56601
auauauucacaaaaaaa

SEQ ID NO: 2785979 - RNA, 19 nt, Leptospira interrogans serovar lai str. 56601
auauauucacaaaaaaauu

SEQ ID NO: 2785980 - RNA, 13 nt, Leptospira interrogans serovar lai str. 56601
auauauucuuuuc

SEQ ID NO: 2785981 - RNA, 23 nt, Leptospira interrogans serovar lai str. 56601
auauauucuuuucugaauaaaaa

SEQ ID NO: 2785982 - RNA, 14 nt, Leptospira interrogans serovar lai str. 56601
auauauugaaauau

SEQ ID NO: 2785983 - RNA, 15 nt, Leptospira interrogans serovar lai str. 56601
auauauugaaauauu

SEQ ID NO: 2785984 - RNA, 18 nt, Leptospira interrogans serovar lai str. 56601
auauauugaaauauuaua

SEQ ID NO: 2785985 - RNA, 19 nt, Leptospira interrogans serovar lai str. 56601
auauauugaaauauuauaa

SEQ ID NO: 2785986 - RNA, 20 nt, Leptospira interrogans serovar lai str. 56601
auauauugaaauauuauaaa

SEQ ID NO: 2785987 - RNA, 12 nt, Leptospira interrogans serovar lai str. 56601
auauauuuuuaa

SEQ ID NO: 2785988 - RNA, 14 nt, Leptospira interrogans serovar lai str. 56601
auauauuuuuaaag

SEQ ID NO: 2785989 - RNA, 12 nt, Leptospira interrogans serovar lai str. 56601
auaucaaacuua

SEQ ID NO: 2785990 - RNA, 12 nt, Leptospira interrogans serovar lai str. 56601
auaucaaauuca

SEQ ID NO: 2785991 - RNA, 16 nt, Leptospira interrogans serovar lai str. 56601
auaucaaauucaugau

SEQ ID NO: 2785992 - RNA, 14 nt, Leptospira interrogans serovar lai str. 56601
auaucacaaauuuu

SEQ ID NO: 2785993 - RNA, 21 nt, Leptospira interrogans serovar lai str. 56601
auaucacaaauuuuaaaguaa

SEQ ID NO: 2785994 - RNA, 20 nt, Leptospira interrogans serovar lai str. 56601
auaucaguuuuguuaaccaa

SEQ ID NO: 2785995 - RNA, 14 nt, Leptospira interrogans serovar lai str. 56601
auaucauaaauuuu

SEQ ID NO: 2785996 - RNA, 22 nt, Leptospira interrogans serovar lai str. 56601
auaucauaacaaauaaaaggag

SEQ ID NO: 2785997 - RNA, 16 nt, Leptospira interrogans serovar lai str. 56601
auaucauauuguuuaa

SEQ ID NO: 2785998 - RNA, 13 nt, Leptospira interrogans serovar lai str. 56601
auauccaauuuca

SEQ ID NO: 2785999 - RNA, 17 nt, Leptospira interrogans serovar lai str. 56601
auauccgaaagauaaau

SEQ ID NO: 2786000 - RNA, 17 nt, Leptospira interrogans serovar lai str. 56601
auauuuaacuguaauua

SEQ ID NO: 2786001 - RNA, 20 nt, Leptospira interrogans serovar lai str. 56601
auauuuaacuguaauuagag

SEQ ID NO: 2786002 - RNA, 16 nt, Leptospira interrogans serovar lai str. 56601
auauuuagaauaaaau

SEQ ID NO: 2786003 - RNA, 15 nt, Leptospira interrogans serovar lai str. 56601
auauuuaguauuuua

SEQ ID NO: 2786004 - RNA, 13 nt, Leptospira interrogans serovar lai str. 56601
auauuuauaaaac

SEQ ID NO: 2786005 - RNA, 21 nt, Leptospira interrogans serovar lai str. 56601
auauuuauuuuuuuuaauaua

SEQ ID NO: 2786006 - RNA, 12 nt, Leptospira interrogans serovar lai str. 56601
auauuucaaaaa

SEQ ID NO: 2786007 - RNA, 13 nt, Leptospira interrogans serovar lai str. 56601
auauuucauucuu

SEQ ID NO: 2786008 - RNA, 18 nt, Leptospira interrogans serovar lai str. 56601
auauuucauugaaauaug

SEQ ID NO: 2786009 - RNA, 11 nt, Leptospira interrogans serovar lai str. 56601
auauuuccaaa

SEQ ID NO: 2786010 - RNA, 23 nt, Leptospira interrogans serovar lai str. 56601
auauuucguaagauaugaauuaa

SEQ ID NO: 2786011 - RNA, 16 nt, Leptospira interrogans serovar lai str. 56601
auauuucuaaaagaag

SEQ ID NO: 2786012 - RNA, 22 nt, Leptospira interrogans serovar lai str. 56601
auauuucuaaaagaagaugcuu

SEQ ID NO: 2786013 - RNA, 16 nt, Leptospira interrogans serovar lai str. 56601
auauuugaauuuuaua

SEQ ID NO: 2786014 - RNA, 13 nt, Leptospira interrogans serovar lai str. 56601
auauuugauauaa

SEQ ID NO: 2786015 - RNA, 21 nt, Leptospira interrogans serovar lai str. 56601
auauuugauauaaucuuaaua

SEQ ID NO: 2786016 - RNA, 18 nt, Leptospira interrogans serovar lai str. 56601
auauuuuaaagaaacuca

SEQ ID NO: 2786017 - RNA, 15 nt, Leptospira interrogans serovar lai str. 56601
auauuuuaauuuuau

SEQ ID NO: 2786018 - RNA, 15 nt, Leptospira interrogans serovar lai str. 56601
auauuuuccaaaaau

SEQ ID NO: 2786019 - RNA, 20 nt, Leptospira interrogans serovar lai str. 56601
auauuuuccaaaaauuuaaa

SEQ ID NO: 2786020 - RNA, 11 nt, Leptospira interrogans serovar lai str. 56601
auauuuuccuu

SEQ ID NO: 2786021 - RNA, 21 nt, Leptospira interrogans serovar lai str. 56601
auauuuucgccgaaacauucg

SEQ ID NO: 2786022 - RNA, 17 nt, Leptospira interrogans serovar lai str. 56601
auauuuugauaaagaau

SEQ ID NO: 2786023 - RNA, 21 nt, Leptospira interrogans serovar lai str. 56601
auauuuugaucuaauaauaua

SEQ ID NO: 2786024 - RNA, 16 nt, Leptospira interrogans serovar lai str. 56601
auauuuuguuuuuagu

SEQ ID NO: 2786025 - RNA, 17 nt, Leptospira interrogans serovar lai str. 56601
auauuuuuaaaaaguag

SEQ ID NO: 2786026 - RNA, 14 nt, Leptospira interrogans serovar lai str. 56601
auauuuuuaaacuc

SEQ ID NO: 2786027 - RNA, 16 nt, Leptospira interrogans serovar lai str. 56601
auauuuuuaaacucau

SEQ ID NO: 2786028 - RNA, 13 nt, Leptospira interrogans serovar lai str. 56601
auauuuuuaaagc

SEQ ID NO: 2786029 - RNA, 12 nt, Leptospira interrogans serovar lai str. 56601
auauuuuuagaa

SEQ ID NO: 2786030 - RNA, 22 nt, Leptospira interrogans serovar lai str. 56601
auauuuuuagaaaauuuuuacu

SEQ ID NO: 2786031 - RNA, 18 nt, Leptospira interrogans serovar lai str. 56601
auauuuuugugaaacuca

SEQ ID NO: 2786032 - RNA, 12 nt, Leptospira interrogans serovar lai str. 56601
auauuuuuuaaa

SEQ ID NO: 2786033 - RNA, 13 nt, Leptospira interrogans serovar lai str. 56601
auauuuuuuaaaa

SEQ ID NO: 2786034 - RNA, 14 nt, Leptospira interrogans serovar lai str. 56601
auauuuuuuccaaa

SEQ ID NO: 2786035 - RNA, 17 nt, Leptospira interrogans serovar lai str. 56601
auauuuuuuccaaaaag

SEQ ID NO: 2786036 - RNA, 23 nt, Leptospira interrogans serovar lai str. 56601
auauuuuuuccaaaaagaaaaac

SEQ ID NO: 2786037 - RNA, 13 nt, Leptospira interrogans serovar lai str. 56601
auauuuuuuuaau

SEQ ID NO: 2786038 - RNA, 15 nt, Leptospira interrogans serovar lai str. 56601
aucaaaaaaaugaua

SEQ ID NO: 2786039 - RNA, 12 nt, Leptospira interrogans serovar lai str. 56601
aucaaaaccauu

SEQ ID NO: 2786040 - RNA, 13 nt, Leptospira interrogans serovar lai str. 56601
aucaaaacuuaaa

SEQ ID NO: 2786041 - RNA, 16 nt, Leptospira interrogans serovar lai str. 56601
aucaaaaggaauacaa

SEQ ID NO: 2786042 - RNA, 17 nt, Leptospira interrogans serovar lai str. 56601
aucaaaaggaauacaau

SEQ ID NO: 2786043 - RNA, 16 nt, Leptospira interrogans serovar lai str. 56601
aucaaaagguauaaaa

SEQ ID NO: 2786044 - RNA, 17 nt, Leptospira interrogans serovar lai str. 56601
aucaaaagguauaaaau

SEQ ID NO: 2786045 - RNA, 18 nt, Leptospira interrogans serovar lai str. 56601
aucaaaagguauaaaaua

SEQ ID NO: 2786046 - RNA, 20 nt, Leptospira interrogans serovar lai str. 56601
aucaaaagguauaaaauaaa

SEQ ID NO: 2786047 - RNA, 13 nt, Leptospira interrogans serovar lai str. 56601
aucaaaauccguu

SEQ ID NO: 2786048 - RNA, 11 nt, Leptospira interrogans serovar lai str. 56601
aucaaaaugaa

SEQ ID NO: 2786049 - RNA, 14 nt, Leptospira interrogans serovar lai str. 56601
aucaaaauuucuuu

SEQ ID NO: 2786050 - RNA, 22 nt, Leptospira interrogans serovar lai str. 56601
aucaaacggucuuucuucugua

SEQ ID NO: 2786051 - RNA, 18 nt, Leptospira interrogans serovar lai str. 56601
aucaaacucguuucgucu

SEQ ID NO: 2786052 - RNA, 17 nt, Leptospira interrogans serovar lai str. 56601
aucaaacucuuuuucuu

SEQ ID NO: 2786053 - RNA, 20 nt, Leptospira interrogans serovar lai str. 56601
aucaaagaaacguuauacaa

SEQ ID NO: 2786054 - RNA, 15 nt, Leptospira interrogans serovar lai str. 56601
aucaaaggaaauaaa

SEQ ID NO: 2786055 - RNA, 17 nt, Leptospira interrogans serovar lai str. 56601
aucaaaggaaauaaaaa

SEQ ID NO: 2786056 - RNA, 14 nt, Leptospira interrogans serovar lai str. 56601
aucaaauacaaaau

SEQ ID NO: 2786057 - RNA, 23 nt, Leptospira interrogans serovar lai str. 56601
aucaaauaccgcgaaauaaaaac

SEQ ID NO: 2786058 - RNA, 18 nt, Leptospira interrogans serovar lai str. 56601
aucaaaucugaaauucau

SEQ ID NO: 2786059 - RNA, 16 nt, Leptospira interrogans serovar lai str. 56601
aucaaauucacauaaa

SEQ ID NO: 2786060 - RNA, 14 nt, Leptospira interrogans serovar lai str. 56601
aucaaauucaugau

SEQ ID NO: 2786061 - RNA, 21 nt, Leptospira interrogans serovar lai str. 56601
aucaaauucaugauaguuaau

SEQ ID NO: 2786062 - RNA, 14 nt, Leptospira interrogans serovar lai str. 56601
aucaaauuucugca

SEQ ID NO: 2786063 - RNA, 15 nt, Leptospira interrogans serovar lai str. 56601
aucaaauuucugcau

SEQ ID NO: 2786064 - RNA, 12 nt, Leptospira interrogans serovar lai str. 56601
aucaaauuuuug

SEQ ID NO: 2786065 - RNA, 14 nt, Leptospira interrogans serovar lai str. 56601
aucaaauuuuugaa

SEQ ID NO: 2786066 - RNA, 23 nt, Leptospira interrogans serovar lai str. 56601
aucaaauuuuugcauaaaaucgu

SEQ ID NO: 2786067 - RNA, 13 nt, Leptospira interrogans serovar lai str. 56601
aucaacaaaauua

SEQ ID NO: 2786068 - RNA, 16 nt, Leptospira interrogans serovar lai str. 56601
aucaacacaaauauua

SEQ ID NO: 2786069 - RNA, 19 nt, Leptospira interrogans serovar lai str. 56601
aucaacauuauguuaaacu

SEQ ID NO: 2786070 - RNA, 15 nt, Leptospira interrogans serovar lai str. 56601
aucaacucuguaaau

SEQ ID NO: 2786071 - RNA, 20 nt, Leptospira interrogans serovar lai str. 56601
aucaacucuguaaauucaaa

SEQ ID NO: 2786072 - RNA, 17 nt, Leptospira interrogans serovar lai str. 56601
aucaacuuggaaucuua

SEQ ID NO: 2786073 - RNA, 21 nt, Leptospira interrogans serovar lai str. 56601
aucaacuuggaaucuuaaaaa

SEQ ID NO: 2786074 - RNA, 13 nt, Leptospira interrogans serovar lai str. 56601
aucaacuuuucca

SEQ ID NO: 2786075 - RNA, 12 nt, Leptospira interrogans serovar lai str. 56601
aucaagauuuua

SEQ ID NO: 2786076 - RNA, 16 nt, Leptospira interrogans serovar lai str. 56601
aucaauagaaauacca

SEQ ID NO: 2786077 - RNA, 15 nt, Leptospira interrogans serovar lai str. 56601
aucaauagaaauacu

SEQ ID NO: 2786078 - RNA, 15 nt, Leptospira interrogans serovar lai str. 56601
aucaauagaauuguu

SEQ ID NO: 2786079 - RNA, 21 nt, Leptospira interrogans serovar lai str. 56601
aucaauagagucguugaaaaa

SEQ ID NO: 2786080 - RNA, 20 nt, Leptospira interrogans serovar lai str. 56601
aucaauccuguaaauucaaa

SEQ ID NO: 2786081 - RNA, 19 nt, Leptospira interrogans serovar lai str. 56601
aucaauggaaaauuaauuu

SEQ ID NO: 2786082 - RNA, 22 nt, Leptospira interrogans serovar lai str. 56601
aucaauggaaaauuaauuuuuc

SEQ ID NO: 2786083 - RNA, 23 nt, Leptospira interrogans serovar lai str. 56601
aucaauggaaaauuaauuuuuca

SEQ ID NO: 2786084 - RNA, 16 nt, Leptospira interrogans serovar lai str. 56601
auccacaaagucucca

SEQ ID NO: 2786085 - RNA, 15 nt, Leptospira interrogans serovar lai str. 56601
auccacuaaaauacu

SEQ ID NO: 2786086 - RNA, 14 nt, Leptospira interrogans serovar lai str. 56601
auccacuacggaag

SEQ ID NO: 2786087 - RNA, 15 nt, Leptospira interrogans serovar lai str. 56601
auccaggauuuucac

SEQ ID NO: 2786088 - RNA, 22 nt, Leptospira interrogans serovar lai str. 56601
auccauaaauucuacaaauucu

SEQ ID NO: 2786089 - RNA, 14 nt, Leptospira interrogans serovar lai str. 56601
auccauaaguuccu

SEQ ID NO: 2786090 - RNA, 18 nt, Leptospira interrogans serovar lai str. 56601
auccauaaguuccuuaaa

SEQ ID NO: 2786091 - RNA, 22 nt, Leptospira interrogans serovar lai str. 56601
auccauagaguguuguguugag

SEQ ID NO: 2786092 - RNA, 17 nt, Leptospira interrogans serovar lai str. 56601
auccaucguaucuuuca

SEQ ID NO: 2786093 - RNA, 21 nt, Leptospira interrogans serovar lai str. 56601
auccaucugagaauuucugca

SEQ ID NO: 2786094 - RNA, 23 nt, Leptospira interrogans serovar lai str. 56601
auccaugauuuguaauaguuccc

SEQ ID NO: 2786095 - RNA, 16 nt, Leptospira interrogans serovar lai str. 56601
auccaugucuucuaaa

SEQ ID NO: 2786096 - RNA, 21 nt, Leptospira interrogans serovar lai str. 56601
auccauuucuauaaauugagu

SEQ ID NO: 2786097 - RNA, 17 nt, Leptospira interrogans serovar lai str. 56601
auccauuuuuccguaaa

SEQ ID NO: 2786098 - RNA, 21 nt, Leptospira interrogans serovar lai str. 56601
auccauuuuuccguaaaaagu

SEQ ID NO: 2786099 - RNA, 18 nt, Leptospira interrogans serovar lai str. 56601
auccauuuuucugaaaaa

SEQ ID NO: 2786100 - RNA, 22 nt, Leptospira interrogans serovar lai str. 56601
aucccaaauucuuuccuuuccu

SEQ ID NO: 2786101 - RNA, 13 nt, Leptospira interrogans serovar lai str. 56601
aucccaguugaga

SEQ ID NO: 2786102 - RNA, 20 nt, Leptospira interrogans serovar lai str. 56601
aucccaugauagaguucuga

SEQ ID NO: 2786103 - RNA, 22 nt, Leptospira interrogans serovar lai str. 56601
aucccaugauagaguucugaaa

SEQ ID NO: 2786104 - RNA, 18 nt, Leptospira interrogans serovar lai str. 56601
aucccgauacagaauaaa

SEQ ID NO: 2786105 - RNA, 14 nt, Leptospira interrogans serovar lai str. 56601
aucccuuucgcauu

SEQ ID NO: 2786106 - RNA, 13 nt, Leptospira interrogans serovar lai str. 56601
auccgaaaaaccu

SEQ ID NO: 2786107 - RNA, 16 nt, Leptospira interrogans serovar lai str. 56601
auccgaaaaauuccac

SEQ ID NO: 2786108 - RNA, 16 nt, Leptospira interrogans serovar lai str. 56601
auccgaaaucccaaaa

SEQ ID NO: 2786109 - RNA, 20 nt, Leptospira interrogans serovar lai str. 56601
auccgaauuuuuacacacuc

SEQ ID NO: 2786110 - RNA, 13 nt, Leptospira interrogans serovar lai str. 56601
auccguaaaaauc

SEQ ID NO: 2786111 - RNA, 22 nt, Leptospira interrogans serovar lai str. 56601
auccguaaaaaucaaacucguu

SEQ ID NO: 2786112 - RNA, 13 nt, Leptospira interrogans serovar lai str. 56601
auccguuuuaaaa

SEQ ID NO: 2786113 - RNA, 22 nt, Leptospira interrogans serovar lai str. 56601
auccuaaagucgaauuuuuuca

SEQ ID NO: 2786114 - RNA, 16 nt, Leptospira interrogans serovar lai str. 56601
auccuagcuauuuuca

SEQ ID NO: 2786115 - RNA, 19 nt, Leptospira interrogans serovar lai str. 56601
auccuagcuauuuucagaa

SEQ ID NO: 2786116 - RNA, 15 nt, Leptospira interrogans serovar lai str. 56601
auccuauaauaaaau

SEQ ID NO: 2786117 - RNA, 16 nt, Leptospira interrogans serovar lai str. 56601
auccuauucaacuugu

SEQ ID NO: 2786118 - RNA, 21 nt, Leptospira interrogans serovar lai str. 56601
auccugaucuauguuauagac

SEQ ID NO: 2786119 - RNA, 13 nt, Leptospira interrogans serovar lai str. 56601
auccuuaaaauga

SEQ ID NO: 2786120 - RNA, 21 nt, Leptospira interrogans serovar lai str. 56601
auccuuaaaaugaaaauuaua

SEQ ID NO: 2786121 - RNA, 23 nt, Leptospira interrogans serovar lai str. 56601
auccuuaaaaugaaaauuauaag

SEQ ID NO: 2786122 - RNA, 23 nt, Leptospira interrogans serovar lai str. 56601
auccuuacuuaccucuauaaaau

SEQ ID NO: 2786123 - RNA, 15 nt, Leptospira interrogans serovar lai str. 56601
auccuuauacuuucc

SEQ ID NO: 2786124 - RNA, 20 nt, Leptospira interrogans serovar lai str. 56601
auccuuccaaaucugaaucu

SEQ ID NO: 2786125 - RNA, 20 nt, Leptospira interrogans serovar lai str. 56601
auccuuccuccaaaauauga

SEQ ID NO: 2786126 - RNA, 19 nt, Leptospira interrogans serovar lai str. 56601
auccuucgcauaacaaaaa

SEQ ID NO: 2786127 - RNA, 22 nt, Leptospira interrogans serovar lai str. 56601
auccuugggauaaauauucucu

SEQ ID NO: 2786128 - RNA, 21 nt, Leptospira interrogans serovar lai str. 56601
auccuuucauguuauaucgaa

SEQ ID NO: 2786129 - RNA, 21 nt, Leptospira interrogans serovar lai str. 56601
aucgaaaauuaacaaucgauu

SEQ ID NO: 2786130 - RNA, 20 nt, Leptospira interrogans serovar lai str. 56601
aucgaaauuaaaauaaaggc

SEQ ID NO: 2786131 - RNA, 17 nt, Leptospira interrogans serovar lai str. 56601
aucgaacagcccaaaaa

SEQ ID NO: 2786132 - RNA, 20 nt, Leptospira interrogans serovar lai str. 56601
aucgaacccagucuucuugu

SEQ ID NO: 2786133 - RNA, 15 nt, Leptospira interrogans serovar lai str. 56601
aucgaagagaagaug

SEQ ID NO: 2786134 - RNA, 21 nt, Leptospira interrogans serovar lai str. 56601
aucgaauucacguuaaaauaa

SEQ ID NO: 2786135 - RNA, 16 nt, Leptospira interrogans serovar lai str. 56601
aucgaauuucuucaua

SEQ ID NO: 2786136 - RNA, 13 nt, Leptospira interrogans serovar lai str. 56601
aucgacaaaacuu

SEQ ID NO: 2786137 - RNA, 20 nt, Leptospira interrogans serovar lai str. 56601
aucgacauuccccaaguaaa

SEQ ID NO: 2786138 - RNA, 14 nt, Leptospira interrogans serovar lai str. 56601
aucgacgauuuuac

SEQ ID NO: 2786139 - RNA, 23 nt, Leptospira interrogans serovar lai str. 56601
aucgauagaaguaguaguuccca

SEQ ID NO: 2786140 - RNA, 16 nt, Leptospira interrogans serovar lai str. 56601
aucgaucuguaaaauu

SEQ ID NO: 2786141 - RNA, 22 nt, Leptospira interrogans serovar lai str. 56601
aucgaucuguaaaauucagauu

SEQ ID NO: 2786142 - RNA, 15 nt, Leptospira interrogans serovar lai str. 56601
aucgaucuguaaagu

SEQ ID NO: 2786143 - RNA, 14 nt, Leptospira interrogans serovar lai str. 56601
aucgauuccaaucg

SEQ ID NO: 2786144 - RNA, 16 nt, Leptospira interrogans serovar lai str. 56601
aucgauucuuuuuacu

SEQ ID NO: 2786145 - RNA, 14 nt, Leptospira interrogans serovar lai str. 56601
aucgauuucuaaau

SEQ ID NO: 2786146 - RNA, 15 nt, Leptospira interrogans serovar lai str. 56601
aucgauuucuaaauu

SEQ ID NO: 2786147 - RNA, 22 nt, Leptospira interrogans serovar lai str. 56601
aucgauuuguaaaauucagauu

SEQ ID NO: 2786148 - RNA, 11 nt, Leptospira interrogans serovar lai str. 56601
aucgauuuuac

SEQ ID NO: 2786149 - RNA, 21 nt, Leptospira interrogans serovar lai str. 56601
aucgcauaaaauucuuugaga

SEQ ID NO: 2786150 - RNA, 22 nt, Leptospira interrogans serovar lai str. 56601
aucgcauuugacaauuugugaa

SEQ ID NO: 2786151 - RNA, 18 nt, Leptospira interrogans serovar lai str. 56601
aucgcguuugaaacucag

SEQ ID NO: 2786152 - RNA, 18 nt, Leptospira interrogans serovar lai str. 56601
aucgcucgcaaauuuuau

SEQ ID NO: 2786153 - RNA, 21 nt, Leptospira interrogans serovar lai str. 56601
aucgcucugaaguaucucuuc

SEQ ID NO: 2786154 - RNA, 22 nt, Leptospira interrogans serovar lai str. 56601
aucgcugguuuuauuucugcug

SEQ ID NO: 2786155 - RNA, 14 nt, Leptospira interrogans serovar lai str. 56601
aucgcuguuuugug

SEQ ID NO: 2786156 - RNA, 24 nt, Leptospira interrogans serovar lai str. 56601
aucgcuucuaugguccucuacagg

SEQ ID NO: 2786157 - RNA, 13 nt, Leptospira interrogans serovar lai str. 56601
aucggaaccaaag

SEQ ID NO: 2786158 - RNA, 18 nt, Leptospira interrogans serovar lai str. 56601
aucggagaauaaggcaaa

SEQ ID NO: 2786159 - RNA, 17 nt, Leptospira interrogans serovar lai str. 56601
aucggcaauugaagcag

SEQ ID NO: 2786160 - RNA, 15 nt, Leptospira interrogans serovar lai str. 56601
aucggcguucuacaa

SEQ ID NO: 2786161 - RNA, 21 nt, Leptospira interrogans serovar lai str. 56601
aucgguucacguuaauugaga

SEQ ID NO: 2786162 - RNA, 14 nt, Leptospira interrogans serovar lai str. 56601
aucgguuuuagaau

SEQ ID NO: 2786163 - RNA, 15 nt, Leptospira interrogans serovar lai str. 56601
aucguaaaaaaauau

SEQ ID NO: 2786164 - RNA, 21 nt, Leptospira interrogans serovar lai str. 56601
aucguaaaaaagauaaaaaga

SEQ ID NO: 2786165 - RNA, 23 nt, Leptospira interrogans serovar lai str. 56601
aucguaaaaaagauaaaaagaga

SEQ ID NO: 2786166 - RNA, 19 nt, Leptospira interrogans serovar lai str. 56601
aucucguauugaauuuuuu

SEQ ID NO: 2786167 - RNA, 22 nt, Leptospira interrogans serovar lai str. 56601
aucucuaacaaaaaguguuuau

SEQ ID NO: 2786168 - RNA, 17 nt, Leptospira interrogans serovar lai str. 56601
aucucugauaauuuuuu

SEQ ID NO: 2786169 - RNA, 23 nt, Leptospira interrogans serovar lai str. 56601
aucucugauaauuuuuuaaaaaa

SEQ ID NO: 2786170 - RNA, 20 nt, Leptospira interrogans serovar lai str. 56601
aucucuucgucucaccaaca

SEQ ID NO: 2786171 - RNA, 19 nt, Leptospira interrogans serovar lai str. 56601
aucucuuuuacgacuuuau

SEQ ID NO: 2786172 - RNA, 13 nt, Leptospira interrogans serovar lai str. 56601
aucucuuuuucuc

SEQ ID NO: 2786173 - RNA, 17 nt, Leptospira interrogans serovar lai str. 56601
aucugaaauucaucaaa

SEQ ID NO: 2786174 - RNA, 17 nt, Leptospira interrogans serovar lai str. 56601
aucugaaccugcaaauu

SEQ ID NO: 2786175 - RNA, 22 nt, Leptospira interrogans serovar lai str. 56601
aucugauugagaaaauaaaaaa

SEQ ID NO: 2786176 - RNA, 20 nt, Leptospira interrogans serovar lai str. 56601
aucugcgauuaaagauuuuu

SEQ ID NO: 2786177 - RNA, 16 nt, Leptospira interrogans serovar lai str. 56601
aucugcuuuuuuaaac

SEQ ID NO: 2786178 - RNA, 19 nt, Leptospira interrogans serovar lai str. 56601
aucugcuuuuuuaaaccuu

SEQ ID NO: 2786179 - RNA, 17 nt, Leptospira interrogans serovar lai str. 56601
aucugggcaaauuuagc

SEQ ID NO: 2786180 - RNA, 21 nt, Leptospira interrogans serovar lai str. 56601
aucuguaaaaugaugugggaa

SEQ ID NO: 2786181 - RNA, 16 nt, Leptospira interrogans serovar lai str. 56601
aucuguaaaauguaga

SEQ ID NO: 2786182 - RNA, 15 nt, Leptospira interrogans serovar lai str. 56601
aucuguaaaauucag

SEQ ID NO: 2786183 - RNA, 16 nt, Leptospira interrogans serovar lai str. 56601
aucuguaaaauucaga

SEQ ID NO: 2786184 - RNA, 21 nt, Leptospira interrogans serovar lai str. 56601
aucuguaaaguuuagauuuua

SEQ ID NO: 2786185 - RNA, 14 nt, Leptospira interrogans serovar lai str. 56601
aucuguaaaucaac

SEQ ID NO: 2786186 - RNA, 21 nt, Leptospira interrogans serovar lai str. 56601
aucugucggaauuacgacaaa

SEQ ID NO: 2786187 - RNA, 14 nt, Leptospira interrogans serovar lai str. 56601
aucuguggagaaaa

SEQ ID NO: 2786188 - RNA, 15 nt, Leptospira interrogans serovar lai str. 56601
aucugugggaacuac

SEQ ID NO: 2786189 - RNA, 21 nt, Leptospira interrogans serovar lai str. 56601
aucugugggaacucucacaaa

SEQ ID NO: 2786190 - RNA, 18 nt, Leptospira interrogans serovar lai str. 56601
aucuguuuagaauauuuu

SEQ ID NO: 2786191 - RNA, 19 nt, Leptospira interrogans serovar lai str. 56601
aucuguuucuauuuuaugu

SEQ ID NO: 2786192 - RNA, 21 nt, Leptospira interrogans serovar lai str. 56601
aucuguuucuauuuuauguaa

SEQ ID NO: 2786193 - RNA, 17 nt, Leptospira interrogans serovar lai str. 56601
aucuguuuuguuuccuu

SEQ ID NO: 2786194 - RNA, 14 nt, Leptospira interrogans serovar lai str. 56601
aucuuaaaaugauu

SEQ ID NO: 2786195 - RNA, 23 nt, Leptospira interrogans serovar lai str. 56601
aucuuaaauaucgaauuucuuca

SEQ ID NO: 2786196 - RNA, 20 nt, Leptospira interrogans serovar lai str. 56601
aucuuaaaucuuuaaaauac

SEQ ID NO: 2786197 - RNA, 17 nt, Leptospira interrogans serovar lai str. 56601
aucuuaacuuuaagcaa

SEQ ID NO: 2786198 - RNA, 20 nt, Leptospira interrogans serovar lai str. 56601
aucuuaagaauugaucuaaa

SEQ ID NO: 2786199 - RNA, 14 nt, Leptospira interrogans serovar lai str. 56601
aucuuaauaaaauu

SEQ ID NO: 2786200 - RNA, 14 nt, Leptospira interrogans serovar lai str. 56601
aucuuaauguaaag

SEQ ID NO: 2786201 - RNA, 16 nt, Leptospira interrogans serovar lai str. 56601
aucuuaauguaaaguu

SEQ ID NO: 2786202 - RNA, 22 nt, Leptospira interrogans serovar lai str. 56601
aucuuaauguaaaguucuuuuc

SEQ ID NO: 2786203 - RNA, 13 nt, Leptospira interrogans serovar lai str. 56601
aucuuaauuaaaa

SEQ ID NO: 2786204 - RNA, 14 nt, Leptospira interrogans serovar lai str. 56601
aucuuacaaguuau

SEQ ID NO: 2786205 - RNA, 17 nt, Leptospira interrogans serovar lai str. 56601
aucuuagaaugugggaa

SEQ ID NO: 2786206 - RNA, 18 nt, Leptospira interrogans serovar lai str. 56601
aucuuagaaugugggaac

SEQ ID NO: 2786207 - RNA, 19 nt, Leptospira interrogans serovar lai str. 56601
aucuuaggacggauuuuag

SEQ ID NO: 2786208 - RNA, 17 nt, Leptospira interrogans serovar lai str. 56601
aucuuauggacucuauu

SEQ ID NO: 2786209 - RNA, 14 nt, Leptospira interrogans serovar lai str. 56601
aucuuauucaauaa

SEQ ID NO: 2786210 - RNA, 16 nt, Leptospira interrogans serovar lai str. 56601
aucuuauucaauaaaa

SEQ ID NO: 2786211 - RNA, 18 nt, Leptospira interrogans serovar lai str. 56601
aucuuauucaauaaaaua

SEQ ID NO: 2786212 - RNA, 21 nt, Leptospira interrogans serovar lai str. 56601
aucuuauucaauaaaauacca

SEQ ID NO: 2786213 - RNA, 13 nt, Leptospira interrogans serovar lai str. 56601
aucuuauuuuuac

SEQ ID NO: 2786214 - RNA, 21 nt, Leptospira interrogans serovar lai str. 56601
aucuuauuuuuacagaaaaau

SEQ ID NO: 2786215 - RNA, 13 nt, Leptospira interrogans serovar lai str. 56601
aucuuauuuuuua

SEQ ID NO: 2786216 - RNA, 15 nt, Leptospira interrogans serovar lai str. 56601
aucuuauuuuuuaau

SEQ ID NO: 2786217 - RNA, 22 nt, Leptospira interrogans serovar lai str. 56601
aucuuauuuuuuaauauucaac

SEQ ID NO: 2786218 - RNA, 15 nt, Leptospira interrogans serovar lai str. 56601
aucuucaaguuugug

SEQ ID NO: 2786219 - RNA, 23 nt, Leptospira interrogans serovar lai str. 56601
aucuucaguucuuauagaaacua

SEQ ID NO: 2786220 - RNA, 18 nt, Leptospira interrogans serovar lai str. 56601
aucuucauuaauuuuuga

SEQ ID NO: 2786221 - RNA, 19 nt, Leptospira interrogans serovar lai str. 56601
aucuuccugggaaguugua

SEQ ID NO: 2786222 - RNA, 20 nt, Leptospira interrogans serovar lai str. 56601
aucuuccugggaaguuguau

SEQ ID NO: 2786223 - RNA, 21 nt, Leptospira interrogans serovar lai str. 56601
aucuucgguuuaauauacuaa

SEQ ID NO: 2786224 - RNA, 23 nt, Leptospira interrogans serovar lai str. 56601
aucuucuaauuaaauucuacauu

SEQ ID NO: 2786225 - RNA, 17 nt, Leptospira interrogans serovar lai str. 56601
aucuucucuagaaacug

SEQ ID NO: 2786226 - RNA, 15 nt, Leptospira interrogans serovar lai str. 56601
aucuugaaucgaauc

SEQ ID NO: 2786227 - RNA, 21 nt, Leptospira interrogans serovar lai str. 56601
aucuugaaucgaaucuuuugc

SEQ ID NO: 2786228 - RNA, 20 nt, Leptospira interrogans serovar lai str. 56601
aucuugagauccaauuauuu

SEQ ID NO: 2786229 - RNA, 19 nt, Leptospira interrogans serovar lai str. 56601
aucuugcucuaaaugacuu

SEQ ID NO: 2786230 - RNA, 14 nt, Leptospira interrogans serovar lai str. 56601
aucuuggaucaucc

SEQ ID NO: 2786231 - RNA, 19 nt, Leptospira interrogans serovar lai str. 56601
aucuuggcgacaaaaggau

SEQ ID NO: 2786232 - RNA, 13 nt, Leptospira interrogans serovar lai str. 56601
aucuuuaaaagag

SEQ ID NO: 2786233 - RNA, 20 nt, Leptospira interrogans serovar lai str. 56601
aucuuuaaaauacuuuaccg

SEQ ID NO: 2786234 - RNA, 11 nt, Leptospira interrogans serovar lai str. 56601
aucuuuagaau

SEQ ID NO: 2786235 - RNA, 16 nt, Leptospira interrogans serovar lai str. 56601
aucuuuagaauuuuuc

SEQ ID NO: 2786236 - RNA, 14 nt, Leptospira interrogans serovar lai str. 56601
aucuuuauaaaaau

SEQ ID NO: 2786237 - RNA, 15 nt, Leptospira interrogans serovar lai str. 56601
aucuuuauaaaaaug

SEQ ID NO: 2786238 - RNA, 17 nt, Leptospira interrogans serovar lai str. 56601
aucuuuauaaaaaugau

SEQ ID NO: 2786239 - RNA, 18 nt, Leptospira interrogans serovar lai str. 56601
aucuuuauaaaaaugaua

SEQ ID NO: 2786240 - RNA, 17 nt, Leptospira interrogans serovar lai str. 56601
aucuuuauagguuucuu

SEQ ID NO: 2786241 - RNA, 19 nt, Leptospira interrogans serovar lai str. 56601
aucuuuauaucuugaacuu

SEQ ID NO: 2786242 - RNA, 18 nt, Leptospira interrogans serovar lai str. 56601
aucuuucauguauuacuc

SEQ ID NO: 2786243 - RNA, 21 nt, Leptospira interrogans serovar lai str. 56601
aucuuuggauuuuauuuuuac

SEQ ID NO: 2786244 - RNA, 19 nt, Leptospira interrogans serovar lai str. 56601
aucuuuguaugaguuccca

SEQ ID NO: 2786245 - RNA, 18 nt, Leptospira interrogans serovar lai str. 56601
aucuuuuaaaaucaagag

SEQ ID NO: 2786246 - RNA, 17 nt, Leptospira interrogans serovar lai str. 56601
aucuuuuagauauuuau

SEQ ID NO: 2786247 - RNA, 15 nt, Leptospira interrogans serovar lai str. 56601
aucuuuucaaaagua

SEQ ID NO: 2786248 - RNA, 23 nt, Leptospira interrogans serovar lai str. 56601
aucuuuuugauaaaauauaguua

SEQ ID NO: 2786249 - RNA, 21 nt, Leptospira interrogans serovar lai str. 56601
augaguucccacauuuuuaaa

SEQ ID NO: 2786250 - RNA, 22 nt, Leptospira interrogans serovar lai str. 56601
augaguucccacauuuuuaaaa

SEQ ID NO: 2786251 - RNA, 11 nt, Leptospira interrogans serovar lai str. 56601
augaguuccua

SEQ ID NO: 2786252 - RNA, 18 nt, Leptospira interrogans serovar lai str. 56601
augaguuccuacauguuc

SEQ ID NO: 2786253 - RNA, 19 nt, Leptospira interrogans serovar lai str. 56601
augaguuccuacauuuuca

SEQ ID NO: 2786254 - RNA, 21 nt, Leptospira interrogans serovar lai str. 56601
augaguuucuccacuuaaaaa

SEQ ID NO: 2786255 - RNA, 15 nt, Leptospira interrogans serovar lai str. 56601
augaguuuuagaaua

SEQ ID NO: 2786256 - RNA, 20 nt, Leptospira interrogans serovar lai str. 56601
augaguuuuagaauauuaag

SEQ ID NO: 2786257 - RNA, 22 nt, Leptospira interrogans serovar lai str. 56601
augauaacguauguguaaugau

SEQ ID NO: 2786258 - RNA, 19 nt, Leptospira interrogans serovar lai str. 56601
augauaauaauuagaaaaa

SEQ ID NO: 2786259 - RNA, 20 nt, Leptospira interrogans serovar lai str. 56601
augauaauaauuagaaaaau

SEQ ID NO: 2786260 - RNA, 14 nt, Leptospira interrogans serovar lai str. 56601
augauagucaaaac

SEQ ID NO: 2786261 - RNA, 13 nt, Leptospira interrogans serovar lai str. 56601
augauaguuaauu

SEQ ID NO: 2786262 - RNA, 17 nt, Leptospira interrogans serovar lai str. 56601
augauaguuaauuuuau

SEQ ID NO: 2786263 - RNA, 18 nt, Leptospira interrogans serovar lai str. 56601
augauauggaauuccgac

SEQ ID NO: 2786264 - RNA, 15 nt, Leptospira interrogans serovar lai str. 56601
augauccauuuuucu

SEQ ID NO: 2786265 - RNA, 23 nt, Leptospira interrogans serovar lai str. 56601
augauccauuuuucugaaaaaag

SEQ ID NO: 2786266 - RNA, 23 nt, Leptospira interrogans serovar lai str. 56601
augaucgcaaaacgguaauuuca

SEQ ID NO: 2786267 - RNA, 16 nt, Leptospira interrogans serovar lai str. 56601
augaucgcauaaaauu

SEQ ID NO: 2786268 - RNA, 18 nt, Leptospira interrogans serovar lai str. 56601
augaucgcguaauauuuc

SEQ ID NO: 2786269 - RNA, 21 nt, Leptospira interrogans serovar lai str. 56601
augaucgcguaauauuucaau

SEQ ID NO: 2786270 - RNA, 22 nt, Leptospira interrogans serovar lai str. 56601
augaucgucgcuugauuccaag

SEQ ID NO: 2786271 - RNA, 19 nt, Leptospira interrogans serovar lai str. 56601
augaucuaagauuuucuuu

SEQ ID NO: 2786272 - RNA, 16 nt, Leptospira interrogans serovar lai str. 56601
augauguaaggagcca

SEQ ID NO: 2786273 - RNA, 18 nt, Leptospira interrogans serovar lai str. 56601
augauguagaguaaauuu

SEQ ID NO: 2786274 - RNA, 15 nt, Leptospira interrogans serovar lai str. 56601
augaugugggaacua

SEQ ID NO: 2786275 - RNA, 13 nt, Leptospira interrogans serovar lai str. 56601
augauuauuacuc

SEQ ID NO: 2786276 - RNA, 21 nt, Leptospira interrogans serovar lai str. 56601
augauucauuuaaaaauugau

SEQ ID NO: 2786277 - RNA, 15 nt, Leptospira interrogans serovar lai str. 56601
augauucauuuuucu

SEQ ID NO: 2786278 - RNA, 20 nt, Leptospira interrogans serovar lai str. 56601
augauucauuuuucuaaaaa

SEQ ID NO: 2786279 - RNA, 23 nt, Leptospira interrogans serovar lai str. 56601
augauucauuuuucugaaaaaag

SEQ ID NO: 2786280 - RNA, 16 nt, Leptospira interrogans serovar lai str. 56601
augauucugaaaagaa

SEQ ID NO: 2786281 - RNA, 23 nt, Leptospira interrogans serovar lai str. 56601
augauucugaaaagaauugaaau

SEQ ID NO: 2786282 - RNA, 22 nt, Leptospira interrogans serovar lai str. 56601
augauugaaacguuuucaaaaa

SEQ ID NO: 2786283 - RNA, 13 nt, Leptospira interrogans serovar lai str. 56601
augauuucuugau

SEQ ID NO: 2786284 - RNA, 17 nt, Leptospira interrogans serovar lai str. 56601
augauuucuugaucgac

SEQ ID NO: 2786285 - RNA, 22 nt, Leptospira interrogans serovar lai str. 56601
augauuugcggaucguuuuuau

SEQ ID NO: 2786286 - RNA, 23 nt, Leptospira interrogans serovar lai str. 56601
augauuuuacgaaccaauucuaa

SEQ ID NO: 2786287 - RNA, 9 nt, Leptospira interrogans serovar lai str. 56601
augauuuuu

SEQ ID NO: 2786288 - RNA, 14 nt, Leptospira interrogans serovar lai str. 56601
augauuuuucuaau

SEQ ID NO: 2786289 - RNA, 23 nt, Leptospira interrogans serovar lai str. 56601
augauuuuuggguuaaaguuuac

SEQ ID NO: 2786290 - RNA, 18 nt, Leptospira interrogans serovar lai str. 56601
augauuuuuuaaaauaac

SEQ ID NO: 2786291 - RNA, 13 nt, Leptospira interrogans serovar lai str. 56601
augauuuuuuaau

SEQ ID NO: 2786292 - RNA, 15 nt, Leptospira interrogans serovar lai str. 56601
augcaaaaauuuaau

SEQ ID NO: 2786293 - RNA, 17 nt, Leptospira interrogans serovar lai str. 56601
augcaaaaugcucggua

SEQ ID NO: 2786294 - RNA, 16 nt, Leptospira interrogans serovar lai str. 56601
augcaacgaaaucaau

SEQ ID NO: 2786295 - RNA, 13 nt, Leptospira interrogans serovar lai str. 56601
augcaaguucugg

SEQ ID NO: 2786296 - RNA, 22 nt, Leptospira interrogans serovar lai str. 56601
augcaaguucuggguaaaaaaa

SEQ ID NO: 2786297 - RNA, 15 nt, Leptospira interrogans serovar lai str. 56601
augcaauaguuccug

SEQ ID NO: 2786298 - RNA, 13 nt, Leptospira interrogans serovar lai str. 56601
augcagcuauuuu

SEQ ID NO: 2786299 - RNA, 22 nt, Leptospira interrogans serovar lai str. 56601
augcagcuucuuccaaagucaa

SEQ ID NO: 2786300 - RNA, 16 nt, Leptospira interrogans serovar lai str. 56601
augcaggaaacauaau

SEQ ID NO: 2786301 - RNA, 15 nt, Leptospira interrogans serovar lai str. 56601
augcaggaaacauac

SEQ ID NO: 2786302 - RNA, 14 nt, Leptospira interrogans serovar lai str. 56601
augcaguaguuccu

SEQ ID NO: 2786303 - RNA, 16 nt, Leptospira interrogans serovar lai str. 56601
augcaguaguuccuac

SEQ ID NO: 2786304 - RNA, 20 nt, Leptospira interrogans serovar lai str. 56601
augcaguaguuccuauaaau

SEQ ID NO: 2786305 - RNA, 13 nt, Leptospira interrogans serovar lai str. 56601
augcaguauuuug

SEQ ID NO: 2786306 - RNA, 20 nt, Leptospira interrogans serovar lai str. 56601
augcaguugugaucagugau

SEQ ID NO: 2786307 - RNA, 18 nt, Leptospira interrogans serovar lai str. 56601
augcauaaauagaauaag

SEQ ID NO: 2786308 - RNA, 17 nt, Leptospira interrogans serovar lai str. 56601
augcauccaaucaugaa

SEQ ID NO: 2786309 - RNA, 12 nt, Leptospira interrogans serovar lai str. 56601
augcauuuaggu

SEQ ID NO: 2786310 - RNA, 14 nt, Leptospira interrogans serovar lai str. 56601
augccccauucuuu

SEQ ID NO: 2786311 - RNA, 18 nt, Leptospira interrogans serovar lai str. 56601
augcucggcuucuucaau

SEQ ID NO: 2786312 - RNA, 20 nt, Leptospira interrogans serovar lai str. 56601
augcucggcuucuucaaugu

SEQ ID NO: 2786313 - RNA, 17 nt, Leptospira interrogans serovar lai str. 56601
augcucuaaaagcgacc

SEQ ID NO: 2786314 - RNA, 18 nt, Leptospira interrogans serovar lai str. 56601
augcugaaggaccgcaga

SEQ ID NO: 2786315 - RNA, 19 nt, Leptospira interrogans serovar lai str. 56601
augcugaaggaccgcagac

SEQ ID NO: 2786316 - RNA, 14 nt, Leptospira interrogans serovar lai str. 56601
augcugauuuuucu

SEQ ID NO: 2786317 - RNA, 21 nt, Leptospira interrogans serovar lai str. 56601
augcugauuuuucuuuagaca

SEQ ID NO: 2786318 - RNA, 21 nt, Leptospira interrogans serovar lai str. 56601
augcugcaaaucccgaauuua

SEQ ID NO: 2786319 - RNA, 15 nt, Leptospira interrogans serovar lai str. 56601
augcuguaacucaua

SEQ ID NO: 2786320 - RNA, 20 nt, Leptospira interrogans serovar lai str. 56601
augcuguaguuuauuuuucu

SEQ ID NO: 2786321 - RNA, 17 nt, Leptospira interrogans serovar lai str. 56601
augcuuuccaaaaggaa

SEQ ID NO: 2786322 - RNA, 14 nt, Leptospira interrogans serovar lai str. 56601
augcuuucucuuuu

SEQ ID NO: 2786323 - RNA, 20 nt, Leptospira interrogans serovar lai str. 56601
augcuuucucuuuuuagaca

SEQ ID NO: 2786324 - RNA, 11 nt, Leptospira interrogans serovar lai str. 56601
auggaaaaaug

SEQ ID NO: 2786325 - RNA, 12 nt, Leptospira interrogans serovar lai str. 56601
auggaaaaauga

SEQ ID NO: 2786326 - RNA, 14 nt, Leptospira interrogans serovar lai str. 56601
auggaaaaugaauu

SEQ ID NO: 2786327 - RNA, 19 nt, Leptospira interrogans serovar lai str. 56601
auggaaaguguuaguuccc

SEQ ID NO: 2786328 - RNA, 23 nt, Leptospira interrogans serovar lai str. 56601
auggaagcuaacacaaguuugga

SEQ ID NO: 2786329 - RNA, 15 nt, Leptospira interrogans serovar lai str. 56601
auggaaggucucaac

SEQ ID NO: 2786330 - RNA, 20 nt, Leptospira interrogans serovar lai str. 56601
auggaauuuauuauaucgaa

SEQ ID NO: 2786331 - RNA, 21 nt, Leptospira interrogans serovar lai str. 56601
auggaauuuuucaacaacucu

SEQ ID NO: 2786332 - RNA, 17 nt, Leptospira interrogans serovar lai str. 56601
auuaaucuguaaaucaa

SEQ ID NO: 2786333 - RNA, 15 nt, Leptospira interrogans serovar lai str. 56601
auuaaugaauaacuu

SEQ ID NO: 2786334 - RNA, 20 nt, Leptospira interrogans serovar lai str. 56601
auuaaugcgaaaauuuaacu

SEQ ID NO: 2786335 - RNA, 20 nt, Leptospira interrogans serovar lai str. 56601
auuaauggcuuuaaucuuuu

SEQ ID NO: 2786336 - RNA, 20 nt, Leptospira interrogans serovar lai str. 56601
auuaauucuccauccuauuu

SEQ ID NO: 2786337 - RNA, 12 nt, Leptospira interrogans serovar lai str. 56601
auuaauuucuaa

SEQ ID NO: 2786338 - RNA, 21 nt, Leptospira interrogans serovar lai str. 56601
auuaauuugaauauaauaaaa

SEQ ID NO: 2786339 - RNA, 18 nt, Leptospira interrogans serovar lai str. 56601
auuaauuuuuauagaauu

SEQ ID NO: 2786340 - RNA, 23 nt, Leptospira interrogans serovar lai str. 56601
auuaauuuuuauagaauuuaagu

SEQ ID NO: 2786341 - RNA, 11 nt, Leptospira interrogans serovar lai str. 56601
auuaauuuuuc

SEQ ID NO: 2786342 - RNA, 20 nt, Leptospira interrogans serovar lai str. 56601
auuaauuuuucaacaacucu

SEQ ID NO: 2786343 - RNA, 16 nt, Leptospira interrogans serovar lai str. 56601
auuaauuuuuuaaaaa

SEQ ID NO: 2786344 - RNA, 24 nt, Leptospira interrogans serovar lai str. 56601
auuacaaaaaaugaauuuagcauu

SEQ ID NO: 2786345 - RNA, 22 nt, Leptospira interrogans serovar lai str. 56601
auuacaaaaucugaauuuuacc

SEQ ID NO: 2786346 - RNA, 13 nt, Leptospira interrogans serovar lai str. 56601
auuacaaaucgac

SEQ ID NO: 2786347 - RNA, 15 nt, Leptospira interrogans serovar lai str. 56601
auuacaauuauacua

SEQ ID NO: 2786348 - RNA, 20 nt, Leptospira interrogans serovar lai str. 56601
auuacaauugauuauagaac

SEQ ID NO: 2786349 - RNA, 22 nt, Leptospira interrogans serovar lai str. 56601
auuacauaacuaauaaaaacaa

SEQ ID NO: 2786350 - RNA, 22 nt, Leptospira interrogans serovar lai str. 56601
auuacauaaguucgguguaaaa

SEQ ID NO: 2786351 - RNA, 19 nt, Leptospira interrogans serovar lai str. 56601
auuacauaauaaaguacua

SEQ ID NO: 2786352 - RNA, 22 nt, Leptospira interrogans serovar lai str. 56601
auuacauucaauaauuuuaaua

SEQ ID NO: 2786353 - RNA, 17 nt, Leptospira interrogans serovar lai str. 56601
auuacauuuuucuaaau

SEQ ID NO: 2786354 - RNA, 13 nt, Leptospira interrogans serovar lai str. 56601
auuaccaauugau

SEQ ID NO: 2786355 - RNA, 22 nt, Leptospira interrogans serovar lai str. 56601
auuaccaauugauaauuuguuu

SEQ ID NO: 2786356 - RNA, 17 nt, Leptospira interrogans serovar lai str. 56601
auuacccauuuccgauu

SEQ ID NO: 2786357 - RNA, 20 nt, Leptospira interrogans serovar lai str. 56601
auuacgaaaacuauuuuucu

SEQ ID NO: 2786358 - RNA, 17 nt, Leptospira interrogans serovar lai str. 56601
auuacgaauuuuuaaau

SEQ ID NO: 2786359 - RNA, 16 nt, Leptospira interrogans serovar lai str. 56601
auuacgacgcgauuca

SEQ ID NO: 2786360 - RNA, 16 nt, Leptospira interrogans serovar lai str. 56601
auuacgcugauuagaa

SEQ ID NO: 2786361 - RNA, 16 nt, Leptospira interrogans serovar lai str. 56601
auuacguaaagaacuu

SEQ ID NO: 2786362 - RNA, 14 nt, Leptospira interrogans serovar lai str. 56601
auuacuaaugcaau

SEQ ID NO: 2786363 - RNA, 20 nt, Leptospira interrogans serovar lai str. 56601
auuacucggauguauaaaaa

SEQ ID NO: 2786364 - RNA, 14 nt, Leptospira interrogans serovar lai str. 56601
auuacugauuucaa

SEQ ID NO: 2786365 - RNA, 16 nt, Leptospira interrogans serovar lai str. 56601
auuacugauuucaaaa

SEQ ID NO: 2786366 - RNA, 22 nt, Leptospira interrogans serovar lai str. 56601
auuagaaaauuauaaacaaauc

SEQ ID NO: 2786367 - RNA, 12 nt, Leptospira interrogans serovar lai str. 56601
auuagaacauca

SEQ ID NO: 2786368 - RNA, 13 nt, Leptospira interrogans serovar lai str. 56601
auuagaacaucaa

SEQ ID NO: 2786369 - RNA, 13 nt, Leptospira interrogans serovar lai str. 56601
auuagaacuacuc

SEQ ID NO: 2786370 - RNA, 21 nt, Leptospira interrogans serovar lai str. 56601
auuagaacuguugaaaaaauc

SEQ ID NO: 2786371 - RNA, 16 nt, Leptospira interrogans serovar lai str. 56601
auuagaagaauuguau

SEQ ID NO: 2786372 - RNA, 14 nt, Leptospira interrogans serovar lai str. 56601
auuagaauauacaa

SEQ ID NO: 2786373 - RNA, 21 nt, Leptospira interrogans serovar lai str. 56601
auuagaauuguugaaaaacuc

SEQ ID NO: 2786374 - RNA, 17 nt, Leptospira interrogans serovar lai str. 56601
auuagagaaguuaaaaa

SEQ ID NO: 2786375 - RNA, 20 nt, Leptospira interrogans serovar lai str. 56601
auuagagaaguuaaaaaaug

SEQ ID NO: 2786376 - RNA, 12 nt, Leptospira interrogans serovar lai str. 56601
auuagaguuauu

SEQ ID NO: 2786377 - RNA, 16 nt, Leptospira interrogans serovar lai str. 56601
auuagaguuguugaaa

SEQ ID NO: 2786378 - RNA, 18 nt, Leptospira interrogans serovar lai str. 56601
auuagaguuguugaaaaa

SEQ ID NO: 2786379 - RNA, 17 nt, Leptospira interrogans serovar lai str. 56601
auuagaguuucuaaaaa

SEQ ID NO: 2786380 - RNA, 18 nt, Leptospira interrogans serovar lai str. 56601
auuagaguuucuaaaaaa

SEQ ID NO: 2786381 - RNA, 15 nt, Leptospira interrogans serovar lai str. 56601
auuagaguuuuugaa

SEQ ID NO: 2786382 - RNA, 15 nt, Leptospira interrogans serovar lai str. 56601
auuagcaaauuuacu

SEQ ID NO: 2786383 - RNA, 15 nt, Leptospira interrogans serovar lai str. 56601
auuagcaugaaauuu

SEQ ID NO: 2786384 - RNA, 22 nt, Leptospira interrogans serovar lai str. 56601
auuagcaugaaauuuucuuaga

SEQ ID NO: 2786385 - RNA, 14 nt, Leptospira interrogans serovar lai str. 56601
auuaguaauaugau

SEQ ID NO: 2786386 - RNA, 15 nt, Leptospira interrogans serovar lai str. 56601
auuaguuaacgugaa

SEQ ID NO: 2786387 - RNA, 18 nt, Leptospira interrogans serovar lai str. 56601
auuaguuauguuuuaaaa

SEQ ID NO: 2786388 - RNA, 16 nt, Leptospira interrogans serovar lai str. 56601
auuaguuuaaaaacuu

SEQ ID NO: 2786389 - RNA, 22 nt, Leptospira interrogans serovar lai str. 56601
auuaguuuaauauacaaaacau

SEQ ID NO: 2786390 - RNA, 21 nt, Leptospira interrogans serovar lai str. 56601
auuaguuuucuucuauuucuu

SEQ ID NO: 2786391 - RNA, 13 nt, Leptospira interrogans serovar lai str. 56601
auuauaaaaacaa

SEQ ID NO: 2786392 - RNA, 16 nt, Leptospira interrogans serovar lai str. 56601
auuauaaaauacaaaa

SEQ ID NO: 2786393 - RNA, 17 nt, Leptospira interrogans serovar lai str. 56601
auuauaaaauacaaaag

SEQ ID NO: 2786394 - RNA, 16 nt, Leptospira interrogans serovar lai str. 56601
auuauaaaauuuuucu

SEQ ID NO: 2786395 - RNA, 16 nt, Leptospira interrogans serovar lai str. 56601
auuauaaauuuaaaaa

SEQ ID NO: 2786396 - RNA, 16 nt, Leptospira interrogans serovar lai str. 56601
auuauaaguagaaauu

SEQ ID NO: 2786397 - RNA, 22 nt, Leptospira interrogans serovar lai str. 56601
auuauaaguagaaauuuaauuu

SEQ ID NO: 2786398 - RNA, 17 nt, Leptospira interrogans serovar lai str. 56601
auuauaauauauauaaa

SEQ ID NO: 2786399 - RNA, 16 nt, Leptospira interrogans serovar lai str. 56601
auuauaauuuuaaaua

SEQ ID NO: 2786400 - RNA, 19 nt, Leptospira interrogans serovar lai str. 56601
auuauaauuuuaaauaaua

SEQ ID NO: 2786401 - RNA, 12 nt, Leptospira interrogans serovar lai str. 56601
auuauacaaaac

SEQ ID NO: 2786402 - RNA, 15 nt, Leptospira interrogans serovar lai str. 56601
auuauacaauuuaau

SEQ ID NO: 2786403 - RNA, 22 nt, Leptospira interrogans serovar lai str. 56601
auuauacaauuuaauaguuuau

SEQ ID NO: 2786404 - RNA, 21 nt, Leptospira interrogans serovar lai str. 56601
auuauacuauaaguuuacaau

SEQ ID NO: 2786405 - RNA, 22 nt, Leptospira interrogans serovar lai str. 56601
auuauacuuuauuaagaauuuc

SEQ ID NO: 2786406 - RNA, 23 nt, Leptospira interrogans serovar lai str. 56601
auuauaguuuuuucaaaaauucc

SEQ ID NO: 2786407 - RNA, 16 nt, Leptospira interrogans serovar lai str. 56601
auuauauaaucugauu

SEQ ID NO: 2786408 - RNA, 16 nt, Leptospira interrogans serovar lai str. 56601
auuauauuuuuaaaaa

SEQ ID NO: 2786409 - RNA, 18 nt, Leptospira interrogans serovar lai str. 56601
auuauauuuuuaaaaagu

SEQ ID NO: 2786410 - RNA, 19 nt, Leptospira interrogans serovar lai str. 56601
auuauauuuuuaaaaagua

SEQ ID NO: 2786411 - RNA, 14 nt, Leptospira interrogans serovar lai str. 56601
auuaucaaaauuua

SEQ ID NO: 2786412 - RNA, 17 nt, Leptospira interrogans serovar lai str. 56601
auuaucauguaaaauuu

SEQ ID NO: 2786413 - RNA, 23 nt, Leptospira interrogans serovar lai str. 56601
auuauccauuucuauaaauugag

SEQ ID NO: 2786414 - RNA, 15 nt, Leptospira interrogans serovar lai str. 56601
auuaucccaguugag

SEQ ID NO: 2786415 - RNA, 17 nt, Leptospira interrogans serovar lai str. 56601
auucauuuaccuaaaau

SEQ ID NO: 2786416 - RNA, 16 nt, Leptospira interrogans serovar lai str. 56601
auucauuuggaucugu

SEQ ID NO: 2786417 - RNA, 20 nt, Leptospira interrogans serovar lai str. 56601
auucauuuuacagaauauua

SEQ ID NO: 2786418 - RNA, 17 nt, Leptospira interrogans serovar lai str. 56601
auucauuuuucuaaaaa

SEQ ID NO: 2786419 - RNA, 15 nt, Leptospira interrogans serovar lai str. 56601
auucauuuuuugaaa

SEQ ID NO: 2786420 - RNA, 18 nt, Leptospira interrogans serovar lai str. 56601
auucauuuuuugaaaaag

SEQ ID NO: 2786421 - RNA, 17 nt, Leptospira interrogans serovar lai str. 56601
auuccaaaauucguuga

SEQ ID NO: 2786422 - RNA, 12 nt, Leptospira interrogans serovar lai str. 56601
auuccaaagaua

SEQ ID NO: 2786423 - RNA, 13 nt, Leptospira interrogans serovar lai str. 56601
auuccaaagauaa

SEQ ID NO: 2786424 - RNA, 14 nt, Leptospira interrogans serovar lai str. 56601
auuccaaagauaaa

SEQ ID NO: 2786425 - RNA, 15 nt, Leptospira interrogans serovar lai str. 56601
auuccaaagauaaaa

SEQ ID NO: 2786426 - RNA, 15 nt, Leptospira interrogans serovar lai str. 56601
auuccaacuuuuuca

SEQ ID NO: 2786427 - RNA, 18 nt, Leptospira interrogans serovar lai str. 56601
auuccaacuuuuucagaa

SEQ ID NO: 2786428 - RNA, 14 nt, Leptospira interrogans serovar lai str. 56601
auuccaagcaauuc

SEQ ID NO: 2786429 - RNA, 19 nt, Leptospira interrogans serovar lai str. 56601
auuccaccuuggaaagaaa

SEQ ID NO: 2786430 - RNA, 20 nt, Leptospira interrogans serovar lai str. 56601
auuccaccuuggaaagaaaa

SEQ ID NO: 2786431 - RNA, 21 nt, Leptospira interrogans serovar lai str. 56601
auuccacuaugaaaguuuuuc

SEQ ID NO: 2786432 - RNA, 17 nt, Leptospira interrogans serovar lai str. 56601
auuccacuucucacaaa

SEQ ID NO: 2786433 - RNA, 14 nt, Leptospira interrogans serovar lai str. 56601
auuccagaaguauu

SEQ ID NO: 2786434 - RNA, 18 nt, Leptospira interrogans serovar lai str. 56601
auuccagaggcaguacaa

SEQ ID NO: 2786435 - RNA, 16 nt, Leptospira interrogans serovar lai str. 56601
auuccagcuuuuuuca

SEQ ID NO: 2786436 - RNA, 19 nt, Leptospira interrogans serovar lai str. 56601
auuccaguaggauaauaca

SEQ ID NO: 2786437 - RNA, 13 nt, Leptospira interrogans serovar lai str. 56601
auuccauaaugaa

SEQ ID NO: 2786438 - RNA, 14 nt, Leptospira interrogans serovar lai str. 56601
auuccauaaugaag

SEQ ID NO: 2786439 - RNA, 18 nt, Leptospira interrogans serovar lai str. 56601
auuccauauagagaauuu

SEQ ID NO: 2786440 - RNA, 18 nt, Leptospira interrogans serovar lai str. 56601
auuccaucguuuauuuuu

SEQ ID NO: 2786441 - RNA, 21 nt, Leptospira interrogans serovar lai str. 56601
auuccaucguuuauuuuucua

SEQ ID NO: 2786442 - RNA, 15 nt, Leptospira interrogans serovar lai str. 56601
auuccaugguuuuuu

SEQ ID NO: 2786443 - RNA, 13 nt, Leptospira interrogans serovar lai str. 56601
auuccauucuuca

SEQ ID NO: 2786444 - RNA, 21 nt, Leptospira interrogans serovar lai str. 56601
auuccauucuucaaauaacau

SEQ ID NO: 2786445 - RNA, 16 nt, Leptospira interrogans serovar lai str. 56601
auuccauugauuuuca

SEQ ID NO: 2786446 - RNA, 11 nt, Leptospira interrogans serovar lai str. 56601
auucccaaaaa

SEQ ID NO: 2786447 - RNA, 15 nt, Leptospira interrogans serovar lai str. 56601
auucccacauuuuca

SEQ ID NO: 2786448 - RNA, 19 nt, Leptospira interrogans serovar lai str. 56601
auucccacauuuucaaaau

SEQ ID NO: 2786449 - RNA, 17 nt, Leptospira interrogans serovar lai str. 56601
auucccuucuccugcau

SEQ ID NO: 2786450 - RNA, 13 nt, Leptospira interrogans serovar lai str. 56601
auuccgaaggaau

SEQ ID NO: 2786451 - RNA, 17 nt, Leptospira interrogans serovar lai str. 56601
auuccgacccagaaaaa

SEQ ID NO: 2786452 - RNA, 22 nt, Leptospira interrogans serovar lai str. 56601
auuccgaucauuugaaguauuu

SEQ ID NO: 2786453 - RNA, 21 nt, Leptospira interrogans serovar lai str. 56601
auuccgcaaaaauuccuuuuu

SEQ ID NO: 2786454 - RNA, 17 nt, Leptospira interrogans serovar lai str. 56601
auuccgguaaauuuuuu

SEQ ID NO: 2786455 - RNA, 19 nt, Leptospira interrogans serovar lai str. 56601
auuccuaaaacaccuucuc

SEQ ID NO: 2786456 - RNA, 13 nt, Leptospira interrogans serovar lai str. 56601
auuccuaaaaugu

SEQ ID NO: 2786457 - RNA, 17 nt, Leptospira interrogans serovar lai str. 56601
auuccuaaaauguggga

SEQ ID NO: 2786458 - RNA, 20 nt, Leptospira interrogans serovar lai str. 56601
auuccuaaaaugugggaacu

SEQ ID NO: 2786459 - RNA, 20 nt, Leptospira interrogans serovar lai str. 56601
auuccuaacuaauaaauagg

SEQ ID NO: 2786460 - RNA, 14 nt, Leptospira interrogans serovar lai str. 56601
auuccuacauuauu

SEQ ID NO: 2786461 - RNA, 18 nt, Leptospira interrogans serovar lai str. 56601
auuccuacauuauuuuau

SEQ ID NO: 2786462 - RNA, 16 nt, Leptospira interrogans serovar lai str. 56601
auuccuacauucauuu

SEQ ID NO: 2786463 - RNA, 19 nt, Leptospira interrogans serovar lai str. 56601
auuccuacauucauuuuua

SEQ ID NO: 2786464 - RNA, 15 nt, Leptospira interrogans serovar lai str. 56601
auuccuauaaauaaa

SEQ ID NO: 2786465 - RNA, 21 nt, Leptospira interrogans serovar lai str. 56601
auuccuauaaauaaauuuaaa

SEQ ID NO: 2786466 - RNA, 19 nt, Leptospira interrogans serovar lai str. 56601
auuccuccagugcaauaca

SEQ ID NO: 2786467 - RNA, 18 nt, Leptospira interrogans serovar lai str. 56601
auuccuguaguauuucca

SEQ ID NO: 2786468 - RNA, 22 nt, Leptospira interrogans serovar lai str. 56601
auuccuucguuuuguugugaac

SEQ ID NO: 2786469 - RNA, 13 nt, Leptospira interrogans serovar lai str. 56601
auuccuugagaaa

SEQ ID NO: 2786470 - RNA, 22 nt, Leptospira interrogans serovar lai str. 56601
auuccuugagaaaaguguuuuu

SEQ ID NO: 2786471 - RNA, 18 nt, Leptospira interrogans serovar lai str. 56601
auuccuuuccgauuucuu

SEQ ID NO: 2786472 - RNA, 14 nt, Leptospira interrogans serovar lai str. 56601
auuccuuucugcug

SEQ ID NO: 2786473 - RNA, 18 nt, Leptospira interrogans serovar lai str. 56601
auuccuuuuaagaauacu

SEQ ID NO: 2786474 - RNA, 20 nt, Leptospira interrogans serovar lai str. 56601
auuccuuuucuuuuuuaaac

SEQ ID NO: 2786475 - RNA, 14 nt, Leptospira interrogans serovar lai str. 56601
auuccuuuuucuaa

SEQ ID NO: 2786476 - RNA, 15 nt, Leptospira interrogans serovar lai str. 56601
auucgaaagauuuuu

SEQ ID NO: 2786477 - RNA, 17 nt, Leptospira interrogans serovar lai str. 56601
auucgaaagauuuuuca

SEQ ID NO: 2786478 - RNA, 17 nt, Leptospira interrogans serovar lai str. 56601
auucgacguaaggaacu

SEQ ID NO: 2786479 - RNA, 19 nt, Leptospira interrogans serovar lai str. 56601
auucgaguaguuaauaaau

SEQ ID NO: 2786480 - RNA, 20 nt, Leptospira interrogans serovar lai str. 56601
auucgaguaguuaauaaauu

SEQ ID NO: 2786481 - RNA, 12 nt, Leptospira interrogans serovar lai str. 56601
auucgaguccuu

SEQ ID NO: 2786482 - RNA, 17 nt, Leptospira interrogans serovar lai str. 56601
auucgauagaauccaau

SEQ ID NO: 2786483 - RNA, 20 nt, Leptospira interrogans serovar lai str. 56601
auucgaucaaguaagaaucc

SEQ ID NO: 2786484 - RNA, 16 nt, Leptospira interrogans serovar lai str. 56601
auucgcauugaucuuu

SEQ ID NO: 2786485 - RNA, 22 nt, Leptospira interrogans serovar lai str. 56601
auucgcccacuucugguuuuuu

SEQ ID NO: 2786486 - RNA, 17 nt, Leptospira interrogans serovar lai str. 56601
auucggacgauuucuau

SEQ ID NO: 2786487 - RNA, 17 nt, Leptospira interrogans serovar lai str. 56601
auucgguuauugugaau

SEQ ID NO: 2786488 - RNA, 15 nt, Leptospira interrogans serovar lai str. 56601
auucguaagaaaaaa

SEQ ID NO: 2786489 - RNA, 19 nt, Leptospira interrogans serovar lai str. 56601
auucguaagaaaaaauuuc

SEQ ID NO: 2786490 - RNA, 18 nt, Leptospira interrogans serovar lai str. 56601
auucguacaaccaaacag

SEQ ID NO: 2786491 - RNA, 21 nt, Leptospira interrogans serovar lai str. 56601
auucguauuuuauagaaauac

SEQ ID NO: 2786492 - RNA, 19 nt, Leptospira interrogans serovar lai str. 56601
auucguucauagagauaga

SEQ ID NO: 2786493 - RNA, 13 nt, Leptospira interrogans serovar lai str. 56601
auucguuccaaau

SEQ ID NO: 2786494 - RNA, 20 nt, Leptospira interrogans serovar lai str. 56601
auucguuuuaaugagaaagg

SEQ ID NO: 2786495 - RNA, 12 nt, Leptospira interrogans serovar lai str. 56601
auucuaaaaaaa

SEQ ID NO: 2786496 - RNA, 16 nt, Leptospira interrogans serovar lai str. 56601
auucuaaaaaaauacg

SEQ ID NO: 2786497 - RNA, 15 nt, Leptospira interrogans serovar lai str. 56601
auucuaaaaaugaaa

SEQ ID NO: 2786498 - RNA, 13 nt, Leptospira interrogans serovar lai str. 56601
auucuuaaaaugu

SEQ ID NO: 2786499 - RNA, 18 nt, Leptospira interrogans serovar lai str. 56601
auucuuaaaaugugggaa

SEQ ID NO: 2786500 - RNA, 14 nt, Leptospira interrogans serovar lai str. 56601
auucuuacauuaga

SEQ ID NO: 2786501 - RNA, 19 nt, Leptospira interrogans serovar lai str. 56601
auucuucaauaucuuuauu

SEQ ID NO: 2786502 - RNA, 20 nt, Leptospira interrogans serovar lai str. 56601
auucuuccgggaggaauuuu

SEQ ID NO: 2786503 - RNA, 12 nt, Leptospira interrogans serovar lai str. 56601
auucuuccuucu

SEQ ID NO: 2786504 - RNA, 13 nt, Leptospira interrogans serovar lai str. 56601
auucuuccuuuuu

SEQ ID NO: 2786505 - RNA, 15 nt, Leptospira interrogans serovar lai str. 56601
auucuuccuuuuuca

SEQ ID NO: 2786506 - RNA, 20 nt, Leptospira interrogans serovar lai str. 56601
auucuugagacgguucaaug

SEQ ID NO: 2786507 - RNA, 15 nt, Leptospira interrogans serovar lai str. 56601
auucuuggguuuuau

SEQ ID NO: 2786508 - RNA, 20 nt, Leptospira interrogans serovar lai str. 56601
auucuugucggaacacuuga

SEQ ID NO: 2786509 - RNA, 15 nt, Leptospira interrogans serovar lai str. 56601
auucuuuaaaauaga

SEQ ID NO: 2786510 - RNA, 17 nt, Leptospira interrogans serovar lai str. 56601
auucuuuaaaauuuuua

SEQ ID NO: 2786511 - RNA, 16 nt, Leptospira interrogans serovar lai str. 56601
auucuuuaaauguaga

SEQ ID NO: 2786512 - RNA, 17 nt, Leptospira interrogans serovar lai str. 56601
auucuuuaaauguggga

SEQ ID NO: 2786513 - RNA, 18 nt, Leptospira interrogans serovar lai str. 56601
auucuuuagaaauuuuua

SEQ ID NO: 2786514 - RNA, 20 nt, Leptospira interrogans serovar lai str. 56601
auucuuuagaaauuuuuaau

SEQ ID NO: 2786515 - RNA, 21 nt, Leptospira interrogans serovar lai str. 56601
auucuuuccaaccauuuaaua

SEQ ID NO: 2786516 - RNA, 20 nt, Leptospira interrogans serovar lai str. 56601
auucuuuccaucguuuaaga

SEQ ID NO: 2786517 - RNA, 14 nt, Leptospira interrogans serovar lai str. 56601
auucuuuccuuucc

SEQ ID NO: 2786518 - RNA, 19 nt, Leptospira interrogans serovar lai str. 56601
auucuuucuuaaauuuuuu

SEQ ID NO: 2786519 - RNA, 20 nt, Leptospira interrogans serovar lai str. 56601
auucuuuucccgcuaaaagu

SEQ ID NO: 2786520 - RNA, 24 nt, Leptospira interrogans serovar lai str. 56601
auucuuuucccgcuaaaaguacuu

SEQ ID NO: 2786521 - RNA, 16 nt, Leptospira interrogans serovar lai str. 56601
auucuuuucugaauaa

SEQ ID NO: 2786522 - RNA, 20 nt, Leptospira interrogans serovar lai str. 56601
auucuuuugcauaguuuuau

SEQ ID NO: 2786523 - RNA, 13 nt, Leptospira interrogans serovar lai str. 56601
auucuuuugugac

SEQ ID NO: 2786524 - RNA, 15 nt, Leptospira interrogans serovar lai str. 56601
auucuuuuuauuuuu

SEQ ID NO: 2786525 - RNA, 17 nt, Leptospira interrogans serovar lai str. 56601
auucuuuuugccaauuc

SEQ ID NO: 2786526 - RNA, 11 nt, Leptospira interrogans serovar lai str. 56601
auugaaaaauu

SEQ ID NO: 2786527 - RNA, 20 nt, Leptospira interrogans serovar lai str. 56601
auugaaacaauuuugccaau

SEQ ID NO: 2786528 - RNA, 18 nt, Leptospira interrogans serovar lai str. 56601
auugaaacguuuucaaaa

SEQ ID NO: 2786529 - RNA, 15 nt, Leptospira interrogans serovar lai str. 56601
auugaaagaagauag

SEQ ID NO: 2786530 - RNA, 14 nt, Leptospira interrogans serovar lai str. 56601
auugaaauauuaua

SEQ ID NO: 2786531 - RNA, 16 nt, Leptospira interrogans serovar lai str. 56601
auugaaauauuauaaa

SEQ ID NO: 2786532 - RNA, 15 nt, Leptospira interrogans serovar lai str. 56601
auugaaaucagaguc

SEQ ID NO: 2786533 - RNA, 13 nt, Leptospira interrogans serovar lai str. 56601
auugaagaaaaaa

SEQ ID NO: 2786534 - RNA, 22 nt, Leptospira interrogans serovar lai str. 56601
auugaagaaaaaaagauuuuac

SEQ ID NO: 2786535 - RNA, 17 nt, Leptospira interrogans serovar lai str. 56601
auugaagcaguuuuguc

SEQ ID NO: 2786536 - RNA, 17 nt, Leptospira interrogans serovar lai str. 56601
auugaagcaguuuuguu

SEQ ID NO: 2786537 - RNA, 19 nt, Leptospira interrogans serovar lai str. 56601
auugaagcaguuuuguuaa

SEQ ID NO: 2786538 - RNA, 16 nt, Leptospira interrogans serovar lai str. 56601
auugaagcguuuuguu

SEQ ID NO: 2786539 - RNA, 18 nt, Leptospira interrogans serovar lai str. 56601
auugaagcguuuuguuaa

SEQ ID NO: 2786540 - RNA, 17 nt, Leptospira interrogans serovar lai str. 56601
auugaaggaguuuuguu

SEQ ID NO: 2786541 - RNA, 16 nt, Leptospira interrogans serovar lai str. 56601
auugaaggguaacuca

SEQ ID NO: 2786542 - RNA, 18 nt, Leptospira interrogans serovar lai str. 56601
auugaaggguaacucagc

SEQ ID NO: 2786543 - RNA, 16 nt, Leptospira interrogans serovar lai str. 56601
auugaauaaacuguuu

SEQ ID NO: 2786544 - RNA, 21 nt, Leptospira interrogans serovar lai str. 56601
auugaauccuuccuccaaaau

SEQ ID NO: 2786545 - RNA, 14 nt, Leptospira interrogans serovar lai str. 56601
auugaauuuaaaag

SEQ ID NO: 2786546 - RNA, 17 nt, Leptospira interrogans serovar lai str. 56601
auugaauuuaaaaguuu

SEQ ID NO: 2786547 - RNA, 15 nt, Leptospira interrogans serovar lai str. 56601
auugaauuuuuuaaa

SEQ ID NO: 2786548 - RNA, 23 nt, Leptospira interrogans serovar lai str. 56601
auugaauuuuuucguaucuaaag

SEQ ID NO: 2786549 - RNA, 15 nt, Leptospira interrogans serovar lai str. 56601
auugacuuucuguau

SEQ ID NO: 2786550 - RNA, 18 nt, Leptospira interrogans serovar lai str. 56601
auugacuuucuguauuuu

SEQ ID NO: 2786551 - RNA, 17 nt, Leptospira interrogans serovar lai str. 56601
auugagaaaauaaaaaa

SEQ ID NO: 2786552 - RNA, 22 nt, Leptospira interrogans serovar lai str. 56601
auugagaaaauaaaaaauuuuc

SEQ ID NO: 2786553 - RNA, 17 nt, Leptospira interrogans serovar lai str. 56601
auugagaauucuacauu

SEQ ID NO: 2786554 - RNA, 20 nt, Leptospira interrogans serovar lai str. 56601
auugagaauuuguuuuaaaa

SEQ ID NO: 2786555 - RNA, 13 nt, Leptospira interrogans serovar lai str. 56601
auugagauaaaaa

SEQ ID NO: 2786556 - RNA, 22 nt, Leptospira interrogans serovar lai str. 56601
auugagauuuggugauuuaaaa

SEQ ID NO: 2786557 - RNA, 17 nt, Leptospira interrogans serovar lai str. 56601
auugagcuaauucuuaa

SEQ ID NO: 2786558 - RNA, 19 nt, Leptospira interrogans serovar lai str. 56601
auugagcuuguuuuuaaau

SEQ ID NO: 2786559 - RNA, 18 nt, Leptospira interrogans serovar lai str. 56601
auugaguuucacaaaaau

SEQ ID NO: 2786560 - RNA, 14 nt, Leptospira interrogans serovar lai str. 56601
auugaguuucuaua

SEQ ID NO: 2786561 - RNA, 17 nt, Leptospira interrogans serovar lai str. 56601
auugaguuucuauaaau

SEQ ID NO: 2786562 - RNA, 15 nt, Leptospira interrogans serovar lai str. 56601
auugaguuucuugaa

SEQ ID NO: 2786563 - RNA, 16 nt, Leptospira interrogans serovar lai str. 56601
auugaguuucuugaac

SEQ ID NO: 2786564 - RNA, 15 nt, Leptospira interrogans serovar lai str. 56601
auugaguuuuccaau

SEQ ID NO: 2786565 - RNA, 18 nt, Leptospira interrogans serovar lai str. 56601
auugaguuuuuguuugaa

SEQ ID NO: 2786566 - RNA, 21 nt, Leptospira interrogans serovar lai str. 56601
auugaguuuuuguuugaaugu

SEQ ID NO: 2786567 - RNA, 13 nt, Leptospira interrogans serovar lai str. 56601
auugaguuuuuua

SEQ ID NO: 2786568 - RNA, 23 nt, Leptospira interrogans serovar lai str. 56601
auugauaaagcgccgauuauuca

SEQ ID NO: 2786569 - RNA, 23 nt, Leptospira interrogans serovar lai str. 56601
auugauaauuuuuguuuguaaaa

SEQ ID NO: 2786570 - RNA, 15 nt, Leptospira interrogans serovar lai str. 56601
auugauacugcauca

SEQ ID NO: 2786571 - RNA, 24 nt, Leptospira interrogans serovar lai str. 56601
auugauauucaaauuuacucuuau

SEQ ID NO: 2786572 - RNA, 14 nt, Leptospira interrogans serovar lai str. 56601
auugauuuaaaaac

SEQ ID NO: 2786573 - RNA, 16 nt, Leptospira interrogans serovar lai str. 56601
auugauuuacauucug

SEQ ID NO: 2786574 - RNA, 12 nt, Leptospira interrogans serovar lai str. 56601
auugauuuuucu

SEQ ID NO: 2786575 - RNA, 14 nt, Leptospira interrogans serovar lai str. 56601
auugcacaaaagaa

SEQ ID NO: 2786576 - RNA, 21 nt, Leptospira interrogans serovar lai str. 56601
auugcacaaaagaaacguaau

SEQ ID NO: 2786577 - RNA, 14 nt, Leptospira interrogans serovar lai str. 56601
auugccauccacaa

SEQ ID NO: 2786578 - RNA, 15 nt, Leptospira interrogans serovar lai str. 56601
auugccauccacaaa

SEQ ID NO: 2786579 - RNA, 16 nt, Leptospira interrogans serovar lai str. 56601
auugccuaaauuccuu

SEQ ID NO: 2786580 - RNA, 18 nt, Leptospira interrogans serovar lai str. 56601
auugccuaaauuccuucc

SEQ ID NO: 2786581 - RNA, 16 nt, Leptospira interrogans serovar lai str. 56601
auuuaauauauuaaaa

SEQ ID NO: 2786582 - RNA, 14 nt, Leptospira interrogans serovar lai str. 56601
auuuaauauauuuu

SEQ ID NO: 2786583 - RNA, 16 nt, Leptospira interrogans serovar lai str. 56601
auuuaauauauuuuca

SEQ ID NO: 2786584 - RNA, 19 nt, Leptospira interrogans serovar lai str. 56601
auuuaaugaccacaaacua

SEQ ID NO: 2786585 - RNA, 21 nt, Leptospira interrogans serovar lai str. 56601
auuuaauuggacgagcuuuau

SEQ ID NO: 2786586 - RNA, 16 nt, Leptospira interrogans serovar lai str. 56601
auuuaauuuagaaauu

SEQ ID NO: 2786587 - RNA, 13 nt, Leptospira interrogans serovar lai str. 56601
auuuaauuuuuua

SEQ ID NO: 2786588 - RNA, 18 nt, Leptospira interrogans serovar lai str. 56601
auuuacacgauaauuuuc

SEQ ID NO: 2786589 - RNA, 22 nt, Leptospira interrogans serovar lai str. 56601
auuuacacgauaauuuucuuua

SEQ ID NO: 2786590 - RNA, 14 nt, Leptospira interrogans serovar lai str. 56601
auuuaccuccuccu

SEQ ID NO: 2786591 - RNA, 16 nt, Leptospira interrogans serovar lai str. 56601
auuuacgaaaauuuuu

SEQ ID NO: 2786592 - RNA, 18 nt, Leptospira interrogans serovar lai str. 56601
auuuacgaaaauuuuuua

SEQ ID NO: 2786593 - RNA, 20 nt, Leptospira interrogans serovar lai str. 56601
auuuacggcauuuuuuaaau

SEQ ID NO: 2786594 - RNA, 14 nt, Leptospira interrogans serovar lai str. 56601
auuuacuacaucua

SEQ ID NO: 2786595 - RNA, 22 nt, Leptospira interrogans serovar lai str. 56601
auuuacuacaucuaaugauuuc

SEQ ID NO: 2786596 - RNA, 21 nt, Leptospira interrogans serovar lai str. 56601
auuuacuacgucuucuaaauu

SEQ ID NO: 2786597 - RNA, 13 nt, Leptospira interrogans serovar lai str. 56601
auuuacuauuuug

SEQ ID NO: 2786598 - RNA, 18 nt, Leptospira interrogans serovar lai str. 56601
auuuacuauuuugaugaa

SEQ ID NO: 2786599 - RNA, 19 nt, Leptospira interrogans serovar lai str. 56601
auuuacucuuauaaaauuu

SEQ ID NO: 2786600 - RNA, 21 nt, Leptospira interrogans serovar lai str. 56601
auuuacucuuauaaaauuuua

SEQ ID NO: 2786601 - RNA, 14 nt, Leptospira interrogans serovar lai str. 56601
auuuacuucauucg

SEQ ID NO: 2786602 - RNA, 16 nt, Leptospira interrogans serovar lai str. 56601
auuuacuuuaaaauuu

SEQ ID NO: 2786603 - RNA, 13 nt, Leptospira interrogans serovar lai str. 56601
auuuacuuuuucc

SEQ ID NO: 2786604 - RNA, 18 nt, Leptospira interrogans serovar lai str. 56601
auuuagaaauuuauacua

SEQ ID NO: 2786605 - RNA, 17 nt, Leptospira interrogans serovar lai str. 56601
auuuagaacgcaaucug

SEQ ID NO: 2786606 - RNA, 18 nt, Leptospira interrogans serovar lai str. 56601
auuuagaagauugaggau

SEQ ID NO: 2786607 - RNA, 17 nt, Leptospira interrogans serovar lai str. 56601
auuuagaauuguuaucu

SEQ ID NO: 2786608 - RNA, 14 nt, Leptospira interrogans serovar lai str. 56601
auuuagaucaaaua

SEQ ID NO: 2786609 - RNA, 22 nt, Leptospira interrogans serovar lai str. 56601
auuuagauuuguguuaguuccc

SEQ ID NO: 2786610 - RNA, 17 nt, Leptospira interrogans serovar lai str. 56601
auuuagcaauuugugaa

SEQ ID NO: 2786611 - RNA, 20 nt, Leptospira interrogans serovar lai str. 56601
auuuagcuaagucuuuaaaa

SEQ ID NO: 2786612 - RNA, 16 nt, Leptospira interrogans serovar lai str. 56601
auuuaggaaauuuuca

SEQ ID NO: 2786613 - RNA, 21 nt, Leptospira interrogans serovar lai str. 56601
auuuagguuguaacucaaaau

SEQ ID NO: 2786614 - RNA, 23 nt, Leptospira interrogans serovar lai str. 56601
auuuagguuugugguaguuccca

SEQ ID NO: 2786615 - RNA, 15 nt, Leptospira interrogans serovar lai str. 56601
auuuaguaaaauuua

SEQ ID NO: 2786616 - RNA, 19 nt, Leptospira interrogans serovar lai str. 56601
auuuaguaguaaauaaaaa

SEQ ID NO: 2786617 - RNA, 20 nt, Leptospira interrogans serovar lai str. 56601
auuuaguuucaauuuaaaac

SEQ ID NO: 2786618 - RNA, 18 nt, Leptospira interrogans serovar lai str. 56601
auuuaguuuuuguaugag

SEQ ID NO: 2786619 - RNA, 13 nt, Leptospira interrogans serovar lai str. 56601
auuuauaaaauaa

SEQ ID NO: 2786620 - RNA, 15 nt, Leptospira interrogans serovar lai str. 56601
auuuauaaauguagg

SEQ ID NO: 2786621 - RNA, 19 nt, Leptospira interrogans serovar lai str. 56601
auuuauaacgggaauuaua

SEQ ID NO: 2786622 - RNA, 20 nt, Leptospira interrogans serovar lai str. 56601
auuuauaacgggaauuauaa

SEQ ID NO: 2786623 - RNA, 13 nt, Leptospira interrogans serovar lai str. 56601
auuuauaauaaau

SEQ ID NO: 2786624 - RNA, 14 nt, Leptospira interrogans serovar lai str. 56601
auuuauaauaaauc

SEQ ID NO: 2786625 - RNA, 12 nt, Leptospira interrogans serovar lai str. 56601
auuuauaaugaa

SEQ ID NO: 2786626 - RNA, 22 nt, Leptospira interrogans serovar lai str. 56601
auuuauaaugaaucguaaaaaa

SEQ ID NO: 2786627 - RNA, 19 nt, Leptospira interrogans serovar lai str. 56601
auuuauaauucguuuuuua

SEQ ID NO: 2786628 - RNA, 13 nt, Leptospira interrogans serovar lai str. 56601
auuuauagauaua

SEQ ID NO: 2786629 - RNA, 19 nt, Leptospira interrogans serovar lai str. 56601
auuuauagauauaacuuag

SEQ ID NO: 2786630 - RNA, 16 nt, Leptospira interrogans serovar lai str. 56601
auuuauaguuuuuaac

SEQ ID NO: 2786631 - RNA, 14 nt, Leptospira interrogans serovar lai str. 56601
auuuauauauauuc

SEQ ID NO: 2786632 - RNA, 23 nt, Leptospira interrogans serovar lai str. 56601
auuuauauguuucuuuuguaaaa

SEQ ID NO: 2786633 - RNA, 13 nt, Leptospira interrogans serovar lai str. 56601
auuuaucuaaaac

SEQ ID NO: 2786634 - RNA, 16 nt, Leptospira interrogans serovar lai str. 56601
auuuaucuaaaacaca

SEQ ID NO: 2786635 - RNA, 14 nt, Leptospira interrogans serovar lai str. 56601
auuuaucuauaaaa

SEQ ID NO: 2786636 - RNA, 16 nt, Leptospira interrogans serovar lai str. 56601
auuuaucuguaaaauu

SEQ ID NO: 2786637 - RNA, 22 nt, Leptospira interrogans serovar lai str. 56601
auuuaugacagcuugaagauua

SEQ ID NO: 2786638 - RNA, 22 nt, Leptospira interrogans serovar lai str. 56601
auuuaugaucuacuauuauaau

SEQ ID NO: 2786639 - RNA, 14 nt, Leptospira interrogans serovar lai str. 56601
auuuaugcuuuaau

SEQ ID NO: 2786640 - RNA, 19 nt, Leptospira interrogans serovar lai str. 56601
auuuauuacaaaguaucuu

SEQ ID NO: 2786641 - RNA, 19 nt, Leptospira interrogans serovar lai str. 56601
auuuauuaugugacuuaau

SEQ ID NO: 2786642 - RNA, 12 nt, Leptospira interrogans serovar lai str. 56601
auuuauucaaaa

SEQ ID NO: 2786643 - RNA, 14 nt, Leptospira interrogans serovar lai str. 56601
auuuauucaaaaua

SEQ ID NO: 2786644 - RNA, 15 nt, Leptospira interrogans serovar lai str. 56601
auuuauucuacauga

SEQ ID NO: 2786645 - RNA, 21 nt, Leptospira interrogans serovar lai str. 56601
auuuauucuacaugauucauu

SEQ ID NO: 2786646 - RNA, 14 nt, Leptospira interrogans serovar lai str. 56601
auuuauugaaaaau

SEQ ID NO: 2786647 - RNA, 16 nt, Leptospira interrogans serovar lai str. 56601
auuuauuucaaaauuu

SEQ ID NO: 2786648 - RNA, 14 nt, Leptospira interrogans serovar lai str. 56601
auuuauuuuaaaau

SEQ ID NO: 2786649 - RNA, 13 nt, Leptospira interrogans serovar lai str. 56601
auuuauuuuaaag

SEQ ID NO: 2786650 - RNA, 21 nt, Leptospira interrogans serovar lai str. 56601
auuuauuuuuuuuaauauagu

SEQ ID NO: 2786651 - RNA, 22 nt, Leptospira interrogans serovar lai str. 56601
auuuauuuuuuuuaauauagua

SEQ ID NO: 2786652 - RNA, 23 nt, Leptospira interrogans serovar lai str. 56601
auuuauuuuuuuuaauauaguau

SEQ ID NO: 2786653 - RNA, 22 nt, Leptospira interrogans serovar lai str. 56601
auuucaaaaaacuuucuuaaau

SEQ ID NO: 2786654 - RNA, 13 nt, Leptospira interrogans serovar lai str. 56601
auuucaaaaauaa

SEQ ID NO: 2786655 - RNA, 19 nt, Leptospira interrogans serovar lai str. 56601
auuucaaaaauauauuaua

SEQ ID NO: 2786656 - RNA, 23 nt, Leptospira interrogans serovar lai str. 56601
auuucaaaaauauauuauaauaa

SEQ ID NO: 2786657 - RNA, 14 nt, Leptospira interrogans serovar lai str. 56601
auuucaaaaauuuu

SEQ ID NO: 2786658 - RNA, 15 nt, Leptospira interrogans serovar lai str. 56601
auuucaaaaauuuuc

SEQ ID NO: 2786659 - RNA, 19 nt, Leptospira interrogans serovar lai str. 56601
auuucaaaaauuuucuguu

SEQ ID NO: 2786660 - RNA, 14 nt, Leptospira interrogans serovar lai str. 56601
auuucaaaauuuau

SEQ ID NO: 2786661 - RNA, 18 nt, Leptospira interrogans serovar lai str. 56601
auuucaaaauuuauggua

SEQ ID NO: 2786662 - RNA, 13 nt, Leptospira interrogans serovar lai str. 56601
auuucaaauuuau

SEQ ID NO: 2786663 - RNA, 23 nt, Leptospira interrogans serovar lai str. 56601
auuucaacuuuuuucagaaaaag

SEQ ID NO: 2786664 - RNA, 18 nt, Leptospira interrogans serovar lai str. 56601
auuucuuucgauuuuucg

SEQ ID NO: 2786665 - RNA, 12 nt, Leptospira interrogans serovar lai str. 56601
auuucuuuuuau

SEQ ID NO: 2786666 - RNA, 13 nt, Leptospira interrogans serovar lai str. 56601
auuucuuuuugaa

SEQ ID NO: 2786667 - RNA, 18 nt, Leptospira interrogans serovar lai str. 56601
auuucuuuuuuguuuugu

SEQ ID NO: 2786668 - RNA, 23 nt, Leptospira interrogans serovar lai str. 56601
auuugaaaaagggauucuauucu

SEQ ID NO: 2786669 - RNA, 13 nt, Leptospira interrogans serovar lai str. 56601
auuugaaaagaaa

SEQ ID NO: 2786670 - RNA, 18 nt, Leptospira interrogans serovar lai str. 56601
auuugaaaauugaauuua

SEQ ID NO: 2786671 - RNA, 16 nt, Leptospira interrogans serovar lai str. 56601
auuugaaaguaaaaaa

SEQ ID NO: 2786672 - RNA, 15 nt, Leptospira interrogans serovar lai str. 56601
auuugaauauaauaa

SEQ ID NO: 2786673 - RNA, 13 nt, Leptospira interrogans serovar lai str. 56601
auuugaauuuuuu

SEQ ID NO: 2786674 - RNA, 19 nt, Leptospira interrogans serovar lai str. 56601
auuugauauauuuuuaaag

SEQ ID NO: 2786675 - RNA, 18 nt, Leptospira interrogans serovar lai str. 56601
auuugaucucaauauaaa

SEQ ID NO: 2786676 - RNA, 15 nt, Leptospira interrogans serovar lai str. 56601
auuugauuagaaaaa

SEQ ID NO: 2786677 - RNA, 16 nt, Leptospira interrogans serovar lai str. 56601
auuugauuagaaaaaa

SEQ ID NO: 2786678 - RNA, 19 nt, Leptospira interrogans serovar lai str. 56601
auuugcauaggugauuaaa

SEQ ID NO: 2786679 - RNA, 17 nt, Leptospira interrogans serovar lai str. 56601
auuugcaucgacaaaac

SEQ ID NO: 2786680 - RNA, 22 nt, Leptospira interrogans serovar lai str. 56601
auuugcggaaucaauuuuagaa

SEQ ID NO: 2786681 - RNA, 19 nt, Leptospira interrogans serovar lai str. 56601
auuugcuaaaauaagaauc

SEQ ID NO: 2786682 - RNA, 14 nt, Leptospira interrogans serovar lai str. 56601
auuugcuuccauug

SEQ ID NO: 2786683 - RNA, 23 nt, Leptospira interrogans serovar lai str. 56601
auuuggaaucugcaucuuuucua

SEQ ID NO: 2786684 - RNA, 16 nt, Leptospira interrogans serovar lai str. 56601
auuuggacgaauccgg

SEQ ID NO: 2786685 - RNA, 19 nt, Leptospira interrogans serovar lai str. 56601
auuuggaucgguuuuagaa

SEQ ID NO: 2786686 - RNA, 20 nt, Leptospira interrogans serovar lai str. 56601
auuugguaauuugugaaccu

SEQ ID NO: 2786687 - RNA, 20 nt, Leptospira interrogans serovar lai str. 56601
auuugguuuucauucaaaau

SEQ ID NO: 2786688 - RNA, 16 nt, Leptospira interrogans serovar lai str. 56601
auuuguaaaaaugagu

SEQ ID NO: 2786689 - RNA, 14 nt, Leptospira interrogans serovar lai str. 56601
auuuguaaauaaac

SEQ ID NO: 2786690 - RNA, 18 nt, Leptospira interrogans serovar lai str. 56601
auuuguaagaguuccaca

SEQ ID NO: 2786691 - RNA, 14 nt, Leptospira interrogans serovar lai str. 56601
auuuguaauaguuc

SEQ ID NO: 2786692 - RNA, 18 nt, Leptospira interrogans serovar lai str. 56601
auuuguaauaguucccac

SEQ ID NO: 2786693 - RNA, 16 nt, Leptospira interrogans serovar lai str. 56601
auuuguagagauugau

SEQ ID NO: 2786694 - RNA, 15 nt, Leptospira interrogans serovar lai str. 56601
auuuguaggaacuac

SEQ ID NO: 2786695 - RNA, 17 nt, Leptospira interrogans serovar lai str. 56601
auuuguaggaacuacug

SEQ ID NO: 2786696 - RNA, 14 nt, Leptospira interrogans serovar lai str. 56601
auuuguaggaacuc

SEQ ID NO: 2786697 - RNA, 17 nt, Leptospira interrogans serovar lai str. 56601
auuuguaggaauuacua

SEQ ID NO: 2786698 - RNA, 16 nt, Leptospira interrogans serovar lai str. 56601
auuuguauucaagagc

SEQ ID NO: 2786699 - RNA, 16 nt, Leptospira interrogans serovar lai str. 56601
auuugucucaaaauuu

SEQ ID NO: 2786700 - RNA, 16 nt, Leptospira interrogans serovar lai str. 56601
auuugugcaaaaauuu

SEQ ID NO: 2786701 - RNA, 19 nt, Leptospira interrogans serovar lai str. 56601
auuugugcaaaaauuuuuu

SEQ ID NO: 2786702 - RNA, 20 nt, Leptospira interrogans serovar lai str. 56601
auuugugcaaaaauuuuuua

SEQ ID NO: 2786703 - RNA, 19 nt, Leptospira interrogans serovar lai str. 56601
auuuguggaaacuauuaca

SEQ ID NO: 2786704 - RNA, 20 nt, Leptospira interrogans serovar lai str. 56601
auuugugggaguucccacau

SEQ ID NO: 2786705 - RNA, 21 nt, Leptospira interrogans serovar lai str. 56601
auuuguguuaguucccacauu

SEQ ID NO: 2786706 - RNA, 17 nt, Leptospira interrogans serovar lai str. 56601
auuuguuccuaaaaaau

SEQ ID NO: 2786707 - RNA, 14 nt, Leptospira interrogans serovar lai str. 56601
auuuguugauuuuu

SEQ ID NO: 2786708 - RNA, 20 nt, Leptospira interrogans serovar lai str. 56601
auuuguugcaauacauucuu

SEQ ID NO: 2786709 - RNA, 22 nt, Leptospira interrogans serovar lai str. 56601
auuuguugcaauacauucuuau

SEQ ID NO: 2786710 - RNA, 23 nt, Leptospira interrogans serovar lai str. 56601
auuuguuguaucgaacucacguu

SEQ ID NO: 2786711 - RNA, 19 nt, Leptospira interrogans serovar lai str. 56601
auuuguuuaggaauuuuuu

SEQ ID NO: 2786712 - RNA, 20 nt, Leptospira interrogans serovar lai str. 56601
auuuguuuaggaauuuuuua

SEQ ID NO: 2786713 - RNA, 17 nt, Leptospira interrogans serovar lai str. 56601
auuuguuucuauuuuau

SEQ ID NO: 2786714 - RNA, 18 nt, Leptospira interrogans serovar lai str. 56601
auuuguuugucuuuuucu

SEQ ID NO: 2786715 - RNA, 13 nt, Leptospira interrogans serovar lai str. 56601
auuuguuuuauaa

SEQ ID NO: 2786716 - RNA, 16 nt, Leptospira interrogans serovar lai str. 56601
auuuguuuuauaaaac

SEQ ID NO: 2786717 - RNA, 14 nt, Leptospira interrogans serovar lai str. 56601
auuuuaaaaaaauu

SEQ ID NO: 2786718 - RNA, 18 nt, Leptospira interrogans serovar lai str. 56601
auuuuaaaaaaauuuuua

SEQ ID NO: 2786719 - RNA, 14 nt, Leptospira interrogans serovar lai str. 56601
auuuuaaaauucac

SEQ ID NO: 2786720 - RNA, 20 nt, Leptospira interrogans serovar lai str. 56601
auuuuaaaauucacauuaua

SEQ ID NO: 2786721 - RNA, 19 nt, Leptospira interrogans serovar lai str. 56601
auuuuaaacaaagacaaag

SEQ ID NO: 2786722 - RNA, 15 nt, Leptospira interrogans serovar lai str. 56601
auuuuaaagaaacuc

SEQ ID NO: 2786723 - RNA, 17 nt, Leptospira interrogans serovar lai str. 56601
auuuuaaaguuuugaaa

SEQ ID NO: 2786724 - RNA, 13 nt, Leptospira interrogans serovar lai str. 56601
auuuuaaauaaaa

SEQ ID NO: 2786725 - RNA, 15 nt, Leptospira interrogans serovar lai str. 56601
auuuuaaauauuaau

SEQ ID NO: 2786726 - RNA, 22 nt, Leptospira interrogans serovar lai str. 56601
auuuuaacaaucguacgaauca

SEQ ID NO: 2786727 - RNA, 20 nt, Leptospira interrogans serovar lai str. 56601
auuuuaacagauuaaaugua

SEQ ID NO: 2786728 - RNA, 13 nt, Leptospira interrogans serovar lai str. 56601
auuuuaacgugag

SEQ ID NO: 2786729 - RNA, 18 nt, Leptospira interrogans serovar lai str. 56601
auuuuaacuuuuuuuaaa

SEQ ID NO: 2786730 - RNA, 20 nt, Leptospira interrogans serovar lai str. 56601
auuuuaacuuuuuuuaaaaa

SEQ ID NO: 2786731 - RNA, 20 nt, Leptospira interrogans serovar lai str. 56601
auuuuaagaacaauuuaaaa

SEQ ID NO: 2786732 - RNA, 20 nt, Leptospira interrogans serovar lai str. 56601
auuuuaagaaucgaucugca

SEQ ID NO: 2786733 - RNA, 20 nt, Leptospira interrogans serovar lai str. 56601
auuuuaagacaaacuuuuag

SEQ ID NO: 2786734 - RNA, 21 nt, Leptospira interrogans serovar lai str. 56601
auuuuaagaucuauuccuaaa

SEQ ID NO: 2786735 - RNA, 20 nt, Leptospira interrogans serovar lai str. 56601
auuuuaagcucgaauaaaaa

SEQ ID NO: 2786736 - RNA, 14 nt, Leptospira interrogans serovar lai str. 56601
auuuuaauauauug

SEQ ID NO: 2786737 - RNA, 22 nt, Leptospira interrogans serovar lai str. 56601
auuuuaauauuauuaaauuuuu

SEQ ID NO: 2786738 - RNA, 13 nt, Leptospira interrogans serovar lai str. 56601
auuuuaaucuucu

SEQ ID NO: 2786739 - RNA, 17 nt, Leptospira interrogans serovar lai str. 56601
auuuuaauggaaaugga

SEQ ID NO: 2786740 - RNA, 20 nt, Leptospira interrogans serovar lai str. 56601
auuuuacacgaucauucuuu

SEQ ID NO: 2786741 - RNA, 18 nt, Leptospira interrogans serovar lai str. 56601
auuuuacacguaauucuu

SEQ ID NO: 2786742 - RNA, 20 nt, Leptospira interrogans serovar lai str. 56601
auuuuacagagauauagaaa

SEQ ID NO: 2786743 - RNA, 17 nt, Leptospira interrogans serovar lai str. 56601
auuuuacagagaucauu

SEQ ID NO: 2786744 - RNA, 17 nt, Leptospira interrogans serovar lai str. 56601
auuuuacauacgaucua

SEQ ID NO: 2786745 - RNA, 13 nt, Leptospira interrogans serovar lai str. 56601
auuuuaccaaauu

SEQ ID NO: 2786746 - RNA, 20 nt, Leptospira interrogans serovar lai str. 56601
auuuuaccagaucaauucuu

SEQ ID NO: 2786747 - RNA, 17 nt, Leptospira interrogans serovar lai str. 56601
auuuucgccgaaacauu

SEQ ID NO: 2786748 - RNA, 15 nt, Leptospira interrogans serovar lai str. 56601
auuuucuaaaaguag

SEQ ID NO: 2786749 - RNA, 14 nt, Leptospira interrogans serovar lai str. 56601
auuuucuaaagauu

SEQ ID NO: 2786750 - RNA, 17 nt, Leptospira interrogans serovar lai str. 56601
auuuucuaaugcauuua

SEQ ID NO: 2786751 - RNA, 22 nt, Leptospira interrogans serovar lai str. 56601
auuuucuaggauuuuauauaua

SEQ ID NO: 2786752 - RNA, 18 nt, Leptospira interrogans serovar lai str. 56601
auuuucuauuuaacguga

SEQ ID NO: 2786753 - RNA, 18 nt, Leptospira interrogans serovar lai str. 56601
auuuucuuagguaauuua

SEQ ID NO: 2786754 - RNA, 23 nt, Leptospira interrogans serovar lai str. 56601
auuuucuuaguuuuguacuuuac

SEQ ID NO: 2786755 - RNA, 20 nt, Leptospira interrogans serovar lai str. 56601
auuuucuuugaaaaaauuuu

SEQ ID NO: 2786756 - RNA, 19 nt, Leptospira interrogans serovar lai str. 56601
auuuugaacaaguucuaaa

SEQ ID NO: 2786757 - RNA, 15 nt, Leptospira interrogans serovar lai str. 56601
auuuugaacauuuuc

SEQ ID NO: 2786758 - RNA, 13 nt, Leptospira interrogans serovar lai str. 56601
auuuugaaggaaa

SEQ ID NO: 2786759 - RNA, 18 nt, Leptospira interrogans serovar lai str. 56601
auuuugaauaaguuuuau

SEQ ID NO: 2786760 - RNA, 23 nt, Leptospira interrogans serovar lai str. 56601
auuuugagacaggcucaauauuu

SEQ ID NO: 2786761 - RNA, 21 nt, Leptospira interrogans serovar lai str. 56601
auuuugagcagauucuaaaaa

SEQ ID NO: 2786762 - RNA, 22 nt, Leptospira interrogans serovar lai str. 56601
auuuugagguauuuuagagaaa

SEQ ID NO: 2786763 - RNA, 18 nt, Leptospira interrogans serovar lai str. 56601
auuuugauccguuuuaaa

SEQ ID NO: 2786764 - RNA, 14 nt, Leptospira interrogans serovar lai str. 56601
auuuugauuccaaa

SEQ ID NO: 2786765 - RNA, 16 nt, Leptospira interrogans serovar lai str. 56601
auuuugcacugaaaua

SEQ ID NO: 2786766 - RNA, 18 nt, Leptospira interrogans serovar lai str. 56601
auuuugcaugaaaucagu

SEQ ID NO: 2786767 - RNA, 20 nt, Leptospira interrogans serovar lai str. 56601
auuuugcucacucauuuuua

SEQ ID NO: 2786768 - RNA, 15 nt, Leptospira interrogans serovar lai str. 56601
auuuuggaaagaaua

SEQ ID NO: 2786769 - RNA, 21 nt, Leptospira interrogans serovar lai str. 56601
auuuuggauagcaaaaaaauc

SEQ ID NO: 2786770 - RNA, 22 nt, Leptospira interrogans serovar lai str. 56601
auuuugggcgugccucucgcca

SEQ ID NO: 2786771 - RNA, 18 nt, Leptospira interrogans serovar lai str. 56601
auuuuguaaugaaaucua

SEQ ID NO: 2786772 - RNA, 21 nt, Leptospira interrogans serovar lai str. 56601
auuuuguauugaaauagaauc

SEQ ID NO: 2786773 - RNA, 22 nt, Leptospira interrogans serovar lai str. 56601
auuuugucuccugucaauuuuc

SEQ ID NO: 2786774 - RNA, 15 nt, Leptospira interrogans serovar lai str. 56601
auuuugugaaacuua

SEQ ID NO: 2786775 - RNA, 19 nt, Leptospira interrogans serovar lai str. 56601
auuuuguugcguuuaaaaa

SEQ ID NO: 2786776 - RNA, 12 nt, Leptospira interrogans serovar lai str. 56601
auuuuguuugaa

SEQ ID NO: 2786777 - RNA, 23 nt, Leptospira interrogans serovar lai str. 56601
auuuuguuugaauccaaaaguuu

SEQ ID NO: 2786778 - RNA, 14 nt, Leptospira interrogans serovar lai str. 56601
auuuuguuuugaaa

SEQ ID NO: 2786779 - RNA, 12 nt, Leptospira interrogans serovar lai str. 56601
auuuuuaaaaaa

SEQ ID NO: 2786780 - RNA, 21 nt, Leptospira interrogans serovar lai str. 56601
auuuuuaaaaaauuaauucuc

SEQ ID NO: 2786781 - RNA, 15 nt, Leptospira interrogans serovar lai str. 56601
auuuuuaaaaagaau

SEQ ID NO: 2786782 - RNA, 22 nt, Leptospira interrogans serovar lai str. 56601
auuuuuaaaaauauaguuccua

SEQ ID NO: 2786783 - RNA, 16 nt, Leptospira interrogans serovar lai str. 56601
auuuuuaaaaauuaga

SEQ ID NO: 2786784 - RNA, 22 nt, Leptospira interrogans serovar lai str. 56601
auuuuuaaacauuuauuuuucg

SEQ ID NO: 2786785 - RNA, 16 nt, Leptospira interrogans serovar lai str. 56601
auuuuuaaacucauuc

SEQ ID NO: 2786786 - RNA, 14 nt, Leptospira interrogans serovar lai str. 56601
auuuuuaacgugaa

SEQ ID NO: 2786787 - RNA, 13 nt, Leptospira interrogans serovar lai str. 56601
auuuuuaagaaua

SEQ ID NO: 2786788 - RNA, 14 nt, Leptospira interrogans serovar lai str. 56601
auuuuuaauaaaau

SEQ ID NO: 2786789 - RNA, 15 nt, Leptospira interrogans serovar lai str. 56601
auuuuuaauaaaaug

SEQ ID NO: 2786790 - RNA, 17 nt, Leptospira interrogans serovar lai str. 56601
auuuuuaauaaaaugca

SEQ ID NO: 2786791 - RNA, 12 nt, Leptospira interrogans serovar lai str. 56601
auuuuuacaaaa

SEQ ID NO: 2786792 - RNA, 18 nt, Leptospira interrogans serovar lai str. 56601
auuuuuacaaaaaaauca

SEQ ID NO: 2786793 - RNA, 15 nt, Leptospira interrogans serovar lai str. 56601
auuuuuacacauuca

SEQ ID NO: 2786794 - RNA, 23 nt, Leptospira interrogans serovar lai str. 56601
auuuuuacacauucauuuuuucu

SEQ ID NO: 2786795 - RNA, 19 nt, Leptospira interrogans serovar lai str. 56601
auuuuuacaccaaacucac

SEQ ID NO: 2786796 - RNA, 14 nt, Leptospira interrogans serovar lai str. 56601
auuuuuacagaaaa

SEQ ID NO: 2786797 - RNA, 22 nt, Leptospira interrogans serovar lai str. 56601
auuuuuacgacccaagauuuuu

SEQ ID NO: 2786798 - RNA, 20 nt, Leptospira interrogans serovar lai str. 56601
auuuuuacggaucaaaauuc

SEQ ID NO: 2786799 - RNA, 16 nt, Leptospira interrogans serovar lai str. 56601
auuuuuacugauuuuc

SEQ ID NO: 2786800 - RNA, 12 nt, Leptospira interrogans serovar lai str. 56601
auuuuuagaaaa

SEQ ID NO: 2786801 - RNA, 17 nt, Leptospira interrogans serovar lai str. 56601
auuuuuagaaaauuuuu

SEQ ID NO: 2786802 - RNA, 16 nt, Leptospira interrogans serovar lai str. 56601
auuuuuagaaauuuuu

SEQ ID NO: 2786803 - RNA, 15 nt, Leptospira interrogans serovar lai str. 56601
auuuuuauaaaaaua

SEQ ID NO: 2786804 - RNA, 16 nt, Leptospira interrogans serovar lai str. 56601
auuuuuauaaaauacc

SEQ ID NO: 2786805 - RNA, 13 nt, Leptospira interrogans serovar lai str. 56601
auuuuuauaaaga

SEQ ID NO: 2786806 - RNA, 17 nt, Leptospira interrogans serovar lai str. 56601
auuuuuauaaagauaaa

SEQ ID NO: 2786807 - RNA, 17 nt, Leptospira interrogans serovar lai str. 56601
auuuuuauaaguuuaau

SEQ ID NO: 2786808 - RNA, 17 nt, Leptospira interrogans serovar lai str. 56601
auuuuuaucuugaucca

SEQ ID NO: 2786809 - RNA, 23 nt, Leptospira interrogans serovar lai str. 56601
auuuuuauggaucaaaaccauuu

SEQ ID NO: 2786810 - RNA, 23 nt, Leptospira interrogans serovar lai str. 56601
auuuuucaaauaaagaaaaggaa

SEQ ID NO: 2786811 - RNA, 15 nt, Leptospira interrogans serovar lai str. 56601
auuuuucaauaacuc

SEQ ID NO: 2786812 - RNA, 22 nt, Leptospira interrogans serovar lai str. 56601
auuuuucaauaauucuauuuua

SEQ ID NO: 2786813 - RNA, 15 nt, Leptospira interrogans serovar lai str. 56601
auuuuuccauaaaaa

SEQ ID NO: 2786814 - RNA, 16 nt, Leptospira interrogans serovar lai str. 56601
auuuuuccauaaaaaa

SEQ ID NO: 2786815 - RNA, 19 nt, Leptospira interrogans serovar lai str. 56601
auuuuuccguaaaaaguua

SEQ ID NO: 2786816 - RNA, 22 nt, Leptospira interrogans serovar lai str. 56601
auuuuuccguaaauaucaaaug

SEQ ID NO: 2786817 - RNA, 19 nt, Leptospira interrogans serovar lai str. 56601
auuuuucgaaacaaaauca

SEQ ID NO: 2786818 - RNA, 16 nt, Leptospira interrogans serovar lai str. 56601
auuuuucgaacgugaa

SEQ ID NO: 2786819 - RNA, 18 nt, Leptospira interrogans serovar lai str. 56601
auuuuucgaagauauaau

SEQ ID NO: 2786820 - RNA, 16 nt, Leptospira interrogans serovar lai str. 56601
auuuuucguaauggga

SEQ ID NO: 2786821 - RNA, 19 nt, Leptospira interrogans serovar lai str. 56601
auuuuucguucuaagaauc

SEQ ID NO: 2786822 - RNA, 11 nt, Leptospira interrogans serovar lai str. 56601
auuuuucuagu

SEQ ID NO: 2786823 - RNA, 12 nt, Leptospira interrogans serovar lai str. 56601
auuuuucucuau

SEQ ID NO: 2786824 - RNA, 19 nt, Leptospira interrogans serovar lai str. 56601
auuuuucugaaaaaaguug

SEQ ID NO: 2786825 - RNA, 20 nt, Leptospira interrogans serovar lai str. 56601
auuuuucugaaaaaaguugg

SEQ ID NO: 2786826 - RNA, 18 nt, Leptospira interrogans serovar lai str. 56601
auuuuucugaaaaaguug

SEQ ID NO: 2786827 - RNA, 19 nt, Leptospira interrogans serovar lai str. 56601
auuuuucugaaaaaguugg

SEQ ID NO: 2786828 - RNA, 22 nt, Leptospira interrogans serovar lai str. 56601
auuuuucuuaaaaaaauuguga

SEQ ID NO: 2786829 - RNA, 17 nt, Leptospira interrogans serovar lai str. 56601
auuuuucuuaauuucuc

SEQ ID NO: 2786830 - RNA, 21 nt, Leptospira interrogans serovar lai str. 56601
caaaaaugugggaacuauaau

SEQ ID NO: 2786831 - RNA, 22 nt, Leptospira interrogans serovar lai str. 56601
caaaaauuauaaaucauacaau

SEQ ID NO: 2786832 - RNA, 13 nt, Leptospira interrogans serovar lai str. 56601
caaaaauucaggu

SEQ ID NO: 2786833 - RNA, 14 nt, Leptospira interrogans serovar lai str. 56601
caaaaauucuaaua

SEQ ID NO: 2786834 - RNA, 16 nt, Leptospira interrogans serovar lai str. 56601
caaaaauuuaaaaauu

SEQ ID NO: 2786835 - RNA, 14 nt, Leptospira interrogans serovar lai str. 56601
caaaaauuuaaguc

SEQ ID NO: 2786836 - RNA, 12 nt, Leptospira interrogans serovar lai str. 56601
caaaaauuuaau

SEQ ID NO: 2786837 - RNA, 16 nt, Leptospira interrogans serovar lai str. 56601
caaaaauuuucuaaaa

SEQ ID NO: 2786838 - RNA, 19 nt, Leptospira interrogans serovar lai str. 56601
caaaaauuuucuaaaagua

SEQ ID NO: 2786839 - RNA, 14 nt, Leptospira interrogans serovar lai str. 56601
caaaaauuuuuuag

SEQ ID NO: 2786840 - RNA, 16 nt, Leptospira interrogans serovar lai str. 56601
caaaaauuuuuuagag

SEQ ID NO: 2786841 - RNA, 19 nt, Leptospira interrogans serovar lai str. 56601
caaaacaauagcuucuuua

SEQ ID NO: 2786842 - RNA, 16 nt, Leptospira interrogans serovar lai str. 56601
caaaaccgaaucugga

SEQ ID NO: 2786843 - RNA, 23 nt, Leptospira interrogans serovar lai str. 56601
caaaaccuaauaaacaaaauuca

SEQ ID NO: 2786844 - RNA, 21 nt, Leptospira interrogans serovar lai str. 56601
caaaaccuaucuaacgauccu

SEQ ID NO: 2786845 - RNA, 17 nt, Leptospira interrogans serovar lai str. 56601
caaaaccucaaaaaauu

SEQ ID NO: 2786846 - RNA, 18 nt, Leptospira interrogans serovar lai str. 56601
caaaaccuguaaaugaau

SEQ ID NO: 2786847 - RNA, 20 nt, Leptospira interrogans serovar lai str. 56601
caaaacgauauuuuuuaaaa

SEQ ID NO: 2786848 - RNA, 23 nt, Leptospira interrogans serovar lai str. 56601
caaaacgauauuuuuuaaaaaua

SEQ ID NO: 2786849 - RNA, 22 nt, Leptospira interrogans serovar lai str. 56601
caaaacgcgauccguaaaaaac

SEQ ID NO: 2786850 - RNA, 13 nt, Leptospira interrogans serovar lai str. 56601
caaaacgguaauu

SEQ ID NO: 2786851 - RNA, 14 nt, Leptospira interrogans serovar lai str. 56601
caaaacgguaauuu

SEQ ID NO: 2786852 - RNA, 12 nt, Leptospira interrogans serovar lai str. 56601
caaaacuaaaac

SEQ ID NO: 2786853 - RNA, 15 nt, Leptospira interrogans serovar lai str. 56601
caaaacuaaaaccga

SEQ ID NO: 2786854 - RNA, 14 nt, Leptospira interrogans serovar lai str. 56601
caaaacuaggaucu

SEQ ID NO: 2786855 - RNA, 16 nt, Leptospira interrogans serovar lai str. 56601
caaaacuaggaucucc

SEQ ID NO: 2786856 - RNA, 17 nt, Leptospira interrogans serovar lai str. 56601
caaaacucuuuaaaaac

SEQ ID NO: 2786857 - RNA, 18 nt, Leptospira interrogans serovar lai str. 56601
caaaacucuuuaaaaacu

SEQ ID NO: 2786858 - RNA, 17 nt, Leptospira interrogans serovar lai str. 56601
caaaacugcuucaauug

SEQ ID NO: 2786859 - RNA, 11 nt, Leptospira interrogans serovar lai str. 56601
caaaacuuaaa

SEQ ID NO: 2786860 - RNA, 15 nt, Leptospira interrogans serovar lai str. 56601
caaaacuuaaaaaug

SEQ ID NO: 2786861 - RNA, 12 nt, Leptospira interrogans serovar lai str. 56601
caaaacuuaaau

SEQ ID NO: 2786862 - RNA, 14 nt, Leptospira interrogans serovar lai str. 56601
caaaacuuaaauuc

SEQ ID NO: 2786863 - RNA, 15 nt, Leptospira interrogans serovar lai str. 56601
caaaacuucaaagaa

SEQ ID NO: 2786864 - RNA, 14 nt, Leptospira interrogans serovar lai str. 56601
caaaagaggucuau

SEQ ID NO: 2786865 - RNA, 22 nt, Leptospira interrogans serovar lai str. 56601
caaaagaguuuucaaucgaaga

SEQ ID NO: 2786866 - RNA, 19 nt, Leptospira interrogans serovar lai str. 56601
caaaagauugaauuuuuau

SEQ ID NO: 2786867 - RNA, 15 nt, Leptospira interrogans serovar lai str. 56601
caaaagguauaaaau

SEQ ID NO: 2786868 - RNA, 16 nt, Leptospira interrogans serovar lai str. 56601
caaaagguauaaaaua

SEQ ID NO: 2786869 - RNA, 18 nt, Leptospira interrogans serovar lai str. 56601
caaaagguauaaaauaaa

SEQ ID NO: 2786870 - RNA, 21 nt, Leptospira interrogans serovar lai str. 56601
caaaagguauaaaauaaaaau

SEQ ID NO: 2786871 - RNA, 22 nt, Leptospira interrogans serovar lai str. 56601
caaaagguauaaaauaaaaauu

SEQ ID NO: 2786872 - RNA, 16 nt, Leptospira interrogans serovar lai str. 56601
caaaagucauugaagg

SEQ ID NO: 2786873 - RNA, 19 nt, Leptospira interrogans serovar lai str. 56601
caaaaguccaauuuuaaaa

SEQ ID NO: 2786874 - RNA, 23 nt, Leptospira interrogans serovar lai str. 56601
caaaaguccaauuuuaaaaccaa

SEQ ID NO: 2786875 - RNA, 13 nt, Leptospira interrogans serovar lai str. 56601
caaaagucuauuu

SEQ ID NO: 2786876 - RNA, 19 nt, Leptospira interrogans serovar lai str. 56601
caaaagucuauuucuaaac

SEQ ID NO: 2786877 - RNA, 15 nt, Leptospira interrogans serovar lai str. 56601
caaaaguuuauaaac

SEQ ID NO: 2786878 - RNA, 16 nt, Leptospira interrogans serovar lai str. 56601
caaaaguuuauaaacu

SEQ ID NO: 2786879 - RNA, 18 nt, Leptospira interrogans serovar lai str. 56601
caaaaguuuauaaacuuc

SEQ ID NO: 2786880 - RNA, 22 nt, Leptospira interrogans serovar lai str. 56601
caaaaguuuauaaacuucucaa

SEQ ID NO: 2786881 - RNA, 18 nt, Leptospira interrogans serovar lai str. 56601
caaaaguuucaucuuuga

SEQ ID NO: 2786882 - RNA, 21 nt, Leptospira interrogans serovar lai str. 56601
caaaaguuuucaaaaauguau

SEQ ID NO: 2786883 - RNA, 18 nt, Leptospira interrogans serovar lai str. 56601
caaaauaaauaauacauu

SEQ ID NO: 2786884 - RNA, 19 nt, Leptospira interrogans serovar lai str. 56601
caaaauaagaaaauaaagg

SEQ ID NO: 2786885 - RNA, 18 nt, Leptospira interrogans serovar lai str. 56601
caaaauacgaucuaauuu

SEQ ID NO: 2786886 - RNA, 12 nt, Leptospira interrogans serovar lai str. 56601
caaaauacuuua

SEQ ID NO: 2786887 - RNA, 22 nt, Leptospira interrogans serovar lai str. 56601
caaaauacuuuaucuuuacuua

SEQ ID NO: 2786888 - RNA, 23 nt, Leptospira interrogans serovar lai str. 56601
caaaauaucuggaacuuuaauua

SEQ ID NO: 2786889 - RNA, 14 nt, Leptospira interrogans serovar lai str. 56601
caaaauauucagaa

SEQ ID NO: 2786890 - RNA, 22 nt, Leptospira interrogans serovar lai str. 56601
caaaauauucguguucuauuau

SEQ ID NO: 2786891 - RNA, 12 nt, Leptospira interrogans serovar lai str. 56601
caaaaucggaau

SEQ ID NO: 2786892 - RNA, 18 nt, Leptospira interrogans serovar lai str. 56601
caaaaucguuuuaaaaac

SEQ ID NO: 2786893 - RNA, 22 nt, Leptospira interrogans serovar lai str. 56601
caaaaucugaauuuuaccaaau

SEQ ID NO: 2786894 - RNA, 18 nt, Leptospira interrogans serovar lai str. 56601
caaaaucuuaauaaaauu

SEQ ID NO: 2786895 - RNA, 13 nt, Leptospira interrogans serovar lai str. 56601
caaaaugaacuca

SEQ ID NO: 2786896 - RNA, 20 nt, Leptospira interrogans serovar lai str. 56601
caaaaugaauuguaaaaaac

SEQ ID NO: 2786897 - RNA, 23 nt, Leptospira interrogans serovar lai str. 56601
caaaauuacuucaauuguccauu

SEQ ID NO: 2786898 - RNA, 23 nt, Leptospira interrogans serovar lai str. 56601
caaaauuaggcuuaucuguaaaa

SEQ ID NO: 2786899 - RNA, 18 nt, Leptospira interrogans serovar lai str. 56601
caaaauucuuaaaaaaua

SEQ ID NO: 2786900 - RNA, 12 nt, Leptospira interrogans serovar lai str. 56601
caaaauugagaa

SEQ ID NO: 2786901 - RNA, 18 nt, Leptospira interrogans serovar lai str. 56601
caaaauugagaauagaag

SEQ ID NO: 2786902 - RNA, 23 nt, Leptospira interrogans serovar lai str. 56601
caaaauugagcuuguuuuuaaau

SEQ ID NO: 2786903 - RNA, 23 nt, Leptospira interrogans serovar lai str. 56601
caaaauuguuggccuuuuugaag

SEQ ID NO: 2786904 - RNA, 15 nt, Leptospira interrogans serovar lai str. 56601
caaaauuuaaaaagu

SEQ ID NO: 2786905 - RNA, 20 nt, Leptospira interrogans serovar lai str. 56601
caaaauuuaagauuacucua

SEQ ID NO: 2786906 - RNA, 14 nt, Leptospira interrogans serovar lai str. 56601
caaaauuuccaacg

SEQ ID NO: 2786907 - RNA, 14 nt, Leptospira interrogans serovar lai str. 56601
caaaauuucuaaag

SEQ ID NO: 2786908 - RNA, 15 nt, Leptospira interrogans serovar lai str. 56601
caaaauuucuuuuuu

SEQ ID NO: 2786909 - RNA, 18 nt, Leptospira interrogans serovar lai str. 56601
caaaauuugauccucuaa

SEQ ID NO: 2786910 - RNA, 22 nt, Leptospira interrogans serovar lai str. 56601
caaaauuugcuuccauugucua

SEQ ID NO: 2786911 - RNA, 13 nt, Leptospira interrogans serovar lai str. 56601
caaaauuuuauaa

SEQ ID NO: 2786912 - RNA, 21 nt, Leptospira interrogans serovar lai str. 56601
caaaauuuuuguguaaaauua

SEQ ID NO: 2786913 - RNA, 15 nt, Leptospira interrogans serovar lai str. 56601
caaauaauaaaacuu

SEQ ID NO: 2786914 - RNA, 13 nt, Leptospira interrogans serovar lai str. 56601
caaauacaaaaac

SEQ ID NO: 2786915 - RNA, 19 nt, Leptospira interrogans serovar lai str. 56601
caaauacaaaauuuuuucc

SEQ ID NO: 2786916 - RNA, 15 nt, Leptospira interrogans serovar lai str. 56601
caaauacaauuugau

SEQ ID NO: 2786917 - RNA, 17 nt, Leptospira interrogans serovar lai str. 56601
caaauacuuagaauuuu

SEQ ID NO: 2786918 - RNA, 13 nt, Leptospira interrogans serovar lai str. 56601
caaauagaaauag

SEQ ID NO: 2786919 - RNA, 12 nt, Leptospira interrogans serovar lai str. 56601
caaaucaaaucg

SEQ ID NO: 2786920 - RNA, 16 nt, Leptospira interrogans serovar lai str. 56601
caaaucaauuuuaaau

SEQ ID NO: 2786921 - RNA, 23 nt, Leptospira interrogans serovar lai str. 56601
caaaucacaauuuuaagaacaau

SEQ ID NO: 2786922 - RNA, 19 nt, Leptospira interrogans serovar lai str. 56601
caaaucacauccaacccaa

SEQ ID NO: 2786923 - RNA, 18 nt, Leptospira interrogans serovar lai str. 56601
caaaucagguuuuuacag

SEQ ID NO: 2786924 - RNA, 21 nt, Leptospira interrogans serovar lai str. 56601
caaaucaucccgcccaaagua

SEQ ID NO: 2786925 - RNA, 14 nt, Leptospira interrogans serovar lai str. 56601
caaauccccaaaag

SEQ ID NO: 2786926 - RNA, 22 nt, Leptospira interrogans serovar lai str. 56601
caaaucgaagaugguacuuuac

SEQ ID NO: 2786927 - RNA, 19 nt, Leptospira interrogans serovar lai str. 56601
caaaucgauccuguuuaua

SEQ ID NO: 2786928 - RNA, 19 nt, Leptospira interrogans serovar lai str. 56601
caaaucgcugguuuuauuu

SEQ ID NO: 2786929 - RNA, 20 nt, Leptospira interrogans serovar lai str. 56601
caaaucgcugguuuuauuuc

SEQ ID NO: 2786930 - RNA, 14 nt, Leptospira interrogans serovar lai str. 56601
caaaucugaaauuc

SEQ ID NO: 2786931 - RNA, 21 nt, Leptospira interrogans serovar lai str. 56601
caaaucugaaauucaucaaau

SEQ ID NO: 2786932 - RNA, 14 nt, Leptospira interrogans serovar lai str. 56601
caaaucugaaucuc

SEQ ID NO: 2786933 - RNA, 17 nt, Leptospira interrogans serovar lai str. 56601
caaaucugaaucucuuu

SEQ ID NO: 2786934 - RNA, 18 nt, Leptospira interrogans serovar lai str. 56601
caaaucuuucacuuuaaa

SEQ ID NO: 2786935 - RNA, 21 nt, Leptospira interrogans serovar lai str. 56601
caaaucuuucacuuuaaaaca

SEQ ID NO: 2786936 - RNA, 22 nt, Leptospira interrogans serovar lai str. 56601
caaaucuuucacuuuaaaacau

SEQ ID NO: 2786937 - RNA, 18 nt, Leptospira interrogans serovar lai str. 56601
caaaugagagcgaaugca

SEQ ID NO: 2786938 - RNA, 23 nt, Leptospira interrogans serovar lai str. 56601
caaaugcaguaaugccuacaaau

SEQ ID NO: 2786939 - RNA, 23 nt, Leptospira interrogans serovar lai str. 56601
caaaugcgaccuaacuuguagaa

SEQ ID NO: 2786940 - RNA, 23 nt, Leptospira interrogans serovar lai str. 56601
caaaugcugaauugcucaaagaa

SEQ ID NO: 2786941 - RNA, 14 nt, Leptospira interrogans serovar lai str. 56601
caaauggagaauua

SEQ ID NO: 2786942 - RNA, 18 nt, Leptospira interrogans serovar lai str. 56601
caaauggagaauuaauuu

SEQ ID NO: 2786943 - RNA, 21 nt, Leptospira interrogans serovar lai str. 56601
caaauuaaguuuaaaaacagu

SEQ ID NO: 2786944 - RNA, 21 nt, Leptospira interrogans serovar lai str. 56601
caaauuaauuacuuagaugaa

SEQ ID NO: 2786945 - RNA, 15 nt, Leptospira interrogans serovar lai str. 56601
caaauuaguauuuuu

SEQ ID NO: 2786946 - RNA, 17 nt, Leptospira interrogans serovar lai str. 56601
caaauuaguauuuuucu

SEQ ID NO: 2786947 - RNA, 22 nt, Leptospira interrogans serovar lai str. 56601
caaauuaguauuuuucuuaauu

SEQ ID NO: 2786948 - RNA, 20 nt, Leptospira interrogans serovar lai str. 56601
caaauucacauaaaguuaau

SEQ ID NO: 2786949 - RNA, 22 nt, Leptospira interrogans serovar lai str. 56601
caaauucacguucaacaaacaa

SEQ ID NO: 2786950 - RNA, 18 nt, Leptospira interrogans serovar lai str. 56601
caaauucaucacuucuac

SEQ ID NO: 2786951 - RNA, 17 nt, Leptospira interrogans serovar lai str. 56601
caaauuccaauuuuucu

SEQ ID NO: 2786952 - RNA, 18 nt, Leptospira interrogans serovar lai str. 56601
caaauuccaauuuuucug

SEQ ID NO: 2786953 - RNA, 17 nt, Leptospira interrogans serovar lai str. 56601
caaauucgucaaaacca

SEQ ID NO: 2786954 - RNA, 17 nt, Leptospira interrogans serovar lai str. 56601
caaauucuaaacuugua

SEQ ID NO: 2786955 - RNA, 17 nt, Leptospira interrogans serovar lai str. 56601
caaauucucauuuagag

SEQ ID NO: 2786956 - RNA, 13 nt, Leptospira interrogans serovar lai str. 56601
caaauucuuuuug

SEQ ID NO: 2786957 - RNA, 22 nt, Leptospira interrogans serovar lai str. 56601
caaauugaacggacuguuuuaa

SEQ ID NO: 2786958 - RNA, 21 nt, Leptospira interrogans serovar lai str. 56601
caaauugaauuugcaguaaaa

SEQ ID NO: 2786959 - RNA, 15 nt, Leptospira interrogans serovar lai str. 56601
caaauugaguuucuu

SEQ ID NO: 2786960 - RNA, 18 nt, Leptospira interrogans serovar lai str. 56601
caaauugauaauuuuugu

SEQ ID NO: 2786961 - RNA, 18 nt, Leptospira interrogans serovar lai str. 56601
caaauugcaacuuugguu

SEQ ID NO: 2786962 - RNA, 19 nt, Leptospira interrogans serovar lai str. 56601
caaauuggcagaugaaacu

SEQ ID NO: 2786963 - RNA, 15 nt, Leptospira interrogans serovar lai str. 56601
caaauuuaaaauaac

SEQ ID NO: 2786964 - RNA, 16 nt, Leptospira interrogans serovar lai str. 56601
caaauuuauguacuuu

SEQ ID NO: 2786965 - RNA, 21 nt, Leptospira interrogans serovar lai str. 56601
caaauuuauguacuuuuaaga

SEQ ID NO: 2786966 - RNA, 17 nt, Leptospira interrogans serovar lai str. 56601
caaauuucugaaacaau

SEQ ID NO: 2786967 - RNA, 19 nt, Leptospira interrogans serovar lai str. 56601
caaauuugcgaaaaaaaua

SEQ ID NO: 2786968 - RNA, 22 nt, Leptospira interrogans serovar lai str. 56601
caaauuugcgaaaaaaauaacg

SEQ ID NO: 2786969 - RNA, 19 nt, Leptospira interrogans serovar lai str. 56601
caaauuuggaaauugugag

SEQ ID NO: 2786970 - RNA, 13 nt, Leptospira interrogans serovar lai str. 56601
caacaaacaaaua

SEQ ID NO: 2786971 - RNA, 14 nt, Leptospira interrogans serovar lai str. 56601
caacaaacaaauag

SEQ ID NO: 2786972 - RNA, 13 nt, Leptospira interrogans serovar lai str. 56601
caacaaauugaaa

SEQ ID NO: 2786973 - RNA, 17 nt, Leptospira interrogans serovar lai str. 56601
caacaacaccaccaaca

SEQ ID NO: 2786974 - RNA, 13 nt, Leptospira interrogans serovar lai str. 56601
caacaacucuaau

SEQ ID NO: 2786975 - RNA, 23 nt, Leptospira interrogans serovar lai str. 56601
caacaacucuaauacaaaaaaug

SEQ ID NO: 2786976 - RNA, 19 nt, Leptospira interrogans serovar lai str. 56601
caacaacucuaauauaaaa

SEQ ID NO: 2786977 - RNA, 21 nt, Leptospira interrogans serovar lai str. 56601
caacaacucuaauauaaaauc

SEQ ID NO: 2786978 - RNA, 14 nt, Leptospira interrogans serovar lai str. 56601
caacaagaaugaaa

SEQ ID NO: 2786979 - RNA, 21 nt, Leptospira interrogans serovar lai str. 56601
caacaaguuuacacauuuauu

SEQ ID NO: 2786980 - RNA, 17 nt, Leptospira interrogans serovar lai str. 56601
caacaauucuauuagaa

SEQ ID NO: 2786981 - RNA, 17 nt, Leptospira interrogans serovar lai str. 56601
caacacaacgcucucua

SEQ ID NO: 2786982 - RNA, 18 nt, Leptospira interrogans serovar lai str. 56601
caacacaacgcucuuuau

SEQ ID NO: 2786983 - RNA, 21 nt, Leptospira interrogans serovar lai str. 56601
caacacacacuuuauaaaagu

SEQ ID NO: 2786984 - RNA, 14 nt, Leptospira interrogans serovar lai str. 56601
caacacauuuucau

SEQ ID NO: 2786985 - RNA, 16 nt, Leptospira interrogans serovar lai str. 56601
caacaccaccaacagc

SEQ ID NO: 2786986 - RNA, 19 nt, Leptospira interrogans serovar lai str. 56601
caacaccaccaacagcauc

SEQ ID NO: 2786987 - RNA, 23 nt, Leptospira interrogans serovar lai str. 56601
caacacugagucaacaaauauuc

SEQ ID NO: 2786988 - RNA, 20 nt, Leptospira interrogans serovar lai str. 56601
caacagaacgggcuuucuau

SEQ ID NO: 2786989 - RNA, 16 nt, Leptospira interrogans serovar lai str. 56601
caacagaauguucuua

SEQ ID NO: 2786990 - RNA, 12 nt, Leptospira interrogans serovar lai str. 56601
caacagagaaag

SEQ ID NO: 2786991 - RNA, 13 nt, Leptospira interrogans serovar lai str. 56601
caacagagaaagu

SEQ ID NO: 2786992 - RNA, 15 nt, Leptospira interrogans serovar lai str. 56601
caacaguacaagaau

SEQ ID NO: 2786993 - RNA, 19 nt, Leptospira interrogans serovar lai str. 56601
caacauuaugaaucuuuca

SEQ ID NO: 2786994 - RNA, 18 nt, Leptospira interrogans serovar lai str. 56601
caacauugcgagauuuua

SEQ ID NO: 2786995 - RNA, 19 nt, Leptospira interrogans serovar lai str. 56601
caauaaaggaaaguucuau

SEQ ID NO: 2786996 - RNA, 15 nt, Leptospira interrogans serovar lai str. 56601
caauaaaucaaaagg

SEQ ID NO: 2786997 - RNA, 22 nt, Leptospira interrogans serovar lai str. 56601
caauaaauugaaaguaaagaug

SEQ ID NO: 2786998 - RNA, 21 nt, Leptospira interrogans serovar lai str. 56601
caauaacaaccaccuuuacau

SEQ ID NO: 2786999 - RNA, 11 nt, Leptospira interrogans serovar lai str. 56601
caauaagaagc

SEQ ID NO: 2787000 - RNA, 19 nt, Leptospira interrogans serovar lai str. 56601
caauaauguccgaaauuuu

SEQ ID NO: 2787001 - RNA, 19 nt, Leptospira interrogans serovar lai str. 56601
caauaauuuuaauauuucg

SEQ ID NO: 2787002 - RNA, 14 nt, Leptospira interrogans serovar lai str. 56601
caauacaaaacaag

SEQ ID NO: 2787003 - RNA, 19 nt, Leptospira interrogans serovar lai str. 56601
caauacaucgcuuccugaa

SEQ ID NO: 2787004 - RNA, 19 nt, Leptospira interrogans serovar lai str. 56601
caauacauuagaauuuuau

SEQ ID NO: 2787005 - RNA, 14 nt, Leptospira interrogans serovar lai str. 56601
caauaccaaacgau

SEQ ID NO: 2787006 - RNA, 23 nt, Leptospira interrogans serovar lai str. 56601
caauaccgauuucuauuuuaaaa

SEQ ID NO: 2787007 - RNA, 23 nt, Leptospira interrogans serovar lai str. 56601
caauacuuacacuccucaaagau

SEQ ID NO: 2787008 - RNA, 12 nt, Leptospira interrogans serovar lai str. 56601
caauagaaauac

SEQ ID NO: 2787009 - RNA, 15 nt, Leptospira interrogans serovar lai str. 56601
caauagaaauaccau

SEQ ID NO: 2787010 - RNA, 12 nt, Leptospira interrogans serovar lai str. 56601
caauagaauugu

SEQ ID NO: 2787011 - RNA, 21 nt, Leptospira interrogans serovar lai str. 56601
caauagaauuguguuaguucc

SEQ ID NO: 2787012 - RNA, 22 nt, Leptospira interrogans serovar lai str. 56601
caauagaauuguugaaaaauua

SEQ ID NO: 2787013 - RNA, 23 nt, Leptospira interrogans serovar lai str. 56601
caauagaguuguugaaaaauuuc

SEQ ID NO: 2787014 - RNA, 17 nt, Leptospira interrogans serovar lai str. 56601
caauagcuucuuuaaaa

SEQ ID NO: 2787015 - RNA, 19 nt, Leptospira interrogans serovar lai str. 56601
caauagcuucuuuaaaaac

SEQ ID NO: 2787016 - RNA, 20 nt, Leptospira interrogans serovar lai str. 56601
caauagcuucuuuaaaaacu

SEQ ID NO: 2787017 - RNA, 14 nt, Leptospira interrogans serovar lai str. 56601
caauaggaaaggga

SEQ ID NO: 2787018 - RNA, 21 nt, Leptospira interrogans serovar lai str. 56601
caauaguuucuacauuuuugu

SEQ ID NO: 2787019 - RNA, 13 nt, Leptospira interrogans serovar lai str. 56601
caauauaaaaauu

SEQ ID NO: 2787020 - RNA, 17 nt, Leptospira interrogans serovar lai str. 56601
caauaucccaaauucga

SEQ ID NO: 2787021 - RNA, 15 nt, Leptospira interrogans serovar lai str. 56601
caauauuuaaaaauu

SEQ ID NO: 2787022 - RNA, 17 nt, Leptospira interrogans serovar lai str. 56601
caauauuuaaaaauucu

SEQ ID NO: 2787023 - RNA, 20 nt, Leptospira interrogans serovar lai str. 56601
caauauuuugucuuuaauuu

SEQ ID NO: 2787024 - RNA, 23 nt, Leptospira interrogans serovar lai str. 56601
caauauuuugucuuuaauuucaa

SEQ ID NO: 2787025 - RNA, 22 nt, Leptospira interrogans serovar lai str. 56601
caaucaauaaauugcacaaaag

SEQ ID NO: 2787026 - RNA, 18 nt, Leptospira interrogans serovar lai str. 56601
caaucaauaccgauuucu

SEQ ID NO: 2787027 - RNA, 19 nt, Leptospira interrogans serovar lai str. 56601
caaucacuuuauauugguu

SEQ ID NO: 2787028 - RNA, 13 nt, Leptospira interrogans serovar lai str. 56601
caaucaguaaaau

SEQ ID NO: 2787029 - RNA, 20 nt, Leptospira interrogans serovar lai str. 56601
caaucauauuuuaauuuucu

SEQ ID NO: 2787030 - RNA, 17 nt, Leptospira interrogans serovar lai str. 56601
caaucaugaauauuuuc

SEQ ID NO: 2787031 - RNA, 13 nt, Leptospira interrogans serovar lai str. 56601
caaucauucuuua

SEQ ID NO: 2787032 - RNA, 18 nt, Leptospira interrogans serovar lai str. 56601
caauccgcggauguuuga

SEQ ID NO: 2787033 - RNA, 19 nt, Leptospira interrogans serovar lai str. 56601
caauccgcggauguuugaa

SEQ ID NO: 2787034 - RNA, 22 nt, Leptospira interrogans serovar lai str. 56601
caauccucgcuuuuaauaauuc

SEQ ID NO: 2787035 - RNA, 15 nt, Leptospira interrogans serovar lai str. 56601
caaucgaaguugauu

SEQ ID NO: 2787036 - RNA, 15 nt, Leptospira interrogans serovar lai str. 56601
caaucgauaacuuga

SEQ ID NO: 2787037 - RNA, 21 nt, Leptospira interrogans serovar lai str. 56601
caaucgaucuguaaaauucag

SEQ ID NO: 2787038 - RNA, 17 nt, Leptospira interrogans serovar lai str. 56601
caaucggguaaaaaaua

SEQ ID NO: 2787039 - RNA, 21 nt, Leptospira interrogans serovar lai str. 56601
caaucguaggcacguggaaaa

SEQ ID NO: 2787040 - RNA, 19 nt, Leptospira interrogans serovar lai str. 56601
caaucgucuguaaaagaaa

SEQ ID NO: 2787041 - RNA, 21 nt, Leptospira interrogans serovar lai str. 56601
caaucgucuguaaaagaaaaa

SEQ ID NO: 2787042 - RNA, 18 nt, Leptospira interrogans serovar lai str. 56601
caaucuauuaacuuuaca

SEQ ID NO: 2787043 - RNA, 20 nt, Leptospira interrogans serovar lai str. 56601
caaucuccacuauggaauuu

SEQ ID NO: 2787044 - RNA, 20 nt, Leptospira interrogans serovar lai str. 56601
caaucuccccaaaaucuuua

SEQ ID NO: 2787045 - RNA, 21 nt, Leptospira interrogans serovar lai str. 56601
caaucugcaaagcucagauuc

SEQ ID NO: 2787046 - RNA, 18 nt, Leptospira interrogans serovar lai str. 56601
caaucugggugaauccgg

SEQ ID NO: 2787047 - RNA, 17 nt, Leptospira interrogans serovar lai str. 56601
caaucuguuuagaauau

SEQ ID NO: 2787048 - RNA, 21 nt, Leptospira interrogans serovar lai str. 56601
caaucuguuuagaauauuuuc

SEQ ID NO: 2787049 - RNA, 22 nt, Leptospira interrogans serovar lai str. 56601
caaucuguuuagaauauuuucu

SEQ ID NO: 2787050 - RNA, 16 nt, Leptospira interrogans serovar lai str. 56601
caaucuuacaaguuau

SEQ ID NO: 2787051 - RNA, 12 nt, Leptospira interrogans serovar lai str. 56601
caaugaaauuuu

SEQ ID NO: 2787052 - RNA, 16 nt, Leptospira interrogans serovar lai str. 56601
caaugaauuuuuauaa

SEQ ID NO: 2787053 - RNA, 21 nt, Leptospira interrogans serovar lai str. 56601
caaugaauuuuuauaaaaaua

SEQ ID NO: 2787054 - RNA, 22 nt, Leptospira interrogans serovar lai str. 56601
caaugacaacagucauucugua

SEQ ID NO: 2787055 - RNA, 23 nt, Leptospira interrogans serovar lai str. 56601
caaugaugaauucugggaaccgg

SEQ ID NO: 2787056 - RNA, 15 nt, Leptospira interrogans serovar lai str. 56601
caaugcgaaauagau

SEQ ID NO: 2787057 - RNA, 20 nt, Leptospira interrogans serovar lai str. 56601
caaugcuuuccaaaaggaaa

SEQ ID NO: 2787058 - RNA, 21 nt, Leptospira interrogans serovar lai str. 56601
caaugcuuuccaaaaggaaag

SEQ ID NO: 2787059 - RNA, 23 nt, Leptospira interrogans serovar lai str. 56601
caauggaaaguguuaguucccac

SEQ ID NO: 2787060 - RNA, 20 nt, Leptospira interrogans serovar lai str. 56601
caaugguucacucaaaauac

SEQ ID NO: 2787061 - RNA, 20 nt, Leptospira interrogans serovar lai str. 56601
caaugguugcaaaaaagaaa

SEQ ID NO: 2787062 - RNA, 21 nt, Leptospira interrogans serovar lai str. 56601
caauguaacggaaauagaugg

SEQ ID NO: 2787063 - RNA, 15 nt, Leptospira interrogans serovar lai str. 56601
caauguaagaaacuc

SEQ ID NO: 2787064 - RNA, 17 nt, Leptospira interrogans serovar lai str. 56601
caaugugccuucguuua

SEQ ID NO: 2787065 - RNA, 20 nt, Leptospira interrogans serovar lai str. 56601
caaugugccuucguuuaaaa

SEQ ID NO: 2787066 - RNA, 21 nt, Leptospira interrogans serovar lai str. 56601
caauuaaacgaucggaaggau

SEQ ID NO: 2787067 - RNA, 12 nt, Leptospira interrogans serovar lai str. 56601
caauuaaaucca

SEQ ID NO: 2787068 - RNA, 21 nt, Leptospira interrogans serovar lai str. 56601
caauuaaauuguaugaaagaa

SEQ ID NO: 2787069 - RNA, 14 nt, Leptospira interrogans serovar lai str. 56601
caauuaacaaaacu

SEQ ID NO: 2787070 - RNA, 19 nt, Leptospira interrogans serovar lai str. 56601
caauuauaaaauuuuucuc

SEQ ID NO: 2787071 - RNA, 15 nt, Leptospira interrogans serovar lai str. 56601
caauuauuauaaacu

SEQ ID NO: 2787072 - RNA, 13 nt, Leptospira interrogans serovar lai str. 56601
caauucacucuua

SEQ ID NO: 2787073 - RNA, 14 nt, Leptospira interrogans serovar lai str. 56601
caauucaguaaauu

SEQ ID NO: 2787074 - RNA, 17 nt, Leptospira interrogans serovar lai str. 56601
caauuccaccuuggaaa

SEQ ID NO: 2787075 - RNA, 18 nt, Leptospira interrogans serovar lai str. 56601
caauuccaccuuggaaag

SEQ ID NO: 2787076 - RNA, 21 nt, Leptospira interrogans serovar lai str. 56601
caauuccacuaugaaaguuuu

SEQ ID NO: 2787077 - RNA, 20 nt, Leptospira interrogans serovar lai str. 56601
caauuccauuucuguaacau

SEQ ID NO: 2787078 - RNA, 16 nt, Leptospira interrogans serovar lai str. 56601
caauucuaauuuuuua

SEQ ID NO: 2787079 - RNA, 13 nt, Leptospira interrogans serovar lai str. 56601
caauucuuccuuu

SEQ ID NO: 2787080 - RNA, 23 nt, Leptospira interrogans serovar lai str. 56601
caauugaaaguaucagaaucaaa

SEQ ID NO: 2787081 - RNA, 17 nt, Leptospira interrogans serovar lai str. 56601
caauugaauauaaaauu

SEQ ID NO: 2787082 - RNA, 20 nt, Leptospira interrogans serovar lai str. 56601
caauugacuuucuguauuuu

SEQ ID NO: 2787083 - RNA, 14 nt, Leptospira interrogans serovar lai str. 56601
caauuguuggcuuu

SEQ ID NO: 2787084 - RNA, 14 nt, Leptospira interrogans serovar lai str. 56601
caauuuaaaauaau

SEQ ID NO: 2787085 - RNA, 20 nt, Leptospira interrogans serovar lai str. 56601
caauuuaucuaaaacacauc

SEQ ID NO: 2787086 - RNA, 15 nt, Leptospira interrogans serovar lai str. 56601
caauuuauuauaaaa

SEQ ID NO: 2787087 - RNA, 17 nt, Leptospira interrogans serovar lai str. 56601
caauuuauuauaaaacg

SEQ ID NO: 2787088 - RNA, 13 nt, Leptospira interrogans serovar lai str. 56601
caauuucagaaac

SEQ ID NO: 2787089 - RNA, 22 nt, Leptospira interrogans serovar lai str. 56601
caauuucagaaacauuggaacu

SEQ ID NO: 2787090 - RNA, 22 nt, Leptospira interrogans serovar lai str. 56601
caauuucuucuuuuguuuuuau

SEQ ID NO: 2787091 - RNA, 13 nt, Leptospira interrogans serovar lai str. 56601
caauuucuuuaau

SEQ ID NO: 2787092 - RNA, 20 nt, Leptospira interrogans serovar lai str. 56601
caauuugcuaaaauaagaau

SEQ ID NO: 2787093 - RNA, 21 nt, Leptospira interrogans serovar lai str. 56601
caauuuguaauguauaauccu

SEQ ID NO: 2787094 - RNA, 14 nt, Leptospira interrogans serovar lai str. 56601
caauuuuagaauuu

SEQ ID NO: 2787095 - RNA, 16 nt, Leptospira interrogans serovar lai str. 56601
caauuuuaguaaacua

SEQ ID NO: 2787096 - RNA, 20 nt, Leptospira interrogans serovar lai str. 56601
caauuuuaguaaacuacuaa

SEQ ID NO: 2787097 - RNA, 15 nt, Leptospira interrogans serovar lai str. 56601
caauuuuaucuuaau

SEQ ID NO: 2787098 - RNA, 17 nt, Leptospira interrogans serovar lai str. 56601
caauuuuccauuucaau

SEQ ID NO: 2787099 - RNA, 22 nt, Leptospira interrogans serovar lai str. 56601
caauuuucuccuccuugaguuu

SEQ ID NO: 2787100 - RNA, 17 nt, Leptospira interrogans serovar lai str. 56601
caauuuugccaauucca

SEQ ID NO: 2787101 - RNA, 12 nt, Leptospira interrogans serovar lai str. 56601
caauuuuggaaa

SEQ ID NO: 2787102 - RNA, 16 nt, Leptospira interrogans serovar lai str. 56601
caauuuuuauaaacuu

SEQ ID NO: 2787103 - RNA, 13 nt, Leptospira interrogans serovar lai str. 56601
caauuuuugaaag

SEQ ID NO: 2787104 - RNA, 14 nt, Leptospira interrogans serovar lai str. 56601
caauuuuuugaaaa

SEQ ID NO: 2787105 - RNA, 16 nt, Leptospira interrogans serovar lai str. 56601
caauuuuuugaaaaag

SEQ ID NO: 2787106 - RNA, 21 nt, Leptospira interrogans serovar lai str. 56601
caauuuuuugaaaaagaauau

SEQ ID NO: 2787107 - RNA, 16 nt, Leptospira interrogans serovar lai str. 56601
caauuuuuuuguaaaa

SEQ ID NO: 2787108 - RNA, 19 nt, Leptospira interrogans serovar lai str. 56601
caauuuuuuuguaaaaaaa

SEQ ID NO: 2787109 - RNA, 20 nt, Leptospira interrogans serovar lai str. 56601
caauuuuuuuguaaaaaaau

SEQ ID NO: 2787110 - RNA, 21 nt, Leptospira interrogans serovar lai str. 56601
caauuuuuuuguaaaaaaaua

SEQ ID NO: 2787111 - RNA, 12 nt, Leptospira interrogans serovar lai str. 56601
cacaaaaaaauu

SEQ ID NO: 2787112 - RNA, 14 nt, Leptospira interrogans serovar lai str. 56601
cacaaaaaaauuca

SEQ ID NO: 2787113 - RNA, 15 nt, Leptospira interrogans serovar lai str. 56601
cacaaaaaaauucau

SEQ ID NO: 2787114 - RNA, 20 nt, Leptospira interrogans serovar lai str. 56601
cacaaaaaaauucauaauaa

SEQ ID NO: 2787115 - RNA, 16 nt, Leptospira interrogans serovar lai str. 56601
cacaaaaacaaauuca

SEQ ID NO: 2787116 - RNA, 21 nt, Leptospira interrogans serovar lai str. 56601
cacaaaucaucccgcccaaag

SEQ ID NO: 2787117 - RNA, 15 nt, Leptospira interrogans serovar lai str. 56601
cacaaaucauggauu

SEQ ID NO: 2787118 - RNA, 18 nt, Leptospira interrogans serovar lai str. 56601
cacaaaucauggauuuac

SEQ ID NO: 2787119 - RNA, 21 nt, Leptospira interrogans serovar lai str. 56601
cacaaauuaggucacauuuga

SEQ ID NO: 2787120 - RNA, 18 nt, Leptospira interrogans serovar lai str. 56601
cacaaauuccaauuuuuc

SEQ ID NO: 2787121 - RNA, 19 nt, Leptospira interrogans serovar lai str. 56601
cacaaauuccaauuuuucu

SEQ ID NO: 2787122 - RNA, 18 nt, Leptospira interrogans serovar lai str. 56601
cacaaauucuaaaguugu

SEQ ID NO: 2787123 - RNA, 12 nt, Leptospira interrogans serovar lai str. 56601
cacaaauuguca

SEQ ID NO: 2787124 - RNA, 17 nt, Leptospira interrogans serovar lai str. 56601
cacaaauugucaaaugc

SEQ ID NO: 2787125 - RNA, 14 nt, Leptospira interrogans serovar lai str. 56601
cacaaauuuuauau

SEQ ID NO: 2787126 - RNA, 14 nt, Leptospira interrogans serovar lai str. 56601
cacaacgcgaccca

SEQ ID NO: 2787127 - RNA, 14 nt, Leptospira interrogans serovar lai str. 56601
cacaacgcucucua

SEQ ID NO: 2787128 - RNA, 19 nt, Leptospira interrogans serovar lai str. 56601
cacaacgcucuuuaugaau

SEQ ID NO: 2787129 - RNA, 19 nt, Leptospira interrogans serovar lai str. 56601
cacaagcuuccuuuuuuau

SEQ ID NO: 2787130 - RNA, 18 nt, Leptospira interrogans serovar lai str. 56601
cacaaguauuugaucuca

SEQ ID NO: 2787131 - RNA, 20 nt, Leptospira interrogans serovar lai str. 56601
cacaaguucgccuacacugu

SEQ ID NO: 2787132 - RNA, 19 nt, Leptospira interrogans serovar lai str. 56601
cacaaguugaauaggauuu

SEQ ID NO: 2787133 - RNA, 18 nt, Leptospira interrogans serovar lai str. 56601
cacaaguuuggaaauuga

SEQ ID NO: 2787134 - RNA, 20 nt, Leptospira interrogans serovar lai str. 56601
cacaaguuuggaaauugacu

SEQ ID NO: 2787135 - RNA, 16 nt, Leptospira interrogans serovar lai str. 56601
cacaauuuugaauauu

SEQ ID NO: 2787136 - RNA, 16 nt, Leptospira interrogans serovar lai str. 56601
cacacccuugaccuca

SEQ ID NO: 2787137 - RNA, 20 nt, Leptospira interrogans serovar lai str. 56601
cacaccggauucacauuaaa

SEQ ID NO: 2787138 - RNA, 17 nt, Leptospira interrogans serovar lai str. 56601
cacacguugaauaagau

SEQ ID NO: 2787139 - RNA, 15 nt, Leptospira interrogans serovar lai str. 56601
cacacuuuauaaaag

SEQ ID NO: 2787140 - RNA, 21 nt, Leptospira interrogans serovar lai str. 56601
cacacuuuauaaaaguauaau

SEQ ID NO: 2787141 - RNA, 21 nt, Leptospira interrogans serovar lai str. 56601
cacacuuugcaccgcauugau

SEQ ID NO: 2787142 - RNA, 13 nt, Leptospira interrogans serovar lai str. 56601
cacagacuucuuu

SEQ ID NO: 2787143 - RNA, 16 nt, Leptospira interrogans serovar lai str. 56601
cacauccgcauucuca

SEQ ID NO: 2787144 - RNA, 14 nt, Leptospira interrogans serovar lai str. 56601
cacaucgaaaaaac

SEQ ID NO: 2787145 - RNA, 19 nt, Leptospira interrogans serovar lai str. 56601
cacaucgaaaaaacaaaua

SEQ ID NO: 2787146 - RNA, 22 nt, Leptospira interrogans serovar lai str. 56601
cacaucguuaccagcaagcaca

SEQ ID NO: 2787147 - RNA, 12 nt, Leptospira interrogans serovar lai str. 56601
cacaucuuuuuu

SEQ ID NO: 2787148 - RNA, 15 nt, Leptospira interrogans serovar lai str. 56601
cacaugagcauucuu

SEQ ID NO: 2787149 - RNA, 18 nt, Leptospira interrogans serovar lai str. 56601
cacaugauucugaaaaaa

SEQ ID NO: 2787150 - RNA, 22 nt, Leptospira interrogans serovar lai str. 56601
cacauuaaaauaggauuuaaau

SEQ ID NO: 2787151 - RNA, 18 nt, Leptospira interrogans serovar lai str. 56601
cacauuacgaauuuuuaa

SEQ ID NO: 2787152 - RNA, 16 nt, Leptospira interrogans serovar lai str. 56601
cacauucauuuuuucu

SEQ ID NO: 2787153 - RNA, 14 nt, Leptospira interrogans serovar lai str. 56601
cacauuuaaauuaa

SEQ ID NO: 2787154 - RNA, 17 nt, Leptospira interrogans serovar lai str. 56601
cacauuugaauacgaca

SEQ ID NO: 2787155 - RNA, 15 nt, Leptospira interrogans serovar lai str. 56601
cacauuuuaaagauu

SEQ ID NO: 2787156 - RNA, 13 nt, Leptospira interrogans serovar lai str. 56601
cacauuuuaaagg

SEQ ID NO: 2787157 - RNA, 13 nt, Leptospira interrogans serovar lai str. 56601
cacauuuuaaagu

SEQ ID NO: 2787158 - RNA, 14 nt, Leptospira interrogans serovar lai str. 56601
cacauuuuaaaguu

SEQ ID NO: 2787159 - RNA, 21 nt, Leptospira interrogans serovar lai str. 56601
cacauuuuaaaguuuugaaau

SEQ ID NO: 2787160 - RNA, 18 nt, Leptospira interrogans serovar lai str. 56601
cagaauuuaggcaauuuu

SEQ ID NO: 2787161 - RNA, 15 nt, Leptospira interrogans serovar lai str. 56601
cagaauuucuuucuc

SEQ ID NO: 2787162 - RNA, 12 nt, Leptospira interrogans serovar lai str. 56601
cagaauuuugaa

SEQ ID NO: 2787163 - RNA, 21 nt, Leptospira interrogans serovar lai str. 56601
cagacaugauucauuuuucug

SEQ ID NO: 2787164 - RNA, 15 nt, Leptospira interrogans serovar lai str. 56601
cagacugacugaaaa

SEQ ID NO: 2787165 - RNA, 15 nt, Leptospira interrogans serovar lai str. 56601
cagacugauucuuua

SEQ ID NO: 2787166 - RNA, 13 nt, Leptospira interrogans serovar lai str. 56601
cagacugauuuuu

SEQ ID NO: 2787167 - RNA, 12 nt, Leptospira interrogans serovar lai str. 56601
cagacuuugaau

SEQ ID NO: 2787168 - RNA, 15 nt, Leptospira interrogans serovar lai str. 56601
cagacuuugaaugca

SEQ ID NO: 2787169 - RNA, 22 nt, Leptospira interrogans serovar lai str. 56601
cagagaauaucugaauuuuuau

SEQ ID NO: 2787170 - RNA, 16 nt, Leptospira interrogans serovar lai str. 56601
cagagauaggaauguu

SEQ ID NO: 2787171 - RNA, 18 nt, Leptospira interrogans serovar lai str. 56601
cagagauuccgauucucc

SEQ ID NO: 2787172 - RNA, 17 nt, Leptospira interrogans serovar lai str. 56601
cagagcauauaauuaaa

SEQ ID NO: 2787173 - RNA, 18 nt, Leptospira interrogans serovar lai str. 56601
cagagcaucauacaguaa

SEQ ID NO: 2787174 - RNA, 17 nt, Leptospira interrogans serovar lai str. 56601
cagagcgauauaauaaa

SEQ ID NO: 2787175 - RNA, 20 nt, Leptospira interrogans serovar lai str. 56601
cagagcuuuacaauaaaaau

SEQ ID NO: 2787176 - RNA, 18 nt, Leptospira interrogans serovar lai str. 56601
cagaggcaguacaauuca

SEQ ID NO: 2787177 - RNA, 15 nt, Leptospira interrogans serovar lai str. 56601
cagagucuauaaaau

SEQ ID NO: 2787178 - RNA, 16 nt, Leptospira interrogans serovar lai str. 56601
cagaguuauauaagau

SEQ ID NO: 2787179 - RNA, 21 nt, Leptospira interrogans serovar lai str. 56601
cagauacgcccguaaauuucu

SEQ ID NO: 2787180 - RNA, 14 nt, Leptospira interrogans serovar lai str. 56601
cagaucaagaauua

SEQ ID NO: 2787181 - RNA, 12 nt, Leptospira interrogans serovar lai str. 56601
cagaucaauucu

SEQ ID NO: 2787182 - RNA, 14 nt, Leptospira interrogans serovar lai str. 56601
cagaucauuuugua

SEQ ID NO: 2787183 - RNA, 22 nt, Leptospira interrogans serovar lai str. 56601
cagaucgcguuuuauaauaaau

SEQ ID NO: 2787184 - RNA, 23 nt, Leptospira interrogans serovar lai str. 56601
cagaugaauugaauuuuuuaaau

SEQ ID NO: 2787185 - RNA, 13 nt, Leptospira interrogans serovar lai str. 56601
cagauuaaaaaau

SEQ ID NO: 2787186 - RNA, 14 nt, Leptospira interrogans serovar lai str. 56601
cagauuaaaaaaua

SEQ ID NO: 2787187 - RNA, 15 nt, Leptospira interrogans serovar lai str. 56601
cagauucuaaaaaug

SEQ ID NO: 2787188 - RNA, 17 nt, Leptospira interrogans serovar lai str. 56601
cagauucuaaaaaugaa

SEQ ID NO: 2787189 - RNA, 24 nt, Leptospira interrogans serovar lai str. 56601
cagauuguuauuggaucguguaau

SEQ ID NO: 2787190 - RNA, 14 nt, Leptospira interrogans serovar lai str. 56601
cagauuuauuuuag

SEQ ID NO: 2787191 - RNA, 15 nt, Leptospira interrogans serovar lai str. 56601
cagauuuauuuuaga

SEQ ID NO: 2787192 - RNA, 20 nt, Leptospira interrogans serovar lai str. 56601
cagauuuauuuuagaaugug

SEQ ID NO: 2787193 - RNA, 22 nt, Leptospira interrogans serovar lai str. 56601
cagauuucagcuccaaaaaaau

SEQ ID NO: 2787194 - RNA, 23 nt, Leptospira interrogans serovar lai str. 56601
cagauuucagcuccaaaaaaaua

SEQ ID NO: 2787195 - RNA, 20 nt, Leptospira interrogans serovar lai str. 56601
cagauuuccgguaaguaaua

SEQ ID NO: 2787196 - RNA, 21 nt, Leptospira interrogans serovar lai str. 56601
cagauuugauguaaagaaaac

SEQ ID NO: 2787197 - RNA, 12 nt, Leptospira interrogans serovar lai str. 56601
cagauuuguccg

SEQ ID NO: 2787198 - RNA, 23 nt, Leptospira interrogans serovar lai str. 56601
cagauuuuauuuugauuccaaag

SEQ ID NO: 2787199 - RNA, 23 nt, Leptospira interrogans serovar lai str. 56601
cagauuuucucaaaaaaaguaau

SEQ ID NO: 2787200 - RNA, 20 nt, Leptospira interrogans serovar lai str. 56601
cagauuuuuucugguggaau

SEQ ID NO: 2787201 - RNA, 21 nt, Leptospira interrogans serovar lai str. 56601
cagauuuuuucugguggaauu

SEQ ID NO: 2787202 - RNA, 18 nt, Leptospira interrogans serovar lai str. 56601
cagcaaaaccuucgugaa

SEQ ID NO: 2787203 - RNA, 23 nt, Leptospira interrogans serovar lai str. 56601
cagcaaagaaggcagcuaagaaa

SEQ ID NO: 2787204 - RNA, 22 nt, Leptospira interrogans serovar lai str. 56601
cagcaagcacauccgcauucuc

SEQ ID NO: 2787205 - RNA, 23 nt, Leptospira interrogans serovar lai str. 56601
cagcaagcacauccgcauucuca

SEQ ID NO: 2787206 - RNA, 16 nt, Leptospira interrogans serovar lai str. 56601
cagcaaggagcaacau

SEQ ID NO: 2787207 - RNA, 13 nt, Leptospira interrogans serovar lai str. 56601
cagcacaacgcug

SEQ ID NO: 2787208 - RNA, 23 nt, Leptospira interrogans serovar lai str. 56601
cagcacaaguuucuuaaauuugu

SEQ ID NO: 2787209 - RNA, 20 nt, Leptospira interrogans serovar lai str. 56601
cagcauaaguauuauuuuua

SEQ ID NO: 2787210 - RNA, 23 nt, Leptospira interrogans serovar lai str. 56601
cagcauugaguuuaagaaacuca

SEQ ID NO: 2787211 - RNA, 14 nt, Leptospira interrogans serovar lai str. 56601
cagccaaagaaaua

SEQ ID NO: 2787212 - RNA, 18 nt, Leptospira interrogans serovar lai str. 56601
cagcgaauaccucuaaaa

SEQ ID NO: 2787213 - RNA, 18 nt, Leptospira interrogans serovar lai str. 56601
cagcgaucgugauaagag

SEQ ID NO: 2787214 - RNA, 22 nt, Leptospira interrogans serovar lai str. 56601
cagcguaagguguuuauaaaaa

SEQ ID NO: 2787215 - RNA, 12 nt, Leptospira interrogans serovar lai str. 56601
cagcuaaaaaga

SEQ ID NO: 2787216 - RNA, 13 nt, Leptospira interrogans serovar lai str. 56601
cagcuaaaaagaa

SEQ ID NO: 2787217 - RNA, 14 nt, Leptospira interrogans serovar lai str. 56601
cagcuaaaaagaaa

SEQ ID NO: 2787218 - RNA, 16 nt, Leptospira interrogans serovar lai str. 56601
cagcuaaaaagaaagu

SEQ ID NO: 2787219 - RNA, 13 nt, Leptospira interrogans serovar lai str. 56601
cagcuaagaaaaa

SEQ ID NO: 2787220 - RNA, 14 nt, Leptospira interrogans serovar lai str. 56601
cagcuagaaaagga

SEQ ID NO: 2787221 - RNA, 13 nt, Leptospira interrogans serovar lai str. 56601
cagcuauaaaaua

SEQ ID NO: 2787222 - RNA, 17 nt, Leptospira interrogans serovar lai str. 56601
cagcucuuuugcuucuu

SEQ ID NO: 2787223 - RNA, 23 nt, Leptospira interrogans serovar lai str. 56601
cagcucuuuugcuucuuuuaaac

SEQ ID NO: 2787224 - RNA, 23 nt, Leptospira interrogans serovar lai str. 56601
cagcugaggaguuuuuauaaaau

SEQ ID NO: 2787225 - RNA, 12 nt, Leptospira interrogans serovar lai str. 56601
cagcuucuucca

SEQ ID NO: 2787226 - RNA, 14 nt, Leptospira interrogans serovar lai str. 56601
cagcuuuuuuaaau

SEQ ID NO: 2787227 - RNA, 20 nt, Leptospira interrogans serovar lai str. 56601
caggaaaauuuaaauucccu

SEQ ID NO: 2787228 - RNA, 14 nt, Leptospira interrogans serovar lai str. 56601
caggaaacauaaua

SEQ ID NO: 2787229 - RNA, 18 nt, Leptospira interrogans serovar lai str. 56601
caggaaucguuuguaaaa

SEQ ID NO: 2787230 - RNA, 17 nt, Leptospira interrogans serovar lai str. 56601
caggacggaaucggcuu

SEQ ID NO: 2787231 - RNA, 17 nt, Leptospira interrogans serovar lai str. 56601
caggacggauguaacag

SEQ ID NO: 2787232 - RNA, 15 nt, Leptospira interrogans serovar lai str. 56601
caggaucaaaauccg

SEQ ID NO: 2787233 - RNA, 13 nt, Leptospira interrogans serovar lai str. 56601
caggauuacuaau

SEQ ID NO: 2787234 - RNA, 16 nt, Leptospira interrogans serovar lai str. 56601
caggcuuaaaucucau

SEQ ID NO: 2787235 - RNA, 12 nt, Leptospira interrogans serovar lai str. 56601
cagggaaaaaua

SEQ ID NO: 2787236 - RNA, 15 nt, Leptospira interrogans serovar lai str. 56601
cagguacuuuauuua

SEQ ID NO: 2787237 - RNA, 18 nt, Leptospira interrogans serovar lai str. 56601
cagguacuuuauuuacag

SEQ ID NO: 2787238 - RNA, 13 nt, Leptospira interrogans serovar lai str. 56601
cagguuuuaaacu

SEQ ID NO: 2787239 - RNA, 19 nt, Leptospira interrogans serovar lai str. 56601
cagguuuuaaacuauagag

SEQ ID NO: 2787240 - RNA, 16 nt, Leptospira interrogans serovar lai str. 56601
cagguuuuauaaagug

SEQ ID NO: 2787241 - RNA, 19 nt, Leptospira interrogans serovar lai str. 56601
cagguuuuaucaaauaaag

SEQ ID NO: 2787242 - RNA, 21 nt, Leptospira interrogans serovar lai str. 56601
cagguuuuucgaaaagaaaua

SEQ ID NO: 2787243 - RNA, 14 nt, Leptospira interrogans serovar lai str. 56601
cauacaaaauuuaa

SEQ ID NO: 2787244 - RNA, 15 nt, Leptospira interrogans serovar lai str. 56601
cauacaaaauuuaaa

SEQ ID NO: 2787245 - RNA, 16 nt, Leptospira interrogans serovar lai str. 56601
cauacaaaauuuaaaa

SEQ ID NO: 2787246 - RNA, 19 nt, Leptospira interrogans serovar lai str. 56601
cauacaaaauuuaaaaaug

SEQ ID NO: 2787247 - RNA, 13 nt, Leptospira interrogans serovar lai str. 56601
cauacaauaaagc

SEQ ID NO: 2787248 - RNA, 18 nt, Leptospira interrogans serovar lai str. 56601
cauacaaucaaauuuuug

SEQ ID NO: 2787249 - RNA, 14 nt, Leptospira interrogans serovar lai str. 56601
cauacaaugaaaaa

SEQ ID NO: 2787250 - RNA, 17 nt, Leptospira interrogans serovar lai str. 56601
cauacaaugaaaaagca

SEQ ID NO: 2787251 - RNA, 24 nt, Leptospira interrogans serovar lai str. 56601
cauacaaugaaaaagcauauagga

SEQ ID NO: 2787252 - RNA, 16 nt, Leptospira interrogans serovar lai str. 56601
cauacauagauaaauc

SEQ ID NO: 2787253 - RNA, 13 nt, Leptospira interrogans serovar lai str. 56601
cauacauuuugua

SEQ ID NO: 2787254 - RNA, 23 nt, Leptospira interrogans serovar lai str. 56601
cauaccuguuuuaguucaaaaac

SEQ ID NO: 2787255 - RNA, 17 nt, Leptospira interrogans serovar lai str. 56601
cauacuaaucuauggau

SEQ ID NO: 2787256 - RNA, 15 nt, Leptospira interrogans serovar lai str. 56601
cauacuucuaaaaaa

SEQ ID NO: 2787257 - RNA, 16 nt, Leptospira interrogans serovar lai str. 56601
cauacuucuaaaaaau

SEQ ID NO: 2787258 - RNA, 17 nt, Leptospira interrogans serovar lai str. 56601
cauacuucuaaaaaauu

SEQ ID NO: 2787259 - RNA, 16 nt, Leptospira interrogans serovar lai str. 56601
cauacuuuuaaaaaau

SEQ ID NO: 2787260 - RNA, 17 nt, Leptospira interrogans serovar lai str. 56601
cauacuuuuaaaaaauu

SEQ ID NO: 2787261 - RNA, 16 nt, Leptospira interrogans serovar lai str. 56601
cauacuuuuaaaaagu

SEQ ID NO: 2787262 - RNA, 16 nt, Leptospira interrogans serovar lai str. 56601
cauacuuuuagauaau

SEQ ID NO: 2787263 - RNA, 19 nt, Leptospira interrogans serovar lai str. 56601
cauacuuuuugcaaguaaa

SEQ ID NO: 2787264 - RNA, 20 nt, Leptospira interrogans serovar lai str. 56601
cauacuuuuugcaaguaaaa

SEQ ID NO: 2787265 - RNA, 19 nt, Leptospira interrogans serovar lai str. 56601
cauagaaaaaauacauaaa

SEQ ID NO: 2787266 - RNA, 12 nt, Leptospira interrogans serovar lai str. 56601
cauagaagugaa

SEQ ID NO: 2787267 - RNA, 12 nt, Leptospira interrogans serovar lai str. 56601
cauagagaacgc

SEQ ID NO: 2787268 - RNA, 22 nt, Leptospira interrogans serovar lai str. 56601
cauagagauagaaccuauaucu

SEQ ID NO: 2787269 - RNA, 22 nt, Leptospira interrogans serovar lai str. 56601
cauagaggcuuuacauuuuuaa

SEQ ID NO: 2787270 - RNA, 18 nt, Leptospira interrogans serovar lai str. 56601
cauagaugggguugaauc

SEQ ID NO: 2787271 - RNA, 18 nt, Leptospira interrogans serovar lai str. 56601
cauaggaaauaauuccuc

SEQ ID NO: 2787272 - RNA, 21 nt, Leptospira interrogans serovar lai str. 56601
cauaggaaauaauuccuccau

SEQ ID NO: 2787273 - RNA, 22 nt, Leptospira interrogans serovar lai str. 56601
cauaggaaauaauuccuccaug

SEQ ID NO: 2787274 - RNA, 14 nt, Leptospira interrogans serovar lai str. 56601
cauaggauacaaaa

SEQ ID NO: 2787275 - RNA, 14 nt, Leptospira interrogans serovar lai str. 56601
cauaggaugaauug

SEQ ID NO: 2787276 - RNA, 17 nt, Leptospira interrogans serovar lai str. 56601
cauaggcgcggaaaaau

SEQ ID NO: 2787277 - RNA, 20 nt, Leptospira interrogans serovar lai str. 56601
cauaggcgcggaaaaauuau

SEQ ID NO: 2787278 - RNA, 18 nt, Leptospira interrogans serovar lai str. 56601
cauaguaaacacaaucgu

SEQ ID NO: 2787279 - RNA, 20 nt, Leptospira interrogans serovar lai str. 56601
cauagugaagauuuguaaaa

SEQ ID NO: 2787280 - RNA, 19 nt, Leptospira interrogans serovar lai str. 56601
cauaguuauauaauaaagc

SEQ ID NO: 2787281 - RNA, 15 nt, Leptospira interrogans serovar lai str. 56601
cauauaauaaaaaua

SEQ ID NO: 2787282 - RNA, 18 nt, Leptospira interrogans serovar lai str. 56601
cauauaauuaaaaagaua

SEQ ID NO: 2787283 - RNA, 11 nt, Leptospira interrogans serovar lai str. 56601
cauaucaaauu

SEQ ID NO: 2787284 - RNA, 16 nt, Leptospira interrogans serovar lai str. 56601
cauaucaaauucauga

SEQ ID NO: 2787285 - RNA, 13 nt, Leptospira interrogans serovar lai str. 56601
cauaucauauugu

SEQ ID NO: 2787286 - RNA, 15 nt, Leptospira interrogans serovar lai str. 56601
cauauccgaaagaua

SEQ ID NO: 2787287 - RNA, 14 nt, Leptospira interrogans serovar lai str. 56601
cauaugaaaauaau

SEQ ID NO: 2787288 - RNA, 22 nt, Leptospira interrogans serovar lai str. 56601
cauauggauuauccaaaacaau

SEQ ID NO: 2787289 - RNA, 19 nt, Leptospira interrogans serovar lai str. 56601
cauauuauuuguaguuuca

SEQ ID NO: 2787290 - RNA, 21 nt, Leptospira interrogans serovar lai str. 56601
cauauuauuuguaguuucaau

SEQ ID NO: 2787291 - RNA, 17 nt, Leptospira interrogans serovar lai str. 56601
cauauuuucaaaaaaua

SEQ ID NO: 2787292 - RNA, 16 nt, Leptospira interrogans serovar lai str. 56601
caucaaaaaaaugaua

SEQ ID NO: 2787293 - RNA, 22 nt, Leptospira interrogans serovar lai str. 56601
caucaaauuugcuucaacacug

SEQ ID NO: 2787294 - RNA, 23 nt, Leptospira interrogans serovar lai str. 56601
caucaacaucacgcacaucguua

SEQ ID NO: 2787295 - RNA, 17 nt, Leptospira interrogans serovar lai str. 56601
caucaaccaagaauuuc

SEQ ID NO: 2787296 - RNA, 17 nt, Leptospira interrogans serovar lai str. 56601
caucaaugucaaaaaaa

SEQ ID NO: 2787297 - RNA, 12 nt, Leptospira interrogans serovar lai str. 56601
caucaauuauuu

SEQ ID NO: 2787298 - RNA, 18 nt, Leptospira interrogans serovar lai str. 56601
caucacaacgcucuuuau

SEQ ID NO: 2787299 - RNA, 16 nt, Leptospira interrogans serovar lai str. 56601
caucaccaaccccaca

SEQ ID NO: 2787300 - RNA, 23 nt, Leptospira interrogans serovar lai str. 56601
caucauauuauuuguaguuucaa

SEQ ID NO: 2787301 - RNA, 12 nt, Leptospira interrogans serovar lai str. 56601
caucauuauuug

SEQ ID NO: 2787302 - RNA, 12 nt, Leptospira interrogans serovar lai str. 56601
caucauucugaa

SEQ ID NO: 2787303 - RNA, 20 nt, Leptospira interrogans serovar lai str. 56601
caucauucuuuagaaauuuu

SEQ ID NO: 2787304 - RNA, 23 nt, Leptospira interrogans serovar lai str. 56601
caucauucuuuagaaauuuuuaa

SEQ ID NO: 2787305 - RNA, 16 nt, Leptospira interrogans serovar lai str. 56601
cauccaaugaaauuuu

SEQ ID NO: 2787306 - RNA, 17 nt, Leptospira interrogans serovar lai str. 56601
cauccaaugaaauuuuu

SEQ ID NO: 2787307 - RNA, 20 nt, Leptospira interrogans serovar lai str. 56601
cauccauacaacuuucagau

SEQ ID NO: 2787308 - RNA, 16 nt, Leptospira interrogans serovar lai str. 56601
caucccacuuuuauau

SEQ ID NO: 2787309 - RNA, 16 nt, Leptospira interrogans serovar lai str. 56601
caucccagaacaaaac

SEQ ID NO: 2787310 - RNA, 16 nt, Leptospira interrogans serovar lai str. 56601
caucccgcccaaagua

SEQ ID NO: 2787311 - RNA, 22 nt, Leptospira interrogans serovar lai str. 56601
caucccuuccuuccgaucccaa

SEQ ID NO: 2787312 - RNA, 13 nt, Leptospira interrogans serovar lai str. 56601
cauccgcauucuc

SEQ ID NO: 2787313 - RNA, 17 nt, Leptospira interrogans serovar lai str. 56601
cauccuaagaaucaaau

SEQ ID NO: 2787314 - RNA, 14 nt, Leptospira interrogans serovar lai str. 56601
cauccuauuucugu

SEQ ID NO: 2787315 - RNA, 21 nt, Leptospira interrogans serovar lai str. 56601
cauccuuguuuaggugcaaau

SEQ ID NO: 2787316 - RNA, 17 nt, Leptospira interrogans serovar lai str. 56601
caucgaaaaaacaaaua

SEQ ID NO: 2787317 - RNA, 18 nt, Leptospira interrogans serovar lai str. 56601
caucgcacgucccacaaa

SEQ ID NO: 2787318 - RNA, 19 nt, Leptospira interrogans serovar lai str. 56601
caucguuaccagcaagcac

SEQ ID NO: 2787319 - RNA, 13 nt, Leptospira interrogans serovar lai str. 56601
caucguuccaaac

SEQ ID NO: 2787320 - RNA, 15 nt, Leptospira interrogans serovar lai str. 56601
caucguuccaaaccc

SEQ ID NO: 2787321 - RNA, 23 nt, Leptospira interrogans serovar lai str. 56601
caucguuuaagaauuuuaaaaaa

SEQ ID NO: 2787322 - RNA, 19 nt, Leptospira interrogans serovar lai str. 56601
caucguuuagguaaagauu

SEQ ID NO: 2787323 - RNA, 23 nt, Leptospira interrogans serovar lai str. 56601
caucuaaaaaaaacaccgugauc

SEQ ID NO: 2787324 - RNA, 19 nt, Leptospira interrogans serovar lai str. 56601
caucuacauaaaaaaggaa

SEQ ID NO: 2787325 - RNA, 13 nt, Leptospira interrogans serovar lai str. 56601
caucuaucuuuuc

SEQ ID NO: 2787326 - RNA, 22 nt, Leptospira interrogans serovar lai str. 56601
cauucuuagaauuuuccucccg

SEQ ID NO: 2787327 - RNA, 14 nt, Leptospira interrogans serovar lai str. 56601
cauucuuauaaaga

SEQ ID NO: 2787328 - RNA, 13 nt, Leptospira interrogans serovar lai str. 56601
cauucuucaaaua

SEQ ID NO: 2787329 - RNA, 15 nt, Leptospira interrogans serovar lai str. 56601
cauucuucaaauaac

SEQ ID NO: 2787330 - RNA, 17 nt, Leptospira interrogans serovar lai str. 56601
cauucuuuaaaauagaa

SEQ ID NO: 2787331 - RNA, 22 nt, Leptospira interrogans serovar lai str. 56601
cauucuuuagaaauuuuuaauc

SEQ ID NO: 2787332 - RNA, 12 nt, Leptospira interrogans serovar lai str. 56601
cauucuuuccau

SEQ ID NO: 2787333 - RNA, 19 nt, Leptospira interrogans serovar lai str. 56601
cauucuuuccuauaaaagu

SEQ ID NO: 2787334 - RNA, 14 nt, Leptospira interrogans serovar lai str. 56601
cauucuuuguuuug

SEQ ID NO: 2787335 - RNA, 19 nt, Leptospira interrogans serovar lai str. 56601
cauucuuuuugccaauuca

SEQ ID NO: 2787336 - RNA, 15 nt, Leptospira interrogans serovar lai str. 56601
cauugaaaucagagu

SEQ ID NO: 2787337 - RNA, 23 nt, Leptospira interrogans serovar lai str. 56601
cauugaguuuuuuaguaguucca

SEQ ID NO: 2787338 - RNA, 20 nt, Leptospira interrogans serovar lai str. 56601
cauugauuuucauuuugcua

SEQ ID NO: 2787339 - RNA, 17 nt, Leptospira interrogans serovar lai str. 56601
cauuggaguuuuuuaaa

SEQ ID NO: 2787340 - RNA, 16 nt, Leptospira interrogans serovar lai str. 56601
cauuggauucugcucu

SEQ ID NO: 2787341 - RNA, 20 nt, Leptospira interrogans serovar lai str. 56601
cauuguaagaaauauggcau

SEQ ID NO: 2787342 - RNA, 14 nt, Leptospira interrogans serovar lai str. 56601
cauugucuauuuua

SEQ ID NO: 2787343 - RNA, 17 nt, Leptospira interrogans serovar lai str. 56601
cauuguguuuuuuaaca

SEQ ID NO: 2787344 - RNA, 17 nt, Leptospira interrogans serovar lai str. 56601
cauuguuuuacucuuau

SEQ ID NO: 2787345 - RNA, 12 nt, Leptospira interrogans serovar lai str. 56601
cauuuaaaaaau

SEQ ID NO: 2787346 - RNA, 18 nt, Leptospira interrogans serovar lai str. 56601
cauuuaacccggauuugu

SEQ ID NO: 2787347 - RNA, 20 nt, Leptospira interrogans serovar lai str. 56601
cauuuaauauauucaaaaga

SEQ ID NO: 2787348 - RNA, 16 nt, Leptospira interrogans serovar lai str. 56601
cauuuaccuaaaauuc

SEQ ID NO: 2787349 - RNA, 22 nt, Leptospira interrogans serovar lai str. 56601
cauuuacgggagaccucuaacu

SEQ ID NO: 2787350 - RNA, 18 nt, Leptospira interrogans serovar lai str. 56601
cauuuacucaaauuaacu

SEQ ID NO: 2787351 - RNA, 19 nt, Leptospira interrogans serovar lai str. 56601
cauuuagagacgaauuuuu

SEQ ID NO: 2787352 - RNA, 20 nt, Leptospira interrogans serovar lai str. 56601
cauuuauuuuuuacgaaaaa

SEQ ID NO: 2787353 - RNA, 13 nt, Leptospira interrogans serovar lai str. 56601
cauuuauuuuuuu

SEQ ID NO: 2787354 - RNA, 14 nt, Leptospira interrogans serovar lai str. 56601
cauuucaaauuuau

SEQ ID NO: 2787355 - RNA, 18 nt, Leptospira interrogans serovar lai str. 56601
cauuucaauacaauaaaa

SEQ ID NO: 2787356 - RNA, 13 nt, Leptospira interrogans serovar lai str. 56601
cauuucauuuuuu

SEQ ID NO: 2787357 - RNA, 18 nt, Leptospira interrogans serovar lai str. 56601
cauuuccauaacagaauu

SEQ ID NO: 2787358 - RNA, 12 nt, Leptospira interrogans serovar lai str. 56601
cauuuccaucuu

SEQ ID NO: 2787359 - RNA, 14 nt, Leptospira interrogans serovar lai str. 56601
cauuuccaucuuua

SEQ ID NO: 2787360 - RNA, 15 nt, Leptospira interrogans serovar lai str. 56601
cauuuccuccaaaca

SEQ ID NO: 2787361 - RNA, 23 nt, Leptospira interrogans serovar lai str. 56601
cauuucgaaaacgauuuuucaaa

SEQ ID NO: 2787362 - RNA, 17 nt, Leptospira interrogans serovar lai str. 56601
cauuucguuucccucuu

SEQ ID NO: 2787363 - RNA, 21 nt, Leptospira interrogans serovar lai str. 56601
cauuucguuucccucuucuag

SEQ ID NO: 2787364 - RNA, 13 nt, Leptospira interrogans serovar lai str. 56601
cauuucuaaaaua

SEQ ID NO: 2787365 - RNA, 14 nt, Leptospira interrogans serovar lai str. 56601
cauuugaauuuaua

SEQ ID NO: 2787366 - RNA, 18 nt, Leptospira interrogans serovar lai str. 56601
cauuugacaauuugugaa

SEQ ID NO: 2787367 - RNA, 14 nt, Leptospira interrogans serovar lai str. 56601
cauuugauuaaaaa

SEQ ID NO: 2787368 - RNA, 17 nt, Leptospira interrogans serovar lai str. 56601
cauuugauuaaaaauuu

SEQ ID NO: 2787369 - RNA, 15 nt, Leptospira interrogans serovar lai str. 56601
cauuugauugcaaau

SEQ ID NO: 2787370 - RNA, 17 nt, Leptospira interrogans serovar lai str. 56601
cauuugcauaggugauu

SEQ ID NO: 2787371 - RNA, 15 nt, Leptospira interrogans serovar lai str. 56601
cauuuguaaauaaac

SEQ ID NO: 2787372 - RNA, 21 nt, Leptospira interrogans serovar lai str. 56601
cauuuguuucuauuuuaugga

SEQ ID NO: 2787373 - RNA, 13 nt, Leptospira interrogans serovar lai str. 56601
cauuuguuuuuua

SEQ ID NO: 2787374 - RNA, 20 nt, Leptospira interrogans serovar lai str. 56601
cauuuuaaacaaagacaaag

SEQ ID NO: 2787375 - RNA, 16 nt, Leptospira interrogans serovar lai str. 56601
cauuuuagagcagaac

SEQ ID NO: 2787376 - RNA, 17 nt, Leptospira interrogans serovar lai str. 56601
cauuuuaggaaucaaga

SEQ ID NO: 2787377 - RNA, 15 nt, Leptospira interrogans serovar lai str. 56601
cauuuuaggaaucga

SEQ ID NO: 2787378 - RNA, 16 nt, Leptospira interrogans serovar lai str. 56601
cauuuuauuaaaaaua

SEQ ID NO: 2787379 - RNA, 17 nt, Leptospira interrogans serovar lai str. 56601
cauuuuauuauaaauuu

SEQ ID NO: 2787380 - RNA, 22 nt, Leptospira interrogans serovar lai str. 56601
cauuuuauuauaaauuuauaaa

SEQ ID NO: 2787381 - RNA, 22 nt, Leptospira interrogans serovar lai str. 56601
cauuuuauugugaguuuaaaga

SEQ ID NO: 2787382 - RNA, 19 nt, Leptospira interrogans serovar lai str. 56601
cauuuuauuuuuacaaaaa

SEQ ID NO: 2787383 - RNA, 20 nt, Leptospira interrogans serovar lai str. 56601
cauuuuauuuuuuaugaaaa

SEQ ID NO: 2787384 - RNA, 18 nt, Leptospira interrogans serovar lai str. 56601
cauuuucagguuuuaaaa

SEQ ID NO: 2787385 - RNA, 15 nt, Leptospira interrogans serovar lai str. 56601
cauuuucauaauaaa

SEQ ID NO: 2787386 - RNA, 20 nt, Leptospira interrogans serovar lai str. 56601
cauuuucauaauaaauuuuu

SEQ ID NO: 2787387 - RNA, 18 nt, Leptospira interrogans serovar lai str. 56601
cauuuucauauauaguuu

SEQ ID NO: 2787388 - RNA, 12 nt, Leptospira interrogans serovar lai str. 56601
cauuuuccuuuu

SEQ ID NO: 2787389 - RNA, 23 nt, Leptospira interrogans serovar lai str. 56601
cauuuucgaaauuuuacaguaaa

SEQ ID NO: 2787390 - RNA, 17 nt, Leptospira interrogans serovar lai str. 56601
cauuuugauaauuucau

SEQ ID NO: 2787391 - RNA, 17 nt, Leptospira interrogans serovar lai str. 56601
cauuuuggcguuuuugu

SEQ ID NO: 2787392 - RNA, 19 nt, Leptospira interrogans serovar lai str. 56601
cauuuuguugcguuuaaaa

SEQ ID NO: 2787393 - RNA, 22 nt, Leptospira interrogans serovar lai str. 56601
cauuuuguugcguuuaaaaaca

SEQ ID NO: 2787394 - RNA, 20 nt, Leptospira interrogans serovar lai str. 56601
cauuuuuaaaaauuagaacu

SEQ ID NO: 2787395 - RNA, 15 nt, Leptospira interrogans serovar lai str. 56601
cauuuuuaagauuac

SEQ ID NO: 2787396 - RNA, 23 nt, Leptospira interrogans serovar lai str. 56601
cauuuuuagaauuuguuuuuaaa

SEQ ID NO: 2787397 - RNA, 16 nt, Leptospira interrogans serovar lai str. 56601
cauuuuuauuugcauu

SEQ ID NO: 2787398 - RNA, 14 nt, Leptospira interrogans serovar lai str. 56601
cauuuuucaaauaa

SEQ ID NO: 2787399 - RNA, 16 nt, Leptospira interrogans serovar lai str. 56601
cauuuuucaaauaaag

SEQ ID NO: 2787400 - RNA, 18 nt, Leptospira interrogans serovar lai str. 56601
cauuuuucaaauaaagaa

SEQ ID NO: 2787401 - RNA, 12 nt, Leptospira interrogans serovar lai str. 56601
cauuuuucaagu

SEQ ID NO: 2787402 - RNA, 16 nt, Leptospira interrogans serovar lai str. 56601
cauuuuuccauaaaaa

SEQ ID NO: 2787403 - RNA, 13 nt, Leptospira interrogans serovar lai str. 56601
cauuuuucuaaaa

SEQ ID NO: 2787404 - RNA, 20 nt, Leptospira interrogans serovar lai str. 56601
cauuuuucuacaauuauauu

SEQ ID NO: 2787405 - RNA, 14 nt, Leptospira interrogans serovar lai str. 56601
cauuuuucuuaaaa

SEQ ID NO: 2787406 - RNA, 13 nt, Leptospira interrogans serovar lai str. 56601
cauuuuucuucuu

SEQ ID NO: 2787407 - RNA, 12 nt, Leptospira interrogans serovar lai str. 56601
cauuuuuuaaau

SEQ ID NO: 2787408 - RNA, 14 nt, Leptospira interrogans serovar lai str. 56601
cauuuuuuaaaugc

SEQ ID NO: 2787409 - RNA, 14 nt, Leptospira interrogans serovar lai str. 56601
ccacauuuugugaa

SEQ ID NO: 2787410 - RNA, 14 nt, Leptospira interrogans serovar lai str. 56601
ccacauuuuuaaaa

SEQ ID NO: 2787411 - RNA, 13 nt, Leptospira interrogans serovar lai str. 56601
ccaccaaaguaug

SEQ ID NO: 2787412 - RNA, 14 nt, Leptospira interrogans serovar lai str. 56601
ccacccaaaaauag

SEQ ID NO: 2787413 - RNA, 19 nt, Leptospira interrogans serovar lai str. 56601
ccaccuaaaaugaaaaaaa

SEQ ID NO: 2787414 - RNA, 23 nt, Leptospira interrogans serovar lai str. 56601
ccaccuaaaaugaaaaaaaacaa

SEQ ID NO: 2787415 - RNA, 12 nt, Leptospira interrogans serovar lai str. 56601
ccaccuauacua

SEQ ID NO: 2787416 - RNA, 19 nt, Leptospira interrogans serovar lai str. 56601
ccacgucccguauaaaagu

SEQ ID NO: 2787417 - RNA, 19 nt, Leptospira interrogans serovar lai str. 56601
ccacguuuugaagguugag

SEQ ID NO: 2787418 - RNA, 13 nt, Leptospira interrogans serovar lai str. 56601
ccacuauggaauu

SEQ ID NO: 2787419 - RNA, 20 nt, Leptospira interrogans serovar lai str. 56601
ccacuguaaaaguuuuugaa

SEQ ID NO: 2787420 - RNA, 15 nt, Leptospira interrogans serovar lai str. 56601
ccacuucucacaaau

SEQ ID NO: 2787421 - RNA, 18 nt, Leptospira interrogans serovar lai str. 56601
ccacuucugguuuuuuaa

SEQ ID NO: 2787422 - RNA, 23 nt, Leptospira interrogans serovar lai str. 56601
ccacuugaauagaaccuuuugaa

SEQ ID NO: 2787423 - RNA, 23 nt, Leptospira interrogans serovar lai str. 56601
ccacuuuaaaaaugaucuaagau

SEQ ID NO: 2787424 - RNA, 13 nt, Leptospira interrogans serovar lai str. 56601
ccagaaaaaaccu

SEQ ID NO: 2787425 - RNA, 16 nt, Leptospira interrogans serovar lai str. 56601
ccagaaaccauaaaau

SEQ ID NO: 2787426 - RNA, 22 nt, Leptospira interrogans serovar lai str. 56601
ccagaaaccauaaaauaaaaaa

SEQ ID NO: 2787427 - RNA, 12 nt, Leptospira interrogans serovar lai str. 56601
ccagaacaaaac

SEQ ID NO: 2787428 - RNA, 19 nt, Leptospira interrogans serovar lai str. 56601
ccagaacggcgauccauag

SEQ ID NO: 2787429 - RNA, 14 nt, Leptospira interrogans serovar lai str. 56601
ccagaagauugaaa

SEQ ID NO: 2787430 - RNA, 15 nt, Leptospira interrogans serovar lai str. 56601
ccagaauuagauuaa

SEQ ID NO: 2787431 - RNA, 22 nt, Leptospira interrogans serovar lai str. 56601
ccagaauuagauuaaauuuuua

SEQ ID NO: 2787432 - RNA, 20 nt, Leptospira interrogans serovar lai str. 56601
ccagaauuuugaacauuuuc

SEQ ID NO: 2787433 - RNA, 17 nt, Leptospira interrogans serovar lai str. 56601
ccagacguaucaaaaua

SEQ ID NO: 2787434 - RNA, 18 nt, Leptospira interrogans serovar lai str. 56601
ccagauaugacaauuucu

SEQ ID NO: 2787435 - RNA, 22 nt, Leptospira interrogans serovar lai str. 56601
ccagauucacgcucauuagaau

SEQ ID NO: 2787436 - RNA, 16 nt, Leptospira interrogans serovar lai str. 56601
ccagauucccuuuuga

SEQ ID NO: 2787437 - RNA, 16 nt, Leptospira interrogans serovar lai str. 56601
ccagcccauucuuucc

SEQ ID NO: 2787438 - RNA, 14 nt, Leptospira interrogans serovar lai str. 56601
ccagcccucagcua

SEQ ID NO: 2787439 - RNA, 18 nt, Leptospira interrogans serovar lai str. 56601
ccagcguuuugcugaguu

SEQ ID NO: 2787440 - RNA, 20 nt, Leptospira interrogans serovar lai str. 56601
ccagcuuuuuuaaauuuuua

SEQ ID NO: 2787441 - RNA, 21 nt, Leptospira interrogans serovar lai str. 56601
ccagcuuuuuuaaauuuuuau

SEQ ID NO: 2787442 - RNA, 20 nt, Leptospira interrogans serovar lai str. 56601
ccagguuuuucgaaaagaaa

SEQ ID NO: 2787443 - RNA, 13 nt, Leptospira interrogans serovar lai str. 56601
ccagucaaguaaa

SEQ ID NO: 2787444 - RNA, 13 nt, Leptospira interrogans serovar lai str. 56601
ccagucuucuugu

SEQ ID NO: 2787445 - RNA, 23 nt, Leptospira interrogans serovar lai str. 56601
ccaguuggggggaauauacguua

SEQ ID NO: 2787446 - RNA, 17 nt, Leptospira interrogans serovar lai str. 56601
ccauaaaaaacauaaga

SEQ ID NO: 2787447 - RNA, 17 nt, Leptospira interrogans serovar lai str. 56601
ccauaaaaaaugaaugu

SEQ ID NO: 2787448 - RNA, 15 nt, Leptospira interrogans serovar lai str. 56601
ccauaaaauaaaaaa

SEQ ID NO: 2787449 - RNA, 16 nt, Leptospira interrogans serovar lai str. 56601
ccauaaauucuacaaa

SEQ ID NO: 2787450 - RNA, 13 nt, Leptospira interrogans serovar lai str. 56601
ccauaaauuuuua

SEQ ID NO: 2787451 - RNA, 14 nt, Leptospira interrogans serovar lai str. 56601
ccauaaauuuuuau

SEQ ID NO: 2787452 - RNA, 15 nt, Leptospira interrogans serovar lai str. 56601
ccauacaaaauuuaa

SEQ ID NO: 2787453 - RNA, 22 nt, Leptospira interrogans serovar lai str. 56601
ccauagaaagguuauccucuga

SEQ ID NO: 2787454 - RNA, 20 nt, Leptospira interrogans serovar lai str. 56601
ccauagagaacgcgaacuuu

SEQ ID NO: 2787455 - RNA, 22 nt, Leptospira interrogans serovar lai str. 56601
ccauagagaacgcgaacuuuuu

SEQ ID NO: 2787456 - RNA, 22 nt, Leptospira interrogans serovar lai str. 56601
ccauaucuacaaaagauuuuua

SEQ ID NO: 2787457 - RNA, 15 nt, Leptospira interrogans serovar lai str. 56601
ccauaugaguuccca

SEQ ID NO: 2787458 - RNA, 21 nt, Leptospira interrogans serovar lai str. 56601
ccauauugaguuaauuuucga

SEQ ID NO: 2787459 - RNA, 15 nt, Leptospira interrogans serovar lai str. 56601
ccaucaucuuacaca

SEQ ID NO: 2787460 - RNA, 22 nt, Leptospira interrogans serovar lai str. 56601
ccauccaaagaaagaaaauaca

SEQ ID NO: 2787461 - RNA, 16 nt, Leptospira interrogans serovar lai str. 56601
ccauccacaaaggcac

SEQ ID NO: 2787462 - RNA, 15 nt, Leptospira interrogans serovar lai str. 56601
ccauccgaaauccca

SEQ ID NO: 2787463 - RNA, 18 nt, Leptospira interrogans serovar lai str. 56601
ccauccgaaaucccaaaa

SEQ ID NO: 2787464 - RNA, 23 nt, Leptospira interrogans serovar lai str. 56601
ccaucuauuuccguuauauuaaa

SEQ ID NO: 2787465 - RNA, 14 nt, Leptospira interrogans serovar lai str. 56601
ccaucucuucgucu

SEQ ID NO: 2787466 - RNA, 15 nt, Leptospira interrogans serovar lai str. 56601
ccaucuguuuucuuu

SEQ ID NO: 2787467 - RNA, 21 nt, Leptospira interrogans serovar lai str. 56601
ccaugauccauuuuucugaaa

SEQ ID NO: 2787468 - RNA, 18 nt, Leptospira interrogans serovar lai str. 56601
ccaugauucugaaaaaag

SEQ ID NO: 2787469 - RNA, 22 nt, Leptospira interrogans serovar lai str. 56601
ccaugauuuguaauaguuccca

SEQ ID NO: 2787470 - RNA, 23 nt, Leptospira interrogans serovar lai str. 56601
ccauggaggcugccgcucuuucu

SEQ ID NO: 2787471 - RNA, 22 nt, Leptospira interrogans serovar lai str. 56601
ccaugucuucuaaaucuaauuc

SEQ ID NO: 2787472 - RNA, 13 nt, Leptospira interrogans serovar lai str. 56601
ccauguuuuuaaa

SEQ ID NO: 2787473 - RNA, 11 nt, Leptospira interrogans serovar lai str. 56601
ccauuaacuau

SEQ ID NO: 2787474 - RNA, 20 nt, Leptospira interrogans serovar lai str. 56601
ccauucaacuuagaacuugu

SEQ ID NO: 2787475 - RNA, 14 nt, Leptospira interrogans serovar lai str. 56601
ccauucuaaaaucu

SEQ ID NO: 2787476 - RNA, 19 nt, Leptospira interrogans serovar lai str. 56601
ccauucuaaaaucuggauu

SEQ ID NO: 2787477 - RNA, 17 nt, Leptospira interrogans serovar lai str. 56601
ccauugucuauuuuaau

SEQ ID NO: 2787478 - RNA, 21 nt, Leptospira interrogans serovar lai str. 56601
ccauuuuagcauaaguucguc

SEQ ID NO: 2787479 - RNA, 12 nt, Leptospira interrogans serovar lai str. 56601
ccauuuuccuuc

SEQ ID NO: 2787480 - RNA, 21 nt, Leptospira interrogans serovar lai str. 56601
ccauuuuccuucggugauacu

SEQ ID NO: 2787481 - RNA, 12 nt, Leptospira interrogans serovar lai str. 56601
ccauuuuuuaga

SEQ ID NO: 2787482 - RNA, 15 nt, Leptospira interrogans serovar lai str. 56601
cccaaaaccgaaucu

SEQ ID NO: 2787483 - RNA, 23 nt, Leptospira interrogans serovar lai str. 56601
cccaaacacaugagcauucuuga

SEQ ID NO: 2787484 - RNA, 16 nt, Leptospira interrogans serovar lai str. 56601
cccaaugauucuaacu

SEQ ID NO: 2787485 - RNA, 13 nt, Leptospira interrogans serovar lai str. 56601
cccacaaguauuu

SEQ ID NO: 2787486 - RNA, 18 nt, Leptospira interrogans serovar lai str. 56601
cccacaucgaaaaaacaa

SEQ ID NO: 2787487 - RNA, 21 nt, Leptospira interrogans serovar lai str. 56601
cccacaucgaaaaaacaaaua

SEQ ID NO: 2787488 - RNA, 18 nt, Leptospira interrogans serovar lai str. 56601
cccacaucuuauuuuuac

SEQ ID NO: 2787489 - RNA, 11 nt, Leptospira interrogans serovar lai str. 56601
cccacauuuuc

SEQ ID NO: 2787490 - RNA, 19 nt, Leptospira interrogans serovar lai str. 56601
cccacauuuugaagguuga

SEQ ID NO: 2787491 - RNA, 13 nt, Leptospira interrogans serovar lai str. 56601
cccacauuuuguu

SEQ ID NO: 2787492 - RNA, 16 nt, Leptospira interrogans serovar lai str. 56601
ccguuuuacguaaauu

SEQ ID NO: 2787493 - RNA, 12 nt, Leptospira interrogans serovar lai str. 56601
ccguuuuuaaau

SEQ ID NO: 2787494 - RNA, 13 nt, Leptospira interrogans serovar lai str. 56601
ccuaaaaaauaaa

SEQ ID NO: 2787495 - RNA, 14 nt, Leptospira interrogans serovar lai str. 56601
ccuaaaaaauaaau

SEQ ID NO: 2787496 - RNA, 17 nt, Leptospira interrogans serovar lai str. 56601
ccuaaaaaauuuuuaga

SEQ ID NO: 2787497 - RNA, 12 nt, Leptospira interrogans serovar lai str. 56601
ccuaaaaauugu

SEQ ID NO: 2787498 - RNA, 12 nt, Leptospira interrogans serovar lai str. 56601
ccuaaaaugaaa

SEQ ID NO: 2787499 - RNA, 14 nt, Leptospira interrogans serovar lai str. 56601
ccuaaaaugaaaaa

SEQ ID NO: 2787500 - RNA, 19 nt, Leptospira interrogans serovar lai str. 56601
ccuaaaaugugggaacuac

SEQ ID NO: 2787501 - RNA, 11 nt, Leptospira interrogans serovar lai str. 56601
ccuaaaauugc

SEQ ID NO: 2787502 - RNA, 13 nt, Leptospira interrogans serovar lai str. 56601
ccuaaaauuuuaa

SEQ ID NO: 2787503 - RNA, 11 nt, Leptospira interrogans serovar lai str. 56601
ccuaaacccug

SEQ ID NO: 2787504 - RNA, 15 nt, Leptospira interrogans serovar lai str. 56601
ccuaacccugcaaag

SEQ ID NO: 2787505 - RNA, 16 nt, Leptospira interrogans serovar lai str. 56601
ccuaagaaucaaaucu

SEQ ID NO: 2787506 - RNA, 19 nt, Leptospira interrogans serovar lai str. 56601
ccuaauaaacaaaauucaa

SEQ ID NO: 2787507 - RNA, 15 nt, Leptospira interrogans serovar lai str. 56601
ccuaauauaucagau

SEQ ID NO: 2787508 - RNA, 21 nt, Leptospira interrogans serovar lai str. 56601
ccuaaugcagcuucuuccaaa

SEQ ID NO: 2787509 - RNA, 19 nt, Leptospira interrogans serovar lai str. 56601
ccuaauuacgauuuuuuga

SEQ ID NO: 2787510 - RNA, 23 nt, Leptospira interrogans serovar lai str. 56601
ccuaauuacgauuuuuugauuca

SEQ ID NO: 2787511 - RNA, 12 nt, Leptospira interrogans serovar lai str. 56601
ccuaauuuacua

SEQ ID NO: 2787512 - RNA, 13 nt, Leptospira interrogans serovar lai str. 56601
ccuacaaaucgaa

SEQ ID NO: 2787513 - RNA, 18 nt, Leptospira interrogans serovar lai str. 56601
ccuacaguuuuagaaucu

SEQ ID NO: 2787514 - RNA, 13 nt, Leptospira interrogans serovar lai str. 56601
ccuacauuuuuua

SEQ ID NO: 2787515 - RNA, 23 nt, Leptospira interrogans serovar lai str. 56601
ccuacgcuucaaucucuuucuca

SEQ ID NO: 2787516 - RNA, 13 nt, Leptospira interrogans serovar lai str. 56601
ccuagaggagcca

SEQ ID NO: 2787517 - RNA, 23 nt, Leptospira interrogans serovar lai str. 56601
ccuaguuccaauuaacaaaacug

SEQ ID NO: 2787518 - RNA, 22 nt, Leptospira interrogans serovar lai str. 56601
ccuaguuuaugugaguucccau

SEQ ID NO: 2787519 - RNA, 18 nt, Leptospira interrogans serovar lai str. 56601
ccuauaucaacaaucgga

SEQ ID NO: 2787520 - RNA, 15 nt, Leptospira interrogans serovar lai str. 56601
ccuauggacagaauc

SEQ ID NO: 2787521 - RNA, 13 nt, Leptospira interrogans serovar lai str. 56601
ccuauguuucuug

SEQ ID NO: 2787522 - RNA, 17 nt, Leptospira interrogans serovar lai str. 56601
ccuauguuucuuguguc

SEQ ID NO: 2787523 - RNA, 22 nt, Leptospira interrogans serovar lai str. 56601
ccuauuguauuugauuuuaccu

SEQ ID NO: 2787524 - RNA, 19 nt, Leptospira interrogans serovar lai str. 56601
ccuauuucuguuuuauaga

SEQ ID NO: 2787525 - RNA, 19 nt, Leptospira interrogans serovar lai str. 56601
ccuauuuuuuuaaaaaauu

SEQ ID NO: 2787526 - RNA, 19 nt, Leptospira interrogans serovar lai str. 56601
ccucaaagaaauuuuacuc

SEQ ID NO: 2787527 - RNA, 20 nt, Leptospira interrogans serovar lai str. 56601
ccucaacggguucuucauua

SEQ ID NO: 2787528 - RNA, 22 nt, Leptospira interrogans serovar lai str. 56601
ccucacuccgauacauuugcuu

SEQ ID NO: 2787529 - RNA, 17 nt, Leptospira interrogans serovar lai str. 56601
ccucauaucaaaaauug

SEQ ID NO: 2787530 - RNA, 13 nt, Leptospira interrogans serovar lai str. 56601
ccuccaaacacua

SEQ ID NO: 2787531 - RNA, 12 nt, Leptospira interrogans serovar lai str. 56601
ccuccuccuucu

SEQ ID NO: 2787532 - RNA, 13 nt, Leptospira interrogans serovar lai str. 56601
ccuccucuaaaau

SEQ ID NO: 2787533 - RNA, 22 nt, Leptospira interrogans serovar lai str. 56601
ccucuaaaaaucggcauucaau

SEQ ID NO: 2787534 - RNA, 12 nt, Leptospira interrogans serovar lai str. 56601
ccucuauaaaau

SEQ ID NO: 2787535 - RNA, 14 nt, Leptospira interrogans serovar lai str. 56601
ccucuauaaaaucu

SEQ ID NO: 2787536 - RNA, 20 nt, Leptospira interrogans serovar lai str. 56601
ccucuauaaaaucuaaaaaa

SEQ ID NO: 2787537 - RNA, 14 nt, Leptospira interrogans serovar lai str. 56601
ccucuauaaaugaa

SEQ ID NO: 2787538 - RNA, 19 nt, Leptospira interrogans serovar lai str. 56601
ccucuaugaaacuuaguuc

SEQ ID NO: 2787539 - RNA, 15 nt, Leptospira interrogans serovar lai str. 56601
ccucugauaaaauca

SEQ ID NO: 2787540 - RNA, 17 nt, Leptospira interrogans serovar lai str. 56601
ccucuguaaauacaaaa

SEQ ID NO: 2787541 - RNA, 16 nt, Leptospira interrogans serovar lai str. 56601
ccucuucugauuguaa

SEQ ID NO: 2787542 - RNA, 21 nt, Leptospira interrogans serovar lai str. 56601
ccucuugaagccuuccaucaa

SEQ ID NO: 2787543 - RNA, 23 nt, Leptospira interrogans serovar lai str. 56601
ccucuuuauacggaugugaauuc

SEQ ID NO: 2787544 - RNA, 16 nt, Leptospira interrogans serovar lai str. 56601
ccugaaaauuuuccuu

SEQ ID NO: 2787545 - RNA, 17 nt, Leptospira interrogans serovar lai str. 56601
ccugaaaauuuuccuuu

SEQ ID NO: 2787546 - RNA, 16 nt, Leptospira interrogans serovar lai str. 56601
ccugagacgcugaguu

SEQ ID NO: 2787547 - RNA, 21 nt, Leptospira interrogans serovar lai str. 56601
ccugauaaauuccguaaaauu

SEQ ID NO: 2787548 - RNA, 18 nt, Leptospira interrogans serovar lai str. 56601
ccugauuuuuccauaaaa

SEQ ID NO: 2787549 - RNA, 19 nt, Leptospira interrogans serovar lai str. 56601
ccugauuuuuccauaaaaa

SEQ ID NO: 2787550 - RNA, 22 nt, Leptospira interrogans serovar lai str. 56601
ccugauuuuucuguaaaaauaa

SEQ ID NO: 2787551 - RNA, 18 nt, Leptospira interrogans serovar lai str. 56601
ccugcaaauuuuuuucua

SEQ ID NO: 2787552 - RNA, 11 nt, Leptospira interrogans serovar lai str. 56601
ccugccaaaau

SEQ ID NO: 2787553 - RNA, 15 nt, Leptospira interrogans serovar lai str. 56601
ccugccaaaauccca

SEQ ID NO: 2787554 - RNA, 19 nt, Leptospira interrogans serovar lai str. 56601
ccugccaaaaucccagaaa

SEQ ID NO: 2787555 - RNA, 21 nt, Leptospira interrogans serovar lai str. 56601
ccugcuaacugauuauaaaaa

SEQ ID NO: 2787556 - RNA, 13 nt, Leptospira interrogans serovar lai str. 56601
ccuggaaaagaau

SEQ ID NO: 2787557 - RNA, 14 nt, Leptospira interrogans serovar lai str. 56601
ccuggaaaagaauc

SEQ ID NO: 2787558 - RNA, 23 nt, Leptospira interrogans serovar lai str. 56601
ccuggauuuguaauaguucccac

SEQ ID NO: 2787559 - RNA, 16 nt, Leptospira interrogans serovar lai str. 56601
ccugggaaguuguauc

SEQ ID NO: 2787560 - RNA, 16 nt, Leptospira interrogans serovar lai str. 56601
ccugguuucaaaaaau

SEQ ID NO: 2787561 - RNA, 17 nt, Leptospira interrogans serovar lai str. 56601
ccugguuucaaaaaauc

SEQ ID NO: 2787562 - RNA, 19 nt, Leptospira interrogans serovar lai str. 56601
ccugguuuuuuguuggcuc

SEQ ID NO: 2787563 - RNA, 16 nt, Leptospira interrogans serovar lai str. 56601
ccuguuugaaaaaaug

SEQ ID NO: 2787564 - RNA, 18 nt, Leptospira interrogans serovar lai str. 56601
ccuguuugaaaaaaugua

SEQ ID NO: 2787565 - RNA, 12 nt, Leptospira interrogans serovar lai str. 56601
ccuuaaaaugac

SEQ ID NO: 2787566 - RNA, 20 nt, Leptospira interrogans serovar lai str. 56601
ccuuaaauauaucuucuuug

SEQ ID NO: 2787567 - RNA, 22 nt, Leptospira interrogans serovar lai str. 56601
ccuuaaauauaucuucuuuggu

SEQ ID NO: 2787568 - RNA, 18 nt, Leptospira interrogans serovar lai str. 56601
ccuuacaaacuccgugaa

SEQ ID NO: 2787569 - RNA, 19 nt, Leptospira interrogans serovar lai str. 56601
ccuuaccgccuucacccac

SEQ ID NO: 2787570 - RNA, 16 nt, Leptospira interrogans serovar lai str. 56601
ccuuaccuccuuuuuc

SEQ ID NO: 2787571 - RNA, 17 nt, Leptospira interrogans serovar lai str. 56601
ccuuaccuccuuuuuca

SEQ ID NO: 2787572 - RNA, 19 nt, Leptospira interrogans serovar lai str. 56601
ccuuacgaucuaaaaggac

SEQ ID NO: 2787573 - RNA, 19 nt, Leptospira interrogans serovar lai str. 56601
ccuuacgaugucuuuucaa

SEQ ID NO: 2787574 - RNA, 20 nt, Leptospira interrogans serovar lai str. 56601
ccuuauuaaaaccaucuuug

SEQ ID NO: 2787575 - RNA, 20 nt, Leptospira interrogans serovar lai str. 56601
cgaauucuuucuauuuuuuc

SEQ ID NO: 2787576 - RNA, 23 nt, Leptospira interrogans serovar lai str. 56601
cgaauugaucucauaaagacaau

SEQ ID NO: 2787577 - RNA, 22 nt, Leptospira interrogans serovar lai str. 56601
cgaauuguauccgaaaaauucc

SEQ ID NO: 2787578 - RNA, 14 nt, Leptospira interrogans serovar lai str. 56601
cgaauuguuuuuaa

SEQ ID NO: 2787579 - RNA, 16 nt, Leptospira interrogans serovar lai str. 56601
cgaauuguuuuuaaau

SEQ ID NO: 2787580 - RNA, 19 nt, Leptospira interrogans serovar lai str. 56601
cgaauuguuuuuaaauacu

SEQ ID NO: 2787581 - RNA, 20 nt, Leptospira interrogans serovar lai str. 56601
cgaauuguuuuuaaauacuc

SEQ ID NO: 2787582 - RNA, 14 nt, Leptospira interrogans serovar lai str. 56601
cgaauuucagauag

SEQ ID NO: 2787583 - RNA, 13 nt, Leptospira interrogans serovar lai str. 56601
cgaauuuccauuu

SEQ ID NO: 2787584 - RNA, 22 nt, Leptospira interrogans serovar lai str. 56601
cgaauuuccuuuuguuuuucuu

SEQ ID NO: 2787585 - RNA, 20 nt, Leptospira interrogans serovar lai str. 56601
cgaauuucuucauaaaaucg

SEQ ID NO: 2787586 - RNA, 18 nt, Leptospira interrogans serovar lai str. 56601
cgaauuugcgaaaaaaau

SEQ ID NO: 2787587 - RNA, 17 nt, Leptospira interrogans serovar lai str. 56601
cgaauuuuaaauauuaa

SEQ ID NO: 2787588 - RNA, 20 nt, Leptospira interrogans serovar lai str. 56601
cgaauuuuuuuuauuuuuag

SEQ ID NO: 2787589 - RNA, 20 nt, Leptospira interrogans serovar lai str. 56601
cgacaaaaggauuccauuuc

SEQ ID NO: 2787590 - RNA, 20 nt, Leptospira interrogans serovar lai str. 56601
cgacaacuuauaauuuucuu

SEQ ID NO: 2787591 - RNA, 14 nt, Leptospira interrogans serovar lai str. 56601
cgacaagaaugagu

SEQ ID NO: 2787592 - RNA, 17 nt, Leptospira interrogans serovar lai str. 56601
cgacaaucguaggcacg

SEQ ID NO: 2787593 - RNA, 19 nt, Leptospira interrogans serovar lai str. 56601
cgacagauucaauuuuuau

SEQ ID NO: 2787594 - RNA, 15 nt, Leptospira interrogans serovar lai str. 56601
cgaccuguagagaag

SEQ ID NO: 2787595 - RNA, 17 nt, Leptospira interrogans serovar lai str. 56601
cgaccuuucuaaaaauu

SEQ ID NO: 2787596 - RNA, 16 nt, Leptospira interrogans serovar lai str. 56601
cgacucagaaaacuca

SEQ ID NO: 2787597 - RNA, 13 nt, Leptospira interrogans serovar lai str. 56601
cgacuucuuuuuu

SEQ ID NO: 2787598 - RNA, 18 nt, Leptospira interrogans serovar lai str. 56601
cgacuugagauuccuuuu

SEQ ID NO: 2787599 - RNA, 14 nt, Leptospira interrogans serovar lai str. 56601
cgacuuuaguucuc

SEQ ID NO: 2787600 - RNA, 14 nt, Leptospira interrogans serovar lai str. 56601
cgagaaagaauuuc

SEQ ID NO: 2787601 - RNA, 15 nt, Leptospira interrogans serovar lai str. 56601
cgagagacgcugagu

SEQ ID NO: 2787602 - RNA, 21 nt, Leptospira interrogans serovar lai str. 56601
cgagaucugucgagcucccug

SEQ ID NO: 2787603 - RNA, 17 nt, Leptospira interrogans serovar lai str. 56601
cgagauugauauuucuu

SEQ ID NO: 2787604 - RNA, 20 nt, Leptospira interrogans serovar lai str. 56601
cgagcaucuuuagaaugagc

SEQ ID NO: 2787605 - RNA, 21 nt, Leptospira interrogans serovar lai str. 56601
cgagcgaaagccgccuuucca

SEQ ID NO: 2787606 - RNA, 17 nt, Leptospira interrogans serovar lai str. 56601
cgagcucacguugaagu

SEQ ID NO: 2787607 - RNA, 15 nt, Leptospira interrogans serovar lai str. 56601
cgaguagaauucuca

SEQ ID NO: 2787608 - RNA, 13 nt, Leptospira interrogans serovar lai str. 56601
cgaguucaacuua

SEQ ID NO: 2787609 - RNA, 16 nt, Leptospira interrogans serovar lai str. 56601
cgaguuuaucagaaac

SEQ ID NO: 2787610 - RNA, 16 nt, Leptospira interrogans serovar lai str. 56601
cgaguuucacaaaaau

SEQ ID NO: 2787611 - RNA, 22 nt, Leptospira interrogans serovar lai str. 56601
cgauaaagaaaguaauuuugaa

SEQ ID NO: 2787612 - RNA, 17 nt, Leptospira interrogans serovar lai str. 56601
cgauaagaauauaagau

SEQ ID NO: 2787613 - RNA, 23 nt, Leptospira interrogans serovar lai str. 56601
cgauaagucucucuugaacguga

SEQ ID NO: 2787614 - RNA, 21 nt, Leptospira interrogans serovar lai str. 56601
cgauaauucuuuagaaauuuu

SEQ ID NO: 2787615 - RNA, 16 nt, Leptospira interrogans serovar lai str. 56601
cgauacagaauaaaua

SEQ ID NO: 2787616 - RNA, 16 nt, Leptospira interrogans serovar lai str. 56601
cgauacauuugcuuug

SEQ ID NO: 2787617 - RNA, 19 nt, Leptospira interrogans serovar lai str. 56601
cgauacugccaaugaugau

SEQ ID NO: 2787618 - RNA, 16 nt, Leptospira interrogans serovar lai str. 56601
cgauacuuaaaaauac

SEQ ID NO: 2787619 - RNA, 12 nt, Leptospira interrogans serovar lai str. 56601
cgauagauucaa

SEQ ID NO: 2787620 - RNA, 17 nt, Leptospira interrogans serovar lai str. 56601
cgauauaauaaaauccc

SEQ ID NO: 2787621 - RNA, 15 nt, Leptospira interrogans serovar lai str. 56601
cgauauuaaaaugag

SEQ ID NO: 2787622 - RNA, 16 nt, Leptospira interrogans serovar lai str. 56601
cgauauuaaaaugagc

SEQ ID NO: 2787623 - RNA, 14 nt, Leptospira interrogans serovar lai str. 56601
cgauauuuuuuaaa

SEQ ID NO: 2787624 - RNA, 24 nt, Leptospira interrogans serovar lai str. 56601
cgaucacgucgcuuacaaagugau

SEQ ID NO: 2787625 - RNA, 15 nt, Leptospira interrogans serovar lai str. 56601
cgauccguaaaaaac

SEQ ID NO: 2787626 - RNA, 18 nt, Leptospira interrogans serovar lai str. 56601
cgauccuuuuuuguaaag

SEQ ID NO: 2787627 - RNA, 22 nt, Leptospira interrogans serovar lai str. 56601
cgaucgacauuccccaaguaaa

SEQ ID NO: 2787628 - RNA, 22 nt, Leptospira interrogans serovar lai str. 56601
cgaucgcaacauaaugcuccaa

SEQ ID NO: 2787629 - RNA, 15 nt, Leptospira interrogans serovar lai str. 56601
cgaucgcgggcaauu

SEQ ID NO: 2787630 - RNA, 13 nt, Leptospira interrogans serovar lai str. 56601
cgaucuaaaagga

SEQ ID NO: 2787631 - RNA, 14 nt, Leptospira interrogans serovar lai str. 56601
cgaucuaaaaggac

SEQ ID NO: 2787632 - RNA, 16 nt, Leptospira interrogans serovar lai str. 56601
cgaucuguaaaaugua

SEQ ID NO: 2787633 - RNA, 19 nt, Leptospira interrogans serovar lai str. 56601
cgaucuguaaaauguagau

SEQ ID NO: 2787634 - RNA, 19 nt, Leptospira interrogans serovar lai str. 56601
cgaucuuguagacaaauca

SEQ ID NO: 2787635 - RNA, 18 nt, Leptospira interrogans serovar lai str. 56601
cgaugagccaucuuuuuu

SEQ ID NO: 2787636 - RNA, 20 nt, Leptospira interrogans serovar lai str. 56601
cgaugaucgauuuuuuagca

SEQ ID NO: 2787637 - RNA, 14 nt, Leptospira interrogans serovar lai str. 56601
cgauguaauuccag

SEQ ID NO: 2787638 - RNA, 20 nt, Leptospira interrogans serovar lai str. 56601
cgauguauggcucauuuuuc

SEQ ID NO: 2787639 - RNA, 15 nt, Leptospira interrogans serovar lai str. 56601
cgauuaaauuuugaa

SEQ ID NO: 2787640 - RNA, 12 nt, Leptospira interrogans serovar lai str. 56601
cgauucaauucg

SEQ ID NO: 2787641 - RNA, 16 nt, Leptospira interrogans serovar lai str. 56601
cgauucacuuccauug

SEQ ID NO: 2787642 - RNA, 16 nt, Leptospira interrogans serovar lai str. 56601
cgauucauaaagagcg

SEQ ID NO: 2787643 - RNA, 14 nt, Leptospira interrogans serovar lai str. 56601
cgauucuaaauuau

SEQ ID NO: 2787644 - RNA, 16 nt, Leptospira interrogans serovar lai str. 56601
cgauucuaacugguuu

SEQ ID NO: 2787645 - RNA, 15 nt, Leptospira interrogans serovar lai str. 56601
cgauugagaauucua

SEQ ID NO: 2787646 - RNA, 19 nt, Leptospira interrogans serovar lai str. 56601
cgauugaucuaucuuucca

SEQ ID NO: 2787647 - RNA, 14 nt, Leptospira interrogans serovar lai str. 56601
cgauugauugaagc

SEQ ID NO: 2787648 - RNA, 13 nt, Leptospira interrogans serovar lai str. 56601
cgauuguaaaaaa

SEQ ID NO: 2787649 - RNA, 21 nt, Leptospira interrogans serovar lai str. 56601
cgauuguaacgaaaauuccga

SEQ ID NO: 2787650 - RNA, 15 nt, Leptospira interrogans serovar lai str. 56601
cgauuuaaaaacuau

SEQ ID NO: 2787651 - RNA, 19 nt, Leptospira interrogans serovar lai str. 56601
cgauuucuacaauggagga

SEQ ID NO: 2787652 - RNA, 12 nt, Leptospira interrogans serovar lai str. 56601
cgauuucuuuca

SEQ ID NO: 2787653 - RNA, 12 nt, Leptospira interrogans serovar lai str. 56601
cgauuuggaaua

SEQ ID NO: 2787654 - RNA, 23 nt, Leptospira interrogans serovar lai str. 56601
cgauuuguuuuuuugcagaagua

SEQ ID NO: 2787655 - RNA, 22 nt, Leptospira interrogans serovar lai str. 56601
cgauuuuaccaaggauguggaa

SEQ ID NO: 2787656 - RNA, 23 nt, Leptospira interrogans serovar lai str. 56601
cgauuuuacgaacgaauucuaaa

SEQ ID NO: 2787657 - RNA, 19 nt, Leptospira interrogans serovar lai str. 56601
cgauuuuggguuuggagua

SEQ ID NO: 2787658 - RNA, 14 nt, Leptospira interrogans serovar lai str. 56601
cggguuagaaucaa

SEQ ID NO: 2787659 - RNA, 19 nt, Leptospira interrogans serovar lai str. 56601
cggguuuuucuuuuuaaau

SEQ ID NO: 2787660 - RNA, 22 nt, Leptospira interrogans serovar lai str. 56601
cggguuuuucuuuuuaaauaca

SEQ ID NO: 2787661 - RNA, 15 nt, Leptospira interrogans serovar lai str. 56601
cgguaaaaggagcca

SEQ ID NO: 2787662 - RNA, 22 nt, Leptospira interrogans serovar lai str. 56601
cgguaaauuuuuuagaaaucaa

SEQ ID NO: 2787663 - RNA, 12 nt, Leptospira interrogans serovar lai str. 56601
cgguaauuauaa

SEQ ID NO: 2787664 - RNA, 17 nt, Leptospira interrogans serovar lai str. 56601
cggucuuucuucuguaa

SEQ ID NO: 2787665 - RNA, 15 nt, Leptospira interrogans serovar lai str. 56601
cgguguaaaaaaauu

SEQ ID NO: 2787666 - RNA, 17 nt, Leptospira interrogans serovar lai str. 56601
cgguguaaaaaaucaug

SEQ ID NO: 2787667 - RNA, 15 nt, Leptospira interrogans serovar lai str. 56601
cgguuaacgcguuga

SEQ ID NO: 2787668 - RNA, 16 nt, Leptospira interrogans serovar lai str. 56601
cgguucgguggaaacu

SEQ ID NO: 2787669 - RNA, 21 nt, Leptospira interrogans serovar lai str. 56601
cgguucuaaaagucccaauuc

SEQ ID NO: 2787670 - RNA, 13 nt, Leptospira interrogans serovar lai str. 56601
cgguuuaaaacua

SEQ ID NO: 2787671 - RNA, 11 nt, Leptospira interrogans serovar lai str. 56601
cguaaaaaaau

SEQ ID NO: 2787672 - RNA, 12 nt, Leptospira interrogans serovar lai str. 56601
cguaaaaaaaua

SEQ ID NO: 2787673 - RNA, 13 nt, Leptospira interrogans serovar lai str. 56601
cguaaaaaaauau

SEQ ID NO: 2787674 - RNA, 18 nt, Leptospira interrogans serovar lai str. 56601
cguaaaauggaaaaaaga

SEQ ID NO: 2787675 - RNA, 15 nt, Leptospira interrogans serovar lai str. 56601
cguaaacaaaagugg

SEQ ID NO: 2787676 - RNA, 14 nt, Leptospira interrogans serovar lai str. 56601
cguaaaccaagaau

SEQ ID NO: 2787677 - RNA, 12 nt, Leptospira interrogans serovar lai str. 56601
cguaaauauuuu

SEQ ID NO: 2787678 - RNA, 21 nt, Leptospira interrogans serovar lai str. 56601
cguaaauucaggauaaacauc

SEQ ID NO: 2787679 - RNA, 22 nt, Leptospira interrogans serovar lai str. 56601
cguaagaccagugccauuuuuc

SEQ ID NO: 2787680 - RNA, 15 nt, Leptospira interrogans serovar lai str. 56601
cguaagauaugaauu

SEQ ID NO: 2787681 - RNA, 19 nt, Leptospira interrogans serovar lai str. 56601
cguaaguaauccauuuuuc

SEQ ID NO: 2787682 - RNA, 21 nt, Leptospira interrogans serovar lai str. 56601
cguaaguuaaauauaaaagau

SEQ ID NO: 2787683 - RNA, 13 nt, Leptospira interrogans serovar lai str. 56601
cguaauaguuccc

SEQ ID NO: 2787684 - RNA, 18 nt, Leptospira interrogans serovar lai str. 56601
cguaauaucuaaaaccuc

SEQ ID NO: 2787685 - RNA, 19 nt, Leptospira interrogans serovar lai str. 56601
cguaaucugugggaacuac

SEQ ID NO: 2787686 - RNA, 20 nt, Leptospira interrogans serovar lai str. 56601
cguaauuuuuuggaaauuuu

SEQ ID NO: 2787687 - RNA, 15 nt, Leptospira interrogans serovar lai str. 56601
cguagccgcuucaaa

SEQ ID NO: 2787688 - RNA, 18 nt, Leptospira interrogans serovar lai str. 56601
cguaguuuuuguuccgaa

SEQ ID NO: 2787689 - RNA, 14 nt, Leptospira interrogans serovar lai str. 56601
cguauacuuuaaaa

SEQ ID NO: 2787690 - RNA, 15 nt, Leptospira interrogans serovar lai str. 56601
cguauauaaaaaaug

SEQ ID NO: 2787691 - RNA, 15 nt, Leptospira interrogans serovar lai str. 56601
cguauccuuaaaaug

SEQ ID NO: 2787692 - RNA, 17 nt, Leptospira interrogans serovar lai str. 56601
cguaugauuugcggauc

SEQ ID NO: 2787693 - RNA, 11 nt, Leptospira interrogans serovar lai str. 56601
cguauucuuua

SEQ ID NO: 2787694 - RNA, 13 nt, Leptospira interrogans serovar lai str. 56601
cguauuuuuaaau

SEQ ID NO: 2787695 - RNA, 19 nt, Leptospira interrogans serovar lai str. 56601
cgucauaguucccacaaau

SEQ ID NO: 2787696 - RNA, 22 nt, Leptospira interrogans serovar lai str. 56601
cgucccaaaaucuuaaaagaaa

SEQ ID NO: 2787697 - RNA, 20 nt, Leptospira interrogans serovar lai str. 56601
cgucgaacucacauuauuua

SEQ ID NO: 2787698 - RNA, 15 nt, Leptospira interrogans serovar lai str. 56601
cgucuauaaaauuca

SEQ ID NO: 2787699 - RNA, 14 nt, Leptospira interrogans serovar lai str. 56601
cgucuaucuuuuuu

SEQ ID NO: 2787700 - RNA, 14 nt, Leptospira interrogans serovar lai str. 56601
cgucucgcuucuau

SEQ ID NO: 2787701 - RNA, 15 nt, Leptospira interrogans serovar lai str. 56601
cgucuuaaauucuaa

SEQ ID NO: 2787702 - RNA, 19 nt, Leptospira interrogans serovar lai str. 56601
cgucuucuuuacaauuugc

SEQ ID NO: 2787703 - RNA, 13 nt, Leptospira interrogans serovar lai str. 56601
cgucuucuuuuuu

SEQ ID NO: 2787704 - RNA, 21 nt, Leptospira interrogans serovar lai str. 56601
cgugaacucgguguaaaaaaa

SEQ ID NO: 2787705 - RNA, 23 nt, Leptospira interrogans serovar lai str. 56601
cgugaacucgguguaaaaaaauu

SEQ ID NO: 2787706 - RNA, 18 nt, Leptospira interrogans serovar lai str. 56601
cgugaccagcguuuugcu

SEQ ID NO: 2787707 - RNA, 21 nt, Leptospira interrogans serovar lai str. 56601
cgugaccagcguuuugcugag

SEQ ID NO: 2787708 - RNA, 20 nt, Leptospira interrogans serovar lai str. 56601
cgugacgaucacacuuugca

SEQ ID NO: 2787709 - RNA, 22 nt, Leptospira interrogans serovar lai str. 56601
cgugagcucuauguaagaaaau

SEQ ID NO: 2787710 - RNA, 13 nt, Leptospira interrogans serovar lai str. 56601
cgugaguucagac

SEQ ID NO: 2787711 - RNA, 23 nt, Leptospira interrogans serovar lai str. 56601
cgugaguuugacguaaaaaaauc

SEQ ID NO: 2787712 - RNA, 19 nt, Leptospira interrogans serovar lai str. 56601
cgugaucuccuaaaauaaa

SEQ ID NO: 2787713 - RNA, 22 nt, Leptospira interrogans serovar lai str. 56601
cguggauuuuauguaagaaaaa

SEQ ID NO: 2787714 - RNA, 22 nt, Leptospira interrogans serovar lai str. 56601
cgugguaguucccacauuuaaa

SEQ ID NO: 2787715 - RNA, 21 nt, Leptospira interrogans serovar lai str. 56601
cguuaaauuuucguaguaguc

SEQ ID NO: 2787716 - RNA, 17 nt, Leptospira interrogans serovar lai str. 56601
cguuaaguaggaacuac

SEQ ID NO: 2787717 - RNA, 14 nt, Leptospira interrogans serovar lai str. 56601
cguuaaguuaucgu

SEQ ID NO: 2787718 - RNA, 14 nt, Leptospira interrogans serovar lai str. 56601
cguuauuaaaauuu

SEQ ID NO: 2787719 - RNA, 22 nt, Leptospira interrogans serovar lai str. 56601
cguuauucuauucguauuuuau

SEQ ID NO: 2787720 - RNA, 17 nt, Leptospira interrogans serovar lai str. 56601
cguuauuuuaacuugag

SEQ ID NO: 2787721 - RNA, 20 nt, Leptospira interrogans serovar lai str. 56601
cguucaacaaacaaauagaa

SEQ ID NO: 2787722 - RNA, 14 nt, Leptospira interrogans serovar lai str. 56601
cguuccaaacccug

SEQ ID NO: 2787723 - RNA, 15 nt, Leptospira interrogans serovar lai str. 56601
cguucggaaaaagua

SEQ ID NO: 2787724 - RNA, 14 nt, Leptospira interrogans serovar lai str. 56601
cguucguaguuuuu

SEQ ID NO: 2787725 - RNA, 17 nt, Leptospira interrogans serovar lai str. 56601
cguucguaguuuuuguu

SEQ ID NO: 2787726 - RNA, 18 nt, Leptospira interrogans serovar lai str. 56601
cguucugggcuccaaaag

SEQ ID NO: 2787727 - RNA, 14 nt, Leptospira interrogans serovar lai str. 56601
cguucuuuuuuccu

SEQ ID NO: 2787728 - RNA, 17 nt, Leptospira interrogans serovar lai str. 56601
cguucuuuuuuccuucu

SEQ ID NO: 2787729 - RNA, 22 nt, Leptospira interrogans serovar lai str. 56601
cguucuuuuuuccuucuuuaca

SEQ ID NO: 2787730 - RNA, 16 nt, Leptospira interrogans serovar lai str. 56601
cguugaauaagauuuu

SEQ ID NO: 2787731 - RNA, 21 nt, Leptospira interrogans serovar lai str. 56601
cguuggccucgaaaguuuaca

SEQ ID NO: 2787732 - RNA, 15 nt, Leptospira interrogans serovar lai str. 56601
cguuguauuuuaaac

SEQ ID NO: 2787733 - RNA, 12 nt, Leptospira interrogans serovar lai str. 56601
cguuuaaaaaac

SEQ ID NO: 2787734 - RNA, 14 nt, Leptospira interrogans serovar lai str. 56601
cguuuaaaaacaga

SEQ ID NO: 2787735 - RNA, 15 nt, Leptospira interrogans serovar lai str. 56601
cguuuaacaauucua

SEQ ID NO: 2787736 - RNA, 22 nt, Leptospira interrogans serovar lai str. 56601
cguuuaacaucaaagaaucauu

SEQ ID NO: 2787737 - RNA, 18 nt, Leptospira interrogans serovar lai str. 56601
cguuuaagaauuuuaaaa

SEQ ID NO: 2787738 - RNA, 18 nt, Leptospira interrogans serovar lai str. 56601
cguuuagaaauuaaagua

SEQ ID NO: 2787739 - RNA, 19 nt, Leptospira interrogans serovar lai str. 56601
cguuucaacuuuagaaaaa

SEQ ID NO: 2787740 - RNA, 14 nt, Leptospira interrogans serovar lai str. 56601
cguuucaauuuuug

SEQ ID NO: 2787741 - RNA, 22 nt, Leptospira interrogans serovar lai str. 56601
cuaacgauuguaaaaaaacaug

SEQ ID NO: 2787742 - RNA, 13 nt, Leptospira interrogans serovar lai str. 56601
cuaacgcaaguuc

SEQ ID NO: 2787743 - RNA, 23 nt, Leptospira interrogans serovar lai str. 56601
cuaacuaugauaaguaauuugug

SEQ ID NO: 2787744 - RNA, 17 nt, Leptospira interrogans serovar lai str. 56601
cuaagaaaaaagcagcu

SEQ ID NO: 2787745 - RNA, 20 nt, Leptospira interrogans serovar lai str. 56601
cuaagaaaaaaguugcuaag

SEQ ID NO: 2787746 - RNA, 13 nt, Leptospira interrogans serovar lai str. 56601
cuaagaaauccgu

SEQ ID NO: 2787747 - RNA, 23 nt, Leptospira interrogans serovar lai str. 56601
cuaagaguagaguaagaaacauc

SEQ ID NO: 2787748 - RNA, 15 nt, Leptospira interrogans serovar lai str. 56601
cuaagaucaaagaga

SEQ ID NO: 2787749 - RNA, 17 nt, Leptospira interrogans serovar lai str. 56601
cuaagaucaaagagaug

SEQ ID NO: 2787750 - RNA, 19 nt, Leptospira interrogans serovar lai str. 56601
cuaagcuuuagaaaauaau

SEQ ID NO: 2787751 - RNA, 14 nt, Leptospira interrogans serovar lai str. 56601
cuaaggauccaaua

SEQ ID NO: 2787752 - RNA, 22 nt, Leptospira interrogans serovar lai str. 56601
cuaaggauccaauacaaaacaa

SEQ ID NO: 2787753 - RNA, 19 nt, Leptospira interrogans serovar lai str. 56601
cuaaguaauuuaaaaaaau

SEQ ID NO: 2787754 - RNA, 12 nt, Leptospira interrogans serovar lai str. 56601
cuaaguccuuuu

SEQ ID NO: 2787755 - RNA, 13 nt, Leptospira interrogans serovar lai str. 56601
cuaagucuuuaaa

SEQ ID NO: 2787756 - RNA, 16 nt, Leptospira interrogans serovar lai str. 56601
cuaaguuuuacagaag

SEQ ID NO: 2787757 - RNA, 16 nt, Leptospira interrogans serovar lai str. 56601
cuaaguuuuuaaauaa

SEQ ID NO: 2787758 - RNA, 14 nt, Leptospira interrogans serovar lai str. 56601
cuaauaaaaacaau

SEQ ID NO: 2787759 - RNA, 15 nt, Leptospira interrogans serovar lai str. 56601
cuaauaaaaaugugg

SEQ ID NO: 2787760 - RNA, 20 nt, Leptospira interrogans serovar lai str. 56601
cuaauacaaaaaauguuuaa

SEQ ID NO: 2787761 - RNA, 21 nt, Leptospira interrogans serovar lai str. 56601
cuaauacggauaaccaaaaac

SEQ ID NO: 2787762 - RNA, 16 nt, Leptospira interrogans serovar lai str. 56601
cuaauagagaaaaauu

SEQ ID NO: 2787763 - RNA, 18 nt, Leptospira interrogans serovar lai str. 56601
cuaauauaucagauugau

SEQ ID NO: 2787764 - RNA, 16 nt, Leptospira interrogans serovar lai str. 56601
cuaauauguuuagagu

SEQ ID NO: 2787765 - RNA, 22 nt, Leptospira interrogans serovar lai str. 56601
cuaaucgagcuuuucuguucau

SEQ ID NO: 2787766 - RNA, 23 nt, Leptospira interrogans serovar lai str. 56601
cuaaucgagcuuuucuguucauu

SEQ ID NO: 2787767 - RNA, 15 nt, Leptospira interrogans serovar lai str. 56601
cuaaugaaaaagaaa

SEQ ID NO: 2787768 - RNA, 14 nt, Leptospira interrogans serovar lai str. 56601
cuaaugaaggaauu

SEQ ID NO: 2787769 - RNA, 16 nt, Leptospira interrogans serovar lai str. 56601
cuaauguugaaugaaa

SEQ ID NO: 2787770 - RNA, 18 nt, Leptospira interrogans serovar lai str. 56601
cuaauguuuguccuagau

SEQ ID NO: 2787771 - RNA, 13 nt, Leptospira interrogans serovar lai str. 56601
cuaauuaaauucu

SEQ ID NO: 2787772 - RNA, 13 nt, Leptospira interrogans serovar lai str. 56601
cuaauucaauaag

SEQ ID NO: 2787773 - RNA, 16 nt, Leptospira interrogans serovar lai str. 56601
cuaauucaguuuuucg

SEQ ID NO: 2787774 - RNA, 15 nt, Leptospira interrogans serovar lai str. 56601
cuaauucuaaaaauu

SEQ ID NO: 2787775 - RNA, 17 nt, Leptospira interrogans serovar lai str. 56601
cuaauucucuucguuuu

SEQ ID NO: 2787776 - RNA, 16 nt, Leptospira interrogans serovar lai str. 56601
cuaauucuuaaaaauu

SEQ ID NO: 2787777 - RNA, 18 nt, Leptospira interrogans serovar lai str. 56601
cuaauucuuaaaaauuua

SEQ ID NO: 2787778 - RNA, 20 nt, Leptospira interrogans serovar lai str. 56601
cuaauuuaaaaaagaagaau

SEQ ID NO: 2787779 - RNA, 14 nt, Leptospira interrogans serovar lai str. 56601
cuaauuuauaaacu

SEQ ID NO: 2787780 - RNA, 16 nt, Leptospira interrogans serovar lai str. 56601
cuaauuuauaaacuua

SEQ ID NO: 2787781 - RNA, 22 nt, Leptospira interrogans serovar lai str. 56601
cuaauuuaugaaagucuuuuuu

SEQ ID NO: 2787782 - RNA, 15 nt, Leptospira interrogans serovar lai str. 56601
cuaauuuguaggaau

SEQ ID NO: 2787783 - RNA, 23 nt, Leptospira interrogans serovar lai str. 56601
cuaauuuguaggaauuacuacau

SEQ ID NO: 2787784 - RNA, 15 nt, Leptospira interrogans serovar lai str. 56601
cuaauuuuauuccaa

SEQ ID NO: 2787785 - RNA, 14 nt, Leptospira interrogans serovar lai str. 56601
cuaauuuuuaucca

SEQ ID NO: 2787786 - RNA, 17 nt, Leptospira interrogans serovar lai str. 56601
cuaauuuuucaaaaacu

SEQ ID NO: 2787787 - RNA, 18 nt, Leptospira interrogans serovar lai str. 56601
cuaauuuuucaaaaacuc

SEQ ID NO: 2787788 - RNA, 17 nt, Leptospira interrogans serovar lai str. 56601
cuacaaaagauuuuuau

SEQ ID NO: 2787789 - RNA, 15 nt, Leptospira interrogans serovar lai str. 56601
cuacaaaauuuagaa

SEQ ID NO: 2787790 - RNA, 14 nt, Leptospira interrogans serovar lai str. 56601
cuacaaauuaaguc

SEQ ID NO: 2787791 - RNA, 12 nt, Leptospira interrogans serovar lai str. 56601
cuacaaauucau

SEQ ID NO: 2787792 - RNA, 18 nt, Leptospira interrogans serovar lai str. 56601
cuacaaauucuucuuccu

SEQ ID NO: 2787793 - RNA, 21 nt, Leptospira interrogans serovar lai str. 56601
cuacaaauucuucuuccuuuu

SEQ ID NO: 2787794 - RNA, 15 nt, Leptospira interrogans serovar lai str. 56601
cuacaaguucauaag

SEQ ID NO: 2787795 - RNA, 13 nt, Leptospira interrogans serovar lai str. 56601
cuacaaucacuuu

SEQ ID NO: 2787796 - RNA, 20 nt, Leptospira interrogans serovar lai str. 56601
cuacaaugucuaucaaaguu

SEQ ID NO: 2787797 - RNA, 15 nt, Leptospira interrogans serovar lai str. 56601
cuacaauuaaaaaga

SEQ ID NO: 2787798 - RNA, 14 nt, Leptospira interrogans serovar lai str. 56601
cuacaauuauauua

SEQ ID NO: 2787799 - RNA, 20 nt, Leptospira interrogans serovar lai str. 56601
cuacaauuuuagaauuuauu

SEQ ID NO: 2787800 - RNA, 20 nt, Leptospira interrogans serovar lai str. 56601
cuacaauuuuagaauuuguu

SEQ ID NO: 2787801 - RNA, 19 nt, Leptospira interrogans serovar lai str. 56601
cuacacuguguucuuuuug

SEQ ID NO: 2787802 - RNA, 12 nt, Leptospira interrogans serovar lai str. 56601
cuacagaauaaa

SEQ ID NO: 2787803 - RNA, 17 nt, Leptospira interrogans serovar lai str. 56601
cuacagaauuuuuuaac

SEQ ID NO: 2787804 - RNA, 16 nt, Leptospira interrogans serovar lai str. 56601
cuacagauaaaaauag

SEQ ID NO: 2787805 - RNA, 13 nt, Leptospira interrogans serovar lai str. 56601
cuacagcaaauca

SEQ ID NO: 2787806 - RNA, 21 nt, Leptospira interrogans serovar lai str. 56601
cuacagcugaggaguuuuuau

SEQ ID NO: 2787807 - RNA, 21 nt, Leptospira interrogans serovar lai str. 56601
cuacaguuuuagaaucuguuc

SEQ ID NO: 2787808 - RNA, 15 nt, Leptospira interrogans serovar lai str. 56601
cuacaucgucuucuu

SEQ ID NO: 2787809 - RNA, 21 nt, Leptospira interrogans serovar lai str. 56601
cuacaugauucauuuaaaaau

SEQ ID NO: 2787810 - RNA, 20 nt, Leptospira interrogans serovar lai str. 56601
cuacauuagaguuguugaaa

SEQ ID NO: 2787811 - RNA, 22 nt, Leptospira interrogans serovar lai str. 56601
cuacauuagaguuguugaacau

SEQ ID NO: 2787812 - RNA, 18 nt, Leptospira interrogans serovar lai str. 56601
cuacauucaauuucuuua

SEQ ID NO: 2787813 - RNA, 14 nt, Leptospira interrogans serovar lai str. 56601
cuacauucauuuuu

SEQ ID NO: 2787814 - RNA, 15 nt, Leptospira interrogans serovar lai str. 56601
cuacauucauuuuua

SEQ ID NO: 2787815 - RNA, 18 nt, Leptospira interrogans serovar lai str. 56601
cuacauucauuuuuauuu

SEQ ID NO: 2787816 - RNA, 20 nt, Leptospira interrogans serovar lai str. 56601
cuacauucugaaacuuuuca

SEQ ID NO: 2787817 - RNA, 16 nt, Leptospira interrogans serovar lai str. 56601
cuacauuuuaaaaauu

SEQ ID NO: 2787818 - RNA, 15 nt, Leptospira interrogans serovar lai str. 56601
cuacauuuuauugug

SEQ ID NO: 2787819 - RNA, 14 nt, Leptospira interrogans serovar lai str. 56601
cuacauuuuauuuu

SEQ ID NO: 2787820 - RNA, 15 nt, Leptospira interrogans serovar lai str. 56601
cuacauuuuugugaa

SEQ ID NO: 2787821 - RNA, 21 nt, Leptospira interrogans serovar lai str. 56601
cuacauuuuugugaaacucaa

SEQ ID NO: 2787822 - RNA, 22 nt, Leptospira interrogans serovar lai str. 56601
cuacauuuuugugaaacucaau

SEQ ID NO: 2787823 - RNA, 18 nt, Leptospira interrogans serovar lai str. 56601
cuacauuuuuuaaauuua

SEQ ID NO: 2787824 - RNA, 20 nt, Leptospira interrogans serovar lai str. 56601
cuauaaauucaucuaaaaaa

SEQ ID NO: 2787825 - RNA, 22 nt, Leptospira interrogans serovar lai str. 56601
cuauaaauuggguaucuaaaua

SEQ ID NO: 2787826 - RNA, 18 nt, Leptospira interrogans serovar lai str. 56601
cuauaacuuuaaaaaaua

SEQ ID NO: 2787827 - RNA, 14 nt, Leptospira interrogans serovar lai str. 56601
cuauaauaacaaaa

SEQ ID NO: 2787828 - RNA, 16 nt, Leptospira interrogans serovar lai str. 56601
cuauaauaacaaaaaa

SEQ ID NO: 2787829 - RNA, 14 nt, Leptospira interrogans serovar lai str. 56601
cuauaauuaauaaa

SEQ ID NO: 2787830 - RNA, 15 nt, Leptospira interrogans serovar lai str. 56601
cuauaauuaauaaaa

SEQ ID NO: 2787831 - RNA, 17 nt, Leptospira interrogans serovar lai str. 56601
cuauaauuaauaaaacu

SEQ ID NO: 2787832 - RNA, 15 nt, Leptospira interrogans serovar lai str. 56601
cuauaauuuaacgug

SEQ ID NO: 2787833 - RNA, 16 nt, Leptospira interrogans serovar lai str. 56601
cuauaauuuccggaau

SEQ ID NO: 2787834 - RNA, 23 nt, Leptospira interrogans serovar lai str. 56601
cuauaauuuccggaauaucagga

SEQ ID NO: 2787835 - RNA, 14 nt, Leptospira interrogans serovar lai str. 56601
cuauacuuucaaaa

SEQ ID NO: 2787836 - RNA, 20 nt, Leptospira interrogans serovar lai str. 56601
cuauagagaaauccaaucau

SEQ ID NO: 2787837 - RNA, 14 nt, Leptospira interrogans serovar lai str. 56601
cuauagauugauuu

SEQ ID NO: 2787838 - RNA, 18 nt, Leptospira interrogans serovar lai str. 56601
cuauagauugauuuaaau

SEQ ID NO: 2787839 - RNA, 21 nt, Leptospira interrogans serovar lai str. 56601
cuauagauugauuuaaaugug

SEQ ID NO: 2787840 - RNA, 21 nt, Leptospira interrogans serovar lai str. 56601
cuauaguaaagauuagaaaaa

SEQ ID NO: 2787841 - RNA, 13 nt, Leptospira interrogans serovar lai str. 56601
cuauauaaagaaa

SEQ ID NO: 2787842 - RNA, 17 nt, Leptospira interrogans serovar lai str. 56601
cuauauaacaaaguauu

SEQ ID NO: 2787843 - RNA, 22 nt, Leptospira interrogans serovar lai str. 56601
cuauauaacaaaguauuuaauu

SEQ ID NO: 2787844 - RNA, 13 nt, Leptospira interrogans serovar lai str. 56601
cuauauaauaucu

SEQ ID NO: 2787845 - RNA, 18 nt, Leptospira interrogans serovar lai str. 56601
cuauauauccuuaugaaa

SEQ ID NO: 2787846 - RNA, 16 nt, Leptospira interrogans serovar lai str. 56601
cuauaucgugaaacuu

SEQ ID NO: 2787847 - RNA, 12 nt, Leptospira interrogans serovar lai str. 56601
cuauauucaaaa

SEQ ID NO: 2787848 - RNA, 16 nt, Leptospira interrogans serovar lai str. 56601
cuauauucaaaaaagu

SEQ ID NO: 2787849 - RNA, 18 nt, Leptospira interrogans serovar lai str. 56601
cuauauucaaaaaaguuu

SEQ ID NO: 2787850 - RNA, 15 nt, Leptospira interrogans serovar lai str. 56601
cuauauucaaaaaau

SEQ ID NO: 2787851 - RNA, 21 nt, Leptospira interrogans serovar lai str. 56601
cuauauuuuugugaaacucaa

SEQ ID NO: 2787852 - RNA, 22 nt, Leptospira interrogans serovar lai str. 56601
cuauauuuuugugaaacucaau

SEQ ID NO: 2787853 - RNA, 13 nt, Leptospira interrogans serovar lai str. 56601
cuaucaaaaaauu

SEQ ID NO: 2787854 - RNA, 18 nt, Leptospira interrogans serovar lai str. 56601
cuaucaacaagaaugaaa

SEQ ID NO: 2787855 - RNA, 21 nt, Leptospira interrogans serovar lai str. 56601
cuaucaacaagaaugaaaaaa

SEQ ID NO: 2787856 - RNA, 15 nt, Leptospira interrogans serovar lai str. 56601
cuauccaaaaguuua

SEQ ID NO: 2787857 - RNA, 18 nt, Leptospira interrogans serovar lai str. 56601
cuauccacuaaaauacuu

SEQ ID NO: 2787858 - RNA, 13 nt, Leptospira interrogans serovar lai str. 56601
cuaucgaacgacc

SEQ ID NO: 2787859 - RNA, 16 nt, Leptospira interrogans serovar lai str. 56601
cuaucgguuuucguug

SEQ ID NO: 2787860 - RNA, 15 nt, Leptospira interrogans serovar lai str. 56601
cuaucucaaaaccua

SEQ ID NO: 2787861 - RNA, 13 nt, Leptospira interrogans serovar lai str. 56601
cuaucuuaaaaug

SEQ ID NO: 2787862 - RNA, 14 nt, Leptospira interrogans serovar lai str. 56601
cuaucuuguuucug

SEQ ID NO: 2787863 - RNA, 20 nt, Leptospira interrogans serovar lai str. 56601
cuaugaaaauuuaauuuuua

SEQ ID NO: 2787864 - RNA, 16 nt, Leptospira interrogans serovar lai str. 56601
cuaugaaauacaaaaa

SEQ ID NO: 2787865 - RNA, 20 nt, Leptospira interrogans serovar lai str. 56601
cuaugaagucuuaucucaaa

SEQ ID NO: 2787866 - RNA, 18 nt, Leptospira interrogans serovar lai str. 56601
cuaugauauggaauuccg

SEQ ID NO: 2787867 - RNA, 19 nt, Leptospira interrogans serovar lai str. 56601
cuaugauucugaaaaaaau

SEQ ID NO: 2787868 - RNA, 20 nt, Leptospira interrogans serovar lai str. 56601
cuaugauucugaaaaaaauu

SEQ ID NO: 2787869 - RNA, 23 nt, Leptospira interrogans serovar lai str. 56601
cuaugccccauucuuuuugccaa

SEQ ID NO: 2787870 - RNA, 20 nt, Leptospira interrogans serovar lai str. 56601
cuauggaaggucucaacaac

SEQ ID NO: 2787871 - RNA, 16 nt, Leptospira interrogans serovar lai str. 56601
cuauggaauauaaaag

SEQ ID NO: 2787872 - RNA, 18 nt, Leptospira interrogans serovar lai str. 56601
cuauggaauauaaaagaa

SEQ ID NO: 2787873 - RNA, 16 nt, Leptospira interrogans serovar lai str. 56601
cuauggaauuuuucaa

SEQ ID NO: 2787874 - RNA, 18 nt, Leptospira interrogans serovar lai str. 56601
cuauggaauuuuucaaca

SEQ ID NO: 2787875 - RNA, 23 nt, Leptospira interrogans serovar lai str. 56601
cuaugggaauuuuuguaaaaucc

SEQ ID NO: 2787876 - RNA, 16 nt, Leptospira interrogans serovar lai str. 56601
cuaugguugcucugca

SEQ ID NO: 2787877 - RNA, 23 nt, Leptospira interrogans serovar lai str. 56601
cuauguccuuuuuuucuuuuaaa

SEQ ID NO: 2787878 - RNA, 22 nt, Leptospira interrogans serovar lai str. 56601
cuauguuucuugugucaagccc

SEQ ID NO: 2787879 - RNA, 16 nt, Leptospira interrogans serovar lai str. 56601
cuauuacguaauguga

SEQ ID NO: 2787880 - RNA, 20 nt, Leptospira interrogans serovar lai str. 56601
cuauuaggaaauacaaaaag

SEQ ID NO: 2787881 - RNA, 19 nt, Leptospira interrogans serovar lai str. 56601
cuauuauaauauauauaaa

SEQ ID NO: 2787882 - RNA, 14 nt, Leptospira interrogans serovar lai str. 56601
cuauucauaaauga

SEQ ID NO: 2787883 - RNA, 16 nt, Leptospira interrogans serovar lai str. 56601
cuauucuacagauaaa

SEQ ID NO: 2787884 - RNA, 18 nt, Leptospira interrogans serovar lai str. 56601
cuauucuacagauaaaaa

SEQ ID NO: 2787885 - RNA, 20 nt, Leptospira interrogans serovar lai str. 56601
cuauucuacagauaaaaaua

SEQ ID NO: 2787886 - RNA, 16 nt, Leptospira interrogans serovar lai str. 56601
cuauugcagauaagua

SEQ ID NO: 2787887 - RNA, 22 nt, Leptospira interrogans serovar lai str. 56601
cuauugcuuuaucuuuauaaaa

SEQ ID NO: 2787888 - RNA, 14 nt, Leptospira interrogans serovar lai str. 56601
cuauuguaauaaau

SEQ ID NO: 2787889 - RNA, 20 nt, Leptospira interrogans serovar lai str. 56601
cuauuuauaaaauaaaaaaa

SEQ ID NO: 2787890 - RNA, 11 nt, Leptospira interrogans serovar lai str. 56601
cuauuuauacg

SEQ ID NO: 2787891 - RNA, 20 nt, Leptospira interrogans serovar lai str. 56601
cuauuucaguucauucccuu

SEQ ID NO: 2787892 - RNA, 20 nt, Leptospira interrogans serovar lai str. 56601
cuauuuccguuauauuaaaa

SEQ ID NO: 2787893 - RNA, 19 nt, Leptospira interrogans serovar lai str. 56601
cuauuuuacugauuuagag

SEQ ID NO: 2787894 - RNA, 22 nt, Leptospira interrogans serovar lai str. 56601
cuauuuuacugauuuagagagu

SEQ ID NO: 2787895 - RNA, 12 nt, Leptospira interrogans serovar lai str. 56601
cuauuuuauaau

SEQ ID NO: 2787896 - RNA, 16 nt, Leptospira interrogans serovar lai str. 56601
cuauuuuauuuuucuu

SEQ ID NO: 2787897 - RNA, 15 nt, Leptospira interrogans serovar lai str. 56601
cuauuuugagaaaau

SEQ ID NO: 2787898 - RNA, 17 nt, Leptospira interrogans serovar lai str. 56601
cuauuuuguuuuauaga

SEQ ID NO: 2787899 - RNA, 21 nt, Leptospira interrogans serovar lai str. 56601
cuauuuuugagaugauuuaua

SEQ ID NO: 2787900 - RNA, 13 nt, Leptospira interrogans serovar lai str. 56601
cuauuuuuuuaaa

SEQ ID NO: 2787901 - RNA, 17 nt, Leptospira interrogans serovar lai str. 56601
cuauuuuuuuaaaaaau

SEQ ID NO: 2787902 - RNA, 12 nt, Leptospira interrogans serovar lai str. 56601
cuauuuuuuucg

SEQ ID NO: 2787903 - RNA, 23 nt, Leptospira interrogans serovar lai str. 56601
cucaaaaaauuuacacgauaauu

SEQ ID NO: 2787904 - RNA, 21 nt, Leptospira interrogans serovar lai str. 56601
cucaaaaaauuuuacgcaauc

SEQ ID NO: 2787905 - RNA, 19 nt, Leptospira interrogans serovar lai str. 56601
cucaaaaaggcacauuuuu

SEQ ID NO: 2787906 - RNA, 20 nt, Leptospira interrogans serovar lai str. 56601
cucaaaaaggcacauuuuuc

SEQ ID NO: 2787907 - RNA, 20 nt, Leptospira interrogans serovar lai str. 56601
cuccgauaauuguagaagca

SEQ ID NO: 2787908 - RNA, 16 nt, Leptospira interrogans serovar lai str. 56601
cuccgcucuauuucca

SEQ ID NO: 2787909 - RNA, 18 nt, Leptospira interrogans serovar lai str. 56601
cuccguuaugcaugaauu

SEQ ID NO: 2787910 - RNA, 22 nt, Leptospira interrogans serovar lai str. 56601
cuccguuaugcaugaauuuguu

SEQ ID NO: 2787911 - RNA, 13 nt, Leptospira interrogans serovar lai str. 56601
cuccuacauuuua

SEQ ID NO: 2787912 - RNA, 14 nt, Leptospira interrogans serovar lai str. 56601
cuccuauguuucuu

SEQ ID NO: 2787913 - RNA, 20 nt, Leptospira interrogans serovar lai str. 56601
cuccuauguuucuuguguca

SEQ ID NO: 2787914 - RNA, 16 nt, Leptospira interrogans serovar lai str. 56601
cuccuccugaaaauuu

SEQ ID NO: 2787915 - RNA, 12 nt, Leptospira interrogans serovar lai str. 56601
cuccuccuucuc

SEQ ID NO: 2787916 - RNA, 17 nt, Leptospira interrogans serovar lai str. 56601
cuccugaaaauuuuccu

SEQ ID NO: 2787917 - RNA, 20 nt, Leptospira interrogans serovar lai str. 56601
cuccugaaaauuuuccuuua

SEQ ID NO: 2787918 - RNA, 17 nt, Leptospira interrogans serovar lai str. 56601
cuccugucaauuuucca

SEQ ID NO: 2787919 - RNA, 22 nt, Leptospira interrogans serovar lai str. 56601
cuccuuuuucaaaauaagaauu

SEQ ID NO: 2787920 - RNA, 15 nt, Leptospira interrogans serovar lai str. 56601
cuccuuuuuuauuuu

SEQ ID NO: 2787921 - RNA, 14 nt, Leptospira interrogans serovar lai str. 56601
cucgaaaaucucag

SEQ ID NO: 2787922 - RNA, 15 nt, Leptospira interrogans serovar lai str. 56601
cucgaaaaucucaga

SEQ ID NO: 2787923 - RNA, 19 nt, Leptospira interrogans serovar lai str. 56601
cucgaaaccauacaauaaa

SEQ ID NO: 2787924 - RNA, 21 nt, Leptospira interrogans serovar lai str. 56601
cucgaaauaucguucuagaau

SEQ ID NO: 2787925 - RNA, 12 nt, Leptospira interrogans serovar lai str. 56601
cucgaaaugaga

SEQ ID NO: 2787926 - RNA, 19 nt, Leptospira interrogans serovar lai str. 56601
cucgaaaugagauuuuguc

SEQ ID NO: 2787927 - RNA, 14 nt, Leptospira interrogans serovar lai str. 56601
cucgaacuucguug

SEQ ID NO: 2787928 - RNA, 14 nt, Leptospira interrogans serovar lai str. 56601
cucgaauuuauaua

SEQ ID NO: 2787929 - RNA, 16 nt, Leptospira interrogans serovar lai str. 56601
cucgaauuuuuuucag

SEQ ID NO: 2787930 - RNA, 14 nt, Leptospira interrogans serovar lai str. 56601
cucgacaaaacacu

SEQ ID NO: 2787931 - RNA, 15 nt, Leptospira interrogans serovar lai str. 56601
cucgcauuuuccuuu

SEQ ID NO: 2787932 - RNA, 20 nt, Leptospira interrogans serovar lai str. 56601
cucgcauuuuccuuuuuccg

SEQ ID NO: 2787933 - RNA, 19 nt, Leptospira interrogans serovar lai str. 56601
cucgccauuaucgaacagu

SEQ ID NO: 2787934 - RNA, 22 nt, Leptospira interrogans serovar lai str. 56601
cucggaauauuuuuuccaaaaa

SEQ ID NO: 2787935 - RNA, 15 nt, Leptospira interrogans serovar lai str. 56601
cucggaguauauaau

SEQ ID NO: 2787936 - RNA, 14 nt, Leptospira interrogans serovar lai str. 56601
cucgguguaaaaaa

SEQ ID NO: 2787937 - RNA, 19 nt, Leptospira interrogans serovar lai str. 56601
cucguaauaucuaaaaccu

SEQ ID NO: 2787938 - RNA, 14 nt, Leptospira interrogans serovar lai str. 56601
cucguacuaauucu

SEQ ID NO: 2787939 - RNA, 16 nt, Leptospira interrogans serovar lai str. 56601
cucguauugaauuuuu

SEQ ID NO: 2787940 - RNA, 18 nt, Leptospira interrogans serovar lai str. 56601
cucguauugaauuuuuuc

SEQ ID NO: 2787941 - RNA, 20 nt, Leptospira interrogans serovar lai str. 56601
cucguauugaauuuuuucgu

SEQ ID NO: 2787942 - RNA, 14 nt, Leptospira interrogans serovar lai str. 56601
cucgucuaucuuuu

SEQ ID NO: 2787943 - RNA, 14 nt, Leptospira interrogans serovar lai str. 56601
cucgucuuuauaaa

SEQ ID NO: 2787944 - RNA, 15 nt, Leptospira interrogans serovar lai str. 56601
cucguuauuuaggau

SEQ ID NO: 2787945 - RNA, 19 nt, Leptospira interrogans serovar lai str. 56601
cucguucaacuuuccuuuu

SEQ ID NO: 2787946 - RNA, 15 nt, Leptospira interrogans serovar lai str. 56601
cucguuuuuaggauu

SEQ ID NO: 2787947 - RNA, 20 nt, Leptospira interrogans serovar lai str. 56601
cucuaaaaaucggcauucaa

SEQ ID NO: 2787948 - RNA, 16 nt, Leptospira interrogans serovar lai str. 56601
cucuaaaauaauuuuu

SEQ ID NO: 2787949 - RNA, 21 nt, Leptospira interrogans serovar lai str. 56601
cucuaaagaucggcauucagg

SEQ ID NO: 2787950 - RNA, 17 nt, Leptospira interrogans serovar lai str. 56601
cucuaaaugacuugcau

SEQ ID NO: 2787951 - RNA, 23 nt, Leptospira interrogans serovar lai str. 56601
cucuaauauuuuaaagaaacuca

SEQ ID NO: 2787952 - RNA, 13 nt, Leptospira interrogans serovar lai str. 56601
cucuaauuuuuua

SEQ ID NO: 2787953 - RNA, 18 nt, Leptospira interrogans serovar lai str. 56601
cucuaguaaagaaacucg

SEQ ID NO: 2787954 - RNA, 14 nt, Leptospira interrogans serovar lai str. 56601
cucuauaaaaguaa

SEQ ID NO: 2787955 - RNA, 15 nt, Leptospira interrogans serovar lai str. 56601
cucuauaaaaucaag

SEQ ID NO: 2787956 - RNA, 19 nt, Leptospira interrogans serovar lai str. 56601
cucuauaaaaucuaaaaaa

SEQ ID NO: 2787957 - RNA, 19 nt, Leptospira interrogans serovar lai str. 56601
cucuauagauugauuuaaa

SEQ ID NO: 2787958 - RNA, 18 nt, Leptospira interrogans serovar lai str. 56601
cucuaucagaaaaacaua

SEQ ID NO: 2787959 - RNA, 13 nt, Leptospira interrogans serovar lai str. 56601
cucuauggaauuu

SEQ ID NO: 2787960 - RNA, 14 nt, Leptospira interrogans serovar lai str. 56601
cucuauggguuuuc

SEQ ID NO: 2787961 - RNA, 16 nt, Leptospira interrogans serovar lai str. 56601
cucuauguaagaaaau

SEQ ID NO: 2787962 - RNA, 19 nt, Leptospira interrogans serovar lai str. 56601
cucuauucauaaaugauaa

SEQ ID NO: 2787963 - RNA, 13 nt, Leptospira interrogans serovar lai str. 56601
cucuauuuaagua

SEQ ID NO: 2787964 - RNA, 17 nt, Leptospira interrogans serovar lai str. 56601
cucuauuucaguucauu

SEQ ID NO: 2787965 - RNA, 15 nt, Leptospira interrogans serovar lai str. 56601
cucucacaaaucgug

SEQ ID NO: 2787966 - RNA, 19 nt, Leptospira interrogans serovar lai str. 56601
cucuccuauguuucuugug

SEQ ID NO: 2787967 - RNA, 17 nt, Leptospira interrogans serovar lai str. 56601
cucucuuguaguucaau

SEQ ID NO: 2787968 - RNA, 16 nt, Leptospira interrogans serovar lai str. 56601
cucugaaaagaaacag

SEQ ID NO: 2787969 - RNA, 23 nt, Leptospira interrogans serovar lai str. 56601
cucugaagcccgaguauucuuaa

SEQ ID NO: 2787970 - RNA, 14 nt, Leptospira interrogans serovar lai str. 56601
cucugaauucacau

SEQ ID NO: 2787971 - RNA, 21 nt, Leptospira interrogans serovar lai str. 56601
cucugagucuagaauucuuug

SEQ ID NO: 2787972 - RNA, 17 nt, Leptospira interrogans serovar lai str. 56601
cucugcuauuauaaucu

SEQ ID NO: 2787973 - RNA, 14 nt, Leptospira interrogans serovar lai str. 56601
cucugggaucggaa

SEQ ID NO: 2787974 - RNA, 21 nt, Leptospira interrogans serovar lai str. 56601
cucuggucaaguuauuguaaa

SEQ ID NO: 2787975 - RNA, 14 nt, Leptospira interrogans serovar lai str. 56601
cucuguaaauacaa

SEQ ID NO: 2787976 - RNA, 13 nt, Leptospira interrogans serovar lai str. 56601
cucugugaaacuc

SEQ ID NO: 2787977 - RNA, 22 nt, Leptospira interrogans serovar lai str. 56601
cucuguucaguguaagauuaac

SEQ ID NO: 2787978 - RNA, 21 nt, Leptospira interrogans serovar lai str. 56601
cucuuaaaauuuagaaauaga

SEQ ID NO: 2787979 - RNA, 13 nt, Leptospira interrogans serovar lai str. 56601
cucuuacauuuug

SEQ ID NO: 2787980 - RNA, 14 nt, Leptospira interrogans serovar lai str. 56601
cucuuauaaaauuu

SEQ ID NO: 2787981 - RNA, 22 nt, Leptospira interrogans serovar lai str. 56601
cucuuccgguggauuuuuuuau

SEQ ID NO: 2787982 - RNA, 19 nt, Leptospira interrogans serovar lai str. 56601
cucuucuaauucaguuuuu

SEQ ID NO: 2787983 - RNA, 20 nt, Leptospira interrogans serovar lai str. 56601
cucuucuaauucaguuuuuc

SEQ ID NO: 2787984 - RNA, 14 nt, Leptospira interrogans serovar lai str. 56601
cucuucucccauca

SEQ ID NO: 2787985 - RNA, 23 nt, Leptospira interrogans serovar lai str. 56601
cucuugaacagaaagaucaugaa

SEQ ID NO: 2787986 - RNA, 17 nt, Leptospira interrogans serovar lai str. 56601
cucuugcgguucuugcu

SEQ ID NO: 2787987 - RNA, 23 nt, Leptospira interrogans serovar lai str. 56601
cucuugcuaaaauuuuuuuaaga

SEQ ID NO: 2787988 - RNA, 13 nt, Leptospira interrogans serovar lai str. 56601
cucuuuauauaaa

SEQ ID NO: 2787989 - RNA, 18 nt, Leptospira interrogans serovar lai str. 56601
cucuuucguuuuuuucau

SEQ ID NO: 2787990 - RNA, 14 nt, Leptospira interrogans serovar lai str. 56601
cuggaagccaaaac

SEQ ID NO: 2787991 - RNA, 16 nt, Leptospira interrogans serovar lai str. 56601
cuggaagccaaaacca

SEQ ID NO: 2787992 - RNA, 13 nt, Leptospira interrogans serovar lai str. 56601
cuggaauucuuuu

SEQ ID NO: 2787993 - RNA, 16 nt, Leptospira interrogans serovar lai str. 56601
cuggacggucguuuuc

SEQ ID NO: 2787994 - RNA, 17 nt, Leptospira interrogans serovar lai str. 56601
cuggauauauagaagcc

SEQ ID NO: 2787995 - RNA, 17 nt, Leptospira interrogans serovar lai str. 56601
cuggauuuguaauaguu

SEQ ID NO: 2787996 - RNA, 19 nt, Leptospira interrogans serovar lai str. 56601
cuggauuuugaucuuuuuu

SEQ ID NO: 2787997 - RNA, 13 nt, Leptospira interrogans serovar lai str. 56601
cugggaucggaac

SEQ ID NO: 2787998 - RNA, 14 nt, Leptospira interrogans serovar lai str. 56601
cugggcuccaaaag

SEQ ID NO: 2787999 - RNA, 20 nt, Leptospira interrogans serovar lai str. 56601
cuggggacuuuauuuuauaa

SEQ ID NO: 2788000 - RNA, 17 nt, Leptospira interrogans serovar lai str. 56601
cuggguaaaaaaaaaug

SEQ ID NO: 2788001 - RNA, 19 nt, Leptospira interrogans serovar lai str. 56601
cuggguaaaaaaaaaugag

SEQ ID NO: 2788002 - RNA, 22 nt, Leptospira interrogans serovar lai str. 56601
cuggguaaaaaaaaaugagaaa

SEQ ID NO: 2788003 - RNA, 16 nt, Leptospira interrogans serovar lai str. 56601
cugguuccauaaagac

SEQ ID NO: 2788004 - RNA, 19 nt, Leptospira interrogans serovar lai str. 56601
cugguuuauuuuugaauuu

SEQ ID NO: 2788005 - RNA, 22 nt, Leptospira interrogans serovar lai str. 56601
cugguuuauuuuugaauuuuuu

SEQ ID NO: 2788006 - RNA, 16 nt, Leptospira interrogans serovar lai str. 56601
cugguuucaaaaaauc

SEQ ID NO: 2788007 - RNA, 14 nt, Leptospira interrogans serovar lai str. 56601
cugguuuuauuucu

SEQ ID NO: 2788008 - RNA, 15 nt, Leptospira interrogans serovar lai str. 56601
cuguaaaaaauaaac

SEQ ID NO: 2788009 - RNA, 16 nt, Leptospira interrogans serovar lai str. 56601
cuguaaaacuuaguuc

SEQ ID NO: 2788010 - RNA, 18 nt, Leptospira interrogans serovar lai str. 56601
cuguaaaacuuaguuccc

SEQ ID NO: 2788011 - RNA, 20 nt, Leptospira interrogans serovar lai str. 56601
cuguaaaacuuaguucccgc

SEQ ID NO: 2788012 - RNA, 13 nt, Leptospira interrogans serovar lai str. 56601
cuguaaaagaaaa

SEQ ID NO: 2788013 - RNA, 17 nt, Leptospira interrogans serovar lai str. 56601
cuguaaaagaaaaauua

SEQ ID NO: 2788014 - RNA, 12 nt, Leptospira interrogans serovar lai str. 56601
cuguaaaaguuu

SEQ ID NO: 2788015 - RNA, 18 nt, Leptospira interrogans serovar lai str. 56601
cuguaaaauaaauuuaua

SEQ ID NO: 2788016 - RNA, 23 nt, Leptospira interrogans serovar lai str. 56601
cuguaaaaugauguaggaacuac

SEQ ID NO: 2788017 - RNA, 23 nt, Leptospira interrogans serovar lai str. 56601
cuguaaaaugaugugggaacuau

SEQ ID NO: 2788018 - RNA, 14 nt, Leptospira interrogans serovar lai str. 56601
cuguaaaguuuaga

SEQ ID NO: 2788019 - RNA, 12 nt, Leptospira interrogans serovar lai str. 56601
cuguaaaucaac

SEQ ID NO: 2788020 - RNA, 17 nt, Leptospira interrogans serovar lai str. 56601
cuguaaauuagauuauu

SEQ ID NO: 2788021 - RNA, 21 nt, Leptospira interrogans serovar lai str. 56601
cuguaaauucaaaauaagaaa

SEQ ID NO: 2788022 - RNA, 19 nt, Leptospira interrogans serovar lai str. 56601
cuguaacauccaaacucuu

SEQ ID NO: 2788023 - RNA, 19 nt, Leptospira interrogans serovar lai str. 56601
cuguagaaauucuauuuua

SEQ ID NO: 2788024 - RNA, 14 nt, Leptospira interrogans serovar lai str. 56601
cuguaguauuucca

SEQ ID NO: 2788025 - RNA, 16 nt, Leptospira interrogans serovar lai str. 56601
cuguaguuuauuuuuc

SEQ ID NO: 2788026 - RNA, 15 nt, Leptospira interrogans serovar lai str. 56601
cuguauuuuuaaguu

SEQ ID NO: 2788027 - RNA, 23 nt, Leptospira interrogans serovar lai str. 56601
cugucaagcgacgauagaagcga

SEQ ID NO: 2788028 - RNA, 14 nt, Leptospira interrogans serovar lai str. 56601
cugucaauuuucca

SEQ ID NO: 2788029 - RNA, 17 nt, Leptospira interrogans serovar lai str. 56601
cugucauaaaccgauuu

SEQ ID NO: 2788030 - RNA, 21 nt, Leptospira interrogans serovar lai str. 56601
cugucauaaaccgauuuuccc

SEQ ID NO: 2788031 - RNA, 14 nt, Leptospira interrogans serovar lai str. 56601
cugugggaacucuc

SEQ ID NO: 2788032 - RNA, 12 nt, Leptospira interrogans serovar lai str. 56601
cuguguucuuuu

SEQ ID NO: 2788033 - RNA, 15 nt, Leptospira interrogans serovar lai str. 56601
cuguuaaucagagca

SEQ ID NO: 2788034 - RNA, 15 nt, Leptospira interrogans serovar lai str. 56601
cuguuacggauucgu

SEQ ID NO: 2788035 - RNA, 23 nt, Leptospira interrogans serovar lai str. 56601
cuguuacggauucguaaaaaccg

SEQ ID NO: 2788036 - RNA, 18 nt, Leptospira interrogans serovar lai str. 56601
cuguuauccgauuuuugu

SEQ ID NO: 2788037 - RNA, 14 nt, Leptospira interrogans serovar lai str. 56601
cuguugaaaaaauc

SEQ ID NO: 2788038 - RNA, 18 nt, Leptospira interrogans serovar lai str. 56601
cuguuguuaaauuuuugu

SEQ ID NO: 2788039 - RNA, 14 nt, Leptospira interrogans serovar lai str. 56601
cuguuuaauaaaga

SEQ ID NO: 2788040 - RNA, 14 nt, Leptospira interrogans serovar lai str. 56601
cuguuuauuuugaa

SEQ ID NO: 2788041 - RNA, 22 nt, Leptospira interrogans serovar lai str. 56601
cuguuuccaguguccauuucaa

SEQ ID NO: 2788042 - RNA, 15 nt, Leptospira interrogans serovar lai str. 56601
cuguuuuaauuugua

SEQ ID NO: 2788043 - RNA, 22 nt, Leptospira interrogans serovar lai str. 56601
cuguuuucuuugaauugaaaug

SEQ ID NO: 2788044 - RNA, 13 nt, Leptospira interrogans serovar lai str. 56601
cuuaaaaaaauga

SEQ ID NO: 2788045 - RNA, 13 nt, Leptospira interrogans serovar lai str. 56601
cuuaaaaaaauug

SEQ ID NO: 2788046 - RNA, 14 nt, Leptospira interrogans serovar lai str. 56601
cuuaaaaaauauuu

SEQ ID NO: 2788047 - RNA, 23 nt, Leptospira interrogans serovar lai str. 56601
cuuaaaaaugagucuuuacucua

SEQ ID NO: 2788048 - RNA, 12 nt, Leptospira interrogans serovar lai str. 56601
cuuaaaacugua

SEQ ID NO: 2788049 - RNA, 18 nt, Leptospira interrogans serovar lai str. 56601
cuuaaaagaagauuuuuc

SEQ ID NO: 2788050 - RNA, 19 nt, Leptospira interrogans serovar lai str. 56601
cuuaaaagaagauuuuucu

SEQ ID NO: 2788051 - RNA, 20 nt, Leptospira interrogans serovar lai str. 56601
cuuaaaagaagauuuuucuu

SEQ ID NO: 2788052 - RNA, 12 nt, Leptospira interrogans serovar lai str. 56601
cuuaaaagugau

SEQ ID NO: 2788053 - RNA, 19 nt, Leptospira interrogans serovar lai str. 56601
cuuaaaauguaggaacuac

SEQ ID NO: 2788054 - RNA, 19 nt, Leptospira interrogans serovar lai str. 56601
cuuaaaaugugggaauuac

SEQ ID NO: 2788055 - RNA, 12 nt, Leptospira interrogans serovar lai str. 56601
cuuaaaauuuag

SEQ ID NO: 2788056 - RNA, 17 nt, Leptospira interrogans serovar lai str. 56601
cuuaaaauuugaaaaga

SEQ ID NO: 2788057 - RNA, 16 nt, Leptospira interrogans serovar lai str. 56601
cuuaaacguauaaaaa

SEQ ID NO: 2788058 - RNA, 22 nt, Leptospira interrogans serovar lai str. 56601
cuuaaagcauuaaaaaagauaa

SEQ ID NO: 2788059 - RNA, 14 nt, Leptospira interrogans serovar lai str. 56601
cuuaaauaaaauuu

SEQ ID NO: 2788060 - RNA, 14 nt, Leptospira interrogans serovar lai str. 56601
cuuaaauacuuaaa

SEQ ID NO: 2788061 - RNA, 12 nt, Leptospira interrogans serovar lai str. 56601
cuuaaaucaauc

SEQ ID NO: 2788062 - RNA, 20 nt, Leptospira interrogans serovar lai str. 56601
cuuaaaucuuagauucacuu

SEQ ID NO: 2788063 - RNA, 19 nt, Leptospira interrogans serovar lai str. 56601
cuuaaaucuuuaaaauacu

SEQ ID NO: 2788064 - RNA, 16 nt, Leptospira interrogans serovar lai str. 56601
cuuaaauucuaaaaaa

SEQ ID NO: 2788065 - RNA, 18 nt, Leptospira interrogans serovar lai str. 56601
cuuaaauucuaaaaaaau

SEQ ID NO: 2788066 - RNA, 19 nt, Leptospira interrogans serovar lai str. 56601
cuuaaauucuaaaaaaaua

SEQ ID NO: 2788067 - RNA, 20 nt, Leptospira interrogans serovar lai str. 56601
cuuaacuuuaagcaaagauu

SEQ ID NO: 2788068 - RNA, 20 nt, Leptospira interrogans serovar lai str. 56601
cuuaagagaaccucuauaaa

SEQ ID NO: 2788069 - RNA, 20 nt, Leptospira interrogans serovar lai str. 56601
cuuaaggaaauucauuuuuc

SEQ ID NO: 2788070 - RNA, 21 nt, Leptospira interrogans serovar lai str. 56601
cuuaaggaaauucauuuuucu

SEQ ID NO: 2788071 - RNA, 16 nt, Leptospira interrogans serovar lai str. 56601
cuuaaguuucaaguuu

SEQ ID NO: 2788072 - RNA, 15 nt, Leptospira interrogans serovar lai str. 56601
cuuaauaaaauuuuc

SEQ ID NO: 2788073 - RNA, 13 nt, Leptospira interrogans serovar lai str. 56601
cuuccaaagauuu

SEQ ID NO: 2788074 - RNA, 17 nt, Leptospira interrogans serovar lai str. 56601
cuuccacaucuuuuuuc

SEQ ID NO: 2788075 - RNA, 19 nt, Leptospira interrogans serovar lai str. 56601
cuuccaucaaauacaaaau

SEQ ID NO: 2788076 - RNA, 20 nt, Leptospira interrogans serovar lai str. 56601
cuuccauuggauucugcucu

SEQ ID NO: 2788077 - RNA, 13 nt, Leptospira interrogans serovar lai str. 56601
cuuccauuuuuua

SEQ ID NO: 2788078 - RNA, 23 nt, Leptospira interrogans serovar lai str. 56601
cuucccagacguaucaaaauagu

SEQ ID NO: 2788079 - RNA, 21 nt, Leptospira interrogans serovar lai str. 56601
cuucccucgaaaucugaccuc

SEQ ID NO: 2788080 - RNA, 14 nt, Leptospira interrogans serovar lai str. 56601
cuuccgaucccaac

SEQ ID NO: 2788081 - RNA, 17 nt, Leptospira interrogans serovar lai str. 56601
cuuccugauuuggaauc

SEQ ID NO: 2788082 - RNA, 22 nt, Leptospira interrogans serovar lai str. 56601
cuuccugauuuggaaucugcau

SEQ ID NO: 2788083 - RNA, 24 nt, Leptospira interrogans serovar lai str. 56601
cuuccugauuuggaaucugcaucu

SEQ ID NO: 2788084 - RNA, 12 nt, Leptospira interrogans serovar lai str. 56601
cuuccuucuuga

SEQ ID NO: 2788085 - RNA, 18 nt, Leptospira interrogans serovar lai str. 56601
cuuccuuuuucauuuuua

SEQ ID NO: 2788086 - RNA, 19 nt, Leptospira interrogans serovar lai str. 56601
cuuccuuuuucauuuuuaa

SEQ ID NO: 2788087 - RNA, 23 nt, Leptospira interrogans serovar lai str. 56601
cuucgauuaucgguuucaucuuu

SEQ ID NO: 2788088 - RNA, 14 nt, Leptospira interrogans serovar lai str. 56601
cuucgccuauuuuu

SEQ ID NO: 2788089 - RNA, 20 nt, Leptospira interrogans serovar lai str. 56601
cuucgugaaaugguaccaua

SEQ ID NO: 2788090 - RNA, 10 nt, Leptospira interrogans serovar lai str. 56601
cuucuaauga

SEQ ID NO: 2788091 - RNA, 18 nt, Leptospira interrogans serovar lai str. 56601
cuucuaauucaguuuuuc

SEQ ID NO: 2788092 - RNA, 15 nt, Leptospira interrogans serovar lai str. 56601
cuucuauuuuuuaau

SEQ ID NO: 2788093 - RNA, 23 nt, Leptospira interrogans serovar lai str. 56601
cuucuccucuuccggaagaacaa

SEQ ID NO: 2788094 - RNA, 22 nt, Leptospira interrogans serovar lai str. 56601
cuucucgcaacggauuccucca

SEQ ID NO: 2788095 - RNA, 21 nt, Leptospira interrogans serovar lai str. 56601
cuucugaaaguaguauucuuu

SEQ ID NO: 2788096 - RNA, 13 nt, Leptospira interrogans serovar lai str. 56601
cuucuggaaaaau

SEQ ID NO: 2788097 - RNA, 19 nt, Leptospira interrogans serovar lai str. 56601
cuucuucaauguuauaaaa

SEQ ID NO: 2788098 - RNA, 13 nt, Leptospira interrogans serovar lai str. 56601
cuucuuuacaauu

SEQ ID NO: 2788099 - RNA, 19 nt, Leptospira interrogans serovar lai str. 56601
cuucuuuuuucuaaauaau

SEQ ID NO: 2788100 - RNA, 23 nt, Leptospira interrogans serovar lai str. 56601
cuugaaaaagcggucuugaaaau

SEQ ID NO: 2788101 - RNA, 12 nt, Leptospira interrogans serovar lai str. 56601
cuugaaacccca

SEQ ID NO: 2788102 - RNA, 19 nt, Leptospira interrogans serovar lai str. 56601
cuugaaacuuuuaauaaaa

SEQ ID NO: 2788103 - RNA, 17 nt, Leptospira interrogans serovar lai str. 56601
cuugaaccauuugaaaa

SEQ ID NO: 2788104 - RNA, 20 nt, Leptospira interrogans serovar lai str. 56601
cuugaacucaauguugcucc

SEQ ID NO: 2788105 - RNA, 16 nt, Leptospira interrogans serovar lai str. 56601
cuugaauagaaccuuu

SEQ ID NO: 2788106 - RNA, 23 nt, Leptospira interrogans serovar lai str. 56601
cuugaauagaaccuuuugaagua

SEQ ID NO: 2788107 - RNA, 14 nt, Leptospira interrogans serovar lai str. 56601
cuugaaucaaauaa

SEQ ID NO: 2788108 - RNA, 13 nt, Leptospira interrogans serovar lai str. 56601
cuugaccucauau

SEQ ID NO: 2788109 - RNA, 16 nt, Leptospira interrogans serovar lai str. 56601
cuugagaaaucauuuu

SEQ ID NO: 2788110 - RNA, 20 nt, Leptospira interrogans serovar lai str. 56601
cuugagaagggugaauuuuu

SEQ ID NO: 2788111 - RNA, 20 nt, Leptospira interrogans serovar lai str. 56601
cuugagauuccuuuuaagaa

SEQ ID NO: 2788112 - RNA, 18 nt, Leptospira interrogans serovar lai str. 56601
cuugagggguuuuuccuu

SEQ ID NO: 2788113 - RNA, 19 nt, Leptospira interrogans serovar lai str. 56601
cuugagggguuuuuccuuu

SEQ ID NO: 2788114 - RNA, 21 nt, Leptospira interrogans serovar lai str. 56601
cuugaguguaaguuuuuaaau

SEQ ID NO: 2788115 - RNA, 19 nt, Leptospira interrogans serovar lai str. 56601
cuugauauuucuguaaaaa

SEQ ID NO: 2788116 - RNA, 23 nt, Leptospira interrogans serovar lai str. 56601
cuugauuugagaaucuucauuuu

SEQ ID NO: 2788117 - RNA, 15 nt, Leptospira interrogans serovar lai str. 56601
cuugcaaaaauagaa

SEQ ID NO: 2788118 - RNA, 15 nt, Leptospira interrogans serovar lai str. 56601
cuugccauuuccaau

SEQ ID NO: 2788119 - RNA, 22 nt, Leptospira interrogans serovar lai str. 56601
cuugcggauuccauucuucaaa

SEQ ID NO: 2788120 - RNA, 15 nt, Leptospira interrogans serovar lai str. 56601
cuugcuaaaauuuuu

SEQ ID NO: 2788121 - RNA, 23 nt, Leptospira interrogans serovar lai str. 56601
cuugcugucgcaacauaauguuu

SEQ ID NO: 2788122 - RNA, 14 nt, Leptospira interrogans serovar lai str. 56601
cuuggaaauaucua

SEQ ID NO: 2788123 - RNA, 15 nt, Leptospira interrogans serovar lai str. 56601
cuugggauaaauauu

SEQ ID NO: 2788124 - RNA, 16 nt, Leptospira interrogans serovar lai str. 56601
cuuggugauaaucauc

SEQ ID NO: 2788125 - RNA, 20 nt, Leptospira interrogans serovar lai str. 56601
cuuggugauaaucaucaaaa

SEQ ID NO: 2788126 - RNA, 22 nt, Leptospira interrogans serovar lai str. 56601
cuuguagauugauccagauucc

SEQ ID NO: 2788127 - RNA, 16 nt, Leptospira interrogans serovar lai str. 56601
cuuguauaagaaauga

SEQ ID NO: 2788128 - RNA, 18 nt, Leptospira interrogans serovar lai str. 56601
cuuguauuuuauuuuugg

SEQ ID NO: 2788129 - RNA, 15 nt, Leptospira interrogans serovar lai str. 56601
cuugucacuauuuuu

SEQ ID NO: 2788130 - RNA, 18 nt, Leptospira interrogans serovar lai str. 56601
cuugucccaaaaacucaa

SEQ ID NO: 2788131 - RNA, 21 nt, Leptospira interrogans serovar lai str. 56601
cuugucccaaaaacucaaaga

SEQ ID NO: 2788132 - RNA, 13 nt, Leptospira interrogans serovar lai str. 56601
cuugucccaaaau

SEQ ID NO: 2788133 - RNA, 17 nt, Leptospira interrogans serovar lai str. 56601
cuugucccaaaauuuua

SEQ ID NO: 2788134 - RNA, 20 nt, Leptospira interrogans serovar lai str. 56601
cuugucccgaaaccucaaaa

SEQ ID NO: 2788135 - RNA, 19 nt, Leptospira interrogans serovar lai str. 56601
cuugugcaauaauuuuuug

SEQ ID NO: 2788136 - RNA, 16 nt, Leptospira interrogans serovar lai str. 56601
cuugugucaagcccuc

SEQ ID NO: 2788137 - RNA, 17 nt, Leptospira interrogans serovar lai str. 56601
cuugugucaagcccucc

SEQ ID NO: 2788138 - RNA, 18 nt, Leptospira interrogans serovar lai str. 56601
cuugugucaagcccuccc

SEQ ID NO: 2788139 - RNA, 18 nt, Leptospira interrogans serovar lai str. 56601
cuugugucaagcccuccu

SEQ ID NO: 2788140 - RNA, 16 nt, Leptospira interrogans serovar lai str. 56601
cuuguuaaaauaaaaa

SEQ ID NO: 2788141 - RNA, 21 nt, Leptospira interrogans serovar lai str. 56601
cuuguuaaaauaaaaaaauug

SEQ ID NO: 2788142 - RNA, 13 nt, Leptospira interrogans serovar lai str. 56601
cuuguuuuuaaau

SEQ ID NO: 2788143 - RNA, 15 nt, Leptospira interrogans serovar lai str. 56601
cuuguuuuuaaauua

SEQ ID NO: 2788144 - RNA, 13 nt, Leptospira interrogans serovar lai str. 56601
cuuuaaaaaauaa

SEQ ID NO: 2788145 - RNA, 17 nt, Leptospira interrogans serovar lai str. 56601
cuuuaaaaauaggaauu

SEQ ID NO: 2788146 - RNA, 15 nt, Leptospira interrogans serovar lai str. 56601
cuuuaaaauacuuua

SEQ ID NO: 2788147 - RNA, 13 nt, Leptospira interrogans serovar lai str. 56601
cuuuaaaauuuuu

SEQ ID NO: 2788148 - RNA, 15 nt, Leptospira interrogans serovar lai str. 56601
cuuuaaaauuuuuaa

SEQ ID NO: 2788149 - RNA, 18 nt, Leptospira interrogans serovar lai str. 56601
cuuuaaaguaaaauuaaa

SEQ ID NO: 2788150 - RNA, 13 nt, Leptospira interrogans serovar lai str. 56601
cuuuaaauacuuu

SEQ ID NO: 2788151 - RNA, 19 nt, Leptospira interrogans serovar lai str. 56601
cuuuaaaugugggaacuac

SEQ ID NO: 2788152 - RNA, 19 nt, Leptospira interrogans serovar lai str. 56601
cuuuaaauugaauucuucc

SEQ ID NO: 2788153 - RNA, 21 nt, Leptospira interrogans serovar lai str. 56601
cuuuaaauugaauucuuccuu

SEQ ID NO: 2788154 - RNA, 22 nt, Leptospira interrogans serovar lai str. 56601
cuuuaaauugaauucuuccuuc

SEQ ID NO: 2788155 - RNA, 17 nt, Leptospira interrogans serovar lai str. 56601
cuuuaacaacaucugaa

SEQ ID NO: 2788156 - RNA, 23 nt, Leptospira interrogans serovar lai str. 56601
cuuugcagacugauucuuuaaau

SEQ ID NO: 2788157 - RNA, 15 nt, Leptospira interrogans serovar lai str. 56601
cuuuggaaauuuuua

SEQ ID NO: 2788158 - RNA, 18 nt, Leptospira interrogans serovar lai str. 56601
cuuuggaaauuuuuaaua

SEQ ID NO: 2788159 - RNA, 16 nt, Leptospira interrogans serovar lai str. 56601
cuuuggaauuggcuuc

SEQ ID NO: 2788160 - RNA, 19 nt, Leptospira interrogans serovar lai str. 56601
cuuuggauuuuauuuuuac

SEQ ID NO: 2788161 - RNA, 20 nt, Leptospira interrogans serovar lai str. 56601
cuuuggucgaucguuuuuug

SEQ ID NO: 2788162 - RNA, 18 nt, Leptospira interrogans serovar lai str. 56601
cuuugguuaucauaaaaa

SEQ ID NO: 2788163 - RNA, 20 nt, Leptospira interrogans serovar lai str. 56601
cuuugguuaucauaaaaaua

SEQ ID NO: 2788164 - RNA, 23 nt, Leptospira interrogans serovar lai str. 56601
cuuugguuuguaauaguucccac

SEQ ID NO: 2788165 - RNA, 20 nt, Leptospira interrogans serovar lai str. 56601
cuuuguaaaucuauucuuaa

SEQ ID NO: 2788166 - RNA, 18 nt, Leptospira interrogans serovar lai str. 56601
cuuuguaaccuuuguuuc

SEQ ID NO: 2788167 - RNA, 17 nt, Leptospira interrogans serovar lai str. 56601
cuuuguaauaaaaauuu

SEQ ID NO: 2788168 - RNA, 21 nt, Leptospira interrogans serovar lai str. 56601
cuuuguaauaaaaauuuaaaa

SEQ ID NO: 2788169 - RNA, 21 nt, Leptospira interrogans serovar lai str. 56601
cuuuguaauaauguauugcuu

SEQ ID NO: 2788170 - RNA, 17 nt, Leptospira interrogans serovar lai str. 56601
cuuuguaauuaaaauuu

SEQ ID NO: 2788171 - RNA, 18 nt, Leptospira interrogans serovar lai str. 56601
cuuuguaugaguucccac

SEQ ID NO: 2788172 - RNA, 9 nt, Leptospira interrogans serovar lai str. 56601
cuuuuaaaa

SEQ ID NO: 2788173 - RNA, 16 nt, Leptospira interrogans serovar lai str. 56601
cuuuuaaaaaauuuuu

SEQ ID NO: 2788174 - RNA, 20 nt, Leptospira interrogans serovar lai str. 56601
cuuuuaaaaaauuuuuucuu

SEQ ID NO: 2788175 - RNA, 14 nt, Leptospira interrogans serovar lai str. 56601
cuuuuaaaaacuug

SEQ ID NO: 2788176 - RNA, 12 nt, Leptospira interrogans serovar lai str. 56601
cuuuuaaaaagu

SEQ ID NO: 2788177 - RNA, 13 nt, Leptospira interrogans serovar lai str. 56601
cuuuuaaaaaguu

SEQ ID NO: 2788178 - RNA, 15 nt, Leptospira interrogans serovar lai str. 56601
cuuuuaaacaauuga

SEQ ID NO: 2788179 - RNA, 22 nt, Leptospira interrogans serovar lai str. 56601
cuuuuaacuugccguuuuucua

SEQ ID NO: 2788180 - RNA, 20 nt, Leptospira interrogans serovar lai str. 56601
cuuuuaauaauucaaaauuu

SEQ ID NO: 2788181 - RNA, 23 nt, Leptospira interrogans serovar lai str. 56601
cuuuuaccuuaccaccguguuga

SEQ ID NO: 2788182 - RNA, 15 nt, Leptospira interrogans serovar lai str. 56601
cuuuuacgacuuuau

SEQ ID NO: 2788183 - RNA, 14 nt, Leptospira interrogans serovar lai str. 56601
cuuuuacggauucu

SEQ ID NO: 2788184 - RNA, 15 nt, Leptospira interrogans serovar lai str. 56601
cuuuuacuucauaua

SEQ ID NO: 2788185 - RNA, 15 nt, Leptospira interrogans serovar lai str. 56601
cuuuuagaaaaaauu

SEQ ID NO: 2788186 - RNA, 16 nt, Leptospira interrogans serovar lai str. 56601
cuuuuagaaaaaauuu

SEQ ID NO: 2788187 - RNA, 23 nt, Leptospira interrogans serovar lai str. 56601
cuuuuagaaguggaucuugaauc

SEQ ID NO: 2788188 - RNA, 21 nt, Leptospira interrogans serovar lai str. 56601
cuuuuagaauucuccacaaaa

SEQ ID NO: 2788189 - RNA, 15 nt, Leptospira interrogans serovar lai str. 56601
cuuuuagauaauuau

SEQ ID NO: 2788190 - RNA, 19 nt, Leptospira interrogans serovar lai str. 56601
cuuuuaggauuuuaugaaa

SEQ ID NO: 2788191 - RNA, 15 nt, Leptospira interrogans serovar lai str. 56601
cuuuuauaaaaucua

SEQ ID NO: 2788192 - RNA, 13 nt, Leptospira interrogans serovar lai str. 56601
cuuuuauaauuca

SEQ ID NO: 2788193 - RNA, 23 nt, Leptospira interrogans serovar lai str. 56601
cuuuuauaauucaagacuuuaua

SEQ ID NO: 2788194 - RNA, 19 nt, Leptospira interrogans serovar lai str. 56601
cuuuuaucgaauggaauuu

SEQ ID NO: 2788195 - RNA, 21 nt, Leptospira interrogans serovar lai str. 56601
cuuuuaugaguucacuucuug

SEQ ID NO: 2788196 - RNA, 14 nt, Leptospira interrogans serovar lai str. 56601
cuuuucaaaaucua

SEQ ID NO: 2788197 - RNA, 15 nt, Leptospira interrogans serovar lai str. 56601
cuuuuccaaaaacuu

SEQ ID NO: 2788198 - RNA, 16 nt, Leptospira interrogans serovar lai str. 56601
cuuuuccaaaaacuuu

SEQ ID NO: 2788199 - RNA, 23 nt, Leptospira interrogans serovar lai str. 56601
cuuuuccaaauauacgaaucuga

SEQ ID NO: 2788200 - RNA, 21 nt, Leptospira interrogans serovar lai str. 56601
cuuuuccaucgcguagauaau

SEQ ID NO: 2788201 - RNA, 19 nt, Leptospira interrogans serovar lai str. 56601
cuuuuccccuuuuuuaaua

SEQ ID NO: 2788202 - RNA, 11 nt, Leptospira interrogans serovar lai str. 56601
cuuuuccuaaa

SEQ ID NO: 2788203 - RNA, 17 nt, Leptospira interrogans serovar lai str. 56601
cuuuuccuaaaauuuug

SEQ ID NO: 2788204 - RNA, 20 nt, Leptospira interrogans serovar lai str. 56601
cuuuuccuaaaauuuugcag

SEQ ID NO: 2788205 - RNA, 17 nt, Leptospira interrogans serovar lai str. 56601
cuuuucgaauuuccuuu

SEQ ID NO: 2788206 - RNA, 16 nt, Leptospira interrogans serovar lai str. 56601
cuuuucggaacaagau

SEQ ID NO: 2788207 - RNA, 17 nt, Leptospira interrogans serovar lai str. 56601
cuuuucuagacuuucuu

SEQ ID NO: 2788208 - RNA, 13 nt, Leptospira interrogans serovar lai str. 56601
cuuuucuauaaaa

SEQ ID NO: 2788209 - RNA, 14 nt, Leptospira interrogans serovar lai str. 56601
cuuuucuauaaaau

SEQ ID NO: 2788210 - RNA, 23 nt, Leptospira interrogans serovar lai str. 56601
cuuuucuauaaucugaaauagaa

SEQ ID NO: 2788211 - RNA, 17 nt, Leptospira interrogans serovar lai str. 56601
cuuuucucaucaaaaaa

SEQ ID NO: 2788212 - RNA, 18 nt, Leptospira interrogans serovar lai str. 56601
cuuuucugauuuuuauaa

SEQ ID NO: 2788213 - RNA, 15 nt, Leptospira interrogans serovar lai str. 56601
cuuuucuuaaaaaaa

SEQ ID NO: 2788214 - RNA, 14 nt, Leptospira interrogans serovar lai str. 56601
cuuuucuuaaaauu

SEQ ID NO: 2788215 - RNA, 23 nt, Leptospira interrogans serovar lai str. 56601
cuuuucuuauaaccuaucacaaa

SEQ ID NO: 2788216 - RNA, 18 nt, Leptospira interrogans serovar lai str. 56601
cuuuucuucccagauucc

SEQ ID NO: 2788217 - RNA, 14 nt, Leptospira interrogans serovar lai str. 56601
cuuuucuucuggaa

SEQ ID NO: 2788218 - RNA, 12 nt, Leptospira interrogans serovar lai str. 56601
cuuuugaaacua

SEQ ID NO: 2788219 - RNA, 21 nt, Leptospira interrogans serovar lai str. 56601
cuuuugaaaguuuuuuuauaa

SEQ ID NO: 2788220 - RNA, 19 nt, Leptospira interrogans serovar lai str. 56601
cuuuugaacacgucuuaaa

SEQ ID NO: 2788221 - RNA, 19 nt, Leptospira interrogans serovar lai str. 56601
cuuuugaucuuuaaaagag

SEQ ID NO: 2788222 - RNA, 15 nt, Leptospira interrogans serovar lai str. 56601
cuuuugcauugaaau

SEQ ID NO: 2788223 - RNA, 23 nt, Leptospira interrogans serovar lai str. 56601
cuuuugccccuccguuuacaaaa

SEQ ID NO: 2788224 - RNA, 15 nt, Leptospira interrogans serovar lai str. 56601
cuuuugcuucuuuua

SEQ ID NO: 2788225 - RNA, 18 nt, Leptospira interrogans serovar lai str. 56601
cuuuugcuucuuuuaaac

SEQ ID NO: 2788226 - RNA, 14 nt, Leptospira interrogans serovar lai str. 56601
cuuuugcuuuuaaa

SEQ ID NO: 2788227 - RNA, 15 nt, Leptospira interrogans serovar lai str. 56601
cuuuugcuuuuaaag

SEQ ID NO: 2788228 - RNA, 15 nt, Leptospira interrogans serovar lai str. 56601
cuuuuggacagcucu

SEQ ID NO: 2788229 - RNA, 24 nt, Leptospira interrogans serovar lai str. 56601
cuuuuguugcggagaauguuugag

SEQ ID NO: 2788230 - RNA, 14 nt, Leptospira interrogans serovar lai str. 56601
cuuuuguuuuucuu

SEQ ID NO: 2788231 - RNA, 14 nt, Leptospira interrogans serovar lai str. 56601
cuuuuuaaaaccaa

SEQ ID NO: 2788232 - RNA, 17 nt, Leptospira interrogans serovar lai str. 56601
cuuuuuaaaaccaaaau

SEQ ID NO: 2788233 - RNA, 19 nt, Leptospira interrogans serovar lai str. 56601
cuuuuuaaaacgauuuuag

SEQ ID NO: 2788234 - RNA, 22 nt, Leptospira interrogans serovar lai str. 56601
cuuuuuacucaugacuacagaa

SEQ ID NO: 2788235 - RNA, 15 nt, Leptospira interrogans serovar lai str. 56601
cuuuuuauaaaaagc

SEQ ID NO: 2788236 - RNA, 17 nt, Leptospira interrogans serovar lai str. 56601
cuuuuuauaaaaagcug

SEQ ID NO: 2788237 - RNA, 14 nt, Leptospira interrogans serovar lai str. 56601
cuuuuuauaaagau

SEQ ID NO: 2788238 - RNA, 13 nt, Leptospira interrogans serovar lai str. 56601
cuuuuuauuucua

SEQ ID NO: 2788239 - RNA, 21 nt, Leptospira interrogans serovar lai str. 56601
gaaaaucgaguguaauaugaa

SEQ ID NO: 2788240 - RNA, 23 nt, Leptospira interrogans serovar lai str. 56601
gaaaaucgaguguaauaugaauu

SEQ ID NO: 2788241 - RNA, 23 nt, Leptospira interrogans serovar lai str. 56601
gaaaaucggauaguuuaaauucu

SEQ ID NO: 2788242 - RNA, 19 nt, Leptospira interrogans serovar lai str. 56601
gaaaaucuagguuuccuuc

SEQ ID NO: 2788243 - RNA, 16 nt, Leptospira interrogans serovar lai str. 56601
gaaaaucucagaaaau

SEQ ID NO: 2788244 - RNA, 21 nt, Leptospira interrogans serovar lai str. 56601
gaaaaugugagagaggauacu

SEQ ID NO: 2788245 - RNA, 22 nt, Leptospira interrogans serovar lai str. 56601
gaaaauuaauuuuucaacaauu

SEQ ID NO: 2788246 - RNA, 21 nt, Leptospira interrogans serovar lai str. 56601
gaaaauuccgaaggaauugca

SEQ ID NO: 2788247 - RNA, 22 nt, Leptospira interrogans serovar lai str. 56601
gaaaauucuaagaucaaagaga

SEQ ID NO: 2788248 - RNA, 22 nt, Leptospira interrogans serovar lai str. 56601
gaaaauucuuucuauauauccu

SEQ ID NO: 2788249 - RNA, 15 nt, Leptospira interrogans serovar lai str. 56601
gaaaauuuaaaauau

SEQ ID NO: 2788250 - RNA, 13 nt, Leptospira interrogans serovar lai str. 56601
gaaaauuuaaauu

SEQ ID NO: 2788251 - RNA, 16 nt, Leptospira interrogans serovar lai str. 56601
gaaaauuuaacaacau

SEQ ID NO: 2788252 - RNA, 13 nt, Leptospira interrogans serovar lai str. 56601
gaaaauuugaaaa

SEQ ID NO: 2788253 - RNA, 19 nt, Leptospira interrogans serovar lai str. 56601
gaaaauuuggacgaauccg

SEQ ID NO: 2788254 - RNA, 14 nt, Leptospira interrogans serovar lai str. 56601
gaaaauuuuccuuu

SEQ ID NO: 2788255 - RNA, 21 nt, Leptospira interrogans serovar lai str. 56601
gaaaauuuuuacucagucgaa

SEQ ID NO: 2788256 - RNA, 15 nt, Leptospira interrogans serovar lai str. 56601
gaaaauuuuuuauuu

SEQ ID NO: 2788257 - RNA, 20 nt, Leptospira interrogans serovar lai str. 56601
gaaacaaaaaugagaaucag

SEQ ID NO: 2788258 - RNA, 16 nt, Leptospira interrogans serovar lai str. 56601
gaaacaaauggagaau

SEQ ID NO: 2788259 - RNA, 19 nt, Leptospira interrogans serovar lai str. 56601
gaaacaacauugaguuuga

SEQ ID NO: 2788260 - RNA, 20 nt, Leptospira interrogans serovar lai str. 56601
gaaacaaguuccaaauuacu

SEQ ID NO: 2788261 - RNA, 12 nt, Leptospira interrogans serovar lai str. 56601
gaaacaaucuaa

SEQ ID NO: 2788262 - RNA, 17 nt, Leptospira interrogans serovar lai str. 56601
gaaacaauucuuccuuu

SEQ ID NO: 2788263 - RNA, 20 nt, Leptospira interrogans serovar lai str. 56601
gaaacagauggaaaguuagu

SEQ ID NO: 2788264 - RNA, 22 nt, Leptospira interrogans serovar lai str. 56601
gaaacauaaugcaauauauugu

SEQ ID NO: 2788265 - RNA, 22 nt, Leptospira interrogans serovar lai str. 56601
gaaacaucacuuccauuuuuug

SEQ ID NO: 2788266 - RNA, 18 nt, Leptospira interrogans serovar lai str. 56601
gaaacauuucuaaaauau

SEQ ID NO: 2788267 - RNA, 14 nt, Leptospira interrogans serovar lai str. 56601
gaaaccccaugagc

SEQ ID NO: 2788268 - RNA, 20 nt, Leptospira interrogans serovar lai str. 56601
gaaaccucggaguauauaau

SEQ ID NO: 2788269 - RNA, 15 nt, Leptospira interrogans serovar lai str. 56601
gaaacggaagaaaau

SEQ ID NO: 2788270 - RNA, 20 nt, Leptospira interrogans serovar lai str. 56601
gaaacguauuuuuacccgau

SEQ ID NO: 2788271 - RNA, 20 nt, Leptospira interrogans serovar lai str. 56601
gaaacgucauaguucccaca

SEQ ID NO: 2788272 - RNA, 23 nt, Leptospira interrogans serovar lai str. 56601
gaaacuauacuuucaaaaaauau

SEQ ID NO: 2788273 - RNA, 15 nt, Leptospira interrogans serovar lai str. 56601
gaaacuauuauacuu

SEQ ID NO: 2788274 - RNA, 11 nt, Leptospira interrogans serovar lai str. 56601
gaaacucagua

SEQ ID NO: 2788275 - RNA, 18 nt, Leptospira interrogans serovar lai str. 56601
gaaacucaguaaaacgcu

SEQ ID NO: 2788276 - RNA, 18 nt, Leptospira interrogans serovar lai str. 56601
gaaacucaguaaacucaa

SEQ ID NO: 2788277 - RNA, 14 nt, Leptospira interrogans serovar lai str. 56601
gaaacuuaauaaaa

SEQ ID NO: 2788278 - RNA, 15 nt, Leptospira interrogans serovar lai str. 56601
gaaacuuauacuuua

SEQ ID NO: 2788279 - RNA, 19 nt, Leptospira interrogans serovar lai str. 56601
gaaacuuauacuuuauaga

SEQ ID NO: 2788280 - RNA, 12 nt, Leptospira interrogans serovar lai str. 56601
gaaacuuucaaa

SEQ ID NO: 2788281 - RNA, 14 nt, Leptospira interrogans serovar lai str. 56601
gaaagaaaaagaga

SEQ ID NO: 2788282 - RNA, 19 nt, Leptospira interrogans serovar lai str. 56601
gaaagaacaagauuaacaa

SEQ ID NO: 2788283 - RNA, 16 nt, Leptospira interrogans serovar lai str. 56601
gaaagaacguuuugcu

SEQ ID NO: 2788284 - RNA, 10 nt, Leptospira interrogans serovar lai str. 56601
gaaagaacuc

SEQ ID NO: 2788285 - RNA, 22 nt, Leptospira interrogans serovar lai str. 56601
gaaagaaucuuuuuaaaaguau

SEQ ID NO: 2788286 - RNA, 22 nt, Leptospira interrogans serovar lai str. 56601
gaaagaauguauaccaauaauu

SEQ ID NO: 2788287 - RNA, 13 nt, Leptospira interrogans serovar lai str. 56601
gaaagaauuuccu

SEQ ID NO: 2788288 - RNA, 17 nt, Leptospira interrogans serovar lai str. 56601
gaaagaauuuucuaaaa

SEQ ID NO: 2788289 - RNA, 21 nt, Leptospira interrogans serovar lai str. 56601
gaaagaauuuucuaaaaguau

SEQ ID NO: 2788290 - RNA, 14 nt, Leptospira interrogans serovar lai str. 56601
gaaagacuuuucau

SEQ ID NO: 2788291 - RNA, 20 nt, Leptospira interrogans serovar lai str. 56601
gaaagcaaacuuuuuauaaa

SEQ ID NO: 2788292 - RNA, 13 nt, Leptospira interrogans serovar lai str. 56601
gaaagcaauccau

SEQ ID NO: 2788293 - RNA, 16 nt, Leptospira interrogans serovar lai str. 56601
gaaagcagcaaagaag

SEQ ID NO: 2788294 - RNA, 18 nt, Leptospira interrogans serovar lai str. 56601
gaaagccgccuuuccaac

SEQ ID NO: 2788295 - RNA, 20 nt, Leptospira interrogans serovar lai str. 56601
gaaagcgcagacucuucucc

SEQ ID NO: 2788296 - RNA, 17 nt, Leptospira interrogans serovar lai str. 56601
gaaagcgugacuaaaau

SEQ ID NO: 2788297 - RNA, 19 nt, Leptospira interrogans serovar lai str. 56601
gaaaggcggagaaauuaau

SEQ ID NO: 2788298 - RNA, 15 nt, Leptospira interrogans serovar lai str. 56601
gaaagguagcuugga

SEQ ID NO: 2788299 - RNA, 20 nt, Leptospira interrogans serovar lai str. 56601
gaaagguuauccucugaacu

SEQ ID NO: 2788300 - RNA, 13 nt, Leptospira interrogans serovar lai str. 56601
gaaaguaaaaaag

SEQ ID NO: 2788301 - RNA, 15 nt, Leptospira interrogans serovar lai str. 56601
gaaaguaaaaaagag

SEQ ID NO: 2788302 - RNA, 15 nt, Leptospira interrogans serovar lai str. 56601
gaaaguaaaauuaca

SEQ ID NO: 2788303 - RNA, 17 nt, Leptospira interrogans serovar lai str. 56601
gaaaguaucagaaucaa

SEQ ID NO: 2788304 - RNA, 18 nt, Leptospira interrogans serovar lai str. 56601
gaaagugauccaacaaau

SEQ ID NO: 2788305 - RNA, 19 nt, Leptospira interrogans serovar lai str. 56601
gaaaguguuaguucccaca

SEQ ID NO: 2788306 - RNA, 18 nt, Leptospira interrogans serovar lai str. 56601
gaaaguucacaaauugca

SEQ ID NO: 2788307 - RNA, 20 nt, Leptospira interrogans serovar lai str. 56601
gaaaguucacaaauugcaaa

SEQ ID NO: 2788308 - RNA, 20 nt, Leptospira interrogans serovar lai str. 56601
gaaaguucuauaaacucaaa

SEQ ID NO: 2788309 - RNA, 12 nt, Leptospira interrogans serovar lai str. 56601
gaaaguugaaag

SEQ ID NO: 2788310 - RNA, 15 nt, Leptospira interrogans serovar lai str. 56601
gaaaguugcaaagaa

SEQ ID NO: 2788311 - RNA, 16 nt, Leptospira interrogans serovar lai str. 56601
gaaaguugcaaagaag

SEQ ID NO: 2788312 - RNA, 14 nt, Leptospira interrogans serovar lai str. 56601
gaaaguuuauaaau

SEQ ID NO: 2788313 - RNA, 18 nt, Leptospira interrogans serovar lai str. 56601
gaaaguuuuuuaaaaaau

SEQ ID NO: 2788314 - RNA, 10 nt, Leptospira interrogans serovar lai str. 56601
gaaauaaaaa

SEQ ID NO: 2788315 - RNA, 23 nt, Leptospira interrogans serovar lai str. 56601
gaaauaaucgaacccagucuucu

SEQ ID NO: 2788316 - RNA, 19 nt, Leptospira interrogans serovar lai str. 56601
gaaauaauuccuccaugaa

SEQ ID NO: 2788317 - RNA, 18 nt, Leptospira interrogans serovar lai str. 56601
gaaauacaaaaagaauau

SEQ ID NO: 2788318 - RNA, 15 nt, Leptospira interrogans serovar lai str. 56601
gaaauacuucuccac

SEQ ID NO: 2788319 - RNA, 12 nt, Leptospira interrogans serovar lai str. 56601
gaaauagaauuu

SEQ ID NO: 2788320 - RNA, 16 nt, Leptospira interrogans serovar lai str. 56601
gaaauagaauuuugca

SEQ ID NO: 2788321 - RNA, 21 nt, Leptospira interrogans serovar lai str. 56601
gaaauauauucuuuucugaau

SEQ ID NO: 2788322 - RNA, 20 nt, Leptospira interrogans serovar lai str. 56601
gaacuauuauaaaauacaaa

SEQ ID NO: 2788323 - RNA, 17 nt, Leptospira interrogans serovar lai str. 56601
gaacuauuuuuuguaug

SEQ ID NO: 2788324 - RNA, 14 nt, Leptospira interrogans serovar lai str. 56601
gaacucaacagaac

SEQ ID NO: 2788325 - RNA, 19 nt, Leptospira interrogans serovar lai str. 56601
gaacucaacagaacgggcu

SEQ ID NO: 2788326 - RNA, 16 nt, Leptospira interrogans serovar lai str. 56601
gaacucaauguugcuc

SEQ ID NO: 2788327 - RNA, 16 nt, Leptospira interrogans serovar lai str. 56601
gaacucacguuaaaua

SEQ ID NO: 2788328 - RNA, 16 nt, Leptospira interrogans serovar lai str. 56601
gaacucccacaauuua

SEQ ID NO: 2788329 - RNA, 13 nt, Leptospira interrogans serovar lai str. 56601
gaacucucacaaa

SEQ ID NO: 2788330 - RNA, 17 nt, Leptospira interrogans serovar lai str. 56601
gaacucucacaaaucau

SEQ ID NO: 2788331 - RNA, 20 nt, Leptospira interrogans serovar lai str. 56601
gaacucucacaaaucaugga

SEQ ID NO: 2788332 - RNA, 22 nt, Leptospira interrogans serovar lai str. 56601
gaacucuuacuuugagaaaauu

SEQ ID NO: 2788333 - RNA, 17 nt, Leptospira interrogans serovar lai str. 56601
gaacucuuucaaagcua

SEQ ID NO: 2788334 - RNA, 19 nt, Leptospira interrogans serovar lai str. 56601
gaacucuuuuaccuuacca

SEQ ID NO: 2788335 - RNA, 22 nt, Leptospira interrogans serovar lai str. 56601
gaacuuacaaagcacuuuuuuc

SEQ ID NO: 2788336 - RNA, 20 nt, Leptospira interrogans serovar lai str. 56601
gaacuucguuggaaaguuuu

SEQ ID NO: 2788337 - RNA, 17 nt, Leptospira interrogans serovar lai str. 56601
gaacuugcucaaaagcu

SEQ ID NO: 2788338 - RNA, 15 nt, Leptospira interrogans serovar lai str. 56601
gaacuuguccuaaaa

SEQ ID NO: 2788339 - RNA, 12 nt, Leptospira interrogans serovar lai str. 56601
gaacuuuacaga

SEQ ID NO: 2788340 - RNA, 19 nt, Leptospira interrogans serovar lai str. 56601
gaacuuuaccggguuccau

SEQ ID NO: 2788341 - RNA, 11 nt, Leptospira interrogans serovar lai str. 56601
gaacuuuagag

SEQ ID NO: 2788342 - RNA, 18 nt, Leptospira interrogans serovar lai str. 56601
gaacuuucgaguaguuau

SEQ ID NO: 2788343 - RNA, 13 nt, Leptospira interrogans serovar lai str. 56601
gaacuuuuauaau

SEQ ID NO: 2788344 - RNA, 21 nt, Leptospira interrogans serovar lai str. 56601
gaacuuuuauaauucaagacu

SEQ ID NO: 2788345 - RNA, 18 nt, Leptospira interrogans serovar lai str. 56601
gaacuuuuucaaguguuc

SEQ ID NO: 2788346 - RNA, 14 nt, Leptospira interrogans serovar lai str. 56601
gaagaaaaaaagau

SEQ ID NO: 2788347 - RNA, 13 nt, Leptospira interrogans serovar lai str. 56601
gaagaaaauuaau

SEQ ID NO: 2788348 - RNA, 15 nt, Leptospira interrogans serovar lai str. 56601
gaagaagcuaaaauu

SEQ ID NO: 2788349 - RNA, 18 nt, Leptospira interrogans serovar lai str. 56601
gaagaauccgaaaaaccu

SEQ ID NO: 2788350 - RNA, 16 nt, Leptospira interrogans serovar lai str. 56601
gaagaaugauaaaucu

SEQ ID NO: 2788351 - RNA, 14 nt, Leptospira interrogans serovar lai str. 56601
gaagaauuguauuu

SEQ ID NO: 2788352 - RNA, 18 nt, Leptospira interrogans serovar lai str. 56601
gaagacgcuuaaaaauga

SEQ ID NO: 2788353 - RNA, 18 nt, Leptospira interrogans serovar lai str. 56601
gaagaggugaaauuucca

SEQ ID NO: 2788354 - RNA, 17 nt, Leptospira interrogans serovar lai str. 56601
gaagagucaaacacucu

SEQ ID NO: 2788355 - RNA, 21 nt, Leptospira interrogans serovar lai str. 56601
gaagagucuauauguaaauga

SEQ ID NO: 2788356 - RNA, 17 nt, Leptospira interrogans serovar lai str. 56601
gaagauaaauauuucca

SEQ ID NO: 2788357 - RNA, 18 nt, Leptospira interrogans serovar lai str. 56601
gaagauaaauauuuccaa

SEQ ID NO: 2788358 - RNA, 13 nt, Leptospira interrogans serovar lai str. 56601
gaagauagauuua

SEQ ID NO: 2788359 - RNA, 13 nt, Leptospira interrogans serovar lai str. 56601
gaagauagguuca

SEQ ID NO: 2788360 - RNA, 23 nt, Leptospira interrogans serovar lai str. 56601
gaagauucuucuccucuuccgga

SEQ ID NO: 2788361 - RNA, 12 nt, Leptospira interrogans serovar lai str. 56601
gaagauuuguaa

SEQ ID NO: 2788362 - RNA, 13 nt, Leptospira interrogans serovar lai str. 56601
gaagauuuguaaa

SEQ ID NO: 2788363 - RNA, 19 nt, Leptospira interrogans serovar lai str. 56601
gaagauuuuucaaucuaac

SEQ ID NO: 2788364 - RNA, 13 nt, Leptospira interrogans serovar lai str. 56601
gaagauuuuucuu

SEQ ID NO: 2788365 - RNA, 16 nt, Leptospira interrogans serovar lai str. 56601
gaagauuuuucuuuaa

SEQ ID NO: 2788366 - RNA, 20 nt, Leptospira interrogans serovar lai str. 56601
gaagcaaucuguuuagaaua

SEQ ID NO: 2788367 - RNA, 18 nt, Leptospira interrogans serovar lai str. 56601
gaagcacaagcuuccuuu

SEQ ID NO: 2788368 - RNA, 19 nt, Leptospira interrogans serovar lai str. 56601
gaagcacaagcuuccuuuu

SEQ ID NO: 2788369 - RNA, 22 nt, Leptospira interrogans serovar lai str. 56601
gaagcaguuuuguuaauugcca

SEQ ID NO: 2788370 - RNA, 18 nt, Leptospira interrogans serovar lai str. 56601
gaagccaaugugccuucg

SEQ ID NO: 2788371 - RNA, 12 nt, Leptospira interrogans serovar lai str. 56601
gaagccuauauu

SEQ ID NO: 2788372 - RNA, 16 nt, Leptospira interrogans serovar lai str. 56601
gaagcuaugaagaggu

SEQ ID NO: 2788373 - RNA, 13 nt, Leptospira interrogans serovar lai str. 56601
gaaggaauuggaa

SEQ ID NO: 2788374 - RNA, 18 nt, Leptospira interrogans serovar lai str. 56601
gaaggauuagcaugaaau

SEQ ID NO: 2788375 - RNA, 21 nt, Leptospira interrogans serovar lai str. 56601
gaaggcagcuaagaaaaaagu

SEQ ID NO: 2788376 - RNA, 15 nt, Leptospira interrogans serovar lai str. 56601
gaagguagauaaagg

SEQ ID NO: 2788377 - RNA, 11 nt, Leptospira interrogans serovar lai str. 56601
gaagguugagc

SEQ ID NO: 2788378 - RNA, 12 nt, Leptospira interrogans serovar lai str. 56601
gaaguaaucuuu

SEQ ID NO: 2788379 - RNA, 15 nt, Leptospira interrogans serovar lai str. 56601
gaaguaguuccuaca

SEQ ID NO: 2788380 - RNA, 15 nt, Leptospira interrogans serovar lai str. 56601
gaaguauuuucgcac

SEQ ID NO: 2788381 - RNA, 20 nt, Leptospira interrogans serovar lai str. 56601
gaaguggguuguuaugcaaa

SEQ ID NO: 2788382 - RNA, 16 nt, Leptospira interrogans serovar lai str. 56601
gaaguguuugcugagu

SEQ ID NO: 2788383 - RNA, 17 nt, Leptospira interrogans serovar lai str. 56601
gaaguuaagaagauaaa

SEQ ID NO: 2788384 - RNA, 18 nt, Leptospira interrogans serovar lai str. 56601
gaaguuuaccccgaagag

SEQ ID NO: 2788385 - RNA, 15 nt, Leptospira interrogans serovar lai str. 56601
gaauaaaaaacucaa

SEQ ID NO: 2788386 - RNA, 15 nt, Leptospira interrogans serovar lai str. 56601
gaauaaaaacaaacu

SEQ ID NO: 2788387 - RNA, 17 nt, Leptospira interrogans serovar lai str. 56601
gaauaaacaauaaaaua

SEQ ID NO: 2788388 - RNA, 22 nt, Leptospira interrogans serovar lai str. 56601
gaauaaauacauacaaugaaaa

SEQ ID NO: 2788389 - RNA, 14 nt, Leptospira interrogans serovar lai str. 56601
gaauaacuuucuuc

SEQ ID NO: 2788390 - RNA, 13 nt, Leptospira interrogans serovar lai str. 56601
gaauaaggcaaaa

SEQ ID NO: 2788391 - RNA, 14 nt, Leptospira interrogans serovar lai str. 56601
gaauaauaaucuua

SEQ ID NO: 2788392 - RNA, 18 nt, Leptospira interrogans serovar lai str. 56601
gaauaauaaucuuaaaua

SEQ ID NO: 2788393 - RNA, 16 nt, Leptospira interrogans serovar lai str. 56601
gaauaccaaaaaagua

SEQ ID NO: 2788394 - RNA, 20 nt, Leptospira interrogans serovar lai str. 56601
gaauaccguucuuacauuga

SEQ ID NO: 2788395 - RNA, 15 nt, Leptospira interrogans serovar lai str. 56601
gaauacgauagauuc

SEQ ID NO: 2788396 - RNA, 14 nt, Leptospira interrogans serovar lai str. 56601
gaauacgauuuaau

SEQ ID NO: 2788397 - RNA, 17 nt, Leptospira interrogans serovar lai str. 56601
gaauagagucuuuaaaa

SEQ ID NO: 2788398 - RNA, 17 nt, Leptospira interrogans serovar lai str. 56601
gaauagaguuguuaaaa

SEQ ID NO: 2788399 - RNA, 14 nt, Leptospira interrogans serovar lai str. 56601
gaauaggaucagaa

SEQ ID NO: 2788400 - RNA, 23 nt, Leptospira interrogans serovar lai str. 56601
gaauaggauuuuagaaucaaaau

SEQ ID NO: 2788401 - RNA, 22 nt, Leptospira interrogans serovar lai str. 56601
gaauaggauuuuagaaucagaa

SEQ ID NO: 2788402 - RNA, 13 nt, Leptospira interrogans serovar lai str. 56601
gaauagucaaugg

SEQ ID NO: 2788403 - RNA, 20 nt, Leptospira interrogans serovar lai str. 56601
gaauagucaaugguugcaaa

SEQ ID NO: 2788404 - RNA, 19 nt, Leptospira interrogans serovar lai str. 56601
gaauaguuuacauaucaau

SEQ ID NO: 2788405 - RNA, 19 nt, Leptospira interrogans serovar lai str. 56601
gaauuguugaaaaauuuca

SEQ ID NO: 2788406 - RNA, 21 nt, Leptospira interrogans serovar lai str. 56601
gaauuguuugaaaguucccaa

SEQ ID NO: 2788407 - RNA, 18 nt, Leptospira interrogans serovar lai str. 56601
gaauuguuuuuaaauacu

SEQ ID NO: 2788408 - RNA, 16 nt, Leptospira interrogans serovar lai str. 56601
gaauuuaacuaguucc

SEQ ID NO: 2788409 - RNA, 20 nt, Leptospira interrogans serovar lai str. 56601
gaauuuaccuccuccuucuc

SEQ ID NO: 2788410 - RNA, 16 nt, Leptospira interrogans serovar lai str. 56601
gaauuuccaaacucaa

SEQ ID NO: 2788411 - RNA, 9 nt, Leptospira interrogans serovar lai str. 56601
gaauuucua

SEQ ID NO: 2788412 - RNA, 19 nt, Leptospira interrogans serovar lai str. 56601
gaauuucuaaaauucuucc

SEQ ID NO: 2788413 - RNA, 21 nt, Leptospira interrogans serovar lai str. 56601
gaauuucuaauagauuuauga

SEQ ID NO: 2788414 - RNA, 21 nt, Leptospira interrogans serovar lai str. 56601
gaauuugacguaaaggaaucc

SEQ ID NO: 2788415 - RNA, 15 nt, Leptospira interrogans serovar lai str. 56601
gaauuugaggagaau

SEQ ID NO: 2788416 - RNA, 15 nt, Leptospira interrogans serovar lai str. 56601
gaauuugcgaaaaaa

SEQ ID NO: 2788417 - RNA, 19 nt, Leptospira interrogans serovar lai str. 56601
gaauuuggcgguuaaaauc

SEQ ID NO: 2788418 - RNA, 18 nt, Leptospira interrogans serovar lai str. 56601
gaauuuguuuguaaaaua

SEQ ID NO: 2788419 - RNA, 17 nt, Leptospira interrogans serovar lai str. 56601
gaauuuguuuuaaaauu

SEQ ID NO: 2788420 - RNA, 21 nt, Leptospira interrogans serovar lai str. 56601
gaauuuguuuuaaaauuuaug

SEQ ID NO: 2788421 - RNA, 14 nt, Leptospira interrogans serovar lai str. 56601
gaauuuguuuuucu

SEQ ID NO: 2788422 - RNA, 12 nt, Leptospira interrogans serovar lai str. 56601
gaauuuuaaaaa

SEQ ID NO: 2788423 - RNA, 13 nt, Leptospira interrogans serovar lai str. 56601
gaauuuuaaauau

SEQ ID NO: 2788424 - RNA, 15 nt, Leptospira interrogans serovar lai str. 56601
gaauuuuaaauauua

SEQ ID NO: 2788425 - RNA, 15 nt, Leptospira interrogans serovar lai str. 56601
gaauuuuaagaucua

SEQ ID NO: 2788426 - RNA, 20 nt, Leptospira interrogans serovar lai str. 56601
gaauuuuacagauugauucu

SEQ ID NO: 2788427 - RNA, 14 nt, Leptospira interrogans serovar lai str. 56601
gaauuuuaccagau

SEQ ID NO: 2788428 - RNA, 20 nt, Leptospira interrogans serovar lai str. 56601
gaauuuuacgugauaauucu

SEQ ID NO: 2788429 - RNA, 19 nt, Leptospira interrogans serovar lai str. 56601
gaauuuuacuaaaaauuca

SEQ ID NO: 2788430 - RNA, 22 nt, Leptospira interrogans serovar lai str. 56601
gaauuuuaguucucucgaaaug

SEQ ID NO: 2788431 - RNA, 11 nt, Leptospira interrogans serovar lai str. 56601
gaauuuuauag

SEQ ID NO: 2788432 - RNA, 16 nt, Leptospira interrogans serovar lai str. 56601
gaauuuuaugauuuuc

SEQ ID NO: 2788433 - RNA, 13 nt, Leptospira interrogans serovar lai str. 56601
gaauuuucaaaau

SEQ ID NO: 2788434 - RNA, 11 nt, Leptospira interrogans serovar lai str. 56601
gaauuuucauc

SEQ ID NO: 2788435 - RNA, 13 nt, Leptospira interrogans serovar lai str. 56601
gaauuuuuaaaaa

SEQ ID NO: 2788436 - RNA, 15 nt, Leptospira interrogans serovar lai str. 56601
gaauuuuuaaaaaga

SEQ ID NO: 2788437 - RNA, 15 nt, Leptospira interrogans serovar lai str. 56601
gaauuuuuaagaaua

SEQ ID NO: 2788438 - RNA, 16 nt, Leptospira interrogans serovar lai str. 56601
gaauuuuuacacacuc

SEQ ID NO: 2788439 - RNA, 17 nt, Leptospira interrogans serovar lai str. 56601
gaauuuuuauaaaaaua

SEQ ID NO: 2788440 - RNA, 18 nt, Leptospira interrogans serovar lai str. 56601
gaauuuuuauaaguuuaa

SEQ ID NO: 2788441 - RNA, 20 nt, Leptospira interrogans serovar lai str. 56601
gaauuuuucaacaacucuaa

SEQ ID NO: 2788442 - RNA, 21 nt, Leptospira interrogans serovar lai str. 56601
gaauuuuucaacaacucuauu

SEQ ID NO: 2788443 - RNA, 19 nt, Leptospira interrogans serovar lai str. 56601
gaauuuuucgaaacaaaau

SEQ ID NO: 2788444 - RNA, 22 nt, Leptospira interrogans serovar lai str. 56601
gaauuuuucgguaggauccuga

SEQ ID NO: 2788445 - RNA, 18 nt, Leptospira interrogans serovar lai str. 56601
gaauuuuuguaaaaucca

SEQ ID NO: 2788446 - RNA, 15 nt, Leptospira interrogans serovar lai str. 56601
gaauuuuuguagaau

SEQ ID NO: 2788447 - RNA, 20 nt, Leptospira interrogans serovar lai str. 56601
gaauuuuuuaacaacucuaa

SEQ ID NO: 2788448 - RNA, 19 nt, Leptospira interrogans serovar lai str. 56601
gaauuuuuucguuccuuug

SEQ ID NO: 2788449 - RNA, 21 nt, Leptospira interrogans serovar lai str. 56601
gaauuuuuucguuccuuugaa

SEQ ID NO: 2788450 - RNA, 15 nt, Leptospira interrogans serovar lai str. 56601
gacaaaaauacuaaa

SEQ ID NO: 2788451 - RNA, 16 nt, Leptospira interrogans serovar lai str. 56601
gacaaaaauacuaaau

SEQ ID NO: 2788452 - RNA, 22 nt, Leptospira interrogans serovar lai str. 56601
gacaaaaugaguuauaguaaaa

SEQ ID NO: 2788453 - RNA, 22 nt, Leptospira interrogans serovar lai str. 56601
gacaaacuuagguuuuguaaua

SEQ ID NO: 2788454 - RNA, 12 nt, Leptospira interrogans serovar lai str. 56601
gacaaacuuuua

SEQ ID NO: 2788455 - RNA, 12 nt, Leptospira interrogans serovar lai str. 56601
gacaaaguauuu

SEQ ID NO: 2788456 - RNA, 18 nt, Leptospira interrogans serovar lai str. 56601
gacaaaucuucuguaaaa

SEQ ID NO: 2788457 - RNA, 24 nt, Leptospira interrogans serovar lai str. 56601
gacaacagaacaaaauuuacgaaa

SEQ ID NO: 2788458 - RNA, 14 nt, Leptospira interrogans serovar lai str. 56601
gacaagaagaaaag

SEQ ID NO: 2788459 - RNA, 15 nt, Leptospira interrogans serovar lai str. 56601
gacaagaaugagucu

SEQ ID NO: 2788460 - RNA, 16 nt, Leptospira interrogans serovar lai str. 56601
gacaaugcuuuccaaa

SEQ ID NO: 2788461 - RNA, 14 nt, Leptospira interrogans serovar lai str. 56601
gacaauuucuguag

SEQ ID NO: 2788462 - RNA, 13 nt, Leptospira interrogans serovar lai str. 56601
gacaauuuuucuc

SEQ ID NO: 2788463 - RNA, 17 nt, Leptospira interrogans serovar lai str. 56601
gacacucuaauguacaa

SEQ ID NO: 2788464 - RNA, 14 nt, Leptospira interrogans serovar lai str. 56601
gacagauuuauauu

SEQ ID NO: 2788465 - RNA, 16 nt, Leptospira interrogans serovar lai str. 56601
gacagcuugaagauua

SEQ ID NO: 2788466 - RNA, 14 nt, Leptospira interrogans serovar lai str. 56601
gacagguucuuaug

SEQ ID NO: 2788467 - RNA, 23 nt, Leptospira interrogans serovar lai str. 56601
gacauagucaagcagauuugucc

SEQ ID NO: 2788468 - RNA, 14 nt, Leptospira interrogans serovar lai str. 56601
gacaucuuuuaaaa

SEQ ID NO: 2788469 - RNA, 21 nt, Leptospira interrogans serovar lai str. 56601
gacauuagaacuacucacaaa

SEQ ID NO: 2788470 - RNA, 23 nt, Leptospira interrogans serovar lai str. 56601
gaccaauuuuuuuguaaaaaaau

SEQ ID NO: 2788471 - RNA, 18 nt, Leptospira interrogans serovar lai str. 56601
gaccagcguuuugcugag

SEQ ID NO: 2788472 - RNA, 19 nt, Leptospira interrogans serovar lai str. 56601
gaccagcguuuugcugagu

SEQ ID NO: 2788473 - RNA, 23 nt, Leptospira interrogans serovar lai str. 56601
gaccagcguuuugcugaguuuga

SEQ ID NO: 2788474 - RNA, 18 nt, Leptospira interrogans serovar lai str. 56601
gaccaucaucaaaacuua

SEQ ID NO: 2788475 - RNA, 14 nt, Leptospira interrogans serovar lai str. 56601
gaccauuuuccuuc

SEQ ID NO: 2788476 - RNA, 15 nt, Leptospira interrogans serovar lai str. 56601
gacccaagauuuuuc

SEQ ID NO: 2788477 - RNA, 16 nt, Leptospira interrogans serovar lai str. 56601
gacccagaaaaaaccu

SEQ ID NO: 2788478 - RNA, 15 nt, Leptospira interrogans serovar lai str. 56601
gacccuuagaaagug

SEQ ID NO: 2788479 - RNA, 15 nt, Leptospira interrogans serovar lai str. 56601
gaccgcgcuugaacu

SEQ ID NO: 2788480 - RNA, 17 nt, Leptospira interrogans serovar lai str. 56601
gaccugccuuucuuauu

SEQ ID NO: 2788481 - RNA, 16 nt, Leptospira interrogans serovar lai str. 56601
gaccuuguguuucaga

SEQ ID NO: 2788482 - RNA, 20 nt, Leptospira interrogans serovar lai str. 56601
gacgauccuuuuuuguaaag

SEQ ID NO: 2788483 - RNA, 17 nt, Leptospira interrogans serovar lai str. 56601
gacgauguuguuuaaaa

SEQ ID NO: 2788484 - RNA, 14 nt, Leptospira interrogans serovar lai str. 56601
gacgccauguuuuu

SEQ ID NO: 2788485 - RNA, 13 nt, Leptospira interrogans serovar lai str. 56601
gacguaaaaauau

SEQ ID NO: 2788486 - RNA, 15 nt, Leptospira interrogans serovar lai str. 56601
gacguaaguaaucca

SEQ ID NO: 2788487 - RNA, 21 nt, Leptospira interrogans serovar lai str. 56601
gacguaauuuaccuugaaacu

SEQ ID NO: 2788488 - RNA, 19 nt, Leptospira interrogans serovar lai str. 56601
gagcucuauguaagaaaau

SEQ ID NO: 2788489 - RNA, 12 nt, Leptospira interrogans serovar lai str. 56601
gagcugagugau

SEQ ID NO: 2788490 - RNA, 22 nt, Leptospira interrogans serovar lai str. 56601
gagcuugucccaaaaacucaaa

SEQ ID NO: 2788491 - RNA, 17 nt, Leptospira interrogans serovar lai str. 56601
gaggaacaauuuguaau

SEQ ID NO: 2788492 - RNA, 14 nt, Leptospira interrogans serovar lai str. 56601
gaggaauagucaau

SEQ ID NO: 2788493 - RNA, 15 nt, Leptospira interrogans serovar lai str. 56601
gaggaauuuuuaaaa

SEQ ID NO: 2788494 - RNA, 21 nt, Leptospira interrogans serovar lai str. 56601
gaggaguccaugauucugaaa

SEQ ID NO: 2788495 - RNA, 17 nt, Leptospira interrogans serovar lai str. 56601
gagggguuuuuccuuuu

SEQ ID NO: 2788496 - RNA, 16 nt, Leptospira interrogans serovar lai str. 56601
gagguacagaaacaaa

SEQ ID NO: 2788497 - RNA, 22 nt, Leptospira interrogans serovar lai str. 56601
gaggucuaugaugcauuucugc

SEQ ID NO: 2788498 - RNA, 20 nt, Leptospira interrogans serovar lai str. 56601
gaggugaaauuuccacuuca

SEQ ID NO: 2788499 - RNA, 17 nt, Leptospira interrogans serovar lai str. 56601
gaguaaaacuuuuaaag

SEQ ID NO: 2788500 - RNA, 13 nt, Leptospira interrogans serovar lai str. 56601
gaguaaacuauug

SEQ ID NO: 2788501 - RNA, 24 nt, Leptospira interrogans serovar lai str. 56601
gaguaacgauuucuauuuuucguc

SEQ ID NO: 2788502 - RNA, 13 nt, Leptospira interrogans serovar lai str. 56601
gaguaaggcaaac

SEQ ID NO: 2788503 - RNA, 17 nt, Leptospira interrogans serovar lai str. 56601
gaguaccauaaauuuua

SEQ ID NO: 2788504 - RNA, 17 nt, Leptospira interrogans serovar lai str. 56601
gaguaccauaaauuuuu

SEQ ID NO: 2788505 - RNA, 15 nt, Leptospira interrogans serovar lai str. 56601
gaguaguagaaaaug

SEQ ID NO: 2788506 - RNA, 16 nt, Leptospira interrogans serovar lai str. 56601
gaguaguagaaaaugu

SEQ ID NO: 2788507 - RNA, 16 nt, Leptospira interrogans serovar lai str. 56601
gaguauuaucuuuaua

SEQ ID NO: 2788508 - RNA, 17 nt, Leptospira interrogans serovar lai str. 56601
gaguauuaucuuuauau

SEQ ID NO: 2788509 - RNA, 14 nt, Leptospira interrogans serovar lai str. 56601
gagucgaaugcgac

SEQ ID NO: 2788510 - RNA, 22 nt, Leptospira interrogans serovar lai str. 56601
gagucuuuuuacuugcaaaaag

SEQ ID NO: 2788511 - RNA, 18 nt, Leptospira interrogans serovar lai str. 56601
gagugagguuuuggaaag

SEQ ID NO: 2788512 - RNA, 17 nt, Leptospira interrogans serovar lai str. 56601
gagugauacgcugaguu

SEQ ID NO: 2788513 - RNA, 13 nt, Leptospira interrogans serovar lai str. 56601
gagugcagauuaa

SEQ ID NO: 2788514 - RNA, 19 nt, Leptospira interrogans serovar lai str. 56601
gagugcagauuaaaaaaua

SEQ ID NO: 2788515 - RNA, 16 nt, Leptospira interrogans serovar lai str. 56601
gagugccuaaauuuuu

SEQ ID NO: 2788516 - RNA, 13 nt, Leptospira interrogans serovar lai str. 56601
gaguguaaucuua

SEQ ID NO: 2788517 - RNA, 20 nt, Leptospira interrogans serovar lai str. 56601
gaguguuguguugaguuuca

SEQ ID NO: 2788518 - RNA, 17 nt, Leptospira interrogans serovar lai str. 56601
gaguuauaguaaaagaa

SEQ ID NO: 2788519 - RNA, 21 nt, Leptospira interrogans serovar lai str. 56601
gaguuauaguaaaagaaaauu

SEQ ID NO: 2788520 - RNA, 18 nt, Leptospira interrogans serovar lai str. 56601
gaguuauugaaaaauuuc

SEQ ID NO: 2788521 - RNA, 19 nt, Leptospira interrogans serovar lai str. 56601
gaguuauugaaaaauuuca

SEQ ID NO: 2788522 - RNA, 16 nt, Leptospira interrogans serovar lai str. 56601
gaguucacuucuugaa

SEQ ID NO: 2788523 - RNA, 12 nt, Leptospira interrogans serovar lai str. 56601
gaguucauucug

SEQ ID NO: 2788524 - RNA, 21 nt, Leptospira interrogans serovar lai str. 56601
gaguucccacauuuuaaagau

SEQ ID NO: 2788525 - RNA, 17 nt, Leptospira interrogans serovar lai str. 56601
gaguucccacauuuuua

SEQ ID NO: 2788526 - RNA, 21 nt, Leptospira interrogans serovar lai str. 56601
gaguucccacguuuuaaaggu

SEQ ID NO: 2788527 - RNA, 16 nt, Leptospira interrogans serovar lai str. 56601
gaguuccgaaaauuug

SEQ ID NO: 2788528 - RNA, 20 nt, Leptospira interrogans serovar lai str. 56601
gaguuccuaacuuugaaaau

SEQ ID NO: 2788529 - RNA, 18 nt, Leptospira interrogans serovar lai str. 56601
gaguuccuacauuuucag

SEQ ID NO: 2788530 - RNA, 16 nt, Leptospira interrogans serovar lai str. 56601
gaguuccuacauuuuu

SEQ ID NO: 2788531 - RNA, 19 nt, Leptospira interrogans serovar lai str. 56601
gaguucgacauaagaaaga

SEQ ID NO: 2788532 - RNA, 22 nt, Leptospira interrogans serovar lai str. 56601
gaguucgacguaagaauauuug

SEQ ID NO: 2788533 - RNA, 21 nt, Leptospira interrogans serovar lai str. 56601
gaguucgauguaagaaaauau

SEQ ID NO: 2788534 - RNA, 15 nt, Leptospira interrogans serovar lai str. 56601
gaguucguggagaaa

SEQ ID NO: 2788535 - RNA, 20 nt, Leptospira interrogans serovar lai str. 56601
gaguucguuaagaauaaaua

SEQ ID NO: 2788536 - RNA, 14 nt, Leptospira interrogans serovar lai str. 56601
gaguuguauaacag

SEQ ID NO: 2788537 - RNA, 15 nt, Leptospira interrogans serovar lai str. 56601
gaguuguuaaaagug

SEQ ID NO: 2788538 - RNA, 18 nt, Leptospira interrogans serovar lai str. 56601
gaguuguugaaaaauuuc

SEQ ID NO: 2788539 - RNA, 11 nt, Leptospira interrogans serovar lai str. 56601
gaguuuaaaaa

SEQ ID NO: 2788540 - RNA, 15 nt, Leptospira interrogans serovar lai str. 56601
gaguuuaaggaagug

SEQ ID NO: 2788541 - RNA, 22 nt, Leptospira interrogans serovar lai str. 56601
gaguuuaguauaaucaaauaca

SEQ ID NO: 2788542 - RNA, 17 nt, Leptospira interrogans serovar lai str. 56601
gaguuucuugaacucaa

SEQ ID NO: 2788543 - RNA, 13 nt, Leptospira interrogans serovar lai str. 56601
gaguuugagagag

SEQ ID NO: 2788544 - RNA, 16 nt, Leptospira interrogans serovar lai str. 56601
gaguuugaguuucuuu

SEQ ID NO: 2788545 - RNA, 22 nt, Leptospira interrogans serovar lai str. 56601
gaguuuguucuaaaaacucaaa

SEQ ID NO: 2788546 - RNA, 15 nt, Leptospira interrogans serovar lai str. 56601
gaguuuuuuaaaauu

SEQ ID NO: 2788547 - RNA, 21 nt, Leptospira interrogans serovar lai str. 56601
gauaaaaaaauguuuagacuu

SEQ ID NO: 2788548 - RNA, 18 nt, Leptospira interrogans serovar lai str. 56601
gauaaaaaagaaagcaaa

SEQ ID NO: 2788549 - RNA, 23 nt, Leptospira interrogans serovar lai str. 56601
gauaaaaagucugucuuaaaauu

SEQ ID NO: 2788550 - RNA, 16 nt, Leptospira interrogans serovar lai str. 56601
gauaaacauuagaguu

SEQ ID NO: 2788551 - RNA, 21 nt, Leptospira interrogans serovar lai str. 56601
gauaaacuguaaacuugauua

SEQ ID NO: 2788552 - RNA, 19 nt, Leptospira interrogans serovar lai str. 56601
gauaaagaaaguaauuuug

SEQ ID NO: 2788553 - RNA, 15 nt, Leptospira interrogans serovar lai str. 56601
gauaaagaaucgaua

SEQ ID NO: 2788554 - RNA, 17 nt, Leptospira interrogans serovar lai str. 56601
gauaaagguaaaagaga

SEQ ID NO: 2788555 - RNA, 11 nt, Leptospira interrogans serovar lai str. 56601
gauaaaguaaa

SEQ ID NO: 2788556 - RNA, 21 nt, Leptospira interrogans serovar lai str. 56601
gauaaauagggaauauuccau

SEQ ID NO: 2788557 - RNA, 17 nt, Leptospira interrogans serovar lai str. 56601
gauaaaucgcaaauaca

SEQ ID NO: 2788558 - RNA, 13 nt, Leptospira interrogans serovar lai str. 56601
gauaaauuagaaa

SEQ ID NO: 2788559 - RNA, 18 nt, Leptospira interrogans serovar lai str. 56601
gauaaauuagaaaauuau

SEQ ID NO: 2788560 - RNA, 16 nt, Leptospira interrogans serovar lai str. 56601
gauaaauuuuagaaua

SEQ ID NO: 2788561 - RNA, 21 nt, Leptospira interrogans serovar lai str. 56601
gauaacgcguccucaaaucuu

SEQ ID NO: 2788562 - RNA, 19 nt, Leptospira interrogans serovar lai str. 56601
gauaacggucuccuuagaa

SEQ ID NO: 2788563 - RNA, 13 nt, Leptospira interrogans serovar lai str. 56601
gauaagaaaaauu

SEQ ID NO: 2788564 - RNA, 16 nt, Leptospira interrogans serovar lai str. 56601
gauaaggcuaaagaau

SEQ ID NO: 2788565 - RNA, 21 nt, Leptospira interrogans serovar lai str. 56601
gauaaguuuucuaguaaaaau

SEQ ID NO: 2788566 - RNA, 20 nt, Leptospira interrogans serovar lai str. 56601
gauaauaauuagaaaaauau

SEQ ID NO: 2788567 - RNA, 19 nt, Leptospira interrogans serovar lai str. 56601
gauaaucaucaaaaucagu

SEQ ID NO: 2788568 - RNA, 15 nt, Leptospira interrogans serovar lai str. 56601
gauaaucuaccccau

SEQ ID NO: 2788569 - RNA, 13 nt, Leptospira interrogans serovar lai str. 56601
gauaaugagccag

SEQ ID NO: 2788570 - RNA, 18 nt, Leptospira interrogans serovar lai str. 56601
gauaauuguagaagcaac

SEQ ID NO: 2788571 - RNA, 21 nt, Leptospira interrogans serovar lai str. 56601
gaugcuuucucuuuuuagaca

SEQ ID NO: 2788572 - RNA, 15 nt, Leptospira interrogans serovar lai str. 56601
gauggagauuacuuu

SEQ ID NO: 2788573 - RNA, 23 nt, Leptospira interrogans serovar lai str. 56601
gauggaucuauaucgugaaacuu

SEQ ID NO: 2788574 - RNA, 14 nt, Leptospira interrogans serovar lai str. 56601
gaugguuucaauuu

SEQ ID NO: 2788575 - RNA, 17 nt, Leptospira interrogans serovar lai str. 56601
gauguaagaaaauauug

SEQ ID NO: 2788576 - RNA, 12 nt, Leptospira interrogans serovar lai str. 56601
gauguaaggagc

SEQ ID NO: 2788577 - RNA, 23 nt, Leptospira interrogans serovar lai str. 56601
gauguagaguaaauuuugaaaau

SEQ ID NO: 2788578 - RNA, 21 nt, Leptospira interrogans serovar lai str. 56601
gauguauugaguuuaaggaag

SEQ ID NO: 2788579 - RNA, 18 nt, Leptospira interrogans serovar lai str. 56601
gaugucguuuaacaaaaa

SEQ ID NO: 2788580 - RNA, 21 nt, Leptospira interrogans serovar lai str. 56601
gaugucuaaauccuucaaaac

SEQ ID NO: 2788581 - RNA, 18 nt, Leptospira interrogans serovar lai str. 56601
gaugugaauucucuagaa

SEQ ID NO: 2788582 - RNA, 18 nt, Leptospira interrogans serovar lai str. 56601
gauguuugaauacauaca

SEQ ID NO: 2788583 - RNA, 12 nt, Leptospira interrogans serovar lai str. 56601
gauuaaaaaggu

SEQ ID NO: 2788584 - RNA, 13 nt, Leptospira interrogans serovar lai str. 56601
gauuaaaaauuuc

SEQ ID NO: 2788585 - RNA, 16 nt, Leptospira interrogans serovar lai str. 56601
gauuaaagauuuuucu

SEQ ID NO: 2788586 - RNA, 18 nt, Leptospira interrogans serovar lai str. 56601
gauuaaauuuuuauaaaa

SEQ ID NO: 2788587 - RNA, 20 nt, Leptospira interrogans serovar lai str. 56601
gauuaaauuuuuauaaaaua

SEQ ID NO: 2788588 - RNA, 15 nt, Leptospira interrogans serovar lai str. 56601
gauuaaucuguaaau

SEQ ID NO: 2788589 - RNA, 19 nt, Leptospira interrogans serovar lai str. 56601
gauuaaucuguaaaucaac

SEQ ID NO: 2788590 - RNA, 24 nt, Leptospira interrogans serovar lai str. 56601
gauuacaaaaaaugaauuuagcau

SEQ ID NO: 2788591 - RNA, 22 nt, Leptospira interrogans serovar lai str. 56601
gauuacaauuauacuauaaguu

SEQ ID NO: 2788592 - RNA, 14 nt, Leptospira interrogans serovar lai str. 56601
gauuaccuaacuau

SEQ ID NO: 2788593 - RNA, 22 nt, Leptospira interrogans serovar lai str. 56601
gauuacucaacagugauuucau

SEQ ID NO: 2788594 - RNA, 11 nt, Leptospira interrogans serovar lai str. 56601
gauuagaaaaa

SEQ ID NO: 2788595 - RNA, 14 nt, Leptospira interrogans serovar lai str. 56601
gauuagaaaaaaag

SEQ ID NO: 2788596 - RNA, 16 nt, Leptospira interrogans serovar lai str. 56601
gauuagaaaaaaagua

SEQ ID NO: 2788597 - RNA, 21 nt, Leptospira interrogans serovar lai str. 56601
gauuagaaaaaaaguauauau

SEQ ID NO: 2788598 - RNA, 16 nt, Leptospira interrogans serovar lai str. 56601
gauuagaagaauugua

SEQ ID NO: 2788599 - RNA, 15 nt, Leptospira interrogans serovar lai str. 56601
gauuagaguuaaauu

SEQ ID NO: 2788600 - RNA, 15 nt, Leptospira interrogans serovar lai str. 56601
gauuagcaugaaauu

SEQ ID NO: 2788601 - RNA, 16 nt, Leptospira interrogans serovar lai str. 56601
gauuaggucuaaaaga

SEQ ID NO: 2788602 - RNA, 18 nt, Leptospira interrogans serovar lai str. 56601
gauuauaaaaacaaguuu

SEQ ID NO: 2788603 - RNA, 20 nt, Leptospira interrogans serovar lai str. 56601
gauuauaaaaacaaguuuaa

SEQ ID NO: 2788604 - RNA, 17 nt, Leptospira interrogans serovar lai str. 56601
gauuauaaccugcaaca

SEQ ID NO: 2788605 - RNA, 12 nt, Leptospira interrogans serovar lai str. 56601
gauuaugaagaa

SEQ ID NO: 2788606 - RNA, 14 nt, Leptospira interrogans serovar lai str. 56601
gauuaugaagaaug

SEQ ID NO: 2788607 - RNA, 18 nt, Leptospira interrogans serovar lai str. 56601
gauuaugguaaaauuuca

SEQ ID NO: 2788608 - RNA, 17 nt, Leptospira interrogans serovar lai str. 56601
gauuaugugacuuuaau

SEQ ID NO: 2788609 - RNA, 19 nt, Leptospira interrogans serovar lai str. 56601
gauuauuuacauauauaau

SEQ ID NO: 2788610 - RNA, 18 nt, Leptospira interrogans serovar lai str. 56601
gauuauuucaaaaauuua

SEQ ID NO: 2788611 - RNA, 15 nt, Leptospira interrogans serovar lai str. 56601
gauuauuuuuuaaaa

SEQ ID NO: 2788612 - RNA, 19 nt, Leptospira interrogans serovar lai str. 56601
gauucaaagauaaaauaua

SEQ ID NO: 2788613 - RNA, 17 nt, Leptospira interrogans serovar lai str. 56601
gauucaauuauuauaaa

SEQ ID NO: 2788614 - RNA, 17 nt, Leptospira interrogans serovar lai str. 56601
gauucaauuuuuauaaa

SEQ ID NO: 2788615 - RNA, 21 nt, Leptospira interrogans serovar lai str. 56601
gauucaauuuuuauaaacuuc

SEQ ID NO: 2788616 - RNA, 22 nt, Leptospira interrogans serovar lai str. 56601
gauucacaaacgguuuuaguaa

SEQ ID NO: 2788617 - RNA, 12 nt, Leptospira interrogans serovar lai str. 56601
gauucacuucca

SEQ ID NO: 2788618 - RNA, 15 nt, Leptospira interrogans serovar lai str. 56601
gauucacuuccauug

SEQ ID NO: 2788619 - RNA, 13 nt, Leptospira interrogans serovar lai str. 56601
gauucauaaagag

SEQ ID NO: 2788620 - RNA, 19 nt, Leptospira interrogans serovar lai str. 56601
gauucauaaagagcguugu

SEQ ID NO: 2788621 - RNA, 18 nt, Leptospira interrogans serovar lai str. 56601
gauucaucgcuuuuaaau

SEQ ID NO: 2788622 - RNA, 14 nt, Leptospira interrogans serovar lai str. 56601
gauucauuucgaaa

SEQ ID NO: 2788623 - RNA, 21 nt, Leptospira interrogans serovar lai str. 56601
gauucauuucguaaaauccau

SEQ ID NO: 2788624 - RNA, 20 nt, Leptospira interrogans serovar lai str. 56601
gauuccaacuuuuucagaaa

SEQ ID NO: 2788625 - RNA, 15 nt, Leptospira interrogans serovar lai str. 56601
gauuccaagauuuuu

SEQ ID NO: 2788626 - RNA, 12 nt, Leptospira interrogans serovar lai str. 56601
gauuccauucuu

SEQ ID NO: 2788627 - RNA, 16 nt, Leptospira interrogans serovar lai str. 56601
gauuccgauucuccca

SEQ ID NO: 2788628 - RNA, 22 nt, Leptospira interrogans serovar lai str. 56601
gauuccuuuccgauuucuuuca

SEQ ID NO: 2788629 - RNA, 15 nt, Leptospira interrogans serovar lai str. 56601
gauuccuuuuaagaa

SEQ ID NO: 2788630 - RNA, 13 nt, Leptospira interrogans serovar lai str. 56601
gauucgaaagauu

SEQ ID NO: 2788631 - RNA, 14 nt, Leptospira interrogans serovar lai str. 56601
gauucgaaauuuuc

SEQ ID NO: 2788632 - RNA, 20 nt, Leptospira interrogans serovar lai str. 56601
gauucgaacuuuuuuuagaa

SEQ ID NO: 2788633 - RNA, 14 nt, Leptospira interrogans serovar lai str. 56601
gauucgcucaaauu

SEQ ID NO: 2788634 - RNA, 17 nt, Leptospira interrogans serovar lai str. 56601
gauucgcucaaauuuuc

SEQ ID NO: 2788635 - RNA, 14 nt, Leptospira interrogans serovar lai str. 56601
gauucguacaacca

SEQ ID NO: 2788636 - RNA, 18 nt, Leptospira interrogans serovar lai str. 56601
gauucuaaaaaaaguuuu

SEQ ID NO: 2788637 - RNA, 16 nt, Leptospira interrogans serovar lai str. 56601
gauucuaaaaaugaaa

SEQ ID NO: 2788638 - RNA, 13 nt, Leptospira interrogans serovar lai str. 56601
gauucuaauuuuu

SEQ ID NO: 2788639 - RNA, 17 nt, Leptospira interrogans serovar lai str. 56601
gauucuaggaaacucaa

SEQ ID NO: 2788640 - RNA, 22 nt, Leptospira interrogans serovar lai str. 56601
gauucuauccaauugaauauaa

SEQ ID NO: 2788641 - RNA, 21 nt, Leptospira interrogans serovar lai str. 56601
gauucuauuuucuuugaaaaa

SEQ ID NO: 2788642 - RNA, 14 nt, Leptospira interrogans serovar lai str. 56601
gauucuauuuugag

SEQ ID NO: 2788643 - RNA, 14 nt, Leptospira interrogans serovar lai str. 56601
gauucucaaaaugg

SEQ ID NO: 2788644 - RNA, 21 nt, Leptospira interrogans serovar lai str. 56601
gauucuccauccgaauugauc

SEQ ID NO: 2788645 - RNA, 15 nt, Leptospira interrogans serovar lai str. 56601
gauucucccacacau

SEQ ID NO: 2788646 - RNA, 22 nt, Leptospira interrogans serovar lai str. 56601
gauucucguucaacuuuccuuu

SEQ ID NO: 2788647 - RNA, 23 nt, Leptospira interrogans serovar lai str. 56601
gauucucguucaacuuuccuuuu

SEQ ID NO: 2788648 - RNA, 14 nt, Leptospira interrogans serovar lai str. 56601
gauucugaaaaaag

SEQ ID NO: 2788649 - RNA, 20 nt, Leptospira interrogans serovar lai str. 56601
gauucugauaacuauauaac

SEQ ID NO: 2788650 - RNA, 17 nt, Leptospira interrogans serovar lai str. 56601
gauucugcucuucuaau

SEQ ID NO: 2788651 - RNA, 15 nt, Leptospira interrogans serovar lai str. 56601
gauucuuuaaaugug

SEQ ID NO: 2788652 - RNA, 20 nt, Leptospira interrogans serovar lai str. 56601
gauucuuucgacuucuuuuu

SEQ ID NO: 2788653 - RNA, 17 nt, Leptospira interrogans serovar lai str. 56601
gauugaaaauuauagau

SEQ ID NO: 2788654 - RNA, 20 nt, Leptospira interrogans serovar lai str. 56601
gcaauucgcauuaaaauuuu

SEQ ID NO: 2788655 - RNA, 15 nt, Leptospira interrogans serovar lai str. 56601
gcaauuguuggcuuu

SEQ ID NO: 2788656 - RNA, 17 nt, Leptospira interrogans serovar lai str. 56601
gcaauuuagaauaaaga

SEQ ID NO: 2788657 - RNA, 21 nt, Leptospira interrogans serovar lai str. 56601
gcaauuuagaauaaagagaag

SEQ ID NO: 2788658 - RNA, 12 nt, Leptospira interrogans serovar lai str. 56601
gcacaaaccaaa

SEQ ID NO: 2788659 - RNA, 13 nt, Leptospira interrogans serovar lai str. 56601
gcacaaguuuuuu

SEQ ID NO: 2788660 - RNA, 14 nt, Leptospira interrogans serovar lai str. 56601
gcacaauauauuca

SEQ ID NO: 2788661 - RNA, 13 nt, Leptospira interrogans serovar lai str. 56601
gcacagcaaaaaa

SEQ ID NO: 2788662 - RNA, 15 nt, Leptospira interrogans serovar lai str. 56601
gcacauuuuucaagu

SEQ ID NO: 2788663 - RNA, 11 nt, Leptospira interrogans serovar lai str. 56601
gcaccugguuu

SEQ ID NO: 2788664 - RNA, 12 nt, Leptospira interrogans serovar lai str. 56601
gcacguggaaaa

SEQ ID NO: 2788665 - RNA, 18 nt, Leptospira interrogans serovar lai str. 56601
gcagaagcuuuauuaaau

SEQ ID NO: 2788666 - RNA, 14 nt, Leptospira interrogans serovar lai str. 56601
gcagaauguuuucu

SEQ ID NO: 2788667 - RNA, 18 nt, Leptospira interrogans serovar lai str. 56601
gcagacugauucuuuaaa

SEQ ID NO: 2788668 - RNA, 12 nt, Leptospira interrogans serovar lai str. 56601
gcagauuaaaaa

SEQ ID NO: 2788669 - RNA, 19 nt, Leptospira interrogans serovar lai str. 56601
gcagauuugauguaaagaa

SEQ ID NO: 2788670 - RNA, 21 nt, Leptospira interrogans serovar lai str. 56601
gcagauuugauguaaagaaaa

SEQ ID NO: 2788671 - RNA, 13 nt, Leptospira interrogans serovar lai str. 56601
gcagcaaagaagg

SEQ ID NO: 2788672 - RNA, 20 nt, Leptospira interrogans serovar lai str. 56601
gcagcauugaguuuaagaaa

SEQ ID NO: 2788673 - RNA, 21 nt, Leptospira interrogans serovar lai str. 56601
gcagcauugaguuuaagaaac

SEQ ID NO: 2788674 - RNA, 15 nt, Leptospira interrogans serovar lai str. 56601
gcagcuaagaaaaaa

SEQ ID NO: 2788675 - RNA, 21 nt, Leptospira interrogans serovar lai str. 56601
gcagcuucuuccaaagucaaa

SEQ ID NO: 2788676 - RNA, 14 nt, Leptospira interrogans serovar lai str. 56601
gcaguucaauuuuu

SEQ ID NO: 2788677 - RNA, 13 nt, Leptospira interrogans serovar lai str. 56601
gcauaaaaaaaua

SEQ ID NO: 2788678 - RNA, 18 nt, Leptospira interrogans serovar lai str. 56601
gcauaacgucuugauuau

SEQ ID NO: 2788679 - RNA, 15 nt, Leptospira interrogans serovar lai str. 56601
gcauaagcaaaaaua

SEQ ID NO: 2788680 - RNA, 16 nt, Leptospira interrogans serovar lai str. 56601
gcauaagcaaaaauaa

SEQ ID NO: 2788681 - RNA, 15 nt, Leptospira interrogans serovar lai str. 56601
gcauauaauuaaaaa

SEQ ID NO: 2788682 - RNA, 13 nt, Leptospira interrogans serovar lai str. 56601
gcaucuuuucuaa

SEQ ID NO: 2788683 - RNA, 22 nt, Leptospira interrogans serovar lai str. 56601
gcaugaaauuuucuuagaaaac

SEQ ID NO: 2788684 - RNA, 14 nt, Leptospira interrogans serovar lai str. 56601
gcaugaauggauuu

SEQ ID NO: 2788685 - RNA, 18 nt, Leptospira interrogans serovar lai str. 56601
gcaugaauuuguuuuucu

SEQ ID NO: 2788686 - RNA, 21 nt, Leptospira interrogans serovar lai str. 56601
gcauucaaaaaguuuuauaaa

SEQ ID NO: 2788687 - RNA, 18 nt, Leptospira interrogans serovar lai str. 56601
gcauucaaggaagugaaa

SEQ ID NO: 2788688 - RNA, 21 nt, Leptospira interrogans serovar lai str. 56601
gcauucaauuuaggaagcguu

SEQ ID NO: 2788689 - RNA, 15 nt, Leptospira interrogans serovar lai str. 56601
gcauucccauaaaag

SEQ ID NO: 2788690 - RNA, 13 nt, Leptospira interrogans serovar lai str. 56601
gcauucucacaaa

SEQ ID NO: 2788691 - RNA, 14 nt, Leptospira interrogans serovar lai str. 56601
gcauugaaaucaga

SEQ ID NO: 2788692 - RNA, 15 nt, Leptospira interrogans serovar lai str. 56601
gcauugaaaucagag

SEQ ID NO: 2788693 - RNA, 21 nt, Leptospira interrogans serovar lai str. 56601
gcauugaguuuaagaaacuca

SEQ ID NO: 2788694 - RNA, 23 nt, Leptospira interrogans serovar lai str. 56601
gcauugaguuuaagaaacucagu

SEQ ID NO: 2788695 - RNA, 13 nt, Leptospira interrogans serovar lai str. 56601
gcauugaugacaa

SEQ ID NO: 2788696 - RNA, 17 nt, Leptospira interrogans serovar lai str. 56601
gcauuguuuaaauagau

SEQ ID NO: 2788697 - RNA, 16 nt, Leptospira interrogans serovar lai str. 56601
gcauuuuaaacaaaga

SEQ ID NO: 2788698 - RNA, 14 nt, Leptospira interrogans serovar lai str. 56601
gcauuuuauuaaaa

SEQ ID NO: 2788699 - RNA, 17 nt, Leptospira interrogans serovar lai str. 56601
gcauuuuuaagauuaca

SEQ ID NO: 2788700 - RNA, 18 nt, Leptospira interrogans serovar lai str. 56601
gcauuuuuaagauuacau

SEQ ID NO: 2788701 - RNA, 15 nt, Leptospira interrogans serovar lai str. 56601
gcauuuuuuaaaugc

SEQ ID NO: 2788702 - RNA, 17 nt, Leptospira interrogans serovar lai str. 56601
gccaaaaacgcaaaaag

SEQ ID NO: 2788703 - RNA, 15 nt, Leptospira interrogans serovar lai str. 56601
gccaaaaauuagaau

SEQ ID NO: 2788704 - RNA, 18 nt, Leptospira interrogans serovar lai str. 56601
gccaaaaucccagaaagg

SEQ ID NO: 2788705 - RNA, 17 nt, Leptospira interrogans serovar lai str. 56601
gccaaucuccauuauag

SEQ ID NO: 2788706 - RNA, 16 nt, Leptospira interrogans serovar lai str. 56601
gccaucuuuuuuugcc

SEQ ID NO: 2788707 - RNA, 14 nt, Leptospira interrogans serovar lai str. 56601
gccaugccaaacac

SEQ ID NO: 2788708 - RNA, 22 nt, Leptospira interrogans serovar lai str. 56601
gccaugccaaacacgaauuccu

SEQ ID NO: 2788709 - RNA, 18 nt, Leptospira interrogans serovar lai str. 56601
gccauggaaauuuuuccg

SEQ ID NO: 2788710 - RNA, 20 nt, Leptospira interrogans serovar lai str. 56601
gccauguuuuuaaaaucuuc

SEQ ID NO: 2788711 - RNA, 18 nt, Leptospira interrogans serovar lai str. 56601
gccauuucaaaaauauau

SEQ ID NO: 2788712 - RNA, 16 nt, Leptospira interrogans serovar lai str. 56601
gccauuuccaauuuug

SEQ ID NO: 2788713 - RNA, 20 nt, Leptospira interrogans serovar lai str. 56601
gccauuuccaauuuugcuuc

SEQ ID NO: 2788714 - RNA, 15 nt, Leptospira interrogans serovar lai str. 56601
gcccacaucgaaaaa

SEQ ID NO: 2788715 - RNA, 17 nt, Leptospira interrogans serovar lai str. 56601
gccccaaaauuuagaau

SEQ ID NO: 2788716 - RNA, 15 nt, Leptospira interrogans serovar lai str. 56601
gcccgcguauauaaa

SEQ ID NO: 2788717 - RNA, 12 nt, Leptospira interrogans serovar lai str. 56601
gcccuccuaugu

SEQ ID NO: 2788718 - RNA, 19 nt, Leptospira interrogans serovar lai str. 56601
gcccuccuauguuucuugu

SEQ ID NO: 2788719 - RNA, 20 nt, Leptospira interrogans serovar lai str. 56601
gcccugcuuucagccccagu

SEQ ID NO: 2788720 - RNA, 13 nt, Leptospira interrogans serovar lai str. 56601
gccgaacucacgu

SEQ ID NO: 2788721 - RNA, 23 nt, Leptospira interrogans serovar lai str. 56601
gccgauucuaacugguuuuucuu

SEQ ID NO: 2788722 - RNA, 17 nt, Leptospira interrogans serovar lai str. 56601
gccgauuggcugauucc

SEQ ID NO: 2788723 - RNA, 13 nt, Leptospira interrogans serovar lai str. 56601
gccggagaaaauu

SEQ ID NO: 2788724 - RNA, 21 nt, Leptospira interrogans serovar lai str. 56601
gccgucuauaaaauucaaaaa

SEQ ID NO: 2788725 - RNA, 21 nt, Leptospira interrogans serovar lai str. 56601
gccguucugggcucaaaaagg

SEQ ID NO: 2788726 - RNA, 22 nt, Leptospira interrogans serovar lai str. 56601
gccguucugggcucaaaaaggc

SEQ ID NO: 2788727 - RNA, 14 nt, Leptospira interrogans serovar lai str. 56601
gccuaaauuccuuc

SEQ ID NO: 2788728 - RNA, 18 nt, Leptospira interrogans serovar lai str. 56601
gccuaaauuuuuaucaca

SEQ ID NO: 2788729 - RNA, 16 nt, Leptospira interrogans serovar lai str. 56601
gccugccaaaagaacu

SEQ ID NO: 2788730 - RNA, 15 nt, Leptospira interrogans serovar lai str. 56601
gccuucacccaccaa

SEQ ID NO: 2788731 - RNA, 23 nt, Leptospira interrogans serovar lai str. 56601
gccuucucucgacaaucaaaacu

SEQ ID NO: 2788732 - RNA, 15 nt, Leptospira interrogans serovar lai str. 56601
gccuucuuuucaaaa

SEQ ID NO: 2788733 - RNA, 16 nt, Leptospira interrogans serovar lai str. 56601
gccuucuuuucaaaag

SEQ ID NO: 2788734 - RNA, 16 nt, Leptospira interrogans serovar lai str. 56601
gccuuucuuauuaauu

SEQ ID NO: 2788735 - RNA, 15 nt, Leptospira interrogans serovar lai str. 56601
gccuuugguauuuua

SEQ ID NO: 2788736 - RNA, 12 nt, Leptospira interrogans serovar lai str. 56601
gcgaaagaaugu

SEQ ID NO: 2788737 - RNA, 21 nt, Leptospira interrogans serovar lai str. 56601
gcgaaagaauguauaccaaua

SEQ ID NO: 2788738 - RNA, 21 nt, Leptospira interrogans serovar lai str. 56601
ggagacuugauuugagaaucu

SEQ ID NO: 2788739 - RNA, 14 nt, Leptospira interrogans serovar lai str. 56601
ggagauaaaaaagg

SEQ ID NO: 2788740 - RNA, 20 nt, Leptospira interrogans serovar lai str. 56601
ggagauuacuuuuucugguu

SEQ ID NO: 2788741 - RNA, 21 nt, Leptospira interrogans serovar lai str. 56601
ggagcgcuugaaaauucuaag

SEQ ID NO: 2788742 - RNA, 15 nt, Leptospira interrogans serovar lai str. 56601
ggaggauaaauuaga

SEQ ID NO: 2788743 - RNA, 19 nt, Leptospira interrogans serovar lai str. 56601
ggauaaauuuuagaauauc

SEQ ID NO: 2788744 - RNA, 21 nt, Leptospira interrogans serovar lai str. 56601
ggauaacccucaucagucauu

SEQ ID NO: 2788745 - RNA, 17 nt, Leptospira interrogans serovar lai str. 56601
ggauaaccuaaaauuuc

SEQ ID NO: 2788746 - RNA, 23 nt, Leptospira interrogans serovar lai str. 56601
ggauccuuacgaucuaaaaggac

SEQ ID NO: 2788747 - RNA, 18 nt, Leptospira interrogans serovar lai str. 56601
ggaucuaaacuuugcaaa

SEQ ID NO: 2788748 - RNA, 16 nt, Leptospira interrogans serovar lai str. 56601
ggaugcgcaaacucag

SEQ ID NO: 2788749 - RNA, 15 nt, Leptospira interrogans serovar lai str. 56601
ggauggaaaaugaau

SEQ ID NO: 2788750 - RNA, 19 nt, Leptospira interrogans serovar lai str. 56601
ggauggaugcgcaaacuca

SEQ ID NO: 2788751 - RNA, 13 nt, Leptospira interrogans serovar lai str. 56601
ggauuaugaagaa

SEQ ID NO: 2788752 - RNA, 21 nt, Leptospira interrogans serovar lai str. 56601
ggauucuuuucccgcuaaaag

SEQ ID NO: 2788753 - RNA, 14 nt, Leptospira interrogans serovar lai str. 56601
ggauuuguaauagu

SEQ ID NO: 2788754 - RNA, 23 nt, Leptospira interrogans serovar lai str. 56601
ggauuuuauaaaguaaagguuuc

SEQ ID NO: 2788755 - RNA, 23 nt, Leptospira interrogans serovar lai str. 56601
ggauuuugaucuuuuuuucuaga

SEQ ID NO: 2788756 - RNA, 18 nt, Leptospira interrogans serovar lai str. 56601
ggcagccaauuccaaacg

SEQ ID NO: 2788757 - RNA, 17 nt, Leptospira interrogans serovar lai str. 56601
ggcagcuaagaaaaaag

SEQ ID NO: 2788758 - RNA, 18 nt, Leptospira interrogans serovar lai str. 56601
ggcaggaucaaaauccgu

SEQ ID NO: 2788759 - RNA, 18 nt, Leptospira interrogans serovar lai str. 56601
ggcaguacaauucaaaac

SEQ ID NO: 2788760 - RNA, 18 nt, Leptospira interrogans serovar lai str. 56601
ggcauaggaaauaauucc

SEQ ID NO: 2788761 - RNA, 23 nt, Leptospira interrogans serovar lai str. 56601
ggcauaggaaauaauuccuccau

SEQ ID NO: 2788762 - RNA, 13 nt, Leptospira interrogans serovar lai str. 56601
ggcauuaauauaa

SEQ ID NO: 2788763 - RNA, 13 nt, Leptospira interrogans serovar lai str. 56601
ggcauuuauauuc

SEQ ID NO: 2788764 - RNA, 20 nt, Leptospira interrogans serovar lai str. 56601
ggccaaauuugcgaaaaaaa

SEQ ID NO: 2788765 - RNA, 22 nt, Leptospira interrogans serovar lai str. 56601
ggccaaauuugcgaaaaaaaua

SEQ ID NO: 2788766 - RNA, 20 nt, Leptospira interrogans serovar lai str. 56601
ggccccaccuaaaaugaaaa

SEQ ID NO: 2788767 - RNA, 14 nt, Leptospira interrogans serovar lai str. 56601
ggccuuuuuuauuu

SEQ ID NO: 2788768 - RNA, 15 nt, Leptospira interrogans serovar lai str. 56601
ggcgaauaaaaaacu

SEQ ID NO: 2788769 - RNA, 13 nt, Leptospira interrogans serovar lai str. 56601
ggcgaaucgcucg

SEQ ID NO: 2788770 - RNA, 19 nt, Leptospira interrogans serovar lai str. 56601
ggcgagacauaaaaaaauu

SEQ ID NO: 2788771 - RNA, 19 nt, Leptospira interrogans serovar lai str. 56601
ggcgguucuaaaaguccca

SEQ ID NO: 2788772 - RNA, 18 nt, Leptospira interrogans serovar lai str. 56601
ggcuauuuuacugauuua

SEQ ID NO: 2788773 - RNA, 12 nt, Leptospira interrogans serovar lai str. 56601
ggcucaacuuuu

SEQ ID NO: 2788774 - RNA, 21 nt, Leptospira interrogans serovar lai str. 56601
ggcucaauauuuaaaaauucu

SEQ ID NO: 2788775 - RNA, 12 nt, Leptospira interrogans serovar lai str. 56601
ggcucccacaau

SEQ ID NO: 2788776 - RNA, 15 nt, Leptospira interrogans serovar lai str. 56601
ggcucgguaaaaaga

SEQ ID NO: 2788777 - RNA, 18 nt, Leptospira interrogans serovar lai str. 56601
ggcugauucccaguaaau

SEQ ID NO: 2788778 - RNA, 14 nt, Leptospira interrogans serovar lai str. 56601
ggcugcuuuuuuga

SEQ ID NO: 2788779 - RNA, 20 nt, Leptospira interrogans serovar lai str. 56601
ggcuucgaucguaaaauuuu

SEQ ID NO: 2788780 - RNA, 16 nt, Leptospira interrogans serovar lai str. 56601
gggaacuaccaccaaa

SEQ ID NO: 2788781 - RNA, 18 nt, Leptospira interrogans serovar lai str. 56601
gggaacuacuacaaaaau

SEQ ID NO: 2788782 - RNA, 23 nt, Leptospira interrogans serovar lai str. 56601
gggaacuacuacauuuuauugug

SEQ ID NO: 2788783 - RNA, 17 nt, Leptospira interrogans serovar lai str. 56601
gggaacuacuaugaaau

SEQ ID NO: 2788784 - RNA, 15 nt, Leptospira interrogans serovar lai str. 56601
gggaacucucacaaa

SEQ ID NO: 2788785 - RNA, 22 nt, Leptospira interrogans serovar lai str. 56601
gggaaguaauuuucgaauucuu

SEQ ID NO: 2788786 - RNA, 12 nt, Leptospira interrogans serovar lai str. 56601
gggaauaaaaac

SEQ ID NO: 2788787 - RNA, 19 nt, Leptospira interrogans serovar lai str. 56601
gggaauaaaaacaaaauca

SEQ ID NO: 2788788 - RNA, 18 nt, Leptospira interrogans serovar lai str. 56601
gggaauuacuacaaauua

SEQ ID NO: 2788789 - RNA, 22 nt, Leptospira interrogans serovar lai str. 56601
gggaauuuuuguaaaauccaga

SEQ ID NO: 2788790 - RNA, 13 nt, Leptospira interrogans serovar lai str. 56601
gggacaagcucau

SEQ ID NO: 2788791 - RNA, 14 nt, Leptospira interrogans serovar lai str. 56601
gggagcgcuugaaa

SEQ ID NO: 2788792 - RNA, 18 nt, Leptospira interrogans serovar lai str. 56601
gggauuuuaaaaauuuug

SEQ ID NO: 2788793 - RNA, 14 nt, Leptospira interrogans serovar lai str. 56601
gggcgaaucgcucg

SEQ ID NO: 2788794 - RNA, 21 nt, Leptospira interrogans serovar lai str. 56601
ggguugguuaugguaaggagc

SEQ ID NO: 2788795 - RNA, 12 nt, Leptospira interrogans serovar lai str. 56601
gguaaaaaauac

SEQ ID NO: 2788796 - RNA, 23 nt, Leptospira interrogans serovar lai str. 56601
gguaaaaucuuuaaguuugugag

SEQ ID NO: 2788797 - RNA, 18 nt, Leptospira interrogans serovar lai str. 56601
gguaaauuuuuuagaaau

SEQ ID NO: 2788798 - RNA, 23 nt, Leptospira interrogans serovar lai str. 56601
gguaaauuuuuuagaaaucaauu

SEQ ID NO: 2788799 - RNA, 14 nt, Leptospira interrogans serovar lai str. 56601
gguaaggagcucau

SEQ ID NO: 2788800 - RNA, 13 nt, Leptospira interrogans serovar lai str. 56601
gguaauuugugaa

SEQ ID NO: 2788801 - RNA, 11 nt, Leptospira interrogans serovar lai str. 56601
gguacuuuacg

SEQ ID NO: 2788802 - RNA, 22 nt, Leptospira interrogans serovar lai str. 56601
gguaguucccacaaauuccaau

SEQ ID NO: 2788803 - RNA, 19 nt, Leptospira interrogans serovar lai str. 56601
gguauaaaauaaaaauuuc

SEQ ID NO: 2788804 - RNA, 12 nt, Leptospira interrogans serovar lai str. 56601
gguauuuauuau

SEQ ID NO: 2788805 - RNA, 18 nt, Leptospira interrogans serovar lai str. 56601
gguauuuuagguauuucu

SEQ ID NO: 2788806 - RNA, 19 nt, Leptospira interrogans serovar lai str. 56601
ggucccaaacuuucuuuuu

SEQ ID NO: 2788807 - RNA, 16 nt, Leptospira interrogans serovar lai str. 56601
ggucgauuuugauucg

SEQ ID NO: 2788808 - RNA, 20 nt, Leptospira interrogans serovar lai str. 56601
ggucggaauuacgacaaguc

SEQ ID NO: 2788809 - RNA, 16 nt, Leptospira interrogans serovar lai str. 56601
ggucucaacaacucua

SEQ ID NO: 2788810 - RNA, 21 nt, Leptospira interrogans serovar lai str. 56601
ggugaacuauuuauaaaauaa

SEQ ID NO: 2788811 - RNA, 16 nt, Leptospira interrogans serovar lai str. 56601
ggugaucuuagaaaac

SEQ ID NO: 2788812 - RNA, 15 nt, Leptospira interrogans serovar lai str. 56601
ggugauuuaaaaaua

SEQ ID NO: 2788813 - RNA, 13 nt, Leptospira interrogans serovar lai str. 56601
gguuaauuaaaug

SEQ ID NO: 2788814 - RNA, 18 nt, Leptospira interrogans serovar lai str. 56601
gguuaucgucaaaauuua

SEQ ID NO: 2788815 - RNA, 22 nt, Leptospira interrogans serovar lai str. 56601
gguuaugguaaggagcucauca

SEQ ID NO: 2788816 - RNA, 21 nt, Leptospira interrogans serovar lai str. 56601
gguucacguuaauugagauuu

SEQ ID NO: 2788817 - RNA, 13 nt, Leptospira interrogans serovar lai str. 56601
gguucuauaaaag

SEQ ID NO: 2788818 - RNA, 17 nt, Leptospira interrogans serovar lai str. 56601
gguucuugcaaaaauag

SEQ ID NO: 2788819 - RNA, 18 nt, Leptospira interrogans serovar lai str. 56601
gguugagcaguaaaaucu

SEQ ID NO: 2788820 - RNA, 18 nt, Leptospira interrogans serovar lai str. 56601
gguugaguaguaaaaucu

SEQ ID NO: 2788821 - RNA, 13 nt, Leptospira interrogans serovar lai str. 56601
guaauuuaaaaaa

SEQ ID NO: 2788822 - RNA, 15 nt, Leptospira interrogans serovar lai str. 56601
guaauuuaaaaaaau

SEQ ID NO: 2788823 - RNA, 21 nt, Leptospira interrogans serovar lai str. 56601
guaauuucauaaaauucuuag

SEQ ID NO: 2788824 - RNA, 22 nt, Leptospira interrogans serovar lai str. 56601
guaauuucguuuuuuuaauauu

SEQ ID NO: 2788825 - RNA, 11 nt, Leptospira interrogans serovar lai str. 56601
guaauuuugaa

SEQ ID NO: 2788826 - RNA, 19 nt, Leptospira interrogans serovar lai str. 56601
guacaacauccuucaaacu

SEQ ID NO: 2788827 - RNA, 13 nt, Leptospira interrogans serovar lai str. 56601
guacaagaaucaa

SEQ ID NO: 2788828 - RNA, 19 nt, Leptospira interrogans serovar lai str. 56601
guacaaucggguaaaaaau

SEQ ID NO: 2788829 - RNA, 21 nt, Leptospira interrogans serovar lai str. 56601
guacaaucggguaaaaaauac

SEQ ID NO: 2788830 - RNA, 13 nt, Leptospira interrogans serovar lai str. 56601
guacaauucaaaa

SEQ ID NO: 2788831 - RNA, 13 nt, Leptospira interrogans serovar lai str. 56601
guacauaaaucag

SEQ ID NO: 2788832 - RNA, 16 nt, Leptospira interrogans serovar lai str. 56601
guacaucuuaaaaaau

SEQ ID NO: 2788833 - RNA, 23 nt, Leptospira interrogans serovar lai str. 56601
guacauggcauccaggauuuuca

SEQ ID NO: 2788834 - RNA, 14 nt, Leptospira interrogans serovar lai str. 56601
guacccuuaaaauc

SEQ ID NO: 2788835 - RNA, 14 nt, Leptospira interrogans serovar lai str. 56601
guacguaaaaauga

SEQ ID NO: 2788836 - RNA, 17 nt, Leptospira interrogans serovar lai str. 56601
guacuaauucuuuugca

SEQ ID NO: 2788837 - RNA, 23 nt, Leptospira interrogans serovar lai str. 56601
guacuauauuuuugugaaacuca

SEQ ID NO: 2788838 - RNA, 14 nt, Leptospira interrogans serovar lai str. 56601
guacuuaaauuuua

SEQ ID NO: 2788839 - RNA, 16 nt, Leptospira interrogans serovar lai str. 56601
guagaaacuuauacuu

SEQ ID NO: 2788840 - RNA, 16 nt, Leptospira interrogans serovar lai str. 56601
guagaaaguuauuuua

SEQ ID NO: 2788841 - RNA, 22 nt, Leptospira interrogans serovar lai str. 56601
guagaaauuuaauuugaucauc

SEQ ID NO: 2788842 - RNA, 23 nt, Leptospira interrogans serovar lai str. 56601
guagaaccuaaaaauauggaagc

SEQ ID NO: 2788843 - RNA, 19 nt, Leptospira interrogans serovar lai str. 56601
guagaaccuggauuuguaa

SEQ ID NO: 2788844 - RNA, 15 nt, Leptospira interrogans serovar lai str. 56601
guagaauugaucuga

SEQ ID NO: 2788845 - RNA, 16 nt, Leptospira interrogans serovar lai str. 56601
guagacaacuaaaaga

SEQ ID NO: 2788846 - RNA, 12 nt, Leptospira interrogans serovar lai str. 56601
guagagaaacuu

SEQ ID NO: 2788847 - RNA, 15 nt, Leptospira interrogans serovar lai str. 56601
guagagaaacuuagc

SEQ ID NO: 2788848 - RNA, 20 nt, Leptospira interrogans serovar lai str. 56601
guagagaagcagcauugagu

SEQ ID NO: 2788849 - RNA, 19 nt, Leptospira interrogans serovar lai str. 56601
guagagauugauauucaaa

SEQ ID NO: 2788850 - RNA, 15 nt, Leptospira interrogans serovar lai str. 56601
guagaguaagaaaca

SEQ ID NO: 2788851 - RNA, 17 nt, Leptospira interrogans serovar lai str. 56601
guagauaauuaaacaaa

SEQ ID NO: 2788852 - RNA, 13 nt, Leptospira interrogans serovar lai str. 56601
guagaucaaaucu

SEQ ID NO: 2788853 - RNA, 16 nt, Leptospira interrogans serovar lai str. 56601
guagaucaaaucugaa

SEQ ID NO: 2788854 - RNA, 21 nt, Leptospira interrogans serovar lai str. 56601
guagaucaaaucugaaauuca

SEQ ID NO: 2788855 - RNA, 12 nt, Leptospira interrogans serovar lai str. 56601
guagaucuuuua

SEQ ID NO: 2788856 - RNA, 14 nt, Leptospira interrogans serovar lai str. 56601
guagauguaauacg

SEQ ID NO: 2788857 - RNA, 17 nt, Leptospira interrogans serovar lai str. 56601
guagauugauuuuucua

SEQ ID NO: 2788858 - RNA, 21 nt, Leptospira interrogans serovar lai str. 56601
guagauugcuuuuuaaaagau

SEQ ID NO: 2788859 - RNA, 14 nt, Leptospira interrogans serovar lai str. 56601
guagauuuuaacaa

SEQ ID NO: 2788860 - RNA, 16 nt, Leptospira interrogans serovar lai str. 56601
guagccaaaaauuaga

SEQ ID NO: 2788861 - RNA, 20 nt, Leptospira interrogans serovar lai str. 56601
guaggaacuacagcaaauca

SEQ ID NO: 2788862 - RNA, 21 nt, Leptospira interrogans serovar lai str. 56601
guaggaacuaccgcaaaucaa

SEQ ID NO: 2788863 - RNA, 12 nt, Leptospira interrogans serovar lai str. 56601
guaggaacuauu

SEQ ID NO: 2788864 - RNA, 10 nt, Leptospira interrogans serovar lai str. 56601
guaggaacuc

SEQ ID NO: 2788865 - RNA, 13 nt, Leptospira interrogans serovar lai str. 56601
guaguaaauaaaa

SEQ ID NO: 2788866 - RNA, 24 nt, Leptospira interrogans serovar lai str. 56601
guaguagucuuacaauuuuagaau

SEQ ID NO: 2788867 - RNA, 14 nt, Leptospira interrogans serovar lai str. 56601
guaguaguucccac

SEQ ID NO: 2788868 - RNA, 22 nt, Leptospira interrogans serovar lai str. 56601
guagucuuacaauuuuagaauu

SEQ ID NO: 2788869 - RNA, 18 nt, Leptospira interrogans serovar lai str. 56601
guaguuccuacauuuuag

SEQ ID NO: 2788870 - RNA, 22 nt, Leptospira interrogans serovar lai str. 56601
guaguuccuacgguuuuaguca

SEQ ID NO: 2788871 - RNA, 13 nt, Leptospira interrogans serovar lai str. 56601
guauaaaauaaaa

SEQ ID NO: 2788872 - RNA, 20 nt, Leptospira interrogans serovar lai str. 56601
guauaagucgaucuacuaaa

SEQ ID NO: 2788873 - RNA, 14 nt, Leptospira interrogans serovar lai str. 56601
guauaauauuuauu

SEQ ID NO: 2788874 - RNA, 20 nt, Leptospira interrogans serovar lai str. 56601
guauaauucuguaaaaauag

SEQ ID NO: 2788875 - RNA, 12 nt, Leptospira interrogans serovar lai str. 56601
guauauaaaaaa

SEQ ID NO: 2788876 - RNA, 21 nt, Leptospira interrogans serovar lai str. 56601
guauauaaacgaguaguucuu

SEQ ID NO: 2788877 - RNA, 18 nt, Leptospira interrogans serovar lai str. 56601
guauauaaauuuauauuu

SEQ ID NO: 2788878 - RNA, 17 nt, Leptospira interrogans serovar lai str. 56601
guauauuaacuuucauu

SEQ ID NO: 2788879 - RNA, 13 nt, Leptospira interrogans serovar lai str. 56601
guauauuauaaaa

SEQ ID NO: 2788880 - RNA, 19 nt, Leptospira interrogans serovar lai str. 56601
guauauuauaaaauuugcg

SEQ ID NO: 2788881 - RNA, 22 nt, Leptospira interrogans serovar lai str. 56601
guaucaccguaauucuuaauuu

SEQ ID NO: 2788882 - RNA, 12 nt, Leptospira interrogans serovar lai str. 56601
guauccauuucg

SEQ ID NO: 2788883 - RNA, 17 nt, Leptospira interrogans serovar lai str. 56601
guauccgaaaaauucca

SEQ ID NO: 2788884 - RNA, 21 nt, Leptospira interrogans serovar lai str. 56601
guaucgaauggaaaucuuuua

SEQ ID NO: 2788885 - RNA, 19 nt, Leptospira interrogans serovar lai str. 56601
guaucuugcguuaaaacgg

SEQ ID NO: 2788886 - RNA, 15 nt, Leptospira interrogans serovar lai str. 56601
guaugaguucccaca

SEQ ID NO: 2788887 - RNA, 13 nt, Leptospira interrogans serovar lai str. 56601
guaugaguuccua

SEQ ID NO: 2788888 - RNA, 18 nt, Leptospira interrogans serovar lai str. 56601
guaugcaggaaacauaau

SEQ ID NO: 2788889 - RNA, 17 nt, Leptospira interrogans serovar lai str. 56601
guauuacucagaguuau

SEQ ID NO: 2788890 - RNA, 14 nt, Leptospira interrogans serovar lai str. 56601
guauuauaaacagu

SEQ ID NO: 2788891 - RNA, 11 nt, Leptospira interrogans serovar lai str. 56601
guauuauaaau

SEQ ID NO: 2788892 - RNA, 15 nt, Leptospira interrogans serovar lai str. 56601
guauuauaaauuuug

SEQ ID NO: 2788893 - RNA, 15 nt, Leptospira interrogans serovar lai str. 56601
guauucaagagcaaa

SEQ ID NO: 2788894 - RNA, 20 nt, Leptospira interrogans serovar lai str. 56601
guauuccaagggaagguuuu

SEQ ID NO: 2788895 - RNA, 21 nt, Leptospira interrogans serovar lai str. 56601
guauucucccccaacugaaaa

SEQ ID NO: 2788896 - RNA, 14 nt, Leptospira interrogans serovar lai str. 56601
guauucuuuccaac

SEQ ID NO: 2788897 - RNA, 17 nt, Leptospira interrogans serovar lai str. 56601
guauuguuaagauaaau

SEQ ID NO: 2788898 - RNA, 19 nt, Leptospira interrogans serovar lai str. 56601
guauuguuaagauaaauuu

SEQ ID NO: 2788899 - RNA, 21 nt, Leptospira interrogans serovar lai str. 56601
guauuguuaagauaaauuuag

SEQ ID NO: 2788900 - RNA, 13 nt, Leptospira interrogans serovar lai str. 56601
guauuuaaaauua

SEQ ID NO: 2788901 - RNA, 20 nt, Leptospira interrogans serovar lai str. 56601
guauuuaaugaccacaaacu

SEQ ID NO: 2788902 - RNA, 22 nt, Leptospira interrogans serovar lai str. 56601
guauuuaguuuuuugaguccac

SEQ ID NO: 2788903 - RNA, 14 nt, Leptospira interrogans serovar lai str. 56601
guauuugaucucaa

SEQ ID NO: 2788904 - RNA, 12 nt, Leptospira interrogans serovar lai str. 56601
gugaacuuuaga

SEQ ID NO: 2788905 - RNA, 16 nt, Leptospira interrogans serovar lai str. 56601
gugaacuuuuaagcag

SEQ ID NO: 2788906 - RNA, 12 nt, Leptospira interrogans serovar lai str. 56601
gugaagauuugu

SEQ ID NO: 2788907 - RNA, 14 nt, Leptospira interrogans serovar lai str. 56601
gugaaucaaaaggu

SEQ ID NO: 2788908 - RNA, 22 nt, Leptospira interrogans serovar lai str. 56601
gugaaucaaaagguauaaaaua

SEQ ID NO: 2788909 - RNA, 16 nt, Leptospira interrogans serovar lai str. 56601
gugaauuaaaagaaac

SEQ ID NO: 2788910 - RNA, 16 nt, Leptospira interrogans serovar lai str. 56601
gugaauucagaaaaaa

SEQ ID NO: 2788911 - RNA, 16 nt, Leptospira interrogans serovar lai str. 56601
gugaauuuugcucacu

SEQ ID NO: 2788912 - RNA, 12 nt, Leptospira interrogans serovar lai str. 56601
gugaccaccuau

SEQ ID NO: 2788913 - RNA, 17 nt, Leptospira interrogans serovar lai str. 56601
gugacggcaaugugcaa

SEQ ID NO: 2788914 - RNA, 11 nt, Leptospira interrogans serovar lai str. 56601
gugacuaaaau

SEQ ID NO: 2788915 - RNA, 23 nt, Leptospira interrogans serovar lai str. 56601
gugauaagaggccuuuuucuugc

SEQ ID NO: 2788916 - RNA, 18 nt, Leptospira interrogans serovar lai str. 56601
gugauuaaaccgguaaaa

SEQ ID NO: 2788917 - RNA, 22 nt, Leptospira interrogans serovar lai str. 56601
gugauuguuuguuuuuuccagc

SEQ ID NO: 2788918 - RNA, 16 nt, Leptospira interrogans serovar lai str. 56601
gugauuuaaaaauagu

SEQ ID NO: 2788919 - RNA, 23 nt, Leptospira interrogans serovar lai str. 56601
gugcaacgcguuuuaguuuuaua

SEQ ID NO: 2788920 - RNA, 17 nt, Leptospira interrogans serovar lai str. 56601
gugcagauuaaaaaaua

SEQ ID NO: 2788921 - RNA, 23 nt, Leptospira interrogans serovar lai str. 56601
gugcaugaaaauaauaucaaaau

SEQ ID NO: 2788922 - RNA, 23 nt, Leptospira interrogans serovar lai str. 56601
gugcaugcaucaacguaaauaaa

SEQ ID NO: 2788923 - RNA, 18 nt, Leptospira interrogans serovar lai str. 56601
gugcauuuaaaaaauuca

SEQ ID NO: 2788924 - RNA, 22 nt, Leptospira interrogans serovar lai str. 56601
gugcauuuaaaaaauucaauuc

SEQ ID NO: 2788925 - RNA, 15 nt, Leptospira interrogans serovar lai str. 56601
gugccucucgccaaa

SEQ ID NO: 2788926 - RNA, 19 nt, Leptospira interrogans serovar lai str. 56601
gugcgacuacgauuucauc

SEQ ID NO: 2788927 - RNA, 12 nt, Leptospira interrogans serovar lai str. 56601
gugcuacugcaa

SEQ ID NO: 2788928 - RNA, 19 nt, Leptospira interrogans serovar lai str. 56601
gugcucgaaguaacucagc

SEQ ID NO: 2788929 - RNA, 22 nt, Leptospira interrogans serovar lai str. 56601
gugcuuuguucaaagaaaugug

SEQ ID NO: 2788930 - RNA, 12 nt, Leptospira interrogans serovar lai str. 56601
guggaaacgucc

SEQ ID NO: 2788931 - RNA, 20 nt, Leptospira interrogans serovar lai str. 56601
guggaacucuauauaaagaa

SEQ ID NO: 2788932 - RNA, 19 nt, Leptospira interrogans serovar lai str. 56601
guggaaguuuucaaaaaau

SEQ ID NO: 2788933 - RNA, 23 nt, Leptospira interrogans serovar lai str. 56601
gugggaacuacuacgaaaauuua

SEQ ID NO: 2788934 - RNA, 17 nt, Leptospira interrogans serovar lai str. 56601
gugggaacuauuacaaa

SEQ ID NO: 2788935 - RNA, 20 nt, Leptospira interrogans serovar lai str. 56601
gugggaacuauuauaaaaua

SEQ ID NO: 2788936 - RNA, 21 nt, Leptospira interrogans serovar lai str. 56601
gugggaacucucacaaaucau

SEQ ID NO: 2788937 - RNA, 14 nt, Leptospira interrogans serovar lai str. 56601
gugguaguucccac

SEQ ID NO: 2788938 - RNA, 13 nt, Leptospira interrogans serovar lai str. 56601
gugguaguuccua

SEQ ID NO: 2788939 - RNA, 16 nt, Leptospira interrogans serovar lai str. 56601
guggucaacaucucaa

SEQ ID NO: 2788940 - RNA, 20 nt, Leptospira interrogans serovar lai str. 56601
guggucaacaucucaaucaa

SEQ ID NO: 2788941 - RNA, 14 nt, Leptospira interrogans serovar lai str. 56601
guguaaaauuaaaa

SEQ ID NO: 2788942 - RNA, 20 nt, Leptospira interrogans serovar lai str. 56601
guguaaucuuauuuuuuaau

SEQ ID NO: 2788943 - RNA, 13 nt, Leptospira interrogans serovar lai str. 56601
guguccauuucaa

SEQ ID NO: 2788944 - RNA, 21 nt, Leptospira interrogans serovar lai str. 56601
guguggauaccuuuaguuuuu

SEQ ID NO: 2788945 - RNA, 18 nt, Leptospira interrogans serovar lai str. 56601
guguggucuauuacaaaa

SEQ ID NO: 2788946 - RNA, 14 nt, Leptospira interrogans serovar lai str. 56601
guguuaguucccac

SEQ ID NO: 2788947 - RNA, 17 nt, Leptospira interrogans serovar lai str. 56601
guguuaguucccacaaa

SEQ ID NO: 2788948 - RNA, 23 nt, Leptospira interrogans serovar lai str. 56601
guguucaucguuccaaacccugc

SEQ ID NO: 2788949 - RNA, 13 nt, Leptospira interrogans serovar lai str. 56601
guguuccgacaag

SEQ ID NO: 2788950 - RNA, 21 nt, Leptospira interrogans serovar lai str. 56601
guguugacucuuuugagaaac

SEQ ID NO: 2788951 - RNA, 14 nt, Leptospira interrogans serovar lai str. 56601
guguugaguuucaa

SEQ ID NO: 2788952 - RNA, 22 nt, Leptospira interrogans serovar lai str. 56601
guguugaguuuucccuauuuuu

SEQ ID NO: 2788953 - RNA, 22 nt, Leptospira interrogans serovar lai str. 56601
guguugaguuuuuccuauuuuu

SEQ ID NO: 2788954 - RNA, 16 nt, Leptospira interrogans serovar lai str. 56601
guguuuauaaaaaccu

SEQ ID NO: 2788955 - RNA, 19 nt, Leptospira interrogans serovar lai str. 56601
guguuuugugauaaaauua

SEQ ID NO: 2788956 - RNA, 21 nt, Leptospira interrogans serovar lai str. 56601
guuaaaaaaugaauuuuucau

SEQ ID NO: 2788957 - RNA, 23 nt, Leptospira interrogans serovar lai str. 56601
guuaaaagauuuguuuuauaaaa

SEQ ID NO: 2788958 - RNA, 14 nt, Leptospira interrogans serovar lai str. 56601
guuaaaauaaaaaa

SEQ ID NO: 2788959 - RNA, 22 nt, Leptospira interrogans serovar lai str. 56601
guuaaaguuuacaucaaaaaca

SEQ ID NO: 2788960 - RNA, 23 nt, Leptospira interrogans serovar lai str. 56601
guuaaaguuuacaucaaaaacaa

SEQ ID NO: 2788961 - RNA, 11 nt, Leptospira interrogans serovar lai str. 56601
guuaaauuuuu

SEQ ID NO: 2788962 - RNA, 23 nt, Leptospira interrogans serovar lai str. 56601
guuaagaagauaaauauuuccaa

SEQ ID NO: 2788963 - RNA, 18 nt, Leptospira interrogans serovar lai str. 56601
guuaagagaauuucuaua

SEQ ID NO: 2788964 - RNA, 16 nt, Leptospira interrogans serovar lai str. 56601
guuaagucguuguauu

SEQ ID NO: 2788965 - RNA, 18 nt, Leptospira interrogans serovar lai str. 56601
guuaauaaauuuuugacu

SEQ ID NO: 2788966 - RNA, 18 nt, Leptospira interrogans serovar lai str. 56601
guuaauacaaaaaacuga

SEQ ID NO: 2788967 - RNA, 22 nt, Leptospira interrogans serovar lai str. 56601
guuaauuguuguuauggaauuu

SEQ ID NO: 2788968 - RNA, 14 nt, Leptospira interrogans serovar lai str. 56601
guuaauuuagaaua

SEQ ID NO: 2788969 - RNA, 18 nt, Leptospira interrogans serovar lai str. 56601
guuaauuuagaauaaaaa

SEQ ID NO: 2788970 - RNA, 19 nt, Leptospira interrogans serovar lai str. 56601
guuacaauuuauuauaaaa

SEQ ID NO: 2788971 - RNA, 16 nt, Leptospira interrogans serovar lai str. 56601
guuacauuaugaauuu

SEQ ID NO: 2788972 - RNA, 23 nt, Leptospira interrogans serovar lai str. 56601
guuacauuugguaauuugugaac

SEQ ID NO: 2788973 - RNA, 20 nt, Leptospira interrogans serovar lai str. 56601
guuacuacaauuuuagaauu

SEQ ID NO: 2788974 - RNA, 14 nt, Leptospira interrogans serovar lai str. 56601
guuacuuauuuuug

SEQ ID NO: 2788975 - RNA, 14 nt, Leptospira interrogans serovar lai str. 56601
guuacuucccuuca

SEQ ID NO: 2788976 - RNA, 14 nt, Leptospira interrogans serovar lai str. 56601
guuaggauaaaagg

SEQ ID NO: 2788977 - RNA, 16 nt, Leptospira interrogans serovar lai str. 56601
guuaggauaaaaggga

SEQ ID NO: 2788978 - RNA, 14 nt, Leptospira interrogans serovar lai str. 56601
guuauaaaauguau

SEQ ID NO: 2788979 - RNA, 11 nt, Leptospira interrogans serovar lai str. 56601
guuauaauucu

SEQ ID NO: 2788980 - RNA, 18 nt, Leptospira interrogans serovar lai str. 56601
guuauaauucuuuaaaau

SEQ ID NO: 2788981 - RNA, 21 nt, Leptospira interrogans serovar lai str. 56601
guuauaauucuuuaaaauuuu

SEQ ID NO: 2788982 - RNA, 22 nt, Leptospira interrogans serovar lai str. 56601
guuauagacaacguuacuuuua

SEQ ID NO: 2788983 - RNA, 14 nt, Leptospira interrogans serovar lai str. 56601
guuauagaugaaau

SEQ ID NO: 2788984 - RNA, 23 nt, Leptospira interrogans serovar lai str. 56601
guuauagcgucguuaaauuugcg

SEQ ID NO: 2788985 - RNA, 18 nt, Leptospira interrogans serovar lai str. 56601
guuauaguaaaagaaaau

SEQ ID NO: 2788986 - RNA, 14 nt, Leptospira interrogans serovar lai str. 56601
guuauauuaaaaug

SEQ ID NO: 2788987 - RNA, 21 nt, Leptospira interrogans serovar lai str. 56601
guugaucuuauacucuuaaaa

SEQ ID NO: 2788988 - RNA, 12 nt, Leptospira interrogans serovar lai str. 56601
guugauucugcu

SEQ ID NO: 2788989 - RNA, 16 nt, Leptospira interrogans serovar lai str. 56601
guugcaaaaaagaaag

SEQ ID NO: 2788990 - RNA, 20 nt, Leptospira interrogans serovar lai str. 56601
guugcaaaaaagaaagcagc

SEQ ID NO: 2788991 - RNA, 15 nt, Leptospira interrogans serovar lai str. 56601
guugcaaagaagaaa

SEQ ID NO: 2788992 - RNA, 16 nt, Leptospira interrogans serovar lai str. 56601
guugcaaagaagaaau

SEQ ID NO: 2788993 - RNA, 15 nt, Leptospira interrogans serovar lai str. 56601
guugcguuuaaaaac

SEQ ID NO: 2788994 - RNA, 14 nt, Leptospira interrogans serovar lai str. 56601
guugcuaagaaaaa

SEQ ID NO: 2788995 - RNA, 15 nt, Leptospira interrogans serovar lai str. 56601
guugcuaagaaaaaa

SEQ ID NO: 2788996 - RNA, 21 nt, Leptospira interrogans serovar lai str. 56601
guugcuauggaauuuuuucaa

SEQ ID NO: 2788997 - RNA, 19 nt, Leptospira interrogans serovar lai str. 56601
guuggaaucuaaacucuau

SEQ ID NO: 2788998 - RNA, 23 nt, Leptospira interrogans serovar lai str. 56601
guuggaaucuaaacuuuguaaau

SEQ ID NO: 2788999 - RNA, 15 nt, Leptospira interrogans serovar lai str. 56601
guuggauuccuuucu

SEQ ID NO: 2789000 - RNA, 18 nt, Leptospira interrogans serovar lai str. 56601
guugggaucuaaacuuug

SEQ ID NO: 2789001 - RNA, 20 nt, Leptospira interrogans serovar lai str. 56601
guuguacaaaaaugugggaa

SEQ ID NO: 2789002 - RNA, 20 nt, Leptospira interrogans serovar lai str. 56601
guuguacucugcaaaauuua

SEQ ID NO: 2789003 - RNA, 23 nt, Leptospira interrogans serovar lai str. 56601
guuguagaucaaaucugaaauuc

SEQ ID NO: 2789004 - RNA, 17 nt, Leptospira interrogans serovar lai str. 56601
guuguauccccauaaac

SEQ ID NO: 2789005 - RNA, 19 nt, Leptospira interrogans serovar lai str. 56601
guuguaugauuuauaguuu

SEQ ID NO: 2789006 - RNA, 14 nt, Leptospira interrogans serovar lai str. 56601
guuguauuuuaaac

SEQ ID NO: 2789007 - RNA, 23 nt, Leptospira interrogans serovar lai str. 56601
guugucuacgaucgcaacauaau

SEQ ID NO: 2789008 - RNA, 17 nt, Leptospira interrogans serovar lai str. 56601
guuguguuaguucccac

SEQ ID NO: 2789009 - RNA, 15 nt, Leptospira interrogans serovar lai str. 56601
guuguuaaauuuuug

SEQ ID NO: 2789010 - RNA, 16 nt, Leptospira interrogans serovar lai str. 56601
guuguuauggaauuuu

SEQ ID NO: 2789011 - RNA, 19 nt, Leptospira interrogans serovar lai str. 56601
guuguuauggaauuuuuca

SEQ ID NO: 2789012 - RNA, 17 nt, Leptospira interrogans serovar lai str. 56601
guuguugaaaaauuaau

SEQ ID NO: 2789013 - RNA, 14 nt, Leptospira interrogans serovar lai str. 56601
guuguugaaagggg

SEQ ID NO: 2789014 - RNA, 21 nt, Leptospira interrogans serovar lai str. 56601
guuguuuacccgauauuaaaa

SEQ ID NO: 2789015 - RNA, 15 nt, Leptospira interrogans serovar lai str. 56601
guuuaaaaacagaau

SEQ ID NO: 2789016 - RNA, 22 nt, Leptospira interrogans serovar lai str. 56601
guuuaaaagccagaauuuugaa

SEQ ID NO: 2789017 - RNA, 16 nt, Leptospira interrogans serovar lai str. 56601
guuuaaagaauuuuua

SEQ ID NO: 2789018 - RNA, 15 nt, Leptospira interrogans serovar lai str. 56601
guuuaaauagauuca

SEQ ID NO: 2789019 - RNA, 14 nt, Leptospira interrogans serovar lai str. 56601
guuuaacuguaaau

SEQ ID NO: 2789020 - RNA, 18 nt, Leptospira interrogans serovar lai str. 56601
guuuaacuguaaauccac

SEQ ID NO: 2789021 - RNA, 20 nt, Leptospira interrogans serovar lai str. 56601
guuuaagaaacucaguaaaa

SEQ ID NO: 2789022 - RNA, 15 nt, Leptospira interrogans serovar lai str. 56601
guuuaauauacaaaa

SEQ ID NO: 2789023 - RNA, 17 nt, Leptospira interrogans serovar lai str. 56601
guuuaauuguuauaaac

SEQ ID NO: 2789024 - RNA, 13 nt, Leptospira interrogans serovar lai str. 56601
guuuaauuucuuc

SEQ ID NO: 2789025 - RNA, 21 nt, Leptospira interrogans serovar lai str. 56601
guuuaauuucuucauaucaaa

SEQ ID NO: 2789026 - RNA, 19 nt, Leptospira interrogans serovar lai str. 56601
guuuacaauggaaaguguu

SEQ ID NO: 2789027 - RNA, 21 nt, Leptospira interrogans serovar lai str. 56601
guuuacaucaacucuguaaau

SEQ ID NO: 2789028 - RNA, 17 nt, Leptospira interrogans serovar lai str. 56601
guuuaccccgaagagcu

SEQ ID NO: 2789029 - RNA, 18 nt, Leptospira interrogans serovar lai str. 56601
guuuacccgauauuaaaa

SEQ ID NO: 2789030 - RNA, 23 nt, Leptospira interrogans serovar lai str. 56601
guuuacgaucugcuuuuuuaaac

SEQ ID NO: 2789031 - RNA, 14 nt, Leptospira interrogans serovar lai str. 56601
guuuacgugaguuc

SEQ ID NO: 2789032 - RNA, 23 nt, Leptospira interrogans serovar lai str. 56601
guuuagaacagaaugucuuagaa

SEQ ID NO: 2789033 - RNA, 15 nt, Leptospira interrogans serovar lai str. 56601
guuuagauuuuaacu

SEQ ID NO: 2789034 - RNA, 19 nt, Leptospira interrogans serovar lai str. 56601
guuuagguaaagauuuucu

SEQ ID NO: 2789035 - RNA, 22 nt, Leptospira interrogans serovar lai str. 56601
guuuauacuuuaauaauaugaa

SEQ ID NO: 2789036 - RNA, 19 nt, Leptospira interrogans serovar lai str. 56601
guuuauaugaguucccaca

SEQ ID NO: 2789037 - RNA, 21 nt, Leptospira interrogans serovar lai str. 56601
guuuauccuaaugaaaaagaa

SEQ ID NO: 2789038 - RNA, 14 nt, Leptospira interrogans serovar lai str. 56601
guuuaugugaguuc

SEQ ID NO: 2789039 - RNA, 16 nt, Leptospira interrogans serovar lai str. 56601
guuuauuguuuauaaa

SEQ ID NO: 2789040 - RNA, 17 nt, Leptospira interrogans serovar lai str. 56601
guuuauuguuuauaaaa

SEQ ID NO: 2789041 - RNA, 13 nt, Leptospira interrogans serovar lai str. 56601
guuuauuuuaaaa

SEQ ID NO: 2789042 - RNA, 18 nt, Leptospira interrogans serovar lai str. 56601
guuuauuuuucuaaaaaa

SEQ ID NO: 2789043 - RNA, 21 nt, Leptospira interrogans serovar lai str. 56601
guuuauuuuucuuuuaaaauu

SEQ ID NO: 2789044 - RNA, 14 nt, Leptospira interrogans serovar lai str. 56601
guuuauuuuugaau

SEQ ID NO: 2789045 - RNA, 19 nt, Leptospira interrogans serovar lai str. 56601
guuucaacuuuagaaaaau

SEQ ID NO: 2789046 - RNA, 16 nt, Leptospira interrogans serovar lai str. 56601
guuucaauuuaaaaua

SEQ ID NO: 2789047 - RNA, 14 nt, Leptospira interrogans serovar lai str. 56601
guuucaauuuagaa

SEQ ID NO: 2789048 - RNA, 15 nt, Leptospira interrogans serovar lai str. 56601
guuucaauuuagaac

SEQ ID NO: 2789049 - RNA, 19 nt, Leptospira interrogans serovar lai str. 56601
guuucaauuuaucauagaa

SEQ ID NO: 2789050 - RNA, 14 nt, Leptospira interrogans serovar lai str. 56601
guuucacaaauuuu

SEQ ID NO: 2789051 - RNA, 23 nt, Leptospira interrogans serovar lai str. 56601
guuucagacugacugaaaaaaac

SEQ ID NO: 2789052 - RNA, 19 nt, Leptospira interrogans serovar lai str. 56601
guuucauaaaauucuccga

SEQ ID NO: 2789053 - RNA, 13 nt, Leptospira interrogans serovar lai str. 56601
guuucauagaagg

SEQ ID NO: 2789054 - RNA, 13 nt, Leptospira interrogans serovar lai str. 56601
guuucaugaaaua

SEQ ID NO: 2789055 - RNA, 15 nt, Leptospira interrogans serovar lai str. 56601
guuuccaugaaauag

SEQ ID NO: 2789056 - RNA, 22 nt, Leptospira interrogans serovar lai str. 56601
guuucccaguucuuaaauaaaa

SEQ ID NO: 2789057 - RNA, 18 nt, Leptospira interrogans serovar lai str. 56601
guuuccccaagacuuuga

SEQ ID NO: 2789058 - RNA, 17 nt, Leptospira interrogans serovar lai str. 56601
guuuccggaauccgauu

SEQ ID NO: 2789059 - RNA, 14 nt, Leptospira interrogans serovar lai str. 56601
guuucgaaaauuuu

SEQ ID NO: 2789060 - RNA, 23 nt, Leptospira interrogans serovar lai str. 56601
guuucgaacucacguuaaaagua

SEQ ID NO: 2789061 - RNA, 14 nt, Leptospira interrogans serovar lai str. 56601
guuucuaaaaaaau

SEQ ID NO: 2789062 - RNA, 14 nt, Leptospira interrogans serovar lai str. 56601
guuucuacauuuuu

SEQ ID NO: 2789063 - RNA, 22 nt, Leptospira interrogans serovar lai str. 56601
guuucuauaaaacaaaauagau

SEQ ID NO: 2789064 - RNA, 17 nt, Leptospira interrogans serovar lai str. 56601
guuucuauacuacgaau

SEQ ID NO: 2789065 - RNA, 21 nt, Leptospira interrogans serovar lai str. 56601
guuucugaaaccagauuuccg

SEQ ID NO: 2789066 - RNA, 22 nt, Leptospira interrogans serovar lai str. 56601
guuucuguuugaugaaauaguc

SEQ ID NO: 2789067 - RNA, 22 nt, Leptospira interrogans serovar lai str. 56601
guuucuuaaaucuuagauucac

SEQ ID NO: 2789068 - RNA, 15 nt, Leptospira interrogans serovar lai str. 56601
guuucuuaaauuugu

SEQ ID NO: 2789069 - RNA, 16 nt, Leptospira interrogans serovar lai str. 56601
guuucuuaauuuuacu

SEQ ID NO: 2789070 - RNA, 15 nt, Leptospira interrogans serovar lai str. 56601
uaaaaaaauaauaau

SEQ ID NO: 2789071 - RNA, 23 nt, Leptospira interrogans serovar lai str. 56601
uaaaaaaauacgauucgaaagau

SEQ ID NO: 2789072 - RNA, 12 nt, Leptospira interrogans serovar lai str. 56601
uaaaaaaauaga

SEQ ID NO: 2789073 - RNA, 13 nt, Leptospira interrogans serovar lai str. 56601
uaaaaaaauagau

SEQ ID NO: 2789074 - RNA, 15 nt, Leptospira interrogans serovar lai str. 56601
uaaaaaaauauuaaa

SEQ ID NO: 2789075 - RNA, 16 nt, Leptospira interrogans serovar lai str. 56601
uaaaaaaauauuaaaa

SEQ ID NO: 2789076 - RNA, 17 nt, Leptospira interrogans serovar lai str. 56601
uaaaaaaaucaagagcc

SEQ ID NO: 2789077 - RNA, 14 nt, Leptospira interrogans serovar lai str. 56601
uaaaaaaaucacua

SEQ ID NO: 2789078 - RNA, 13 nt, Leptospira interrogans serovar lai str. 56601
uaaaaaaaugauu

SEQ ID NO: 2789079 - RNA, 15 nt, Leptospira interrogans serovar lai str. 56601
uaaaaaaaugauuuc

SEQ ID NO: 2789080 - RNA, 13 nt, Leptospira interrogans serovar lai str. 56601
uaaaaaaauguuu

SEQ ID NO: 2789081 - RNA, 17 nt, Leptospira interrogans serovar lai str. 56601
uaaaaaaauuaaaaaag

SEQ ID NO: 2789082 - RNA, 13 nt, Leptospira interrogans serovar lai str. 56601
uaaaaaaauuaau

SEQ ID NO: 2789083 - RNA, 19 nt, Leptospira interrogans serovar lai str. 56601
uaaaaaaauuuuuaugacu

SEQ ID NO: 2789084 - RNA, 10 nt, Leptospira interrogans serovar lai str. 56601
uaaaaaacaa

SEQ ID NO: 2789085 - RNA, 12 nt, Leptospira interrogans serovar lai str. 56601
uaaaaaacauaa

SEQ ID NO: 2789086 - RNA, 16 nt, Leptospira interrogans serovar lai str. 56601
uaaaaaagauaaaaag

SEQ ID NO: 2789087 - RNA, 23 nt, Leptospira interrogans serovar lai str. 56601
uaaaaaagauaagucuaacguga

SEQ ID NO: 2789088 - RNA, 11 nt, Leptospira interrogans serovar lai str. 56601
uaaaaaauagg

SEQ ID NO: 2789089 - RNA, 22 nt, Leptospira interrogans serovar lai str. 56601
uaaaaaaucauauccaauuuca

SEQ ID NO: 2789090 - RNA, 14 nt, Leptospira interrogans serovar lai str. 56601
uaaaaaauccauga

SEQ ID NO: 2789091 - RNA, 15 nt, Leptospira interrogans serovar lai str. 56601
uaaaaaaucccggau

SEQ ID NO: 2789092 - RNA, 13 nt, Leptospira interrogans serovar lai str. 56601
uaaaaaauuaauc

SEQ ID NO: 2789093 - RNA, 12 nt, Leptospira interrogans serovar lai str. 56601
uaaaaaauuacc

SEQ ID NO: 2789094 - RNA, 15 nt, Leptospira interrogans serovar lai str. 56601
uaaaaaauucaauuc

SEQ ID NO: 2789095 - RNA, 15 nt, Leptospira interrogans serovar lai str. 56601
uaaaaaauucauucc

SEQ ID NO: 2789096 - RNA, 13 nt, Leptospira interrogans serovar lai str. 56601
uaaaaaauucuuu

SEQ ID NO: 2789097 - RNA, 18 nt, Leptospira interrogans serovar lai str. 56601
uaaaaaauuucuucaauu

SEQ ID NO: 2789098 - RNA, 22 nt, Leptospira interrogans serovar lai str. 56601
uaaaaaauuuuacccugguuuc

SEQ ID NO: 2789099 - RNA, 19 nt, Leptospira interrogans serovar lai str. 56601
uaaaaacaaaaucaaagau

SEQ ID NO: 2789100 - RNA, 19 nt, Leptospira interrogans serovar lai str. 56601
uaaaaacaaguuuaaauga

SEQ ID NO: 2789101 - RNA, 23 nt, Leptospira interrogans serovar lai str. 56601
uaaaaacaaguuuaaaugaaaug

SEQ ID NO: 2789102 - RNA, 23 nt, Leptospira interrogans serovar lai str. 56601
uaaaaacaguauuuguaaaaaug

SEQ ID NO: 2789103 - RNA, 18 nt, Leptospira interrogans serovar lai str. 56601
uaaaaaccccauuaaaaa

SEQ ID NO: 2789104 - RNA, 19 nt, Leptospira interrogans serovar lai str. 56601
uaaaaaccguuuucaauua

SEQ ID NO: 2789105 - RNA, 16 nt, Leptospira interrogans serovar lai str. 56601
uaaaaacgucaaaauu

SEQ ID NO: 2789106 - RNA, 17 nt, Leptospira interrogans serovar lai str. 56601
uaaaaacgucuaguccu

SEQ ID NO: 2789107 - RNA, 20 nt, Leptospira interrogans serovar lai str. 56601
uaaaaacucuaccuuuauuu

SEQ ID NO: 2789108 - RNA, 21 nt, Leptospira interrogans serovar lai str. 56601
uaaaaacuuaugcuauuuaau

SEQ ID NO: 2789109 - RNA, 14 nt, Leptospira interrogans serovar lai str. 56601
uaaaaacuucacuu

SEQ ID NO: 2789110 - RNA, 21 nt, Leptospira interrogans serovar lai str. 56601
uaaaaacuucacuucuuuuag

SEQ ID NO: 2789111 - RNA, 17 nt, Leptospira interrogans serovar lai str. 56601
uaaaaagagccauaaau

SEQ ID NO: 2789112 - RNA, 14 nt, Leptospira interrogans serovar lai str. 56601
uaaaaagaguauua

SEQ ID NO: 2789113 - RNA, 17 nt, Leptospira interrogans serovar lai str. 56601
uaaaaagcguuucauug

SEQ ID NO: 2789114 - RNA, 20 nt, Leptospira interrogans serovar lai str. 56601
uaaaaaguacauggcaucca

SEQ ID NO: 2789115 - RNA, 21 nt, Leptospira interrogans serovar lai str. 56601
uaaaaagucugucuuaaaauu

SEQ ID NO: 2789116 - RNA, 18 nt, Leptospira interrogans serovar lai str. 56601
uaaaaagugaauuaaaag

SEQ ID NO: 2789117 - RNA, 23 nt, Leptospira interrogans serovar lai str. 56601
uaaaaagugaauuaaaagaaacu

SEQ ID NO: 2789118 - RNA, 14 nt, Leptospira interrogans serovar lai str. 56601
uaaaaauaaagaaa

SEQ ID NO: 2789119 - RNA, 16 nt, Leptospira interrogans serovar lai str. 56601
uaaaaauacuuuauuu

SEQ ID NO: 2789120 - RNA, 19 nt, Leptospira interrogans serovar lai str. 56601
uaaaaauagccuucaauua

SEQ ID NO: 2789121 - RNA, 17 nt, Leptospira interrogans serovar lai str. 56601
uaaaaauauaaaucaau

SEQ ID NO: 2789122 - RNA, 11 nt, Leptospira interrogans serovar lai str. 56601
uaaaaauauac

SEQ ID NO: 2789123 - RNA, 20 nt, Leptospira interrogans serovar lai str. 56601
uaaaaauauacaauaaauca

SEQ ID NO: 2789124 - RNA, 22 nt, Leptospira interrogans serovar lai str. 56601
uaaaaauauggaagcuaacaca

SEQ ID NO: 2789125 - RNA, 24 nt, Leptospira interrogans serovar lai str. 56601
uaaaaaucgacuucucauucuuga

SEQ ID NO: 2789126 - RNA, 16 nt, Leptospira interrogans serovar lai str. 56601
uaaaaaucucuuuuac

SEQ ID NO: 2789127 - RNA, 20 nt, Leptospira interrogans serovar lai str. 56601
uaaaaaugaaaucuacaaaa

SEQ ID NO: 2789128 - RNA, 18 nt, Leptospira interrogans serovar lai str. 56601
uaaaaaugauacuauuaa

SEQ ID NO: 2789129 - RNA, 19 nt, Leptospira interrogans serovar lai str. 56601
uaaaaaugauacuauuaau

SEQ ID NO: 2789130 - RNA, 17 nt, Leptospira interrogans serovar lai str. 56601
uaaaaauggauacuuau

SEQ ID NO: 2789131 - RNA, 16 nt, Leptospira interrogans serovar lai str. 56601
uaaaaauuaaacagua

SEQ ID NO: 2789132 - RNA, 17 nt, Leptospira interrogans serovar lai str. 56601
uaaaaauuaauuuuaua

SEQ ID NO: 2789133 - RNA, 18 nt, Leptospira interrogans serovar lai str. 56601
uaaaaauuagaaaugauu

SEQ ID NO: 2789134 - RNA, 19 nt, Leptospira interrogans serovar lai str. 56601
uaaaaauuagaacuguguu

SEQ ID NO: 2789135 - RNA, 20 nt, Leptospira interrogans serovar lai str. 56601
uaaaaauucaacuaaauccu

SEQ ID NO: 2789136 - RNA, 21 nt, Leptospira interrogans serovar lai str. 56601
uaaaaauucgaguaguuaaua

SEQ ID NO: 2789137 - RNA, 14 nt, Leptospira interrogans serovar lai str. 56601
uaaaaauucuuaau

SEQ ID NO: 2789138 - RNA, 15 nt, Leptospira interrogans serovar lai str. 56601
uaaaaauucuucguu

SEQ ID NO: 2789139 - RNA, 12 nt, Leptospira interrogans serovar lai str. 56601
uaaaaauugauc

SEQ ID NO: 2789140 - RNA, 14 nt, Leptospira interrogans serovar lai str. 56601
uaaaaauuuaauuu

SEQ ID NO: 2789141 - RNA, 15 nt, Leptospira interrogans serovar lai str. 56601
uaaaaauuuauaaag

SEQ ID NO: 2789142 - RNA, 21 nt, Leptospira interrogans serovar lai str. 56601
uaaaaauuucagauuuuauuu

SEQ ID NO: 2789143 - RNA, 14 nt, Leptospira interrogans serovar lai str. 56601
uaaaaauuuccuuu

SEQ ID NO: 2789144 - RNA, 19 nt, Leptospira interrogans serovar lai str. 56601
uaaaaauuucuaaagaauu

SEQ ID NO: 2789145 - RNA, 16 nt, Leptospira interrogans serovar lai str. 56601
uaaaaauuuuauuaaa

SEQ ID NO: 2789146 - RNA, 21 nt, Leptospira interrogans serovar lai str. 56601
uaaaaauuuuauuaaauaaag

SEQ ID NO: 2789147 - RNA, 13 nt, Leptospira interrogans serovar lai str. 56601
uaaaaauuuugaa

SEQ ID NO: 2789148 - RNA, 15 nt, Leptospira interrogans serovar lai str. 56601
uaaaacaaaaaaaca

SEQ ID NO: 2789149 - RNA, 14 nt, Leptospira interrogans serovar lai str. 56601
uaaaacaaaauaga

SEQ ID NO: 2789150 - RNA, 12 nt, Leptospira interrogans serovar lai str. 56601
uaaaacaaucuu

SEQ ID NO: 2789151 - RNA, 20 nt, Leptospira interrogans serovar lai str. 56601
uaaaacaaucuucaaauucu

SEQ ID NO: 2789152 - RNA, 22 nt, Leptospira interrogans serovar lai str. 56601
uaaaacaccuucucuuuuaaaa

SEQ ID NO: 2789153 - RNA, 20 nt, Leptospira interrogans serovar lai str. 56601
uaaaaucauauuuucaaaaa

SEQ ID NO: 2789154 - RNA, 20 nt, Leptospira interrogans serovar lai str. 56601
uaaaauccaugauuuguaau

SEQ ID NO: 2789155 - RNA, 21 nt, Leptospira interrogans serovar lai str. 56601
uaaaauccccaguauuuugca

SEQ ID NO: 2789156 - RNA, 21 nt, Leptospira interrogans serovar lai str. 56601
uaaaauccguagccgcuucaa

SEQ ID NO: 2789157 - RNA, 19 nt, Leptospira interrogans serovar lai str. 56601
uaaaauccuauucaacuug

SEQ ID NO: 2789158 - RNA, 23 nt, Leptospira interrogans serovar lai str. 56601
uaaaaucgaguuucacaaaaaug

SEQ ID NO: 2789159 - RNA, 16 nt, Leptospira interrogans serovar lai str. 56601
uaaaaucgauuacucu

SEQ ID NO: 2789160 - RNA, 18 nt, Leptospira interrogans serovar lai str. 56601
uaaaaucggaaaauugaa

SEQ ID NO: 2789161 - RNA, 20 nt, Leptospira interrogans serovar lai str. 56601
uaaaaucggaaaauugaaua

SEQ ID NO: 2789162 - RNA, 15 nt, Leptospira interrogans serovar lai str. 56601
uaaaaucuaaaaaaa

SEQ ID NO: 2789163 - RNA, 15 nt, Leptospira interrogans serovar lai str. 56601
uaaaaucuaaaaaua

SEQ ID NO: 2789164 - RNA, 19 nt, Leptospira interrogans serovar lai str. 56601
uaaaaucuaaauuuguaau

SEQ ID NO: 2789165 - RNA, 19 nt, Leptospira interrogans serovar lai str. 56601
uaaaaucuaucucaaaaau

SEQ ID NO: 2789166 - RNA, 19 nt, Leptospira interrogans serovar lai str. 56601
uaaaaucuuaaauuagaua

SEQ ID NO: 2789167 - RNA, 14 nt, Leptospira interrogans serovar lai str. 56601
uaaaaucuuaauuu

SEQ ID NO: 2789168 - RNA, 21 nt, Leptospira interrogans serovar lai str. 56601
uaaaaucuucaaguuugugag

SEQ ID NO: 2789169 - RNA, 14 nt, Leptospira interrogans serovar lai str. 56601
uaaaaucuuuaagu

SEQ ID NO: 2789170 - RNA, 21 nt, Leptospira interrogans serovar lai str. 56601
uaaaaucuuuaaguuugugag

SEQ ID NO: 2789171 - RNA, 13 nt, Leptospira interrogans serovar lai str. 56601
uaaaaugaaaaaa

SEQ ID NO: 2789172 - RNA, 16 nt, Leptospira interrogans serovar lai str. 56601
uaaaaugaaaauuaua

SEQ ID NO: 2789173 - RNA, 22 nt, Leptospira interrogans serovar lai str. 56601
uaaaaugcaguaguuccuacaa

SEQ ID NO: 2789174 - RNA, 23 nt, Leptospira interrogans serovar lai str. 56601
uaaaaugcggaaacuuuuucguu

SEQ ID NO: 2789175 - RNA, 14 nt, Leptospira interrogans serovar lai str. 56601
uaaaauggaaaaaa

SEQ ID NO: 2789176 - RNA, 20 nt, Leptospira interrogans serovar lai str. 56601
uaaaauggacugcaaaauca

SEQ ID NO: 2789177 - RNA, 22 nt, Leptospira interrogans serovar lai str. 56601
uaaaaugggaaguuuaccccga

SEQ ID NO: 2789178 - RNA, 17 nt, Leptospira interrogans serovar lai str. 56601
uaaaauggguuuucauu

SEQ ID NO: 2789179 - RNA, 18 nt, Leptospira interrogans serovar lai str. 56601
uaaaauggguuuuuaauu

SEQ ID NO: 2789180 - RNA, 19 nt, Leptospira interrogans serovar lai str. 56601
uaaaauggguuuuuaauuu

SEQ ID NO: 2789181 - RNA, 14 nt, Leptospira interrogans serovar lai str. 56601
uaaaauguaaaaac

SEQ ID NO: 2789182 - RNA, 17 nt, Leptospira interrogans serovar lai str. 56601
uaaaauguacaauuaaa

SEQ ID NO: 2789183 - RNA, 16 nt, Leptospira interrogans serovar lai str. 56601
uaaaauguaguaacua

SEQ ID NO: 2789184 - RNA, 18 nt, Leptospira interrogans serovar lai str. 56601
uaaaauguggaaacuauc

SEQ ID NO: 2789185 - RNA, 10 nt, Leptospira interrogans serovar lai str. 56601
uaaaauuaaa

SEQ ID NO: 2789186 - RNA, 14 nt, Leptospira interrogans serovar lai str. 56601
uaaaauuaaaaauu

SEQ ID NO: 2789187 - RNA, 23 nt, Leptospira interrogans serovar lai str. 56601
uaaaauuaaaauccucaacagau

SEQ ID NO: 2789188 - RNA, 18 nt, Leptospira interrogans serovar lai str. 56601
uaaaauuaaaguaaauuc

SEQ ID NO: 2789189 - RNA, 10 nt, Leptospira interrogans serovar lai str. 56601
uaaaauuaag

SEQ ID NO: 2789190 - RNA, 21 nt, Leptospira interrogans serovar lai str. 56601
uaaaauuagauuuguguuauu

SEQ ID NO: 2789191 - RNA, 14 nt, Leptospira interrogans serovar lai str. 56601
uaaaauuauaggaa

SEQ ID NO: 2789192 - RNA, 14 nt, Leptospira interrogans serovar lai str. 56601
uaaaauuauuaacu

SEQ ID NO: 2789193 - RNA, 13 nt, Leptospira interrogans serovar lai str. 56601
uaaaauucaaaaa

SEQ ID NO: 2789194 - RNA, 15 nt, Leptospira interrogans serovar lai str. 56601
uaaaauucaaaaaga

SEQ ID NO: 2789195 - RNA, 16 nt, Leptospira interrogans serovar lai str. 56601
uaaaauucaaaaagaa

SEQ ID NO: 2789196 - RNA, 11 nt, Leptospira interrogans serovar lai str. 56601
uaaaauucaca

SEQ ID NO: 2789197 - RNA, 19 nt, Leptospira interrogans serovar lai str. 56601
uaaaauuccgaauucuaaa

SEQ ID NO: 2789198 - RNA, 23 nt, Leptospira interrogans serovar lai str. 56601
uaaaauucuccgauuugguuuuc

SEQ ID NO: 2789199 - RNA, 19 nt, Leptospira interrogans serovar lai str. 56601
uaaaauucuuagaguaaaa

SEQ ID NO: 2789200 - RNA, 13 nt, Leptospira interrogans serovar lai str. 56601
uaaaauugaauau

SEQ ID NO: 2789201 - RNA, 20 nt, Leptospira interrogans serovar lai str. 56601
uaaaauuguaggaacuacua

SEQ ID NO: 2789202 - RNA, 16 nt, Leptospira interrogans serovar lai str. 56601
uaaaauuuaaaauucu

SEQ ID NO: 2789203 - RNA, 13 nt, Leptospira interrogans serovar lai str. 56601
uaaaauuuaaaga

SEQ ID NO: 2789204 - RNA, 12 nt, Leptospira interrogans serovar lai str. 56601
uaaaauuuaaau

SEQ ID NO: 2789205 - RNA, 14 nt, Leptospira interrogans serovar lai str. 56601
uaaaauuuaaauuu

SEQ ID NO: 2789206 - RNA, 22 nt, Leptospira interrogans serovar lai str. 56601
uaaaauuuacggaacuuaauuu

SEQ ID NO: 2789207 - RNA, 16 nt, Leptospira interrogans serovar lai str. 56601
uaaaauuuagaaauag

SEQ ID NO: 2789208 - RNA, 14 nt, Leptospira interrogans serovar lai str. 56601
uaaaauuuagauuu

SEQ ID NO: 2789209 - RNA, 12 nt, Leptospira interrogans serovar lai str. 56601
uaaaauuucauu

SEQ ID NO: 2789210 - RNA, 17 nt, Leptospira interrogans serovar lai str. 56601
uaaaauuucauuuuacu

SEQ ID NO: 2789211 - RNA, 13 nt, Leptospira interrogans serovar lai str. 56601
uaaaauuugaaaa

SEQ ID NO: 2789212 - RNA, 14 nt, Leptospira interrogans serovar lai str. 56601
uaaaauuugaaagu

SEQ ID NO: 2789213 - RNA, 19 nt, Leptospira interrogans serovar lai str. 56601
uaaaauuugaaaguaaaaa

SEQ ID NO: 2789214 - RNA, 22 nt, Leptospira interrogans serovar lai str. 56601
uaaaauuugaaaguaaaaaaga

SEQ ID NO: 2789215 - RNA, 21 nt, Leptospira interrogans serovar lai str. 56601
uaaaauuugauuccaagauuu

SEQ ID NO: 2789216 - RNA, 18 nt, Leptospira interrogans serovar lai str. 56601
uaaaauuuguaggaacuc

SEQ ID NO: 2789217 - RNA, 12 nt, Leptospira interrogans serovar lai str. 56601
uaaaauuuuaaa

SEQ ID NO: 2789218 - RNA, 15 nt, Leptospira interrogans serovar lai str. 56601
uaaaauuuuauaaaa

SEQ ID NO: 2789219 - RNA, 18 nt, Leptospira interrogans serovar lai str. 56601
uaaaauuuuauaaaaauc

SEQ ID NO: 2789220 - RNA, 23 nt, Leptospira interrogans serovar lai str. 56601
uaaaauuuuauacuuuaauaaua

SEQ ID NO: 2789221 - RNA, 14 nt, Leptospira interrogans serovar lai str. 56601
uaaaauuuucauuu

SEQ ID NO: 2789222 - RNA, 17 nt, Leptospira interrogans serovar lai str. 56601
uaaaauuuuuaaaaaau

SEQ ID NO: 2789223 - RNA, 18 nt, Leptospira interrogans serovar lai str. 56601
uaaaauuuuuaauaaaau

SEQ ID NO: 2789224 - RNA, 19 nt, Leptospira interrogans serovar lai str. 56601
uaaaauuuuuaauaaaaug

SEQ ID NO: 2789225 - RNA, 13 nt, Leptospira interrogans serovar lai str. 56601
uaaaauuuuucuc

SEQ ID NO: 2789226 - RNA, 18 nt, Leptospira interrogans serovar lai str. 56601
uaaaauuuuucucccuua

SEQ ID NO: 2789227 - RNA, 12 nt, Leptospira interrogans serovar lai str. 56601
uaaacaaagaau

SEQ ID NO: 2789228 - RNA, 16 nt, Leptospira interrogans serovar lai str. 56601
uaaacaaagaauaaau

SEQ ID NO: 2789229 - RNA, 11 nt, Leptospira interrogans serovar lai str. 56601
uaaacaaagac

SEQ ID NO: 2789230 - RNA, 21 nt, Leptospira interrogans serovar lai str. 56601
uaaacaaauccgaaaauguag

SEQ ID NO: 2789231 - RNA, 13 nt, Leptospira interrogans serovar lai str. 56601
uaaacaauuuuau

SEQ ID NO: 2789232 - RNA, 22 nt, Leptospira interrogans serovar lai str. 56601
uaaacacaaucgucaucucgaa

SEQ ID NO: 2789233 - RNA, 18 nt, Leptospira interrogans serovar lai str. 56601
uaaacagucgcuaaacuc

SEQ ID NO: 2789234 - RNA, 16 nt, Leptospira interrogans serovar lai str. 56601
uaaacauuagaguugu

SEQ ID NO: 2789235 - RNA, 19 nt, Leptospira interrogans serovar lai str. 56601
uaaacauuuaacuuuuauu

SEQ ID NO: 2789236 - RNA, 13 nt, Leptospira interrogans serovar lai str. 56601
uaaauacaaaaug

SEQ ID NO: 2789237 - RNA, 17 nt, Leptospira interrogans serovar lai str. 56601
uaaauacauacaaugaa

SEQ ID NO: 2789238 - RNA, 18 nt, Leptospira interrogans serovar lai str. 56601
uaaauacaucucuuuuuu

SEQ ID NO: 2789239 - RNA, 16 nt, Leptospira interrogans serovar lai str. 56601
uaaauaccuaaauauu

SEQ ID NO: 2789240 - RNA, 23 nt, Leptospira interrogans serovar lai str. 56601
uaaauaccuguucggaguuguau

SEQ ID NO: 2789241 - RNA, 18 nt, Leptospira interrogans serovar lai str. 56601
uaaauacuuuauaauuga

SEQ ID NO: 2789242 - RNA, 21 nt, Leptospira interrogans serovar lai str. 56601
uaaauacuuuauaauugaaca

SEQ ID NO: 2789243 - RNA, 23 nt, Leptospira interrogans serovar lai str. 56601
uaaauagagcuuuguaauaaaaa

SEQ ID NO: 2789244 - RNA, 18 nt, Leptospira interrogans serovar lai str. 56601
uaaauagauucaaaaguc

SEQ ID NO: 2789245 - RNA, 23 nt, Leptospira interrogans serovar lai str. 56601
uaaauagggcucgguaaaaagau

SEQ ID NO: 2789246 - RNA, 13 nt, Leptospira interrogans serovar lai str. 56601
uaaauauaucuuc

SEQ ID NO: 2789247 - RNA, 21 nt, Leptospira interrogans serovar lai str. 56601
uaaauaucgaauuucuucaua

SEQ ID NO: 2789248 - RNA, 15 nt, Leptospira interrogans serovar lai str. 56601
uaaauauuaauuuaa

SEQ ID NO: 2789249 - RNA, 17 nt, Leptospira interrogans serovar lai str. 56601
uaaauauuaauuuaaaa

SEQ ID NO: 2789250 - RNA, 13 nt, Leptospira interrogans serovar lai str. 56601
uaaauauucucua

SEQ ID NO: 2789251 - RNA, 14 nt, Leptospira interrogans serovar lai str. 56601
uaaauauucucuau

SEQ ID NO: 2789252 - RNA, 21 nt, Leptospira interrogans serovar lai str. 56601
uaaauauugaucuaaacuagc

SEQ ID NO: 2789253 - RNA, 14 nt, Leptospira interrogans serovar lai str. 56601
uaaauauuuccaaa

SEQ ID NO: 2789254 - RNA, 17 nt, Leptospira interrogans serovar lai str. 56601
uaaauauuuccaaauug

SEQ ID NO: 2789255 - RNA, 18 nt, Leptospira interrogans serovar lai str. 56601
uaaauauuuuuuuuaauc

SEQ ID NO: 2789256 - RNA, 11 nt, Leptospira interrogans serovar lai str. 56601
uaaaucaauca

SEQ ID NO: 2789257 - RNA, 19 nt, Leptospira interrogans serovar lai str. 56601
uaaaucaauccucuuugaa

SEQ ID NO: 2789258 - RNA, 21 nt, Leptospira interrogans serovar lai str. 56601
uaaaucaauccucuuugaaau

SEQ ID NO: 2789259 - RNA, 20 nt, Leptospira interrogans serovar lai str. 56601
uaaaucaaucuacuugaauu

SEQ ID NO: 2789260 - RNA, 20 nt, Leptospira interrogans serovar lai str. 56601
uaaaucaccuuuuacuucau

SEQ ID NO: 2789261 - RNA, 15 nt, Leptospira interrogans serovar lai str. 56601
uaaaucagaauaauc

SEQ ID NO: 2789262 - RNA, 17 nt, Leptospira interrogans serovar lai str. 56601
uaaaucagaauaaucuc

SEQ ID NO: 2789263 - RNA, 17 nt, Leptospira interrogans serovar lai str. 56601
uaaaucaugaucaaauu

SEQ ID NO: 2789264 - RNA, 21 nt, Leptospira interrogans serovar lai str. 56601
uaaaucaugaucaaauucaca

SEQ ID NO: 2789265 - RNA, 15 nt, Leptospira interrogans serovar lai str. 56601
uaaauccaacuuaaa

SEQ ID NO: 2789266 - RNA, 19 nt, Leptospira interrogans serovar lai str. 56601
uaaaucccauuuuagcaua

SEQ ID NO: 2789267 - RNA, 19 nt, Leptospira interrogans serovar lai str. 56601
uaaauccguauacuuuaaa

SEQ ID NO: 2789268 - RNA, 21 nt, Leptospira interrogans serovar lai str. 56601
uaaaucgaaucgaauguauuu

SEQ ID NO: 2789269 - RNA, 13 nt, Leptospira interrogans serovar lai str. 56601
uaaaucgcaaaua

SEQ ID NO: 2789270 - RNA, 19 nt, Leptospira interrogans serovar lai str. 56601
uaaaucuaauucuucuaau

SEQ ID NO: 2789271 - RNA, 16 nt, Leptospira interrogans serovar lai str. 56601
uaaaucucauuaccaa

SEQ ID NO: 2789272 - RNA, 13 nt, Leptospira interrogans serovar lai str. 56601
uaaaucuuagauu

SEQ ID NO: 2789273 - RNA, 17 nt, Leptospira interrogans serovar lai str. 56601
uaaaucuuagauucacu

SEQ ID NO: 2789274 - RNA, 21 nt, Leptospira interrogans serovar lai str. 56601
uaaaucuuaggaacuuuuaua

SEQ ID NO: 2789275 - RNA, 23 nt, Leptospira interrogans serovar lai str. 56601
uaaaucuuaggaacuuuuauaau

SEQ ID NO: 2789276 - RNA, 13 nt, Leptospira interrogans serovar lai str. 56601
uaaaucuuuaaaa

SEQ ID NO: 2789277 - RNA, 15 nt, Leptospira interrogans serovar lai str. 56601
uaaaugaauuuagaa

SEQ ID NO: 2789278 - RNA, 16 nt, Leptospira interrogans serovar lai str. 56601
uaaaugaauuuagaaa

SEQ ID NO: 2789279 - RNA, 15 nt, Leptospira interrogans serovar lai str. 56601
uaaaugaauuuuaaa

SEQ ID NO: 2789280 - RNA, 18 nt, Leptospira interrogans serovar lai str. 56601
uaaaugacuugcauuuaa

SEQ ID NO: 2789281 - RNA, 19 nt, Leptospira interrogans serovar lai str. 56601
uaaaugacuugcauuuaau

SEQ ID NO: 2789282 - RNA, 21 nt, Leptospira interrogans serovar lai str. 56601
uaaaugacuugcauuuaauau

SEQ ID NO: 2789283 - RNA, 23 nt, Leptospira interrogans serovar lai str. 56601
uaaaugacuugcauuuaauauau

SEQ ID NO: 2789284 - RNA, 16 nt, Leptospira interrogans serovar lai str. 56601
uaaaugaguuuuagaa

SEQ ID NO: 2789285 - RNA, 23 nt, Leptospira interrogans serovar lai str. 56601
uaaaugaguuuuagaauauuaag

SEQ ID NO: 2789286 - RNA, 21 nt, Leptospira interrogans serovar lai str. 56601
uaaaugauacguucaaacuug

SEQ ID NO: 2789287 - RNA, 19 nt, Leptospira interrogans serovar lai str. 56601
uaaaugauacuuuguaaaa

SEQ ID NO: 2789288 - RNA, 19 nt, Leptospira interrogans serovar lai str. 56601
uaaaugcaccguuucuaua

SEQ ID NO: 2789289 - RNA, 14 nt, Leptospira interrogans serovar lai str. 56601
uaaauggauaaauu

SEQ ID NO: 2789290 - RNA, 23 nt, Leptospira interrogans serovar lai str. 56601
uaaauggauaaauuuuagaauau

SEQ ID NO: 2789291 - RNA, 17 nt, Leptospira interrogans serovar lai str. 56601
uaaauggcguauaagaa

SEQ ID NO: 2789292 - RNA, 13 nt, Leptospira interrogans serovar lai str. 56601
uaaaugggauuuu

SEQ ID NO: 2789293 - RNA, 15 nt, Leptospira interrogans serovar lai str. 56601
uaaauguauauucgu

SEQ ID NO: 2789294 - RNA, 15 nt, Leptospira interrogans serovar lai str. 56601
uaaauguauguuuac

SEQ ID NO: 2789295 - RNA, 22 nt, Leptospira interrogans serovar lai str. 56601
uaaaugugggaacuacuacaau

SEQ ID NO: 2789296 - RNA, 20 nt, Leptospira interrogans serovar lai str. 56601
uaaauguuauuuuguauaaa

SEQ ID NO: 2789297 - RNA, 15 nt, Leptospira interrogans serovar lai str. 56601
uaaauguucaaauuc

SEQ ID NO: 2789298 - RNA, 20 nt, Leptospira interrogans serovar lai str. 56601
uaaauuaauauuuauaaaac

SEQ ID NO: 2789299 - RNA, 20 nt, Leptospira interrogans serovar lai str. 56601
uaaauuacugauuucaaaaa

SEQ ID NO: 2789300 - RNA, 19 nt, Leptospira interrogans serovar lai str. 56601
uaaauuagaaaauuauaaa

SEQ ID NO: 2789301 - RNA, 18 nt, Leptospira interrogans serovar lai str. 56601
uaaauuagcuuaagaauu

SEQ ID NO: 2789302 - RNA, 16 nt, Leptospira interrogans serovar lai str. 56601
uaaauuaguaauuuaa

SEQ ID NO: 2789303 - RNA, 20 nt, Leptospira interrogans serovar lai str. 56601
uaaauuauaguuuuauuaga

SEQ ID NO: 2789304 - RNA, 15 nt, Leptospira interrogans serovar lai str. 56601
uaaauuauauacagg

SEQ ID NO: 2789305 - RNA, 23 nt, Leptospira interrogans serovar lai str. 56601
uaaauuaugauagucaaaacucu

SEQ ID NO: 2789306 - RNA, 14 nt, Leptospira interrogans serovar lai str. 56601
uaaauucaaaauaa

SEQ ID NO: 2789307 - RNA, 20 nt, Leptospira interrogans serovar lai str. 56601
uaaauucacuguuaaaagau

SEQ ID NO: 2789308 - RNA, 20 nt, Leptospira interrogans serovar lai str. 56601
uaaauucagaaaaaaaaaga

SEQ ID NO: 2789309 - RNA, 18 nt, Leptospira interrogans serovar lai str. 56601
uaaauucaggauaaacau

SEQ ID NO: 2789310 - RNA, 17 nt, Leptospira interrogans serovar lai str. 56601
uaaauucaucaaugaau

SEQ ID NO: 2789311 - RNA, 19 nt, Leptospira interrogans serovar lai str. 56601
uaaauuccccaaaaugaau

SEQ ID NO: 2789312 - RNA, 16 nt, Leptospira interrogans serovar lai str. 56601
uaaauuccguaaaauu

SEQ ID NO: 2789313 - RNA, 16 nt, Leptospira interrogans serovar lai str. 56601
uaaauucgaucuaaga

SEQ ID NO: 2789314 - RNA, 16 nt, Leptospira interrogans serovar lai str. 56601
uaaauucgcaaaaaaa

SEQ ID NO: 2789315 - RNA, 22 nt, Leptospira interrogans serovar lai str. 56601
uaaauucgcaaaaaaaauucga

SEQ ID NO: 2789316 - RNA, 14 nt, Leptospira interrogans serovar lai str. 56601
uaaauucuaaaaaa

SEQ ID NO: 2789317 - RNA, 16 nt, Leptospira interrogans serovar lai str. 56601
uaaauucuaaaaaaau

SEQ ID NO: 2789318 - RNA, 22 nt, Leptospira interrogans serovar lai str. 56601
uaacucaaaauuucggaaccgg

SEQ ID NO: 2789319 - RNA, 19 nt, Leptospira interrogans serovar lai str. 56601
uaacucauauagaaauuau

SEQ ID NO: 2789320 - RNA, 23 nt, Leptospira interrogans serovar lai str. 56601
uaacucauauagaaauuauagua

SEQ ID NO: 2789321 - RNA, 17 nt, Leptospira interrogans serovar lai str. 56601
uaacucaucuaaucgaa

SEQ ID NO: 2789322 - RNA, 19 nt, Leptospira interrogans serovar lai str. 56601
uaacuccuacauuagaguu

SEQ ID NO: 2789323 - RNA, 22 nt, Leptospira interrogans serovar lai str. 56601
uaacucguuagagaaaagcauu

SEQ ID NO: 2789324 - RNA, 15 nt, Leptospira interrogans serovar lai str. 56601
uaacucuauuaguuu

SEQ ID NO: 2789325 - RNA, 15 nt, Leptospira interrogans serovar lai str. 56601
uaacugguuuuucuu

SEQ ID NO: 2789326 - RNA, 15 nt, Leptospira interrogans serovar lai str. 56601
uaacuuacugauuuc

SEQ ID NO: 2789327 - RNA, 13 nt, Leptospira interrogans serovar lai str. 56601
uaacuucauuucc

SEQ ID NO: 2789328 - RNA, 20 nt, Leptospira interrogans serovar lai str. 56601
uaacuucguugaaaaucgga

SEQ ID NO: 2789329 - RNA, 15 nt, Leptospira interrogans serovar lai str. 56601
uaacuuugaaaauuu

SEQ ID NO: 2789330 - RNA, 20 nt, Leptospira interrogans serovar lai str. 56601
uaacuuugauagaaaaaauc

SEQ ID NO: 2789331 - RNA, 12 nt, Leptospira interrogans serovar lai str. 56601
uaacuuuuacug

SEQ ID NO: 2789332 - RNA, 12 nt, Leptospira interrogans serovar lai str. 56601
uaacuuuuucag

SEQ ID NO: 2789333 - RNA, 12 nt, Leptospira interrogans serovar lai str. 56601
uaagaaaaaagc

SEQ ID NO: 2789334 - RNA, 21 nt, Leptospira interrogans serovar lai str. 56601
uaagaaaaaaguugcuaagaa

SEQ ID NO: 2789335 - RNA, 11 nt, Leptospira interrogans serovar lai str. 56601
uaagaaaaaau

SEQ ID NO: 2789336 - RNA, 13 nt, Leptospira interrogans serovar lai str. 56601
uaagaaaaacuag

SEQ ID NO: 2789337 - RNA, 20 nt, Leptospira interrogans serovar lai str. 56601
uaagaaaaauuaaaauucua

SEQ ID NO: 2789338 - RNA, 12 nt, Leptospira interrogans serovar lai str. 56601
uaagaaaacuca

SEQ ID NO: 2789339 - RNA, 13 nt, Leptospira interrogans serovar lai str. 56601
uaagaaaauuuaa

SEQ ID NO: 2789340 - RNA, 17 nt, Leptospira interrogans serovar lai str. 56601
uaagaaaauuuaaaaua

SEQ ID NO: 2789341 - RNA, 23 nt, Leptospira interrogans serovar lai str. 56601
uaagaaagaauuuucuaaaagua

SEQ ID NO: 2789342 - RNA, 12 nt, Leptospira interrogans serovar lai str. 56601
uaagaaaguauu

SEQ ID NO: 2789343 - RNA, 14 nt, Leptospira interrogans serovar lai str. 56601
uaagaaaguauuaa

SEQ ID NO: 2789344 - RNA, 12 nt, Leptospira interrogans serovar lai str. 56601
uaagaaauagau

SEQ ID NO: 2789345 - RNA, 22 nt, Leptospira interrogans serovar lai str. 56601
uaagaacaaacaccacaauuua

SEQ ID NO: 2789346 - RNA, 19 nt, Leptospira interrogans serovar lai str. 56601
uaagaacaauuuaaaauaa

SEQ ID NO: 2789347 - RNA, 23 nt, Leptospira interrogans serovar lai str. 56601
uaagaacuuucucgaaaaucuca

SEQ ID NO: 2789348 - RNA, 16 nt, Leptospira interrogans serovar lai str. 56601
uaagaagauaaauauu

SEQ ID NO: 2789349 - RNA, 21 nt, Leptospira interrogans serovar lai str. 56601
uaagaagauaaauauuuccaa

SEQ ID NO: 2789350 - RNA, 15 nt, Leptospira interrogans serovar lai str. 56601
uaagaauaauuuaaa

SEQ ID NO: 2789351 - RNA, 17 nt, Leptospira interrogans serovar lai str. 56601
uaagaauaauuuaaacu

SEQ ID NO: 2789352 - RNA, 23 nt, Leptospira interrogans serovar lai str. 56601
uaagaauacgugaguucguuaua

SEQ ID NO: 2789353 - RNA, 12 nt, Leptospira interrogans serovar lai str. 56601
uaagaauauuau

SEQ ID NO: 2789354 - RNA, 22 nt, Leptospira interrogans serovar lai str. 56601
uaagaauccaugauccauuuuu

SEQ ID NO: 2789355 - RNA, 16 nt, Leptospira interrogans serovar lai str. 56601
uaagaaucgaaaaaau

SEQ ID NO: 2789356 - RNA, 23 nt, Leptospira interrogans serovar lai str. 56601
uaagaaucugccccaaaauuuag

SEQ ID NO: 2789357 - RNA, 22 nt, Leptospira interrogans serovar lai str. 56601
uaagaauguuuuccagaaacca

SEQ ID NO: 2789358 - RNA, 19 nt, Leptospira interrogans serovar lai str. 56601
uaagaauuuaucauuucuu

SEQ ID NO: 2789359 - RNA, 20 nt, Leptospira interrogans serovar lai str. 56601
uaagaauuuaucauuucuuu

SEQ ID NO: 2789360 - RNA, 15 nt, Leptospira interrogans serovar lai str. 56601
uaagaauuuguuugu

SEQ ID NO: 2789361 - RNA, 14 nt, Leptospira interrogans serovar lai str. 56601
uaagaauuuuaaaa

SEQ ID NO: 2789362 - RNA, 16 nt, Leptospira interrogans serovar lai str. 56601
uaagaauuuuaaaaaa

SEQ ID NO: 2789363 - RNA, 19 nt, Leptospira interrogans serovar lai str. 56601
uaagaccgucucaagauuu

SEQ ID NO: 2789364 - RNA, 21 nt, Leptospira interrogans serovar lai str. 56601
uaagagaaccucuauaaaauc

SEQ ID NO: 2789365 - RNA, 22 nt, Leptospira interrogans serovar lai str. 56601
uaagagaauuucuauaaaaucu

SEQ ID NO: 2789366 - RNA, 19 nt, Leptospira interrogans serovar lai str. 56601
uaagagaugugaguuuuaa

SEQ ID NO: 2789367 - RNA, 21 nt, Leptospira interrogans serovar lai str. 56601
uaagagaugugaguuuuaaaa

SEQ ID NO: 2789368 - RNA, 22 nt, Leptospira interrogans serovar lai str. 56601
uaagagccuacaaaucgaagau

SEQ ID NO: 2789369 - RNA, 19 nt, Leptospira interrogans serovar lai str. 56601
uaagagccuuucacaucuc

SEQ ID NO: 2789370 - RNA, 16 nt, Leptospira interrogans serovar lai str. 56601
uaagagcgucuuugaa

SEQ ID NO: 2789371 - RNA, 17 nt, Leptospira interrogans serovar lai str. 56601
uaagagcgucuuugaau

SEQ ID NO: 2789372 - RNA, 20 nt, Leptospira interrogans serovar lai str. 56601
uaagagugcagauuaaaaaa

SEQ ID NO: 2789373 - RNA, 23 nt, Leptospira interrogans serovar lai str. 56601
uaagaguuacuacaauuuuagaa

SEQ ID NO: 2789374 - RNA, 13 nt, Leptospira interrogans serovar lai str. 56601
uaagauaaauuau

SEQ ID NO: 2789375 - RNA, 20 nt, Leptospira interrogans serovar lai str. 56601
uaagauaaauuuaguaguaa

SEQ ID NO: 2789376 - RNA, 19 nt, Leptospira interrogans serovar lai str. 56601
uaagauagccuaauuuacu

SEQ ID NO: 2789377 - RNA, 16 nt, Leptospira interrogans serovar lai str. 56601
uaagauaugaauuaau

SEQ ID NO: 2789378 - RNA, 14 nt, Leptospira interrogans serovar lai str. 56601
uaagaucauuuaaa

SEQ ID NO: 2789379 - RNA, 15 nt, Leptospira interrogans serovar lai str. 56601
uaagaucauuuaaaa

SEQ ID NO: 2789380 - RNA, 15 nt, Leptospira interrogans serovar lai str. 56601
uaagauccaaauuuu

SEQ ID NO: 2789381 - RNA, 21 nt, Leptospira interrogans serovar lai str. 56601
uaagauccaaauuuuuuacaa

SEQ ID NO: 2789382 - RNA, 16 nt, Leptospira interrogans serovar lai str. 56601
uaagaucuaucucaaa

SEQ ID NO: 2789383 - RNA, 22 nt, Leptospira interrogans serovar lai str. 56601
uaagaucuauuccuaaaaugug

SEQ ID NO: 2789384 - RNA, 18 nt, Leptospira interrogans serovar lai str. 56601
uaagauuauauuauauuu

SEQ ID NO: 2789385 - RNA, 21 nt, Leptospira interrogans serovar lai str. 56601
uaagauuaugguaaaauuuca

SEQ ID NO: 2789386 - RNA, 17 nt, Leptospira interrogans serovar lai str. 56601
uaagauugaaugaaauc

SEQ ID NO: 2789387 - RNA, 21 nt, Leptospira interrogans serovar lai str. 56601
uaagauugaaugaaaucuaaa

SEQ ID NO: 2789388 - RNA, 16 nt, Leptospira interrogans serovar lai str. 56601
uaagauuuguugaaaa

SEQ ID NO: 2789389 - RNA, 21 nt, Leptospira interrogans serovar lai str. 56601
uaagauuuguugaaaagugag

SEQ ID NO: 2789390 - RNA, 15 nt, Leptospira interrogans serovar lai str. 56601
uaagcaaaaauaaag

SEQ ID NO: 2789391 - RNA, 23 nt, Leptospira interrogans serovar lai str. 56601
uaagcaguuuuacuguuguuaaa

SEQ ID NO: 2789392 - RNA, 18 nt, Leptospira interrogans serovar lai str. 56601
uaagcauaaaauucuaau

SEQ ID NO: 2789393 - RNA, 18 nt, Leptospira interrogans serovar lai str. 56601
uaagccaaaccaaauaga

SEQ ID NO: 2789394 - RNA, 17 nt, Leptospira interrogans serovar lai str. 56601
uaagcuaagcauaaaau

SEQ ID NO: 2789395 - RNA, 20 nt, Leptospira interrogans serovar lai str. 56601
uaagcucuccuacgcuucaa

SEQ ID NO: 2789396 - RNA, 17 nt, Leptospira interrogans serovar lai str. 56601
uaagcugaagacuucca

SEQ ID NO: 2789397 - RNA, 14 nt, Leptospira interrogans serovar lai str. 56601
uaagcuuuagaaaa

SEQ ID NO: 2789398 - RNA, 15 nt, Leptospira interrogans serovar lai str. 56601
uaagcuuuagaaaau

SEQ ID NO: 2789399 - RNA, 23 nt, Leptospira interrogans serovar lai str. 56601
uaaggaacacaugauucugaaaa

SEQ ID NO: 2789400 - RNA, 19 nt, Leptospira interrogans serovar lai str. 56601
uaaggaaccaucaccaacc

SEQ ID NO: 2789401 - RNA, 10 nt, Leptospira interrogans serovar lai str. 56601
uaauauuaaa

SEQ ID NO: 2789402 - RNA, 12 nt, Leptospira interrogans serovar lai str. 56601
uaauauuaaaaa

SEQ ID NO: 2789403 - RNA, 16 nt, Leptospira interrogans serovar lai str. 56601
uaauauuaaaaacaca

SEQ ID NO: 2789404 - RNA, 22 nt, Leptospira interrogans serovar lai str. 56601
uaauauuauuaaauuuuuauac

SEQ ID NO: 2789405 - RNA, 13 nt, Leptospira interrogans serovar lai str. 56601
uaauauucuuuua

SEQ ID NO: 2789406 - RNA, 16 nt, Leptospira interrogans serovar lai str. 56601
uaauauuuauaaaaca

SEQ ID NO: 2789407 - RNA, 16 nt, Leptospira interrogans serovar lai str. 56601
uaauauuucaauuccu

SEQ ID NO: 2789408 - RNA, 18 nt, Leptospira interrogans serovar lai str. 56601
uaauauuucgauguaauu

SEQ ID NO: 2789409 - RNA, 23 nt, Leptospira interrogans serovar lai str. 56601
uaauauuucguuuuuaguuucaa

SEQ ID NO: 2789410 - RNA, 22 nt, Leptospira interrogans serovar lai str. 56601
uaauauuucucucaaauucuuc

SEQ ID NO: 2789411 - RNA, 19 nt, Leptospira interrogans serovar lai str. 56601
uaauauuucucuuuguaau

SEQ ID NO: 2789412 - RNA, 13 nt, Leptospira interrogans serovar lai str. 56601
uaauauuuuaaag

SEQ ID NO: 2789413 - RNA, 14 nt, Leptospira interrogans serovar lai str. 56601
uaauauuuuaaaga

SEQ ID NO: 2789414 - RNA, 18 nt, Leptospira interrogans serovar lai str. 56601
uaaucaaaauuucuuuuu

SEQ ID NO: 2789415 - RNA, 12 nt, Leptospira interrogans serovar lai str. 56601
uaaucaaaugca

SEQ ID NO: 2789416 - RNA, 22 nt, Leptospira interrogans serovar lai str. 56601
uaaucagauuuugcacaaaacc

SEQ ID NO: 2789417 - RNA, 23 nt, Leptospira interrogans serovar lai str. 56601
uaaucauggccuucuggaaaaau

SEQ ID NO: 2789418 - RNA, 18 nt, Leptospira interrogans serovar lai str. 56601
uaaucaugugaauucaga

SEQ ID NO: 2789419 - RNA, 18 nt, Leptospira interrogans serovar lai str. 56601
uaauccagcugaaacuaa

SEQ ID NO: 2789420 - RNA, 15 nt, Leptospira interrogans serovar lai str. 56601
uaauccuaugaaaau

SEQ ID NO: 2789421 - RNA, 19 nt, Leptospira interrogans serovar lai str. 56601
uaauccucuuucguuuuuu

SEQ ID NO: 2789422 - RNA, 16 nt, Leptospira interrogans serovar lai str. 56601
uaaucgaauuuccauu

SEQ ID NO: 2789423 - RNA, 16 nt, Leptospira interrogans serovar lai str. 56601
uaaucgauuuuacaga

SEQ ID NO: 2789424 - RNA, 22 nt, Leptospira interrogans serovar lai str. 56601
uaaucgcucugaaguaucucuu

SEQ ID NO: 2789425 - RNA, 20 nt, Leptospira interrogans serovar lai str. 56601
uaaucuaagauccaaauuuu

SEQ ID NO: 2789426 - RNA, 14 nt, Leptospira interrogans serovar lai str. 56601
uaaucuaauucgaa

SEQ ID NO: 2789427 - RNA, 16 nt, Leptospira interrogans serovar lai str. 56601
uaaucuaguuuauaug

SEQ ID NO: 2789428 - RNA, 22 nt, Leptospira interrogans serovar lai str. 56601
uaaucuaguuuauaugaguucc

SEQ ID NO: 2789429 - RNA, 20 nt, Leptospira interrogans serovar lai str. 56601
uaaucuccgcucuauuucca

SEQ ID NO: 2789430 - RNA, 19 nt, Leptospira interrogans serovar lai str. 56601
uaaucucgauuucuaaaau

SEQ ID NO: 2789431 - RNA, 16 nt, Leptospira interrogans serovar lai str. 56601
uaaucuguaaaucaac

SEQ ID NO: 2789432 - RNA, 23 nt, Leptospira interrogans serovar lai str. 56601
uaaucugugggaacuaccacaaa

SEQ ID NO: 2789433 - RNA, 21 nt, Leptospira interrogans serovar lai str. 56601
uaaucugugggaacuaucaca

SEQ ID NO: 2789434 - RNA, 17 nt, Leptospira interrogans serovar lai str. 56601
uaaucuuaauauuucuc

SEQ ID NO: 2789435 - RNA, 22 nt, Leptospira interrogans serovar lai str. 56601
uaaucuuauuuuuuaauauuca

SEQ ID NO: 2789436 - RNA, 21 nt, Leptospira interrogans serovar lai str. 56601
uaaucuuuauagguuucuucg

SEQ ID NO: 2789437 - RNA, 13 nt, Leptospira interrogans serovar lai str. 56601
uaaucuuuguaug

SEQ ID NO: 2789438 - RNA, 22 nt, Leptospira interrogans serovar lai str. 56601
uaaucuuuguaugaguucccac

SEQ ID NO: 2789439 - RNA, 12 nt, Leptospira interrogans serovar lai str. 56601
uaaucuuuugaa

SEQ ID NO: 2789440 - RNA, 23 nt, Leptospira interrogans serovar lai str. 56601
uaaucuuuugaguauuuaacuuc

SEQ ID NO: 2789441 - RNA, 14 nt, Leptospira interrogans serovar lai str. 56601
uaaucuuuuuaaaa

SEQ ID NO: 2789442 - RNA, 21 nt, Leptospira interrogans serovar lai str. 56601
uaaucuuuuuaaaaguuugau

SEQ ID NO: 2789443 - RNA, 20 nt, Leptospira interrogans serovar lai str. 56601
uaaugaauaacuuuacaaaa

SEQ ID NO: 2789444 - RNA, 15 nt, Leptospira interrogans serovar lai str. 56601
uaaugaaucguaaaa

SEQ ID NO: 2789445 - RNA, 20 nt, Leptospira interrogans serovar lai str. 56601
uaaugaaucguaaaaaaaua

SEQ ID NO: 2789446 - RNA, 19 nt, Leptospira interrogans serovar lai str. 56601
uaaugaauuucuaauagau

SEQ ID NO: 2789447 - RNA, 19 nt, Leptospira interrogans serovar lai str. 56601
uaaugacgauuuucuccuc

SEQ ID NO: 2789448 - RNA, 19 nt, Leptospira interrogans serovar lai str. 56601
uaaugagauuaaaacugcu

SEQ ID NO: 2789449 - RNA, 21 nt, Leptospira interrogans serovar lai str. 56601
uaaugagccagguuaauuaaa

SEQ ID NO: 2789450 - RNA, 17 nt, Leptospira interrogans serovar lai str. 56601
uaaugagucugucccaa

SEQ ID NO: 2789451 - RNA, 21 nt, Leptospira interrogans serovar lai str. 56601
uaaugagucugucccaaaauc

SEQ ID NO: 2789452 - RNA, 23 nt, Leptospira interrogans serovar lai str. 56601
uaaugcagcuucuuccaaaguca

SEQ ID NO: 2789453 - RNA, 19 nt, Leptospira interrogans serovar lai str. 56601
uaaugccuacaaaucaaau

SEQ ID NO: 2789454 - RNA, 20 nt, Leptospira interrogans serovar lai str. 56601
uaaugccuacaaaucaaauc

SEQ ID NO: 2789455 - RNA, 14 nt, Leptospira interrogans serovar lai str. 56601
uaaugcugauuuuu

SEQ ID NO: 2789456 - RNA, 17 nt, Leptospira interrogans serovar lai str. 56601
uaauguacaacauccuu

SEQ ID NO: 2789457 - RNA, 20 nt, Leptospira interrogans serovar lai str. 56601
uaauguaggaacuauuacuu

SEQ ID NO: 2789458 - RNA, 14 nt, Leptospira interrogans serovar lai str. 56601
uaauguauaauccu

SEQ ID NO: 2789459 - RNA, 18 nt, Leptospira interrogans serovar lai str. 56601
uaaugucccagauucguu

SEQ ID NO: 2789460 - RNA, 20 nt, Leptospira interrogans serovar lai str. 56601
uaauguuaauuuagaauaaa

SEQ ID NO: 2789461 - RNA, 18 nt, Leptospira interrogans serovar lai str. 56601
uaauguuucaauuccuaa

SEQ ID NO: 2789462 - RNA, 14 nt, Leptospira interrogans serovar lai str. 56601
uaauuaaaaaauca

SEQ ID NO: 2789463 - RNA, 12 nt, Leptospira interrogans serovar lai str. 56601
uaauuaaaaaga

SEQ ID NO: 2789464 - RNA, 15 nt, Leptospira interrogans serovar lai str. 56601
uaauuacaguuaaua

SEQ ID NO: 2789465 - RNA, 16 nt, Leptospira interrogans serovar lai str. 56601
uaauuacaguuaauaa

SEQ ID NO: 2789466 - RNA, 16 nt, Leptospira interrogans serovar lai str. 56601
uaauuagaaaaauauu

SEQ ID NO: 2789467 - RNA, 16 nt, Leptospira interrogans serovar lai str. 56601
uaauuauccuuaaaau

SEQ ID NO: 2789468 - RNA, 23 nt, Leptospira interrogans serovar lai str. 56601
uaauuauggcacuuauucuuaua

SEQ ID NO: 2789469 - RNA, 20 nt, Leptospira interrogans serovar lai str. 56601
uaauuauguuugccauuuuu

SEQ ID NO: 2789470 - RNA, 22 nt, Leptospira interrogans serovar lai str. 56601
uaauuauugauaaaaaaauguu

SEQ ID NO: 2789471 - RNA, 13 nt, Leptospira interrogans serovar lai str. 56601
uaauuauugauau

SEQ ID NO: 2789472 - RNA, 16 nt, Leptospira interrogans serovar lai str. 56601
uaauucaaaauuugau

SEQ ID NO: 2789473 - RNA, 22 nt, Leptospira interrogans serovar lai str. 56601
uaauucagcaucgaauauccuu

SEQ ID NO: 2789474 - RNA, 14 nt, Leptospira interrogans serovar lai str. 56601
uaauucauuuggau

SEQ ID NO: 2789475 - RNA, 17 nt, Leptospira interrogans serovar lai str. 56601
uaauuccacucagacca

SEQ ID NO: 2789476 - RNA, 22 nt, Leptospira interrogans serovar lai str. 56601
uaauuccagcuccgcauaaaac

SEQ ID NO: 2789477 - RNA, 20 nt, Leptospira interrogans serovar lai str. 56601
uaauuccgacgauagaucuu

SEQ ID NO: 2789478 - RNA, 15 nt, Leptospira interrogans serovar lai str. 56601
uaauucgauccaaaa

SEQ ID NO: 2789479 - RNA, 17 nt, Leptospira interrogans serovar lai str. 56601
uaauucgugaacuuuag

SEQ ID NO: 2789480 - RNA, 19 nt, Leptospira interrogans serovar lai str. 56601
uaauucguuccaaauacaa

SEQ ID NO: 2789481 - RNA, 13 nt, Leptospira interrogans serovar lai str. 56601
uaauucguuugaa

SEQ ID NO: 2789482 - RNA, 15 nt, Leptospira interrogans serovar lai str. 56601
uaauucguuuuuuaa

SEQ ID NO: 2789483 - RNA, 21 nt, Leptospira interrogans serovar lai str. 56601
uaauucguuuuuuaaaaugua

SEQ ID NO: 2789484 - RNA, 18 nt, Leptospira interrogans serovar lai str. 56601
uacaaacuccgugaacuu

SEQ ID NO: 2789485 - RNA, 18 nt, Leptospira interrogans serovar lai str. 56601
uacaaagaguuuaaaaaa

SEQ ID NO: 2789486 - RNA, 19 nt, Leptospira interrogans serovar lai str. 56601
uacaaagaguuuaaaaaau

SEQ ID NO: 2789487 - RNA, 16 nt, Leptospira interrogans serovar lai str. 56601
uacaaaguaaguucaa

SEQ ID NO: 2789488 - RNA, 23 nt, Leptospira interrogans serovar lai str. 56601
uacaaaguaaguucaaauuuaug

SEQ ID NO: 2789489 - RNA, 18 nt, Leptospira interrogans serovar lai str. 56601
uacaaaguauucuuucca

SEQ ID NO: 2789490 - RNA, 19 nt, Leptospira interrogans serovar lai str. 56601
uacaaagugaugaagagaa

SEQ ID NO: 2789491 - RNA, 19 nt, Leptospira interrogans serovar lai str. 56601
uacaaauuaguauuuuucu

SEQ ID NO: 2789492 - RNA, 16 nt, Leptospira interrogans serovar lai str. 56601
uacaaauucuucuucc

SEQ ID NO: 2789493 - RNA, 12 nt, Leptospira interrogans serovar lai str. 56601
uacaaauugaua

SEQ ID NO: 2789494 - RNA, 16 nt, Leptospira interrogans serovar lai str. 56601
uacaaauugauaauuu

SEQ ID NO: 2789495 - RNA, 15 nt, Leptospira interrogans serovar lai str. 56601
uacaacauccuucaa

SEQ ID NO: 2789496 - RNA, 19 nt, Leptospira interrogans serovar lai str. 56601
uacaacauccuucaaacuu

SEQ ID NO: 2789497 - RNA, 13 nt, Leptospira interrogans serovar lai str. 56601
uacaaccaaacag

SEQ ID NO: 2789498 - RNA, 18 nt, Leptospira interrogans serovar lai str. 56601
uacaaccacuggaauaua

SEQ ID NO: 2789499 - RNA, 21 nt, Leptospira interrogans serovar lai str. 56601
uacaaccgaaaagguuaaaaa

SEQ ID NO: 2789500 - RNA, 22 nt, Leptospira interrogans serovar lai str. 56601
uacaaccgaaaagguuaaaaau

SEQ ID NO: 2789501 - RNA, 19 nt, Leptospira interrogans serovar lai str. 56601
uacaacgcgauccauagag

SEQ ID NO: 2789502 - RNA, 15 nt, Leptospira interrogans serovar lai str. 56601
uacaacuuuuuuaau

SEQ ID NO: 2789503 - RNA, 14 nt, Leptospira interrogans serovar lai str. 56601
uacaagaaucaaaa

SEQ ID NO: 2789504 - RNA, 21 nt, Leptospira interrogans serovar lai str. 56601
uacaagacuucuauacucuuc

SEQ ID NO: 2789505 - RNA, 20 nt, Leptospira interrogans serovar lai str. 56601
uacaaguuaugauuucauag

SEQ ID NO: 2789506 - RNA, 12 nt, Leptospira interrogans serovar lai str. 56601
uacaauaaaaau

SEQ ID NO: 2789507 - RNA, 19 nt, Leptospira interrogans serovar lai str. 56601
uacaauaaagcuccaguau

SEQ ID NO: 2789508 - RNA, 22 nt, Leptospira interrogans serovar lai str. 56601
uacaauaaaggaaaguucuaua

SEQ ID NO: 2789509 - RNA, 16 nt, Leptospira interrogans serovar lai str. 56601
uacaauauuucgucuu

SEQ ID NO: 2789510 - RNA, 22 nt, Leptospira interrogans serovar lai str. 56601
uacaauauuuugucuuuaauuu

SEQ ID NO: 2789511 - RNA, 16 nt, Leptospira interrogans serovar lai str. 56601
uacaaucaauaaauug

SEQ ID NO: 2789512 - RNA, 21 nt, Leptospira interrogans serovar lai str. 56601
uacaaucacuuuauauugguu

SEQ ID NO: 2789513 - RNA, 18 nt, Leptospira interrogans serovar lai str. 56601
uacaaucccggcggaaaa

SEQ ID NO: 2789514 - RNA, 18 nt, Leptospira interrogans serovar lai str. 56601
uacaaucggguaaaaaau

SEQ ID NO: 2789515 - RNA, 21 nt, Leptospira interrogans serovar lai str. 56601
uacaaucggguaaaaaauacu

SEQ ID NO: 2789516 - RNA, 12 nt, Leptospira interrogans serovar lai str. 56601
uacaaugaaaaa

SEQ ID NO: 2789517 - RNA, 12 nt, Leptospira interrogans serovar lai str. 56601
uacaauuaaaaa

SEQ ID NO: 2789518 - RNA, 13 nt, Leptospira interrogans serovar lai str. 56601
uacaauuaaaaag

SEQ ID NO: 2789519 - RNA, 14 nt, Leptospira interrogans serovar lai str. 56601
uacaauuaaaaaga

SEQ ID NO: 2789520 - RNA, 17 nt, Leptospira interrogans serovar lai str. 56601
uacaauuaaaaagauag

SEQ ID NO: 2789521 - RNA, 18 nt, Leptospira interrogans serovar lai str. 56601
uacaauuauauuaaauua

SEQ ID NO: 2789522 - RNA, 16 nt, Leptospira interrogans serovar lai str. 56601
uacaauucaucaccaa

SEQ ID NO: 2789523 - RNA, 19 nt, Leptospira interrogans serovar lai str. 56601
uacaauucugaaauuguuu

SEQ ID NO: 2789524 - RNA, 17 nt, Leptospira interrogans serovar lai str. 56601
uacaauugauuuaaaaa

SEQ ID NO: 2789525 - RNA, 18 nt, Leptospira interrogans serovar lai str. 56601
uacaauugauuuaaaaac

SEQ ID NO: 2789526 - RNA, 13 nt, Leptospira interrogans serovar lai str. 56601
uacaauuguagga

SEQ ID NO: 2789527 - RNA, 20 nt, Leptospira interrogans serovar lai str. 56601
uacaauuguaggaauucaua

SEQ ID NO: 2789528 - RNA, 14 nt, Leptospira interrogans serovar lai str. 56601
uacaauuuaauagu

SEQ ID NO: 2789529 - RNA, 14 nt, Leptospira interrogans serovar lai str. 56601
uacaccaaacucac

SEQ ID NO: 2789530 - RNA, 21 nt, Leptospira interrogans serovar lai str. 56601
uacacccuuaacgguuuugau

SEQ ID NO: 2789531 - RNA, 17 nt, Leptospira interrogans serovar lai str. 56601
uacacgauaauuuucuu

SEQ ID NO: 2789532 - RNA, 17 nt, Leptospira interrogans serovar lai str. 56601
uacacguaauucuuugg

SEQ ID NO: 2789533 - RNA, 16 nt, Leptospira interrogans serovar lai str. 56601
uacacuccucaaagau

SEQ ID NO: 2789534 - RNA, 15 nt, Leptospira interrogans serovar lai str. 56601
uacacucuaaguuuu

SEQ ID NO: 2789535 - RNA, 20 nt, Leptospira interrogans serovar lai str. 56601
uacagaaaaccaaauaauaa

SEQ ID NO: 2789536 - RNA, 14 nt, Leptospira interrogans serovar lai str. 56601
uacagaaacaaaau

SEQ ID NO: 2789537 - RNA, 23 nt, Leptospira interrogans serovar lai str. 56601
uacagaacacucaacgaagucuc

SEQ ID NO: 2789538 - RNA, 19 nt, Leptospira interrogans serovar lai str. 56601
uacagaacccaauaaaaac

SEQ ID NO: 2789539 - RNA, 16 nt, Leptospira interrogans serovar lai str. 56601
uacagaagggagaaua

SEQ ID NO: 2789540 - RNA, 23 nt, Leptospira interrogans serovar lai str. 56601
uacagaauaaauacauacaauga

SEQ ID NO: 2789541 - RNA, 14 nt, Leptospira interrogans serovar lai str. 56601
uacagaauauuaaa

SEQ ID NO: 2789542 - RNA, 22 nt, Leptospira interrogans serovar lai str. 56601
uacagaauugauuguugaacuu

SEQ ID NO: 2789543 - RNA, 19 nt, Leptospira interrogans serovar lai str. 56601
uacagacugauuuuuuaaa

SEQ ID NO: 2789544 - RNA, 20 nt, Leptospira interrogans serovar lai str. 56601
uacagacugauuuuuuaaau

SEQ ID NO: 2789545 - RNA, 17 nt, Leptospira interrogans serovar lai str. 56601
uacagagauauagaaau

SEQ ID NO: 2789546 - RNA, 23 nt, Leptospira interrogans serovar lai str. 56601
uacagagauauagaaauuuucaa

SEQ ID NO: 2789547 - RNA, 14 nt, Leptospira interrogans serovar lai str. 56601
uacagauaaaaaua

SEQ ID NO: 2789548 - RNA, 18 nt, Leptospira interrogans serovar lai str. 56601
uacagaucaauucuuuaa

SEQ ID NO: 2789549 - RNA, 18 nt, Leptospira interrogans serovar lai str. 56601
uacagaucgauuccuacu

SEQ ID NO: 2789550 - RNA, 14 nt, Leptospira interrogans serovar lai str. 56601
uacagauugauucu

SEQ ID NO: 2789551 - RNA, 18 nt, Leptospira interrogans serovar lai str. 56601
uacagauuuauuuuagaa

SEQ ID NO: 2789552 - RNA, 17 nt, Leptospira interrogans serovar lai str. 56601
uacaggcgguuuaaaag

SEQ ID NO: 2789553 - RNA, 18 nt, Leptospira interrogans serovar lai str. 56601
uacaggcgguuuaaaagc

SEQ ID NO: 2789554 - RNA, 23 nt, Leptospira interrogans serovar lai str. 56601
uacagucguucccacaucuuauu

SEQ ID NO: 2789555 - RNA, 19 nt, Leptospira interrogans serovar lai str. 56601
uacaguuaaacuuugaaaa

SEQ ID NO: 2789556 - RNA, 21 nt, Leptospira interrogans serovar lai str. 56601
uacaguucugaguaagauauu

SEQ ID NO: 2789557 - RNA, 17 nt, Leptospira interrogans serovar lai str. 56601
uacaguuucgauugaaa

SEQ ID NO: 2789558 - RNA, 23 nt, Leptospira interrogans serovar lai str. 56601
uacauaaguucgguguaaaaaau

SEQ ID NO: 2789559 - RNA, 23 nt, Leptospira interrogans serovar lai str. 56601
uacauaauaaaguacuaauucaa

SEQ ID NO: 2789560 - RNA, 17 nt, Leptospira interrogans serovar lai str. 56601
uacauacaaugaaaaag

SEQ ID NO: 2789561 - RNA, 19 nt, Leptospira interrogans serovar lai str. 56601
uacauacaaugaaaaagca

SEQ ID NO: 2789562 - RNA, 19 nt, Leptospira interrogans serovar lai str. 56601
uacauaggaaccugauuuc

SEQ ID NO: 2789563 - RNA, 14 nt, Leptospira interrogans serovar lai str. 56601
uacauaucaauccu

SEQ ID NO: 2789564 - RNA, 22 nt, Leptospira interrogans serovar lai str. 56601
uacaucaaaaacaaauuaaguu

SEQ ID NO: 2789565 - RNA, 21 nt, Leptospira interrogans serovar lai str. 56601
uacaucaacucuguaaauuca

SEQ ID NO: 2789566 - RNA, 18 nt, Leptospira interrogans serovar lai str. 56601
uacguaaagaacuucgau

SEQ ID NO: 2789567 - RNA, 14 nt, Leptospira interrogans serovar lai str. 56601
uacguaaauggugg

SEQ ID NO: 2789568 - RNA, 17 nt, Leptospira interrogans serovar lai str. 56601
uacguuccuucuacaau

SEQ ID NO: 2789569 - RNA, 20 nt, Leptospira interrogans serovar lai str. 56601
uacguuuuauuauauaauuu

SEQ ID NO: 2789570 - RNA, 12 nt, Leptospira interrogans serovar lai str. 56601
uacuaaaaaaca

SEQ ID NO: 2789571 - RNA, 19 nt, Leptospira interrogans serovar lai str. 56601
uacuaaaaaacauaaaaau

SEQ ID NO: 2789572 - RNA, 20 nt, Leptospira interrogans serovar lai str. 56601
uacuaaaagaguaauucuaa

SEQ ID NO: 2789573 - RNA, 15 nt, Leptospira interrogans serovar lai str. 56601
uacuaaaauuaaaaa

SEQ ID NO: 2789574 - RNA, 14 nt, Leptospira interrogans serovar lai str. 56601
uacuaaaauuauuc

SEQ ID NO: 2789575 - RNA, 20 nt, Leptospira interrogans serovar lai str. 56601
uacuaaaauuuuauaaaaau

SEQ ID NO: 2789576 - RNA, 22 nt, Leptospira interrogans serovar lai str. 56601
uacuaaacgauuuuauacauuc

SEQ ID NO: 2789577 - RNA, 14 nt, Leptospira interrogans serovar lai str. 56601
uacuaaaucagaau

SEQ ID NO: 2789578 - RNA, 11 nt, Leptospira interrogans serovar lai str. 56601
uacuaaaucuc

SEQ ID NO: 2789579 - RNA, 20 nt, Leptospira interrogans serovar lai str. 56601
uacuaaauuaaguuuauuca

SEQ ID NO: 2789580 - RNA, 12 nt, Leptospira interrogans serovar lai str. 56601
uacuaauucaau

SEQ ID NO: 2789581 - RNA, 15 nt, Leptospira interrogans serovar lai str. 56601
uacuaauucaauaag

SEQ ID NO: 2789582 - RNA, 16 nt, Leptospira interrogans serovar lai str. 56601
uacuaauucuuuugca

SEQ ID NO: 2789583 - RNA, 16 nt, Leptospira interrogans serovar lai str. 56601
uacuacaauuaaaaag

SEQ ID NO: 2789584 - RNA, 16 nt, Leptospira interrogans serovar lai str. 56601
uacuacaauuuuagaa

SEQ ID NO: 2789585 - RNA, 11 nt, Leptospira interrogans serovar lai str. 56601
uacuacauuug

SEQ ID NO: 2789586 - RNA, 16 nt, Leptospira interrogans serovar lai str. 56601
uacuacauuuuauugu

SEQ ID NO: 2789587 - RNA, 14 nt, Leptospira interrogans serovar lai str. 56601
uacuaccaaagcuu

SEQ ID NO: 2789588 - RNA, 17 nt, Leptospira interrogans serovar lai str. 56601
uacuacgucuucuaaau

SEQ ID NO: 2789589 - RNA, 20 nt, Leptospira interrogans serovar lai str. 56601
uacuacuuaaacguauaaaa

SEQ ID NO: 2789590 - RNA, 17 nt, Leptospira interrogans serovar lai str. 56601
uacuacuuuuagaaaaa

SEQ ID NO: 2789591 - RNA, 12 nt, Leptospira interrogans serovar lai str. 56601
uacuagaacaau

SEQ ID NO: 2789592 - RNA, 16 nt, Leptospira interrogans serovar lai str. 56601
uacuaggaaaauuuaa

SEQ ID NO: 2789593 - RNA, 15 nt, Leptospira interrogans serovar lai str. 56601
uacuauaaacauauu

SEQ ID NO: 2789594 - RNA, 22 nt, Leptospira interrogans serovar lai str. 56601
uacuauaaacuucucuuaaaau

SEQ ID NO: 2789595 - RNA, 23 nt, Leptospira interrogans serovar lai str. 56601
uacuauauuuuugugaaacucaa

SEQ ID NO: 2789596 - RNA, 18 nt, Leptospira interrogans serovar lai str. 56601
uacuaugaaauacaaaaa

SEQ ID NO: 2789597 - RNA, 22 nt, Leptospira interrogans serovar lai str. 56601
uacuaugaagacgcuuaaaaau

SEQ ID NO: 2789598 - RNA, 21 nt, Leptospira interrogans serovar lai str. 56601
uacuauuaauuuacuuaucug

SEQ ID NO: 2789599 - RNA, 19 nt, Leptospira interrogans serovar lai str. 56601
uacuauuuugaugaaugaa

SEQ ID NO: 2789600 - RNA, 18 nt, Leptospira interrogans serovar lai str. 56601
uacucaauuuuacagaga

SEQ ID NO: 2789601 - RNA, 23 nt, Leptospira interrogans serovar lai str. 56601
uacucagagcgauauaauaaaau

SEQ ID NO: 2789602 - RNA, 17 nt, Leptospira interrogans serovar lai str. 56601
uacucagaguuauauaa

SEQ ID NO: 2789603 - RNA, 18 nt, Leptospira interrogans serovar lai str. 56601
uacucagaguuauauaag

SEQ ID NO: 2789604 - RNA, 14 nt, Leptospira interrogans serovar lai str. 56601
uacucauuuccauc

SEQ ID NO: 2789605 - RNA, 22 nt, Leptospira interrogans serovar lai str. 56601
uacucgaaacuguauuauaaag

SEQ ID NO: 2789606 - RNA, 18 nt, Leptospira interrogans serovar lai str. 56601
uacucgaaaguuuauaaa

SEQ ID NO: 2789607 - RNA, 19 nt, Leptospira interrogans serovar lai str. 56601
uacucguuuuuaguuucuu

SEQ ID NO: 2789608 - RNA, 23 nt, Leptospira interrogans serovar lai str. 56601
uacucguuuuuaguuucuuuuuu

SEQ ID NO: 2789609 - RNA, 14 nt, Leptospira interrogans serovar lai str. 56601
uacucuuauaaaau

SEQ ID NO: 2789610 - RNA, 16 nt, Leptospira interrogans serovar lai str. 56601
uacucuuauaaaauuu

SEQ ID NO: 2789611 - RNA, 21 nt, Leptospira interrogans serovar lai str. 56601
uacucuuauaaaauuuuagau

SEQ ID NO: 2789612 - RNA, 20 nt, Leptospira interrogans serovar lai str. 56601
uacugacagauugauauucu

SEQ ID NO: 2789613 - RNA, 17 nt, Leptospira interrogans serovar lai str. 56601
uacugaguuucaaacac

SEQ ID NO: 2789614 - RNA, 23 nt, Leptospira interrogans serovar lai str. 56601
uacugauuuagagagucaaauca

SEQ ID NO: 2789615 - RNA, 18 nt, Leptospira interrogans serovar lai str. 56601
uacugauuucaaaaauaa

SEQ ID NO: 2789616 - RNA, 11 nt, Leptospira interrogans serovar lai str. 56601
uacugauuuuc

SEQ ID NO: 2789617 - RNA, 17 nt, Leptospira interrogans serovar lai str. 56601
uacugauuuucaugaau

SEQ ID NO: 2789618 - RNA, 14 nt, Leptospira interrogans serovar lai str. 56601
uacugcauuuuauu

SEQ ID NO: 2789619 - RNA, 20 nt, Leptospira interrogans serovar lai str. 56601
uacugguuuuggagaccaaa

SEQ ID NO: 2789620 - RNA, 23 nt, Leptospira interrogans serovar lai str. 56601
uacugguuuuggagaccaaaaau

SEQ ID NO: 2789621 - RNA, 19 nt, Leptospira interrogans serovar lai str. 56601
uacuguuguuaaauuuuug

SEQ ID NO: 2789622 - RNA, 14 nt, Leptospira interrogans serovar lai str. 56601
uacuuaaaaauacc

SEQ ID NO: 2789623 - RNA, 15 nt, Leptospira interrogans serovar lai str. 56601
uacuuaaaaaugaug

SEQ ID NO: 2789624 - RNA, 20 nt, Leptospira interrogans serovar lai str. 56601
uacuuaaacguauaaaaaca

SEQ ID NO: 2789625 - RNA, 22 nt, Leptospira interrogans serovar lai str. 56601
uacuuaaacguauaaaaacagc

SEQ ID NO: 2789626 - RNA, 16 nt, Leptospira interrogans serovar lai str. 56601
uacuuacauagaacuc

SEQ ID NO: 2789627 - RNA, 23 nt, Leptospira interrogans serovar lai str. 56601
uacuuaccucuauaaaauuaaau

SEQ ID NO: 2789628 - RNA, 14 nt, Leptospira interrogans serovar lai str. 56601
uacuuagaugaacu

SEQ ID NO: 2789629 - RNA, 14 nt, Leptospira interrogans serovar lai str. 56601
uacuuauuucuaua

SEQ ID NO: 2789630 - RNA, 19 nt, Leptospira interrogans serovar lai str. 56601
uacuuauuuuugaaaagau

SEQ ID NO: 2789631 - RNA, 18 nt, Leptospira interrogans serovar lai str. 56601
uacuucaauuguccauuu

SEQ ID NO: 2789632 - RNA, 18 nt, Leptospira interrogans serovar lai str. 56601
uacuucguuauaauuuuc

SEQ ID NO: 2789633 - RNA, 20 nt, Leptospira interrogans serovar lai str. 56601
uacuucguuauaauuuucau

SEQ ID NO: 2789634 - RNA, 14 nt, Leptospira interrogans serovar lai str. 56601
uacuucuaaaaaau

SEQ ID NO: 2789635 - RNA, 17 nt, Leptospira interrogans serovar lai str. 56601
uacuucuaaaaaauucu

SEQ ID NO: 2789636 - RNA, 22 nt, Leptospira interrogans serovar lai str. 56601
uacuucuauaauguuaauuuag

SEQ ID NO: 2789637 - RNA, 12 nt, Leptospira interrogans serovar lai str. 56601
uacuucuguaau

SEQ ID NO: 2789638 - RNA, 15 nt, Leptospira interrogans serovar lai str. 56601
uacuugaaaauaaaa

SEQ ID NO: 2789639 - RNA, 13 nt, Leptospira interrogans serovar lai str. 56601
uacuugcaaaaag

SEQ ID NO: 2789640 - RNA, 15 nt, Leptospira interrogans serovar lai str. 56601
uacuugcaaaaagua

SEQ ID NO: 2789641 - RNA, 22 nt, Leptospira interrogans serovar lai str. 56601
uacuugcaaaaaguauguuuuu

SEQ ID NO: 2789642 - RNA, 15 nt, Leptospira interrogans serovar lai str. 56601
uacuugccauggaaa

SEQ ID NO: 2789643 - RNA, 16 nt, Leptospira interrogans serovar lai str. 56601
uacuugucuuuagaac

SEQ ID NO: 2789644 - RNA, 18 nt, Leptospira interrogans serovar lai str. 56601
uacuugucuuuagaacuu

SEQ ID NO: 2789645 - RNA, 13 nt, Leptospira interrogans serovar lai str. 56601
uacuuuaaaaaau

SEQ ID NO: 2789646 - RNA, 13 nt, Leptospira interrogans serovar lai str. 56601
uacuuuaaaauuu

SEQ ID NO: 2789647 - RNA, 14 nt, Leptospira interrogans serovar lai str. 56601
uacuuuaaaauuug

SEQ ID NO: 2789648 - RNA, 15 nt, Leptospira interrogans serovar lai str. 56601
uacuuuagaaauuuc

SEQ ID NO: 2789649 - RNA, 17 nt, Leptospira interrogans serovar lai str. 56601
uagaauuguugaaaaac

SEQ ID NO: 2789650 - RNA, 17 nt, Leptospira interrogans serovar lai str. 56601
uagaauuguugaaaaau

SEQ ID NO: 2789651 - RNA, 20 nt, Leptospira interrogans serovar lai str. 56601
uagaauuguugaaaaauuaa

SEQ ID NO: 2789652 - RNA, 22 nt, Leptospira interrogans serovar lai str. 56601
uagaauuguugaaaaauuaauu

SEQ ID NO: 2789653 - RNA, 18 nt, Leptospira interrogans serovar lai str. 56601
uagaauuuaaguauuaua

SEQ ID NO: 2789654 - RNA, 22 nt, Leptospira interrogans serovar lai str. 56601
uagaauuuauucguaaaaucuu

SEQ ID NO: 2789655 - RNA, 15 nt, Leptospira interrogans serovar lai str. 56601
uagaauuuauuuuca

SEQ ID NO: 2789656 - RNA, 17 nt, Leptospira interrogans serovar lai str. 56601
uagaauuuauuuucaua

SEQ ID NO: 2789657 - RNA, 17 nt, Leptospira interrogans serovar lai str. 56601
uagaauuugaacuuuac

SEQ ID NO: 2789658 - RNA, 20 nt, Leptospira interrogans serovar lai str. 56601
uagaauuuguucgugaaauu

SEQ ID NO: 2789659 - RNA, 19 nt, Leptospira interrogans serovar lai str. 56601
uagaauuuguucuuaaaau

SEQ ID NO: 2789660 - RNA, 15 nt, Leptospira interrogans serovar lai str. 56601
uagaauuuguuugua

SEQ ID NO: 2789661 - RNA, 22 nt, Leptospira interrogans serovar lai str. 56601
uagaauuuguuuguaaaauagu

SEQ ID NO: 2789662 - RNA, 20 nt, Leptospira interrogans serovar lai str. 56601
uagaauuuguuuuuaaaauu

SEQ ID NO: 2789663 - RNA, 18 nt, Leptospira interrogans serovar lai str. 56601
uagaauuuuagacaaaaa

SEQ ID NO: 2789664 - RNA, 14 nt, Leptospira interrogans serovar lai str. 56601
uagaauuuucuaaa

SEQ ID NO: 2789665 - RNA, 18 nt, Leptospira interrogans serovar lai str. 56601
uagaauuuugcaaaaaaa

SEQ ID NO: 2789666 - RNA, 14 nt, Leptospira interrogans serovar lai str. 56601
uagaauuuuuauga

SEQ ID NO: 2789667 - RNA, 14 nt, Leptospira interrogans serovar lai str. 56601
uagaauuuuucgaa

SEQ ID NO: 2789668 - RNA, 13 nt, Leptospira interrogans serovar lai str. 56601
uagaauuuuugua

SEQ ID NO: 2789669 - RNA, 21 nt, Leptospira interrogans serovar lai str. 56601
uagaauuuuuguagaauugaa

SEQ ID NO: 2789670 - RNA, 21 nt, Leptospira interrogans serovar lai str. 56601
uagacauuguuuuacucuuau

SEQ ID NO: 2789671 - RNA, 19 nt, Leptospira interrogans serovar lai str. 56601
uagacguaggaaaugaaaa

SEQ ID NO: 2789672 - RNA, 12 nt, Leptospira interrogans serovar lai str. 56601
uagacuggcuuc

SEQ ID NO: 2789673 - RNA, 22 nt, Leptospira interrogans serovar lai str. 56601
uagagaacgaugcuugagcucc

SEQ ID NO: 2789674 - RNA, 20 nt, Leptospira interrogans serovar lai str. 56601
uagagaaguuaaaaaaugaa

SEQ ID NO: 2789675 - RNA, 21 nt, Leptospira interrogans serovar lai str. 56601
uagagaauuuguguuguaugu

SEQ ID NO: 2789676 - RNA, 21 nt, Leptospira interrogans serovar lai str. 56601
uagagagcguuuuacugaguu

SEQ ID NO: 2789677 - RNA, 13 nt, Leptospira interrogans serovar lai str. 56601
uagagagugaaaa

SEQ ID NO: 2789678 - RNA, 13 nt, Leptospira interrogans serovar lai str. 56601
uagagauugauau

SEQ ID NO: 2789679 - RNA, 19 nt, Leptospira interrogans serovar lai str. 56601
uagagccaaauuuuuagag

SEQ ID NO: 2789680 - RNA, 21 nt, Leptospira interrogans serovar lai str. 56601
uagagccaaauuuuuagagug

SEQ ID NO: 2789681 - RNA, 13 nt, Leptospira interrogans serovar lai str. 56601
uagaggauaaacu

SEQ ID NO: 2789682 - RNA, 15 nt, Leptospira interrogans serovar lai str. 56601
uagaggcuuuacauu

SEQ ID NO: 2789683 - RNA, 18 nt, Leptospira interrogans serovar lai str. 56601
uagaguaccauaaauuuu

SEQ ID NO: 2789684 - RNA, 20 nt, Leptospira interrogans serovar lai str. 56601
uagagugccaaaauuuugcu

SEQ ID NO: 2789685 - RNA, 18 nt, Leptospira interrogans serovar lai str. 56601
uagagugccgcaccuuuu

SEQ ID NO: 2789686 - RNA, 22 nt, Leptospira interrogans serovar lai str. 56601
uagaguguuguguugaguuuca

SEQ ID NO: 2789687 - RNA, 23 nt, Leptospira interrogans serovar lai str. 56601
uagaguguuguguugaguuucaa

SEQ ID NO: 2789688 - RNA, 13 nt, Leptospira interrogans serovar lai str. 56601
uagaguuauugaa

SEQ ID NO: 2789689 - RNA, 15 nt, Leptospira interrogans serovar lai str. 56601
uagaguuguugaaaa

SEQ ID NO: 2789690 - RNA, 17 nt, Leptospira interrogans serovar lai str. 56601
uagaguuguugaaaaau

SEQ ID NO: 2789691 - RNA, 19 nt, Leptospira interrogans serovar lai str. 56601
uagaguuguugaaaaauua

SEQ ID NO: 2789692 - RNA, 21 nt, Leptospira interrogans serovar lai str. 56601
uagaguuguugaaaaauucca

SEQ ID NO: 2789693 - RNA, 22 nt, Leptospira interrogans serovar lai str. 56601
uagaguuguugaaaaauuucau

SEQ ID NO: 2789694 - RNA, 20 nt, Leptospira interrogans serovar lai str. 56601
uagauaagagacaaauauuu

SEQ ID NO: 2789695 - RNA, 19 nt, Leptospira interrogans serovar lai str. 56601
uagauaaggcuaaagaaua

SEQ ID NO: 2789696 - RNA, 15 nt, Leptospira interrogans serovar lai str. 56601
uagauaauuaaacaa

SEQ ID NO: 2789697 - RNA, 16 nt, Leptospira interrogans serovar lai str. 56601
uagauaauuaaacaaa

SEQ ID NO: 2789698 - RNA, 23 nt, Leptospira interrogans serovar lai str. 56601
uagauaauuaaacaaagaauaaa

SEQ ID NO: 2789699 - RNA, 14 nt, Leptospira interrogans serovar lai str. 56601
uagauacaauuaaa

SEQ ID NO: 2789700 - RNA, 13 nt, Leptospira interrogans serovar lai str. 56601
uagauacauaaac

SEQ ID NO: 2789701 - RNA, 22 nt, Leptospira interrogans serovar lai str. 56601
uagauagguucuuagaacuuac

SEQ ID NO: 2789702 - RNA, 16 nt, Leptospira interrogans serovar lai str. 56601
uagauauuaguaaaac

SEQ ID NO: 2789703 - RNA, 13 nt, Leptospira interrogans serovar lai str. 56601
uagaucaauuugu

SEQ ID NO: 2789704 - RNA, 15 nt, Leptospira interrogans serovar lai str. 56601
uagaucugauauuuu

SEQ ID NO: 2789705 - RNA, 23 nt, Leptospira interrogans serovar lai str. 56601
uagaucugauauuuuaaauugaa

SEQ ID NO: 2789706 - RNA, 21 nt, Leptospira interrogans serovar lai str. 56601
uagaugaacuuuuuuauauag

SEQ ID NO: 2789707 - RNA, 22 nt, Leptospira interrogans serovar lai str. 56601
uagauggagaauucauuuuucu

SEQ ID NO: 2789708 - RNA, 20 nt, Leptospira interrogans serovar lai str. 56601
uagauuaaauuuuuauaaaa

SEQ ID NO: 2789709 - RNA, 15 nt, Leptospira interrogans serovar lai str. 56601
uagauuaauuuuuau

SEQ ID NO: 2789710 - RNA, 17 nt, Leptospira interrogans serovar lai str. 56601
uagauuaguuuaaaaac

SEQ ID NO: 2789711 - RNA, 17 nt, Leptospira interrogans serovar lai str. 56601
uagauuauuucaaaaau

SEQ ID NO: 2789712 - RNA, 21 nt, Leptospira interrogans serovar lai str. 56601
uagauuauuucaaaaauuuaa

SEQ ID NO: 2789713 - RNA, 17 nt, Leptospira interrogans serovar lai str. 56601
uagauucaaaagucuau

SEQ ID NO: 2789714 - RNA, 21 nt, Leptospira interrogans serovar lai str. 56601
uagauucaaaagucuauuucu

SEQ ID NO: 2789715 - RNA, 23 nt, Leptospira interrogans serovar lai str. 56601
uagauucaauuauuauaaacuuc

SEQ ID NO: 2789716 - RNA, 16 nt, Leptospira interrogans serovar lai str. 56601
uagauucacuuuugcu

SEQ ID NO: 2789717 - RNA, 19 nt, Leptospira interrogans serovar lai str. 56601
uagauuccuacauuauuuu

SEQ ID NO: 2789718 - RNA, 15 nt, Leptospira interrogans serovar lai str. 56601
uagauucuuaauguc

SEQ ID NO: 2789719 - RNA, 18 nt, Leptospira interrogans serovar lai str. 56601
uagauucuuaauguccca

SEQ ID NO: 2789720 - RNA, 13 nt, Leptospira interrogans serovar lai str. 56601
uagauugauuuaa

SEQ ID NO: 2789721 - RNA, 14 nt, Leptospira interrogans serovar lai str. 56601
uagauugauuuaaa

SEQ ID NO: 2789722 - RNA, 13 nt, Leptospira interrogans serovar lai str. 56601
uagauugcuuuuu

SEQ ID NO: 2789723 - RNA, 18 nt, Leptospira interrogans serovar lai str. 56601
uagauugcuuuuuaaaag

SEQ ID NO: 2789724 - RNA, 19 nt, Leptospira interrogans serovar lai str. 56601
uagauuuagauucuaaaaa

SEQ ID NO: 2789725 - RNA, 15 nt, Leptospira interrogans serovar lai str. 56601
uagauuuauugaaaa

SEQ ID NO: 2789726 - RNA, 17 nt, Leptospira interrogans serovar lai str. 56601
uagauuuauugaaaaau

SEQ ID NO: 2789727 - RNA, 20 nt, Leptospira interrogans serovar lai str. 56601
uagcaaauaacgauuccauu

SEQ ID NO: 2789728 - RNA, 20 nt, Leptospira interrogans serovar lai str. 56601
uagcacaaaugacauuuugu

SEQ ID NO: 2789729 - RNA, 16 nt, Leptospira interrogans serovar lai str. 56601
uagcaccuuuuuuaag

SEQ ID NO: 2789730 - RNA, 21 nt, Leptospira interrogans serovar lai str. 56601
uagcagauuuucucaaaaaaa

SEQ ID NO: 2789731 - RNA, 16 nt, Leptospira interrogans serovar lai str. 56601
uaguaaauuaacagcu

SEQ ID NO: 2789732 - RNA, 17 nt, Leptospira interrogans serovar lai str. 56601
uaguaauucuuacauua

SEQ ID NO: 2789733 - RNA, 17 nt, Leptospira interrogans serovar lai str. 56601
uaguaauuuaauauauu

SEQ ID NO: 2789734 - RNA, 19 nt, Leptospira interrogans serovar lai str. 56601
uaguagucuuacaauuuua

SEQ ID NO: 2789735 - RNA, 14 nt, Leptospira interrogans serovar lai str. 56601
uaguaguucccacc

SEQ ID NO: 2789736 - RNA, 19 nt, Leptospira interrogans serovar lai str. 56601
uaguauauucuaauagucu

SEQ ID NO: 2789737 - RNA, 19 nt, Leptospira interrogans serovar lai str. 56601
uaguaucauaaguuuugau

SEQ ID NO: 2789738 - RNA, 16 nt, Leptospira interrogans serovar lai str. 56601
uaguaugcgaaauucc

SEQ ID NO: 2789739 - RNA, 17 nt, Leptospira interrogans serovar lai str. 56601
uaguaugcgaaauuccu

SEQ ID NO: 2789740 - RNA, 18 nt, Leptospira interrogans serovar lai str. 56601
uaguauguuauuuuagcu

SEQ ID NO: 2789741 - RNA, 20 nt, Leptospira interrogans serovar lai str. 56601
uaguauuuaagaaucaucuu

SEQ ID NO: 2789742 - RNA, 21 nt, Leptospira interrogans serovar lai str. 56601
uagucaaugguugcaaaaaag

SEQ ID NO: 2789743 - RNA, 13 nt, Leptospira interrogans serovar lai str. 56601
uagucauuuugau

SEQ ID NO: 2789744 - RNA, 22 nt, Leptospira interrogans serovar lai str. 56601
uagucauuuugauaauuucauu

SEQ ID NO: 2789745 - RNA, 21 nt, Leptospira interrogans serovar lai str. 56601
uagucccacauuuuugugaaa

SEQ ID NO: 2789746 - RNA, 20 nt, Leptospira interrogans serovar lai str. 56601
uaguccguccacaaauugaa

SEQ ID NO: 2789747 - RNA, 20 nt, Leptospira interrogans serovar lai str. 56601
uagucguguuguuuagacca

SEQ ID NO: 2789748 - RNA, 17 nt, Leptospira interrogans serovar lai str. 56601
uagucugaaauaaauuu

SEQ ID NO: 2789749 - RNA, 14 nt, Leptospira interrogans serovar lai str. 56601
uagugaucgcguuu

SEQ ID NO: 2789750 - RNA, 22 nt, Leptospira interrogans serovar lai str. 56601
uagugcacugcuauaauuuaac

SEQ ID NO: 2789751 - RNA, 15 nt, Leptospira interrogans serovar lai str. 56601
uagugguuuguaaua

SEQ ID NO: 2789752 - RNA, 17 nt, Leptospira interrogans serovar lai str. 56601
uaguguuuaauuuuaaa

SEQ ID NO: 2789753 - RNA, 18 nt, Leptospira interrogans serovar lai str. 56601
uaguuaacgugaauuugg

SEQ ID NO: 2789754 - RNA, 14 nt, Leptospira interrogans serovar lai str. 56601
uaguuaauaaauuu

SEQ ID NO: 2789755 - RNA, 18 nt, Leptospira interrogans serovar lai str. 56601
uaguuauauuaauauucu

SEQ ID NO: 2789756 - RNA, 18 nt, Leptospira interrogans serovar lai str. 56601
uaguucagaugaauugaa

SEQ ID NO: 2789757 - RNA, 20 nt, Leptospira interrogans serovar lai str. 56601
uaguuccaauuaacaaaacu

SEQ ID NO: 2789758 - RNA, 14 nt, Leptospira interrogans serovar lai str. 56601
uaguucccacaaau

SEQ ID NO: 2789759 - RNA, 18 nt, Leptospira interrogans serovar lai str. 56601
uaguucccacaaauuaag

SEQ ID NO: 2789760 - RNA, 17 nt, Leptospira interrogans serovar lai str. 56601
uaguucccacaaauuag

SEQ ID NO: 2789761 - RNA, 18 nt, Leptospira interrogans serovar lai str. 56601
uaguucccacaaauucca

SEQ ID NO: 2789762 - RNA, 18 nt, Leptospira interrogans serovar lai str. 56601
uaguucccacaguuugaa

SEQ ID NO: 2789763 - RNA, 12 nt, Leptospira interrogans serovar lai str. 56601
uaguucccacau

SEQ ID NO: 2789764 - RNA, 17 nt, Leptospira interrogans serovar lai str. 56601
uaguucccacauuuugu

SEQ ID NO: 2789765 - RNA, 20 nt, Leptospira interrogans serovar lai str. 56601
uaguuccuacaaauuaaauc

SEQ ID NO: 2789766 - RNA, 22 nt, Leptospira interrogans serovar lai str. 56601
uaguuccuacauuuuaaaaauu

SEQ ID NO: 2789767 - RNA, 19 nt, Leptospira interrogans serovar lai str. 56601
uaguuccuacgguuuuagu

SEQ ID NO: 2789768 - RNA, 20 nt, Leptospira interrogans serovar lai str. 56601
uaguuccuacgguuuuaguc

SEQ ID NO: 2789769 - RNA, 22 nt, Leptospira interrogans serovar lai str. 56601
uaguuccuauauuuuaaauuca

SEQ ID NO: 2789770 - RNA, 21 nt, Leptospira interrogans serovar lai str. 56601
uaguuccuuaaauauaucuuc

SEQ ID NO: 2789771 - RNA, 19 nt, Leptospira interrogans serovar lai str. 56601
uaguucucucgaaaugaga

SEQ ID NO: 2789772 - RNA, 14 nt, Leptospira interrogans serovar lai str. 56601
uaguucuucaaaau

SEQ ID NO: 2789773 - RNA, 20 nt, Leptospira interrogans serovar lai str. 56601
uaguugcaccugguuuuuug

SEQ ID NO: 2789774 - RNA, 15 nt, Leptospira interrogans serovar lai str. 56601
uaguuguacaaaaau

SEQ ID NO: 2789775 - RNA, 20 nt, Leptospira interrogans serovar lai str. 56601
uaguuuacaaauugauaauu

SEQ ID NO: 2789776 - RNA, 14 nt, Leptospira interrogans serovar lai str. 56601
uaguuuauuuuaaa

SEQ ID NO: 2789777 - RNA, 15 nt, Leptospira interrogans serovar lai str. 56601
uaguuuauuuuaaaa

SEQ ID NO: 2789778 - RNA, 16 nt, Leptospira interrogans serovar lai str. 56601
uaguuuauuuuaaaaa

SEQ ID NO: 2789779 - RNA, 21 nt, Leptospira interrogans serovar lai str. 56601
uaguuuauuuuucuuuuaaaa

SEQ ID NO: 2789780 - RNA, 19 nt, Leptospira interrogans serovar lai str. 56601
uaguuuccaaaaaagacuu

SEQ ID NO: 2789781 - RNA, 19 nt, Leptospira interrogans serovar lai str. 56601
uaguuucuaaguguaaaau

SEQ ID NO: 2789782 - RNA, 17 nt, Leptospira interrogans serovar lai str. 56601
uaguuucuuuuuuagau

SEQ ID NO: 2789783 - RNA, 14 nt, Leptospira interrogans serovar lai str. 56601
uaguuuuauuagaa

SEQ ID NO: 2789784 - RNA, 22 nt, Leptospira interrogans serovar lai str. 56601
uaguuuuccuucuagauaaggu

SEQ ID NO: 2789785 - RNA, 22 nt, Leptospira interrogans serovar lai str. 56601
uaguuuuuauuugauuagaaaa

SEQ ID NO: 2789786 - RNA, 23 nt, Leptospira interrogans serovar lai str. 56601
uaguuuuuugauuccuuuuucua

SEQ ID NO: 2789787 - RNA, 13 nt, Leptospira interrogans serovar lai str. 56601
uauaaaaaauaau

SEQ ID NO: 2789788 - RNA, 14 nt, Leptospira interrogans serovar lai str. 56601
uauaaaaacagcac

SEQ ID NO: 2789789 - RNA, 20 nt, Leptospira interrogans serovar lai str. 56601
uauaaaaacagcacuaaaag

SEQ ID NO: 2789790 - RNA, 19 nt, Leptospira interrogans serovar lai str. 56601
uauaaaaacaguaucgaaa

SEQ ID NO: 2789791 - RNA, 20 nt, Leptospira interrogans serovar lai str. 56601
uauaaaaacgguauuuaaaa

SEQ ID NO: 2789792 - RNA, 14 nt, Leptospira interrogans serovar lai str. 56601
uauaaaaaguuugu

SEQ ID NO: 2789793 - RNA, 21 nt, Leptospira interrogans serovar lai str. 56601
uauaaaaaugauacuauuaau

SEQ ID NO: 2789794 - RNA, 16 nt, Leptospira interrogans serovar lai str. 56601
uauaaaaauuaaacag

SEQ ID NO: 2789795 - RNA, 16 nt, Leptospira interrogans serovar lai str. 56601
uauaaaaccuuuauuu

SEQ ID NO: 2789796 - RNA, 23 nt, Leptospira interrogans serovar lai str. 56601
uauaaaaccuuuauuuaauaaaa

SEQ ID NO: 2789797 - RNA, 22 nt, Leptospira interrogans serovar lai str. 56601
uauaaaacgaaauuauacaaaa

SEQ ID NO: 2789798 - RNA, 18 nt, Leptospira interrogans serovar lai str. 56601
uauaaaagaaacauaaua

SEQ ID NO: 2789799 - RNA, 22 nt, Leptospira interrogans serovar lai str. 56601
uauaaaaguauaauauuuauuu

SEQ ID NO: 2789800 - RNA, 14 nt, Leptospira interrogans serovar lai str. 56601
uauaaaauaaaaaa

SEQ ID NO: 2789801 - RNA, 12 nt, Leptospira interrogans serovar lai str. 56601
uauaaaauacca

SEQ ID NO: 2789802 - RNA, 12 nt, Leptospira interrogans serovar lai str. 56601
uauaaaaucaag

SEQ ID NO: 2789803 - RNA, 15 nt, Leptospira interrogans serovar lai str. 56601
uauaaaaucuaaaaa

SEQ ID NO: 2789804 - RNA, 16 nt, Leptospira interrogans serovar lai str. 56601
uauaaaaucuaaaaaa

SEQ ID NO: 2789805 - RNA, 17 nt, Leptospira interrogans serovar lai str. 56601
uauaaaaucuaaaaaga

SEQ ID NO: 2789806 - RNA, 17 nt, Leptospira interrogans serovar lai str. 56601
uauaaaaucuaaaaaua

SEQ ID NO: 2789807 - RNA, 14 nt, Leptospira interrogans serovar lai str. 56601
uauaaaauucaaaa

SEQ ID NO: 2789808 - RNA, 15 nt, Leptospira interrogans serovar lai str. 56601
uauaaaauugaauau

SEQ ID NO: 2789809 - RNA, 17 nt, Leptospira interrogans serovar lai str. 56601
uauaaaauugaauauca

SEQ ID NO: 2789810 - RNA, 17 nt, Leptospira interrogans serovar lai str. 56601
uauaaaauuugaaagua

SEQ ID NO: 2789811 - RNA, 11 nt, Leptospira interrogans serovar lai str. 56601
uauaaacaaua

SEQ ID NO: 2789812 - RNA, 14 nt, Leptospira interrogans serovar lai str. 56601
uauaaacaauauga

SEQ ID NO: 2789813 - RNA, 16 nt, Leptospira interrogans serovar lai str. 56601
uauaaacaauaugaaa

SEQ ID NO: 2789814 - RNA, 13 nt, Leptospira interrogans serovar lai str. 56601
uauaauuuaguuu

SEQ ID NO: 2789815 - RNA, 14 nt, Leptospira interrogans serovar lai str. 56601
uauaauuuccggaa

SEQ ID NO: 2789816 - RNA, 17 nt, Leptospira interrogans serovar lai str. 56601
uauaauuuuaaauaaua

SEQ ID NO: 2789817 - RNA, 12 nt, Leptospira interrogans serovar lai str. 56601
uauaauuuuaua

SEQ ID NO: 2789818 - RNA, 16 nt, Leptospira interrogans serovar lai str. 56601
uauaauuuucaugaac

SEQ ID NO: 2789819 - RNA, 21 nt, Leptospira interrogans serovar lai str. 56601
uauaauuuucuuaauaaacuu

SEQ ID NO: 2789820 - RNA, 22 nt, Leptospira interrogans serovar lai str. 56601
uauaauuuucuuaauaaacuuu

SEQ ID NO: 2789821 - RNA, 19 nt, Leptospira interrogans serovar lai str. 56601
uauacaaaguaaguucaaa

SEQ ID NO: 2789822 - RNA, 23 nt, Leptospira interrogans serovar lai str. 56601
uauacaacuuuuuuaauuuuaau

SEQ ID NO: 2789823 - RNA, 17 nt, Leptospira interrogans serovar lai str. 56601
uauacaauauuucgucu

SEQ ID NO: 2789824 - RNA, 22 nt, Leptospira interrogans serovar lai str. 56601
uauacaauucuuucuuaaauuu

SEQ ID NO: 2789825 - RNA, 13 nt, Leptospira interrogans serovar lai str. 56601
uauacaauuuaau

SEQ ID NO: 2789826 - RNA, 13 nt, Leptospira interrogans serovar lai str. 56601
uauacaguuugau

SEQ ID NO: 2789827 - RNA, 23 nt, Leptospira interrogans serovar lai str. 56601
uauaccaaguucgauuaaaauaa

SEQ ID NO: 2789828 - RNA, 15 nt, Leptospira interrogans serovar lai str. 56601
uauaccgaaacagag

SEQ ID NO: 2789829 - RNA, 15 nt, Leptospira interrogans serovar lai str. 56601
uauacggauuucuau

SEQ ID NO: 2789830 - RNA, 20 nt, Leptospira interrogans serovar lai str. 56601
uauacggauuucuauaaaau

SEQ ID NO: 2789831 - RNA, 15 nt, Leptospira interrogans serovar lai str. 56601
uauacuagaacaaua

SEQ ID NO: 2789832 - RNA, 19 nt, Leptospira interrogans serovar lai str. 56601
uauacuauaacuuuaaaaa

SEQ ID NO: 2789833 - RNA, 20 nt, Leptospira interrogans serovar lai str. 56601
uauacuauaacuuuaaaaaa

SEQ ID NO: 2789834 - RNA, 17 nt, Leptospira interrogans serovar lai str. 56601
uauacuuauaaagaauu

SEQ ID NO: 2789835 - RNA, 13 nt, Leptospira interrogans serovar lai str. 56601
uauacuuuaaaaa

SEQ ID NO: 2789836 - RNA, 14 nt, Leptospira interrogans serovar lai str. 56601
uauacuuuaaaaaa

SEQ ID NO: 2789837 - RNA, 16 nt, Leptospira interrogans serovar lai str. 56601
uauacuuucaaaaaau

SEQ ID NO: 2789838 - RNA, 20 nt, Leptospira interrogans serovar lai str. 56601
uauacuuucaaaaaauauaa

SEQ ID NO: 2789839 - RNA, 21 nt, Leptospira interrogans serovar lai str. 56601
uauagaaaccgauuuuaaucu

SEQ ID NO: 2789840 - RNA, 18 nt, Leptospira interrogans serovar lai str. 56601
uauagaauuuaaguauua

SEQ ID NO: 2789841 - RNA, 16 nt, Leptospira interrogans serovar lai str. 56601
uauagagauuuccuaa

SEQ ID NO: 2789842 - RNA, 20 nt, Leptospira interrogans serovar lai str. 56601
uauagaggucgucucaaaaa

SEQ ID NO: 2789843 - RNA, 18 nt, Leptospira interrogans serovar lai str. 56601
uauagauugauucuuuaa

SEQ ID NO: 2789844 - RNA, 21 nt, Leptospira interrogans serovar lai str. 56601
uauaggaacucauacuucuaa

SEQ ID NO: 2789845 - RNA, 17 nt, Leptospira interrogans serovar lai str. 56601
uauaggaucguauuuua

SEQ ID NO: 2789846 - RNA, 20 nt, Leptospira interrogans serovar lai str. 56601
uauaguaaagauuagaaaaa

SEQ ID NO: 2789847 - RNA, 20 nt, Leptospira interrogans serovar lai str. 56601
uauaguaacagaaaaauguu

SEQ ID NO: 2789848 - RNA, 22 nt, Leptospira interrogans serovar lai str. 56601
uauagucaaauuuggaaauugu

SEQ ID NO: 2789849 - RNA, 18 nt, Leptospira interrogans serovar lai str. 56601
uauagucuucaaaauuga

SEQ ID NO: 2789850 - RNA, 15 nt, Leptospira interrogans serovar lai str. 56601
uauaguuccuacaau

SEQ ID NO: 2789851 - RNA, 16 nt, Leptospira interrogans serovar lai str. 56601
uauaguuccuacaauu

SEQ ID NO: 2789852 - RNA, 14 nt, Leptospira interrogans serovar lai str. 56601
uauaguuuugagau

SEQ ID NO: 2789853 - RNA, 23 nt, Leptospira interrogans serovar lai str. 56601
uauaguuuugagcauaaaaaaau

SEQ ID NO: 2789854 - RNA, 13 nt, Leptospira interrogans serovar lai str. 56601
uauaguuuuuaac

SEQ ID NO: 2789855 - RNA, 11 nt, Leptospira interrogans serovar lai str. 56601
uauauaaaaaa

SEQ ID NO: 2789856 - RNA, 12 nt, Leptospira interrogans serovar lai str. 56601
uauauaaaaaau

SEQ ID NO: 2789857 - RNA, 15 nt, Leptospira interrogans serovar lai str. 56601
uauauaaagaaaaac

SEQ ID NO: 2789858 - RNA, 17 nt, Leptospira interrogans serovar lai str. 56601
uauauaaagaaaaacag

SEQ ID NO: 2789859 - RNA, 16 nt, Leptospira interrogans serovar lai str. 56601
uauauaaaucaaagca

SEQ ID NO: 2789860 - RNA, 23 nt, Leptospira interrogans serovar lai str. 56601
uauauaaauucgccguaaaaaau

SEQ ID NO: 2789861 - RNA, 19 nt, Leptospira interrogans serovar lai str. 56601
uauauaaucugauugagaa

SEQ ID NO: 2789862 - RNA, 15 nt, Leptospira interrogans serovar lai str. 56601
uauauagaacuuuuc

SEQ ID NO: 2789863 - RNA, 21 nt, Leptospira interrogans serovar lai str. 56601
uauauagauccugauuuguuu

SEQ ID NO: 2789864 - RNA, 18 nt, Leptospira interrogans serovar lai str. 56601
uauauaguuuugagcaua

SEQ ID NO: 2789865 - RNA, 23 nt, Leptospira interrogans serovar lai str. 56601
uauauaguuuugagcauaaaaaa

SEQ ID NO: 2789866 - RNA, 13 nt, Leptospira interrogans serovar lai str. 56601
uauauauaaauuc

SEQ ID NO: 2789867 - RNA, 21 nt, Leptospira interrogans serovar lai str. 56601
uauauauccuuaugaaagcaa

SEQ ID NO: 2789868 - RNA, 22 nt, Leptospira interrogans serovar lai str. 56601
uauauaucuuuggauuuuauuu

SEQ ID NO: 2789869 - RNA, 21 nt, Leptospira interrogans serovar lai str. 56601
uauauauuaaaguauuaauuu

SEQ ID NO: 2789870 - RNA, 15 nt, Leptospira interrogans serovar lai str. 56601
uauauauugaaauau

SEQ ID NO: 2789871 - RNA, 17 nt, Leptospira interrogans serovar lai str. 56601
uauauauugaaauauua

SEQ ID NO: 2789872 - RNA, 16 nt, Leptospira interrogans serovar lai str. 56601
uauauauuuuuaauuu

SEQ ID NO: 2789873 - RNA, 16 nt, Leptospira interrogans serovar lai str. 56601
uauauccuuaugaaag

SEQ ID NO: 2789874 - RNA, 14 nt, Leptospira interrogans serovar lai str. 56601
uauaucuuaauuaa

SEQ ID NO: 2789875 - RNA, 12 nt, Leptospira interrogans serovar lai str. 56601
uauaucuugaac

SEQ ID NO: 2789876 - RNA, 14 nt, Leptospira interrogans serovar lai str. 56601
uauauuaaaaugua

SEQ ID NO: 2789877 - RNA, 20 nt, Leptospira interrogans serovar lai str. 56601
uauauuagauuuauauguuu

SEQ ID NO: 2789878 - RNA, 14 nt, Leptospira interrogans serovar lai str. 56601
uauauuauaauaau

SEQ ID NO: 2789879 - RNA, 17 nt, Leptospira interrogans serovar lai str. 56601
uauauuauaauucucuu

SEQ ID NO: 2789880 - RNA, 19 nt, Leptospira interrogans serovar lai str. 56601
uauauuauaauuuuaaaua

SEQ ID NO: 2789881 - RNA, 18 nt, Leptospira interrogans serovar lai str. 56601
uauauucaaaaaauggaa

SEQ ID NO: 2789882 - RNA, 21 nt, Leptospira interrogans serovar lai str. 56601
uauauucaaaaaauggaacau

SEQ ID NO: 2789883 - RNA, 18 nt, Leptospira interrogans serovar lai str. 56601
uauauucaguauucauuu

SEQ ID NO: 2789884 - RNA, 15 nt, Leptospira interrogans serovar lai str. 56601
uauauucuuauauau

SEQ ID NO: 2789885 - RNA, 20 nt, Leptospira interrogans serovar lai str. 56601
uauauuggcgaaagagggaa

SEQ ID NO: 2789886 - RNA, 14 nt, Leptospira interrogans serovar lai str. 56601
uauauugucuugaa

SEQ ID NO: 2789887 - RNA, 13 nt, Leptospira interrogans serovar lai str. 56601
uauauuuauaaaa

SEQ ID NO: 2789888 - RNA, 16 nt, Leptospira interrogans serovar lai str. 56601
uauauuucuaaaagaa

SEQ ID NO: 2789889 - RNA, 13 nt, Leptospira interrogans serovar lai str. 56601
uauauuuuaauuu

SEQ ID NO: 2789890 - RNA, 21 nt, Leptospira interrogans serovar lai str. 56601
uauauuuucaggcauagaauc

SEQ ID NO: 2789891 - RNA, 15 nt, Leptospira interrogans serovar lai str. 56601
uauauuuucugcuua

SEQ ID NO: 2789892 - RNA, 16 nt, Leptospira interrogans serovar lai str. 56601
uauauuuugaacaagu

SEQ ID NO: 2789893 - RNA, 18 nt, Leptospira interrogans serovar lai str. 56601
uauauuuugauaaagaau

SEQ ID NO: 2789894 - RNA, 14 nt, Leptospira interrogans serovar lai str. 56601
uauauuuuuaaaaa

SEQ ID NO: 2789895 - RNA, 15 nt, Leptospira interrogans serovar lai str. 56601
uauauuuuugugaaa

SEQ ID NO: 2789896 - RNA, 13 nt, Leptospira interrogans serovar lai str. 56601
uauauuuuuugaa

SEQ ID NO: 2789897 - RNA, 13 nt, Leptospira interrogans serovar lai str. 56601
uaugaauuuccau

SEQ ID NO: 2789898 - RNA, 15 nt, Leptospira interrogans serovar lai str. 56601
uaugaauuuccauua

SEQ ID NO: 2789899 - RNA, 15 nt, Leptospira interrogans serovar lai str. 56601
uaugaauuuuuaaac

SEQ ID NO: 2789900 - RNA, 13 nt, Leptospira interrogans serovar lai str. 56601
uaugacaauuucu

SEQ ID NO: 2789901 - RNA, 20 nt, Leptospira interrogans serovar lai str. 56601
uaugagucccuacaauuuua

SEQ ID NO: 2789902 - RNA, 18 nt, Leptospira interrogans serovar lai str. 56601
uaugaguuccuacaauuu

SEQ ID NO: 2789903 - RNA, 14 nt, Leptospira interrogans serovar lai str. 56601
uaugauaaguaauu

SEQ ID NO: 2789904 - RNA, 19 nt, Leptospira interrogans serovar lai str. 56601
uaugauaaguaauuugugg

SEQ ID NO: 2789905 - RNA, 22 nt, Leptospira interrogans serovar lai str. 56601
uaugauuaugugacuuuaauuu

SEQ ID NO: 2789906 - RNA, 16 nt, Leptospira interrogans serovar lai str. 56601
uaugauucugaaaaaa

SEQ ID NO: 2789907 - RNA, 18 nt, Leptospira interrogans serovar lai str. 56601
uaugauucugaaaaaaau

SEQ ID NO: 2789908 - RNA, 15 nt, Leptospira interrogans serovar lai str. 56601
uaugcaguugugauc

SEQ ID NO: 2789909 - RNA, 22 nt, Leptospira interrogans serovar lai str. 56601
uaugcaugaauuuguuuuucuu

SEQ ID NO: 2789910 - RNA, 16 nt, Leptospira interrogans serovar lai str. 56601
uaugccccauucuuuu

SEQ ID NO: 2789911 - RNA, 13 nt, Leptospira interrogans serovar lai str. 56601
uaugcgaaauucc

SEQ ID NO: 2789912 - RNA, 15 nt, Leptospira interrogans serovar lai str. 56601
uaugcgguuuuacuu

SEQ ID NO: 2789913 - RNA, 18 nt, Leptospira interrogans serovar lai str. 56601
uaugcuauuuaauuuugu

SEQ ID NO: 2789914 - RNA, 14 nt, Leptospira interrogans serovar lai str. 56601
uauggaaauuucau

SEQ ID NO: 2789915 - RNA, 16 nt, Leptospira interrogans serovar lai str. 56601
uauggaagcuaacaca

SEQ ID NO: 2789916 - RNA, 23 nt, Leptospira interrogans serovar lai str. 56601
uauggaauuccgacccagaaaaa

SEQ ID NO: 2789917 - RNA, 13 nt, Leptospira interrogans serovar lai str. 56601
uauggacagaauc

SEQ ID NO: 2789918 - RNA, 19 nt, Leptospira interrogans serovar lai str. 56601
uauggcaaucggaaauaua

SEQ ID NO: 2789919 - RNA, 18 nt, Leptospira interrogans serovar lai str. 56601
uauggcgccccaaccaga

SEQ ID NO: 2789920 - RNA, 23 nt, Leptospira interrogans serovar lai str. 56601
uaugggugcucgaaguaacucag

SEQ ID NO: 2789921 - RNA, 17 nt, Leptospira interrogans serovar lai str. 56601
uauguaagaaaaacuag

SEQ ID NO: 2789922 - RNA, 16 nt, Leptospira interrogans serovar lai str. 56601
uauguaauauuucuuu

SEQ ID NO: 2789923 - RNA, 21 nt, Leptospira interrogans serovar lai str. 56601
uauguaauauuucuuucgauu

SEQ ID NO: 2789924 - RNA, 14 nt, Leptospira interrogans serovar lai str. 56601
uauguagaaauuug

SEQ ID NO: 2789925 - RNA, 23 nt, Leptospira interrogans serovar lai str. 56601
uauguaguuuugaguaguagaaa

SEQ ID NO: 2789926 - RNA, 19 nt, Leptospira interrogans serovar lai str. 56601
uauguauuccaugguuuuu

SEQ ID NO: 2789927 - RNA, 17 nt, Leptospira interrogans serovar lai str. 56601
uauguauuuauucaaaa

SEQ ID NO: 2789928 - RNA, 12 nt, Leptospira interrogans serovar lai str. 56601
uauguauuuuaa

SEQ ID NO: 2789929 - RNA, 14 nt, Leptospira interrogans serovar lai str. 56601
uauguauuuuaaac

SEQ ID NO: 2789930 - RNA, 17 nt, Leptospira interrogans serovar lai str. 56601
uauguccuuuuuuucuu

SEQ ID NO: 2789931 - RNA, 18 nt, Leptospira interrogans serovar lai str. 56601
uauguggaaaacuuucuu

SEQ ID NO: 2789932 - RNA, 16 nt, Leptospira interrogans serovar lai str. 56601
uaugugguaguuccca

SEQ ID NO: 2789933 - RNA, 22 nt, Leptospira interrogans serovar lai str. 56601
uauguuauauauuuuuaauuug

SEQ ID NO: 2789934 - RNA, 23 nt, Leptospira interrogans serovar lai str. 56601
uauguucguucccacaaauuaag

SEQ ID NO: 2789935 - RNA, 17 nt, Leptospira interrogans serovar lai str. 56601
uauguugaguuuugaua

SEQ ID NO: 2789936 - RNA, 17 nt, Leptospira interrogans serovar lai str. 56601
uauguuucaguauucua

SEQ ID NO: 2789937 - RNA, 21 nt, Leptospira interrogans serovar lai str. 56601
uauguuucaguauucuagaau

SEQ ID NO: 2789938 - RNA, 14 nt, Leptospira interrogans serovar lai str. 56601
uauguuucuugugu

SEQ ID NO: 2789939 - RNA, 17 nt, Leptospira interrogans serovar lai str. 56601
uauguuucuugugucaa

SEQ ID NO: 2789940 - RNA, 22 nt, Leptospira interrogans serovar lai str. 56601
uauguuucuugugucaagcccu

SEQ ID NO: 2789941 - RNA, 16 nt, Leptospira interrogans serovar lai str. 56601
uauguuuuucggaauc

SEQ ID NO: 2789942 - RNA, 20 nt, Leptospira interrogans serovar lai str. 56601
uauguuuuuggguuuuacua

SEQ ID NO: 2789943 - RNA, 14 nt, Leptospira interrogans serovar lai str. 56601
uauuaaaaaaauaa

SEQ ID NO: 2789944 - RNA, 20 nt, Leptospira interrogans serovar lai str. 56601
uauuaaaaaaauaauauauu

SEQ ID NO: 2789945 - RNA, 11 nt, Leptospira interrogans serovar lai str. 56601
uauuaaaaaua

SEQ ID NO: 2789946 - RNA, 16 nt, Leptospira interrogans serovar lai str. 56601
uauuaaaaauaucuaa

SEQ ID NO: 2789947 - RNA, 21 nt, Leptospira interrogans serovar lai str. 56601
uauuaaaaccaucuuugauau

SEQ ID NO: 2789948 - RNA, 15 nt, Leptospira interrogans serovar lai str. 56601
uauuaaaauguuuua

SEQ ID NO: 2789949 - RNA, 19 nt, Leptospira interrogans serovar lai str. 56601
uauuaaagucucaaguugu

SEQ ID NO: 2789950 - RNA, 11 nt, Leptospira interrogans serovar lai str. 56601
uauuaaauaaa

SEQ ID NO: 2789951 - RNA, 12 nt, Leptospira interrogans serovar lai str. 56601
uauuaaauaaag

SEQ ID NO: 2789952 - RNA, 19 nt, Leptospira interrogans serovar lai str. 56601
uauuaaauuaacgugaguu

SEQ ID NO: 2789953 - RNA, 19 nt, Leptospira interrogans serovar lai str. 56601
uauuaaauugaguuuucca

SEQ ID NO: 2789954 - RNA, 19 nt, Leptospira interrogans serovar lai str. 56601
uauuaaauuuuuauacuuu

SEQ ID NO: 2789955 - RNA, 20 nt, Leptospira interrogans serovar lai str. 56601
uauuaacaaauuuaaaauaa

SEQ ID NO: 2789956 - RNA, 24 nt, Leptospira interrogans serovar lai str. 56601
uauuaagaaaaauuaaaauucuag

SEQ ID NO: 2789957 - RNA, 15 nt, Leptospira interrogans serovar lai str. 56601
uauuaagaauuucua

SEQ ID NO: 2789958 - RNA, 17 nt, Leptospira interrogans serovar lai str. 56601
uauuaaguuuuuuaaau

SEQ ID NO: 2789959 - RNA, 19 nt, Leptospira interrogans serovar lai str. 56601
uauuaaguuuuuuaaauuu

SEQ ID NO: 2789960 - RNA, 21 nt, Leptospira interrogans serovar lai str. 56601
uauuaaguuuuuuaaauuuac

SEQ ID NO: 2789961 - RNA, 16 nt, Leptospira interrogans serovar lai str. 56601
uauuaauuauauucuu

SEQ ID NO: 2789962 - RNA, 12 nt, Leptospira interrogans serovar lai str. 56601
uauuaauucuua

SEQ ID NO: 2789963 - RNA, 13 nt, Leptospira interrogans serovar lai str. 56601
uauuaauuuaaaa

SEQ ID NO: 2789964 - RNA, 15 nt, Leptospira interrogans serovar lai str. 56601
uauuaauuuaaaaac

SEQ ID NO: 2789965 - RNA, 16 nt, Leptospira interrogans serovar lai str. 56601
uauuaauuuaaaaaca

SEQ ID NO: 2789966 - RNA, 17 nt, Leptospira interrogans serovar lai str. 56601
uauuaauuuaaaaacaa

SEQ ID NO: 2789967 - RNA, 17 nt, Leptospira interrogans serovar lai str. 56601
uauuaauuuaaucaaaa

SEQ ID NO: 2789968 - RNA, 18 nt, Leptospira interrogans serovar lai str. 56601
uauuaauuuaaucaaaau

SEQ ID NO: 2789969 - RNA, 22 nt, Leptospira interrogans serovar lai str. 56601
uauuaauuugaauauaauaaaa

SEQ ID NO: 2789970 - RNA, 11 nt, Leptospira interrogans serovar lai str. 56601
uauuacaaaac

SEQ ID NO: 2789971 - RNA, 12 nt, Leptospira interrogans serovar lai str. 56601
uauuacaaaacu

SEQ ID NO: 2789972 - RNA, 17 nt, Leptospira interrogans serovar lai str. 56601
uauuacaauuuuaucuu

SEQ ID NO: 2789973 - RNA, 21 nt, Leptospira interrogans serovar lai str. 56601
uauuacauucaauaauuuuaa

SEQ ID NO: 2789974 - RNA, 23 nt, Leptospira interrogans serovar lai str. 56601
uauuacgcgcuugucccagagcc

SEQ ID NO: 2789975 - RNA, 19 nt, Leptospira interrogans serovar lai str. 56601
uauuagaauaguaguuuuc

SEQ ID NO: 2789976 - RNA, 14 nt, Leptospira interrogans serovar lai str. 56601
uauuagaauauaca

SEQ ID NO: 2789977 - RNA, 17 nt, Leptospira interrogans serovar lai str. 56601
uauuagaauuguugaaa

SEQ ID NO: 2789978 - RNA, 20 nt, Leptospira interrogans serovar lai str. 56601
uauuagaguuguugaaaggg

SEQ ID NO: 2789979 - RNA, 22 nt, Leptospira interrogans serovar lai str. 56601
uauuagauuuauauguuucuuu

SEQ ID NO: 2789980 - RNA, 13 nt, Leptospira interrogans serovar lai str. 56601
uauuucaaaauuu

SEQ ID NO: 2789981 - RNA, 15 nt, Leptospira interrogans serovar lai str. 56601
uauuucaaaauuuuu

SEQ ID NO: 2789982 - RNA, 17 nt, Leptospira interrogans serovar lai str. 56601
uauuucaaaauuuuuuu

SEQ ID NO: 2789983 - RNA, 17 nt, Leptospira interrogans serovar lai str. 56601
uauuucaagaauuuuag

SEQ ID NO: 2789984 - RNA, 22 nt, Leptospira interrogans serovar lai str. 56601
uauuucaagaauuuuagaauau

SEQ ID NO: 2789985 - RNA, 19 nt, Leptospira interrogans serovar lai str. 56601
uauuucaauuccuguagua

SEQ ID NO: 2789986 - RNA, 19 nt, Leptospira interrogans serovar lai str. 56601
uauuuccaaauuguaugaa

SEQ ID NO: 2789987 - RNA, 13 nt, Leptospira interrogans serovar lai str. 56601
uauuucccaaaau

SEQ ID NO: 2789988 - RNA, 23 nt, Leptospira interrogans serovar lai str. 56601
uauuucgucuuugguuucaauuu

SEQ ID NO: 2789989 - RNA, 16 nt, Leptospira interrogans serovar lai str. 56601
uauuucuaaaauugaa

SEQ ID NO: 2789990 - RNA, 21 nt, Leptospira interrogans serovar lai str. 56601
uauuucuaaacgaucuacuuu

SEQ ID NO: 2789991 - RNA, 10 nt, Leptospira interrogans serovar lai str. 56601
uauuucuaau

SEQ ID NO: 2789992 - RNA, 14 nt, Leptospira interrogans serovar lai str. 56601
uauuucuaauaguu

SEQ ID NO: 2789993 - RNA, 17 nt, Leptospira interrogans serovar lai str. 56601
uauuucuaauaguugaa

SEQ ID NO: 2789994 - RNA, 14 nt, Leptospira interrogans serovar lai str. 56601
uauuucuauaaaau

SEQ ID NO: 2789995 - RNA, 15 nt, Leptospira interrogans serovar lai str. 56601
uauuucuauaaaauu

SEQ ID NO: 2789996 - RNA, 12 nt, Leptospira interrogans serovar lai str. 56601
uauuucugcugc

SEQ ID NO: 2789997 - RNA, 17 nt, Leptospira interrogans serovar lai str. 56601
uauuucuguuuuauaga

SEQ ID NO: 2789998 - RNA, 20 nt, Leptospira interrogans serovar lai str. 56601
uauuucuucguuauuuuuau

SEQ ID NO: 2789999 - RNA, 16 nt, Leptospira interrogans serovar lai str. 56601
uauuucuuucaaaaau

SEQ ID NO: 2790000 - RNA, 21 nt, Leptospira interrogans serovar lai str. 56601
uauuugauauaaucuuaauau

SEQ ID NO: 2790001 - RNA, 14 nt, Leptospira interrogans serovar lai str. 56601
uauuugauuagaaa

SEQ ID NO: 2790002 - RNA, 18 nt, Leptospira interrogans serovar lai str. 56601
uauuugcggaaucaauuu

SEQ ID NO: 2790003 - RNA, 23 nt, Leptospira interrogans serovar lai str. 56601
uauuugcggaaucaauuuuagaa

SEQ ID NO: 2790004 - RNA, 21 nt, Leptospira interrogans serovar lai str. 56601
uauuuggcgacugugaucaga

SEQ ID NO: 2790005 - RNA, 15 nt, Leptospira interrogans serovar lai str. 56601
uauuuguaaaaauga

SEQ ID NO: 2790006 - RNA, 13 nt, Leptospira interrogans serovar lai str. 56601
uauuuguaaaauu

SEQ ID NO: 2790007 - RNA, 12 nt, Leptospira interrogans serovar lai str. 56601
uauuuuaaaaaa

SEQ ID NO: 2790008 - RNA, 16 nt, Leptospira interrogans serovar lai str. 56601
uauuuuaaaaaaauuu

SEQ ID NO: 2790009 - RNA, 12 nt, Leptospira interrogans serovar lai str. 56601
uauuuuaaacaa

SEQ ID NO: 2790010 - RNA, 18 nt, Leptospira interrogans serovar lai str. 56601
uauuuuaaacaaaacgug

SEQ ID NO: 2790011 - RNA, 14 nt, Leptospira interrogans serovar lai str. 56601
uauuuuaacuugag

SEQ ID NO: 2790012 - RNA, 22 nt, Leptospira interrogans serovar lai str. 56601
uauuuuacgcaggcuuguuuga

SEQ ID NO: 2790013 - RNA, 14 nt, Leptospira interrogans serovar lai str. 56601
uauuuuagaaugug

SEQ ID NO: 2790014 - RNA, 22 nt, Leptospira interrogans serovar lai str. 56601
uauuuuagagaaacuuuaaaua

SEQ ID NO: 2790015 - RNA, 17 nt, Leptospira interrogans serovar lai str. 56601
uauuuuagguauuucua

SEQ ID NO: 2790016 - RNA, 16 nt, Leptospira interrogans serovar lai str. 56601
uauuuuauaaauugug

SEQ ID NO: 2790017 - RNA, 21 nt, Leptospira interrogans serovar lai str. 56601
uauuuuauaaucgaauuucca

SEQ ID NO: 2790018 - RNA, 16 nt, Leptospira interrogans serovar lai str. 56601
uauuuuauaauucuga

SEQ ID NO: 2790019 - RNA, 13 nt, Leptospira interrogans serovar lai str. 56601
uauuuuauggaaa

SEQ ID NO: 2790020 - RNA, 16 nt, Leptospira interrogans serovar lai str. 56601
uauuuuauguaaaucg

SEQ ID NO: 2790021 - RNA, 14 nt, Leptospira interrogans serovar lai str. 56601
uauuuucaaguaaa

SEQ ID NO: 2790022 - RNA, 12 nt, Leptospira interrogans serovar lai str. 56601
uauuuucagauu

SEQ ID NO: 2790023 - RNA, 15 nt, Leptospira interrogans serovar lai str. 56601
uauuuucauagaaaa

SEQ ID NO: 2790024 - RNA, 16 nt, Leptospira interrogans serovar lai str. 56601
uauuuuccaaaaauuu

SEQ ID NO: 2790025 - RNA, 21 nt, Leptospira interrogans serovar lai str. 56601
uauuuuccguaccccaaagau

SEQ ID NO: 2790026 - RNA, 16 nt, Leptospira interrogans serovar lai str. 56601
uauuuucgcacauucu

SEQ ID NO: 2790027 - RNA, 18 nt, Leptospira interrogans serovar lai str. 56601
uauuuucuaggauuuuau

SEQ ID NO: 2790028 - RNA, 15 nt, Leptospira interrogans serovar lai str. 56601
uauuuucuauuuuaa

SEQ ID NO: 2790029 - RNA, 15 nt, Leptospira interrogans serovar lai str. 56601
uauuuucuuugaaaa

SEQ ID NO: 2790030 - RNA, 12 nt, Leptospira interrogans serovar lai str. 56601
uauuuugaauaa

SEQ ID NO: 2790031 - RNA, 17 nt, Leptospira interrogans serovar lai str. 56601
uauuuugauaaagaauc

SEQ ID NO: 2790032 - RNA, 15 nt, Leptospira interrogans serovar lai str. 56601
uauuuugauuccaaa

SEQ ID NO: 2790033 - RNA, 20 nt, Leptospira interrogans serovar lai str. 56601
uauuuugauuuguuucuuua

SEQ ID NO: 2790034 - RNA, 15 nt, Leptospira interrogans serovar lai str. 56601
uauuuuguauaaagu

SEQ ID NO: 2790035 - RNA, 20 nt, Leptospira interrogans serovar lai str. 56601
uauuuugucuuuaauuucaa

SEQ ID NO: 2790036 - RNA, 15 nt, Leptospira interrogans serovar lai str. 56601
uauuuuguuuuuagu

SEQ ID NO: 2790037 - RNA, 14 nt, Leptospira interrogans serovar lai str. 56601
uauuuuuaaaugua

SEQ ID NO: 2790038 - RNA, 18 nt, Leptospira interrogans serovar lai str. 56601
uauuuuuacaaaaaaauc

SEQ ID NO: 2790039 - RNA, 19 nt, Leptospira interrogans serovar lai str. 56601
uauuuuuacagaaaaauca

SEQ ID NO: 2790040 - RNA, 19 nt, Leptospira interrogans serovar lai str. 56601
uauuuuuacggaucaaaau

SEQ ID NO: 2790041 - RNA, 20 nt, Leptospira interrogans serovar lai str. 56601
uauuuuuaucgcaaaacauu

SEQ ID NO: 2790042 - RNA, 21 nt, Leptospira interrogans serovar lai str. 56601
uauuuuuauggaucaaaacca

SEQ ID NO: 2790043 - RNA, 12 nt, Leptospira interrogans serovar lai str. 56601
uauuuuuccagc

SEQ ID NO: 2790044 - RNA, 22 nt, Leptospira interrogans serovar lai str. 56601
uauuuuugugaaacucaaugca

SEQ ID NO: 2790045 - RNA, 12 nt, Leptospira interrogans serovar lai str. 56601
uauuuuuuaaaa

SEQ ID NO: 2790046 - RNA, 13 nt, Leptospira interrogans serovar lai str. 56601
uauuuuuuaaaaa

SEQ ID NO: 2790047 - RNA, 15 nt, Leptospira interrogans serovar lai str. 56601
uauuuuuuaaaaauc

SEQ ID NO: 2790048 - RNA, 15 nt, Leptospira interrogans serovar lai str. 56601
uauuuuuuaauauuc

SEQ ID NO: 2790049 - RNA, 17 nt, Leptospira interrogans serovar lai str. 56601
uauuuuuuaauauucaa

SEQ ID NO: 2790050 - RNA, 15 nt, Leptospira interrogans serovar lai str. 56601
uauuuuuuaugaaaa

SEQ ID NO: 2790051 - RNA, 19 nt, Leptospira interrogans serovar lai str. 56601
uauuuuuuaugaaaaacuc

SEQ ID NO: 2790052 - RNA, 22 nt, Leptospira interrogans serovar lai str. 56601
uauuuuuuccaaaaagaaaaac

SEQ ID NO: 2790053 - RNA, 19 nt, Leptospira interrogans serovar lai str. 56601
uauuuuuuuauuuuauuca

SEQ ID NO: 2790054 - RNA, 13 nt, Leptospira interrogans serovar lai str. 56601
uauuuuuuuuaau

SEQ ID NO: 2790055 - RNA, 14 nt, Leptospira interrogans serovar lai str. 56601
uauuuuuuuuacau

SEQ ID NO: 2790056 - RNA, 13 nt, Leptospira interrogans serovar lai str. 56601
uauuuuuuuugag

SEQ ID NO: 2790057 - RNA, 15 nt, Leptospira interrogans serovar lai str. 56601
ucaaaaaaauuaaac

SEQ ID NO: 2790058 - RNA, 22 nt, Leptospira interrogans serovar lai str. 56601
ucaaaaaauauaggaacucuua

SEQ ID NO: 2790059 - RNA, 13 nt, Leptospira interrogans serovar lai str. 56601
ucaaaaaauugca

SEQ ID NO: 2790060 - RNA, 13 nt, Leptospira interrogans serovar lai str. 56601
ucaaaaaauuuac

SEQ ID NO: 2790061 - RNA, 17 nt, Leptospira interrogans serovar lai str. 56601
ucaaaaacaaauuaagu

SEQ ID NO: 2790062 - RNA, 15 nt, Leptospira interrogans serovar lai str. 56601
ucaaaaacuaaaaua

SEQ ID NO: 2790063 - RNA, 18 nt, Leptospira interrogans serovar lai str. 56601
ucaaaaacuaaaauacaa

SEQ ID NO: 2790064 - RNA, 20 nt, Leptospira interrogans serovar lai str. 56601
ucaaauaacauuuuuucaua

SEQ ID NO: 2790065 - RNA, 13 nt, Leptospira interrogans serovar lai str. 56601
ucaaauaacuuua

SEQ ID NO: 2790066 - RNA, 22 nt, Leptospira interrogans serovar lai str. 56601
ucaaauaagcgcggauuuauuu

SEQ ID NO: 2790067 - RNA, 23 nt, Leptospira interrogans serovar lai str. 56601
ucaaauaagcgcggauuuauuuu

SEQ ID NO: 2790068 - RNA, 15 nt, Leptospira interrogans serovar lai str. 56601
ucaaauauacaaagu

SEQ ID NO: 2790069 - RNA, 19 nt, Leptospira interrogans serovar lai str. 56601
ucaaaucuacaaaacuuua

SEQ ID NO: 2790070 - RNA, 12 nt, Leptospira interrogans serovar lai str. 56601
ucaaaucugaaa

SEQ ID NO: 2790071 - RNA, 22 nt, Leptospira interrogans serovar lai str. 56601
ucaaaucuucgguuuaauauac

SEQ ID NO: 2790072 - RNA, 18 nt, Leptospira interrogans serovar lai str. 56601
ucaaaugcgacuuaauuu

SEQ ID NO: 2790073 - RNA, 19 nt, Leptospira interrogans serovar lai str. 56601
ucaaaugugagaguuccca

SEQ ID NO: 2790074 - RNA, 20 nt, Leptospira interrogans serovar lai str. 56601
ucaaauucaucaauuuugga

SEQ ID NO: 2790075 - RNA, 23 nt, Leptospira interrogans serovar lai str. 56601
ucaaauucuacaccuucuaaauc

SEQ ID NO: 2790076 - RNA, 13 nt, Leptospira interrogans serovar lai str. 56601
ucaaauucuucag

SEQ ID NO: 2790077 - RNA, 22 nt, Leptospira interrogans serovar lai str. 56601
ucaaauuuacucuuauaaaauu

SEQ ID NO: 2790078 - RNA, 19 nt, Leptospira interrogans serovar lai str. 56601
ucaaauuuauaugauuuua

SEQ ID NO: 2790079 - RNA, 14 nt, Leptospira interrogans serovar lai str. 56601
ucaaauuucugcau

SEQ ID NO: 2790080 - RNA, 17 nt, Leptospira interrogans serovar lai str. 56601
ucaaauuucugcaugaa

SEQ ID NO: 2790081 - RNA, 14 nt, Leptospira interrogans serovar lai str. 56601
ucaaauuuggaaau

SEQ ID NO: 2790082 - RNA, 22 nt, Leptospira interrogans serovar lai str. 56601
ucaaauuuuauguuauauauuu

SEQ ID NO: 2790083 - RNA, 19 nt, Leptospira interrogans serovar lai str. 56601
ucaacaaaauuacuucaau

SEQ ID NO: 2790084 - RNA, 20 nt, Leptospira interrogans serovar lai str. 56601
ucaacaaacaaauagaaaua

SEQ ID NO: 2790085 - RNA, 21 nt, Leptospira interrogans serovar lai str. 56601
ucaacaaacaaauagaaauaa

SEQ ID NO: 2790086 - RNA, 14 nt, Leptospira interrogans serovar lai str. 56601
ucaacaaauauucc

SEQ ID NO: 2790087 - RNA, 12 nt, Leptospira interrogans serovar lai str. 56601
ucaacaacucua

SEQ ID NO: 2790088 - RNA, 13 nt, Leptospira interrogans serovar lai str. 56601
ucaacaacucuaa

SEQ ID NO: 2790089 - RNA, 19 nt, Leptospira interrogans serovar lai str. 56601
ucaacaacucuaauauaaa

SEQ ID NO: 2790090 - RNA, 19 nt, Leptospira interrogans serovar lai str. 56601
ucaacaacucuaaugaauu

SEQ ID NO: 2790091 - RNA, 16 nt, Leptospira interrogans serovar lai str. 56601
ucaacaacucuauuuu

SEQ ID NO: 2790092 - RNA, 17 nt, Leptospira interrogans serovar lai str. 56601
ucaacaacucuauuuua

SEQ ID NO: 2790093 - RNA, 18 nt, Leptospira interrogans serovar lai str. 56601
ucaacaacucuauuuuau

SEQ ID NO: 2790094 - RNA, 19 nt, Leptospira interrogans serovar lai str. 56601
ucaacaacucuauuuuauu

SEQ ID NO: 2790095 - RNA, 16 nt, Leptospira interrogans serovar lai str. 56601
ucaacaagaaugaaaa

SEQ ID NO: 2790096 - RNA, 18 nt, Leptospira interrogans serovar lai str. 56601
ucaacaaguuuacacauu

SEQ ID NO: 2790097 - RNA, 19 nt, Leptospira interrogans serovar lai str. 56601
ucaacaaguuuacacauuu

SEQ ID NO: 2790098 - RNA, 21 nt, Leptospira interrogans serovar lai str. 56601
ucaacaaguuuacacauuuau

SEQ ID NO: 2790099 - RNA, 14 nt, Leptospira interrogans serovar lai str. 56601
ucaacaauucuauu

SEQ ID NO: 2790100 - RNA, 22 nt, Leptospira interrogans serovar lai str. 56601
ucaacaauucuauugugggaac

SEQ ID NO: 2790101 - RNA, 19 nt, Leptospira interrogans serovar lai str. 56601
ucaacacaacgcucucuac

SEQ ID NO: 2790102 - RNA, 21 nt, Leptospira interrogans serovar lai str. 56601
ucaacagaacgggcuuucuau

SEQ ID NO: 2790103 - RNA, 18 nt, Leptospira interrogans serovar lai str. 56601
ucaacaggggcuuugauu

SEQ ID NO: 2790104 - RNA, 17 nt, Leptospira interrogans serovar lai str. 56601
ucaacagugauuucaug

SEQ ID NO: 2790105 - RNA, 22 nt, Leptospira interrogans serovar lai str. 56601
ucaacagugauuucaugcaaaa

SEQ ID NO: 2790106 - RNA, 12 nt, Leptospira interrogans serovar lai str. 56601
ucaacauaaaaa

SEQ ID NO: 2790107 - RNA, 14 nt, Leptospira interrogans serovar lai str. 56601
ucaacauaaaaaca

SEQ ID NO: 2790108 - RNA, 21 nt, Leptospira interrogans serovar lai str. 56601
ucaaccgcaaauuuuuucguu

SEQ ID NO: 2790109 - RNA, 14 nt, Leptospira interrogans serovar lai str. 56601
ucaacgauaagaau

SEQ ID NO: 2790110 - RNA, 16 nt, Leptospira interrogans serovar lai str. 56601
ucaacgauaagaauau

SEQ ID NO: 2790111 - RNA, 17 nt, Leptospira interrogans serovar lai str. 56601
ucaacggguucuucauu

SEQ ID NO: 2790112 - RNA, 22 nt, Leptospira interrogans serovar lai str. 56601
ucaacguucaaacaacaaaaaa

SEQ ID NO: 2790113 - RNA, 22 nt, Leptospira interrogans serovar lai str. 56601
ucaacuaaauccuucuuuucuu

SEQ ID NO: 2790114 - RNA, 22 nt, Leptospira interrogans serovar lai str. 56601
ucaacuacuaaucucuauaaaa

SEQ ID NO: 2790115 - RNA, 13 nt, Leptospira interrogans serovar lai str. 56601
ucaacuuguaaaa

SEQ ID NO: 2790116 - RNA, 15 nt, Leptospira interrogans serovar lai str. 56601
ucaacuuguaaaaca

SEQ ID NO: 2790117 - RNA, 17 nt, Leptospira interrogans serovar lai str. 56601
ucaacuuguaaaacagc

SEQ ID NO: 2790118 - RNA, 13 nt, Leptospira interrogans serovar lai str. 56601
ucaacuuuagaaa

SEQ ID NO: 2790119 - RNA, 16 nt, Leptospira interrogans serovar lai str. 56601
ucaacuuuagaaaaau

SEQ ID NO: 2790120 - RNA, 14 nt, Leptospira interrogans serovar lai str. 56601
ucaacuuuccuuuu

SEQ ID NO: 2790121 - RNA, 12 nt, Leptospira interrogans serovar lai str. 56601
ucaacuuuucca

SEQ ID NO: 2790122 - RNA, 18 nt, Leptospira interrogans serovar lai str. 56601
ucaacuuuuugaagaaac

SEQ ID NO: 2790123 - RNA, 22 nt, Leptospira interrogans serovar lai str. 56601
ucaacuuuuugaagaaacaauu

SEQ ID NO: 2790124 - RNA, 17 nt, Leptospira interrogans serovar lai str. 56601
ucaacuuuuuucagaaa

SEQ ID NO: 2790125 - RNA, 19 nt, Leptospira interrogans serovar lai str. 56601
ucaacuuuuuucagaaaaa

SEQ ID NO: 2790126 - RNA, 20 nt, Leptospira interrogans serovar lai str. 56601
ucaacuuuuuucagaaaaag

SEQ ID NO: 2790127 - RNA, 21 nt, Leptospira interrogans serovar lai str. 56601
ucaacuuuuuucagaaaaagu

SEQ ID NO: 2790128 - RNA, 24 nt, Leptospira interrogans serovar lai str. 56601
ucaagaagagucaaacacucuaaa

SEQ ID NO: 2790129 - RNA, 20 nt, Leptospira interrogans serovar lai str. 56601
ucaagaauuuuagaauauaa

SEQ ID NO: 2790130 - RNA, 22 nt, Leptospira interrogans serovar lai str. 56601
ucaagaauuuuagaauauaaua

SEQ ID NO: 2790131 - RNA, 20 nt, Leptospira interrogans serovar lai str. 56601
ucaagacaacagaacaaaau

SEQ ID NO: 2790132 - RNA, 19 nt, Leptospira interrogans serovar lai str. 56601
ucaagacuuuauagucaaa

SEQ ID NO: 2790133 - RNA, 16 nt, Leptospira interrogans serovar lai str. 56601
ucaagaucacaauuuu

SEQ ID NO: 2790134 - RNA, 20 nt, Leptospira interrogans serovar lai str. 56601
ucaagaugggacuuuuuucg

SEQ ID NO: 2790135 - RNA, 17 nt, Leptospira interrogans serovar lai str. 56601
ucaagauugucuuuauu

SEQ ID NO: 2790136 - RNA, 21 nt, Leptospira interrogans serovar lai str. 56601
ucaagauuuaauuuagaaauu

SEQ ID NO: 2790137 - RNA, 20 nt, Leptospira interrogans serovar lai str. 56601
ucaagauuuuacgaacaaau

SEQ ID NO: 2790138 - RNA, 20 nt, Leptospira interrogans serovar lai str. 56601
ucaagcccucccguuauuuu

SEQ ID NO: 2790139 - RNA, 16 nt, Leptospira interrogans serovar lai str. 56601
ucaaguaaaacguaga

SEQ ID NO: 2790140 - RNA, 21 nt, Leptospira interrogans serovar lai str. 56601
ucaaguaacgaguagaauucu

SEQ ID NO: 2790141 - RNA, 19 nt, Leptospira interrogans serovar lai str. 56601
ucaagugauucauucuaag

SEQ ID NO: 2790142 - RNA, 18 nt, Leptospira interrogans serovar lai str. 56601
ucaaguuaauacaguauu

SEQ ID NO: 2790143 - RNA, 21 nt, Leptospira interrogans serovar lai str. 56601
ucaaguuugugagaguuccca

SEQ ID NO: 2790144 - RNA, 14 nt, Leptospira interrogans serovar lai str. 56601
ucaauaaaacguuu

SEQ ID NO: 2790145 - RNA, 13 nt, Leptospira interrogans serovar lai str. 56601
ucaauaaaauacc

SEQ ID NO: 2790146 - RNA, 21 nt, Leptospira interrogans serovar lai str. 56601
ucaccaacaacaccaccaaca

SEQ ID NO: 2790147 - RNA, 14 nt, Leptospira interrogans serovar lai str. 56601
ucaccaaccccaca

SEQ ID NO: 2790148 - RNA, 22 nt, Leptospira interrogans serovar lai str. 56601
ucaccaaccccacaaguuaaua

SEQ ID NO: 2790149 - RNA, 19 nt, Leptospira interrogans serovar lai str. 56601
ucaccagaauuuagauaac

SEQ ID NO: 2790150 - RNA, 18 nt, Leptospira interrogans serovar lai str. 56601
ucacccaccaaaaauagg

SEQ ID NO: 2790151 - RNA, 22 nt, Leptospira interrogans serovar lai str. 56601
ucaccgcacaaaugauagaaac

SEQ ID NO: 2790152 - RNA, 19 nt, Leptospira interrogans serovar lai str. 56601
ucaccguuuauucuccauu

SEQ ID NO: 2790153 - RNA, 15 nt, Leptospira interrogans serovar lai str. 56601
ucaccucuauaaaau

SEQ ID NO: 2790154 - RNA, 16 nt, Leptospira interrogans serovar lai str. 56601
ucaccucuauaaaauc

SEQ ID NO: 2790155 - RNA, 16 nt, Leptospira interrogans serovar lai str. 56601
ucaccuuccaaagauu

SEQ ID NO: 2790156 - RNA, 17 nt, Leptospira interrogans serovar lai str. 56601
ucacgaaaauuaaaaaa

SEQ ID NO: 2790157 - RNA, 18 nt, Leptospira interrogans serovar lai str. 56601
ucacgaaaauuaaaaaau

SEQ ID NO: 2790158 - RNA, 17 nt, Leptospira interrogans serovar lai str. 56601
ucacgaacacaaauucu

SEQ ID NO: 2790159 - RNA, 23 nt, Leptospira interrogans serovar lai str. 56601
ucacgauuuuacaaacaaauucu

SEQ ID NO: 2790160 - RNA, 17 nt, Leptospira interrogans serovar lai str. 56601
ucacgauuuuacgaaca

SEQ ID NO: 2790161 - RNA, 20 nt, Leptospira interrogans serovar lai str. 56601
ucacgauuuuacgaacaaau

SEQ ID NO: 2790162 - RNA, 13 nt, Leptospira interrogans serovar lai str. 56601
ucacgcuaaaaua

SEQ ID NO: 2790163 - RNA, 16 nt, Leptospira interrogans serovar lai str. 56601
ucacguuaaaaguaau

SEQ ID NO: 2790164 - RNA, 17 nt, Leptospira interrogans serovar lai str. 56601
ucacguucaacaaacaa

SEQ ID NO: 2790165 - RNA, 21 nt, Leptospira interrogans serovar lai str. 56601
ucacguugaaguagucauaua

SEQ ID NO: 2790166 - RNA, 22 nt, Leptospira interrogans serovar lai str. 56601
ucacuaaggcccacaucgaaaa

SEQ ID NO: 2790167 - RNA, 18 nt, Leptospira interrogans serovar lai str. 56601
ucacuaccuuauaaaaau

SEQ ID NO: 2790168 - RNA, 13 nt, Leptospira interrogans serovar lai str. 56601
ucacuauuuuuau

SEQ ID NO: 2790169 - RNA, 21 nt, Leptospira interrogans serovar lai str. 56601
ucacucaaaauacuuuuaauu

SEQ ID NO: 2790170 - RNA, 16 nt, Leptospira interrogans serovar lai str. 56601
ucacucauuuuuagau

SEQ ID NO: 2790171 - RNA, 13 nt, Leptospira interrogans serovar lai str. 56601
ucacugaaaauuu

SEQ ID NO: 2790172 - RNA, 15 nt, Leptospira interrogans serovar lai str. 56601
ucacugaaaauuuaa

SEQ ID NO: 2790173 - RNA, 18 nt, Leptospira interrogans serovar lai str. 56601
ucacuuccauuuuuugau

SEQ ID NO: 2790174 - RNA, 13 nt, Leptospira interrogans serovar lai str. 56601
ucacuucuugaaa

SEQ ID NO: 2790175 - RNA, 15 nt, Leptospira interrogans serovar lai str. 56601
ucacuuuacaaauuu

SEQ ID NO: 2790176 - RNA, 17 nt, Leptospira interrogans serovar lai str. 56601
ucagaaaaaaaaagaau

SEQ ID NO: 2790177 - RNA, 21 nt, Leptospira interrogans serovar lai str. 56601
ucagaaaaaaaaagaauuucu

SEQ ID NO: 2790178 - RNA, 17 nt, Leptospira interrogans serovar lai str. 56601
ucagaaaaacaaaaaac

SEQ ID NO: 2790179 - RNA, 17 nt, Leptospira interrogans serovar lai str. 56601
ucagaaaaacauacuuu

SEQ ID NO: 2790180 - RNA, 15 nt, Leptospira interrogans serovar lai str. 56601
ucagaaaaaugaauu

SEQ ID NO: 2790181 - RNA, 13 nt, Leptospira interrogans serovar lai str. 56601
ucagaaaacucag

SEQ ID NO: 2790182 - RNA, 23 nt, Leptospira interrogans serovar lai str. 56601
ucagaaacguucguauugaauau

SEQ ID NO: 2790183 - RNA, 16 nt, Leptospira interrogans serovar lai str. 56601
ucagaagucuuucuac

SEQ ID NO: 2790184 - RNA, 17 nt, Leptospira interrogans serovar lai str. 56601
ucagaagucuuucuaca

SEQ ID NO: 2790185 - RNA, 15 nt, Leptospira interrogans serovar lai str. 56601
ucagaaucaaaggaa

SEQ ID NO: 2790186 - RNA, 17 nt, Leptospira interrogans serovar lai str. 56601
ucagaaucaaaggaaau

SEQ ID NO: 2790187 - RNA, 18 nt, Leptospira interrogans serovar lai str. 56601
ucagaaucaaaggaaaua

SEQ ID NO: 2790188 - RNA, 20 nt, Leptospira interrogans serovar lai str. 56601
ucagaaucauggguucuuua

SEQ ID NO: 2790189 - RNA, 22 nt, Leptospira interrogans serovar lai str. 56601
ucagaaucauuggaguuuuuua

SEQ ID NO: 2790190 - RNA, 15 nt, Leptospira interrogans serovar lai str. 56601
ucagaauuaaaaauu

SEQ ID NO: 2790191 - RNA, 14 nt, Leptospira interrogans serovar lai str. 56601
ucagacugauauuc

SEQ ID NO: 2790192 - RNA, 18 nt, Leptospira interrogans serovar lai str. 56601
ucagacuuugaaugcaac

SEQ ID NO: 2790193 - RNA, 16 nt, Leptospira interrogans serovar lai str. 56601
ucagagucuauuuaau

SEQ ID NO: 2790194 - RNA, 18 nt, Leptospira interrogans serovar lai str. 56601
ucagagugguuucuuaug

SEQ ID NO: 2790195 - RNA, 22 nt, Leptospira interrogans serovar lai str. 56601
ucagauauuuucgccgaaacau

SEQ ID NO: 2790196 - RNA, 13 nt, Leptospira interrogans serovar lai str. 56601
ucagaugaaaguu

SEQ ID NO: 2790197 - RNA, 17 nt, Leptospira interrogans serovar lai str. 56601
ucagaugaauugaauuu

SEQ ID NO: 2790198 - RNA, 23 nt, Leptospira interrogans serovar lai str. 56601
ucagaugaauugaauuuuuuaaa

SEQ ID NO: 2790199 - RNA, 19 nt, Leptospira interrogans serovar lai str. 56601
ucagauguuuuaaaaguuu

SEQ ID NO: 2790200 - RNA, 14 nt, Leptospira interrogans serovar lai str. 56601
ucagauuaaaaccg

SEQ ID NO: 2790201 - RNA, 13 nt, Leptospira interrogans serovar lai str. 56601
ucagauuccaacu

SEQ ID NO: 2790202 - RNA, 19 nt, Leptospira interrogans serovar lai str. 56601
ucagauuccguuuuuauuu

SEQ ID NO: 2790203 - RNA, 17 nt, Leptospira interrogans serovar lai str. 56601
ucagauugauacugcau

SEQ ID NO: 2790204 - RNA, 20 nt, Leptospira interrogans serovar lai str. 56601
ucagauuucagcuccaaaaa

SEQ ID NO: 2790205 - RNA, 21 nt, Leptospira interrogans serovar lai str. 56601
ucagauuuuauuuugauucca

SEQ ID NO: 2790206 - RNA, 13 nt, Leptospira interrogans serovar lai str. 56601
ucagauuuuuucu

SEQ ID NO: 2790207 - RNA, 14 nt, Leptospira interrogans serovar lai str. 56601
ucagcauaaguauu

SEQ ID NO: 2790208 - RNA, 22 nt, Leptospira interrogans serovar lai str. 56601
ucagcguaagguguuuauaaaa

SEQ ID NO: 2790209 - RNA, 23 nt, Leptospira interrogans serovar lai str. 56601
ucagcguaagguguuuauaaaaa

SEQ ID NO: 2790210 - RNA, 19 nt, Leptospira interrogans serovar lai str. 56601
ucagcuacaaucaauaaau

SEQ ID NO: 2790211 - RNA, 20 nt, Leptospira interrogans serovar lai str. 56601
ucagcuacaaucaauaaauu

SEQ ID NO: 2790212 - RNA, 15 nt, Leptospira interrogans serovar lai str. 56601
ucagcuauaaaauag

SEQ ID NO: 2790213 - RNA, 23 nt, Leptospira interrogans serovar lai str. 56601
ucagcuccaaaaaaauaaaucau

SEQ ID NO: 2790214 - RNA, 19 nt, Leptospira interrogans serovar lai str. 56601
ucagcucuggucaaguuau

SEQ ID NO: 2790215 - RNA, 20 nt, Leptospira interrogans serovar lai str. 56601
ucagcucuggucaauaaauu

SEQ ID NO: 2790216 - RNA, 20 nt, Leptospira interrogans serovar lai str. 56601
ucagcucugguuaauaaauu

SEQ ID NO: 2790217 - RNA, 15 nt, Leptospira interrogans serovar lai str. 56601
ucagcugaacucacg

SEQ ID NO: 2790218 - RNA, 19 nt, Leptospira interrogans serovar lai str. 56601
ucagcuucagucaaguuau

SEQ ID NO: 2790219 - RNA, 20 nt, Leptospira interrogans serovar lai str. 56601
ucagcuucagucaaguuauu

SEQ ID NO: 2790220 - RNA, 14 nt, Leptospira interrogans serovar lai str. 56601
ucaggauaaccuaa

SEQ ID NO: 2790221 - RNA, 13 nt, Leptospira interrogans serovar lai str. 56601
ucaggauuacuaa

SEQ ID NO: 2790222 - RNA, 17 nt, Leptospira interrogans serovar lai str. 56601
ucaggauuacuaaugca

SEQ ID NO: 2790223 - RNA, 14 nt, Leptospira interrogans serovar lai str. 56601
ucagggaaaaauaa

SEQ ID NO: 2790224 - RNA, 17 nt, Leptospira interrogans serovar lai str. 56601
ucagggcucaaagucau

SEQ ID NO: 2790225 - RNA, 14 nt, Leptospira interrogans serovar lai str. 56601
ucaggucacauuuu

SEQ ID NO: 2790226 - RNA, 15 nt, Leptospira interrogans serovar lai str. 56601
ucaggucacauuuua

SEQ ID NO: 2790227 - RNA, 19 nt, Leptospira interrogans serovar lai str. 56601
ucagguuuuaucaaauaaa

SEQ ID NO: 2790228 - RNA, 22 nt, Leptospira interrogans serovar lai str. 56601
ucaguaaauuauggacuauuuu

SEQ ID NO: 2790229 - RNA, 19 nt, Leptospira interrogans serovar lai str. 56601
ucauuagaauuguugaaaa

SEQ ID NO: 2790230 - RNA, 21 nt, Leptospira interrogans serovar lai str. 56601
ucauuagaauuguugaaaaau

SEQ ID NO: 2790231 - RNA, 13 nt, Leptospira interrogans serovar lai str. 56601
ucauuagaguuau

SEQ ID NO: 2790232 - RNA, 19 nt, Leptospira interrogans serovar lai str. 56601
ucauuagaguuauugaaaa

SEQ ID NO: 2790233 - RNA, 22 nt, Leptospira interrogans serovar lai str. 56601
ucauuagaguuauugaaaaauu

SEQ ID NO: 2790234 - RNA, 23 nt, Leptospira interrogans serovar lai str. 56601
ucauuagaguuauugaaaaauuu

SEQ ID NO: 2790235 - RNA, 22 nt, Leptospira interrogans serovar lai str. 56601
ucauuauuagaguuguugaaaa

SEQ ID NO: 2790236 - RNA, 12 nt, Leptospira interrogans serovar lai str. 56601
ucauucaggauu

SEQ ID NO: 2790237 - RNA, 22 nt, Leptospira interrogans serovar lai str. 56601
ucauucccuuaaucauuuuuug

SEQ ID NO: 2790238 - RNA, 21 nt, Leptospira interrogans serovar lai str. 56601
ucauucggagacuugauuuga

SEQ ID NO: 2790239 - RNA, 20 nt, Leptospira interrogans serovar lai str. 56601
ucauucuauuuggauuuuau

SEQ ID NO: 2790240 - RNA, 14 nt, Leptospira interrogans serovar lai str. 56601
ucauucugaaaaaa

SEQ ID NO: 2790241 - RNA, 19 nt, Leptospira interrogans serovar lai str. 56601
ucauucugauucuaaaauc

SEQ ID NO: 2790242 - RNA, 13 nt, Leptospira interrogans serovar lai str. 56601
ucauucuuuaaaa

SEQ ID NO: 2790243 - RNA, 15 nt, Leptospira interrogans serovar lai str. 56601
ucauucuuuaaaaua

SEQ ID NO: 2790244 - RNA, 17 nt, Leptospira interrogans serovar lai str. 56601
ucauucuuuaaaauaga

SEQ ID NO: 2790245 - RNA, 13 nt, Leptospira interrogans serovar lai str. 56601
ucauucuuuagaa

SEQ ID NO: 2790246 - RNA, 16 nt, Leptospira interrogans serovar lai str. 56601
ucauucuuuugugacu

SEQ ID NO: 2790247 - RNA, 17 nt, Leptospira interrogans serovar lai str. 56601
ucauugaguuuuuuagu

SEQ ID NO: 2790248 - RNA, 18 nt, Leptospira interrogans serovar lai str. 56601
ucauuggaguuuuuuaaa

SEQ ID NO: 2790249 - RNA, 23 nt, Leptospira interrogans serovar lai str. 56601
ucauugugaauguauauuuuuuu

SEQ ID NO: 2790250 - RNA, 15 nt, Leptospira interrogans serovar lai str. 56601
ucauuuaaaaauuga

SEQ ID NO: 2790251 - RNA, 20 nt, Leptospira interrogans serovar lai str. 56601
ucauuuaaagcaaauaccaa

SEQ ID NO: 2790252 - RNA, 16 nt, Leptospira interrogans serovar lai str. 56601
ucauuuaccuaaaauu

SEQ ID NO: 2790253 - RNA, 19 nt, Leptospira interrogans serovar lai str. 56601
ucauuuaccuaaaauucag

SEQ ID NO: 2790254 - RNA, 12 nt, Leptospira interrogans serovar lai str. 56601
ucauuuacucaa

SEQ ID NO: 2790255 - RNA, 16 nt, Leptospira interrogans serovar lai str. 56601
ucauuuacucaaauua

SEQ ID NO: 2790256 - RNA, 14 nt, Leptospira interrogans serovar lai str. 56601
ucauuuccuccaaa

SEQ ID NO: 2790257 - RNA, 15 nt, Leptospira interrogans serovar lai str. 56601
ucauuucgaaaacga

SEQ ID NO: 2790258 - RNA, 23 nt, Leptospira interrogans serovar lai str. 56601
ucauuucguuucccauauaauuu

SEQ ID NO: 2790259 - RNA, 23 nt, Leptospira interrogans serovar lai str. 56601
ucauuucuaugauauggaauucc

SEQ ID NO: 2790260 - RNA, 13 nt, Leptospira interrogans serovar lai str. 56601
ucauuugaauuua

SEQ ID NO: 2790261 - RNA, 15 nt, Leptospira interrogans serovar lai str. 56601
ucauuuuaaacgaac

SEQ ID NO: 2790262 - RNA, 15 nt, Leptospira interrogans serovar lai str. 56601
ucauuuuacagaaua

SEQ ID NO: 2790263 - RNA, 20 nt, Leptospira interrogans serovar lai str. 56601
ucauuuuacagaauauuaaa

SEQ ID NO: 2790264 - RNA, 21 nt, Leptospira interrogans serovar lai str. 56601
ucauuuuacagaauauuaaau

SEQ ID NO: 2790265 - RNA, 23 nt, Leptospira interrogans serovar lai str. 56601
ucauuuuacagaauauuaaauuu

SEQ ID NO: 2790266 - RNA, 14 nt, Leptospira interrogans serovar lai str. 56601
ucauuuuauuuuua

SEQ ID NO: 2790267 - RNA, 13 nt, Leptospira interrogans serovar lai str. 56601
ucauuuugauaau

SEQ ID NO: 2790268 - RNA, 14 nt, Leptospira interrogans serovar lai str. 56601
ucauuuugauaauu

SEQ ID NO: 2790269 - RNA, 20 nt, Leptospira interrogans serovar lai str. 56601
ucauuuuguaaguccaauga

SEQ ID NO: 2790270 - RNA, 13 nt, Leptospira interrogans serovar lai str. 56601
ucauuuuucuaaa

SEQ ID NO: 2790271 - RNA, 15 nt, Leptospira interrogans serovar lai str. 56601
ucauuuuucuaaaaa

SEQ ID NO: 2790272 - RNA, 14 nt, Leptospira interrogans serovar lai str. 56601
ucauuuuucuacaa

SEQ ID NO: 2790273 - RNA, 15 nt, Leptospira interrogans serovar lai str. 56601
ucauuuuucugaaaa

SEQ ID NO: 2790274 - RNA, 14 nt, Leptospira interrogans serovar lai str. 56601
ucauuuuucuuaaa

SEQ ID NO: 2790275 - RNA, 15 nt, Leptospira interrogans serovar lai str. 56601
ucauuuuuucuaaau

SEQ ID NO: 2790276 - RNA, 21 nt, Leptospira interrogans serovar lai str. 56601
ucauuuuuuucgaauugaguu

SEQ ID NO: 2790277 - RNA, 20 nt, Leptospira interrogans serovar lai str. 56601
uccaaaaaaagucucaaaac

SEQ ID NO: 2790278 - RNA, 12 nt, Leptospira interrogans serovar lai str. 56601
uccaaaaacgua

SEQ ID NO: 2790279 - RNA, 14 nt, Leptospira interrogans serovar lai str. 56601
uccaaaaagaaaaa

SEQ ID NO: 2790280 - RNA, 16 nt, Leptospira interrogans serovar lai str. 56601
uccaaaaauuuaaaaa

SEQ ID NO: 2790281 - RNA, 19 nt, Leptospira interrogans serovar lai str. 56601
uccaaaacaaucuuagaau

SEQ ID NO: 2790282 - RNA, 11 nt, Leptospira interrogans serovar lai str. 56601
uccaaaaccuc

SEQ ID NO: 2790283 - RNA, 19 nt, Leptospira interrogans serovar lai str. 56601
uccaaaaccucaaaaaauu

SEQ ID NO: 2790284 - RNA, 12 nt, Leptospira interrogans serovar lai str. 56601
uccaaaacucua

SEQ ID NO: 2790285 - RNA, 23 nt, Leptospira interrogans serovar lai str. 56601
uccaaaaucauuuaaagcaaaua

SEQ ID NO: 2790286 - RNA, 20 nt, Leptospira interrogans serovar lai str. 56601
uccaaacaauuuuuugaaaa

SEQ ID NO: 2790287 - RNA, 22 nt, Leptospira interrogans serovar lai str. 56601
uccaaacaauuuuuugaaaaag

SEQ ID NO: 2790288 - RNA, 21 nt, Leptospira interrogans serovar lai str. 56601
uccaaacacuaauaaaaaugu

SEQ ID NO: 2790289 - RNA, 11 nt, Leptospira interrogans serovar lai str. 56601
uccaaacccug

SEQ ID NO: 2790290 - RNA, 19 nt, Leptospira interrogans serovar lai str. 56601
uccaaacccugccaaaauc

SEQ ID NO: 2790291 - RNA, 19 nt, Leptospira interrogans serovar lai str. 56601
uccaaacucaaugcugcuc

SEQ ID NO: 2790292 - RNA, 19 nt, Leptospira interrogans serovar lai str. 56601
uccaaagauuuuaaaaauu

SEQ ID NO: 2790293 - RNA, 22 nt, Leptospira interrogans serovar lai str. 56601
uccaaaguucccgccaaaugcu

SEQ ID NO: 2790294 - RNA, 18 nt, Leptospira interrogans serovar lai str. 56601
uccaaaucugaaucucuu

SEQ ID NO: 2790295 - RNA, 16 nt, Leptospira interrogans serovar lai str. 56601
uccaacaaauugaaau

SEQ ID NO: 2790296 - RNA, 17 nt, Leptospira interrogans serovar lai str. 56601
uccaacaagggcggcuu

SEQ ID NO: 2790297 - RNA, 15 nt, Leptospira interrogans serovar lai str. 56601
uccaaccagagcaua

SEQ ID NO: 2790298 - RNA, 16 nt, Leptospira interrogans serovar lai str. 56601
uccaaccauuuaauag

SEQ ID NO: 2790299 - RNA, 15 nt, Leptospira interrogans serovar lai str. 56601
uccaacguaccaaaa

SEQ ID NO: 2790300 - RNA, 16 nt, Leptospira interrogans serovar lai str. 56601
uccaacuuaaaacugu

SEQ ID NO: 2790301 - RNA, 20 nt, Leptospira interrogans serovar lai str. 56601
uccaacuuuuucagaaaaau

SEQ ID NO: 2790302 - RNA, 21 nt, Leptospira interrogans serovar lai str. 56601
uccaagaccucaaauaacuuu

SEQ ID NO: 2790303 - RNA, 16 nt, Leptospira interrogans serovar lai str. 56601
uccaagauuuuuuaau

SEQ ID NO: 2790304 - RNA, 22 nt, Leptospira interrogans serovar lai str. 56601
uccaagggaagguuuuguaaaa

SEQ ID NO: 2790305 - RNA, 17 nt, Leptospira interrogans serovar lai str. 56601
uccaaguaggaauugga

SEQ ID NO: 2790306 - RNA, 21 nt, Leptospira interrogans serovar lai str. 56601
uccaauauuuaugcuuuaauc

SEQ ID NO: 2790307 - RNA, 15 nt, Leptospira interrogans serovar lai str. 56601
uccaaucaaauuuuu

SEQ ID NO: 2790308 - RNA, 12 nt, Leptospira interrogans serovar lai str. 56601
uccaauccaaaa

SEQ ID NO: 2790309 - RNA, 13 nt, Leptospira interrogans serovar lai str. 56601
uccaauccaaaau

SEQ ID NO: 2790310 - RNA, 22 nt, Leptospira interrogans serovar lai str. 56601
uccaaucgccucuugaagccuu

SEQ ID NO: 2790311 - RNA, 15 nt, Leptospira interrogans serovar lai str. 56601
uccaaucucuuucgg

SEQ ID NO: 2790312 - RNA, 16 nt, Leptospira interrogans serovar lai str. 56601
ucccacauuuuagaaa

SEQ ID NO: 2790313 - RNA, 20 nt, Leptospira interrogans serovar lai str. 56601
ucccacauuuuuaaaaguua

SEQ ID NO: 2790314 - RNA, 17 nt, Leptospira interrogans serovar lai str. 56601
ucccacauuuuucaaau

SEQ ID NO: 2790315 - RNA, 22 nt, Leptospira interrogans serovar lai str. 56601
ucccacauuuuugugaaacuua

SEQ ID NO: 2790316 - RNA, 16 nt, Leptospira interrogans serovar lai str. 56601
ucccacguuuuaaagg

SEQ ID NO: 2790317 - RNA, 15 nt, Leptospira interrogans serovar lai str. 56601
ucccacuuauaauaa

SEQ ID NO: 2790318 - RNA, 14 nt, Leptospira interrogans serovar lai str. 56601
ucccacuuuuaaag

SEQ ID NO: 2790319 - RNA, 15 nt, Leptospira interrogans serovar lai str. 56601
ucccacuuuuaaaga

SEQ ID NO: 2790320 - RNA, 19 nt, Leptospira interrogans serovar lai str. 56601
ucccagacguaucaaaaua

SEQ ID NO: 2790321 - RNA, 14 nt, Leptospira interrogans serovar lai str. 56601
ucccaguucuuaaa

SEQ ID NO: 2790322 - RNA, 13 nt, Leptospira interrogans serovar lai str. 56601
ucccauauaauuu

SEQ ID NO: 2790323 - RNA, 17 nt, Leptospira interrogans serovar lai str. 56601
ucccauauaauuuuauc

SEQ ID NO: 2790324 - RNA, 20 nt, Leptospira interrogans serovar lai str. 56601
ucccauccgaaaucccaaaa

SEQ ID NO: 2790325 - RNA, 22 nt, Leptospira interrogans serovar lai str. 56601
ucccauccgaaaucccaaaacc

SEQ ID NO: 2790326 - RNA, 14 nt, Leptospira interrogans serovar lai str. 56601
ucccauuuuaacgu

SEQ ID NO: 2790327 - RNA, 15 nt, Leptospira interrogans serovar lai str. 56601
uccccaagacgucua

SEQ ID NO: 2790328 - RNA, 18 nt, Leptospira interrogans serovar lai str. 56601
uccccaaguaaaauuaaa

SEQ ID NO: 2790329 - RNA, 15 nt, Leptospira interrogans serovar lai str. 56601
uccccauaaacaaac

SEQ ID NO: 2790330 - RNA, 14 nt, Leptospira interrogans serovar lai str. 56601
ucccccaacugaaa

SEQ ID NO: 2790331 - RNA, 16 nt, Leptospira interrogans serovar lai str. 56601
ucccccaacugaaaau

SEQ ID NO: 2790332 - RNA, 21 nt, Leptospira interrogans serovar lai str. 56601
ucccccaacugaaaaugacca

SEQ ID NO: 2790333 - RNA, 23 nt, Leptospira interrogans serovar lai str. 56601
ucccccaacugaaaaugaccaaa

SEQ ID NO: 2790334 - RNA, 13 nt, Leptospira interrogans serovar lai str. 56601
uccccgaacuaua

SEQ ID NO: 2790335 - RNA, 13 nt, Leptospira interrogans serovar lai str. 56601
uccccuugauucc

SEQ ID NO: 2790336 - RNA, 15 nt, Leptospira interrogans serovar lai str. 56601
uccccuugauuccac

SEQ ID NO: 2790337 - RNA, 14 nt, Leptospira interrogans serovar lai str. 56601
uccccuuucuaauc

SEQ ID NO: 2790338 - RNA, 14 nt, Leptospira interrogans serovar lai str. 56601
ucccgauucucaaa

SEQ ID NO: 2790339 - RNA, 17 nt, Leptospira interrogans serovar lai str. 56601
ucccgauucucaaaaug

SEQ ID NO: 2790340 - RNA, 15 nt, Leptospira interrogans serovar lai str. 56601
ucccgccaaaugcug

SEQ ID NO: 2790341 - RNA, 14 nt, Leptospira interrogans serovar lai str. 56601
ucccgcccaaagua

SEQ ID NO: 2790342 - RNA, 18 nt, Leptospira interrogans serovar lai str. 56601
ucccguuauuuuuuuuac

SEQ ID NO: 2790343 - RNA, 21 nt, Leptospira interrogans serovar lai str. 56601
ucccuauuguauuugauuuua

SEQ ID NO: 2790344 - RNA, 16 nt, Leptospira interrogans serovar lai str. 56601
ucccuuaccuccuuuu

SEQ ID NO: 2790345 - RNA, 18 nt, Leptospira interrogans serovar lai str. 56601
ucccuuaccuccuuuuuc

SEQ ID NO: 2790346 - RNA, 17 nt, Leptospira interrogans serovar lai str. 56601
ucccuuuugaucuuuaa

SEQ ID NO: 2790347 - RNA, 18 nt, Leptospira interrogans serovar lai str. 56601
ucccuuuugaucuuuaaa

SEQ ID NO: 2790348 - RNA, 21 nt, Leptospira interrogans serovar lai str. 56601
uccgaaauuuuuuuaaaaaug

SEQ ID NO: 2790349 - RNA, 14 nt, Leptospira interrogans serovar lai str. 56601
uccgaaccuuacca

SEQ ID NO: 2790350 - RNA, 19 nt, Leptospira interrogans serovar lai str. 56601
uccgaaggaauugcagcau

SEQ ID NO: 2790351 - RNA, 16 nt, Leptospira interrogans serovar lai str. 56601
uccgacaagaaugagu

SEQ ID NO: 2790352 - RNA, 19 nt, Leptospira interrogans serovar lai str. 56601
uccgauacgaguaaaaauu

SEQ ID NO: 2790353 - RNA, 14 nt, Leptospira interrogans serovar lai str. 56601
uccgauuucuuuca

SEQ ID NO: 2790354 - RNA, 19 nt, Leptospira interrogans serovar lai str. 56601
uccgauuugguuuucauuc

SEQ ID NO: 2790355 - RNA, 22 nt, Leptospira interrogans serovar lai str. 56601
uccgauuugguuuucauucaaa

SEQ ID NO: 2790356 - RNA, 15 nt, Leptospira interrogans serovar lai str. 56601
uccgauuuuuguuuu

SEQ ID NO: 2790357 - RNA, 15 nt, Leptospira interrogans serovar lai str. 56601
uccgcaaaaauuccu

SEQ ID NO: 2790358 - RNA, 17 nt, Leptospira interrogans serovar lai str. 56601
uccgcaauaucccaaau

SEQ ID NO: 2790359 - RNA, 14 nt, Leptospira interrogans serovar lai str. 56601
uccgcauucucaca

SEQ ID NO: 2790360 - RNA, 15 nt, Leptospira interrogans serovar lai str. 56601
uccgccccacccaaa

SEQ ID NO: 2790361 - RNA, 22 nt, Leptospira interrogans serovar lai str. 56601
uccgccccacccaaaaauaggg

SEQ ID NO: 2790362 - RNA, 22 nt, Leptospira interrogans serovar lai str. 56601
uccgcgguuaugauauaauaua

SEQ ID NO: 2790363 - RNA, 19 nt, Leptospira interrogans serovar lai str. 56601
uccgcuguaguaucucuug

SEQ ID NO: 2790364 - RNA, 16 nt, Leptospira interrogans serovar lai str. 56601
uccgcuguaugaaaac

SEQ ID NO: 2790365 - RNA, 19 nt, Leptospira interrogans serovar lai str. 56601
uccgcuguaugaaaacgau

SEQ ID NO: 2790366 - RNA, 14 nt, Leptospira interrogans serovar lai str. 56601
uccggaagaacaac

SEQ ID NO: 2790367 - RNA, 21 nt, Leptospira interrogans serovar lai str. 56601
uccggaugcgaguaauauuuu

SEQ ID NO: 2790368 - RNA, 18 nt, Leptospira interrogans serovar lai str. 56601
uccggauuaaaaagguuu

SEQ ID NO: 2790369 - RNA, 19 nt, Leptospira interrogans serovar lai str. 56601
uccggcgugguuuaaaacu

SEQ ID NO: 2790370 - RNA, 19 nt, Leptospira interrogans serovar lai str. 56601
uccggcuaaaaaacugauu

SEQ ID NO: 2790371 - RNA, 21 nt, Leptospira interrogans serovar lai str. 56601
uccgggaggaauuuuuaaaaa

SEQ ID NO: 2790372 - RNA, 14 nt, Leptospira interrogans serovar lai str. 56601
uccgggcuuuucuu

SEQ ID NO: 2790373 - RNA, 17 nt, Leptospira interrogans serovar lai str. 56601
uccgguaaguaauauau

SEQ ID NO: 2790374 - RNA, 17 nt, Leptospira interrogans serovar lai str. 56601
uccguacuguuuuugaa

SEQ ID NO: 2790375 - RNA, 23 nt, Leptospira interrogans serovar lai str. 56601
uccguacuguuuuugaaacauuu

SEQ ID NO: 2790376 - RNA, 13 nt, Leptospira interrogans serovar lai str. 56601
uccguagaacgaa

SEQ ID NO: 2790377 - RNA, 19 nt, Leptospira interrogans serovar lai str. 56601
uccguagaucuuuuauaau

SEQ ID NO: 2790378 - RNA, 21 nt, Leptospira interrogans serovar lai str. 56601
uccguauacuuuaaaaaauau

SEQ ID NO: 2790379 - RNA, 13 nt, Leptospira interrogans serovar lai str. 56601
uccgucguuugca

SEQ ID NO: 2790380 - RNA, 14 nt, Leptospira interrogans serovar lai str. 56601
uccguuauauuaaa

SEQ ID NO: 2790381 - RNA, 13 nt, Leptospira interrogans serovar lai str. 56601
uccguuuuaaaau

SEQ ID NO: 2790382 - RNA, 12 nt, Leptospira interrogans serovar lai str. 56601
uccuaaaaccuc

SEQ ID NO: 2790383 - RNA, 20 nt, Leptospira interrogans serovar lai str. 56601
uccuaaaaccucaaaaaauu

SEQ ID NO: 2790384 - RNA, 13 nt, Leptospira interrogans serovar lai str. 56601
uccuaaaauaaaa

SEQ ID NO: 2790385 - RNA, 23 nt, Leptospira interrogans serovar lai str. 56601
uccuaaaauugugggaacuuuau

SEQ ID NO: 2790386 - RNA, 20 nt, Leptospira interrogans serovar lai str. 56601
uccuaaaauuuuaaaaaauu

SEQ ID NO: 2790387 - RNA, 15 nt, Leptospira interrogans serovar lai str. 56601
uccuaauauaucaga

SEQ ID NO: 2790388 - RNA, 19 nt, Leptospira interrogans serovar lai str. 56601
uccuaaugcagcuucuucc

SEQ ID NO: 2790389 - RNA, 16 nt, Leptospira interrogans serovar lai str. 56601
uccuacaauuuuagaa

SEQ ID NO: 2790390 - RNA, 14 nt, Leptospira interrogans serovar lai str. 56601
uccuacaguuuuag

SEQ ID NO: 2790391 - RNA, 11 nt, Leptospira interrogans serovar lai str. 56601
uccuacauuuu

SEQ ID NO: 2790392 - RNA, 15 nt, Leptospira interrogans serovar lai str. 56601
uccuacauuuuaaaa

SEQ ID NO: 2790393 - RNA, 20 nt, Leptospira interrogans serovar lai str. 56601
uccuacauuuuuuaaauuua

SEQ ID NO: 2790394 - RNA, 17 nt, Leptospira interrogans serovar lai str. 56601
uccuacuccggcuaaaa

SEQ ID NO: 2790395 - RNA, 16 nt, Leptospira interrogans serovar lai str. 56601
ucgacuauuucuucca

SEQ ID NO: 2790396 - RNA, 23 nt, Leptospira interrogans serovar lai str. 56601
ucgacuuuugaaaauccauauga

SEQ ID NO: 2790397 - RNA, 20 nt, Leptospira interrogans serovar lai str. 56601
ucgagauguugaguuucuuu

SEQ ID NO: 2790398 - RNA, 15 nt, Leptospira interrogans serovar lai str. 56601
ucgauaaaguaaaau

SEQ ID NO: 2790399 - RNA, 17 nt, Leptospira interrogans serovar lai str. 56601
ucgauaaaguaaaauua

SEQ ID NO: 2790400 - RNA, 13 nt, Leptospira interrogans serovar lai str. 56601
ucgauaauucuuu

SEQ ID NO: 2790401 - RNA, 16 nt, Leptospira interrogans serovar lai str. 56601
ucgauaauucuuuaga

SEQ ID NO: 2790402 - RNA, 23 nt, Leptospira interrogans serovar lai str. 56601
ucgauaauucuuuagaaauuuuu

SEQ ID NO: 2790403 - RNA, 21 nt, Leptospira interrogans serovar lai str. 56601
ucgauagccaugguaagaaga

SEQ ID NO: 2790404 - RNA, 22 nt, Leptospira interrogans serovar lai str. 56601
ucgauagccaugguaagaagaa

SEQ ID NO: 2790405 - RNA, 18 nt, Leptospira interrogans serovar lai str. 56601
ucgaucugcaaaguucug

SEQ ID NO: 2790406 - RNA, 20 nt, Leptospira interrogans serovar lai str. 56601
ucgaucuguaaaauguagau

SEQ ID NO: 2790407 - RNA, 20 nt, Leptospira interrogans serovar lai str. 56601
ucgaucuguaaaguucagau

SEQ ID NO: 2790408 - RNA, 19 nt, Leptospira interrogans serovar lai str. 56601
ucgaucuguaaaguuuaga

SEQ ID NO: 2790409 - RNA, 16 nt, Leptospira interrogans serovar lai str. 56601
ucgaugcaaaaugcuc

SEQ ID NO: 2790410 - RNA, 17 nt, Leptospira interrogans serovar lai str. 56601
ucgauguaagaaaauau

SEQ ID NO: 2790411 - RNA, 19 nt, Leptospira interrogans serovar lai str. 56601
ucgauuacucuuugagaaa

SEQ ID NO: 2790412 - RNA, 23 nt, Leptospira interrogans serovar lai str. 56601
ucgauucagagugguuucuuaug

SEQ ID NO: 2790413 - RNA, 14 nt, Leptospira interrogans serovar lai str. 56601
ucgauuccuaaaau

SEQ ID NO: 2790414 - RNA, 12 nt, Leptospira interrogans serovar lai str. 56601
ucgauuuaaaaa

SEQ ID NO: 2790415 - RNA, 15 nt, Leptospira interrogans serovar lai str. 56601
ucgauuuacuuuaaa

SEQ ID NO: 2790416 - RNA, 15 nt, Leptospira interrogans serovar lai str. 56601
ucgauuucuaaaaug

SEQ ID NO: 2790417 - RNA, 16 nt, Leptospira interrogans serovar lai str. 56601
ucgauuucuaaaaugu

SEQ ID NO: 2790418 - RNA, 13 nt, Leptospira interrogans serovar lai str. 56601
ucgauuucuaaau

SEQ ID NO: 2790419 - RNA, 16 nt, Leptospira interrogans serovar lai str. 56601
ucgauuucuaauauua

SEQ ID NO: 2790420 - RNA, 15 nt, Leptospira interrogans serovar lai str. 56601
ucgauuugagcgcag

SEQ ID NO: 2790421 - RNA, 14 nt, Leptospira interrogans serovar lai str. 56601
ucgauuuguaaaau

SEQ ID NO: 2790422 - RNA, 15 nt, Leptospira interrogans serovar lai str. 56601
ucgauuuguaaaauu

SEQ ID NO: 2790423 - RNA, 17 nt, Leptospira interrogans serovar lai str. 56601
ucgauuuguaaaauuca

SEQ ID NO: 2790424 - RNA, 18 nt, Leptospira interrogans serovar lai str. 56601
ucgauuuguaaaauucag

SEQ ID NO: 2790425 - RNA, 19 nt, Leptospira interrogans serovar lai str. 56601
ucgauuuuaaauaaaaaga

SEQ ID NO: 2790426 - RNA, 11 nt, Leptospira interrogans serovar lai str. 56601
ucgauuuugau

SEQ ID NO: 2790427 - RNA, 12 nt, Leptospira interrogans serovar lai str. 56601
ucgauuuuucga

SEQ ID NO: 2790428 - RNA, 13 nt, Leptospira interrogans serovar lai str. 56601
ucgcaaaaaaaau

SEQ ID NO: 2790429 - RNA, 17 nt, Leptospira interrogans serovar lai str. 56601
ucgcaaaaaaaauucga

SEQ ID NO: 2790430 - RNA, 22 nt, Leptospira interrogans serovar lai str. 56601
ucgcaacacacacuuuauaaaa

SEQ ID NO: 2790431 - RNA, 13 nt, Leptospira interrogans serovar lai str. 56601
ucgcaacauaaug

SEQ ID NO: 2790432 - RNA, 19 nt, Leptospira interrogans serovar lai str. 56601
ucgcaacauaauguuucaa

SEQ ID NO: 2790433 - RNA, 20 nt, Leptospira interrogans serovar lai str. 56601
ucgcacgucccacaaaucga

SEQ ID NO: 2790434 - RNA, 20 nt, Leptospira interrogans serovar lai str. 56601
ucgcagcauaauaaucgcuu

SEQ ID NO: 2790435 - RNA, 15 nt, Leptospira interrogans serovar lai str. 56601
ucgcauaacaaaaau

SEQ ID NO: 2790436 - RNA, 21 nt, Leptospira interrogans serovar lai str. 56601
ucgcauuaaaauuuucaucuu

SEQ ID NO: 2790437 - RNA, 20 nt, Leptospira interrogans serovar lai str. 56601
ucgcauuaugccgaauucac

SEQ ID NO: 2790438 - RNA, 21 nt, Leptospira interrogans serovar lai str. 56601
ucgcauuaugccgaauucacg

SEQ ID NO: 2790439 - RNA, 16 nt, Leptospira interrogans serovar lai str. 56601
ucgcauuguuuaaaua

SEQ ID NO: 2790440 - RNA, 13 nt, Leptospira interrogans serovar lai str. 56601
ucgcauuuuccuu

SEQ ID NO: 2790441 - RNA, 15 nt, Leptospira interrogans serovar lai str. 56601
ucgcauuuuccuuuu

SEQ ID NO: 2790442 - RNA, 17 nt, Leptospira interrogans serovar lai str. 56601
ucgcauuuuccuuuuuc

SEQ ID NO: 2790443 - RNA, 19 nt, Leptospira interrogans serovar lai str. 56601
ucgccaaaaacgcaaaaag

SEQ ID NO: 2790444 - RNA, 14 nt, Leptospira interrogans serovar lai str. 56601
ucgccguaaaaaau

SEQ ID NO: 2790445 - RNA, 22 nt, Leptospira interrogans serovar lai str. 56601
ucgccguucugggcucaaaaag

SEQ ID NO: 2790446 - RNA, 15 nt, Leptospira interrogans serovar lai str. 56601
ucgccuacacugugu

SEQ ID NO: 2790447 - RNA, 22 nt, Leptospira interrogans serovar lai str. 56601
ucgccuacacuguguucuuuuu

SEQ ID NO: 2790448 - RNA, 17 nt, Leptospira interrogans serovar lai str. 56601
ucgccuauuuuuuuaaa

SEQ ID NO: 2790449 - RNA, 22 nt, Leptospira interrogans serovar lai str. 56601
ucgccuauuuuuuuaaaaaauu

SEQ ID NO: 2790450 - RNA, 15 nt, Leptospira interrogans serovar lai str. 56601
ucgcguagauaauga

SEQ ID NO: 2790451 - RNA, 19 nt, Leptospira interrogans serovar lai str. 56601
ucgcguuaauauaauaaga

SEQ ID NO: 2790452 - RNA, 19 nt, Leptospira interrogans serovar lai str. 56601
ucgcguuuuauaauaaauu

SEQ ID NO: 2790453 - RNA, 12 nt, Leptospira interrogans serovar lai str. 56601
ucgcucaaauuu

SEQ ID NO: 2790454 - RNA, 14 nt, Leptospira interrogans serovar lai str. 56601
ucgcugauaaauuu

SEQ ID NO: 2790455 - RNA, 21 nt, Leptospira interrogans serovar lai str. 56601
ucgcugguuuuauuucugcug

SEQ ID NO: 2790456 - RNA, 23 nt, Leptospira interrogans serovar lai str. 56601
ucgcugguuuuauuucugcugcu

SEQ ID NO: 2790457 - RNA, 16 nt, Leptospira interrogans serovar lai str. 56601
ucgcuuacaaagugau

SEQ ID NO: 2790458 - RNA, 15 nt, Leptospira interrogans serovar lai str. 56601
ucgcuuuuaauaauu

SEQ ID NO: 2790459 - RNA, 13 nt, Leptospira interrogans serovar lai str. 56601
ucggaaaaaauau

SEQ ID NO: 2790460 - RNA, 23 nt, Leptospira interrogans serovar lai str. 56601
ucggaaaaaauaugauuuaaaau

SEQ ID NO: 2790461 - RNA, 15 nt, Leptospira interrogans serovar lai str. 56601
ucggaaaauugaaua

SEQ ID NO: 2790462 - RNA, 22 nt, Leptospira interrogans serovar lai str. 56601
ucggaaauaccgcuggaaauau

SEQ ID NO: 2790463 - RNA, 19 nt, Leptospira interrogans serovar lai str. 56601
ucggaaauauaacaauucu

SEQ ID NO: 2790464 - RNA, 12 nt, Leptospira interrogans serovar lai str. 56601
ucggaaauuuau

SEQ ID NO: 2790465 - RNA, 16 nt, Leptospira interrogans serovar lai str. 56601
ucggaaauuugaauuu

SEQ ID NO: 2790466 - RNA, 21 nt, Leptospira interrogans serovar lai str. 56601
ucggaaucgaggaaauucuau

SEQ ID NO: 2790467 - RNA, 19 nt, Leptospira interrogans serovar lai str. 56601
ucggacuuuccgaauagga

SEQ ID NO: 2790468 - RNA, 14 nt, Leptospira interrogans serovar lai str. 56601
ucggagaauuuaag

SEQ ID NO: 2790469 - RNA, 16 nt, Leptospira interrogans serovar lai str. 56601
ucggagucauacauuu

SEQ ID NO: 2790470 - RNA, 14 nt, Leptospira interrogans serovar lai str. 56601
ucggauaguuuaaa

SEQ ID NO: 2790471 - RNA, 15 nt, Leptospira interrogans serovar lai str. 56601
ucggauuucugaaaa

SEQ ID NO: 2790472 - RNA, 19 nt, Leptospira interrogans serovar lai str. 56601
ucggguuugucuucgaucc

SEQ ID NO: 2790473 - RNA, 12 nt, Leptospira interrogans serovar lai str. 56601
ucgguaaaaaga

SEQ ID NO: 2790474 - RNA, 22 nt, Leptospira interrogans serovar lai str. 56601
ucgguguaaaaaaucaugauuc

SEQ ID NO: 2790475 - RNA, 18 nt, Leptospira interrogans serovar lai str. 56601
ucgguucacguuaauuga

SEQ ID NO: 2790476 - RNA, 22 nt, Leptospira interrogans serovar lai str. 56601
ucgguucgcguuaauauaauaa

SEQ ID NO: 2790477 - RNA, 14 nt, Leptospira interrogans serovar lai str. 56601
ucgguucuauaaaa

SEQ ID NO: 2790478 - RNA, 22 nt, Leptospira interrogans serovar lai str. 56601
ucuaagauugaaugaaaucuaa

SEQ ID NO: 2790479 - RNA, 18 nt, Leptospira interrogans serovar lai str. 56601
ucuaagcuuuagaaaaua

SEQ ID NO: 2790480 - RNA, 20 nt, Leptospira interrogans serovar lai str. 56601
ucuaagcuuuagaaaauaau

SEQ ID NO: 2790481 - RNA, 14 nt, Leptospira interrogans serovar lai str. 56601
ucuaagguuugucu

SEQ ID NO: 2790482 - RNA, 15 nt, Leptospira interrogans serovar lai str. 56601
ucuaaguguaaaauu

SEQ ID NO: 2790483 - RNA, 21 nt, Leptospira interrogans serovar lai str. 56601
ucuaaguguaaaauuaaaauc

SEQ ID NO: 2790484 - RNA, 15 nt, Leptospira interrogans serovar lai str. 56601
ucuaauaaaauauga

SEQ ID NO: 2790485 - RNA, 22 nt, Leptospira interrogans serovar lai str. 56601
ucuaauaauauacuaaauuauu

SEQ ID NO: 2790486 - RNA, 15 nt, Leptospira interrogans serovar lai str. 56601
ucuaauacaaaaaau

SEQ ID NO: 2790487 - RNA, 21 nt, Leptospira interrogans serovar lai str. 56601
ucuaauagucucauacuuaau

SEQ ID NO: 2790488 - RNA, 20 nt, Leptospira interrogans serovar lai str. 56601
ucuaauaguugaaauucacc

SEQ ID NO: 2790489 - RNA, 14 nt, Leptospira interrogans serovar lai str. 56601
ucuaauauaaaaac

SEQ ID NO: 2790490 - RNA, 22 nt, Leptospira interrogans serovar lai str. 56601
ucuaauauaaaaaccacaaaaa

SEQ ID NO: 2790491 - RNA, 18 nt, Leptospira interrogans serovar lai str. 56601
ucuaauauuuuaaagaaa

SEQ ID NO: 2790492 - RNA, 18 nt, Leptospira interrogans serovar lai str. 56601
ucuaaucucguuaaauuu

SEQ ID NO: 2790493 - RNA, 18 nt, Leptospira interrogans serovar lai str. 56601
ucuaauguuguuaaauuu

SEQ ID NO: 2790494 - RNA, 23 nt, Leptospira interrogans serovar lai str. 56601
ucuaauucauuuggaucuguaau

SEQ ID NO: 2790495 - RNA, 16 nt, Leptospira interrogans serovar lai str. 56601
ucuaauucuaaaaauu

SEQ ID NO: 2790496 - RNA, 22 nt, Leptospira interrogans serovar lai str. 56601
ucuaauucuaaaaauuuuuuua

SEQ ID NO: 2790497 - RNA, 18 nt, Leptospira interrogans serovar lai str. 56601
ucuaauugcaacuaaguu

SEQ ID NO: 2790498 - RNA, 17 nt, Leptospira interrogans serovar lai str. 56601
ucuaauugugggaacuc

SEQ ID NO: 2790499 - RNA, 14 nt, Leptospira interrogans serovar lai str. 56601
ucuaauuuauaaac

SEQ ID NO: 2790500 - RNA, 22 nt, Leptospira interrogans serovar lai str. 56601
ucuaauuucauugaguuuuuua

SEQ ID NO: 2790501 - RNA, 13 nt, Leptospira interrogans serovar lai str. 56601
ucuacaaaacugu

SEQ ID NO: 2790502 - RNA, 17 nt, Leptospira interrogans serovar lai str. 56601
ucuacaaaacuuuacga

SEQ ID NO: 2790503 - RNA, 18 nt, Leptospira interrogans serovar lai str. 56601
ucuacaaaagauuuuuau

SEQ ID NO: 2790504 - RNA, 12 nt, Leptospira interrogans serovar lai str. 56601
ucuacaaaauuu

SEQ ID NO: 2790505 - RNA, 16 nt, Leptospira interrogans serovar lai str. 56601
ucuacaaaauuuagaa

SEQ ID NO: 2790506 - RNA, 19 nt, Leptospira interrogans serovar lai str. 56601
ucuacaaauaaaacuucuc

SEQ ID NO: 2790507 - RNA, 15 nt, Leptospira interrogans serovar lai str. 56601
ucuacaauaaaggaa

SEQ ID NO: 2790508 - RNA, 22 nt, Leptospira interrogans serovar lai str. 56601
ucuacaauuguaggaauucaua

SEQ ID NO: 2790509 - RNA, 16 nt, Leptospira interrogans serovar lai str. 56601
ucuacaccuucuaaau

SEQ ID NO: 2790510 - RNA, 16 nt, Leptospira interrogans serovar lai str. 56601
ucuacagauaaaaaua

SEQ ID NO: 2790511 - RNA, 16 nt, Leptospira interrogans serovar lai str. 56601
ucuacaguuucgauug

SEQ ID NO: 2790512 - RNA, 12 nt, Leptospira interrogans serovar lai str. 56601
ucuacauaaaaa

SEQ ID NO: 2790513 - RNA, 20 nt, Leptospira interrogans serovar lai str. 56601
ucuacauaaaaaaggaagca

SEQ ID NO: 2790514 - RNA, 22 nt, Leptospira interrogans serovar lai str. 56601
ucuacauucaauuucuuuaauu

SEQ ID NO: 2790515 - RNA, 19 nt, Leptospira interrogans serovar lai str. 56601
ucuacauucugaaacuuuu

SEQ ID NO: 2790516 - RNA, 20 nt, Leptospira interrogans serovar lai str. 56601
ucuacauucugaaacuuuuc

SEQ ID NO: 2790517 - RNA, 23 nt, Leptospira interrogans serovar lai str. 56601
ucuacauuggaaggacgaacuac

SEQ ID NO: 2790518 - RNA, 21 nt, Leptospira interrogans serovar lai str. 56601
ucuacauuugauauauuagaa

SEQ ID NO: 2790519 - RNA, 22 nt, Leptospira interrogans serovar lai str. 56601
ucuacauuuuugugaaacucaa

SEQ ID NO: 2790520 - RNA, 20 nt, Leptospira interrogans serovar lai str. 56601
ucuacgaaaauucugaaaga

SEQ ID NO: 2790521 - RNA, 13 nt, Leptospira interrogans serovar lai str. 56601
ucuacuaaaucag

SEQ ID NO: 2790522 - RNA, 23 nt, Leptospira interrogans serovar lai str. 56601
ucuacuugucuuuagaacuuguc

SEQ ID NO: 2790523 - RNA, 18 nt, Leptospira interrogans serovar lai str. 56601
ucuacuuuauuaaaaagu

SEQ ID NO: 2790524 - RNA, 19 nt, Leptospira interrogans serovar lai str. 56601
ucuacuuugaaugaaaaga

SEQ ID NO: 2790525 - RNA, 21 nt, Leptospira interrogans serovar lai str. 56601
ucuacuuuuaaaacuuuuaau

SEQ ID NO: 2790526 - RNA, 17 nt, Leptospira interrogans serovar lai str. 56601
ucuagaaagaauuuaau

SEQ ID NO: 2790527 - RNA, 17 nt, Leptospira interrogans serovar lai str. 56601
ucuagacuuucuuugaa

SEQ ID NO: 2790528 - RNA, 22 nt, Leptospira interrogans serovar lai str. 56601
ucuagauuuuacgauuaaauuu

SEQ ID NO: 2790529 - RNA, 20 nt, Leptospira interrogans serovar lai str. 56601
ucuagcaacacauuuucauu

SEQ ID NO: 2790530 - RNA, 18 nt, Leptospira interrogans serovar lai str. 56601
ucuaggaacugcuuccaa

SEQ ID NO: 2790531 - RNA, 20 nt, Leptospira interrogans serovar lai str. 56601
ucuaggaacugcuuccaaaa

SEQ ID NO: 2790532 - RNA, 16 nt, Leptospira interrogans serovar lai str. 56601
ucuaggcgauuuuucg

SEQ ID NO: 2790533 - RNA, 13 nt, Leptospira interrogans serovar lai str. 56601
ucuaguaaaaaug

SEQ ID NO: 2790534 - RNA, 13 nt, Leptospira interrogans serovar lai str. 56601
ucuaguaguuccc

SEQ ID NO: 2790535 - RNA, 22 nt, Leptospira interrogans serovar lai str. 56601
ucuaguaguucccacauuuugu

SEQ ID NO: 2790536 - RNA, 23 nt, Leptospira interrogans serovar lai str. 56601
ucuagucaauuaaauuguaugaa

SEQ ID NO: 2790537 - RNA, 14 nt, Leptospira interrogans serovar lai str. 56601
ucuaguccucuuuu

SEQ ID NO: 2790538 - RNA, 14 nt, Leptospira interrogans serovar lai str. 56601
ucuaguucaacgua

SEQ ID NO: 2790539 - RNA, 16 nt, Leptospira interrogans serovar lai str. 56601
ucuaguuuaaacguuu

SEQ ID NO: 2790540 - RNA, 17 nt, Leptospira interrogans serovar lai str. 56601
ucuaguuugaauuuagg

SEQ ID NO: 2790541 - RNA, 12 nt, Leptospira interrogans serovar lai str. 56601
ucuaguuuuccu

SEQ ID NO: 2790542 - RNA, 15 nt, Leptospira interrogans serovar lai str. 56601
ucuaguuuuccuucu

SEQ ID NO: 2790543 - RNA, 13 nt, Leptospira interrogans serovar lai str. 56601
ucuauaaaauauc

SEQ ID NO: 2790544 - RNA, 15 nt, Leptospira interrogans serovar lai str. 56601
ucuauaaaauaucuu

SEQ ID NO: 2790545 - RNA, 14 nt, Leptospira interrogans serovar lai str. 56601
ucuauaaaaucuaa

SEQ ID NO: 2790546 - RNA, 16 nt, Leptospira interrogans serovar lai str. 56601
ucuauaaaaucuaaaa

SEQ ID NO: 2790547 - RNA, 17 nt, Leptospira interrogans serovar lai str. 56601
ucuauaaaaucuaaaaa

SEQ ID NO: 2790548 - RNA, 22 nt, Leptospira interrogans serovar lai str. 56601
ucuauaaaaucuaaaaaaacaa

SEQ ID NO: 2790549 - RNA, 21 nt, Leptospira interrogans serovar lai str. 56601
ucuauaaaauggguuuucauu

SEQ ID NO: 2790550 - RNA, 14 nt, Leptospira interrogans serovar lai str. 56601
ucuauaaaauuaaa

SEQ ID NO: 2790551 - RNA, 13 nt, Leptospira interrogans serovar lai str. 56601
ucuauaaaauuca

SEQ ID NO: 2790552 - RNA, 16 nt, Leptospira interrogans serovar lai str. 56601
ucuauaaaauucaaaa

SEQ ID NO: 2790553 - RNA, 21 nt, Leptospira interrogans serovar lai str. 56601
ucuauaaaauucaaaaagaau

SEQ ID NO: 2790554 - RNA, 13 nt, Leptospira interrogans serovar lai str. 56601
ucuauaaacucaa

SEQ ID NO: 2790555 - RNA, 19 nt, Leptospira interrogans serovar lai str. 56601
ucuauaaacucaaagaauu

SEQ ID NO: 2790556 - RNA, 20 nt, Leptospira interrogans serovar lai str. 56601
ucuauaaauucaucuaaaaa

SEQ ID NO: 2790557 - RNA, 12 nt, Leptospira interrogans serovar lai str. 56601
ucuauaaauugc

SEQ ID NO: 2790558 - RNA, 16 nt, Leptospira interrogans serovar lai str. 56601
ucuauaaucugaaaua

SEQ ID NO: 2790559 - RNA, 16 nt, Leptospira interrogans serovar lai str. 56601
ucuauaauguuaauuu

SEQ ID NO: 2790560 - RNA, 18 nt, Leptospira interrogans serovar lai str. 56601
ucuauaauguuaauuuag

SEQ ID NO: 2790561 - RNA, 18 nt, Leptospira interrogans serovar lai str. 56601
ucucgacaaucaaaacuu

SEQ ID NO: 2790562 - RNA, 15 nt, Leptospira interrogans serovar lai str. 56601
ucucgauuccuaaaa

SEQ ID NO: 2790563 - RNA, 14 nt, Leptospira interrogans serovar lai str. 56601
ucucgauuucuaaa

SEQ ID NO: 2790564 - RNA, 15 nt, Leptospira interrogans serovar lai str. 56601
ucucgauuucuaaaa

SEQ ID NO: 2790565 - RNA, 21 nt, Leptospira interrogans serovar lai str. 56601
ucucgcauuuuccuuuuuccg

SEQ ID NO: 2790566 - RNA, 14 nt, Leptospira interrogans serovar lai str. 56601
ucucggaauauuuu

SEQ ID NO: 2790567 - RNA, 14 nt, Leptospira interrogans serovar lai str. 56601
ucucggacagauau

SEQ ID NO: 2790568 - RNA, 18 nt, Leptospira interrogans serovar lai str. 56601
ucucguaauaucuaaaac

SEQ ID NO: 2790569 - RNA, 20 nt, Leptospira interrogans serovar lai str. 56601
ucucguaauaucuaaaaccu

SEQ ID NO: 2790570 - RNA, 18 nt, Leptospira interrogans serovar lai str. 56601
ucucguucaacuuuccuu

SEQ ID NO: 2790571 - RNA, 21 nt, Leptospira interrogans serovar lai str. 56601
ucucguucaacuuuccuuuuc

SEQ ID NO: 2790572 - RNA, 13 nt, Leptospira interrogans serovar lai str. 56601
ucucguuuucuua

SEQ ID NO: 2790573 - RNA, 16 nt, Leptospira interrogans serovar lai str. 56601
ucucguuuucuuacgu

SEQ ID NO: 2790574 - RNA, 20 nt, Leptospira interrogans serovar lai str. 56601
ucucguuuuuaggauuaauu

SEQ ID NO: 2790575 - RNA, 15 nt, Leptospira interrogans serovar lai str. 56601
ucucuaauucuaaaa

SEQ ID NO: 2790576 - RNA, 20 nt, Leptospira interrogans serovar lai str. 56601
ucucuaauucuaaaaauuuu

SEQ ID NO: 2790577 - RNA, 19 nt, Leptospira interrogans serovar lai str. 56601
ucucuacgguuaucaauag

SEQ ID NO: 2790578 - RNA, 23 nt, Leptospira interrogans serovar lai str. 56601
ucucuacucuugaaguuaagaag

SEQ ID NO: 2790579 - RNA, 21 nt, Leptospira interrogans serovar lai str. 56601
ucucuagaaauuuauaauauu

SEQ ID NO: 2790580 - RNA, 12 nt, Leptospira interrogans serovar lai str. 56601
ucucuauaaaag

SEQ ID NO: 2790581 - RNA, 13 nt, Leptospira interrogans serovar lai str. 56601
ucucuauaaaauc

SEQ ID NO: 2790582 - RNA, 13 nt, Leptospira interrogans serovar lai str. 56601
ucucuaucagaaa

SEQ ID NO: 2790583 - RNA, 15 nt, Leptospira interrogans serovar lai str. 56601
ucucuaucagaaaaa

SEQ ID NO: 2790584 - RNA, 20 nt, Leptospira interrogans serovar lai str. 56601
ucucuaucagaaaaacauac

SEQ ID NO: 2790585 - RNA, 13 nt, Leptospira interrogans serovar lai str. 56601
ucucucaaauucu

SEQ ID NO: 2790586 - RNA, 15 nt, Leptospira interrogans serovar lai str. 56601
ucucugauaauuuuu

SEQ ID NO: 2790587 - RNA, 17 nt, Leptospira interrogans serovar lai str. 56601
ucucuucgucucaccaa

SEQ ID NO: 2790588 - RNA, 20 nt, Leptospira interrogans serovar lai str. 56601
ucucuucuuuauuuucuauu

SEQ ID NO: 2790589 - RNA, 15 nt, Leptospira interrogans serovar lai str. 56601
ucucuugucagaccu

SEQ ID NO: 2790590 - RNA, 19 nt, Leptospira interrogans serovar lai str. 56601
ucucuugucagaccuaaaa

SEQ ID NO: 2790591 - RNA, 16 nt, Leptospira interrogans serovar lai str. 56601
ucucuuuauauaaaau

SEQ ID NO: 2790592 - RNA, 15 nt, Leptospira interrogans serovar lai str. 56601
ucucuuuguaauaau

SEQ ID NO: 2790593 - RNA, 17 nt, Leptospira interrogans serovar lai str. 56601
ucucuuuguaauaaugu

SEQ ID NO: 2790594 - RNA, 13 nt, Leptospira interrogans serovar lai str. 56601
ucucuuuuaaaaa

SEQ ID NO: 2790595 - RNA, 14 nt, Leptospira interrogans serovar lai str. 56601
ucucuuuuaaaaac

SEQ ID NO: 2790596 - RNA, 21 nt, Leptospira interrogans serovar lai str. 56601
ucucuuuucgaaaauucugcu

SEQ ID NO: 2790597 - RNA, 19 nt, Leptospira interrogans serovar lai str. 56601
ucucuuuuuagacaaaaau

SEQ ID NO: 2790598 - RNA, 14 nt, Leptospira interrogans serovar lai str. 56601
ucucuuuuucucuu

SEQ ID NO: 2790599 - RNA, 14 nt, Leptospira interrogans serovar lai str. 56601
ucugaaaaaaguug

SEQ ID NO: 2790600 - RNA, 12 nt, Leptospira interrogans serovar lai str. 56601
ucugaaaaagag

SEQ ID NO: 2790601 - RNA, 21 nt, Leptospira interrogans serovar lai str. 56601
ucugaaacuuuucaaaaucua

SEQ ID NO: 2790602 - RNA, 14 nt, Leptospira interrogans serovar lai str. 56601
ucugaaauaaaaaa

SEQ ID NO: 2790603 - RNA, 12 nt, Leptospira interrogans serovar lai str. 56601
ucugaaaucuua

SEQ ID NO: 2790604 - RNA, 18 nt, Leptospira interrogans serovar lai str. 56601
ucugaaauuguuuuaaaa

SEQ ID NO: 2790605 - RNA, 17 nt, Leptospira interrogans serovar lai str. 56601
ucugaacuuugcagacu

SEQ ID NO: 2790606 - RNA, 14 nt, Leptospira interrogans serovar lai str. 56601
ucugaauaaaaaua

SEQ ID NO: 2790607 - RNA, 17 nt, Leptospira interrogans serovar lai str. 56601
ucugaauaaaaauacua

SEQ ID NO: 2790608 - RNA, 20 nt, Leptospira interrogans serovar lai str. 56601
ucugaauaaaaauacuaaaa

SEQ ID NO: 2790609 - RNA, 17 nt, Leptospira interrogans serovar lai str. 56601
ucugaaucucuuuuucu

SEQ ID NO: 2790610 - RNA, 20 nt, Leptospira interrogans serovar lai str. 56601
ucugaauuguggguuguaua

SEQ ID NO: 2790611 - RNA, 18 nt, Leptospira interrogans serovar lai str. 56601
ucugaauuuuuauaaguu

SEQ ID NO: 2790612 - RNA, 23 nt, Leptospira interrogans serovar lai str. 56601
ucugaccucuauccacuaaaaua

SEQ ID NO: 2790613 - RNA, 16 nt, Leptospira interrogans serovar lai str. 56601
ucugauaaagaaaacc

SEQ ID NO: 2790614 - RNA, 15 nt, Leptospira interrogans serovar lai str. 56601
ucugauaauuuuuua

SEQ ID NO: 2790615 - RNA, 18 nt, Leptospira interrogans serovar lai str. 56601
ucugauaauuuuuuaaaa

SEQ ID NO: 2790616 - RNA, 19 nt, Leptospira interrogans serovar lai str. 56601
ucugauagagaaaaauuuu

SEQ ID NO: 2790617 - RNA, 16 nt, Leptospira interrogans serovar lai str. 56601
ucugauauuuuaaauu

SEQ ID NO: 2790618 - RNA, 20 nt, Leptospira interrogans serovar lai str. 56601
ucugauugagaaaauaaaaa

SEQ ID NO: 2790619 - RNA, 20 nt, Leptospira interrogans serovar lai str. 56601
ucugauuuuuauaauuuaga

SEQ ID NO: 2790620 - RNA, 15 nt, Leptospira interrogans serovar lai str. 56601
ucugcaauucgcauu

SEQ ID NO: 2790621 - RNA, 13 nt, Leptospira interrogans serovar lai str. 56601
ucugcaucgaucc

SEQ ID NO: 2790622 - RNA, 18 nt, Leptospira interrogans serovar lai str. 56601
ucugcaucuuuucuaagg

SEQ ID NO: 2790623 - RNA, 19 nt, Leptospira interrogans serovar lai str. 56601
ucugcguagaaucucgcuu

SEQ ID NO: 2790624 - RNA, 14 nt, Leptospira interrogans serovar lai str. 56601
ucugcucuucuaau

SEQ ID NO: 2790625 - RNA, 13 nt, Leptospira interrogans serovar lai str. 56601
ucugcuuuuuuaa

SEQ ID NO: 2790626 - RNA, 14 nt, Leptospira interrogans serovar lai str. 56601
ucugcuuuuuuaaa

SEQ ID NO: 2790627 - RNA, 13 nt, Leptospira interrogans serovar lai str. 56601
ucugggaaccggc

SEQ ID NO: 2790628 - RNA, 15 nt, Leptospira interrogans serovar lai str. 56601
ucugguggaauucgu

SEQ ID NO: 2790629 - RNA, 14 nt, Leptospira interrogans serovar lai str. 56601
ucuguaaaauaaau

SEQ ID NO: 2790630 - RNA, 16 nt, Leptospira interrogans serovar lai str. 56601
ucuguaaaauaaauuu

SEQ ID NO: 2790631 - RNA, 20 nt, Leptospira interrogans serovar lai str. 56601
ucuguaaaauaaauuuauaa

SEQ ID NO: 2790632 - RNA, 22 nt, Leptospira interrogans serovar lai str. 56601
ucuguaaaauaaauuuauaauu

SEQ ID NO: 2790633 - RNA, 15 nt, Leptospira interrogans serovar lai str. 56601
ucuguaaaauucaga

SEQ ID NO: 2790634 - RNA, 14 nt, Leptospira interrogans serovar lai str. 56601
ucuguaaaauuugg

SEQ ID NO: 2790635 - RNA, 12 nt, Leptospira interrogans serovar lai str. 56601
ucuguaaaguuu

SEQ ID NO: 2790636 - RNA, 15 nt, Leptospira interrogans serovar lai str. 56601
ucuguaaauacaaaa

SEQ ID NO: 2790637 - RNA, 18 nt, Leptospira interrogans serovar lai str. 56601
ucuguaacauccaaacuc

SEQ ID NO: 2790638 - RNA, 23 nt, Leptospira interrogans serovar lai str. 56601
ucuguaauuggaauguacuaaaa

SEQ ID NO: 2790639 - RNA, 15 nt, Leptospira interrogans serovar lai str. 56601
ucuguagaaauucua

SEQ ID NO: 2790640 - RNA, 19 nt, Leptospira interrogans serovar lai str. 56601
ucuguagaaauucuauuuu

SEQ ID NO: 2790641 - RNA, 12 nt, Leptospira interrogans serovar lai str. 56601
ucuguaguaucc

SEQ ID NO: 2790642 - RNA, 15 nt, Leptospira interrogans serovar lai str. 56601
ucuguauuuuuaagu

SEQ ID NO: 2790643 - RNA, 13 nt, Leptospira interrogans serovar lai str. 56601
ucugucccaaaau

SEQ ID NO: 2790644 - RNA, 13 nt, Leptospira interrogans serovar lai str. 56601
ucugucguuugca

SEQ ID NO: 2790645 - RNA, 12 nt, Leptospira interrogans serovar lai str. 56601
ucuugaaauucu

SEQ ID NO: 2790646 - RNA, 13 nt, Leptospira interrogans serovar lai str. 56601
ucuugaaauucuc

SEQ ID NO: 2790647 - RNA, 17 nt, Leptospira interrogans serovar lai str. 56601
ucuugagggguuuuucc

SEQ ID NO: 2790648 - RNA, 22 nt, Leptospira interrogans serovar lai str. 56601
ucuugcaaaaauagaauuuuug

SEQ ID NO: 2790649 - RNA, 12 nt, Leptospira interrogans serovar lai str. 56601
ucuugcuaaaau

SEQ ID NO: 2790650 - RNA, 13 nt, Leptospira interrogans serovar lai str. 56601
ucuugcuaacauc

SEQ ID NO: 2790651 - RNA, 22 nt, Leptospira interrogans serovar lai str. 56601
ucuuguaaguauucaauuucag

SEQ ID NO: 2790652 - RNA, 19 nt, Leptospira interrogans serovar lai str. 56601
ucuugucucuacucuugaa

SEQ ID NO: 2790653 - RNA, 16 nt, Leptospira interrogans serovar lai str. 56601
ucuugugucaagcccu

SEQ ID NO: 2790654 - RNA, 16 nt, Leptospira interrogans serovar lai str. 56601
ucuuguuaaaauaaaa

SEQ ID NO: 2790655 - RNA, 21 nt, Leptospira interrogans serovar lai str. 56601
ucuuuaaaaauaggaauucga

SEQ ID NO: 2790656 - RNA, 23 nt, Leptospira interrogans serovar lai str. 56601
ucuuuaaaaauaggaauucgaaa

SEQ ID NO: 2790657 - RNA, 14 nt, Leptospira interrogans serovar lai str. 56601
ucuuuaaaauugug

SEQ ID NO: 2790658 - RNA, 19 nt, Leptospira interrogans serovar lai str. 56601
ucuuuaaaauuuuuaauaa

SEQ ID NO: 2790659 - RNA, 22 nt, Leptospira interrogans serovar lai str. 56601
ucuuuaaauguagaaacuacug

SEQ ID NO: 2790660 - RNA, 22 nt, Leptospira interrogans serovar lai str. 56601
ucuuuaagagucauuuuuaaau

SEQ ID NO: 2790661 - RNA, 21 nt, Leptospira interrogans serovar lai str. 56601
ucuuuaaugagucugucccaa

SEQ ID NO: 2790662 - RNA, 13 nt, Leptospira interrogans serovar lai str. 56601
ucuuuaauuucaa

SEQ ID NO: 2790663 - RNA, 16 nt, Leptospira interrogans serovar lai str. 56601
ucuuuaauuucaauaa

SEQ ID NO: 2790664 - RNA, 17 nt, Leptospira interrogans serovar lai str. 56601
ucuuuacaguuuuuaau

SEQ ID NO: 2790665 - RNA, 18 nt, Leptospira interrogans serovar lai str. 56601
ucuuuagaaauuuuuaau

SEQ ID NO: 2790666 - RNA, 23 nt, Leptospira interrogans serovar lai str. 56601
ucuuuagaaauuuuuaauaaaau

SEQ ID NO: 2790667 - RNA, 19 nt, Leptospira interrogans serovar lai str. 56601
ucuuuagaaauuuuuaauc

SEQ ID NO: 2790668 - RNA, 15 nt, Leptospira interrogans serovar lai str. 56601
ucuuuagaacuuguc

SEQ ID NO: 2790669 - RNA, 16 nt, Leptospira interrogans serovar lai str. 56601
ucuuuagaauuuuucg

SEQ ID NO: 2790670 - RNA, 14 nt, Leptospira interrogans serovar lai str. 56601
ucuuuauaaaaaug

SEQ ID NO: 2790671 - RNA, 17 nt, Leptospira interrogans serovar lai str. 56601
ucuuuauaaaaaugaua

SEQ ID NO: 2790672 - RNA, 13 nt, Leptospira interrogans serovar lai str. 56601
ucuuuauaaaguu

SEQ ID NO: 2790673 - RNA, 18 nt, Leptospira interrogans serovar lai str. 56601
ucuuuauauaaaauuuga

SEQ ID NO: 2790674 - RNA, 13 nt, Leptospira interrogans serovar lai str. 56601
ucuuuaucagaaa

SEQ ID NO: 2790675 - RNA, 18 nt, Leptospira interrogans serovar lai str. 56601
ucuuuaucagaaaaacau

SEQ ID NO: 2790676 - RNA, 22 nt, Leptospira interrogans serovar lai str. 56601
ucuuuaucagaaccuuuaguuu

SEQ ID NO: 2790677 - RNA, 18 nt, Leptospira interrogans serovar lai str. 56601
ucuuuaugcgguuuuacu

SEQ ID NO: 2790678 - RNA, 21 nt, Leptospira interrogans serovar lai str. 56601
ucuuuaugcgguuuuacuucu

SEQ ID NO: 2790679 - RNA, 22 nt, Leptospira interrogans serovar lai str. 56601
ucuuuaugcgguuuuacuucug

SEQ ID NO: 2790680 - RNA, 23 nt, Leptospira interrogans serovar lai str. 56601
ucuuuauuuugggcgugccucuc

SEQ ID NO: 2790681 - RNA, 19 nt, Leptospira interrogans serovar lai str. 56601
ucuuuccaucguuuaagaa

SEQ ID NO: 2790682 - RNA, 24 nt, Leptospira interrogans serovar lai str. 56601
ucuuuccccaagacgucuacagau

SEQ ID NO: 2790683 - RNA, 16 nt, Leptospira interrogans serovar lai str. 56601
ucuuucgagauuaaaa

SEQ ID NO: 2790684 - RNA, 21 nt, Leptospira interrogans serovar lai str. 56601
ucuuucgagauuaaaaucgga

SEQ ID NO: 2790685 - RNA, 15 nt, Leptospira interrogans serovar lai str. 56601
ucuuucgauuuuucg

SEQ ID NO: 2790686 - RNA, 23 nt, Leptospira interrogans serovar lai str. 56601
ucuuucgcgguuuucuuuuuucu

SEQ ID NO: 2790687 - RNA, 22 nt, Leptospira interrogans serovar lai str. 56601
ucuuucggcagccaauuccaaa

SEQ ID NO: 2790688 - RNA, 19 nt, Leptospira interrogans serovar lai str. 56601
ucuuucguuuuuuucauga

SEQ ID NO: 2790689 - RNA, 15 nt, Leptospira interrogans serovar lai str. 56601
ucuuucuauuuuuuc

SEQ ID NO: 2790690 - RNA, 12 nt, Leptospira interrogans serovar lai str. 56601
ucuuucugaaau

SEQ ID NO: 2790691 - RNA, 14 nt, Leptospira interrogans serovar lai str. 56601
ucuuucuuaaauuu

SEQ ID NO: 2790692 - RNA, 18 nt, Leptospira interrogans serovar lai str. 56601
ucuuucuuaaauuuuuuu

SEQ ID NO: 2790693 - RNA, 11 nt, Leptospira interrogans serovar lai str. 56601
ucuuucuuccg

SEQ ID NO: 2790694 - RNA, 13 nt, Leptospira interrogans serovar lai str. 56601
ucuuucuuccgga

SEQ ID NO: 2790695 - RNA, 14 nt, Leptospira interrogans serovar lai str. 56601
ucuuucuuccggau

SEQ ID NO: 2790696 - RNA, 16 nt, Leptospira interrogans serovar lai str. 56601
ucuuugaaaaaauuuu

SEQ ID NO: 2790697 - RNA, 20 nt, Leptospira interrogans serovar lai str. 56601
ucuuugaacuugucccaaaa

SEQ ID NO: 2790698 - RNA, 11 nt, Leptospira interrogans serovar lai str. 56601
ucuuugaagaa

SEQ ID NO: 2790699 - RNA, 19 nt, Leptospira interrogans serovar lai str. 56601
ucuuugaagaauaaaagug

SEQ ID NO: 2790700 - RNA, 15 nt, Leptospira interrogans serovar lai str. 56601
ucuuugaauugaaau

SEQ ID NO: 2790701 - RNA, 18 nt, Leptospira interrogans serovar lai str. 56601
ucuuugcgauuuuuccga

SEQ ID NO: 2790702 - RNA, 14 nt, Leptospira interrogans serovar lai str. 56601
ucuuuggaaauuuu

SEQ ID NO: 2790703 - RNA, 24 nt, Leptospira interrogans serovar lai str. 56601
ucuuuguaaccuuuguuuccucuu

SEQ ID NO: 2790704 - RNA, 11 nt, Leptospira interrogans serovar lai str. 56601
ucuuuuaaaaa

SEQ ID NO: 2790705 - RNA, 12 nt, Leptospira interrogans serovar lai str. 56601
ucuuuuaaaaaa

SEQ ID NO: 2790706 - RNA, 18 nt, Leptospira interrogans serovar lai str. 56601
ucuuuuaaaaaagguaua

SEQ ID NO: 2790707 - RNA, 12 nt, Leptospira interrogans serovar lai str. 56601
ucuuuuaaacaa

SEQ ID NO: 2790708 - RNA, 22 nt, Leptospira interrogans serovar lai str. 56601
ucuuuuagaaguggaucuugaa

SEQ ID NO: 2790709 - RNA, 24 nt, Leptospira interrogans serovar lai str. 56601
ucuuuuagaguucguuaagaauaa

SEQ ID NO: 2790710 - RNA, 24 nt, Leptospira interrogans serovar lai str. 56601
ucuuuuagauauuuauaaugaauu

SEQ ID NO: 2790711 - RNA, 16 nt, Leptospira interrogans serovar lai str. 56601
ucuuuucaaaaguauu

SEQ ID NO: 2790712 - RNA, 23 nt, Leptospira interrogans serovar lai str. 56601
ucuuuuccaaaaacuuucggaau

SEQ ID NO: 2790713 - RNA, 12 nt, Leptospira interrogans serovar lai str. 56601
ucuuuucuuaaa

SEQ ID NO: 2790714 - RNA, 22 nt, Leptospira interrogans serovar lai str. 56601
ucuuuugaccaaaagaggucua

SEQ ID NO: 2790715 - RNA, 12 nt, Leptospira interrogans serovar lai str. 56601
ucuuuuguaaaa

SEQ ID NO: 2790716 - RNA, 15 nt, Leptospira interrogans serovar lai str. 56601
ucuuuuguaaguuuu

SEQ ID NO: 2790717 - RNA, 22 nt, Leptospira interrogans serovar lai str. 56601
ucuuuuguaaguuuuccauucu

SEQ ID NO: 2790718 - RNA, 17 nt, Leptospira interrogans serovar lai str. 56601
ucuuuuguuuuuauaaa

SEQ ID NO: 2790719 - RNA, 12 nt, Leptospira interrogans serovar lai str. 56601
ucuuuuuaaaag

SEQ ID NO: 2790720 - RNA, 15 nt, Leptospira interrogans serovar lai str. 56601
ucuuuuuaaaaguau

SEQ ID NO: 2790721 - RNA, 14 nt, Leptospira interrogans serovar lai str. 56601
ucuuuuuaagaaaa

SEQ ID NO: 2790722 - RNA, 17 nt, Leptospira interrogans serovar lai str. 56601
ucuuuuuaaguaauauu

SEQ ID NO: 2790723 - RNA, 12 nt, Leptospira interrogans serovar lai str. 56601
ucuuuuuacuug

SEQ ID NO: 2790724 - RNA, 22 nt, Leptospira interrogans serovar lai str. 56601
ucuuuuuaggaagaaacaaaga

SEQ ID NO: 2790725 - RNA, 12 nt, Leptospira interrogans serovar lai str. 56601
ucuuuuucucuu

SEQ ID NO: 2790726 - RNA, 13 nt, Leptospira interrogans serovar lai str. 56601
ucuuuuucuucug

SEQ ID NO: 2790727 - RNA, 16 nt, Leptospira interrogans serovar lai str. 56601
ucuuuuugauaaaaua

SEQ ID NO: 2790728 - RNA, 13 nt, Leptospira interrogans serovar lai str. 56601
ugaaauuuuucaa

SEQ ID NO: 2790729 - RNA, 17 nt, Leptospira interrogans serovar lai str. 56601
ugaaauuuuucaauaac

SEQ ID NO: 2790730 - RNA, 19 nt, Leptospira interrogans serovar lai str. 56601
ugaaauuuuuguacaaaac

SEQ ID NO: 2790731 - RNA, 15 nt, Leptospira interrogans serovar lai str. 56601
ugaacaagaauuuau

SEQ ID NO: 2790732 - RNA, 16 nt, Leptospira interrogans serovar lai str. 56601
ugaacauuuucauaua

SEQ ID NO: 2790733 - RNA, 17 nt, Leptospira interrogans serovar lai str. 56601
ugaaccauuugaaaaag

SEQ ID NO: 2790734 - RNA, 15 nt, Leptospira interrogans serovar lai str. 56601
ugaaccucuguaaau

SEQ ID NO: 2790735 - RNA, 21 nt, Leptospira interrogans serovar lai str. 56601
ugaaccucuguaaauacaaaa

SEQ ID NO: 2790736 - RNA, 19 nt, Leptospira interrogans serovar lai str. 56601
ugaacgguaaaaucuuuaa

SEQ ID NO: 2790737 - RNA, 22 nt, Leptospira interrogans serovar lai str. 56601
ugaacgguaaaaucuuuaaguu

SEQ ID NO: 2790738 - RNA, 21 nt, Leptospira interrogans serovar lai str. 56601
ugaacguaaguuaaauauaaa

SEQ ID NO: 2790739 - RNA, 14 nt, Leptospira interrogans serovar lai str. 56601
ugaacguaauacaa

SEQ ID NO: 2790740 - RNA, 13 nt, Leptospira interrogans serovar lai str. 56601
ugaacguauucuu

SEQ ID NO: 2790741 - RNA, 21 nt, Leptospira interrogans serovar lai str. 56601
ugaacuacuacuuuaacguga

SEQ ID NO: 2790742 - RNA, 17 nt, Leptospira interrogans serovar lai str. 56601
ugaacucaauguugcuc

SEQ ID NO: 2790743 - RNA, 22 nt, Leptospira interrogans serovar lai str. 56601
ugaacucaauguugcuccuugc

SEQ ID NO: 2790744 - RNA, 14 nt, Leptospira interrogans serovar lai str. 56601
ugaacuccauucuu

SEQ ID NO: 2790745 - RNA, 15 nt, Leptospira interrogans serovar lai str. 56601
ugaacuccauucuua

SEQ ID NO: 2790746 - RNA, 17 nt, Leptospira interrogans serovar lai str. 56601
ugaacucggcucauaaa

SEQ ID NO: 2790747 - RNA, 18 nt, Leptospira interrogans serovar lai str. 56601
ugaacucgguguaaaaaa

SEQ ID NO: 2790748 - RNA, 15 nt, Leptospira interrogans serovar lai str. 56601
ugaacuguuuaauuu

SEQ ID NO: 2790749 - RNA, 18 nt, Leptospira interrogans serovar lai str. 56601
ugaacuuugcagacugau

SEQ ID NO: 2790750 - RNA, 14 nt, Leptospira interrogans serovar lai str. 56601
ugaacuuuuuuaua

SEQ ID NO: 2790751 - RNA, 15 nt, Leptospira interrogans serovar lai str. 56601
ugaagaaaaaaagau

SEQ ID NO: 2790752 - RNA, 13 nt, Leptospira interrogans serovar lai str. 56601
ugaagaaacacuu

SEQ ID NO: 2790753 - RNA, 21 nt, Leptospira interrogans serovar lai str. 56601
ugaagaagcuaaaauugaaua

SEQ ID NO: 2790754 - RNA, 16 nt, Leptospira interrogans serovar lai str. 56601
ugaagaaugauaaauc

SEQ ID NO: 2790755 - RNA, 19 nt, Leptospira interrogans serovar lai str. 56601
ugaagaaugauaaaucuug

SEQ ID NO: 2790756 - RNA, 19 nt, Leptospira interrogans serovar lai str. 56601
ugaagaauuaauucuccau

SEQ ID NO: 2790757 - RNA, 13 nt, Leptospira interrogans serovar lai str. 56601
ugaagacuuccac

SEQ ID NO: 2790758 - RNA, 24 nt, Leptospira interrogans serovar lai str. 56601
ugaagacuuccacgaauuacauag

SEQ ID NO: 2790759 - RNA, 15 nt, Leptospira interrogans serovar lai str. 56601
ugaagauuuguaaaa

SEQ ID NO: 2790760 - RNA, 17 nt, Leptospira interrogans serovar lai str. 56601
ugaagauuuguaaaauu

SEQ ID NO: 2790761 - RNA, 17 nt, Leptospira interrogans serovar lai str. 56601
ugaaggaauuggaauau

SEQ ID NO: 2790762 - RNA, 22 nt, Leptospira interrogans serovar lai str. 56601
ugaagguugagcaguaaaaucu

SEQ ID NO: 2790763 - RNA, 16 nt, Leptospira interrogans serovar lai str. 56601
ugaaguagauacaauu

SEQ ID NO: 2790764 - RNA, 16 nt, Leptospira interrogans serovar lai str. 56601
ugaaguaguaacacuc

SEQ ID NO: 2790765 - RNA, 22 nt, Leptospira interrogans serovar lai str. 56601
ugaaguaguuccuacauuuuaa

SEQ ID NO: 2790766 - RNA, 20 nt, Leptospira interrogans serovar lai str. 56601
ugaaguauuuuacgauucaa

SEQ ID NO: 2790767 - RNA, 22 nt, Leptospira interrogans serovar lai str. 56601
ugaaguauuuuacgauucaauu

SEQ ID NO: 2790768 - RNA, 17 nt, Leptospira interrogans serovar lai str. 56601
ugaagucuuaucucaaa

SEQ ID NO: 2790769 - RNA, 13 nt, Leptospira interrogans serovar lai str. 56601
ugaaguguaaaac

SEQ ID NO: 2790770 - RNA, 21 nt, Leptospira interrogans serovar lai str. 56601
ugaaguuaagaagauaaauau

SEQ ID NO: 2790771 - RNA, 18 nt, Leptospira interrogans serovar lai str. 56601
ugaaguuuccgaaagacu

SEQ ID NO: 2790772 - RNA, 19 nt, Leptospira interrogans serovar lai str. 56601
ugaaguuuccgaaagacua

SEQ ID NO: 2790773 - RNA, 16 nt, Leptospira interrogans serovar lai str. 56601
ugaauaaaauaaaaaa

SEQ ID NO: 2790774 - RNA, 18 nt, Leptospira interrogans serovar lai str. 56601
ugaauaaaauaaaaaaau

SEQ ID NO: 2790775 - RNA, 18 nt, Leptospira interrogans serovar lai str. 56601
ugaauaaagagaaaacaa

SEQ ID NO: 2790776 - RNA, 18 nt, Leptospira interrogans serovar lai str. 56601
ugaauaacuuuacaaaaa

SEQ ID NO: 2790777 - RNA, 17 nt, Leptospira interrogans serovar lai str. 56601
ugaauaagauuuuagaa

SEQ ID NO: 2790778 - RNA, 22 nt, Leptospira interrogans serovar lai str. 56601
ugaauaagauuuuagaaucaga

SEQ ID NO: 2790779 - RNA, 21 nt, Leptospira interrogans serovar lai str. 56601
ugaauacgacagguuuaauug

SEQ ID NO: 2790780 - RNA, 22 nt, Leptospira interrogans serovar lai str. 56601
ugaauacguuauucuauucgua

SEQ ID NO: 2790781 - RNA, 18 nt, Leptospira interrogans serovar lai str. 56601
ugaauacguuuacuccaa

SEQ ID NO: 2790782 - RNA, 23 nt, Leptospira interrogans serovar lai str. 56601
ugaauaggcgauuuuacaaagac

SEQ ID NO: 2790783 - RNA, 13 nt, Leptospira interrogans serovar lai str. 56601
ugaauauaaaauu

SEQ ID NO: 2790784 - RNA, 15 nt, Leptospira interrogans serovar lai str. 56601
ugaauauaaaauuuu

SEQ ID NO: 2790785 - RNA, 21 nt, Leptospira interrogans serovar lai str. 56601
ugaauauccuucgcauaacaa

SEQ ID NO: 2790786 - RNA, 18 nt, Leptospira interrogans serovar lai str. 56601
ugaauauucacuuuucca

SEQ ID NO: 2790787 - RNA, 20 nt, Leptospira interrogans serovar lai str. 56601
ugaauauugagcuaauucuu

SEQ ID NO: 2790788 - RNA, 22 nt, Leptospira interrogans serovar lai str. 56601
ugaauauugagcuaauucuuaa

SEQ ID NO: 2790789 - RNA, 16 nt, Leptospira interrogans serovar lai str. 56601
ugaauauuuuccaaaa

SEQ ID NO: 2790790 - RNA, 20 nt, Leptospira interrogans serovar lai str. 56601
ugaauauuuuuaaacucauu

SEQ ID NO: 2790791 - RNA, 16 nt, Leptospira interrogans serovar lai str. 56601
ugaaucaugaauuccu

SEQ ID NO: 2790792 - RNA, 18 nt, Leptospira interrogans serovar lai str. 56601
ugaauccaucugagaauu

SEQ ID NO: 2790793 - RNA, 14 nt, Leptospira interrogans serovar lai str. 56601
ugaauccuuuaaac

SEQ ID NO: 2790794 - RNA, 14 nt, Leptospira interrogans serovar lai str. 56601
ugaaucgaaucuuu

SEQ ID NO: 2790795 - RNA, 17 nt, Leptospira interrogans serovar lai str. 56601
ugaaucgaaucuuuugc

SEQ ID NO: 2790796 - RNA, 23 nt, Leptospira interrogans serovar lai str. 56601
ugaaucuaggauauuugauauaa

SEQ ID NO: 2790797 - RNA, 16 nt, Leptospira interrogans serovar lai str. 56601
ugaaucuauuguaaua

SEQ ID NO: 2790798 - RNA, 17 nt, Leptospira interrogans serovar lai str. 56601
ugaaucucuuaaucgaa

SEQ ID NO: 2790799 - RNA, 15 nt, Leptospira interrogans serovar lai str. 56601
ugaaucuuaaaucuu

SEQ ID NO: 2790800 - RNA, 24 nt, Leptospira interrogans serovar lai str. 56601
ugaaugaaaccugaaucuauugua

SEQ ID NO: 2790801 - RNA, 22 nt, Leptospira interrogans serovar lai str. 56601
ugaaugauaggcuaaucaaauu

SEQ ID NO: 2790802 - RNA, 15 nt, Leptospira interrogans serovar lai str. 56601
ugaaugccucucuaa

SEQ ID NO: 2790803 - RNA, 23 nt, Leptospira interrogans serovar lai str. 56601
ugaaugugacggcaaugugcaaa

SEQ ID NO: 2790804 - RNA, 20 nt, Leptospira interrogans serovar lai str. 56601
ugaauguuuaaaauuuauua

SEQ ID NO: 2790805 - RNA, 12 nt, Leptospira interrogans serovar lai str. 56601
ugaauuaaaaaa

SEQ ID NO: 2790806 - RNA, 22 nt, Leptospira interrogans serovar lai str. 56601
ugaauuaaaaaacuuuuuaaaa

SEQ ID NO: 2790807 - RNA, 14 nt, Leptospira interrogans serovar lai str. 56601
ugaauuaaagaaga

SEQ ID NO: 2790808 - RNA, 23 nt, Leptospira interrogans serovar lai str. 56601
ugaauuaagcagaagcuuuauua

SEQ ID NO: 2790809 - RNA, 15 nt, Leptospira interrogans serovar lai str. 56601
ugaauucagaaaaaa

SEQ ID NO: 2790810 - RNA, 13 nt, Leptospira interrogans serovar lai str. 56601
ugagcaaaauuug

SEQ ID NO: 2790811 - RNA, 20 nt, Leptospira interrogans serovar lai str. 56601
ugagcacaauauauucagua

SEQ ID NO: 2790812 - RNA, 15 nt, Leptospira interrogans serovar lai str. 56601
ugagcagauucuaaa

SEQ ID NO: 2790813 - RNA, 13 nt, Leptospira interrogans serovar lai str. 56601
ugagcaguaaaau

SEQ ID NO: 2790814 - RNA, 20 nt, Leptospira interrogans serovar lai str. 56601
ugagcaguucuaaucucguu

SEQ ID NO: 2790815 - RNA, 13 nt, Leptospira interrogans serovar lai str. 56601
ugagcauuuuuuu

SEQ ID NO: 2790816 - RNA, 15 nt, Leptospira interrogans serovar lai str. 56601
ugagccaucuuuuuu

SEQ ID NO: 2790817 - RNA, 15 nt, Leptospira interrogans serovar lai str. 56601
ugagcggaaggaaac

SEQ ID NO: 2790818 - RNA, 18 nt, Leptospira interrogans serovar lai str. 56601
ugagcuaauucuuaaaaa

SEQ ID NO: 2790819 - RNA, 16 nt, Leptospira interrogans serovar lai str. 56601
ugagggaauucccaca

SEQ ID NO: 2790820 - RNA, 18 nt, Leptospira interrogans serovar lai str. 56601
ugagggguuuuuccuuuu

SEQ ID NO: 2790821 - RNA, 14 nt, Leptospira interrogans serovar lai str. 56601
ugagguuuuaaaag

SEQ ID NO: 2790822 - RNA, 15 nt, Leptospira interrogans serovar lai str. 56601
ugagguuuuaaaagu

SEQ ID NO: 2790823 - RNA, 20 nt, Leptospira interrogans serovar lai str. 56601
ugagguuuuggaaaggucug

SEQ ID NO: 2790824 - RNA, 21 nt, Leptospira interrogans serovar lai str. 56601
ugaguaacgaaagaagacuau

SEQ ID NO: 2790825 - RNA, 17 nt, Leptospira interrogans serovar lai str. 56601
ugaguaagauauuaaca

SEQ ID NO: 2790826 - RNA, 15 nt, Leptospira interrogans serovar lai str. 56601
ugaguaauuccacuc

SEQ ID NO: 2790827 - RNA, 21 nt, Leptospira interrogans serovar lai str. 56601
ugaguaccuaucaauguugug

SEQ ID NO: 2790828 - RNA, 15 nt, Leptospira interrogans serovar lai str. 56601
ugaguagaaaguuau

SEQ ID NO: 2790829 - RNA, 12 nt, Leptospira interrogans serovar lai str. 56601
ugaguagaagcc

SEQ ID NO: 2790830 - RNA, 18 nt, Leptospira interrogans serovar lai str. 56601
ugaguaguagaaaaugug

SEQ ID NO: 2790831 - RNA, 15 nt, Leptospira interrogans serovar lai str. 56601
ugagucaacaaauau

SEQ ID NO: 2790832 - RNA, 18 nt, Leptospira interrogans serovar lai str. 56601
ugagucccuacaauuuua

SEQ ID NO: 2790833 - RNA, 21 nt, Leptospira interrogans serovar lai str. 56601
ugagucccuacaauuuuagaa

SEQ ID NO: 2790834 - RNA, 19 nt, Leptospira interrogans serovar lai str. 56601
ugaguccuuucgacuuuag

SEQ ID NO: 2790835 - RNA, 17 nt, Leptospira interrogans serovar lai str. 56601
ugagucuagaauucuuu

SEQ ID NO: 2790836 - RNA, 16 nt, Leptospira interrogans serovar lai str. 56601
ugagucugucccaaaa

SEQ ID NO: 2790837 - RNA, 15 nt, Leptospira interrogans serovar lai str. 56601
ugagucuuuuuacuu

SEQ ID NO: 2790838 - RNA, 19 nt, Leptospira interrogans serovar lai str. 56601
ugagucuuuuuacuugcaa

SEQ ID NO: 2790839 - RNA, 21 nt, Leptospira interrogans serovar lai str. 56601
ugaguggauugccauccacaa

SEQ ID NO: 2790840 - RNA, 16 nt, Leptospira interrogans serovar lai str. 56601
ugaguuaauuuucgau

SEQ ID NO: 2790841 - RNA, 19 nt, Leptospira interrogans serovar lai str. 56601
ugaguuauaguaaaagaaa

SEQ ID NO: 2790842 - RNA, 17 nt, Leptospira interrogans serovar lai str. 56601
ugaguucauucauccua

SEQ ID NO: 2790843 - RNA, 14 nt, Leptospira interrogans serovar lai str. 56601
ugaguucauucuga

SEQ ID NO: 2790844 - RNA, 19 nt, Leptospira interrogans serovar lai str. 56601
ugaguucccacaaauuccu

SEQ ID NO: 2790845 - RNA, 22 nt, Leptospira interrogans serovar lai str. 56601
ugaguucccacauuuuaaaguu

SEQ ID NO: 2790846 - RNA, 21 nt, Leptospira interrogans serovar lai str. 56601
ugaguucccacauuuuuaaaa

SEQ ID NO: 2790847 - RNA, 17 nt, Leptospira interrogans serovar lai str. 56601
ugaguuccuaacuuuga

SEQ ID NO: 2790848 - RNA, 20 nt, Leptospira interrogans serovar lai str. 56601
ugaguucgacguaagaaucc

SEQ ID NO: 2790849 - RNA, 20 nt, Leptospira interrogans serovar lai str. 56601
ugaguucgauguaagaaaau

SEQ ID NO: 2790850 - RNA, 19 nt, Leptospira interrogans serovar lai str. 56601
ugaguucggcuuaagaaaa

SEQ ID NO: 2790851 - RNA, 12 nt, Leptospira interrogans serovar lai str. 56601
ugaguuuaaaga

SEQ ID NO: 2790852 - RNA, 12 nt, Leptospira interrogans serovar lai str. 56601
ugaguuucaaac

SEQ ID NO: 2790853 - RNA, 23 nt, Leptospira interrogans serovar lai str. 56601
ugaguuucuccacuuaaaaaguu

SEQ ID NO: 2790854 - RNA, 19 nt, Leptospira interrogans serovar lai str. 56601
ugaguuucuugaacucaau

SEQ ID NO: 2790855 - RNA, 16 nt, Leptospira interrogans serovar lai str. 56601
ugaguuuuagaauauu

SEQ ID NO: 2790856 - RNA, 22 nt, Leptospira interrogans serovar lai str. 56601
ugaguuuuuguuugaaugucaa

SEQ ID NO: 2790857 - RNA, 19 nt, Leptospira interrogans serovar lai str. 56601
ugaguuuuuuaaaacgaac

SEQ ID NO: 2790858 - RNA, 14 nt, Leptospira interrogans serovar lai str. 56601
ugauaaaaaacgaa

SEQ ID NO: 2790859 - RNA, 23 nt, Leptospira interrogans serovar lai str. 56601
ugauaaaaaaucuuuaacaacau

SEQ ID NO: 2790860 - RNA, 22 nt, Leptospira interrogans serovar lai str. 56601
ugauaaaaccguuuuauaaaua

SEQ ID NO: 2790861 - RNA, 22 nt, Leptospira interrogans serovar lai str. 56601
ugauaaauuucauaucuaaaau

SEQ ID NO: 2790862 - RNA, 16 nt, Leptospira interrogans serovar lai str. 56601
ugauaacaaacuuuua

SEQ ID NO: 2790863 - RNA, 17 nt, Leptospira interrogans serovar lai str. 56601
ugauaacuauauaacaa

SEQ ID NO: 2790864 - RNA, 11 nt, Leptospira interrogans serovar lai str. 56601
ugauaauaauu

SEQ ID NO: 2790865 - RNA, 16 nt, Leptospira interrogans serovar lai str. 56601
ugauaaucaucaaaau

SEQ ID NO: 2790866 - RNA, 23 nt, Leptospira interrogans serovar lai str. 56601
ugauaauuauccuuaaaaugaaa

SEQ ID NO: 2790867 - RNA, 13 nt, Leptospira interrogans serovar lai str. 56601
ugauaauucuuua

SEQ ID NO: 2790868 - RNA, 15 nt, Leptospira interrogans serovar lai str. 56601
ugauaauucuuuaga

SEQ ID NO: 2790869 - RNA, 21 nt, Leptospira interrogans serovar lai str. 56601
ugauaauuucuaguuugaauu

SEQ ID NO: 2790870 - RNA, 11 nt, Leptospira interrogans serovar lai str. 56601
ugauaauuugu

SEQ ID NO: 2790871 - RNA, 15 nt, Leptospira interrogans serovar lai str. 56601
ugauaauuugugaac

SEQ ID NO: 2790872 - RNA, 18 nt, Leptospira interrogans serovar lai str. 56601
ugauaauuuuuuaaaaaa

SEQ ID NO: 2790873 - RNA, 22 nt, Leptospira interrogans serovar lai str. 56601
ugauacaauguuccuguggaaa

SEQ ID NO: 2790874 - RNA, 15 nt, Leptospira interrogans serovar lai str. 56601
ugauaccuaaugcua

SEQ ID NO: 2790875 - RNA, 14 nt, Leptospira interrogans serovar lai str. 56601
ugauacuuucggac

SEQ ID NO: 2790876 - RNA, 13 nt, Leptospira interrogans serovar lai str. 56601
ugauagaaacuaa

SEQ ID NO: 2790877 - RNA, 14 nt, Leptospira interrogans serovar lai str. 56601
ugauagagaaaaau

SEQ ID NO: 2790878 - RNA, 19 nt, Leptospira interrogans serovar lai str. 56601
ugauagagaaaaauuuucc

SEQ ID NO: 2790879 - RNA, 18 nt, Leptospira interrogans serovar lai str. 56601
ugauauaaucuuaauauu

SEQ ID NO: 2790880 - RNA, 21 nt, Leptospira interrogans serovar lai str. 56601
ugauauaccaguuaaauucau

SEQ ID NO: 2790881 - RNA, 12 nt, Leptospira interrogans serovar lai str. 56601
ugauauucaaau

SEQ ID NO: 2790882 - RNA, 18 nt, Leptospira interrogans serovar lai str. 56601
ugauauugcugucauaaa

SEQ ID NO: 2790883 - RNA, 23 nt, Leptospira interrogans serovar lai str. 56601
ugauauugcugucauaaaccgau

SEQ ID NO: 2790884 - RNA, 16 nt, Leptospira interrogans serovar lai str. 56601
ugauauuucauucuua

SEQ ID NO: 2790885 - RNA, 19 nt, Leptospira interrogans serovar lai str. 56601
ugauauuucuuaaauucua

SEQ ID NO: 2790886 - RNA, 21 nt, Leptospira interrogans serovar lai str. 56601
ugaucaauagaauuguugaaa

SEQ ID NO: 2790887 - RNA, 16 nt, Leptospira interrogans serovar lai str. 56601
ugaucagacugauauu

SEQ ID NO: 2790888 - RNA, 19 nt, Leptospira interrogans serovar lai str. 56601
ugaucagugauucgaaauu

SEQ ID NO: 2790889 - RNA, 15 nt, Leptospira interrogans serovar lai str. 56601
ugaucauauccgaaa

SEQ ID NO: 2790890 - RNA, 21 nt, Leptospira interrogans serovar lai str. 56601
ugauccaaacccaaugauucu

SEQ ID NO: 2790891 - RNA, 14 nt, Leptospira interrogans serovar lai str. 56601
ugaucgauuuuuua

SEQ ID NO: 2790892 - RNA, 15 nt, Leptospira interrogans serovar lai str. 56601
ugaucgcauaaaauu

SEQ ID NO: 2790893 - RNA, 22 nt, Leptospira interrogans serovar lai str. 56601
ugcaacuuugguuaucauaaaa

SEQ ID NO: 2790894 - RNA, 15 nt, Leptospira interrogans serovar lai str. 56601
ugcaaguaaaaagac

SEQ ID NO: 2790895 - RNA, 21 nt, Leptospira interrogans serovar lai str. 56601
ugcaauacauucuuauaaaga

SEQ ID NO: 2790896 - RNA, 16 nt, Leptospira interrogans serovar lai str. 56601
ugcaauauauugucuu

SEQ ID NO: 2790897 - RNA, 13 nt, Leptospira interrogans serovar lai str. 56601
ugcaauccaaagu

SEQ ID NO: 2790898 - RNA, 20 nt, Leptospira interrogans serovar lai str. 56601
ugcaauccaaaguucccgcc

SEQ ID NO: 2790899 - RNA, 16 nt, Leptospira interrogans serovar lai str. 56601
ugcaaucguccaaucu

SEQ ID NO: 2790900 - RNA, 12 nt, Leptospira interrogans serovar lai str. 56601
ugcaauuccuuc

SEQ ID NO: 2790901 - RNA, 17 nt, Leptospira interrogans serovar lai str. 56601
ugcaauuccuucggaau

SEQ ID NO: 2790902 - RNA, 17 nt, Leptospira interrogans serovar lai str. 56601
ugcaauucgcauuaaaa

SEQ ID NO: 2790903 - RNA, 21 nt, Leptospira interrogans serovar lai str. 56601
ugcaauucgcauuaaaauuuu

SEQ ID NO: 2790904 - RNA, 22 nt, Leptospira interrogans serovar lai str. 56601
ugcaauucgcauuaaaauuuuc

SEQ ID NO: 2790905 - RNA, 16 nt, Leptospira interrogans serovar lai str. 56601
ugcaauuuuacuuaua

SEQ ID NO: 2790906 - RNA, 16 nt, Leptospira interrogans serovar lai str. 56601
ugcaccaguuaaauca

SEQ ID NO: 2790907 - RNA, 15 nt, Leptospira interrogans serovar lai str. 56601
ugcagaaguauucca

SEQ ID NO: 2790908 - RNA, 15 nt, Leptospira interrogans serovar lai str. 56601
ugcagauagugcacu

SEQ ID NO: 2790909 - RNA, 14 nt, Leptospira interrogans serovar lai str. 56601
ugcagauuaaaaaa

SEQ ID NO: 2790910 - RNA, 14 nt, Leptospira interrogans serovar lai str. 56601
ugcagcuucuucca

SEQ ID NO: 2790911 - RNA, 18 nt, Leptospira interrogans serovar lai str. 56601
ugcagcuucuuccaaagu

SEQ ID NO: 2790912 - RNA, 14 nt, Leptospira interrogans serovar lai str. 56601
ugcaggaaacauaa

SEQ ID NO: 2790913 - RNA, 18 nt, Leptospira interrogans serovar lai str. 56601
ugcaguaaugccuacaaa

SEQ ID NO: 2790914 - RNA, 17 nt, Leptospira interrogans serovar lai str. 56601
ugcaguaguuccuacaa

SEQ ID NO: 2790915 - RNA, 22 nt, Leptospira interrogans serovar lai str. 56601
ugcaguaguuccuauaaauuca

SEQ ID NO: 2790916 - RNA, 11 nt, Leptospira interrogans serovar lai str. 56601
ugcauaaaauc

SEQ ID NO: 2790917 - RNA, 18 nt, Leptospira interrogans serovar lai str. 56601
ugcauacauagauaaauc

SEQ ID NO: 2790918 - RNA, 20 nt, Leptospira interrogans serovar lai str. 56601
ugcauacauagauaaauccg

SEQ ID NO: 2790919 - RNA, 19 nt, Leptospira interrogans serovar lai str. 56601
ugcauaguuuuaugugggu

SEQ ID NO: 2790920 - RNA, 21 nt, Leptospira interrogans serovar lai str. 56601
ugcauauuccuugagaaaagu

SEQ ID NO: 2790921 - RNA, 22 nt, Leptospira interrogans serovar lai str. 56601
ugcaucaaagaaacguuauaca

SEQ ID NO: 2790922 - RNA, 23 nt, Leptospira interrogans serovar lai str. 56601
ugcaucaaagaaacguuauacaa

SEQ ID NO: 2790923 - RNA, 12 nt, Leptospira interrogans serovar lai str. 56601
ugcauccacaaa

SEQ ID NO: 2790924 - RNA, 19 nt, Leptospira interrogans serovar lai str. 56601
ugcaucccagaacaaaacg

SEQ ID NO: 2790925 - RNA, 24 nt, Leptospira interrogans serovar lai str. 56601
ugcauccgucucagcaagucuauu

SEQ ID NO: 2790926 - RNA, 16 nt, Leptospira interrogans serovar lai str. 56601
ugcaucuuuucuaagg

SEQ ID NO: 2790927 - RNA, 13 nt, Leptospira interrogans serovar lai str. 56601
ugcauucaaaaag

SEQ ID NO: 2790928 - RNA, 22 nt, Leptospira interrogans serovar lai str. 56601
ugcauucaaaaaguuuuauaaa

SEQ ID NO: 2790929 - RNA, 13 nt, Leptospira interrogans serovar lai str. 56601
ugcauugaaauca

SEQ ID NO: 2790930 - RNA, 14 nt, Leptospira interrogans serovar lai str. 56601
ugcauugaaaucag

SEQ ID NO: 2790931 - RNA, 15 nt, Leptospira interrogans serovar lai str. 56601
ugcauugaaaucaga

SEQ ID NO: 2790932 - RNA, 14 nt, Leptospira interrogans serovar lai str. 56601
ugcauuuaauauau

SEQ ID NO: 2790933 - RNA, 15 nt, Leptospira interrogans serovar lai str. 56601
ugcauuuaauauauu

SEQ ID NO: 2790934 - RNA, 17 nt, Leptospira interrogans serovar lai str. 56601
ugcauuuuauuaaaaau

SEQ ID NO: 2790935 - RNA, 17 nt, Leptospira interrogans serovar lai str. 56601
ugcauuuuauuaaagaa

SEQ ID NO: 2790936 - RNA, 20 nt, Leptospira interrogans serovar lai str. 56601
ugccaaaagaacuuugagau

SEQ ID NO: 2790937 - RNA, 14 nt, Leptospira interrogans serovar lai str. 56601
ugccaaaaucccag

SEQ ID NO: 2790938 - RNA, 18 nt, Leptospira interrogans serovar lai str. 56601
ugccaauaauucuacgaa

SEQ ID NO: 2790939 - RNA, 17 nt, Leptospira interrogans serovar lai str. 56601
ugccauuuuucuucuuu

SEQ ID NO: 2790940 - RNA, 18 nt, Leptospira interrogans serovar lai str. 56601
ugccauuuuuuucuccuu

SEQ ID NO: 2790941 - RNA, 14 nt, Leptospira interrogans serovar lai str. 56601
ugcccaacgguaac

SEQ ID NO: 2790942 - RNA, 19 nt, Leptospira interrogans serovar lai str. 56601
ugcccagaguuuguuggug

SEQ ID NO: 2790943 - RNA, 22 nt, Leptospira interrogans serovar lai str. 56601
ugcccagaguuuguuggugagu

SEQ ID NO: 2790944 - RNA, 13 nt, Leptospira interrogans serovar lai str. 56601
ugccccaaaauuu

SEQ ID NO: 2790945 - RNA, 20 nt, Leptospira interrogans serovar lai str. 56601
ugcccgcgccuuuggacgaa

SEQ ID NO: 2790946 - RNA, 21 nt, Leptospira interrogans serovar lai str. 56601
ugccgcaacucgaauuguauc

SEQ ID NO: 2790947 - RNA, 14 nt, Leptospira interrogans serovar lai str. 56601
ugccgcacuuucag

SEQ ID NO: 2790948 - RNA, 13 nt, Leptospira interrogans serovar lai str. 56601
ugccguugauagu

SEQ ID NO: 2790949 - RNA, 15 nt, Leptospira interrogans serovar lai str. 56601
ugccguuuuucuaau

SEQ ID NO: 2790950 - RNA, 14 nt, Leptospira interrogans serovar lai str. 56601
ugccuaaauuccuu

SEQ ID NO: 2790951 - RNA, 20 nt, Leptospira interrogans serovar lai str. 56601
ugccuaaauuccuuccaagu

SEQ ID NO: 2790952 - RNA, 18 nt, Leptospira interrogans serovar lai str. 56601
ugccuacaaaucaaaucg

SEQ ID NO: 2790953 - RNA, 21 nt, Leptospira interrogans serovar lai str. 56601
ugccucuacaaguucauaaga

SEQ ID NO: 2790954 - RNA, 15 nt, Leptospira interrogans serovar lai str. 56601
ugccuucguuuaaaa

SEQ ID NO: 2790955 - RNA, 15 nt, Leptospira interrogans serovar lai str. 56601
ugccuuguucauaaa

SEQ ID NO: 2790956 - RNA, 15 nt, Leptospira interrogans serovar lai str. 56601
ugccuuucuuauuaa

SEQ ID NO: 2790957 - RNA, 22 nt, Leptospira interrogans serovar lai str. 56601
ugccuuuguauuaauuugaaua

SEQ ID NO: 2790958 - RNA, 21 nt, Leptospira interrogans serovar lai str. 56601
ugcgcugaguaguaaguuuuu

SEQ ID NO: 2790959 - RNA, 13 nt, Leptospira interrogans serovar lai str. 56601
ugcggagaauguu

SEQ ID NO: 2790960 - RNA, 20 nt, Leptospira interrogans serovar lai str. 56601
ugcgguaguucccacauuuu

SEQ ID NO: 2790961 - RNA, 15 nt, Leptospira interrogans serovar lai str. 56601
ugcguuuaaaaacag

SEQ ID NO: 2790962 - RNA, 14 nt, Leptospira interrogans serovar lai str. 56601
ugcguuuuuaaaca

SEQ ID NO: 2790963 - RNA, 19 nt, Leptospira interrogans serovar lai str. 56601
ugcuaaaauuuuuuuaaga

SEQ ID NO: 2790964 - RNA, 17 nt, Leptospira interrogans serovar lai str. 56601
ugcuaacugauuauaaa

SEQ ID NO: 2790965 - RNA, 22 nt, Leptospira interrogans serovar lai str. 56601
ugcuaacugauuauaaaaacaa

SEQ ID NO: 2790966 - RNA, 17 nt, Leptospira interrogans serovar lai str. 56601
ugcuauaaaaaggaucu

SEQ ID NO: 2790967 - RNA, 21 nt, Leptospira interrogans serovar lai str. 56601
ugcuauugaauccuuccucca

SEQ ID NO: 2790968 - RNA, 16 nt, Leptospira interrogans serovar lai str. 56601
ugcucaauaaauuaua

SEQ ID NO: 2790969 - RNA, 19 nt, Leptospira interrogans serovar lai str. 56601
ugcucacuaccuuauaaaa

SEQ ID NO: 2790970 - RNA, 20 nt, Leptospira interrogans serovar lai str. 56601
ugcucgaaaguucacaaauu

SEQ ID NO: 2790971 - RNA, 16 nt, Leptospira interrogans serovar lai str. 56601
ugcucggcuucuucaa

SEQ ID NO: 2790972 - RNA, 21 nt, Leptospira interrogans serovar lai str. 56601
ugcucuaaaauaauuuuuacu

SEQ ID NO: 2790973 - RNA, 16 nt, Leptospira interrogans serovar lai str. 56601
ugcucucgcaaugaaa

SEQ ID NO: 2790974 - RNA, 22 nt, Leptospira interrogans serovar lai str. 56601
ugcucuuaauggaucaaaagag

SEQ ID NO: 2790975 - RNA, 14 nt, Leptospira interrogans serovar lai str. 56601
ugcugaauuuaccu

SEQ ID NO: 2790976 - RNA, 18 nt, Leptospira interrogans serovar lai str. 56601
ugggaauuuuuuuguaua

SEQ ID NO: 2790977 - RNA, 18 nt, Leptospira interrogans serovar lai str. 56601
ugggacaaacucuuuauu

SEQ ID NO: 2790978 - RNA, 13 nt, Leptospira interrogans serovar lai str. 56601
ugggauaaauauu

SEQ ID NO: 2790979 - RNA, 14 nt, Leptospira interrogans serovar lai str. 56601
ugggauaaauauuc

SEQ ID NO: 2790980 - RNA, 18 nt, Leptospira interrogans serovar lai str. 56601
ugggaugauaccgaaaaa

SEQ ID NO: 2790981 - RNA, 19 nt, Leptospira interrogans serovar lai str. 56601
ugggauuugaauuuaaaac

SEQ ID NO: 2790982 - RNA, 13 nt, Leptospira interrogans serovar lai str. 56601
ugggcaaauuuag

SEQ ID NO: 2790983 - RNA, 17 nt, Leptospira interrogans serovar lai str. 56601
ugggcauaggaaauaau

SEQ ID NO: 2790984 - RNA, 22 nt, Leptospira interrogans serovar lai str. 56601
ugggcgugccucucgccaaaau

SEQ ID NO: 2790985 - RNA, 16 nt, Leptospira interrogans serovar lai str. 56601
ugggcucaaaaaggca

SEQ ID NO: 2790986 - RNA, 13 nt, Leptospira interrogans serovar lai str. 56601
ugggguuguuuca

SEQ ID NO: 2790987 - RNA, 12 nt, Leptospira interrogans serovar lai str. 56601
ugggguuuacua

SEQ ID NO: 2790988 - RNA, 21 nt, Leptospira interrogans serovar lai str. 56601
uggguaacgcgccguuugcaa

SEQ ID NO: 2790989 - RNA, 22 nt, Leptospira interrogans serovar lai str. 56601
uggguucuuuacgucaaacuca

SEQ ID NO: 2790990 - RNA, 15 nt, Leptospira interrogans serovar lai str. 56601
uggguuucuuaaauc

SEQ ID NO: 2790991 - RNA, 19 nt, Leptospira interrogans serovar lai str. 56601
uggguuuuacuaaaaaaca

SEQ ID NO: 2790992 - RNA, 21 nt, Leptospira interrogans serovar lai str. 56601
uggguuuuacuaaaaaacaua

SEQ ID NO: 2790993 - RNA, 13 nt, Leptospira interrogans serovar lai str. 56601
ugguaaaaauauc

SEQ ID NO: 2790994 - RNA, 21 nt, Leptospira interrogans serovar lai str. 56601
ugguaaaaauaucaguuucuc

SEQ ID NO: 2790995 - RNA, 20 nt, Leptospira interrogans serovar lai str. 56601
ugguagauugcuuuuuaaaa

SEQ ID NO: 2790996 - RNA, 21 nt, Leptospira interrogans serovar lai str. 56601
ugguaguucccacauuuaaau

SEQ ID NO: 2790997 - RNA, 20 nt, Leptospira interrogans serovar lai str. 56601
ugguauuuuagguauuucua

SEQ ID NO: 2790998 - RNA, 23 nt, Leptospira interrogans serovar lai str. 56601
ugguauuuuagguauuucuaaua

SEQ ID NO: 2790999 - RNA, 18 nt, Leptospira interrogans serovar lai str. 56601
uggucaacaucucaauca

SEQ ID NO: 2791000 - RNA, 19 nt, Leptospira interrogans serovar lai str. 56601
uggucaaguuauuguaaaa

SEQ ID NO: 2791001 - RNA, 16 nt, Leptospira interrogans serovar lai str. 56601
ugguccggaugcgagu

SEQ ID NO: 2791002 - RNA, 18 nt, Leptospira interrogans serovar lai str. 56601
uggugaacuauuuauaaa

SEQ ID NO: 2791003 - RNA, 14 nt, Leptospira interrogans serovar lai str. 56601
uggugauuuaaaaa

SEQ ID NO: 2791004 - RNA, 14 nt, Leptospira interrogans serovar lai str. 56601
ugguuauaccaaau

SEQ ID NO: 2791005 - RNA, 22 nt, Leptospira interrogans serovar lai str. 56601
ugguuaucauaaaaauaaagaa

SEQ ID NO: 2791006 - RNA, 22 nt, Leptospira interrogans serovar lai str. 56601
ugguugaguuuuuuaaaacgaa

SEQ ID NO: 2791007 - RNA, 15 nt, Leptospira interrogans serovar lai str. 56601
ugguugcaaaaaaga

SEQ ID NO: 2791008 - RNA, 21 nt, Leptospira interrogans serovar lai str. 56601
ugguuguggaugauuuuucua

SEQ ID NO: 2791009 - RNA, 14 nt, Leptospira interrogans serovar lai str. 56601
ugguuucaauuuaa

SEQ ID NO: 2791010 - RNA, 19 nt, Leptospira interrogans serovar lai str. 56601
ugguuuccgcuguaugaaa

SEQ ID NO: 2791011 - RNA, 22 nt, Leptospira interrogans serovar lai str. 56601
ugguuuuaaacgauuuaaaaga

SEQ ID NO: 2791012 - RNA, 15 nt, Leptospira interrogans serovar lai str. 56601
ugguuuucauucaaa

SEQ ID NO: 2791013 - RNA, 12 nt, Leptospira interrogans serovar lai str. 56601
ugguuuuuauua

SEQ ID NO: 2791014 - RNA, 20 nt, Leptospira interrogans serovar lai str. 56601
uguaaaaaaacaugaagaag

SEQ ID NO: 2791015 - RNA, 18 nt, Leptospira interrogans serovar lai str. 56601
uguaaaaaaauagaugga

SEQ ID NO: 2791016 - RNA, 21 nt, Leptospira interrogans serovar lai str. 56601
uguaaaaaaccgucccaaaau

SEQ ID NO: 2791017 - RNA, 13 nt, Leptospira interrogans serovar lai str. 56601
uguaaaaaaucau

SEQ ID NO: 2791018 - RNA, 23 nt, Leptospira interrogans serovar lai str. 56601
uguaaaaacuaccacaaaucuaa

SEQ ID NO: 2791019 - RNA, 14 nt, Leptospira interrogans serovar lai str. 56601
uguaaaaaugagua

SEQ ID NO: 2791020 - RNA, 21 nt, Leptospira interrogans serovar lai str. 56601
uguaaaacccaucguaaacaa

SEQ ID NO: 2791021 - RNA, 12 nt, Leptospira interrogans serovar lai str. 56601
uguaaaagaaaa

SEQ ID NO: 2791022 - RNA, 20 nt, Leptospira interrogans serovar lai str. 56601
uguaaaagaaaaauuaaaug

SEQ ID NO: 2791023 - RNA, 18 nt, Leptospira interrogans serovar lai str. 56601
uguaaaagcuuauacuuu

SEQ ID NO: 2791024 - RNA, 18 nt, Leptospira interrogans serovar lai str. 56601
uguaaaauggucuuuuag

SEQ ID NO: 2791025 - RNA, 20 nt, Leptospira interrogans serovar lai str. 56601
uguaaaauucagauuucagc

SEQ ID NO: 2791026 - RNA, 12 nt, Leptospira interrogans serovar lai str. 56601
uguaaaauuuaa

SEQ ID NO: 2791027 - RNA, 18 nt, Leptospira interrogans serovar lai str. 56601
uguaaaauuuaaauuugu

SEQ ID NO: 2791028 - RNA, 12 nt, Leptospira interrogans serovar lai str. 56601
uguaaaauuuag

SEQ ID NO: 2791029 - RNA, 16 nt, Leptospira interrogans serovar lai str. 56601
uguaaaauuuggauuu

SEQ ID NO: 2791030 - RNA, 20 nt, Leptospira interrogans serovar lai str. 56601
uguaaaauuuuuugaaguuu

SEQ ID NO: 2791031 - RNA, 12 nt, Leptospira interrogans serovar lai str. 56601
uguaaacuauua

SEQ ID NO: 2791032 - RNA, 19 nt, Leptospira interrogans serovar lai str. 56601
uguaaacuauuacguaaug

SEQ ID NO: 2791033 - RNA, 11 nt, Leptospira interrogans serovar lai str. 56601
uguaaacuucu

SEQ ID NO: 2791034 - RNA, 12 nt, Leptospira interrogans serovar lai str. 56601
uguaaacuucug

SEQ ID NO: 2791035 - RNA, 14 nt, Leptospira interrogans serovar lai str. 56601
uguaaacuugauua

SEQ ID NO: 2791036 - RNA, 15 nt, Leptospira interrogans serovar lai str. 56601
uguaaaguucuuuuc

SEQ ID NO: 2791037 - RNA, 15 nt, Leptospira interrogans serovar lai str. 56601
uguaaaguuuagauu

SEQ ID NO: 2791038 - RNA, 18 nt, Leptospira interrogans serovar lai str. 56601
uguaaauacaaaaugaau

SEQ ID NO: 2791039 - RNA, 18 nt, Leptospira interrogans serovar lai str. 56601
uguaaauccguauacuuu

SEQ ID NO: 2791040 - RNA, 21 nt, Leptospira interrogans serovar lai str. 56601
uguaaauccguauacuuuaaa

SEQ ID NO: 2791041 - RNA, 17 nt, Leptospira interrogans serovar lai str. 56601
uguaaaugaauuggaaa

SEQ ID NO: 2791042 - RNA, 19 nt, Leptospira interrogans serovar lai str. 56601
uguaaaugaauuuagaaaa

SEQ ID NO: 2791043 - RNA, 18 nt, Leptospira interrogans serovar lai str. 56601
uguaaauucaaagcaaga

SEQ ID NO: 2791044 - RNA, 19 nt, Leptospira interrogans serovar lai str. 56601
uguaacuacugcauucuua

SEQ ID NO: 2791045 - RNA, 21 nt, Leptospira interrogans serovar lai str. 56601
uguaacuacugcauucuuaga

SEQ ID NO: 2791046 - RNA, 16 nt, Leptospira interrogans serovar lai str. 56601
uguaagaaaaacuagg

SEQ ID NO: 2791047 - RNA, 14 nt, Leptospira interrogans serovar lai str. 56601
uguaagaaaauauu

SEQ ID NO: 2791048 - RNA, 16 nt, Leptospira interrogans serovar lai str. 56601
uguaagaguuccacau

SEQ ID NO: 2791049 - RNA, 22 nt, Leptospira interrogans serovar lai str. 56601
uguaagauuucguucggaaaaa

SEQ ID NO: 2791050 - RNA, 17 nt, Leptospira interrogans serovar lai str. 56601
uguaaggaauucauaau

SEQ ID NO: 2791051 - RNA, 19 nt, Leptospira interrogans serovar lai str. 56601
uguaaguaucuaaaaguuu

SEQ ID NO: 2791052 - RNA, 16 nt, Leptospira interrogans serovar lai str. 56601
uguaaguuuugaauuu

SEQ ID NO: 2791053 - RNA, 15 nt, Leptospira interrogans serovar lai str. 56601
uguaauaaaaauuua

SEQ ID NO: 2791054 - RNA, 16 nt, Leptospira interrogans serovar lai str. 56601
uguaauaaaaauuuaa

SEQ ID NO: 2791055 - RNA, 15 nt, Leptospira interrogans serovar lai str. 56601
uguaauaguucccac

SEQ ID NO: 2791056 - RNA, 13 nt, Leptospira interrogans serovar lai str. 56601
uguaauaguuccu

SEQ ID NO: 2791057 - RNA, 21 nt, Leptospira interrogans serovar lai str. 56601
uguaauauacaauaaauagaa

SEQ ID NO: 2791058 - RNA, 16 nt, Leptospira interrogans serovar lai str. 56601
uguaaucuguggacuu

SEQ ID NO: 2791059 - RNA, 20 nt, Leptospira interrogans serovar lai str. 56601
ugugaacucggcguaagaaa

SEQ ID NO: 2791060 - RNA, 22 nt, Leptospira interrogans serovar lai str. 56601
ugugaaucaaaagguauaaaau

SEQ ID NO: 2791061 - RNA, 15 nt, Leptospira interrogans serovar lai str. 56601
ugugaauucagaaaa

SEQ ID NO: 2791062 - RNA, 16 nt, Leptospira interrogans serovar lai str. 56601
ugugaauucagaaaaa

SEQ ID NO: 2791063 - RNA, 22 nt, Leptospira interrogans serovar lai str. 56601
ugugacuuaaucugugggaacu

SEQ ID NO: 2791064 - RNA, 20 nt, Leptospira interrogans serovar lai str. 56601
ugugacuuccugauuuggaa

SEQ ID NO: 2791065 - RNA, 19 nt, Leptospira interrogans serovar lai str. 56601
ugugagaguuccacauuuu

SEQ ID NO: 2791066 - RNA, 13 nt, Leptospira interrogans serovar lai str. 56601
ugugagaguuccc

SEQ ID NO: 2791067 - RNA, 21 nt, Leptospira interrogans serovar lai str. 56601
ugugauaaagagucgauuagc

SEQ ID NO: 2791068 - RNA, 20 nt, Leptospira interrogans serovar lai str. 56601
ugugaucagaauuaaaaauu

SEQ ID NO: 2791069 - RNA, 17 nt, Leptospira interrogans serovar lai str. 56601
ugugcaaaaauuuuuua

SEQ ID NO: 2791070 - RNA, 18 nt, Leptospira interrogans serovar lai str. 56601
ugugcaaaggaguauuuu

SEQ ID NO: 2791071 - RNA, 16 nt, Leptospira interrogans serovar lai str. 56601
ugugccuucguuuaaa

SEQ ID NO: 2791072 - RNA, 19 nt, Leptospira interrogans serovar lai str. 56601
ugugccuucguuuaaaaaa

SEQ ID NO: 2791073 - RNA, 17 nt, Leptospira interrogans serovar lai str. 56601
ugugcuauauucaaaaa

SEQ ID NO: 2791074 - RNA, 16 nt, Leptospira interrogans serovar lai str. 56601
uguggauaccuuuagu

SEQ ID NO: 2791075 - RNA, 20 nt, Leptospira interrogans serovar lai str. 56601
uguggauaccuuuaguuuuu

SEQ ID NO: 2791076 - RNA, 15 nt, Leptospira interrogans serovar lai str. 56601
uguggaugauuuuuc

SEQ ID NO: 2791077 - RNA, 15 nt, Leptospira interrogans serovar lai str. 56601
ugugggaacuaccac

SEQ ID NO: 2791078 - RNA, 20 nt, Leptospira interrogans serovar lai str. 56601
ugugggaacuaccacaaaac

SEQ ID NO: 2791079 - RNA, 19 nt, Leptospira interrogans serovar lai str. 56601
ugugggaacuauaauaaca

SEQ ID NO: 2791080 - RNA, 15 nt, Leptospira interrogans serovar lai str. 56601
ugugggaacuaucac

SEQ ID NO: 2791081 - RNA, 14 nt, Leptospira interrogans serovar lai str. 56601
ugugggaacucaca

SEQ ID NO: 2791082 - RNA, 20 nt, Leptospira interrogans serovar lai str. 56601
ugugggaacucacacaaaau

SEQ ID NO: 2791083 - RNA, 21 nt, Leptospira interrogans serovar lai str. 56601
ugugggaacucccacaauuua

SEQ ID NO: 2791084 - RNA, 20 nt, Leptospira interrogans serovar lai str. 56601
ugugggaacucccacuuuua

SEQ ID NO: 2791085 - RNA, 23 nt, Leptospira interrogans serovar lai str. 56601
ugugggaacucccacuuuuaaag

SEQ ID NO: 2791086 - RNA, 21 nt, Leptospira interrogans serovar lai str. 56601
ugugggaacucucacaaauca

SEQ ID NO: 2791087 - RNA, 20 nt, Leptospira interrogans serovar lai str. 56601
ugugggaacucuuacauuuu

SEQ ID NO: 2791088 - RNA, 20 nt, Leptospira interrogans serovar lai str. 56601
ugugggaguucccacauuua

SEQ ID NO: 2791089 - RNA, 20 nt, Leptospira interrogans serovar lai str. 56601
ugugggaguuuucacauuuu

SEQ ID NO: 2791090 - RNA, 16 nt, Leptospira interrogans serovar lai str. 56601
uguggucaacaucuca

SEQ ID NO: 2791091 - RNA, 15 nt, Leptospira interrogans serovar lai str. 56601
ugugucaagcccucc

SEQ ID NO: 2791092 - RNA, 12 nt, Leptospira interrogans serovar lai str. 56601
ugugucccaaaa

SEQ ID NO: 2791093 - RNA, 16 nt, Leptospira interrogans serovar lai str. 56601
uguguugaaucuuaaa

SEQ ID NO: 2791094 - RNA, 13 nt, Leptospira interrogans serovar lai str. 56601
uguguuucuaauu

SEQ ID NO: 2791095 - RNA, 19 nt, Leptospira interrogans serovar lai str. 56601
uguguuuuuucuuuaaaau

SEQ ID NO: 2791096 - RNA, 18 nt, Leptospira interrogans serovar lai str. 56601
uguuaaaaaacuauaaau

SEQ ID NO: 2791097 - RNA, 14 nt, Leptospira interrogans serovar lai str. 56601
uguuaaaaaauuaa

SEQ ID NO: 2791098 - RNA, 22 nt, Leptospira interrogans serovar lai str. 56601
uguuaaacuagauuauugaucu

SEQ ID NO: 2791099 - RNA, 14 nt, Leptospira interrogans serovar lai str. 56601
uguuaagauaaauu

SEQ ID NO: 2791100 - RNA, 23 nt, Leptospira interrogans serovar lai str. 56601
uguuaaucgccgcuauggaauuu

SEQ ID NO: 2791101 - RNA, 23 nt, Leptospira interrogans serovar lai str. 56601
uguuaauuguuguuauggaauuu

SEQ ID NO: 2791102 - RNA, 15 nt, Leptospira interrogans serovar lai str. 56601
uguuaauuuugaacu

SEQ ID NO: 2791103 - RNA, 22 nt, Leptospira interrogans serovar lai str. 56601
uguuaauuuuuauuggaaaaag

SEQ ID NO: 2791104 - RNA, 20 nt, Leptospira interrogans serovar lai str. 56601
uguuacgguaauauauucaa

SEQ ID NO: 2791105 - RNA, 20 nt, Leptospira interrogans serovar lai str. 56601
uguuagauucuauuuucuuu

SEQ ID NO: 2791106 - RNA, 12 nt, Leptospira interrogans serovar lai str. 56601
uguuaguuccca

SEQ ID NO: 2791107 - RNA, 14 nt, Leptospira interrogans serovar lai str. 56601
uguuaguuugcaau

SEQ ID NO: 2791108 - RNA, 14 nt, Leptospira interrogans serovar lai str. 56601
uguuauaaaaugua

SEQ ID NO: 2791109 - RNA, 16 nt, Leptospira interrogans serovar lai str. 56601
uguuauaaaccaauaa

SEQ ID NO: 2791110 - RNA, 15 nt, Leptospira interrogans serovar lai str. 56601
uguuauaaacuucua

SEQ ID NO: 2791111 - RNA, 12 nt, Leptospira interrogans serovar lai str. 56601
uguuaugcaaau

SEQ ID NO: 2791112 - RNA, 15 nt, Leptospira interrogans serovar lai str. 56601
uguuaugcaaauaca

SEQ ID NO: 2791113 - RNA, 17 nt, Leptospira interrogans serovar lai str. 56601
uguuauggaauuuuuca

SEQ ID NO: 2791114 - RNA, 21 nt, Leptospira interrogans serovar lai str. 56601
uguuauggcaggaucaaaauc

SEQ ID NO: 2791115 - RNA, 21 nt, Leptospira interrogans serovar lai str. 56601
uguuauucagagcuauaacac

SEQ ID NO: 2791116 - RNA, 15 nt, Leptospira interrogans serovar lai str. 56601
uguuauuuuguauaa

SEQ ID NO: 2791117 - RNA, 16 nt, Leptospira interrogans serovar lai str. 56601
uguuauuuuugcacaa

SEQ ID NO: 2791118 - RNA, 13 nt, Leptospira interrogans serovar lai str. 56601
uguucaaaauuua

SEQ ID NO: 2791119 - RNA, 14 nt, Leptospira interrogans serovar lai str. 56601
uguucaaaauuuau

SEQ ID NO: 2791120 - RNA, 12 nt, Leptospira interrogans serovar lai str. 56601
uguucaaagaaa

SEQ ID NO: 2791121 - RNA, 14 nt, Leptospira interrogans serovar lai str. 56601
uguucaaagaaaug

SEQ ID NO: 2791122 - RNA, 18 nt, Leptospira interrogans serovar lai str. 56601
uguucaguguaagauuaa

SEQ ID NO: 2791123 - RNA, 12 nt, Leptospira interrogans serovar lai str. 56601
uguucauaaaaa

SEQ ID NO: 2791124 - RNA, 18 nt, Leptospira interrogans serovar lai str. 56601
uguucaucguuccaaacc

SEQ ID NO: 2791125 - RNA, 21 nt, Leptospira interrogans serovar lai str. 56601
uguucauucuuuaaaauagaa

SEQ ID NO: 2791126 - RNA, 15 nt, Leptospira interrogans serovar lai str. 56601
uguuccaaaaacuca

SEQ ID NO: 2791127 - RNA, 18 nt, Leptospira interrogans serovar lai str. 56601
uguuccaaaaccucaaaa

SEQ ID NO: 2791128 - RNA, 23 nt, Leptospira interrogans serovar lai str. 56601
uguuccaaaaccucaaaaaauuu

SEQ ID NO: 2791129 - RNA, 13 nt, Leptospira interrogans serovar lai str. 56601
uguuccaaagcca

SEQ ID NO: 2791130 - RNA, 18 nt, Leptospira interrogans serovar lai str. 56601
uguuccaaaguuauugaa

SEQ ID NO: 2791131 - RNA, 22 nt, Leptospira interrogans serovar lai str. 56601
uguuccaagaccucaaauaacu

SEQ ID NO: 2791132 - RNA, 20 nt, Leptospira interrogans serovar lai str. 56601
uguuccgacaagaaugaguc

SEQ ID NO: 2791133 - RNA, 16 nt, Leptospira interrogans serovar lai str. 56601
uguuccuauaaaugug

SEQ ID NO: 2791134 - RNA, 19 nt, Leptospira interrogans serovar lai str. 56601
uguuccuauaaauguggua

SEQ ID NO: 2791135 - RNA, 14 nt, Leptospira interrogans serovar lai str. 56601
uguucguucccaca

SEQ ID NO: 2791136 - RNA, 11 nt, Leptospira interrogans serovar lai str. 56601
uguucuaaauu

SEQ ID NO: 2791137 - RNA, 14 nt, Leptospira interrogans serovar lai str. 56601
uguucuaaauugaa

SEQ ID NO: 2791138 - RNA, 22 nt, Leptospira interrogans serovar lai str. 56601
uguucuacggcuuguauuuuau

SEQ ID NO: 2791139 - RNA, 14 nt, Leptospira interrogans serovar lai str. 56601
uguucuuaaaauug

SEQ ID NO: 2791140 - RNA, 14 nt, Leptospira interrogans serovar lai str. 56601
uguucuugugggaa

SEQ ID NO: 2791141 - RNA, 15 nt, Leptospira interrogans serovar lai str. 56601
uguucuuuuauauaa

SEQ ID NO: 2791142 - RNA, 17 nt, Leptospira interrogans serovar lai str. 56601
uuaaaaauauaaaucaa

SEQ ID NO: 2791143 - RNA, 22 nt, Leptospira interrogans serovar lai str. 56601
uuaaaaauucaacuaaauccuu

SEQ ID NO: 2791144 - RNA, 16 nt, Leptospira interrogans serovar lai str. 56601
uuaaaaauucuuaaua

SEQ ID NO: 2791145 - RNA, 15 nt, Leptospira interrogans serovar lai str. 56601
uuaaaaauuuaauuu

SEQ ID NO: 2791146 - RNA, 15 nt, Leptospira interrogans serovar lai str. 56601
uuaaaaauuuauaaa

SEQ ID NO: 2791147 - RNA, 16 nt, Leptospira interrogans serovar lai str. 56601
uuaaaaauuuccuuuu

SEQ ID NO: 2791148 - RNA, 18 nt, Leptospira interrogans serovar lai str. 56601
uuaaaaauuuuauuaaau

SEQ ID NO: 2791149 - RNA, 13 nt, Leptospira interrogans serovar lai str. 56601
uuaaaacauuucg

SEQ ID NO: 2791150 - RNA, 17 nt, Leptospira interrogans serovar lai str. 56601
uuaaaacgaauugauaa

SEQ ID NO: 2791151 - RNA, 19 nt, Leptospira interrogans serovar lai str. 56601
uuaaaacucacaucucuuu

SEQ ID NO: 2791152 - RNA, 19 nt, Leptospira interrogans serovar lai str. 56601
uuaaaacuuuuaauuuaga

SEQ ID NO: 2791153 - RNA, 18 nt, Leptospira interrogans serovar lai str. 56601
uuaaaagaaacuuaauaa

SEQ ID NO: 2791154 - RNA, 20 nt, Leptospira interrogans serovar lai str. 56601
uuaaaagaauauuucuaaaa

SEQ ID NO: 2791155 - RNA, 20 nt, Leptospira interrogans serovar lai str. 56601
uuaaaagagcgaaaugcaga

SEQ ID NO: 2791156 - RNA, 16 nt, Leptospira interrogans serovar lai str. 56601
uuaaaagccagaauuu

SEQ ID NO: 2791157 - RNA, 22 nt, Leptospira interrogans serovar lai str. 56601
uuaaaagccauuucaaaaauau

SEQ ID NO: 2791158 - RNA, 15 nt, Leptospira interrogans serovar lai str. 56601
uuaaaaggguuuuua

SEQ ID NO: 2791159 - RNA, 18 nt, Leptospira interrogans serovar lai str. 56601
uuaaaaggguuuuuacaa

SEQ ID NO: 2791160 - RNA, 22 nt, Leptospira interrogans serovar lai str. 56601
uuaaaaguagaaucaucucaaa

SEQ ID NO: 2791161 - RNA, 18 nt, Leptospira interrogans serovar lai str. 56601
uuaaaagugauuuaaguu

SEQ ID NO: 2791162 - RNA, 16 nt, Leptospira interrogans serovar lai str. 56601
uuaaaaguuugauuuc

SEQ ID NO: 2791163 - RNA, 13 nt, Leptospira interrogans serovar lai str. 56601
uuaaaauaacgug

SEQ ID NO: 2791164 - RNA, 13 nt, Leptospira interrogans serovar lai str. 56601
uuaaaaucacaaa

SEQ ID NO: 2791165 - RNA, 15 nt, Leptospira interrogans serovar lai str. 56601
uuaaaaucacaaaaa

SEQ ID NO: 2791166 - RNA, 21 nt, Leptospira interrogans serovar lai str. 56601
uuaaaaucacaaaaaagauaa

SEQ ID NO: 2791167 - RNA, 17 nt, Leptospira interrogans serovar lai str. 56601
uuaaaauccucaacaga

SEQ ID NO: 2791168 - RNA, 20 nt, Leptospira interrogans serovar lai str. 56601
uuaaaaucguaaaaaagaua

SEQ ID NO: 2791169 - RNA, 21 nt, Leptospira interrogans serovar lai str. 56601
uuaaaaucguaaaaaagauaa

SEQ ID NO: 2791170 - RNA, 23 nt, Leptospira interrogans serovar lai str. 56601
uuaaaaucguaaaaaagauaaaa

SEQ ID NO: 2791171 - RNA, 12 nt, Leptospira interrogans serovar lai str. 56601
uuaaaauguagg

SEQ ID NO: 2791172 - RNA, 14 nt, Leptospira interrogans serovar lai str. 56601
uuaaaauguaggaa

SEQ ID NO: 2791173 - RNA, 18 nt, Leptospira interrogans serovar lai str. 56601
uuaaaauuaaugaauaac

SEQ ID NO: 2791174 - RNA, 21 nt, Leptospira interrogans serovar lai str. 56601
uuaaaauuagauuuauugaaa

SEQ ID NO: 2791175 - RNA, 18 nt, Leptospira interrogans serovar lai str. 56601
uuaaaauucuagaaagaa

SEQ ID NO: 2791176 - RNA, 15 nt, Leptospira interrogans serovar lai str. 56601
uuaaaauugcagaau

SEQ ID NO: 2791177 - RNA, 20 nt, Leptospira interrogans serovar lai str. 56601
uuaaaauuuacggaacuuaa

SEQ ID NO: 2791178 - RNA, 14 nt, Leptospira interrogans serovar lai str. 56601
uuaaaauuuagaaa

SEQ ID NO: 2791179 - RNA, 22 nt, Leptospira interrogans serovar lai str. 56601
uuaaaauuucccgauucucaaa

SEQ ID NO: 2791180 - RNA, 13 nt, Leptospira interrogans serovar lai str. 56601
uuaaacaaagaca

SEQ ID NO: 2791181 - RNA, 19 nt, Leptospira interrogans serovar lai str. 56601
uuaaacaacaguacaagaa

SEQ ID NO: 2791182 - RNA, 18 nt, Leptospira interrogans serovar lai str. 56601
uuaaacagagauaggaau

SEQ ID NO: 2791183 - RNA, 19 nt, Leptospira interrogans serovar lai str. 56601
uuaaaccgguaaaaaguaa

SEQ ID NO: 2791184 - RNA, 17 nt, Leptospira interrogans serovar lai str. 56601
uuaaacgaucagaaaaa

SEQ ID NO: 2791185 - RNA, 18 nt, Leptospira interrogans serovar lai str. 56601
uuaaacgaucagaaaaac

SEQ ID NO: 2791186 - RNA, 20 nt, Leptospira interrogans serovar lai str. 56601
uuaaacgaucagaaaaacaa

SEQ ID NO: 2791187 - RNA, 14 nt, Leptospira interrogans serovar lai str. 56601
uuaaacguauaaaa

SEQ ID NO: 2791188 - RNA, 15 nt, Leptospira interrogans serovar lai str. 56601
uuaaacguauaaaaa

SEQ ID NO: 2791189 - RNA, 17 nt, Leptospira interrogans serovar lai str. 56601
uuaaacguauaaaaaca

SEQ ID NO: 2791190 - RNA, 22 nt, Leptospira interrogans serovar lai str. 56601
uuaaacguuuauuucaaaauuu

SEQ ID NO: 2791191 - RNA, 22 nt, Leptospira interrogans serovar lai str. 56601
uuaaacuauagagaaauccaau

SEQ ID NO: 2791192 - RNA, 15 nt, Leptospira interrogans serovar lai str. 56601
uuaaacucauucuag

SEQ ID NO: 2791193 - RNA, 16 nt, Leptospira interrogans serovar lai str. 56601
uuaaacuucaaaaaau

SEQ ID NO: 2791194 - RNA, 17 nt, Leptospira interrogans serovar lai str. 56601
uuaaacuucaaaaaaua

SEQ ID NO: 2791195 - RNA, 20 nt, Leptospira interrogans serovar lai str. 56601
uuaaacuucaaaaaauauag

SEQ ID NO: 2791196 - RNA, 14 nt, Leptospira interrogans serovar lai str. 56601
uuaaacuuugaaaa

SEQ ID NO: 2791197 - RNA, 18 nt, Leptospira interrogans serovar lai str. 56601
uuaaacuuugaaaauugu

SEQ ID NO: 2791198 - RNA, 18 nt, Leptospira interrogans serovar lai str. 56601
uuaaacuuuuauaaaauc

SEQ ID NO: 2791199 - RNA, 21 nt, Leptospira interrogans serovar lai str. 56601
uuaaacuuuuauaaaaucuaa

SEQ ID NO: 2791200 - RNA, 12 nt, Leptospira interrogans serovar lai str. 56601
uuaaagaaacuc

SEQ ID NO: 2791201 - RNA, 20 nt, Leptospira interrogans serovar lai str. 56601
uuaaagaagagccucaagua

SEQ ID NO: 2791202 - RNA, 22 nt, Leptospira interrogans serovar lai str. 56601
uuaaagacgauuccuaaaaauu

SEQ ID NO: 2791203 - RNA, 16 nt, Leptospira interrogans serovar lai str. 56601
uuaaagauuugcucuu

SEQ ID NO: 2791204 - RNA, 15 nt, Leptospira interrogans serovar lai str. 56601
uuaaagcauuaaaaa

SEQ ID NO: 2791205 - RNA, 20 nt, Leptospira interrogans serovar lai str. 56601
uuaaagcauuaaaaaagaua

SEQ ID NO: 2791206 - RNA, 19 nt, Leptospira interrogans serovar lai str. 56601
uuaaaguaguuucgccaau

SEQ ID NO: 2791207 - RNA, 19 nt, Leptospira interrogans serovar lai str. 56601
uuaaaguauuaauuuaauc

SEQ ID NO: 2791208 - RNA, 16 nt, Leptospira interrogans serovar lai str. 56601
uuaaaguuguugaaaa

SEQ ID NO: 2791209 - RNA, 18 nt, Leptospira interrogans serovar lai str. 56601
uuaaaguuuacaucaaaa

SEQ ID NO: 2791210 - RNA, 12 nt, Leptospira interrogans serovar lai str. 56601
uuaaauaaaaag

SEQ ID NO: 2791211 - RNA, 18 nt, Leptospira interrogans serovar lai str. 56601
uuaaauaaagguuuuaua

SEQ ID NO: 2791212 - RNA, 15 nt, Leptospira interrogans serovar lai str. 56601
uuaaauacacucuuu

SEQ ID NO: 2791213 - RNA, 21 nt, Leptospira interrogans serovar lai str. 56601
uuaaauacacucuuucaaugu

SEQ ID NO: 2791214 - RNA, 20 nt, Leptospira interrogans serovar lai str. 56601
uuaaauagaaaccaguaaua

SEQ ID NO: 2791215 - RNA, 23 nt, Leptospira interrogans serovar lai str. 56601
uuaaauagagcuuuguaauaaaa

SEQ ID NO: 2791216 - RNA, 22 nt, Leptospira interrogans serovar lai str. 56601
uuaaauaucgaauuucuucaua

SEQ ID NO: 2791217 - RNA, 18 nt, Leptospira interrogans serovar lai str. 56601
uuaaauauuaauuauaug

SEQ ID NO: 2791218 - RNA, 21 nt, Leptospira interrogans serovar lai str. 56601
uuaaauccaacuuaaaacugu

SEQ ID NO: 2791219 - RNA, 20 nt, Leptospira interrogans serovar lai str. 56601
uuaaaucccauuuuaacgug

SEQ ID NO: 2791220 - RNA, 14 nt, Leptospira interrogans serovar lai str. 56601
uuaaaucuuuaaaa

SEQ ID NO: 2791221 - RNA, 23 nt, Leptospira interrogans serovar lai str. 56601
uuaaauguauguuuacuugaaaa

SEQ ID NO: 2791222 - RNA, 22 nt, Leptospira interrogans serovar lai str. 56601
uuaaaugugcgggaacucuuuc

SEQ ID NO: 2791223 - RNA, 17 nt, Leptospira interrogans serovar lai str. 56601
uuaaaugugggaacuaa

SEQ ID NO: 2791224 - RNA, 22 nt, Leptospira interrogans serovar lai str. 56601
uuaauauacaaaacauuccaau

SEQ ID NO: 2791225 - RNA, 14 nt, Leptospira interrogans serovar lai str. 56601
uuaauauacuaaaa

SEQ ID NO: 2791226 - RNA, 15 nt, Leptospira interrogans serovar lai str. 56601
uuaauauuauuaaau

SEQ ID NO: 2791227 - RNA, 17 nt, Leptospira interrogans serovar lai str. 56601
uuaauauuauuaaauuu

SEQ ID NO: 2791228 - RNA, 18 nt, Leptospira interrogans serovar lai str. 56601
uuaauauuuauaaaacaa

SEQ ID NO: 2791229 - RNA, 15 nt, Leptospira interrogans serovar lai str. 56601
uuaauauuuauaaua

SEQ ID NO: 2791230 - RNA, 15 nt, Leptospira interrogans serovar lai str. 56601
uuaauauuucgaugu

SEQ ID NO: 2791231 - RNA, 18 nt, Leptospira interrogans serovar lai str. 56601
uuaaucagauuuuugcac

SEQ ID NO: 2791232 - RNA, 17 nt, Leptospira interrogans serovar lai str. 56601
uuaaucaugugaauuca

SEQ ID NO: 2791233 - RNA, 21 nt, Leptospira interrogans serovar lai str. 56601
uuaaucaugugaauucagaaa

SEQ ID NO: 2791234 - RNA, 23 nt, Leptospira interrogans serovar lai str. 56601
uuaaucaugugaauucagaaaaa

SEQ ID NO: 2791235 - RNA, 14 nt, Leptospira interrogans serovar lai str. 56601
uuaaucggaacuag

SEQ ID NO: 2791236 - RNA, 17 nt, Leptospira interrogans serovar lai str. 56601
uuaaucuaagauccaaa

SEQ ID NO: 2791237 - RNA, 19 nt, Leptospira interrogans serovar lai str. 56601
uuaaucugcugaauuuacc

SEQ ID NO: 2791238 - RNA, 12 nt, Leptospira interrogans serovar lai str. 56601
uuaaucuguaaa

SEQ ID NO: 2791239 - RNA, 13 nt, Leptospira interrogans serovar lai str. 56601
uuaaucuuuuuua

SEQ ID NO: 2791240 - RNA, 16 nt, Leptospira interrogans serovar lai str. 56601
uuaaugcgaaaauuua

SEQ ID NO: 2791241 - RNA, 16 nt, Leptospira interrogans serovar lai str. 56601
uuaaugcugauuuuuc

SEQ ID NO: 2791242 - RNA, 23 nt, Leptospira interrogans serovar lai str. 56601
uuaauguaaaguucuuuucuuaa

SEQ ID NO: 2791243 - RNA, 23 nt, Leptospira interrogans serovar lai str. 56601
uuaauuaaaaaaucauauccaau

SEQ ID NO: 2791244 - RNA, 15 nt, Leptospira interrogans serovar lai str. 56601
uuaauuaaguaguuu

SEQ ID NO: 2791245 - RNA, 17 nt, Leptospira interrogans serovar lai str. 56601
uuaauuacaguuaauaa

SEQ ID NO: 2791246 - RNA, 13 nt, Leptospira interrogans serovar lai str. 56601
uuaauucuaaauc

SEQ ID NO: 2791247 - RNA, 12 nt, Leptospira interrogans serovar lai str. 56601
uuaauucuccau

SEQ ID NO: 2791248 - RNA, 19 nt, Leptospira interrogans serovar lai str. 56601
uuaauugcgguaguuccca

SEQ ID NO: 2791249 - RNA, 15 nt, Leptospira interrogans serovar lai str. 56601
uuaauuguuauaaac

SEQ ID NO: 2791250 - RNA, 12 nt, Leptospira interrogans serovar lai str. 56601
uuaauuuaaaaa

SEQ ID NO: 2791251 - RNA, 15 nt, Leptospira interrogans serovar lai str. 56601
uuaauuuaaaaacaa

SEQ ID NO: 2791252 - RNA, 17 nt, Leptospira interrogans serovar lai str. 56601
uuaauuuagaauaaaaa

SEQ ID NO: 2791253 - RNA, 17 nt, Leptospira interrogans serovar lai str. 56601
uuaauuucuaaacaauu

SEQ ID NO: 2791254 - RNA, 16 nt, Leptospira interrogans serovar lai str. 56601
uuaauuucucuuauua

SEQ ID NO: 2791255 - RNA, 23 nt, Leptospira interrogans serovar lai str. 56601
uuaauuucucuuauuagaacuca

SEQ ID NO: 2791256 - RNA, 14 nt, Leptospira interrogans serovar lai str. 56601
uuaauuucuucaua

SEQ ID NO: 2791257 - RNA, 19 nt, Leptospira interrogans serovar lai str. 56601
uuaauuucuucauaucaaa

SEQ ID NO: 2791258 - RNA, 23 nt, Leptospira interrogans serovar lai str. 56601
uuaauuugaucaucguuauauuu

SEQ ID NO: 2791259 - RNA, 19 nt, Leptospira interrogans serovar lai str. 56601
uuaauuuguaagaguucca

SEQ ID NO: 2791260 - RNA, 20 nt, Leptospira interrogans serovar lai str. 56601
uuaauuuguuuggauucucc

SEQ ID NO: 2791261 - RNA, 23 nt, Leptospira interrogans serovar lai str. 56601
uuaauuuguuuggauucuccauc

SEQ ID NO: 2791262 - RNA, 13 nt, Leptospira interrogans serovar lai str. 56601
uuaauuuuaaaga

SEQ ID NO: 2791263 - RNA, 15 nt, Leptospira interrogans serovar lai str. 56601
uuaauuuuaguaaaa

SEQ ID NO: 2791264 - RNA, 12 nt, Leptospira interrogans serovar lai str. 56601
uuaauuuuauuu

SEQ ID NO: 2791265 - RNA, 18 nt, Leptospira interrogans serovar lai str. 56601
uuaauuuuccuauuuucg

SEQ ID NO: 2791266 - RNA, 19 nt, Leptospira interrogans serovar lai str. 56601
uuaauuuucgauuuaauau

SEQ ID NO: 2791267 - RNA, 22 nt, Leptospira interrogans serovar lai str. 56601
uuaauuuucgauuuaauauauu

SEQ ID NO: 2791268 - RNA, 21 nt, Leptospira interrogans serovar lai str. 56601
uuaauuuuguaggaauuagua

SEQ ID NO: 2791269 - RNA, 15 nt, Leptospira interrogans serovar lai str. 56601
uuaauuuuuagaaga

SEQ ID NO: 2791270 - RNA, 17 nt, Leptospira interrogans serovar lai str. 56601
uuaauuuuucaacaauu

SEQ ID NO: 2791271 - RNA, 23 nt, Leptospira interrogans serovar lai str. 56601
uuaauuuuucaacaauucuauua

SEQ ID NO: 2791272 - RNA, 14 nt, Leptospira interrogans serovar lai str. 56601
uuacaaaaucugaa

SEQ ID NO: 2791273 - RNA, 15 nt, Leptospira interrogans serovar lai str. 56601
uuacaaaaucugaau

SEQ ID NO: 2791274 - RNA, 14 nt, Leptospira interrogans serovar lai str. 56601
uuacaaaaugauuu

SEQ ID NO: 2791275 - RNA, 20 nt, Leptospira interrogans serovar lai str. 56601
uuacaaagacucggaaauuc

SEQ ID NO: 2791276 - RNA, 13 nt, Leptospira interrogans serovar lai str. 56601
uuacaaagauugg

SEQ ID NO: 2791277 - RNA, 13 nt, Leptospira interrogans serovar lai str. 56601
uuacaaagugaug

SEQ ID NO: 2791278 - RNA, 12 nt, Leptospira interrogans serovar lai str. 56601
uuacaacuuuug

SEQ ID NO: 2791279 - RNA, 13 nt, Leptospira interrogans serovar lai str. 56601
uuacaauaaaaac

SEQ ID NO: 2791280 - RNA, 18 nt, Leptospira interrogans serovar lai str. 56601
uuacaauggaaaguguua

SEQ ID NO: 2791281 - RNA, 20 nt, Leptospira interrogans serovar lai str. 56601
uuacaauggaaaguguuagu

SEQ ID NO: 2791282 - RNA, 14 nt, Leptospira interrogans serovar lai str. 56601
uuacaauuuauuau

SEQ ID NO: 2791283 - RNA, 18 nt, Leptospira interrogans serovar lai str. 56601
uuacaauuuauuauaaaa

SEQ ID NO: 2791284 - RNA, 18 nt, Leptospira interrogans serovar lai str. 56601
uuacacggccaacaucgu

SEQ ID NO: 2791285 - RNA, 17 nt, Leptospira interrogans serovar lai str. 56601
uuacacuccucaaagau

SEQ ID NO: 2791286 - RNA, 12 nt, Leptospira interrogans serovar lai str. 56601
uuacagaaaaau

SEQ ID NO: 2791287 - RNA, 21 nt, Leptospira interrogans serovar lai str. 56601
uuacagaaaaccaaauaauaa

SEQ ID NO: 2791288 - RNA, 12 nt, Leptospira interrogans serovar lai str. 56601
uuacagaagauu

SEQ ID NO: 2791289 - RNA, 16 nt, Leptospira interrogans serovar lai str. 56601
uuacagaagauuuugu

SEQ ID NO: 2791290 - RNA, 23 nt, Leptospira interrogans serovar lai str. 56601
uuacagacguauuuuuaaaugua

SEQ ID NO: 2791291 - RNA, 20 nt, Leptospira interrogans serovar lai str. 56601
uuacagauacucaauuugau

SEQ ID NO: 2791292 - RNA, 15 nt, Leptospira interrogans serovar lai str. 56601
uuacagaucaauucu

SEQ ID NO: 2791293 - RNA, 17 nt, Leptospira interrogans serovar lai str. 56601
uuacagauugauucuuu

SEQ ID NO: 2791294 - RNA, 19 nt, Leptospira interrogans serovar lai str. 56601
uuacaguaaaaucuaaauu

SEQ ID NO: 2791295 - RNA, 19 nt, Leptospira interrogans serovar lai str. 56601
uuacauaacuaauaaaaac

SEQ ID NO: 2791296 - RNA, 23 nt, Leptospira interrogans serovar lai str. 56601
uuacauaaguucgguguaaaaaa

SEQ ID NO: 2791297 - RNA, 13 nt, Leptospira interrogans serovar lai str. 56601
uuacauauauaau

SEQ ID NO: 2791298 - RNA, 15 nt, Leptospira interrogans serovar lai str. 56601
uuacauauauaauuu

SEQ ID NO: 2791299 - RNA, 19 nt, Leptospira interrogans serovar lai str. 56601
uuacauaucaauccuguaa

SEQ ID NO: 2791300 - RNA, 14 nt, Leptospira interrogans serovar lai str. 56601
uuacauucaauaau

SEQ ID NO: 2791301 - RNA, 15 nt, Leptospira interrogans serovar lai str. 56601
uuacauuuuuaaauu

SEQ ID NO: 2791302 - RNA, 23 nt, Leptospira interrogans serovar lai str. 56601
uuaccaaaaaugcaaaaguuuuc

SEQ ID NO: 2791303 - RNA, 16 nt, Leptospira interrogans serovar lai str. 56601
uuaccacagugaaaga

SEQ ID NO: 2791304 - RNA, 23 nt, Leptospira interrogans serovar lai str. 56601
uuaccacagugaaagauuaaaga

SEQ ID NO: 2791305 - RNA, 15 nt, Leptospira interrogans serovar lai str. 56601
uuaccauaaauuuuu

SEQ ID NO: 2791306 - RNA, 17 nt, Leptospira interrogans serovar lai str. 56601
uuaccgaguuuaucaga

SEQ ID NO: 2791307 - RNA, 16 nt, Leptospira interrogans serovar lai str. 56601
uuagaguuauugaaaa

SEQ ID NO: 2791308 - RNA, 21 nt, Leptospira interrogans serovar lai str. 56601
uuagaguucguuaagaauaaa

SEQ ID NO: 2791309 - RNA, 17 nt, Leptospira interrogans serovar lai str. 56601
uuagaguuguccuaaaa

SEQ ID NO: 2791310 - RNA, 18 nt, Leptospira interrogans serovar lai str. 56601
uuagaguuucuaaaaaaa

SEQ ID NO: 2791311 - RNA, 19 nt, Leptospira interrogans serovar lai str. 56601
uuagaguuugaguuucuuu

SEQ ID NO: 2791312 - RNA, 13 nt, Leptospira interrogans serovar lai str. 56601
uuagauaaauaca

SEQ ID NO: 2791313 - RNA, 20 nt, Leptospira interrogans serovar lai str. 56601
uuagauaaauacaucucuuu

SEQ ID NO: 2791314 - RNA, 21 nt, Leptospira interrogans serovar lai str. 56601
uuagauaagagacaaauauuu

SEQ ID NO: 2791315 - RNA, 15 nt, Leptospira interrogans serovar lai str. 56601
uuagauaauuauucu

SEQ ID NO: 2791316 - RNA, 13 nt, Leptospira interrogans serovar lai str. 56601
uuagaucuaaauu

SEQ ID NO: 2791317 - RNA, 14 nt, Leptospira interrogans serovar lai str. 56601
uuagauuuuaacuu

SEQ ID NO: 2791318 - RNA, 17 nt, Leptospira interrogans serovar lai str. 56601
uuagauuuuaacuuuuu

SEQ ID NO: 2791319 - RNA, 20 nt, Leptospira interrogans serovar lai str. 56601
uuagcaaauuuacuucaauu

SEQ ID NO: 2791320 - RNA, 14 nt, Leptospira interrogans serovar lai str. 56601
uuagcaccuuuuuu

SEQ ID NO: 2791321 - RNA, 19 nt, Leptospira interrogans serovar lai str. 56601
uuaggaaauacaaaaagaa

SEQ ID NO: 2791322 - RNA, 17 nt, Leptospira interrogans serovar lai str. 56601
uuaggaacuuuuauaau

SEQ ID NO: 2791323 - RNA, 16 nt, Leptospira interrogans serovar lai str. 56601
uuaggaauuuuuuaaa

SEQ ID NO: 2791324 - RNA, 19 nt, Leptospira interrogans serovar lai str. 56601
uuaggauuuuaugaaaguu

SEQ ID NO: 2791325 - RNA, 22 nt, Leptospira interrogans serovar lai str. 56601
uuaggcaauauuauuuuaacuu

SEQ ID NO: 2791326 - RNA, 23 nt, Leptospira interrogans serovar lai str. 56601
uuaggcccgaauuuuaaauauua

SEQ ID NO: 2791327 - RNA, 19 nt, Leptospira interrogans serovar lai str. 56601
uuagguuuuguaauaguuc

SEQ ID NO: 2791328 - RNA, 18 nt, Leptospira interrogans serovar lai str. 56601
uuaguaaaaaucaacuug

SEQ ID NO: 2791329 - RNA, 14 nt, Leptospira interrogans serovar lai str. 56601
uuaguaaacuacua

SEQ ID NO: 2791330 - RNA, 13 nt, Leptospira interrogans serovar lai str. 56601
uuaguaauuuaau

SEQ ID NO: 2791331 - RNA, 14 nt, Leptospira interrogans serovar lai str. 56601
uuaguaguaaauaa

SEQ ID NO: 2791332 - RNA, 14 nt, Leptospira interrogans serovar lai str. 56601
uuaguauuuuauua

SEQ ID NO: 2791333 - RNA, 18 nt, Leptospira interrogans serovar lai str. 56601
uuaguauuuuucuuaauu

SEQ ID NO: 2791334 - RNA, 18 nt, Leptospira interrogans serovar lai str. 56601
uuaguuagcugaaauuaa

SEQ ID NO: 2791335 - RNA, 18 nt, Leptospira interrogans serovar lai str. 56601
uuaguucccacaaauuaa

SEQ ID NO: 2791336 - RNA, 15 nt, Leptospira interrogans serovar lai str. 56601
uuaguucccacauuu

SEQ ID NO: 2791337 - RNA, 21 nt, Leptospira interrogans serovar lai str. 56601
uuaguuccuauagaauuuuca

SEQ ID NO: 2791338 - RNA, 13 nt, Leptospira interrogans serovar lai str. 56601
uuaguuuaaaaac

SEQ ID NO: 2791339 - RNA, 13 nt, Leptospira interrogans serovar lai str. 56601
uuaguuuccaaaa

SEQ ID NO: 2791340 - RNA, 12 nt, Leptospira interrogans serovar lai str. 56601
uuauaaaaacaa

SEQ ID NO: 2791341 - RNA, 22 nt, Leptospira interrogans serovar lai str. 56601
uuauaaaaaguuuguuuguaaa

SEQ ID NO: 2791342 - RNA, 19 nt, Leptospira interrogans serovar lai str. 56601
uuauaaaacaaucuucaaa

SEQ ID NO: 2791343 - RNA, 19 nt, Leptospira interrogans serovar lai str. 56601
uuauaaaacgaaauuauac

SEQ ID NO: 2791344 - RNA, 17 nt, Leptospira interrogans serovar lai str. 56601
uuauaaaacuguaaauu

SEQ ID NO: 2791345 - RNA, 22 nt, Leptospira interrogans serovar lai str. 56601
uuauaaaaguauaauauuuauu

SEQ ID NO: 2791346 - RNA, 17 nt, Leptospira interrogans serovar lai str. 56601
uuauaaaauaaaaaaau

SEQ ID NO: 2791347 - RNA, 11 nt, Leptospira interrogans serovar lai str. 56601
uuauaaaaucu

SEQ ID NO: 2791348 - RNA, 15 nt, Leptospira interrogans serovar lai str. 56601
uuauaaaaucuaaaa

SEQ ID NO: 2791349 - RNA, 16 nt, Leptospira interrogans serovar lai str. 56601
uuauaaaaucuaaaaa

SEQ ID NO: 2791350 - RNA, 22 nt, Leptospira interrogans serovar lai str. 56601
uuauaaaauguauuaaaguugu

SEQ ID NO: 2791351 - RNA, 12 nt, Leptospira interrogans serovar lai str. 56601
uuauaaaauuuu

SEQ ID NO: 2791352 - RNA, 14 nt, Leptospira interrogans serovar lai str. 56601
uuauaaaauuuuuc

SEQ ID NO: 2791353 - RNA, 21 nt, Leptospira interrogans serovar lai str. 56601
uuauaaacaauaugaaaggaa

SEQ ID NO: 2791354 - RNA, 18 nt, Leptospira interrogans serovar lai str. 56601
uuauaaagaauuuuaaau

SEQ ID NO: 2791355 - RNA, 23 nt, Leptospira interrogans serovar lai str. 56601
uuauaaaguugagugccuaaauu

SEQ ID NO: 2791356 - RNA, 23 nt, Leptospira interrogans serovar lai str. 56601
uuauaaauacaaaaauucuaaua

SEQ ID NO: 2791357 - RNA, 20 nt, Leptospira interrogans serovar lai str. 56601
uuauaaauauuaauuuaaaa

SEQ ID NO: 2791358 - RNA, 22 nt, Leptospira interrogans serovar lai str. 56601
uuauaaauauuaauuuaaaaac

SEQ ID NO: 2791359 - RNA, 20 nt, Leptospira interrogans serovar lai str. 56601
uuauaaaucuguacuuaaau

SEQ ID NO: 2791360 - RNA, 14 nt, Leptospira interrogans serovar lai str. 56601
uuauaaauguagga

SEQ ID NO: 2791361 - RNA, 17 nt, Leptospira interrogans serovar lai str. 56601
uuauaaauugccaaaua

SEQ ID NO: 2791362 - RNA, 14 nt, Leptospira interrogans serovar lai str. 56601
uuauaaauuuaaaa

SEQ ID NO: 2791363 - RNA, 15 nt, Leptospira interrogans serovar lai str. 56601
uuauaaauuuaaaaa

SEQ ID NO: 2791364 - RNA, 13 nt, Leptospira interrogans serovar lai str. 56601
uuauaaauuuaua

SEQ ID NO: 2791365 - RNA, 16 nt, Leptospira interrogans serovar lai str. 56601
uuauaaccuaucacaa

SEQ ID NO: 2791366 - RNA, 13 nt, Leptospira interrogans serovar lai str. 56601
uuauaagaaucga

SEQ ID NO: 2791367 - RNA, 14 nt, Leptospira interrogans serovar lai str. 56601
uuauaagaauuuuc

SEQ ID NO: 2791368 - RNA, 16 nt, Leptospira interrogans serovar lai str. 56601
uuauaauaaucuuaac

SEQ ID NO: 2791369 - RNA, 23 nt, Leptospira interrogans serovar lai str. 56601
uuauaauagauugauaauuaucc

SEQ ID NO: 2791370 - RNA, 14 nt, Leptospira interrogans serovar lai str. 56601
uuauaauauucuuu

SEQ ID NO: 2791371 - RNA, 22 nt, Leptospira interrogans serovar lai str. 56601
uuauaaugauaaaguagacaac

SEQ ID NO: 2791372 - RNA, 12 nt, Leptospira interrogans serovar lai str. 56601
uuauaauucaaa

SEQ ID NO: 2791373 - RNA, 19 nt, Leptospira interrogans serovar lai str. 56601
uuauaauucguuuuuuaaa

SEQ ID NO: 2791374 - RNA, 16 nt, Leptospira interrogans serovar lai str. 56601
uuauaauucuuuaaaa

SEQ ID NO: 2791375 - RNA, 22 nt, Leptospira interrogans serovar lai str. 56601
uuauaauugaacauuuuuaaaa

SEQ ID NO: 2791376 - RNA, 15 nt, Leptospira interrogans serovar lai str. 56601
uuauaauuuuaaaua

SEQ ID NO: 2791377 - RNA, 17 nt, Leptospira interrogans serovar lai str. 56601
uuauaauuuucuuaaua

SEQ ID NO: 2791378 - RNA, 18 nt, Leptospira interrogans serovar lai str. 56601
uuauaauuuucuuaauaa

SEQ ID NO: 2791379 - RNA, 14 nt, Leptospira interrogans serovar lai str. 56601
uuauacaauauuuc

SEQ ID NO: 2791380 - RNA, 13 nt, Leptospira interrogans serovar lai str. 56601
uuauacuauaacu

SEQ ID NO: 2791381 - RNA, 15 nt, Leptospira interrogans serovar lai str. 56601
uuauacuauaaguuu

SEQ ID NO: 2791382 - RNA, 14 nt, Leptospira interrogans serovar lai str. 56601
uuauacuuuaauaa

SEQ ID NO: 2791383 - RNA, 18 nt, Leptospira interrogans serovar lai str. 56601
uuauagaacgugucaugu

SEQ ID NO: 2791384 - RNA, 11 nt, Leptospira interrogans serovar lai str. 56601
uuauagauaua

SEQ ID NO: 2791385 - RNA, 20 nt, Leptospira interrogans serovar lai str. 56601
uuauaguagauauuaguaaa

SEQ ID NO: 2791386 - RNA, 19 nt, Leptospira interrogans serovar lai str. 56601
uuauaguuuuuaacuguuu

SEQ ID NO: 2791387 - RNA, 21 nt, Leptospira interrogans serovar lai str. 56601
uuauauaaccaugaauaaaca

SEQ ID NO: 2791388 - RNA, 21 nt, Leptospira interrogans serovar lai str. 56601
uuauauaagaucuaucucaaa

SEQ ID NO: 2791389 - RNA, 16 nt, Leptospira interrogans serovar lai str. 56601
uuauauaaguauuaua

SEQ ID NO: 2791390 - RNA, 14 nt, Leptospira interrogans serovar lai str. 56601
uuauuuuuacagaa

SEQ ID NO: 2791391 - RNA, 18 nt, Leptospira interrogans serovar lai str. 56601
uuauuuuuacagaaaaau

SEQ ID NO: 2791392 - RNA, 21 nt, Leptospira interrogans serovar lai str. 56601
uuauuuuucuaaaaaaaaugu

SEQ ID NO: 2791393 - RNA, 19 nt, Leptospira interrogans serovar lai str. 56601
uuauuuuucuuuuaaaauu

SEQ ID NO: 2791394 - RNA, 14 nt, Leptospira interrogans serovar lai str. 56601
uuauuuuuuuauuu

SEQ ID NO: 2791395 - RNA, 19 nt, Leptospira interrogans serovar lai str. 56601
uucaaaaaacuuucuuaaa

SEQ ID NO: 2791396 - RNA, 22 nt, Leptospira interrogans serovar lai str. 56601
uucaaaaaagaaaaaucuucag

SEQ ID NO: 2791397 - RNA, 12 nt, Leptospira interrogans serovar lai str. 56601
uucaaaaaauau

SEQ ID NO: 2791398 - RNA, 19 nt, Leptospira interrogans serovar lai str. 56601
uucaaaaaaucaaauauac

SEQ ID NO: 2791399 - RNA, 22 nt, Leptospira interrogans serovar lai str. 56601
uucaaaaaauuucuaugaaaau

SEQ ID NO: 2791400 - RNA, 19 nt, Leptospira interrogans serovar lai str. 56601
uucaaaaaccgaaauagaa

SEQ ID NO: 2791401 - RNA, 18 nt, Leptospira interrogans serovar lai str. 56601
uucaaaaacguuucuaua

SEQ ID NO: 2791402 - RNA, 21 nt, Leptospira interrogans serovar lai str. 56601
uucaaaaacuaaaauacaaaa

SEQ ID NO: 2791403 - RNA, 22 nt, Leptospira interrogans serovar lai str. 56601
uucaaaaacuaaaauacaaaau

SEQ ID NO: 2791404 - RNA, 19 nt, Leptospira interrogans serovar lai str. 56601
uucaaaaaguuuuauaaac

SEQ ID NO: 2791405 - RNA, 12 nt, Leptospira interrogans serovar lai str. 56601
uucaaaaauaaa

SEQ ID NO: 2791406 - RNA, 13 nt, Leptospira interrogans serovar lai str. 56601
uucaaaaauauau

SEQ ID NO: 2791407 - RNA, 20 nt, Leptospira interrogans serovar lai str. 56601
uucaaaaauauauuauaaua

SEQ ID NO: 2791408 - RNA, 22 nt, Leptospira interrogans serovar lai str. 56601
uucaaaaauuuucuguuuauuu

SEQ ID NO: 2791409 - RNA, 15 nt, Leptospira interrogans serovar lai str. 56601
uucaaaacuauuaaa

SEQ ID NO: 2791410 - RNA, 15 nt, Leptospira interrogans serovar lai str. 56601
uucaaaauaaauaau

SEQ ID NO: 2791411 - RNA, 14 nt, Leptospira interrogans serovar lai str. 56601
uucaaaauaagaaa

SEQ ID NO: 2791412 - RNA, 16 nt, Leptospira interrogans serovar lai str. 56601
uucaaaauaagaaaau

SEQ ID NO: 2791413 - RNA, 19 nt, Leptospira interrogans serovar lai str. 56601
uucaaaaucguuuuaaaaa

SEQ ID NO: 2791414 - RNA, 20 nt, Leptospira interrogans serovar lai str. 56601
uucaaaaucguuuuaaaaac

SEQ ID NO: 2791415 - RNA, 22 nt, Leptospira interrogans serovar lai str. 56601
uucaaaauugagcuuguuuuua

SEQ ID NO: 2791416 - RNA, 19 nt, Leptospira interrogans serovar lai str. 56601
uucaaaauuuaucuguaaa

SEQ ID NO: 2791417 - RNA, 20 nt, Leptospira interrogans serovar lai str. 56601
uucaaacaacaaaaaauaua

SEQ ID NO: 2791418 - RNA, 21 nt, Leptospira interrogans serovar lai str. 56601
uucaaacaacaaaaaauauac

SEQ ID NO: 2791419 - RNA, 18 nt, Leptospira interrogans serovar lai str. 56601
uucaaacgcuuucguaaa

SEQ ID NO: 2791420 - RNA, 17 nt, Leptospira interrogans serovar lai str. 56601
uucaaagaaauguggga

SEQ ID NO: 2791421 - RNA, 20 nt, Leptospira interrogans serovar lai str. 56601
uucaaagaaaugugggaacu

SEQ ID NO: 2791422 - RNA, 17 nt, Leptospira interrogans serovar lai str. 56601
uucaaagaauauaaaau

SEQ ID NO: 2791423 - RNA, 14 nt, Leptospira interrogans serovar lai str. 56601
uucaaagauaaaau

SEQ ID NO: 2791424 - RNA, 15 nt, Leptospira interrogans serovar lai str. 56601
uucaaagauaaaaua

SEQ ID NO: 2791425 - RNA, 22 nt, Leptospira interrogans serovar lai str. 56601
uucaaaggccgcuucuuuauuu

SEQ ID NO: 2791426 - RNA, 19 nt, Leptospira interrogans serovar lai str. 56601
uucaaaguuuucacaaaaa

SEQ ID NO: 2791427 - RNA, 21 nt, Leptospira interrogans serovar lai str. 56601
uucaaaguuuucacaaaaaaa

SEQ ID NO: 2791428 - RNA, 13 nt, Leptospira interrogans serovar lai str. 56601
uucaaauaaagaa

SEQ ID NO: 2791429 - RNA, 14 nt, Leptospira interrogans serovar lai str. 56601
uucaaauaaagaaa

SEQ ID NO: 2791430 - RNA, 16 nt, Leptospira interrogans serovar lai str. 56601
uucaaauaaagaaaag

SEQ ID NO: 2791431 - RNA, 19 nt, Leptospira interrogans serovar lai str. 56601
uucaaauaaagaaaaggaa

SEQ ID NO: 2791432 - RNA, 21 nt, Leptospira interrogans serovar lai str. 56601
uucaaauuuacucuuauaaaa

SEQ ID NO: 2791433 - RNA, 16 nt, Leptospira interrogans serovar lai str. 56601
uucaaauuuauguacu

SEQ ID NO: 2791434 - RNA, 12 nt, Leptospira interrogans serovar lai str. 56601
uucaaauuucug

SEQ ID NO: 2791435 - RNA, 17 nt, Leptospira interrogans serovar lai str. 56601
uucaaauuucugaaaca

SEQ ID NO: 2791436 - RNA, 18 nt, Leptospira interrogans serovar lai str. 56601
uucaacaaacaaauagaa

SEQ ID NO: 2791437 - RNA, 14 nt, Leptospira interrogans serovar lai str. 56601
uucaacaacucuaa

SEQ ID NO: 2791438 - RNA, 22 nt, Leptospira interrogans serovar lai str. 56601
uucaacaacucuaauacaaaaa

SEQ ID NO: 2791439 - RNA, 23 nt, Leptospira interrogans serovar lai str. 56601
uucaacaacucuaauacaaaaaa

SEQ ID NO: 2791440 - RNA, 16 nt, Leptospira interrogans serovar lai str. 56601
uucaacuauuauaaua

SEQ ID NO: 2791441 - RNA, 18 nt, Leptospira interrogans serovar lai str. 56601
uucaacuuaaggaaauuc

SEQ ID NO: 2791442 - RNA, 18 nt, Leptospira interrogans serovar lai str. 56601
uucaacuuagaacuuguc

SEQ ID NO: 2791443 - RNA, 14 nt, Leptospira interrogans serovar lai str. 56601
uucaacuuguaaaa

SEQ ID NO: 2791444 - RNA, 15 nt, Leptospira interrogans serovar lai str. 56601
uucaacuuuagaaaa

SEQ ID NO: 2791445 - RNA, 19 nt, Leptospira interrogans serovar lai str. 56601
uucaacuuuuugaagaaac

SEQ ID NO: 2791446 - RNA, 22 nt, Leptospira interrogans serovar lai str. 56601
uucaacuuuuugaagaaacaau

SEQ ID NO: 2791447 - RNA, 17 nt, Leptospira interrogans serovar lai str. 56601
uucaagacaacagaaca

SEQ ID NO: 2791448 - RNA, 19 nt, Leptospira interrogans serovar lai str. 56601
uucaagagugguuuucaaa

SEQ ID NO: 2791449 - RNA, 18 nt, Leptospira interrogans serovar lai str. 56601
uucaagauugucuuuauu

SEQ ID NO: 2791450 - RNA, 20 nt, Leptospira interrogans serovar lai str. 56601
uucaaguguuccgacaagaa

SEQ ID NO: 2791451 - RNA, 14 nt, Leptospira interrogans serovar lai str. 56601
uucaaguuaauaca

SEQ ID NO: 2791452 - RNA, 19 nt, Leptospira interrogans serovar lai str. 56601
uucaauaaaauaccauaaa

SEQ ID NO: 2791453 - RNA, 15 nt, Leptospira interrogans serovar lai str. 56601
uucaauaacucuaau

SEQ ID NO: 2791454 - RNA, 17 nt, Leptospira interrogans serovar lai str. 56601
uucaauaauuuuaauau

SEQ ID NO: 2791455 - RNA, 22 nt, Leptospira interrogans serovar lai str. 56601
uucaauacaaccgaaaagguua

SEQ ID NO: 2791456 - RNA, 14 nt, Leptospira interrogans serovar lai str. 56601
uucaauauaaaaau

SEQ ID NO: 2791457 - RNA, 17 nt, Leptospira interrogans serovar lai str. 56601
uucaauauaaaaauuaa

SEQ ID NO: 2791458 - RNA, 22 nt, Leptospira interrogans serovar lai str. 56601
uucaaucaauaccgauuucuau

SEQ ID NO: 2791459 - RNA, 19 nt, Leptospira interrogans serovar lai str. 56601
uucaaucgaccguuuccau

SEQ ID NO: 2791460 - RNA, 13 nt, Leptospira interrogans serovar lai str. 56601
uucaaucuaaccc

SEQ ID NO: 2791461 - RNA, 16 nt, Leptospira interrogans serovar lai str. 56601
uucaaucuauuaacuu

SEQ ID NO: 2791462 - RNA, 19 nt, Leptospira interrogans serovar lai str. 56601
uucaaucuauuaacuuuac

SEQ ID NO: 2791463 - RNA, 14 nt, Leptospira interrogans serovar lai str. 56601
uucaaugcaaaaaa

SEQ ID NO: 2791464 - RNA, 15 nt, Leptospira interrogans serovar lai str. 56601
uucaaugcaaaaaau

SEQ ID NO: 2791465 - RNA, 20 nt, Leptospira interrogans serovar lai str. 56601
uucaauguaagaaacucauu

SEQ ID NO: 2791466 - RNA, 15 nt, Leptospira interrogans serovar lai str. 56601
uucaauguuauaaaa

SEQ ID NO: 2791467 - RNA, 16 nt, Leptospira interrogans serovar lai str. 56601
uucaauguuauaaaau

SEQ ID NO: 2791468 - RNA, 16 nt, Leptospira interrogans serovar lai str. 56601
uucaauuaucaaagca

SEQ ID NO: 2791469 - RNA, 15 nt, Leptospira interrogans serovar lai str. 56601
uucaauuauuauaaa

SEQ ID NO: 2791470 - RNA, 18 nt, Leptospira interrogans serovar lai str. 56601
uucaauucaucugaacua

SEQ ID NO: 2791471 - RNA, 18 nt, Leptospira interrogans serovar lai str. 56601
uucaauugauuauagaac

SEQ ID NO: 2791472 - RNA, 13 nt, Leptospira interrogans serovar lai str. 56601
uucaauuuaaaac

SEQ ID NO: 2791473 - RNA, 15 nt, Leptospira interrogans serovar lai str. 56601
uucauuuuucuacaa

SEQ ID NO: 2791474 - RNA, 15 nt, Leptospira interrogans serovar lai str. 56601
uucauuuuucugaaa

SEQ ID NO: 2791475 - RNA, 23 nt, Leptospira interrogans serovar lai str. 56601
uucauuuuuugaaaaaguuggga

SEQ ID NO: 2791476 - RNA, 16 nt, Leptospira interrogans serovar lai str. 56601
uuccaaaaagaaaaac

SEQ ID NO: 2791477 - RNA, 18 nt, Leptospira interrogans serovar lai str. 56601
uuccaaaaccucaaaaaa

SEQ ID NO: 2791478 - RNA, 19 nt, Leptospira interrogans serovar lai str. 56601
uuccaaacccugccaaaau

SEQ ID NO: 2791479 - RNA, 13 nt, Leptospira interrogans serovar lai str. 56601
uuccaaacucaau

SEQ ID NO: 2791480 - RNA, 16 nt, Leptospira interrogans serovar lai str. 56601
uuccaaagauaaaaaa

SEQ ID NO: 2791481 - RNA, 17 nt, Leptospira interrogans serovar lai str. 56601
uuccaaagauuuuaaaa

SEQ ID NO: 2791482 - RNA, 14 nt, Leptospira interrogans serovar lai str. 56601
uuccaaaucugaau

SEQ ID NO: 2791483 - RNA, 22 nt, Leptospira interrogans serovar lai str. 56601
uuccaaaucugaaucucuuuuu

SEQ ID NO: 2791484 - RNA, 15 nt, Leptospira interrogans serovar lai str. 56601
uuccaacguaccaaa

SEQ ID NO: 2791485 - RNA, 21 nt, Leptospira interrogans serovar lai str. 56601
uuccaacguaccaaaacccau

SEQ ID NO: 2791486 - RNA, 22 nt, Leptospira interrogans serovar lai str. 56601
uuccaacuguuuauauaucuua

SEQ ID NO: 2791487 - RNA, 12 nt, Leptospira interrogans serovar lai str. 56601
uuccaacuuuuu

SEQ ID NO: 2791488 - RNA, 18 nt, Leptospira interrogans serovar lai str. 56601
uuccaagaccucaaauaa

SEQ ID NO: 2791489 - RNA, 12 nt, Leptospira interrogans serovar lai str. 56601
uuccaaguuuuu

SEQ ID NO: 2791490 - RNA, 21 nt, Leptospira interrogans serovar lai str. 56601
uuccaaguuuuugugacuucc

SEQ ID NO: 2791491 - RNA, 12 nt, Leptospira interrogans serovar lai str. 56601
uuccaauuuccu

SEQ ID NO: 2791492 - RNA, 21 nt, Leptospira interrogans serovar lai str. 56601
uuccaauuuugcuucuaaaaa

SEQ ID NO: 2791493 - RNA, 23 nt, Leptospira interrogans serovar lai str. 56601
uuccacucuuugacccauaaaaa

SEQ ID NO: 2791494 - RNA, 14 nt, Leptospira interrogans serovar lai str. 56601
uuccacuguauucg

SEQ ID NO: 2791495 - RNA, 17 nt, Leptospira interrogans serovar lai str. 56601
uuccacuucaaaaagac

SEQ ID NO: 2791496 - RNA, 18 nt, Leptospira interrogans serovar lai str. 56601
uuccacuucaaaaagacu

SEQ ID NO: 2791497 - RNA, 22 nt, Leptospira interrogans serovar lai str. 56601
uuccacuuuucucaucaaaaaa

SEQ ID NO: 2791498 - RNA, 16 nt, Leptospira interrogans serovar lai str. 56601
uuccagaaaccauaaa

SEQ ID NO: 2791499 - RNA, 18 nt, Leptospira interrogans serovar lai str. 56601
uuccagaaaccauaaaau

SEQ ID NO: 2791500 - RNA, 20 nt, Leptospira interrogans serovar lai str. 56601
uuccagaaaccauaaaauaa

SEQ ID NO: 2791501 - RNA, 16 nt, Leptospira interrogans serovar lai str. 56601
uuccagaagauugaaa

SEQ ID NO: 2791502 - RNA, 23 nt, Leptospira interrogans serovar lai str. 56601
uuccagaggcaguacaauucaaa

SEQ ID NO: 2791503 - RNA, 17 nt, Leptospira interrogans serovar lai str. 56601
uuccagaucauuuugua

SEQ ID NO: 2791504 - RNA, 19 nt, Leptospira interrogans serovar lai str. 56601
uuccagcccauucuuuccc

SEQ ID NO: 2791505 - RNA, 19 nt, Leptospira interrogans serovar lai str. 56601
uuccaguaggauaauacaa

SEQ ID NO: 2791506 - RNA, 12 nt, Leptospira interrogans serovar lai str. 56601
uuccauaaaaaa

SEQ ID NO: 2791507 - RNA, 15 nt, Leptospira interrogans serovar lai str. 56601
uuccauaaaaaauga

SEQ ID NO: 2791508 - RNA, 20 nt, Leptospira interrogans serovar lai str. 56601
uuccauaaaauagaaacaga

SEQ ID NO: 2791509 - RNA, 15 nt, Leptospira interrogans serovar lai str. 56601
uuccauaaauuuugu

SEQ ID NO: 2791510 - RNA, 13 nt, Leptospira interrogans serovar lai str. 56601
uuccauaaugaag

SEQ ID NO: 2791511 - RNA, 19 nt, Leptospira interrogans serovar lai str. 56601
uuccauagugaagauuugu

SEQ ID NO: 2791512 - RNA, 23 nt, Leptospira interrogans serovar lai str. 56601
uuccaucguuuauuuuucuaaaa

SEQ ID NO: 2791513 - RNA, 21 nt, Leptospira interrogans serovar lai str. 56601
uuccaugaaauagaaaucaau

SEQ ID NO: 2791514 - RNA, 13 nt, Leptospira interrogans serovar lai str. 56601
uuccauuaauuac

SEQ ID NO: 2791515 - RNA, 12 nt, Leptospira interrogans serovar lai str. 56601
uuccauucuaag

SEQ ID NO: 2791516 - RNA, 23 nt, Leptospira interrogans serovar lai str. 56601
uuccauuucuguaacauccaaac

SEQ ID NO: 2791517 - RNA, 11 nt, Leptospira interrogans serovar lai str. 56601
uucccacaaau

SEQ ID NO: 2791518 - RNA, 15 nt, Leptospira interrogans serovar lai str. 56601
uucccacaaauuaag

SEQ ID NO: 2791519 - RNA, 13 nt, Leptospira interrogans serovar lai str. 56601
uucccacauuuca

SEQ ID NO: 2791520 - RNA, 23 nt, Leptospira interrogans serovar lai str. 56601
uucccacauuuuaaagauugaac

SEQ ID NO: 2791521 - RNA, 17 nt, Leptospira interrogans serovar lai str. 56601
uucccacauuuugugaa

SEQ ID NO: 2791522 - RNA, 19 nt, Leptospira interrogans serovar lai str. 56601
uucccacauuuugugaaac

SEQ ID NO: 2791523 - RNA, 23 nt, Leptospira interrogans serovar lai str. 56601
uucccacauuuuuaaaaguuauu

SEQ ID NO: 2791524 - RNA, 20 nt, Leptospira interrogans serovar lai str. 56601
uucccacguuuuaaagguug

SEQ ID NO: 2791525 - RNA, 19 nt, Leptospira interrogans serovar lai str. 56601
uucccagacguaucaaaau

SEQ ID NO: 2791526 - RNA, 14 nt, Leptospira interrogans serovar lai str. 56601
uucccagauucccu

SEQ ID NO: 2791527 - RNA, 18 nt, Leptospira interrogans serovar lai str. 56601
uucccauccgaaauccca

SEQ ID NO: 2791528 - RNA, 20 nt, Leptospira interrogans serovar lai str. 56601
uucccauccgaaaucccaaa

SEQ ID NO: 2791529 - RNA, 15 nt, Leptospira interrogans serovar lai str. 56601
uuccccaaaaugaau

SEQ ID NO: 2791530 - RNA, 23 nt, Leptospira interrogans serovar lai str. 56601
uuccccaagacgucuacagauaa

SEQ ID NO: 2791531 - RNA, 19 nt, Leptospira interrogans serovar lai str. 56601
uuccccccacccaaaaaua

SEQ ID NO: 2791532 - RNA, 18 nt, Leptospira interrogans serovar lai str. 56601
uucccccgguucuagguu

SEQ ID NO: 2791533 - RNA, 15 nt, Leptospira interrogans serovar lai str. 56601
uucccgccaaaugcu

SEQ ID NO: 2791534 - RNA, 14 nt, Leptospira interrogans serovar lai str. 56601
uucccgcuaaaagu

SEQ ID NO: 2791535 - RNA, 24 nt, Leptospira interrogans serovar lai str. 56601
uucccgcuggaaaaugaaaacgau

SEQ ID NO: 2791536 - RNA, 13 nt, Leptospira interrogans serovar lai str. 56601
uucccucaauaau

SEQ ID NO: 2791537 - RNA, 15 nt, Leptospira interrogans serovar lai str. 56601
uucccucaauaaucc

SEQ ID NO: 2791538 - RNA, 13 nt, Leptospira interrogans serovar lai str. 56601
uucccuucuccug

SEQ ID NO: 2791539 - RNA, 18 nt, Leptospira interrogans serovar lai str. 56601
uucccuuuugaucuuuaa

SEQ ID NO: 2791540 - RNA, 19 nt, Leptospira interrogans serovar lai str. 56601
uuccgaauucuaaaauacu

SEQ ID NO: 2791541 - RNA, 16 nt, Leptospira interrogans serovar lai str. 56601
uuccgacaagaaugag

SEQ ID NO: 2791542 - RNA, 18 nt, Leptospira interrogans serovar lai str. 56601
uuccgaucauuugaagua

SEQ ID NO: 2791543 - RNA, 13 nt, Leptospira interrogans serovar lai str. 56601
uuccgauuucuuu

SEQ ID NO: 2791544 - RNA, 21 nt, Leptospira interrogans serovar lai str. 56601
uuccgcauuuuuauuugcauu

SEQ ID NO: 2791545 - RNA, 16 nt, Leptospira interrogans serovar lai str. 56601
uuccgccccacccaaa

SEQ ID NO: 2791546 - RNA, 20 nt, Leptospira interrogans serovar lai str. 56601
uuccgccccacccaaaaaua

SEQ ID NO: 2791547 - RNA, 21 nt, Leptospira interrogans serovar lai str. 56601
uuccgcuguaguaucucuugu

SEQ ID NO: 2791548 - RNA, 21 nt, Leptospira interrogans serovar lai str. 56601
uuccggaauacuuuucuuccc

SEQ ID NO: 2791549 - RNA, 23 nt, Leptospira interrogans serovar lai str. 56601
uuccgggaggaauuuuuaaaaag

SEQ ID NO: 2791550 - RNA, 14 nt, Leptospira interrogans serovar lai str. 56601
uuccgucuuuugua

SEQ ID NO: 2791551 - RNA, 12 nt, Leptospira interrogans serovar lai str. 56601
uuccuaaaaauu

SEQ ID NO: 2791552 - RNA, 11 nt, Leptospira interrogans serovar lai str. 56601
uuccuaaaaug

SEQ ID NO: 2791553 - RNA, 19 nt, Leptospira interrogans serovar lai str. 56601
uuccuaacuuugaaaauuu

SEQ ID NO: 2791554 - RNA, 20 nt, Leptospira interrogans serovar lai str. 56601
uuccuaaucuuauucaauaa

SEQ ID NO: 2791555 - RNA, 21 nt, Leptospira interrogans serovar lai str. 56601
uuccuaaugcagcuucuucca

SEQ ID NO: 2791556 - RNA, 14 nt, Leptospira interrogans serovar lai str. 56601
uucuaaaauugaau

SEQ ID NO: 2791557 - RNA, 14 nt, Leptospira interrogans serovar lai str. 56601
uucuaaaauuugua

SEQ ID NO: 2791558 - RNA, 12 nt, Leptospira interrogans serovar lai str. 56601
uucuaaaggaaa

SEQ ID NO: 2791559 - RNA, 16 nt, Leptospira interrogans serovar lai str. 56601
uucuaaaucugaauuu

SEQ ID NO: 2791560 - RNA, 22 nt, Leptospira interrogans serovar lai str. 56601
uucuaaauuaauauuuauaaaa

SEQ ID NO: 2791561 - RNA, 12 nt, Leptospira interrogans serovar lai str. 56601
uucuaaauugug

SEQ ID NO: 2791562 - RNA, 17 nt, Leptospira interrogans serovar lai str. 56601
uucuaaauuuuauaaaa

SEQ ID NO: 2791563 - RNA, 18 nt, Leptospira interrogans serovar lai str. 56601
uucuaaauuuuauaaaau

SEQ ID NO: 2791564 - RNA, 19 nt, Leptospira interrogans serovar lai str. 56601
uucuaaauuuuauaaaauu

SEQ ID NO: 2791565 - RNA, 15 nt, Leptospira interrogans serovar lai str. 56601
uucuaaccggaauuu

SEQ ID NO: 2791566 - RNA, 12 nt, Leptospira interrogans serovar lai str. 56601
uucuaacugguu

SEQ ID NO: 2791567 - RNA, 18 nt, Leptospira interrogans serovar lai str. 56601
uucuaagaucugauauuc

SEQ ID NO: 2791568 - RNA, 18 nt, Leptospira interrogans serovar lai str. 56601
uucuaaguaauuuaaaaa

SEQ ID NO: 2791569 - RNA, 19 nt, Leptospira interrogans serovar lai str. 56601
uucuaaguaauuuaaaaaa

SEQ ID NO: 2791570 - RNA, 21 nt, Leptospira interrogans serovar lai str. 56601
uucuaaguaauuuaaaaaaau

SEQ ID NO: 2791571 - RNA, 15 nt, Leptospira interrogans serovar lai str. 56601
uucuaaguccuuuuc

SEQ ID NO: 2791572 - RNA, 18 nt, Leptospira interrogans serovar lai str. 56601
uucuaaguccuuuucuua

SEQ ID NO: 2791573 - RNA, 18 nt, Leptospira interrogans serovar lai str. 56601
uucuaauagagaaaaauu

SEQ ID NO: 2791574 - RNA, 21 nt, Leptospira interrogans serovar lai str. 56601
uucuaauagagaaaaauuuuc

SEQ ID NO: 2791575 - RNA, 22 nt, Leptospira interrogans serovar lai str. 56601
uucuaauagucucauacuuaau

SEQ ID NO: 2791576 - RNA, 11 nt, Leptospira interrogans serovar lai str. 56601
uucuaauauaa

SEQ ID NO: 2791577 - RNA, 21 nt, Leptospira interrogans serovar lai str. 56601
uucuaaucacgaaaaaugaau

SEQ ID NO: 2791578 - RNA, 15 nt, Leptospira interrogans serovar lai str. 56601
uucuaauugcaacua

SEQ ID NO: 2791579 - RNA, 20 nt, Leptospira interrogans serovar lai str. 56601
uucuaauuuuauaaauuauu

SEQ ID NO: 2791580 - RNA, 21 nt, Leptospira interrogans serovar lai str. 56601
uucuaauuuuauaaauuauuu

SEQ ID NO: 2791581 - RNA, 19 nt, Leptospira interrogans serovar lai str. 56601
uucuaauuuuuuauugaau

SEQ ID NO: 2791582 - RNA, 19 nt, Leptospira interrogans serovar lai str. 56601
uucuacaaauucuucuucc

SEQ ID NO: 2791583 - RNA, 22 nt, Leptospira interrogans serovar lai str. 56601
uucuacaauggaggauccuuuc

SEQ ID NO: 2791584 - RNA, 16 nt, Leptospira interrogans serovar lai str. 56601
uucuacagauaaaaau

SEQ ID NO: 2791585 - RNA, 14 nt, Leptospira interrogans serovar lai str. 56601
uucuacauucugaa

SEQ ID NO: 2791586 - RNA, 21 nt, Leptospira interrogans serovar lai str. 56601
uucuacauucugaaacuuuuc

SEQ ID NO: 2791587 - RNA, 14 nt, Leptospira interrogans serovar lai str. 56601
uucuacauuuuugu

SEQ ID NO: 2791588 - RNA, 17 nt, Leptospira interrogans serovar lai str. 56601
uucuacauuuuugugaa

SEQ ID NO: 2791589 - RNA, 16 nt, Leptospira interrogans serovar lai str. 56601
uucuacgaauuucaga

SEQ ID NO: 2791590 - RNA, 17 nt, Leptospira interrogans serovar lai str. 56601
uucuacggcuuguauuu

SEQ ID NO: 2791591 - RNA, 21 nt, Leptospira interrogans serovar lai str. 56601
uucuacuuuauuaaaaaguuu

SEQ ID NO: 2791592 - RNA, 15 nt, Leptospira interrogans serovar lai str. 56601
uucuagaaagaauuu

SEQ ID NO: 2791593 - RNA, 22 nt, Leptospira interrogans serovar lai str. 56601
uucuagaauauaaccguaauua

SEQ ID NO: 2791594 - RNA, 12 nt, Leptospira interrogans serovar lai str. 56601
uucuagacuuuc

SEQ ID NO: 2791595 - RNA, 15 nt, Leptospira interrogans serovar lai str. 56601
uucuagcgucuaaaa

SEQ ID NO: 2791596 - RNA, 17 nt, Leptospira interrogans serovar lai str. 56601
uucuaguuuuccuucua

SEQ ID NO: 2791597 - RNA, 11 nt, Leptospira interrogans serovar lai str. 56601
uucuauaaaau

SEQ ID NO: 2791598 - RNA, 12 nt, Leptospira interrogans serovar lai str. 56601
uucuauaaaauc

SEQ ID NO: 2791599 - RNA, 12 nt, Leptospira interrogans serovar lai str. 56601
uucuauaaaauu

SEQ ID NO: 2791600 - RNA, 23 nt, Leptospira interrogans serovar lai str. 56601
uucuauaaaauugaauaucauaa

SEQ ID NO: 2791601 - RNA, 15 nt, Leptospira interrogans serovar lai str. 56601
uucuauaaacucaaa

SEQ ID NO: 2791602 - RNA, 21 nt, Leptospira interrogans serovar lai str. 56601
uucuauaaacucaaagaauuu

SEQ ID NO: 2791603 - RNA, 22 nt, Leptospira interrogans serovar lai str. 56601
uucuauaguaaagauuagaaaa

SEQ ID NO: 2791604 - RNA, 19 nt, Leptospira interrogans serovar lai str. 56601
uucuauauauugaaauauu

SEQ ID NO: 2791605 - RNA, 12 nt, Leptospira interrogans serovar lai str. 56601
uucuaucaaaaa

SEQ ID NO: 2791606 - RNA, 15 nt, Leptospira interrogans serovar lai str. 56601
uucuaucaaaaaauu

SEQ ID NO: 2791607 - RNA, 18 nt, Leptospira interrogans serovar lai str. 56601
uucuauccauucuagaac

SEQ ID NO: 2791608 - RNA, 22 nt, Leptospira interrogans serovar lai str. 56601
uucuaucgaacuuacguaaaac

SEQ ID NO: 2791609 - RNA, 21 nt, Leptospira interrogans serovar lai str. 56601
uucuaugaaacgaaauauauu

SEQ ID NO: 2791610 - RNA, 15 nt, Leptospira interrogans serovar lai str. 56601
uucuauuaguuuuua

SEQ ID NO: 2791611 - RNA, 13 nt, Leptospira interrogans serovar lai str. 56601
uucuauuuuaaaa

SEQ ID NO: 2791612 - RNA, 17 nt, Leptospira interrogans serovar lai str. 56601
uucuauuuuaauauauu

SEQ ID NO: 2791613 - RNA, 19 nt, Leptospira interrogans serovar lai str. 56601
uucuauuuuauaaauugug

SEQ ID NO: 2791614 - RNA, 21 nt, Leptospira interrogans serovar lai str. 56601
uucuauuuucuuugaaaaaau

SEQ ID NO: 2791615 - RNA, 15 nt, Leptospira interrogans serovar lai str. 56601
uucuauuuugaguuu

SEQ ID NO: 2791616 - RNA, 12 nt, Leptospira interrogans serovar lai str. 56601
uucucaaaaaau

SEQ ID NO: 2791617 - RNA, 17 nt, Leptospira interrogans serovar lai str. 56601
uucucaaaaaaugcauu

SEQ ID NO: 2791618 - RNA, 19 nt, Leptospira interrogans serovar lai str. 56601
uucucaaaaucuuaauaaa

SEQ ID NO: 2791619 - RNA, 19 nt, Leptospira interrogans serovar lai str. 56601
uucuccacuuaaaaaguuu

SEQ ID NO: 2791620 - RNA, 13 nt, Leptospira interrogans serovar lai str. 56601
uucuccauccuau

SEQ ID NO: 2791621 - RNA, 21 nt, Leptospira interrogans serovar lai str. 56601
uucucccccaacugaaaauga

SEQ ID NO: 2791622 - RNA, 20 nt, Leptospira interrogans serovar lai str. 56601
uucucccuuaccuccuuuuu

SEQ ID NO: 2791623 - RNA, 16 nt, Leptospira interrogans serovar lai str. 56601
uucuccuccugaaaau

SEQ ID NO: 2791624 - RNA, 22 nt, Leptospira interrogans serovar lai str. 56601
uucuccuccugaaaauuuuccu

SEQ ID NO: 2791625 - RNA, 23 nt, Leptospira interrogans serovar lai str. 56601
uucucgaaaaucucagaaaauuu

SEQ ID NO: 2791626 - RNA, 20 nt, Leptospira interrogans serovar lai str. 56601
uucucgcaacggauuccucc

SEQ ID NO: 2791627 - RNA, 15 nt, Leptospira interrogans serovar lai str. 56601
uucucgcauuuuccu

SEQ ID NO: 2791628 - RNA, 18 nt, Leptospira interrogans serovar lai str. 56601
uucucucgacaaucaaaa

SEQ ID NO: 2791629 - RNA, 22 nt, Leptospira interrogans serovar lai str. 56601
uucucucgacaaucaaaacuuu

SEQ ID NO: 2791630 - RNA, 17 nt, Leptospira interrogans serovar lai str. 56601
uucucuucuaauucagu

SEQ ID NO: 2791631 - RNA, 19 nt, Leptospira interrogans serovar lai str. 56601
uucucuucuaauucaguuu

SEQ ID NO: 2791632 - RNA, 22 nt, Leptospira interrogans serovar lai str. 56601
uucucuuuucgaaaauucugcu

SEQ ID NO: 2791633 - RNA, 14 nt, Leptospira interrogans serovar lai str. 56601
uucugaaaaaaauu

SEQ ID NO: 2791634 - RNA, 15 nt, Leptospira interrogans serovar lai str. 56601
uucugaaaaaaguua

SEQ ID NO: 2791635 - RNA, 21 nt, Leptospira interrogans serovar lai str. 56601
uucugaaaaaaguuagaaucu

SEQ ID NO: 2791636 - RNA, 19 nt, Leptospira interrogans serovar lai str. 56601
uucugaaaaaaguugaaau

SEQ ID NO: 2791637 - RNA, 21 nt, Leptospira interrogans serovar lai str. 56601
uucugaaagugaaaguaaucu

SEQ ID NO: 2791638 - RNA, 18 nt, Leptospira interrogans serovar lai str. 56601
uucugaacaagaauuuau

SEQ ID NO: 2791639 - RNA, 17 nt, Leptospira interrogans serovar lai str. 56601
uugaaacuuuuaauaaa

SEQ ID NO: 2791640 - RNA, 18 nt, Leptospira interrogans serovar lai str. 56601
uugaaacuuuuaauaaaa

SEQ ID NO: 2791641 - RNA, 17 nt, Leptospira interrogans serovar lai str. 56601
uugaaagaaucuaauuu

SEQ ID NO: 2791642 - RNA, 20 nt, Leptospira interrogans serovar lai str. 56601
uugaaagaaucuaauuucag

SEQ ID NO: 2791643 - RNA, 15 nt, Leptospira interrogans serovar lai str. 56601
uugaaaguaaaaaag

SEQ ID NO: 2791644 - RNA, 14 nt, Leptospira interrogans serovar lai str. 56601
uugaaaguaaagau

SEQ ID NO: 2791645 - RNA, 14 nt, Leptospira interrogans serovar lai str. 56601
uugaaaguaucaga

SEQ ID NO: 2791646 - RNA, 16 nt, Leptospira interrogans serovar lai str. 56601
uugaaaguuuuucuuu

SEQ ID NO: 2791647 - RNA, 21 nt, Leptospira interrogans serovar lai str. 56601
uugaaauucucuuuugaccaa

SEQ ID NO: 2791648 - RNA, 18 nt, Leptospira interrogans serovar lai str. 56601
uugaacauuuuuaaaaau

SEQ ID NO: 2791649 - RNA, 19 nt, Leptospira interrogans serovar lai str. 56601
uugaacguaaguuaaauau

SEQ ID NO: 2791650 - RNA, 12 nt, Leptospira interrogans serovar lai str. 56601
uugaagaaaaaa

SEQ ID NO: 2791651 - RNA, 23 nt, Leptospira interrogans serovar lai str. 56601
uugaagaaacaauucuuccuuuu

SEQ ID NO: 2791652 - RNA, 17 nt, Leptospira interrogans serovar lai str. 56601
uugaagcaguuuuguua

SEQ ID NO: 2791653 - RNA, 23 nt, Leptospira interrogans serovar lai str. 56601
uugaagcguuuucuuaauuguug

SEQ ID NO: 2791654 - RNA, 18 nt, Leptospira interrogans serovar lai str. 56601
uugaaggaaauuuuguua

SEQ ID NO: 2791655 - RNA, 17 nt, Leptospira interrogans serovar lai str. 56601
uugaaggaguuuuguua

SEQ ID NO: 2791656 - RNA, 17 nt, Leptospira interrogans serovar lai str. 56601
uugaaggguaacucagc

SEQ ID NO: 2791657 - RNA, 14 nt, Leptospira interrogans serovar lai str. 56601
uugaaguagauaca

SEQ ID NO: 2791658 - RNA, 15 nt, Leptospira interrogans serovar lai str. 56601
uugaaguuaagaaga

SEQ ID NO: 2791659 - RNA, 22 nt, Leptospira interrogans serovar lai str. 56601
uugaaguuacgcguuuaaauac

SEQ ID NO: 2791660 - RNA, 22 nt, Leptospira interrogans serovar lai str. 56601
uugaauaaaaccgcugaaaaaa

SEQ ID NO: 2791661 - RNA, 19 nt, Leptospira interrogans serovar lai str. 56601
uugaauacguuuacuccaa

SEQ ID NO: 2791662 - RNA, 15 nt, Leptospira interrogans serovar lai str. 56601
uugaauagaauuugg

SEQ ID NO: 2791663 - RNA, 14 nt, Leptospira interrogans serovar lai str. 56601
uugaauaucauaaa

SEQ ID NO: 2791664 - RNA, 20 nt, Leptospira interrogans serovar lai str. 56601
uugaauauucacuuuuccaa

SEQ ID NO: 2791665 - RNA, 11 nt, Leptospira interrogans serovar lai str. 56601
uugaauauuuu

SEQ ID NO: 2791666 - RNA, 20 nt, Leptospira interrogans serovar lai str. 56601
uugaauauuuuuaaacucau

SEQ ID NO: 2791667 - RNA, 15 nt, Leptospira interrogans serovar lai str. 56601
uugaauccgaauaca

SEQ ID NO: 2791668 - RNA, 18 nt, Leptospira interrogans serovar lai str. 56601
uugaauccgaauacaaag

SEQ ID NO: 2791669 - RNA, 20 nt, Leptospira interrogans serovar lai str. 56601
uugaaugaaaagauuucaaa

SEQ ID NO: 2791670 - RNA, 14 nt, Leptospira interrogans serovar lai str. 56601
uugaaugaaaucua

SEQ ID NO: 2791671 - RNA, 22 nt, Leptospira interrogans serovar lai str. 56601
uugaaugaaaucuaaauuuguu

SEQ ID NO: 2791672 - RNA, 20 nt, Leptospira interrogans serovar lai str. 56601
uugaaugagcuagauuuaga

SEQ ID NO: 2791673 - RNA, 15 nt, Leptospira interrogans serovar lai str. 56601
uugaauguuuacaaa

SEQ ID NO: 2791674 - RNA, 20 nt, Leptospira interrogans serovar lai str. 56601
uugaauguuuacaaagucuu

SEQ ID NO: 2791675 - RNA, 23 nt, Leptospira interrogans serovar lai str. 56601
uugaauuaaaaaacuuuuuaaaa

SEQ ID NO: 2791676 - RNA, 17 nt, Leptospira interrogans serovar lai str. 56601
uugaauucgcuuugguc

SEQ ID NO: 2791677 - RNA, 16 nt, Leptospira interrogans serovar lai str. 56601
uugaauucuuccuucu

SEQ ID NO: 2791678 - RNA, 12 nt, Leptospira interrogans serovar lai str. 56601
uugaauuuaaaa

SEQ ID NO: 2791679 - RNA, 17 nt, Leptospira interrogans serovar lai str. 56601
uugaauuuaaaaguuuc

SEQ ID NO: 2791680 - RNA, 18 nt, Leptospira interrogans serovar lai str. 56601
uugaauuuaaaaguuucc

SEQ ID NO: 2791681 - RNA, 21 nt, Leptospira interrogans serovar lai str. 56601
uugaauuuaggaaauuuucaa

SEQ ID NO: 2791682 - RNA, 20 nt, Leptospira interrogans serovar lai str. 56601
uugaauuuuacuaaaaauuc

SEQ ID NO: 2791683 - RNA, 21 nt, Leptospira interrogans serovar lai str. 56601
uugaauuuuacuaaaaauuca

SEQ ID NO: 2791684 - RNA, 15 nt, Leptospira interrogans serovar lai str. 56601
uugaauuuuuaagaa

SEQ ID NO: 2791685 - RNA, 18 nt, Leptospira interrogans serovar lai str. 56601
uugaauuuuuuaaaugca

SEQ ID NO: 2791686 - RNA, 21 nt, Leptospira interrogans serovar lai str. 56601
uugacaucuuuuaaaaucaag

SEQ ID NO: 2791687 - RNA, 17 nt, Leptospira interrogans serovar lai str. 56601
uugaccggcuucgaucg

SEQ ID NO: 2791688 - RNA, 17 nt, Leptospira interrogans serovar lai str. 56601
uugacuuaggauaaaac

SEQ ID NO: 2791689 - RNA, 14 nt, Leptospira interrogans serovar lai str. 56601
uugacuucggaaca

SEQ ID NO: 2791690 - RNA, 15 nt, Leptospira interrogans serovar lai str. 56601
uugagaaaaguguuu

SEQ ID NO: 2791691 - RNA, 16 nt, Leptospira interrogans serovar lai str. 56601
uugagaaaauaaaaaa

SEQ ID NO: 2791692 - RNA, 18 nt, Leptospira interrogans serovar lai str. 56601
uugagaaaauucgaauca

SEQ ID NO: 2791693 - RNA, 17 nt, Leptospira interrogans serovar lai str. 56601
uugagaagggugaauuu

SEQ ID NO: 2791694 - RNA, 20 nt, Leptospira interrogans serovar lai str. 56601
uugagaauucuacauucuga

SEQ ID NO: 2791695 - RNA, 15 nt, Leptospira interrogans serovar lai str. 56601
uugagacaagaagaa

SEQ ID NO: 2791696 - RNA, 16 nt, Leptospira interrogans serovar lai str. 56601
uugagacaagaagaaa

SEQ ID NO: 2791697 - RNA, 17 nt, Leptospira interrogans serovar lai str. 56601
uugagacaagaagaaaa

SEQ ID NO: 2791698 - RNA, 20 nt, Leptospira interrogans serovar lai str. 56601
uugagagccuuuuuauuucu

SEQ ID NO: 2791699 - RNA, 21 nt, Leptospira interrogans serovar lai str. 56601
uugagcacaauauauucagua

SEQ ID NO: 2791700 - RNA, 16 nt, Leptospira interrogans serovar lai str. 56601
uugagcaguaaaaaag

SEQ ID NO: 2791701 - RNA, 19 nt, Leptospira interrogans serovar lai str. 56601
uugagcaguucuaaucucg

SEQ ID NO: 2791702 - RNA, 20 nt, Leptospira interrogans serovar lai str. 56601
uugagcuaauucuuaaaaau

SEQ ID NO: 2791703 - RNA, 16 nt, Leptospira interrogans serovar lai str. 56601
uugagggguuuuuccu

SEQ ID NO: 2791704 - RNA, 18 nt, Leptospira interrogans serovar lai str. 56601
uugagggguuuuuccuuu

SEQ ID NO: 2791705 - RNA, 19 nt, Leptospira interrogans serovar lai str. 56601
uugagguauuuuagagaaa

SEQ ID NO: 2791706 - RNA, 23 nt, Leptospira interrogans serovar lai str. 56601
uugaguguuuuuaguuuucauua

SEQ ID NO: 2791707 - RNA, 16 nt, Leptospira interrogans serovar lai str. 56601
uugaguucauucugau

SEQ ID NO: 2791708 - RNA, 16 nt, Leptospira interrogans serovar lai str. 56601
uugaguucgacguaag

SEQ ID NO: 2791709 - RNA, 19 nt, Leptospira interrogans serovar lai str. 56601
uugaguuuaagaaacucag

SEQ ID NO: 2791710 - RNA, 20 nt, Leptospira interrogans serovar lai str. 56601
uugaguuuaagaaacucagu

SEQ ID NO: 2791711 - RNA, 23 nt, Leptospira interrogans serovar lai str. 56601
uugaguuuaaggaaguguuugcu

SEQ ID NO: 2791712 - RNA, 11 nt, Leptospira interrogans serovar lai str. 56601
uugaguuucaa

SEQ ID NO: 2791713 - RNA, 14 nt, Leptospira interrogans serovar lai str. 56601
uugaguuucacaaa

SEQ ID NO: 2791714 - RNA, 16 nt, Leptospira interrogans serovar lai str. 56601
uugaguuugacguaag

SEQ ID NO: 2791715 - RNA, 22 nt, Leptospira interrogans serovar lai str. 56601
uugauaaaauauaguuaaauuu

SEQ ID NO: 2791716 - RNA, 22 nt, Leptospira interrogans serovar lai str. 56601
uugauaauucgugaacuuuaga

SEQ ID NO: 2791717 - RNA, 15 nt, Leptospira interrogans serovar lai str. 56601
uugauaauuucauua

SEQ ID NO: 2791718 - RNA, 16 nt, Leptospira interrogans serovar lai str. 56601
uugauaauuucauuau

SEQ ID NO: 2791719 - RNA, 22 nt, Leptospira interrogans serovar lai str. 56601
uugauaauuuuuguuuguaaaa

SEQ ID NO: 2791720 - RNA, 20 nt, Leptospira interrogans serovar lai str. 56601
uugauaccgggauuuuaaaa

SEQ ID NO: 2791721 - RNA, 15 nt, Leptospira interrogans serovar lai str. 56601
uugauaccuaaugcu

SEQ ID NO: 2791722 - RNA, 15 nt, Leptospira interrogans serovar lai str. 56601
uuggguauuuauuau

SEQ ID NO: 2791723 - RNA, 18 nt, Leptospira interrogans serovar lai str. 56601
uuggguuuuacuaaaaaa

SEQ ID NO: 2791724 - RNA, 22 nt, Leptospira interrogans serovar lai str. 56601
uugguagauugcuuuuuaaaag

SEQ ID NO: 2791725 - RNA, 20 nt, Leptospira interrogans serovar lai str. 56601
uugguauuuuagguauuucu

SEQ ID NO: 2791726 - RNA, 22 nt, Leptospira interrogans serovar lai str. 56601
uugguauuuuagguauuucuaa

SEQ ID NO: 2791727 - RNA, 20 nt, Leptospira interrogans serovar lai str. 56601
uuggugauaaucaucaaaau

SEQ ID NO: 2791728 - RNA, 18 nt, Leptospira interrogans serovar lai str. 56601
uuggugauuuaaaaauag

SEQ ID NO: 2791729 - RNA, 16 nt, Leptospira interrogans serovar lai str. 56601
uugguguuguguuagu

SEQ ID NO: 2791730 - RNA, 20 nt, Leptospira interrogans serovar lai str. 56601
uugguucaaaguuuucacaa

SEQ ID NO: 2791731 - RNA, 21 nt, Leptospira interrogans serovar lai str. 56601
uugguucaaaguuuucacaaa

SEQ ID NO: 2791732 - RNA, 17 nt, Leptospira interrogans serovar lai str. 56601
uugguuuguaauaguuc

SEQ ID NO: 2791733 - RNA, 13 nt, Leptospira interrogans serovar lai str. 56601
uuguaaaaaaaca

SEQ ID NO: 2791734 - RNA, 15 nt, Leptospira interrogans serovar lai str. 56601
uuguaaaaaaacaug

SEQ ID NO: 2791735 - RNA, 14 nt, Leptospira interrogans serovar lai str. 56601
uuguaaaaaaauag

SEQ ID NO: 2791736 - RNA, 14 nt, Leptospira interrogans serovar lai str. 56601
uuguaaaaauucuc

SEQ ID NO: 2791737 - RNA, 22 nt, Leptospira interrogans serovar lai str. 56601
uuguaaaacccuaguuuaugug

SEQ ID NO: 2791738 - RNA, 21 nt, Leptospira interrogans serovar lai str. 56601
uuguaaaaggagaauucaauu

SEQ ID NO: 2791739 - RNA, 14 nt, Leptospira interrogans serovar lai str. 56601
uuguaaaauagugg

SEQ ID NO: 2791740 - RNA, 14 nt, Leptospira interrogans serovar lai str. 56601
uuguaaaauugugg

SEQ ID NO: 2791741 - RNA, 13 nt, Leptospira interrogans serovar lai str. 56601
uuguaaacuucug

SEQ ID NO: 2791742 - RNA, 22 nt, Leptospira interrogans serovar lai str. 56601
uuguaaagcaacugugggaacu

SEQ ID NO: 2791743 - RNA, 21 nt, Leptospira interrogans serovar lai str. 56601
uuguaaaucgguucuauaaaa

SEQ ID NO: 2791744 - RNA, 19 nt, Leptospira interrogans serovar lai str. 56601
uuguaaaucuauucuuaaa

SEQ ID NO: 2791745 - RNA, 17 nt, Leptospira interrogans serovar lai str. 56601
uuguaacaguucucaca

SEQ ID NO: 2791746 - RNA, 15 nt, Leptospira interrogans serovar lai str. 56601
uuguaacucaaaauu

SEQ ID NO: 2791747 - RNA, 17 nt, Leptospira interrogans serovar lai str. 56601
uuguaacucaaaauuuc

SEQ ID NO: 2791748 - RNA, 18 nt, Leptospira interrogans serovar lai str. 56601
uuguaaggauuccuuucc

SEQ ID NO: 2791749 - RNA, 22 nt, Leptospira interrogans serovar lai str. 56601
uuguaaguaucuaaaaguuuuc

SEQ ID NO: 2791750 - RNA, 19 nt, Leptospira interrogans serovar lai str. 56601
uuguaauaaaaauuuaaaa

SEQ ID NO: 2791751 - RNA, 12 nt, Leptospira interrogans serovar lai str. 56601
uuguaauaaugu

SEQ ID NO: 2791752 - RNA, 15 nt, Leptospira interrogans serovar lai str. 56601
uuguaauaguuccca

SEQ ID NO: 2791753 - RNA, 16 nt, Leptospira interrogans serovar lai str. 56601
uuguaauaguucccac

SEQ ID NO: 2791754 - RNA, 20 nt, Leptospira interrogans serovar lai str. 56601
uuguaauaguucccacaaau

SEQ ID NO: 2791755 - RNA, 19 nt, Leptospira interrogans serovar lai str. 56601
uuguaauaguucccacagu

SEQ ID NO: 2791756 - RNA, 20 nt, Leptospira interrogans serovar lai str. 56601
uuguaauaguucccacaguu

SEQ ID NO: 2791757 - RNA, 20 nt, Leptospira interrogans serovar lai str. 56601
uuguaaugacacuuaucaaa

SEQ ID NO: 2791758 - RNA, 21 nt, Leptospira interrogans serovar lai str. 56601
uuguaaugacacuuaucaaau

SEQ ID NO: 2791759 - RNA, 22 nt, Leptospira interrogans serovar lai str. 56601
uuguaauuuguucgaaauuggc

SEQ ID NO: 2791760 - RNA, 18 nt, Leptospira interrogans serovar lai str. 56601
uuguacaucuuaaaaaau

SEQ ID NO: 2791761 - RNA, 17 nt, Leptospira interrogans serovar lai str. 56601
uuguacucugcaaaauu

SEQ ID NO: 2791762 - RNA, 15 nt, Leptospira interrogans serovar lai str. 56601
uuguagaauugaaag

SEQ ID NO: 2791763 - RNA, 14 nt, Leptospira interrogans serovar lai str. 56601
uuguagaauuuauu

SEQ ID NO: 2791764 - RNA, 23 nt, Leptospira interrogans serovar lai str. 56601
uuguagacaaaucauagaguuuc

SEQ ID NO: 2791765 - RNA, 15 nt, Leptospira interrogans serovar lai str. 56601
uuguagaucaaaucu

SEQ ID NO: 2791766 - RNA, 15 nt, Leptospira interrogans serovar lai str. 56601
uuguaguucuacauu

SEQ ID NO: 2791767 - RNA, 11 nt, Leptospira interrogans serovar lai str. 56601
uuguaguuuug

SEQ ID NO: 2791768 - RNA, 20 nt, Leptospira interrogans serovar lai str. 56601
uuguauaaaaauuagaaaug

SEQ ID NO: 2791769 - RNA, 18 nt, Leptospira interrogans serovar lai str. 56601
uuguauacaggaaacauu

SEQ ID NO: 2791770 - RNA, 21 nt, Leptospira interrogans serovar lai str. 56601
uuguauccauuucguuucccu

SEQ ID NO: 2791771 - RNA, 15 nt, Leptospira interrogans serovar lai str. 56601
uuguaugaguuccca

SEQ ID NO: 2791772 - RNA, 18 nt, Leptospira interrogans serovar lai str. 56601
uuguaugcaggaaacaua

SEQ ID NO: 2791773 - RNA, 19 nt, Leptospira interrogans serovar lai str. 56601
uuguaugugguaguuccca

SEQ ID NO: 2791774 - RNA, 19 nt, Leptospira interrogans serovar lai str. 56601
uuguauucugaugcaaauu

SEQ ID NO: 2791775 - RNA, 21 nt, Leptospira interrogans serovar lai str. 56601
uuguauuugcaccagaugucu

SEQ ID NO: 2791776 - RNA, 20 nt, Leptospira interrogans serovar lai str. 56601
uuguauuuucccgaaagaac

SEQ ID NO: 2791777 - RNA, 14 nt, Leptospira interrogans serovar lai str. 56601
uuguccauuuccau

SEQ ID NO: 2791778 - RNA, 21 nt, Leptospira interrogans serovar lai str. 56601
uugucccaaaaacucaaagaa

SEQ ID NO: 2791779 - RNA, 21 nt, Leptospira interrogans serovar lai str. 56601
uugucccaaaacuucaaagaa

SEQ ID NO: 2791780 - RNA, 14 nt, Leptospira interrogans serovar lai str. 56601
uugucccaaaauuu

SEQ ID NO: 2791781 - RNA, 16 nt, Leptospira interrogans serovar lai str. 56601
uugucccaaaauuucu

SEQ ID NO: 2791782 - RNA, 18 nt, Leptospira interrogans serovar lai str. 56601
uugucccaaaauuucuaa

SEQ ID NO: 2791783 - RNA, 21 nt, Leptospira interrogans serovar lai str. 56601
uugucccaaaauuuuauaauu

SEQ ID NO: 2791784 - RNA, 14 nt, Leptospira interrogans serovar lai str. 56601
uuguccgaauccaa

SEQ ID NO: 2791785 - RNA, 14 nt, Leptospira interrogans serovar lai str. 56601
uuguccuccagaac

SEQ ID NO: 2791786 - RNA, 22 nt, Leptospira interrogans serovar lai str. 56601
uugucuacgauuucuccaagaa

SEQ ID NO: 2791787 - RNA, 14 nt, Leptospira interrogans serovar lai str. 56601
uugucucaaaauuu

SEQ ID NO: 2791788 - RNA, 17 nt, Leptospira interrogans serovar lai str. 56601
uugucucaaaauuuaag

SEQ ID NO: 2791789 - RNA, 21 nt, Leptospira interrogans serovar lai str. 56601
uugucucgaaacccaaaaaug

SEQ ID NO: 2791790 - RNA, 14 nt, Leptospira interrogans serovar lai str. 56601
uugucuuuaaaauu

SEQ ID NO: 2791791 - RNA, 22 nt, Leptospira interrogans serovar lai str. 56601
uugucuuuauucgcauaacauu

SEQ ID NO: 2791792 - RNA, 12 nt, Leptospira interrogans serovar lai str. 56601
uugugaaacuca

SEQ ID NO: 2791793 - RNA, 13 nt, Leptospira interrogans serovar lai str. 56601
uugugaaacucaa

SEQ ID NO: 2791794 - RNA, 22 nt, Leptospira interrogans serovar lai str. 56601
uugugaacgcccagagauuguc

SEQ ID NO: 2791795 - RNA, 13 nt, Leptospira interrogans serovar lai str. 56601
uugugaauauuuc

SEQ ID NO: 2791796 - RNA, 21 nt, Leptospira interrogans serovar lai str. 56601
uugugacacugaaaacauuuu

SEQ ID NO: 2791797 - RNA, 22 nt, Leptospira interrogans serovar lai str. 56601
uugugacuaauuuugugaauca

SEQ ID NO: 2791798 - RNA, 14 nt, Leptospira interrogans serovar lai str. 56601
uugugagaguucca

SEQ ID NO: 2791799 - RNA, 19 nt, Leptospira interrogans serovar lai str. 56601
uugugaucagugauucgaa

SEQ ID NO: 2791800 - RNA, 23 nt, Leptospira interrogans serovar lai str. 56601
uuguggaaacgucauaguuccca

SEQ ID NO: 2791801 - RNA, 17 nt, Leptospira interrogans serovar lai str. 56601
uuguggauuaugaagaa

SEQ ID NO: 2791802 - RNA, 21 nt, Leptospira interrogans serovar lai str. 56601
uugugggaacuauuauaaaau

SEQ ID NO: 2791803 - RNA, 21 nt, Leptospira interrogans serovar lai str. 56601
uugugguccggaugcgaguaa

SEQ ID NO: 2791804 - RNA, 15 nt, Leptospira interrogans serovar lai str. 56601
uuuaagacaaacuuu

SEQ ID NO: 2791805 - RNA, 20 nt, Leptospira interrogans serovar lai str. 56601
uuuaagauugauuuuaauuu

SEQ ID NO: 2791806 - RNA, 12 nt, Leptospira interrogans serovar lai str. 56601
uuuaaguuugug

SEQ ID NO: 2791807 - RNA, 14 nt, Leptospira interrogans serovar lai str. 56601
uuuaaguuugugag

SEQ ID NO: 2791808 - RNA, 16 nt, Leptospira interrogans serovar lai str. 56601
uuuaaguuugugagag

SEQ ID NO: 2791809 - RNA, 14 nt, Leptospira interrogans serovar lai str. 56601
uuuaauaaaauaca

SEQ ID NO: 2791810 - RNA, 12 nt, Leptospira interrogans serovar lai str. 56601
uuuaauaaaaug

SEQ ID NO: 2791811 - RNA, 14 nt, Leptospira interrogans serovar lai str. 56601
uuuaauaaaaugca

SEQ ID NO: 2791812 - RNA, 17 nt, Leptospira interrogans serovar lai str. 56601
uuuaauaaaauuuuuaa

SEQ ID NO: 2791813 - RNA, 20 nt, Leptospira interrogans serovar lai str. 56601
uuuaauaaaauuuuuaaaaa

SEQ ID NO: 2791814 - RNA, 12 nt, Leptospira interrogans serovar lai str. 56601
uuuaauaaagau

SEQ ID NO: 2791815 - RNA, 18 nt, Leptospira interrogans serovar lai str. 56601
uuuaauaauaugaauuca

SEQ ID NO: 2791816 - RNA, 12 nt, Leptospira interrogans serovar lai str. 56601
uuuaauaauuca

SEQ ID NO: 2791817 - RNA, 14 nt, Leptospira interrogans serovar lai str. 56601
uuuaauacgaauuu

SEQ ID NO: 2791818 - RNA, 18 nt, Leptospira interrogans serovar lai str. 56601
uuuaauauacaaaacauu

SEQ ID NO: 2791819 - RNA, 12 nt, Leptospira interrogans serovar lai str. 56601
uuuaauauauuc

SEQ ID NO: 2791820 - RNA, 13 nt, Leptospira interrogans serovar lai str. 56601
uuuaaucaaugug

SEQ ID NO: 2791821 - RNA, 22 nt, Leptospira interrogans serovar lai str. 56601
uuuaaucaugugaauucagaaa

SEQ ID NO: 2791822 - RNA, 16 nt, Leptospira interrogans serovar lai str. 56601
uuuaauuacaguuaau

SEQ ID NO: 2791823 - RNA, 11 nt, Leptospira interrogans serovar lai str. 56601
uuuaauuauuu

SEQ ID NO: 2791824 - RNA, 15 nt, Leptospira interrogans serovar lai str. 56601
uuuaauuauuuauuu

SEQ ID NO: 2791825 - RNA, 20 nt, Leptospira interrogans serovar lai str. 56601
uuuaauugcgguaguuccca

SEQ ID NO: 2791826 - RNA, 23 nt, Leptospira interrogans serovar lai str. 56601
uuuaauugcgguaguucccacau

SEQ ID NO: 2791827 - RNA, 22 nt, Leptospira interrogans serovar lai str. 56601
uuuaauuggacgagcuuuauuu

SEQ ID NO: 2791828 - RNA, 22 nt, Leptospira interrogans serovar lai str. 56601
uuuaauuucuucauaucaaauu

SEQ ID NO: 2791829 - RNA, 20 nt, Leptospira interrogans serovar lai str. 56601
uuuaauuuguaggaauuccu

SEQ ID NO: 2791830 - RNA, 18 nt, Leptospira interrogans serovar lai str. 56601
uuuaauuuucuaauauaa

SEQ ID NO: 2791831 - RNA, 14 nt, Leptospira interrogans serovar lai str. 56601
uuuacaaaaaugua

SEQ ID NO: 2791832 - RNA, 11 nt, Leptospira interrogans serovar lai str. 56601
uuuacaaacaa

SEQ ID NO: 2791833 - RNA, 17 nt, Leptospira interrogans serovar lai str. 56601
uuuacaaacaaauucua

SEQ ID NO: 2791834 - RNA, 15 nt, Leptospira interrogans serovar lai str. 56601
uuuacaaacuuacau

SEQ ID NO: 2791835 - RNA, 22 nt, Leptospira interrogans serovar lai str. 56601
uuuacaaagacucggaaauucu

SEQ ID NO: 2791836 - RNA, 19 nt, Leptospira interrogans serovar lai str. 56601
uuuacaaagaguuuaaaaa

SEQ ID NO: 2791837 - RNA, 20 nt, Leptospira interrogans serovar lai str. 56601
uuuacaaagaguuuaaaaaa

SEQ ID NO: 2791838 - RNA, 18 nt, Leptospira interrogans serovar lai str. 56601
uuuacaaagucuugaacu

SEQ ID NO: 2791839 - RNA, 15 nt, Leptospira interrogans serovar lai str. 56601
uuuacaaauuggcag

SEQ ID NO: 2791840 - RNA, 21 nt, Leptospira interrogans serovar lai str. 56601
uuuacaauuaaacuucaaaaa

SEQ ID NO: 2791841 - RNA, 19 nt, Leptospira interrogans serovar lai str. 56601
uuuacaauuuauugaccag

SEQ ID NO: 2791842 - RNA, 15 nt, Leptospira interrogans serovar lai str. 56601
uuuacacauuuauuu

SEQ ID NO: 2791843 - RNA, 14 nt, Leptospira interrogans serovar lai str. 56601
uuuacacgauaauu

SEQ ID NO: 2791844 - RNA, 23 nt, Leptospira interrogans serovar lai str. 56601
uuuacacgaucauucuuuagaaa

SEQ ID NO: 2791845 - RNA, 15 nt, Leptospira interrogans serovar lai str. 56601
uuuacagaaaaauca

SEQ ID NO: 2791846 - RNA, 16 nt, Leptospira interrogans serovar lai str. 56601
uuuacagaaaaaucag

SEQ ID NO: 2791847 - RNA, 17 nt, Leptospira interrogans serovar lai str. 56601
uuuacaguaaaaucuaa

SEQ ID NO: 2791848 - RNA, 22 nt, Leptospira interrogans serovar lai str. 56601
uuuacaguaaaaucuaaauuug

SEQ ID NO: 2791849 - RNA, 16 nt, Leptospira interrogans serovar lai str. 56601
uuuacauaagaccaua

SEQ ID NO: 2791850 - RNA, 16 nt, Leptospira interrogans serovar lai str. 56601
uuuacaucaaaaacaa

SEQ ID NO: 2791851 - RNA, 21 nt, Leptospira interrogans serovar lai str. 56601
uuuacaucaacucuguaaauu

SEQ ID NO: 2791852 - RNA, 23 nt, Leptospira interrogans serovar lai str. 56601
uuuacaucaacucuguaaauuca

SEQ ID NO: 2791853 - RNA, 19 nt, Leptospira interrogans serovar lai str. 56601
uuuacaucauguaauauaa

SEQ ID NO: 2791854 - RNA, 19 nt, Leptospira interrogans serovar lai str. 56601
uuuacccgauauuaaaaug

SEQ ID NO: 2791855 - RNA, 16 nt, Leptospira interrogans serovar lai str. 56601
uuuaccuaaaauucag

SEQ ID NO: 2791856 - RNA, 21 nt, Leptospira interrogans serovar lai str. 56601
uuuaccuaaaauucaguuuca

SEQ ID NO: 2791857 - RNA, 18 nt, Leptospira interrogans serovar lai str. 56601
uuuaccuugaaacuuuua

SEQ ID NO: 2791858 - RNA, 13 nt, Leptospira interrogans serovar lai str. 56601
uuuacgaaaauuu

SEQ ID NO: 2791859 - RNA, 17 nt, Leptospira interrogans serovar lai str. 56601
uuuacgaaaauuuuuua

SEQ ID NO: 2791860 - RNA, 23 nt, Leptospira interrogans serovar lai str. 56601
uuuacgaaaguugaaaguuuuuc

SEQ ID NO: 2791861 - RNA, 17 nt, Leptospira interrogans serovar lai str. 56601
uuuacgaacaaauucua

SEQ ID NO: 2791862 - RNA, 20 nt, Leptospira interrogans serovar lai str. 56601
uuuacgaacaaauucuaaaa

SEQ ID NO: 2791863 - RNA, 18 nt, Leptospira interrogans serovar lai str. 56601
uuuacgaacacauucuaa

SEQ ID NO: 2791864 - RNA, 22 nt, Leptospira interrogans serovar lai str. 56601
uuuacgaacgaauucuaaaauu

SEQ ID NO: 2791865 - RNA, 17 nt, Leptospira interrogans serovar lai str. 56601
uuuacgcaggcuuguuu

SEQ ID NO: 2791866 - RNA, 14 nt, Leptospira interrogans serovar lai str. 56601
uuuacggaucaauu

SEQ ID NO: 2791867 - RNA, 16 nt, Leptospira interrogans serovar lai str. 56601
uuuacggcauuuuuua

SEQ ID NO: 2791868 - RNA, 12 nt, Leptospira interrogans serovar lai str. 56601
uuuacguaaauu

SEQ ID NO: 2791869 - RNA, 23 nt, Leptospira interrogans serovar lai str. 56601
uuuacuaaaaaacauaaaaauuu

SEQ ID NO: 2791870 - RNA, 19 nt, Leptospira interrogans serovar lai str. 56601
uuuacuacgucuucuaaau

SEQ ID NO: 2791871 - RNA, 15 nt, Leptospira interrogans serovar lai str. 56601
uuuacucuuauaaaa

SEQ ID NO: 2791872 - RNA, 18 nt, Leptospira interrogans serovar lai str. 56601
uuuacucuuauaaaauuu

SEQ ID NO: 2791873 - RNA, 15 nt, Leptospira interrogans serovar lai str. 56601
uuuacucuuauuuau

SEQ ID NO: 2791874 - RNA, 17 nt, Leptospira interrogans serovar lai str. 56601
uuuacucuuauuuauau

SEQ ID NO: 2791875 - RNA, 20 nt, Leptospira interrogans serovar lai str. 56601
uuuacugcuugacaucuuuu

SEQ ID NO: 2791876 - RNA, 15 nt, Leptospira interrogans serovar lai str. 56601
uuuacuguaaaauuu

SEQ ID NO: 2791877 - RNA, 15 nt, Leptospira interrogans serovar lai str. 56601
uuuacuucaauuauc

SEQ ID NO: 2791878 - RNA, 17 nt, Leptospira interrogans serovar lai str. 56601
uuuacuugcaaaaagua

SEQ ID NO: 2791879 - RNA, 16 nt, Leptospira interrogans serovar lai str. 56601
uuuacuuuaaaauuug

SEQ ID NO: 2791880 - RNA, 13 nt, Leptospira interrogans serovar lai str. 56601
uuuacuuuuucca

SEQ ID NO: 2791881 - RNA, 11 nt, Leptospira interrogans serovar lai str. 56601
uuuagaaaaag

SEQ ID NO: 2791882 - RNA, 23 nt, Leptospira interrogans serovar lai str. 56601
uuuagaaaaagcacaaaacgauc

SEQ ID NO: 2791883 - RNA, 16 nt, Leptospira interrogans serovar lai str. 56601
uuuagaaaaauauuau

SEQ ID NO: 2791884 - RNA, 21 nt, Leptospira interrogans serovar lai str. 56601
uuuagaaaagacuuuuuaugg

SEQ ID NO: 2791885 - RNA, 15 nt, Leptospira interrogans serovar lai str. 56601
uuuagaaaauucaaa

SEQ ID NO: 2791886 - RNA, 15 nt, Leptospira interrogans serovar lai str. 56601
uuuagaaauuucuaa

SEQ ID NO: 2791887 - RNA, 14 nt, Leptospira interrogans serovar lai str. 56601
uuuauguaagaaaa

SEQ ID NO: 2791888 - RNA, 15 nt, Leptospira interrogans serovar lai str. 56601
uuuauuaaaaaguuu

SEQ ID NO: 2791889 - RNA, 13 nt, Leptospira interrogans serovar lai str. 56601
uuuauuaaaaaua

SEQ ID NO: 2791890 - RNA, 15 nt, Leptospira interrogans serovar lai str. 56601
uuuauuaaaaauuuu

SEQ ID NO: 2791891 - RNA, 13 nt, Leptospira interrogans serovar lai str. 56601
uuuauuaaagaau

SEQ ID NO: 2791892 - RNA, 21 nt, Leptospira interrogans serovar lai str. 56601
uuuauuaagaacuuucucgaa

SEQ ID NO: 2791893 - RNA, 22 nt, Leptospira interrogans serovar lai str. 56601
uuuauuauguagccaaaucuga

SEQ ID NO: 2791894 - RNA, 15 nt, Leptospira interrogans serovar lai str. 56601
uuuauucaaaauauc

SEQ ID NO: 2791895 - RNA, 19 nt, Leptospira interrogans serovar lai str. 56601
uuuauucacugaaaauuua

SEQ ID NO: 2791896 - RNA, 18 nt, Leptospira interrogans serovar lai str. 56601
uuuauucguaaaaucuua

SEQ ID NO: 2791897 - RNA, 16 nt, Leptospira interrogans serovar lai str. 56601
uuuauucuaaacaaaa

SEQ ID NO: 2791898 - RNA, 17 nt, Leptospira interrogans serovar lai str. 56601
uuuauugaaaaauagaa

SEQ ID NO: 2791899 - RNA, 16 nt, Leptospira interrogans serovar lai str. 56601
uuuauuggaaaaaguc

SEQ ID NO: 2791900 - RNA, 14 nt, Leptospira interrogans serovar lai str. 56601
uuuauuuaauaaaa

SEQ ID NO: 2791901 - RNA, 18 nt, Leptospira interrogans serovar lai str. 56601
uuuauuuaauaaaauuuu

SEQ ID NO: 2791902 - RNA, 16 nt, Leptospira interrogans serovar lai str. 56601
uuuauuucaaaauuuu

SEQ ID NO: 2791903 - RNA, 14 nt, Leptospira interrogans serovar lai str. 56601
uuuauuucuaaguc

SEQ ID NO: 2791904 - RNA, 14 nt, Leptospira interrogans serovar lai str. 56601
uuuauuucugcugc

SEQ ID NO: 2791905 - RNA, 22 nt, Leptospira interrogans serovar lai str. 56601
uuuauuuuaaaaaaauuuuuau

SEQ ID NO: 2791906 - RNA, 12 nt, Leptospira interrogans serovar lai str. 56601
uuuauuuuaaag

SEQ ID NO: 2791907 - RNA, 13 nt, Leptospira interrogans serovar lai str. 56601
uuuauuuucuauu

SEQ ID NO: 2791908 - RNA, 13 nt, Leptospira interrogans serovar lai str. 56601
uuuauuuuucuaa

SEQ ID NO: 2791909 - RNA, 23 nt, Leptospira interrogans serovar lai str. 56601
uuuauuuuuuacgaaaaaauuga

SEQ ID NO: 2791910 - RNA, 22 nt, Leptospira interrogans serovar lai str. 56601
uuuauuuuuugaagaaaguuua

SEQ ID NO: 2791911 - RNA, 12 nt, Leptospira interrogans serovar lai str. 56601
uuucaaaaaacu

SEQ ID NO: 2791912 - RNA, 18 nt, Leptospira interrogans serovar lai str. 56601
uuucaaaaaauaaaauuu

SEQ ID NO: 2791913 - RNA, 14 nt, Leptospira interrogans serovar lai str. 56601
uuucaaaaaauaua

SEQ ID NO: 2791914 - RNA, 23 nt, Leptospira interrogans serovar lai str. 56601
uuucaaaaaccgaaauagaaaua

SEQ ID NO: 2791915 - RNA, 13 nt, Leptospira interrogans serovar lai str. 56601
uuucaaaaaugua

SEQ ID NO: 2791916 - RNA, 11 nt, Leptospira interrogans serovar lai str. 56601
uuucaaaaauu

SEQ ID NO: 2791917 - RNA, 20 nt, Leptospira interrogans serovar lai str. 56601
uuucaaaaauuccaauaaca

SEQ ID NO: 2791918 - RNA, 13 nt, Leptospira interrogans serovar lai str. 56601
uuucaaaaguauu

SEQ ID NO: 2791919 - RNA, 12 nt, Leptospira interrogans serovar lai str. 56601
uuucaaaaguua

SEQ ID NO: 2791920 - RNA, 17 nt, Leptospira interrogans serovar lai str. 56601
uuucaaaauaagaauuu

SEQ ID NO: 2791921 - RNA, 22 nt, Leptospira interrogans serovar lai str. 56601
uuucaaaaucggaauuuuaauu

SEQ ID NO: 2791922 - RNA, 21 nt, Leptospira interrogans serovar lai str. 56601
uuucaaaauuuuuuuaagagc

SEQ ID NO: 2791923 - RNA, 12 nt, Leptospira interrogans serovar lai str. 56601
uuucaaacguuc

SEQ ID NO: 2791924 - RNA, 22 nt, Leptospira interrogans serovar lai str. 56601
uuucaaacugagauuugucuca

SEQ ID NO: 2791925 - RNA, 17 nt, Leptospira interrogans serovar lai str. 56601
uuucaaagcuauaguuu

SEQ ID NO: 2791926 - RNA, 15 nt, Leptospira interrogans serovar lai str. 56601
uuucaaauaaagaaa

SEQ ID NO: 2791927 - RNA, 22 nt, Leptospira interrogans serovar lai str. 56601
uuucaacaacucuauuuuauuu

SEQ ID NO: 2791928 - RNA, 16 nt, Leptospira interrogans serovar lai str. 56601
uuucaacuuuagaaaa

SEQ ID NO: 2791929 - RNA, 20 nt, Leptospira interrogans serovar lai str. 56601
uuucaacuuuagaaaaauau

SEQ ID NO: 2791930 - RNA, 12 nt, Leptospira interrogans serovar lai str. 56601
uuucaacuuuuu

SEQ ID NO: 2791931 - RNA, 16 nt, Leptospira interrogans serovar lai str. 56601
uuucaagaauuuauuu

SEQ ID NO: 2791932 - RNA, 22 nt, Leptospira interrogans serovar lai str. 56601
uuucaagacaacagaacaaaau

SEQ ID NO: 2791933 - RNA, 13 nt, Leptospira interrogans serovar lai str. 56601
uuucaagauuguc

SEQ ID NO: 2791934 - RNA, 17 nt, Leptospira interrogans serovar lai str. 56601
uuucaaguguucuacgg

SEQ ID NO: 2791935 - RNA, 18 nt, Leptospira interrogans serovar lai str. 56601
uuucaaguguucuacggc

SEQ ID NO: 2791936 - RNA, 15 nt, Leptospira interrogans serovar lai str. 56601
uuucaaguuuucuuu

SEQ ID NO: 2791937 - RNA, 15 nt, Leptospira interrogans serovar lai str. 56601
uuucaauaauucuau

SEQ ID NO: 2791938 - RNA, 22 nt, Leptospira interrogans serovar lai str. 56601
uuucaauacaauaaaaacagau

SEQ ID NO: 2791939 - RNA, 13 nt, Leptospira interrogans serovar lai str. 56601
uuucaauauaaaa

SEQ ID NO: 2791940 - RNA, 22 nt, Leptospira interrogans serovar lai str. 56601
uuucaaucuaacccauucaaca

SEQ ID NO: 2791941 - RNA, 18 nt, Leptospira interrogans serovar lai str. 56601
uuucaaucuauuaacuuu

SEQ ID NO: 2791942 - RNA, 18 nt, Leptospira interrogans serovar lai str. 56601
uuucaauguuuuucgcuu

SEQ ID NO: 2791943 - RNA, 18 nt, Leptospira interrogans serovar lai str. 56601
uuucaauuuaaaauauca

SEQ ID NO: 2791944 - RNA, 13 nt, Leptospira interrogans serovar lai str. 56601
uuucaauuuauca

SEQ ID NO: 2791945 - RNA, 19 nt, Leptospira interrogans serovar lai str. 56601
uuucaauuuucucaaaaaa

SEQ ID NO: 2791946 - RNA, 13 nt, Leptospira interrogans serovar lai str. 56601
uuucaauuuuuau

SEQ ID NO: 2791947 - RNA, 23 nt, Leptospira interrogans serovar lai str. 56601
uuucacaaaaaaauucuccucuu

SEQ ID NO: 2791948 - RNA, 18 nt, Leptospira interrogans serovar lai str. 56601
uuucacagaaacccucuc

SEQ ID NO: 2791949 - RNA, 22 nt, Leptospira interrogans serovar lai str. 56601
uuucacgaacacaaauucuaaa

SEQ ID NO: 2791950 - RNA, 15 nt, Leptospira interrogans serovar lai str. 56601
uuucacuuuaaaaca

SEQ ID NO: 2791951 - RNA, 16 nt, Leptospira interrogans serovar lai str. 56601
uuucacuuuuuuaaag

SEQ ID NO: 2791952 - RNA, 20 nt, Leptospira interrogans serovar lai str. 56601
uuucagacugacugaaaaaa

SEQ ID NO: 2791953 - RNA, 21 nt, Leptospira interrogans serovar lai str. 56601
uuucaguauucuagaauauaa

SEQ ID NO: 2791954 - RNA, 18 nt, Leptospira interrogans serovar lai str. 56601
uuucagugaauaaaauaa

SEQ ID NO: 2791955 - RNA, 19 nt, Leptospira interrogans serovar lai str. 56601
uuucagugaauaaaauaaa

SEQ ID NO: 2791956 - RNA, 18 nt, Leptospira interrogans serovar lai str. 56601
uuucauaaauacaaagua

SEQ ID NO: 2791957 - RNA, 23 nt, Leptospira interrogans serovar lai str. 56601
uuucauaauaaauuuuucuggaa

SEQ ID NO: 2791958 - RNA, 15 nt, Leptospira interrogans serovar lai str. 56601
uuucauaucuaaaau

SEQ ID NO: 2791959 - RNA, 23 nt, Leptospira interrogans serovar lai str. 56601
uuucaucaggaccaaaucuuuca

SEQ ID NO: 2791960 - RNA, 20 nt, Leptospira interrogans serovar lai str. 56601
uuucauccaugucuucuaaa

SEQ ID NO: 2791961 - RNA, 21 nt, Leptospira interrogans serovar lai str. 56601
uuucauccaugucuucuaaau

SEQ ID NO: 2791962 - RNA, 15 nt, Leptospira interrogans serovar lai str. 56601
uuucaucuuugaacu

SEQ ID NO: 2791963 - RNA, 15 nt, Leptospira interrogans serovar lai str. 56601
uuucaugaaauagug

SEQ ID NO: 2791964 - RNA, 21 nt, Leptospira interrogans serovar lai str. 56601
uuucaugaauuaaagaagagc

SEQ ID NO: 2791965 - RNA, 15 nt, Leptospira interrogans serovar lai str. 56601
uuucaugcaaaaauu

SEQ ID NO: 2791966 - RNA, 16 nt, Leptospira interrogans serovar lai str. 56601
uuucaugcaaaaauuu

SEQ ID NO: 2791967 - RNA, 20 nt, Leptospira interrogans serovar lai str. 56601
uuucaugcaaaaauuuaauu

SEQ ID NO: 2791968 - RNA, 21 nt, Leptospira interrogans serovar lai str. 56601
uuucauucaaaauaaauaaua

SEQ ID NO: 2791969 - RNA, 14 nt, Leptospira interrogans serovar lai str. 56601
uuucauucccuucu

SEQ ID NO: 2791970 - RNA, 21 nt, Leptospira interrogans serovar lai str. 56601
uuucuacaaauaaaacuucuc

SEQ ID NO: 2791971 - RNA, 20 nt, Leptospira interrogans serovar lai str. 56601
uuucuacaauuauauuaaau

SEQ ID NO: 2791972 - RNA, 23 nt, Leptospira interrogans serovar lai str. 56601
uuucuacaauuauauuaaauuaa

SEQ ID NO: 2791973 - RNA, 20 nt, Leptospira interrogans serovar lai str. 56601
uuucuacauuuuugugaaac

SEQ ID NO: 2791974 - RNA, 17 nt, Leptospira interrogans serovar lai str. 56601
uuucuagacuuucuuug

SEQ ID NO: 2791975 - RNA, 21 nt, Leptospira interrogans serovar lai str. 56601
uuucuagacuuucuuugaacu

SEQ ID NO: 2791976 - RNA, 15 nt, Leptospira interrogans serovar lai str. 56601
uuucuagauauuuca

SEQ ID NO: 2791977 - RNA, 17 nt, Leptospira interrogans serovar lai str. 56601
uuucuaggauuuuauau

SEQ ID NO: 2791978 - RNA, 23 nt, Leptospira interrogans serovar lai str. 56601
uuucuagugucuaaacuaaaaaa

SEQ ID NO: 2791979 - RNA, 19 nt, Leptospira interrogans serovar lai str. 56601
uuucuauaaaaucuaaaaa

SEQ ID NO: 2791980 - RNA, 19 nt, Leptospira interrogans serovar lai str. 56601
uuucuaucaaaaaauugca

SEQ ID NO: 2791981 - RNA, 16 nt, Leptospira interrogans serovar lai str. 56601
uuucucauucuacuuu

SEQ ID NO: 2791982 - RNA, 20 nt, Leptospira interrogans serovar lai str. 56601
uuucucccuuaccuccuuuu

SEQ ID NO: 2791983 - RNA, 23 nt, Leptospira interrogans serovar lai str. 56601
uuucucccuuaccuccuuuuuca

SEQ ID NO: 2791984 - RNA, 22 nt, Leptospira interrogans serovar lai str. 56601
uuucuccggcgaccuuucuaaa

SEQ ID NO: 2791985 - RNA, 16 nt, Leptospira interrogans serovar lai str. 56601
uuucucgaaaaucuca

SEQ ID NO: 2791986 - RNA, 13 nt, Leptospira interrogans serovar lai str. 56601
uuucucguuuuuu

SEQ ID NO: 2791987 - RNA, 16 nt, Leptospira interrogans serovar lai str. 56601
uuucucuaauucuaaa

SEQ ID NO: 2791988 - RNA, 16 nt, Leptospira interrogans serovar lai str. 56601
uuucucuaucagaaaa

SEQ ID NO: 2791989 - RNA, 13 nt, Leptospira interrogans serovar lai str. 56601
uuucucuucuaau

SEQ ID NO: 2791990 - RNA, 20 nt, Leptospira interrogans serovar lai str. 56601
uuucucuuuuuagacaaaaa

SEQ ID NO: 2791991 - RNA, 15 nt, Leptospira interrogans serovar lai str. 56601
uuucugaaaaaguug

SEQ ID NO: 2791992 - RNA, 19 nt, Leptospira interrogans serovar lai str. 56601
uuucugaaaaaguuggaau

SEQ ID NO: 2791993 - RNA, 22 nt, Leptospira interrogans serovar lai str. 56601
uuucugaaaaguuuaugaauuu

SEQ ID NO: 2791994 - RNA, 12 nt, Leptospira interrogans serovar lai str. 56601
uuucugaaauaa

SEQ ID NO: 2791995 - RNA, 21 nt, Leptospira interrogans serovar lai str. 56601
uuucugauaaagaaaaccuuu

SEQ ID NO: 2791996 - RNA, 22 nt, Leptospira interrogans serovar lai str. 56601
uuucugauagagaaaaauuuuc

SEQ ID NO: 2791997 - RNA, 18 nt, Leptospira interrogans serovar lai str. 56601
uuucugccauuuuuaguc

SEQ ID NO: 2791998 - RNA, 15 nt, Leptospira interrogans serovar lai str. 56601
uuucugcuucuaagu

SEQ ID NO: 2791999 - RNA, 15 nt, Leptospira interrogans serovar lai str. 56601
uuucuggaaaaguuu

SEQ ID NO: 2792000 - RNA, 23 nt, Leptospira interrogans serovar lai str. 56601
uuucuggaaaaguuuuuaaaaau

SEQ ID NO: 2792001 - RNA, 16 nt, Leptospira interrogans serovar lai str. 56601
uuucuggauucugcug

SEQ ID NO: 2792002 - RNA, 21 nt, Leptospira interrogans serovar lai str. 56601
uuucuguaacauccaaacucu

SEQ ID NO: 2792003 - RNA, 12 nt, Leptospira interrogans serovar lai str. 56601
uuucuguagaaa

SEQ ID NO: 2792004 - RNA, 17 nt, Leptospira interrogans serovar lai str. 56601
uuucuguuucaugaaau

SEQ ID NO: 2792005 - RNA, 12 nt, Leptospira interrogans serovar lai str. 56601
uuucuuaaaaag

SEQ ID NO: 2792006 - RNA, 13 nt, Leptospira interrogans serovar lai str. 56601
uuucuuaaaucuu

SEQ ID NO: 2792007 - RNA, 19 nt, Leptospira interrogans serovar lai str. 56601
uuucuuaaauucuaaaaaa

SEQ ID NO: 2792008 - RNA, 19 nt, Leptospira interrogans serovar lai str. 56601
uuucuuaaauuuuuuuuca

SEQ ID NO: 2792009 - RNA, 13 nt, Leptospira interrogans serovar lai str. 56601
uuucuuaauuucu

SEQ ID NO: 2792010 - RNA, 20 nt, Leptospira interrogans serovar lai str. 56601
uuucuuauaaccuaucacaa

SEQ ID NO: 2792011 - RNA, 21 nt, Leptospira interrogans serovar lai str. 56601
uuucuuauaaccuaucacaaa

SEQ ID NO: 2792012 - RNA, 23 nt, Leptospira interrogans serovar lai str. 56601
uuucuuauaaccuaucacaaacu

SEQ ID NO: 2792013 - RNA, 20 nt, Leptospira interrogans serovar lai str. 56601
uuucuuauguggaugauaaa

SEQ ID NO: 2792014 - RNA, 17 nt, Leptospira interrogans serovar lai str. 56601
uuucuuccaauuguucc

SEQ ID NO: 2792015 - RNA, 12 nt, Leptospira interrogans serovar lai str. 56601
uuucuuccggau

SEQ ID NO: 2792016 - RNA, 13 nt, Leptospira interrogans serovar lai str. 56601
uuucuuccggaug

SEQ ID NO: 2792017 - RNA, 15 nt, Leptospira interrogans serovar lai str. 56601
uuucuucuauuucuu

SEQ ID NO: 2792018 - RNA, 12 nt, Leptospira interrogans serovar lai str. 56601
uuucuucugcug

SEQ ID NO: 2792019 - RNA, 22 nt, Leptospira interrogans serovar lai str. 56601
uuucuucugguugaaagaaucu

SEQ ID NO: 2792020 - RNA, 13 nt, Leptospira interrogans serovar lai str. 56601
uuucuucuuugua

SEQ ID NO: 2792021 - RNA, 11 nt, Leptospira interrogans serovar lai str. 56601
uuucuucuuuu

SEQ ID NO: 2792022 - RNA, 15 nt, Leptospira interrogans serovar lai str. 56601
uuucuugaacucaau

SEQ ID NO: 2792023 - RNA, 20 nt, Leptospira interrogans serovar lai str. 56601
uuucuugaacucaauacauc

SEQ ID NO: 2792024 - RNA, 20 nt, Leptospira interrogans serovar lai str. 56601
uuucuugagggguuuuuccu

SEQ ID NO: 2792025 - RNA, 13 nt, Leptospira interrogans serovar lai str. 56601
uuucuugcccaac

SEQ ID NO: 2792026 - RNA, 17 nt, Leptospira interrogans serovar lai str. 56601
uuucuugucucuacucu

SEQ ID NO: 2792027 - RNA, 14 nt, Leptospira interrogans serovar lai str. 56601
uuucuugugucaag

SEQ ID NO: 2792028 - RNA, 17 nt, Leptospira interrogans serovar lai str. 56601
uuucuugugucaagccc

SEQ ID NO: 2792029 - RNA, 21 nt, Leptospira interrogans serovar lai str. 56601
uuucuugugucaagcccuccu

SEQ ID NO: 2792030 - RNA, 22 nt, Leptospira interrogans serovar lai str. 56601
uuucuuuaaugcugauuuuucu

SEQ ID NO: 2792031 - RNA, 23 nt, Leptospira interrogans serovar lai str. 56601
uuucuuuagaaauuuuuaauaaa

SEQ ID NO: 2792032 - RNA, 22 nt, Leptospira interrogans serovar lai str. 56601
uuucuuuagacauuguuuuacu

SEQ ID NO: 2792033 - RNA, 21 nt, Leptospira interrogans serovar lai str. 56601
uuucuuuaucagaaaaacaua

SEQ ID NO: 2792034 - RNA, 15 nt, Leptospira interrogans serovar lai str. 56601
uuucuuuauuggaaa

SEQ ID NO: 2792035 - RNA, 18 nt, Leptospira interrogans serovar lai str. 56601
uuucuuucaaaaauuuaa

SEQ ID NO: 2792036 - RNA, 19 nt, Leptospira interrogans serovar lai str. 56601
uuucuuucggcagccaauu

SEQ ID NO: 2792037 - RNA, 17 nt, Leptospira interrogans serovar lai str. 56601
uuucuuucucucgaaau

SEQ ID NO: 2792038 - RNA, 13 nt, Leptospira interrogans serovar lai str. 56601
uuugaaaaagaau

SEQ ID NO: 2792039 - RNA, 21 nt, Leptospira interrogans serovar lai str. 56601
uuugaaaaaguugggaucuaa

SEQ ID NO: 2792040 - RNA, 17 nt, Leptospira interrogans serovar lai str. 56601
uuugaaaauugugggaa

SEQ ID NO: 2792041 - RNA, 21 nt, Leptospira interrogans serovar lai str. 56601
uuugaaacaucacuuccauuu

SEQ ID NO: 2792042 - RNA, 17 nt, Leptospira interrogans serovar lai str. 56601
uuugaaacauuucuaaa

SEQ ID NO: 2792043 - RNA, 20 nt, Leptospira interrogans serovar lai str. 56601
uuugaaacauuucuaaaaua

SEQ ID NO: 2792044 - RNA, 18 nt, Leptospira interrogans serovar lai str. 56601
uuugaaacuauccaaaag

SEQ ID NO: 2792045 - RNA, 16 nt, Leptospira interrogans serovar lai str. 56601
uuugaaaguucccaaa

SEQ ID NO: 2792046 - RNA, 19 nt, Leptospira interrogans serovar lai str. 56601
uuugaaaucucuaacaaaa

SEQ ID NO: 2792047 - RNA, 19 nt, Leptospira interrogans serovar lai str. 56601
uuugaaaugcaguuucuuc

SEQ ID NO: 2792048 - RNA, 18 nt, Leptospira interrogans serovar lai str. 56601
uuugaaauucagaucuca

SEQ ID NO: 2792049 - RNA, 18 nt, Leptospira interrogans serovar lai str. 56601
uuugaacacgucuuaaau

SEQ ID NO: 2792050 - RNA, 22 nt, Leptospira interrogans serovar lai str. 56601
uuugaacuuguuccaaaacuaa

SEQ ID NO: 2792051 - RNA, 17 nt, Leptospira interrogans serovar lai str. 56601
uuugaagaaacaauucu

SEQ ID NO: 2792052 - RNA, 15 nt, Leptospira interrogans serovar lai str. 56601
uuuguauccauuucg

SEQ ID NO: 2792053 - RNA, 17 nt, Leptospira interrogans serovar lai str. 56601
uuuguaucgaauggaaa

SEQ ID NO: 2792054 - RNA, 13 nt, Leptospira interrogans serovar lai str. 56601
uuuguaugaguuc

SEQ ID NO: 2792055 - RNA, 15 nt, Leptospira interrogans serovar lai str. 56601
uuuguauucaagagc

SEQ ID NO: 2792056 - RNA, 14 nt, Leptospira interrogans serovar lai str. 56601
uuuguccgaaucca

SEQ ID NO: 2792057 - RNA, 19 nt, Leptospira interrogans serovar lai str. 56601
uuugucguaauuccgacga

SEQ ID NO: 2792058 - RNA, 13 nt, Leptospira interrogans serovar lai str. 56601
uuugucucaaaau

SEQ ID NO: 2792059 - RNA, 14 nt, Leptospira interrogans serovar lai str. 56601
uuugucuuuaaaau

SEQ ID NO: 2792060 - RNA, 22 nt, Leptospira interrogans serovar lai str. 56601
uuugucuuugagaaaauucgaa

SEQ ID NO: 2792061 - RNA, 15 nt, Leptospira interrogans serovar lai str. 56601
uuugugaaacucaau

SEQ ID NO: 2792062 - RNA, 13 nt, Leptospira interrogans serovar lai str. 56601
uuugugaacuuuu

SEQ ID NO: 2792063 - RNA, 22 nt, Leptospira interrogans serovar lai str. 56601
uuugugaaguuaaaacauuucg

SEQ ID NO: 2792064 - RNA, 20 nt, Leptospira interrogans serovar lai str. 56601
uuugugacuaucacaaaaau

SEQ ID NO: 2792065 - RNA, 20 nt, Leptospira interrogans serovar lai str. 56601
uuugugagaguuccacauuu

SEQ ID NO: 2792066 - RNA, 21 nt, Leptospira interrogans serovar lai str. 56601
uuugugagaguuccacauuuu

SEQ ID NO: 2792067 - RNA, 21 nt, Leptospira interrogans serovar lai str. 56601
uuugugagaguucccacauuu

SEQ ID NO: 2792068 - RNA, 21 nt, Leptospira interrogans serovar lai str. 56601
uuugugagaguucccacguuu

SEQ ID NO: 2792069 - RNA, 20 nt, Leptospira interrogans serovar lai str. 56601
uuugugcuauauucaaaaaa

SEQ ID NO: 2792070 - RNA, 16 nt, Leptospira interrogans serovar lai str. 56601
uuuguggaaacuauua

SEQ ID NO: 2792071 - RNA, 19 nt, Leptospira interrogans serovar lai str. 56601
uuuguggauuaugaagaau

SEQ ID NO: 2792072 - RNA, 21 nt, Leptospira interrogans serovar lai str. 56601
uuugugggaguucccacauuu

SEQ ID NO: 2792073 - RNA, 13 nt, Leptospira interrogans serovar lai str. 56601
uuuguuagagugc

SEQ ID NO: 2792074 - RNA, 16 nt, Leptospira interrogans serovar lai str. 56601
uuuguuagauucuauu

SEQ ID NO: 2792075 - RNA, 22 nt, Leptospira interrogans serovar lai str. 56601
uuuguuaucaauagaaauacca

SEQ ID NO: 2792076 - RNA, 19 nt, Leptospira interrogans serovar lai str. 56601
uuuguuccaaaaacucaaa

SEQ ID NO: 2792077 - RNA, 18 nt, Leptospira interrogans serovar lai str. 56601
uuuguucuggagaaagau

SEQ ID NO: 2792078 - RNA, 15 nt, Leptospira interrogans serovar lai str. 56601
uuuguugcaauacau

SEQ ID NO: 2792079 - RNA, 20 nt, Leptospira interrogans serovar lai str. 56601
uuuguugcguuuaaaaacag

SEQ ID NO: 2792080 - RNA, 12 nt, Leptospira interrogans serovar lai str. 56601
uuuguuuccuuc

SEQ ID NO: 2792081 - RNA, 13 nt, Leptospira interrogans serovar lai str. 56601
uuuguuuccuucu

SEQ ID NO: 2792082 - RNA, 13 nt, Leptospira interrogans serovar lai str. 56601
uuuguuuguaucc

SEQ ID NO: 2792083 - RNA, 12 nt, Leptospira interrogans serovar lai str. 56601
uuuguuuuaaaa

SEQ ID NO: 2792084 - RNA, 21 nt, Leptospira interrogans serovar lai str. 56601
uuuguuuuaaaauuuaugauc

SEQ ID NO: 2792085 - RNA, 15 nt, Leptospira interrogans serovar lai str. 56601
uuuguuuuauucuaa

SEQ ID NO: 2792086 - RNA, 15 nt, Leptospira interrogans serovar lai str. 56601
uuuguuuucuuuucu

SEQ ID NO: 2792087 - RNA, 21 nt, Leptospira interrogans serovar lai str. 56601
uuuguuuugaaacaguacuuu

SEQ ID NO: 2792088 - RNA, 20 nt, Leptospira interrogans serovar lai str. 56601
uuuguuuugugucuggaacg

SEQ ID NO: 2792089 - RNA, 12 nt, Leptospira interrogans serovar lai str. 56601
uuuguuuuucuu

SEQ ID NO: 2792090 - RNA, 22 nt, Leptospira interrogans serovar lai str. 56601
uuuguuuuuggaaauguuuuuu

SEQ ID NO: 2792091 - RNA, 12 nt, Leptospira interrogans serovar lai str. 56601
uuuuaaaaaagg

SEQ ID NO: 2792092 - RNA, 13 nt, Leptospira interrogans serovar lai str. 56601
uuuuaaaaaauag

SEQ ID NO: 2792093 - RNA, 18 nt, Leptospira interrogans serovar lai str. 56601
uuuuaaaaaaugugaacu

SEQ ID NO: 2792094 - RNA, 14 nt, Leptospira interrogans serovar lai str. 56601
uuuuaaaaaauuca

SEQ ID NO: 2792095 - RNA, 16 nt, Leptospira interrogans serovar lai str. 56601
uuuuaaaaaauuucuu

SEQ ID NO: 2792096 - RNA, 14 nt, Leptospira interrogans serovar lai str. 56601
uuuuaaaaacuugu

SEQ ID NO: 2792097 - RNA, 12 nt, Leptospira interrogans serovar lai str. 56601
uuuuaaaaagaa

SEQ ID NO: 2792098 - RNA, 13 nt, Leptospira interrogans serovar lai str. 56601
uuuuaaaaaguuc

SEQ ID NO: 2792099 - RNA, 14 nt, Leptospira interrogans serovar lai str. 56601
uuuuaaaaaguucu

SEQ ID NO: 2792100 - RNA, 14 nt, Leptospira interrogans serovar lai str. 56601
uuuuaaaaauauaa

SEQ ID NO: 2792101 - RNA, 13 nt, Leptospira interrogans serovar lai str. 56601
uuuuaaaaauguc

SEQ ID NO: 2792102 - RNA, 17 nt, Leptospira interrogans serovar lai str. 56601
uuuuaaaaauucaacua

SEQ ID NO: 2792103 - RNA, 13 nt, Leptospira interrogans serovar lai str. 56601
uuuuaaaaauuuu

SEQ ID NO: 2792104 - RNA, 20 nt, Leptospira interrogans serovar lai str. 56601
uuuuaaaaauuuuauuaaau

SEQ ID NO: 2792105 - RNA, 14 nt, Leptospira interrogans serovar lai str. 56601
uuuuaaaaauuuug

SEQ ID NO: 2792106 - RNA, 18 nt, Leptospira interrogans serovar lai str. 56601
uuuuaaaaccaaaaugcu

SEQ ID NO: 2792107 - RNA, 21 nt, Leptospira interrogans serovar lai str. 56601
uuuuaaaacggaauuuuguuu

SEQ ID NO: 2792108 - RNA, 23 nt, Leptospira interrogans serovar lai str. 56601
uuuuaaaacuuaaaaugugggau

SEQ ID NO: 2792109 - RNA, 17 nt, Leptospira interrogans serovar lai str. 56601
uuuuaaaacuuuuaauu

SEQ ID NO: 2792110 - RNA, 19 nt, Leptospira interrogans serovar lai str. 56601
uuuuaaaagaucugaguuu

SEQ ID NO: 2792111 - RNA, 15 nt, Leptospira interrogans serovar lai str. 56601
uuuuaaaaggcucuc

SEQ ID NO: 2792112 - RNA, 20 nt, Leptospira interrogans serovar lai str. 56601
uuuuaaaaguagaaucaucu

SEQ ID NO: 2792113 - RNA, 19 nt, Leptospira interrogans serovar lai str. 56601
uuuuaaaaguuauuauuuu

SEQ ID NO: 2792114 - RNA, 12 nt, Leptospira interrogans serovar lai str. 56601
uuuuaaaaguuu

SEQ ID NO: 2792115 - RNA, 16 nt, Leptospira interrogans serovar lai str. 56601
uuuuaaaaucaagagc

SEQ ID NO: 2792116 - RNA, 22 nt, Leptospira interrogans serovar lai str. 56601
uuuuaaaaucguccgaacuucu

SEQ ID NO: 2792117 - RNA, 13 nt, Leptospira interrogans serovar lai str. 56601
uuuuaaaaucuuc

SEQ ID NO: 2792118 - RNA, 14 nt, Leptospira interrogans serovar lai str. 56601
uuuuaaaaucuucu

SEQ ID NO: 2792119 - RNA, 12 nt, Leptospira interrogans serovar lai str. 56601
uuuuaaaauugc

SEQ ID NO: 2792120 - RNA, 22 nt, Leptospira interrogans serovar lai str. 56601
uuuuaaaauugcagaauguuuu

SEQ ID NO: 2792121 - RNA, 13 nt, Leptospira interrogans serovar lai str. 56601
uuuuaaaauugug

SEQ ID NO: 2792122 - RNA, 13 nt, Leptospira interrogans serovar lai str. 56601
uuuuaaaauuuau

SEQ ID NO: 2792123 - RNA, 22 nt, Leptospira interrogans serovar lai str. 56601
uuuuaaacauccaauuauaaaa

SEQ ID NO: 2792124 - RNA, 18 nt, Leptospira interrogans serovar lai str. 56601
uuuuaaaccaguuuguuu

SEQ ID NO: 2792125 - RNA, 23 nt, Leptospira interrogans serovar lai str. 56601
uuuuaaacgaacgacuaucuacc

SEQ ID NO: 2792126 - RNA, 19 nt, Leptospira interrogans serovar lai str. 56601
uuuuaaacgauuuaaaaga

SEQ ID NO: 2792127 - RNA, 19 nt, Leptospira interrogans serovar lai str. 56601
uuuuaaacucauucuaguu

SEQ ID NO: 2792128 - RNA, 22 nt, Leptospira interrogans serovar lai str. 56601
uuuuaaagaaacucauaaaaua

SEQ ID NO: 2792129 - RNA, 15 nt, Leptospira interrogans serovar lai str. 56601
uuuuaaaguuuugaa

SEQ ID NO: 2792130 - RNA, 21 nt, Leptospira interrogans serovar lai str. 56601
uuuuaaaguuuugaaauagcu

SEQ ID NO: 2792131 - RNA, 16 nt, Leptospira interrogans serovar lai str. 56601
uuuuaaauaaaaagaa

SEQ ID NO: 2792132 - RNA, 12 nt, Leptospira interrogans serovar lai str. 56601
uuuuaaauacuc

SEQ ID NO: 2792133 - RNA, 20 nt, Leptospira interrogans serovar lai str. 56601
uuuuaaauacucuaauuuuu

SEQ ID NO: 2792134 - RNA, 22 nt, Leptospira interrogans serovar lai str. 56601
uuuuaaauccaacuuaaaacug

SEQ ID NO: 2792135 - RNA, 19 nt, Leptospira interrogans serovar lai str. 56601
uuuuaguuuuuauuugauu

SEQ ID NO: 2792136 - RNA, 19 nt, Leptospira interrogans serovar lai str. 56601
uuuuauaaaaaguuuguuu

SEQ ID NO: 2792137 - RNA, 15 nt, Leptospira interrogans serovar lai str. 56601
uuuuauaaaaauaca

SEQ ID NO: 2792138 - RNA, 11 nt, Leptospira interrogans serovar lai str. 56601
uuuuauaaaac

SEQ ID NO: 2792139 - RNA, 11 nt, Leptospira interrogans serovar lai str. 56601
uuuuauaaaau

SEQ ID NO: 2792140 - RNA, 14 nt, Leptospira interrogans serovar lai str. 56601
uuuuauaaaauacc

SEQ ID NO: 2792141 - RNA, 14 nt, Leptospira interrogans serovar lai str. 56601
uuuuauaaaauuag

SEQ ID NO: 2792142 - RNA, 14 nt, Leptospira interrogans serovar lai str. 56601
uuuuauaaacuucu

SEQ ID NO: 2792143 - RNA, 19 nt, Leptospira interrogans serovar lai str. 56601
uuuuauaaauuauuuuuug

SEQ ID NO: 2792144 - RNA, 13 nt, Leptospira interrogans serovar lai str. 56601
uuuuauaauuuag

SEQ ID NO: 2792145 - RNA, 16 nt, Leptospira interrogans serovar lai str. 56601
uuuuauacauucguuu

SEQ ID NO: 2792146 - RNA, 22 nt, Leptospira interrogans serovar lai str. 56601
uuuuauagaggucgucucaaaa

SEQ ID NO: 2792147 - RNA, 16 nt, Leptospira interrogans serovar lai str. 56601
uuuuauaguauauaau

SEQ ID NO: 2792148 - RNA, 23 nt, Leptospira interrogans serovar lai str. 56601
uuuuauauaaguuaaauuuuuug

SEQ ID NO: 2792149 - RNA, 17 nt, Leptospira interrogans serovar lai str. 56601
uuuuauauaauuuacuu

SEQ ID NO: 2792150 - RNA, 11 nt, Leptospira interrogans serovar lai str. 56601
uuuuauauaga

SEQ ID NO: 2792151 - RNA, 23 nt, Leptospira interrogans serovar lai str. 56601
uuuuauauagaaccaucucaaaa

SEQ ID NO: 2792152 - RNA, 11 nt, Leptospira interrogans serovar lai str. 56601
uuuuaucaaau

SEQ ID NO: 2792153 - RNA, 13 nt, Leptospira interrogans serovar lai str. 56601
uuuuaucaaauaa

SEQ ID NO: 2792154 - RNA, 18 nt, Leptospira interrogans serovar lai str. 56601
uuuuaucaaauaaaguuu

SEQ ID NO: 2792155 - RNA, 17 nt, Leptospira interrogans serovar lai str. 56601
uuuuaucauaaaacacu

SEQ ID NO: 2792156 - RNA, 17 nt, Leptospira interrogans serovar lai str. 56601
uuuuaucauguuuuaua

SEQ ID NO: 2792157 - RNA, 23 nt, Leptospira interrogans serovar lai str. 56601
uuuuaucgcaaaacauuauuuca

SEQ ID NO: 2792158 - RNA, 18 nt, Leptospira interrogans serovar lai str. 56601
uuuuaucuaaaauuucau

SEQ ID NO: 2792159 - RNA, 15 nt, Leptospira interrogans serovar lai str. 56601
uuuuauguaagaaaa

SEQ ID NO: 2792160 - RNA, 16 nt, Leptospira interrogans serovar lai str. 56601
uuuuauguaauauuuc

SEQ ID NO: 2792161 - RNA, 19 nt, Leptospira interrogans serovar lai str. 56601
uuuuauguaauauuucuuu

SEQ ID NO: 2792162 - RNA, 16 nt, Leptospira interrogans serovar lai str. 56601
uuuuauguauuuuaaa

SEQ ID NO: 2792163 - RNA, 18 nt, Leptospira interrogans serovar lai str. 56601
uuuuauguuauauauuuu

SEQ ID NO: 2792164 - RNA, 23 nt, Leptospira interrogans serovar lai str. 56601
uuuuauuacaauuuuaucuuaau

SEQ ID NO: 2792165 - RNA, 13 nt, Leptospira interrogans serovar lai str. 56601
uuuuauuauaaau

SEQ ID NO: 2792166 - RNA, 18 nt, Leptospira interrogans serovar lai str. 56601
uuuuauuauauaauuuuu

SEQ ID NO: 2792167 - RNA, 12 nt, Leptospira interrogans serovar lai str. 56601
uuuuauuucuaa

SEQ ID NO: 2792168 - RNA, 11 nt, Leptospira interrogans serovar lai str. 56601
uuuuauuucug

SEQ ID NO: 2792169 - RNA, 19 nt, Leptospira interrogans serovar lai str. 56601
uuuuauuucuuuuuuguuu

SEQ ID NO: 2792170 - RNA, 18 nt, Leptospira interrogans serovar lai str. 56601
uuuuauuugauuagaaaa

SEQ ID NO: 2792171 - RNA, 13 nt, Leptospira interrogans serovar lai str. 56601
uuuuauuugcauu

SEQ ID NO: 2792172 - RNA, 16 nt, Leptospira interrogans serovar lai str. 56601
uuuuauuuuauucacu

SEQ ID NO: 2792173 - RNA, 18 nt, Leptospira interrogans serovar lai str. 56601
uuuuauuuuuuaugaaaa

SEQ ID NO: 2792174 - RNA, 14 nt, Leptospira interrogans serovar lai str. 56601
uuuucaaaaaauaa

SEQ ID NO: 2792175 - RNA, 14 nt, Leptospira interrogans serovar lai str. 56601
uuuucaaaaacucu

SEQ ID NO: 2792176 - RNA, 20 nt, Leptospira interrogans serovar lai str. 56601
uuuucaaaaauguauccaau

SEQ ID NO: 2792177 - RNA, 16 nt, Leptospira interrogans serovar lai str. 56601
uuuucaaaaguauuuu

SEQ ID NO: 2792178 - RNA, 21 nt, Leptospira interrogans serovar lai str. 56601
uuuucaaaauaagaauuuucu

SEQ ID NO: 2792179 - RNA, 23 nt, Leptospira interrogans serovar lai str. 56601
uuuucaaacguucguaguuuuug

SEQ ID NO: 2792180 - RNA, 12 nt, Leptospira interrogans serovar lai str. 56601
uuuucaaauuug

SEQ ID NO: 2792181 - RNA, 20 nt, Leptospira interrogans serovar lai str. 56601
uuuucaaucgaagaaauaca

SEQ ID NO: 2792182 - RNA, 21 nt, Leptospira interrogans serovar lai str. 56601
uuuucacaaaaaaauucuccu

SEQ ID NO: 2792183 - RNA, 15 nt, Leptospira interrogans serovar lai str. 56601
uuuucagaaaaauga

SEQ ID NO: 2792184 - RNA, 20 nt, Leptospira interrogans serovar lai str. 56601
uuuucagacuuugaaugcaa

SEQ ID NO: 2792185 - RNA, 16 nt, Leptospira interrogans serovar lai str. 56601
uuuucagauuguuauu

SEQ ID NO: 2792186 - RNA, 18 nt, Leptospira interrogans serovar lai str. 56601
uuuucagggaaaaauaag

SEQ ID NO: 2792187 - RNA, 23 nt, Leptospira interrogans serovar lai str. 56601
uuuucagugaauaaaauaaaaaa

SEQ ID NO: 2792188 - RNA, 22 nt, Leptospira interrogans serovar lai str. 56601
uuuucauaaauacaaaguauuc

SEQ ID NO: 2792189 - RNA, 21 nt, Leptospira interrogans serovar lai str. 56601
uuuucauaauaaauuuuucug

SEQ ID NO: 2792190 - RNA, 19 nt, Leptospira interrogans serovar lai str. 56601
uuuucauagaaaaaauaca

SEQ ID NO: 2792191 - RNA, 15 nt, Leptospira interrogans serovar lai str. 56601
uuuucauucuuucca

SEQ ID NO: 2792192 - RNA, 15 nt, Leptospira interrogans serovar lai str. 56601
uuuucauuugaauuu

SEQ ID NO: 2792193 - RNA, 20 nt, Leptospira interrogans serovar lai str. 56601
uuuucauuugaauuuauaga

SEQ ID NO: 2792194 - RNA, 13 nt, Leptospira interrogans serovar lai str. 56601
uuuucauuuugcu

SEQ ID NO: 2792195 - RNA, 16 nt, Leptospira interrogans serovar lai str. 56601
uuuucauuuuuacaau

SEQ ID NO: 2792196 - RNA, 15 nt, Leptospira interrogans serovar lai str. 56601
uuuuccaaaaacuuu

SEQ ID NO: 2792197 - RNA, 23 nt, Leptospira interrogans serovar lai str. 56601
uuuuccagaucauuuuguaaguc

SEQ ID NO: 2792198 - RNA, 18 nt, Leptospira interrogans serovar lai str. 56601
uuuuccagcccauucuuu

SEQ ID NO: 2792199 - RNA, 17 nt, Leptospira interrogans serovar lai str. 56601
uuuuccauaaaaaauga

SEQ ID NO: 2792200 - RNA, 16 nt, Leptospira interrogans serovar lai str. 56601
uuuucccgaaagaacu

SEQ ID NO: 2792201 - RNA, 20 nt, Leptospira interrogans serovar lai str. 56601
uuuucccgaaagaacuccac

SEQ ID NO: 2792202 - RNA, 21 nt, Leptospira interrogans serovar lai str. 56601
uuuucccgcuaaaaguacuuc

SEQ ID NO: 2792203 - RNA, 15 nt, Leptospira interrogans serovar lai str. 56601
uuuuccgaaccuuac

SEQ ID NO: 2792204 - RNA, 20 nt, Leptospira interrogans serovar lai str. 56601
uuuuccggacuuuccagaaa

SEQ ID NO: 2792205 - RNA, 12 nt, Leptospira interrogans serovar lai str. 56601
uuuuccgguaau

SEQ ID NO: 2792206 - RNA, 16 nt, Leptospira interrogans serovar lai str. 56601
uuuuccguaaaaaguu

SEQ ID NO: 2792207 - RNA, 15 nt, Leptospira interrogans serovar lai str. 56601
uuuuccuaaaauuuu

SEQ ID NO: 2792208 - RNA, 19 nt, Leptospira interrogans serovar lai str. 56601
uuuuccuggccucuuaaau

SEQ ID NO: 2792209 - RNA, 18 nt, Leptospira interrogans serovar lai str. 56601
uuuuccuggcugagaacc

SEQ ID NO: 2792210 - RNA, 22 nt, Leptospira interrogans serovar lai str. 56601
uuuuccuggcugagaaccauuu

SEQ ID NO: 2792211 - RNA, 18 nt, Leptospira interrogans serovar lai str. 56601
uuuuccuuaagacccuaa

SEQ ID NO: 2792212 - RNA, 21 nt, Leptospira interrogans serovar lai str. 56601
uuuuccuuaagacccuaaaaa

SEQ ID NO: 2792213 - RNA, 16 nt, Leptospira interrogans serovar lai str. 56601
uuuucgaaaagaaaua

SEQ ID NO: 2792214 - RNA, 22 nt, Leptospira interrogans serovar lai str. 56601
uuuucgaaaagaaauauuaaaa

SEQ ID NO: 2792215 - RNA, 12 nt, Leptospira interrogans serovar lai str. 56601
uuuucgaaacaa

SEQ ID NO: 2792216 - RNA, 17 nt, Leptospira interrogans serovar lai str. 56601
uuuucgaaacaaaauca

SEQ ID NO: 2792217 - RNA, 18 nt, Leptospira interrogans serovar lai str. 56601
uuuucgaauucuuucuau

SEQ ID NO: 2792218 - RNA, 23 nt, Leptospira interrogans serovar lai str. 56601
uuuuggcccuccucuaaaaugcu

SEQ ID NO: 2792219 - RNA, 16 nt, Leptospira interrogans serovar lai str. 56601
uuuugggauuugaauu

SEQ ID NO: 2792220 - RNA, 20 nt, Leptospira interrogans serovar lai str. 56601
uuuugggauuugaauuuaaa

SEQ ID NO: 2792221 - RNA, 20 nt, Leptospira interrogans serovar lai str. 56601
uuuuggguuuggaguauuuu

SEQ ID NO: 2792222 - RNA, 13 nt, Leptospira interrogans serovar lai str. 56601
uuuuguaacuuuu

SEQ ID NO: 2792223 - RNA, 22 nt, Leptospira interrogans serovar lai str. 56601
uuuuguaaguuuuccauucuca

SEQ ID NO: 2792224 - RNA, 19 nt, Leptospira interrogans serovar lai str. 56601
uuuuguaauaguucccaca

SEQ ID NO: 2792225 - RNA, 14 nt, Leptospira interrogans serovar lai str. 56601
uuuuguaaugaaau

SEQ ID NO: 2792226 - RNA, 15 nt, Leptospira interrogans serovar lai str. 56601
uuuuguaaugaaauc

SEQ ID NO: 2792227 - RNA, 13 nt, Leptospira interrogans serovar lai str. 56601
uuuuguauauaaa

SEQ ID NO: 2792228 - RNA, 14 nt, Leptospira interrogans serovar lai str. 56601
uuuugucuuuaaaa

SEQ ID NO: 2792229 - RNA, 19 nt, Leptospira interrogans serovar lai str. 56601
uuuugucuuuaaaauugug

SEQ ID NO: 2792230 - RNA, 20 nt, Leptospira interrogans serovar lai str. 56601
uuuugugaaguuaaaacauu

SEQ ID NO: 2792231 - RNA, 15 nt, Leptospira interrogans serovar lai str. 56601
uuuugugaaucaaaa

SEQ ID NO: 2792232 - RNA, 20 nt, Leptospira interrogans serovar lai str. 56601
uuuuguuaaccaaaaauuca

SEQ ID NO: 2792233 - RNA, 23 nt, Leptospira interrogans serovar lai str. 56601
uuuuguuaauuaaacuuuuauaa

SEQ ID NO: 2792234 - RNA, 18 nt, Leptospira interrogans serovar lai str. 56601
uuuuguuaauugccacua

SEQ ID NO: 2792235 - RNA, 19 nt, Leptospira interrogans serovar lai str. 56601
uuuuguuaggcaauauuau

SEQ ID NO: 2792236 - RNA, 21 nt, Leptospira interrogans serovar lai str. 56601
uuuuguucuggagaaagauuu

SEQ ID NO: 2792237 - RNA, 21 nt, Leptospira interrogans serovar lai str. 56601
uuuuguuugaauccaaaaguu

SEQ ID NO: 2792238 - RNA, 13 nt, Leptospira interrogans serovar lai str. 56601
uuuuguuugaaug

SEQ ID NO: 2792239 - RNA, 17 nt, Leptospira interrogans serovar lai str. 56601
uuuuguuuuauagaaac

SEQ ID NO: 2792240 - RNA, 10 nt, Leptospira interrogans serovar lai str. 56601
uuuuuaaaaa

SEQ ID NO: 2792241 - RNA, 23 nt, Leptospira interrogans serovar lai str. 56601
uuuuuaaaaaauaggaguuccua

SEQ ID NO: 2792242 - RNA, 11 nt, Leptospira interrogans serovar lai str. 56601
uuuuuaaaaau

SEQ ID NO: 2792243 - RNA, 21 nt, Leptospira interrogans serovar lai str. 56601
uuuuuaaaaauauaguuccua

SEQ ID NO: 2792244 - RNA, 16 nt, Leptospira interrogans serovar lai str. 56601
uuuuuaaaaaugucua

SEQ ID NO: 2792245 - RNA, 13 nt, Leptospira interrogans serovar lai str. 56601
uuuuuaaaaauuu

SEQ ID NO: 2792246 - RNA, 12 nt, Leptospira interrogans serovar lai str. 56601
uuuuuaaaaguu

SEQ ID NO: 2792247 - RNA, 13 nt, Leptospira interrogans serovar lai str. 56601
uuuuuaaaaguuu

SEQ ID NO: 2792248 - RNA, 12 nt, Leptospira interrogans serovar lai str. 56601
uuuuuaaaauaa

SEQ ID NO: 2792249 - RNA, 11 nt, Leptospira interrogans serovar lai str. 56601
uuuuuaaaauu

SEQ ID NO: 2792250 - RNA, 20 nt, Leptospira interrogans serovar lai str. 56601
uuuuuaaacgaucagaaaaa

SEQ ID NO: 2792251 - RNA, 14 nt, Leptospira interrogans serovar lai str. 56601
uuuuuaaauacacu

SEQ ID NO: 2792252 - RNA, 18 nt, Leptospira interrogans serovar lai str. 56601
uuuuuaaaugugggaacu

SEQ ID NO: 2792253 - RNA, 12 nt, Leptospira interrogans serovar lai str. 56601
uuuuuaaauuaa

SEQ ID NO: 2792254 - RNA, 15 nt, Leptospira interrogans serovar lai str. 56601
uuuuuaacaauucua

SEQ ID NO: 2792255 - RNA, 18 nt, Leptospira interrogans serovar lai str. 56601
uuuuuaaucauccaauaa

SEQ ID NO: 2792256 - RNA, 20 nt, Leptospira interrogans serovar lai str. 56601
uuuuuacaugagacuauaaa

SEQ ID NO: 2792257 - RNA, 21 nt, Leptospira interrogans serovar lai str. 56601
uuuuuacgcaaguaauacuua

SEQ ID NO: 2792258 - RNA, 22 nt, Leptospira interrogans serovar lai str. 56601
uuuuuagaaaauucaaaauuga

SEQ ID NO: 2792259 - RNA, 14 nt, Leptospira interrogans serovar lai str. 56601
uuuuuagaaaauuu

SEQ ID NO: 2792260 - RNA, 14 nt, Leptospira interrogans serovar lai str. 56601
uuuuuagaauccca

SEQ ID NO: 2792261 - RNA, 21 nt, Leptospira interrogans serovar lai str. 56601
uuuuuagacaaaaauacuaaa

SEQ ID NO: 2792262 - RNA, 22 nt, Leptospira interrogans serovar lai str. 56601
uuuuuagaguguugacucuuuu

SEQ ID NO: 2792263 - RNA, 14 nt, Leptospira interrogans serovar lai str. 56601
uuuuuaguuuuaau

SEQ ID NO: 2792264 - RNA, 18 nt, Leptospira interrogans serovar lai str. 56601
uuuuuaucauaaaacacu

SEQ ID NO: 2792265 - RNA, 15 nt, Leptospira interrogans serovar lai str. 56601
uuuuuauggaauugu

SEQ ID NO: 2792266 - RNA, 12 nt, Leptospira interrogans serovar lai str. 56601
uuuuuauuauaa

SEQ ID NO: 2792267 - RNA, 15 nt, Leptospira interrogans serovar lai str. 56601
uuuuuauuugcauuc

SEQ ID NO: 2792268 - RNA, 22 nt, Leptospira interrogans serovar lai str. 56601
uuuuucaaaaacucuauuagaa

SEQ ID NO: 2792269 - RNA, 24 nt, Leptospira interrogans serovar lai str. 56601
uuuuucaacaacucuauuacuaaa

SEQ ID NO: 2792270 - RNA, 17 nt, Leptospira interrogans serovar lai str. 56601
uuuuucaacaacucucu

SEQ ID NO: 2792271 - RNA, 16 nt, Leptospira interrogans serovar lai str. 56601
uuuuucaacaauucua

SEQ ID NO: 2792272 - RNA, 22 nt, Leptospira interrogans serovar lai str. 56601
uuuuucaagagugguuuucaaa

SEQ ID NO: 2792273 - RNA, 16 nt, Leptospira interrogans serovar lai str. 56601
uuuuucaauaauucua

SEQ ID NO: 2792274 - RNA, 20 nt, Leptospira interrogans serovar lai str. 56601
uuuuucagaaaaagugaauu

SEQ ID NO: 2792275 - RNA, 18 nt, Leptospira interrogans serovar lai str. 56601
uuuuuccaaaaagaaaaa

SEQ ID NO: 2792276 - RNA, 15 nt, Leptospira interrogans serovar lai str. 56601
uuuuuccauaaaaaa

SEQ ID NO: 2792277 - RNA, 23 nt, Leptospira interrogans serovar lai str. 56601
uuuuucccggucucgaauuguuu

SEQ ID NO: 2792278 - RNA, 18 nt, Leptospira interrogans serovar lai str. 56601
uuuuuccgguaauuauaa

SEQ ID NO: 2792279 - RNA, 23 nt, Leptospira interrogans serovar lai str. 56601
uuuuuccuggcugagaaccauuu

SEQ ID NO: 2792280 - RNA, 22 nt, Leptospira interrogans serovar lai str. 56601
uuuuuccuucuuuacaguuuuu

SEQ ID NO: 2792281 - RNA, 16 nt, Leptospira interrogans serovar lai str. 56601
uuuuuccuuuuacgga

SEQ ID NO: 2792282 - RNA, 20 nt, Leptospira interrogans serovar lai str. 56601
uuuuucgaaaagaaauauua

SEQ ID NO: 2792283 - RNA, 16 nt, Leptospira interrogans serovar lai str. 56601
uuuuucgaagauauaa

SEQ ID NO: 2792284 - RNA, 12 nt, Leptospira interrogans serovar lai str. 56601
uuuuucgaauug

SEQ ID NO: 2792285 - RNA, 12 nt, Leptospira interrogans serovar lai str. 56601
uuuuucgcaaau

SEQ ID NO: 2792286 - RNA, 21 nt, Leptospira interrogans serovar lai str. 56601
uuuuucgugauaacaaacuuu

SEQ ID NO: 2792287 - RNA, 20 nt, Leptospira interrogans serovar lai str. 56601
uuuuucuaaaaaaaauguaa

SEQ ID NO: 2792288 - RNA, 14 nt, Leptospira interrogans serovar lai str. 56601
uuuuucuaaauuaa

SEQ ID NO: 2792289 - RNA, 14 nt, Leptospira interrogans serovar lai str. 56601
uuuuucuacaauua

SEQ ID NO: 2792290 - RNA, 12 nt, Leptospira interrogans serovar lai str. 56601
uuuuucucccuu

SEQ ID NO: 2792291 - RNA, 13 nt, Leptospira interrogans serovar lai str. 56601
uuuuucuccuuuu

SEQ ID NO: 2792292 - RNA, 19 nt, Leptospira interrogans serovar lai str. 56601
uuuuucugaaaaaagcuga

SEQ ID NO: 2792293 - RNA, 17 nt, Leptospira interrogans serovar lai str. 56601
uuuuucuguaaaaauaa

SEQ ID NO: 2792294 - RNA, 20 nt, Leptospira interrogans serovar lai str. 56601
uuuuucuuagaccgaacuca

SEQ ID NO: 2792295 - RNA, 13 nt, Leptospira interrogans serovar lai str. 56601
uuuuucuucuuca

SEQ ID NO: 2792296 - RNA, 12 nt, Leptospira interrogans serovar lai str. 56601
uuuuucuucuuu

SEQ ID NO: 2792297 - RNA, 19 nt, Leptospira interrogans serovar lai str. 56601
uuuuugaaaaagaauauaa

SEQ ID NO: 2792298 - RNA, 13 nt, Leptospira interrogans serovar lai str. 56601
uuuuugaaaaagu

SEQ ID NO: 2792299 - RNA, 17 nt, Leptospira interrogans serovar lai str. 56601
uuuuugaagaaacaauu

SEQ ID NO: 2792300 - RNA, 15 nt, Leptospira interrogans serovar lai str. 56601
uuuuugaguaauucc

SEQ ID NO: 2792301 - RNA, 23 nt, Leptospira interrogans serovar lai str. 56601
uuaagaacuuucucgaaaaucuc

SEQ ID NO: 2792302 - RNA, 13 nt, Leptospira interrogans serovar lai str. 56601
uuaagaauaaaua

SEQ ID NO: 2792303 - RNA, 21 nt, Leptospira interrogans serovar lai str. 56601
uuaagaauaaauaaugaaaac

SEQ ID NO: 2792304 - RNA, 13 nt, Leptospira interrogans serovar lai str. 56601
uuaagaauacugg

SEQ ID NO: 2792305 - RNA, 19 nt, Leptospira interrogans serovar lai str. 56601
uuaagaauucuaaacacag

SEQ ID NO: 2792306 - RNA, 20 nt, Leptospira interrogans serovar lai str. 56601
uuaagaauuuguuugucuuu

SEQ ID NO: 2792307 - RNA, 17 nt, Leptospira interrogans serovar lai str. 56601
uuaagacaaacuuuuag

SEQ ID NO: 2792308 - RNA, 21 nt, Leptospira interrogans serovar lai str. 56601
uuaagacaaacuuuuagauaa

SEQ ID NO: 2792309 - RNA, 16 nt, Leptospira interrogans serovar lai str. 56601
uuaagacccuaaaaaa

SEQ ID NO: 2792310 - RNA, 17 nt, Leptospira interrogans serovar lai str. 56601
uuaagauaaauuuagua

SEQ ID NO: 2792311 - RNA, 17 nt, Leptospira interrogans serovar lai str. 56601
uuaagaucauuuaaaac

SEQ ID NO: 2792312 - RNA, 23 nt, Leptospira interrogans serovar lai str. 56601
uuaagauuacauuuuucuaaauu

SEQ ID NO: 2792313 - RNA, 13 nt, Leptospira interrogans serovar lai str. 56601
uuaagcaaaugcc

SEQ ID NO: 2792314 - RNA, 19 nt, Leptospira interrogans serovar lai str. 56601
uuaagcccuugcguaucaa

SEQ ID NO: 2792315 - RNA, 20 nt, Leptospira interrogans serovar lai str. 56601
uuaagcccuugcguaucaaa

SEQ ID NO: 2792316 - RNA, 20 nt, Leptospira interrogans serovar lai str. 56601
uuaagcucgaauaaaaacaa

SEQ ID NO: 2792317 - RNA, 21 nt, Leptospira interrogans serovar lai str. 56601
uuaaguaauauuucucucaaa

SEQ ID NO: 2792318 - RNA, 15 nt, Leptospira interrogans serovar lai str. 56601
uuaaguacuuaauuu

SEQ ID NO: 2792319 - RNA, 15 nt, Leptospira interrogans serovar lai str. 56601
uuaaguaggaacuac

SEQ ID NO: 2792320 - RNA, 22 nt, Leptospira interrogans serovar lai str. 56601
uuaaguauuguuaagauaaauu

SEQ ID NO: 2792321 - RNA, 23 nt, Leptospira interrogans serovar lai str. 56601
uuaagucccauuuagcaauuugu

SEQ ID NO: 2792322 - RNA, 22 nt, Leptospira interrogans serovar lai str. 56601
uuaagucguuguauuuuaaaca

SEQ ID NO: 2792323 - RNA, 16 nt, Leptospira interrogans serovar lai str. 56601
uuaagugaaaauuaca

SEQ ID NO: 2792324 - RNA, 22 nt, Leptospira interrogans serovar lai str. 56601
uuaaguuguguugaaucuuaaa

SEQ ID NO: 2792325 - RNA, 14 nt, Leptospira interrogans serovar lai str. 56601
uuaaguuuaaaaac

SEQ ID NO: 2792326 - RNA, 18 nt, Leptospira interrogans serovar lai str. 56601
uuaaguuugugagaguuc

SEQ ID NO: 2792327 - RNA, 17 nt, Leptospira interrogans serovar lai str. 56601
uuaauaaaaaaaugaau

SEQ ID NO: 2792328 - RNA, 19 nt, Leptospira interrogans serovar lai str. 56601
uuaauaaaaugcaguaguu

SEQ ID NO: 2792329 - RNA, 21 nt, Leptospira interrogans serovar lai str. 56601
uuaauaaaauuuuuaaaaaau

SEQ ID NO: 2792330 - RNA, 20 nt, Leptospira interrogans serovar lai str. 56601
uuaauaaaucaaucuacuug

SEQ ID NO: 2792331 - RNA, 21 nt, Leptospira interrogans serovar lai str. 56601
uuaauaaauugcauaaaagaa

SEQ ID NO: 2792332 - RNA, 14 nt, Leptospira interrogans serovar lai str. 56601
uuaauaauaugaau

SEQ ID NO: 2792333 - RNA, 19 nt, Leptospira interrogans serovar lai str. 56601
uuaauacaguauuucgucu

SEQ ID NO: 2792334 - RNA, 23 nt, Leptospira interrogans serovar lai str. 56601
uuaauagacuaacgauuguaaaa

SEQ ID NO: 2792335 - RNA, 21 nt, Leptospira interrogans serovar lai str. 56601
uuaauaguuuauacuuuaaua

SEQ ID NO: 2792336 - RNA, 22 nt, Leptospira interrogans serovar lai str. 56601
uuaauaguuuauacuuuaauaa

SEQ ID NO: 2792337 - RNA, 13 nt, Leptospira interrogans serovar lai str. 56601
uuaauauaaaaaa

SEQ ID NO: 2792338 - RNA, 16 nt, Leptospira interrogans serovar lai str. 56601
uuaauauaaaaaauaa

SEQ ID NO: 2792339 - RNA, 17 nt, Leptospira interrogans serovar lai str. 56601
uuaauauauuaaaaugu

SEQ ID NO: 2792340 - RNA, 19 nt, Leptospira interrogans serovar lai str. 56601
uuaauauuacauucaauaa

SEQ ID NO: 2792341 - RNA, 21 nt, Leptospira interrogans serovar lai str. 56601
uuaauauuacauucaauaauu

SEQ ID NO: 2792342 - RNA, 17 nt, Leptospira interrogans serovar lai str. 56601
uuaauauucaacuuuuu

SEQ ID NO: 2792343 - RNA, 17 nt, Leptospira interrogans serovar lai str. 56601
uuaauauuuauaaaaca

SEQ ID NO: 2792344 - RNA, 21 nt, Leptospira interrogans serovar lai str. 56601
uuaauauuuucagaagucuuu

SEQ ID NO: 2792345 - RNA, 10 nt, Leptospira interrogans serovar lai str. 56601
uuaaucaaau

SEQ ID NO: 2792346 - RNA, 19 nt, Leptospira interrogans serovar lai str. 56601
uuaaucauccaauaauuua

SEQ ID NO: 2792347 - RNA, 13 nt, Leptospira interrogans serovar lai str. 56601
uuaaucauguuug

SEQ ID NO: 2792348 - RNA, 16 nt, Leptospira interrogans serovar lai str. 56601
uuaaucuguaaaucaa

SEQ ID NO: 2792349 - RNA, 22 nt, Leptospira interrogans serovar lai str. 56601
uuaaugaauccuauaaacuaac

SEQ ID NO: 2792350 - RNA, 22 nt, Leptospira interrogans serovar lai str. 56601
uuaaugagucugucccaaaauc

SEQ ID NO: 2792351 - RNA, 17 nt, Leptospira interrogans serovar lai str. 56601
uuaaugcgaaaauuuaa

SEQ ID NO: 2792352 - RNA, 21 nt, Leptospira interrogans serovar lai str. 56601
uuaaugcgaaaauuuaacuac

SEQ ID NO: 2792353 - RNA, 13 nt, Leptospira interrogans serovar lai str. 56601
uuaauuauggcac

SEQ ID NO: 2792354 - RNA, 18 nt, Leptospira interrogans serovar lai str. 56601
uuaauuaugucucuaauc

SEQ ID NO: 2792355 - RNA, 22 nt, Leptospira interrogans serovar lai str. 56601
uuaauuauguuugccauuuuuu

SEQ ID NO: 2792356 - RNA, 23 nt, Leptospira interrogans serovar lai str. 56601
uuaauucuccauccuauuucugu

SEQ ID NO: 2792357 - RNA, 17 nt, Leptospira interrogans serovar lai str. 56601
uuaauucuccauuuguu

SEQ ID NO: 2792358 - RNA, 13 nt, Leptospira interrogans serovar lai str. 56601
uuaauuuaaaaac

SEQ ID NO: 2792359 - RNA, 16 nt, Leptospira interrogans serovar lai str. 56601
uuaauuuaaucaaaau

SEQ ID NO: 2792360 - RNA, 19 nt, Leptospira interrogans serovar lai str. 56601
uuaauuuaaucaaaauuuc

SEQ ID NO: 2792361 - RNA, 11 nt, Leptospira interrogans serovar lai str. 56601
uuaauuuagaa

SEQ ID NO: 2792362 - RNA, 17 nt, Leptospira interrogans serovar lai str. 56601
uuaauuucaauaacuug

SEQ ID NO: 2792363 - RNA, 23 nt, Leptospira interrogans serovar lai str. 56601
uuaauuucuaaacaauuuuauuu

SEQ ID NO: 2792364 - RNA, 14 nt, Leptospira interrogans serovar lai str. 56601
uuaauuuuaaagaa

SEQ ID NO: 2792365 - RNA, 14 nt, Leptospira interrogans serovar lai str. 56601
uuaauuuuaguaaa

SEQ ID NO: 2792366 - RNA, 16 nt, Leptospira interrogans serovar lai str. 56601
uuaauuuuaguaaaaa

SEQ ID NO: 2792367 - RNA, 23 nt, Leptospira interrogans serovar lai str. 56601
uuaauuuuguaggaauuaguaau

SEQ ID NO: 2792368 - RNA, 12 nt, Leptospira interrogans serovar lai str. 56601
uuaauuuuuaua

SEQ ID NO: 2792369 - RNA, 12 nt, Leptospira interrogans serovar lai str. 56601
uuaauuuuucaa

SEQ ID NO: 2792370 - RNA, 13 nt, Leptospira interrogans serovar lai str. 56601
uuaauuuuucaau

SEQ ID NO: 2792371 - RNA, 14 nt, Leptospira interrogans serovar lai str. 56601
uuaauuuuucaaua

SEQ ID NO: 2792372 - RNA, 11 nt, Leptospira interrogans serovar lai str. 56601
uuaauuuuuua

SEQ ID NO: 2792373 - RNA, 13 nt, Leptospira interrogans serovar lai str. 56601
uuaauuuuuuaaa

SEQ ID NO: 2792374 - RNA, 17 nt, Leptospira interrogans serovar lai str. 56601
uuaauuuuuuaaaaauu

SEQ ID NO: 2792375 - RNA, 23 nt, Leptospira interrogans serovar lai str. 56601
uuaauuuuuuaaaaauuuuauua

SEQ ID NO: 2792376 - RNA, 13 nt, Leptospira interrogans serovar lai str. 56601
uuacaaaaaauga

SEQ ID NO: 2792377 - RNA, 19 nt, Leptospira interrogans serovar lai str. 56601
uuacaaaaaaugaauuuag

SEQ ID NO: 2792378 - RNA, 21 nt, Leptospira interrogans serovar lai str. 56601
uuacaaagcacuuuuuuccuc

SEQ ID NO: 2792379 - RNA, 18 nt, Leptospira interrogans serovar lai str. 56601
uuacaaagugaugaagag

SEQ ID NO: 2792380 - RNA, 21 nt, Leptospira interrogans serovar lai str. 56601
uuacaaagugaugaagagaaa

SEQ ID NO: 2792381 - RNA, 22 nt, Leptospira interrogans serovar lai str. 56601
uuacaaauagguuuugaacuac

SEQ ID NO: 2792382 - RNA, 17 nt, Leptospira interrogans serovar lai str. 56601
uuacaaauuaguauuuu

SEQ ID NO: 2792383 - RNA, 21 nt, Leptospira interrogans serovar lai str. 56601
aaaaacuuuuuauaaagauuu

SEQ ID NO: 2792384 - RNA, 12 nt, Leptospira interrogans serovar lai str. 56601
aaaaagaaaaac

SEQ ID NO: 2792385 - RNA, 13 nt, Leptospira interrogans serovar lai str. 56601
aaaaagaaaaaca

SEQ ID NO: 2792386 - RNA, 14 nt, Leptospira interrogans serovar lai str. 56601
aaaaagaaaaaucu

SEQ ID NO: 2792387 - RNA, 15 nt, Leptospira interrogans serovar lai str. 56601
aaaaagaaaaaucuu

SEQ ID NO: 2792388 - RNA, 23 nt, Leptospira interrogans serovar lai str. 56601
aaaaagaaaaaucuucaguucuu

SEQ ID NO: 2792389 - RNA, 13 nt, Leptospira interrogans serovar lai str. 56601
aaaaagaaagcaa

SEQ ID NO: 2792390 - RNA, 18 nt, Leptospira interrogans serovar lai str. 56601
aaaaagaaagcaaacuuu

SEQ ID NO: 2792391 - RNA, 19 nt, Leptospira interrogans serovar lai str. 56601
aaaaagaaagcaaacuuuu

SEQ ID NO: 2792392 - RNA, 16 nt, Leptospira interrogans serovar lai str. 56601
aaaaagaaagcagcaa

SEQ ID NO: 2792393 - RNA, 20 nt, Leptospira interrogans serovar lai str. 56601
aaaaagaaaguugcaaagaa

SEQ ID NO: 2792394 - RNA, 15 nt, Leptospira interrogans serovar lai str. 56601
aaaaagaaucauaca

SEQ ID NO: 2792395 - RNA, 11 nt, Leptospira interrogans serovar lai str. 56601
aaaaagaauug

SEQ ID NO: 2792396 - RNA, 13 nt, Leptospira interrogans serovar lai str. 56601
aaaaagaauuguu

SEQ ID NO: 2792397 - RNA, 16 nt, Leptospira interrogans serovar lai str. 56601
aaaaagaauuucuaaa

SEQ ID NO: 2792398 - RNA, 20 nt, Leptospira interrogans serovar lai str. 56601
aaaaagaauuucuaaaauuc

SEQ ID NO: 2792399 - RNA, 21 nt, Leptospira interrogans serovar lai str. 56601
aaaaagaauuucuaaaauucu

SEQ ID NO: 2792400 - RNA, 23 nt, Leptospira interrogans serovar lai str. 56601
aaaaagacucauucuugucggaa

SEQ ID NO: 2792401 - RNA, 15 nt, Leptospira interrogans serovar lai str. 56601
aaaaagacuuaaaag

SEQ ID NO: 2792402 - RNA, 11 nt, Leptospira interrogans serovar lai str. 56601
aaaaagagaau

SEQ ID NO: 2792403 - RNA, 15 nt, Leptospira interrogans serovar lai str. 56601
aaaaagauaaaaaga

SEQ ID NO: 2792404 - RNA, 14 nt, Leptospira interrogans serovar lai str. 56601
aaaaagcacaaaac

SEQ ID NO: 2792405 - RNA, 15 nt, Leptospira interrogans serovar lai str. 56601
aaaaagcacaaaacg

SEQ ID NO: 2792406 - RNA, 17 nt, Leptospira interrogans serovar lai str. 56601
aaaaagcacaaaacgau

SEQ ID NO: 2792407 - RNA, 16 nt, Leptospira interrogans serovar lai str. 56601
aaaaagcagcuaaaaa

SEQ ID NO: 2792408 - RNA, 19 nt, Leptospira interrogans serovar lai str. 56601
aaaaagcagcuaaaaagaa

SEQ ID NO: 2792409 - RNA, 22 nt, Leptospira interrogans serovar lai str. 56601
aaaaagcggucuugaaaauuca

SEQ ID NO: 2792410 - RNA, 21 nt, Leptospira interrogans serovar lai str. 56601
aaaaagcguuucauugaguuu

SEQ ID NO: 2792411 - RNA, 19 nt, Leptospira interrogans serovar lai str. 56601
aaaaagcugaacuuaaaau

SEQ ID NO: 2792412 - RNA, 18 nt, Leptospira interrogans serovar lai str. 56601
aaaaagcuguuguuauag

SEQ ID NO: 2792413 - RNA, 18 nt, Leptospira interrogans serovar lai str. 56601
aaaaaggcacauuuuuca

SEQ ID NO: 2792414 - RNA, 15 nt, Leptospira interrogans serovar lai str. 56601
aaaaagggauucuau

SEQ ID NO: 2792415 - RNA, 17 nt, Leptospira interrogans serovar lai str. 56601
aaaaagggauucuauuc

SEQ ID NO: 2792416 - RNA, 14 nt, Leptospira interrogans serovar lai str. 56601
aaaaaguauaauuu

SEQ ID NO: 2792417 - RNA, 17 nt, Leptospira interrogans serovar lai str. 56601
aaaaaguauauauuaaa

SEQ ID NO: 2792418 - RNA, 13 nt, Leptospira interrogans serovar lai str. 56601
aaaaaguauguuu

SEQ ID NO: 2792419 - RNA, 13 nt, Leptospira interrogans serovar lai str. 56601
aaaaaguccaaaa

SEQ ID NO: 2792420 - RNA, 16 nt, Leptospira interrogans serovar lai str. 56601
aaaaaguccaaaacaa

SEQ ID NO: 2792421 - RNA, 15 nt, Leptospira interrogans serovar lai str. 56601
aaaaagucucaaaac

SEQ ID NO: 2792422 - RNA, 21 nt, Leptospira interrogans serovar lai str. 56601
aaaaaguguuuauaauuuuua

SEQ ID NO: 2792423 - RNA, 22 nt, Leptospira interrogans serovar lai str. 56601
aaaaaguguuuauaauuuuuac

SEQ ID NO: 2792424 - RNA, 14 nt, Leptospira interrogans serovar lai str. 56601
aaaaaguucucuuc

SEQ ID NO: 2792425 - RNA, 20 nt, Leptospira interrogans serovar lai str. 56601
aaaaaguugcuaagaaaaaa

SEQ ID NO: 2792426 - RNA, 21 nt, Leptospira interrogans serovar lai str. 56601
aaaaaguugcuaagaaaaaag

SEQ ID NO: 2792427 - RNA, 22 nt, Leptospira interrogans serovar lai str. 56601
aaaaaguugcuaagaaaaaagc

SEQ ID NO: 2792428 - RNA, 21 nt, Leptospira interrogans serovar lai str. 56601
aaaaaguuggaaucugaauuu

SEQ ID NO: 2792429 - RNA, 22 nt, Leptospira interrogans serovar lai str. 56601
aaaaaguugggaucuaaacuuu

SEQ ID NO: 2792430 - RNA, 13 nt, Leptospira interrogans serovar lai str. 56601
aaaaaguuuuaca

SEQ ID NO: 2792431 - RNA, 20 nt, Leptospira interrogans serovar lai str. 56601
aaaaaguuuuauaaacgauu

SEQ ID NO: 2792432 - RNA, 15 nt, Leptospira interrogans serovar lai str. 56601
aaaaauaaaguauuu

SEQ ID NO: 2792433 - RNA, 23 nt, Leptospira interrogans serovar lai str. 56601
aaaaauaacaauagcuuaaaagu

SEQ ID NO: 2792434 - RNA, 23 nt, Leptospira interrogans serovar lai str. 56601
aaaaauaauacaauucugaaauu

SEQ ID NO: 2792435 - RNA, 18 nt, Leptospira interrogans serovar lai str. 56601
aaaaauacauaaaaaaau

SEQ ID NO: 2792436 - RNA, 20 nt, Leptospira interrogans serovar lai str. 56601
aaaaauacggguaaaucgcu

SEQ ID NO: 2792437 - RNA, 14 nt, Leptospira interrogans serovar lai str. 56601
aaaaauacuaaauu

SEQ ID NO: 2792438 - RNA, 16 nt, Leptospira interrogans serovar lai str. 56601
aaaaauacuguuaauu

SEQ ID NO: 2792439 - RNA, 14 nt, Leptospira interrogans serovar lai str. 56601
aaaaauacuuuacg

SEQ ID NO: 2792440 - RNA, 21 nt, Leptospira interrogans serovar lai str. 56601
aaaaauacuuuauuuguauuc

SEQ ID NO: 2792441 - RNA, 17 nt, Leptospira interrogans serovar lai str. 56601
aaaaauacuuugaacuu

SEQ ID NO: 2792442 - RNA, 21 nt, Leptospira interrogans serovar lai str. 56601
aaaaauagaauuuuuguagaa

SEQ ID NO: 2792443 - RNA, 20 nt, Leptospira interrogans serovar lai str. 56601
aaaaauagcgauacuuaaaa

SEQ ID NO: 2792444 - RNA, 22 nt, Leptospira interrogans serovar lai str. 56601
aaaaauaggaguuccuacauuu

SEQ ID NO: 2792445 - RNA, 11 nt, Leptospira interrogans serovar lai str. 56601
aaaaauaggga

SEQ ID NO: 2792446 - RNA, 17 nt, Leptospira interrogans serovar lai str. 56601
aaaaauagggaaaacuc

SEQ ID NO: 2792447 - RNA, 16 nt, Leptospira interrogans serovar lai str. 56601
aaaaauauaaaucaau

SEQ ID NO: 2792448 - RNA, 14 nt, Leptospira interrogans serovar lai str. 56601
aaaaauauaauaua

SEQ ID NO: 2792449 - RNA, 13 nt, Leptospira interrogans serovar lai str. 56601
aaaaauauaguuc

SEQ ID NO: 2792450 - RNA, 21 nt, Leptospira interrogans serovar lai str. 56601
aaaaauauaguuccuacaauu

SEQ ID NO: 2792451 - RNA, 13 nt, Leptospira interrogans serovar lai str. 56601
aaaaauauauuau

SEQ ID NO: 2792452 - RNA, 12 nt, Leptospira interrogans serovar lai str. 56601
aaaaauaucuaa

SEQ ID NO: 2792453 - RNA, 17 nt, Leptospira interrogans serovar lai str. 56601
aaaaauaucuuagaaua

SEQ ID NO: 2792454 - RNA, 21 nt, Leptospira interrogans serovar lai str. 56601
aaaaauaucuuagaauaauag

SEQ ID NO: 2792455 - RNA, 12 nt, Leptospira interrogans serovar lai str. 56601
aaaaauaugauu

SEQ ID NO: 2792456 - RNA, 16 nt, Leptospira interrogans serovar lai str. 56601
aaaaauaugauuuaaa

SEQ ID NO: 2792457 - RNA, 20 nt, Leptospira interrogans serovar lai str. 56601
aaaaauaugauuuaaaauca

SEQ ID NO: 2792458 - RNA, 24 nt, Leptospira interrogans serovar lai str. 56601
aaaaauaugauuuaaaaucacaaa

SEQ ID NO: 2792459 - RNA, 14 nt, Leptospira interrogans serovar lai str. 56601
aaaaauauuaaaac

SEQ ID NO: 2792460 - RNA, 15 nt, Leptospira interrogans serovar lai str. 56601
aaaaauauuaaaaca

SEQ ID NO: 2792461 - RNA, 18 nt, Leptospira interrogans serovar lai str. 56601
aaaaauauuaaaacacuu

SEQ ID NO: 2792462 - RNA, 21 nt, Leptospira interrogans serovar lai str. 56601
aaaaauauuggguauuuauua

SEQ ID NO: 2792463 - RNA, 14 nt, Leptospira interrogans serovar lai str. 56601
aaaaauauuucaaa

SEQ ID NO: 2792464 - RNA, 19 nt, Leptospira interrogans serovar lai str. 56601
aaaaauauuucaaaaauuu

SEQ ID NO: 2792465 - RNA, 17 nt, Leptospira interrogans serovar lai str. 56601
aaaaaucaaauauacaa

SEQ ID NO: 2792466 - RNA, 20 nt, Leptospira interrogans serovar lai str. 56601
aaaacaauauucuaauuuua

SEQ ID NO: 2792467 - RNA, 19 nt, Leptospira interrogans serovar lai str. 56601
aaaacaaucuucaaauucu

SEQ ID NO: 2792468 - RNA, 22 nt, Leptospira interrogans serovar lai str. 56601
aaaacaaucuucaaauucuaca

SEQ ID NO: 2792469 - RNA, 16 nt, Leptospira interrogans serovar lai str. 56601
aaaacaccuucucuuu

SEQ ID NO: 2792470 - RNA, 22 nt, Leptospira interrogans serovar lai str. 56601
aaaacaccuucucuuuuaaaaa

SEQ ID NO: 2792471 - RNA, 16 nt, Leptospira interrogans serovar lai str. 56601
aaaacacgauuuauag

SEQ ID NO: 2792472 - RNA, 22 nt, Leptospira interrogans serovar lai str. 56601
aaaacagauggagaauugauuu

SEQ ID NO: 2792473 - RNA, 15 nt, Leptospira interrogans serovar lai str. 56601
aaaacagcacuaaaa

SEQ ID NO: 2792474 - RNA, 12 nt, Leptospira interrogans serovar lai str. 56601
aaaacauaaaaa

SEQ ID NO: 2792475 - RNA, 18 nt, Leptospira interrogans serovar lai str. 56601
aaaacauaaaaauuuuuu

SEQ ID NO: 2792476 - RNA, 11 nt, Leptospira interrogans serovar lai str. 56601
aaaacauccuc

SEQ ID NO: 2792477 - RNA, 15 nt, Leptospira interrogans serovar lai str. 56601
aaaacauuauuucaa

SEQ ID NO: 2792478 - RNA, 23 nt, Leptospira interrogans serovar lai str. 56601
aaaacauuauuucaaugcaaaaa

SEQ ID NO: 2792479 - RNA, 12 nt, Leptospira interrogans serovar lai str. 56601
aaaaccaaaaug

SEQ ID NO: 2792480 - RNA, 14 nt, Leptospira interrogans serovar lai str. 56601
aaaaccaauuuuuc

SEQ ID NO: 2792481 - RNA, 19 nt, Leptospira interrogans serovar lai str. 56601
aaaaccagauguaaucuau

SEQ ID NO: 2792482 - RNA, 17 nt, Leptospira interrogans serovar lai str. 56601
aaaaccaucuuugauau

SEQ ID NO: 2792483 - RNA, 21 nt, Leptospira interrogans serovar lai str. 56601
aaaaccaugauucugaaaaaa

SEQ ID NO: 2792484 - RNA, 15 nt, Leptospira interrogans serovar lai str. 56601
aaaacccaauaccaa

SEQ ID NO: 2792485 - RNA, 19 nt, Leptospira interrogans serovar lai str. 56601
aaaacccaauaccaaacga

SEQ ID NO: 2792486 - RNA, 20 nt, Leptospira interrogans serovar lai str. 56601
aaaacccaauaccaaacgau

SEQ ID NO: 2792487 - RNA, 14 nt, Leptospira interrogans serovar lai str. 56601
aaaaccccauuaaa

SEQ ID NO: 2792488 - RNA, 16 nt, Leptospira interrogans serovar lai str. 56601
aaaaccccauuaaaaa

SEQ ID NO: 2792489 - RNA, 15 nt, Leptospira interrogans serovar lai str. 56601
aaaaccgaaaaucgu

SEQ ID NO: 2792490 - RNA, 16 nt, Leptospira interrogans serovar lai str. 56601
aaaaccgcaaauuuua

SEQ ID NO: 2792491 - RNA, 14 nt, Leptospira interrogans serovar lai str. 56601
aaaaccgucccaaa

SEQ ID NO: 2792492 - RNA, 17 nt, Leptospira interrogans serovar lai str. 56601
aaaaccguuguuuuaca

SEQ ID NO: 2792493 - RNA, 14 nt, Leptospira interrogans serovar lai str. 56601
aaaaccguuuguaa

SEQ ID NO: 2792494 - RNA, 16 nt, Leptospira interrogans serovar lai str. 56601
aaaaccguuuuauaaa

SEQ ID NO: 2792495 - RNA, 16 nt, Leptospira interrogans serovar lai str. 56601
aaaaccuaaaauagau

SEQ ID NO: 2792496 - RNA, 21 nt, Leptospira interrogans serovar lai str. 56601
aaaaccuaguguuuaauuuua

SEQ ID NO: 2792497 - RNA, 21 nt, Leptospira interrogans serovar lai str. 56601
aaaaccuaucuaacgauccuu

SEQ ID NO: 2792498 - RNA, 13 nt, Leptospira interrogans serovar lai str. 56601
aaaaccucaaaaa

SEQ ID NO: 2792499 - RNA, 15 nt, Leptospira interrogans serovar lai str. 56601
aaaaccucaaaaaau

SEQ ID NO: 2792500 - RNA, 20 nt, Leptospira interrogans serovar lai str. 56601
aaaaccucuguuuugcgauu

SEQ ID NO: 2792501 - RNA, 16 nt, Leptospira interrogans serovar lai str. 56601
aaaaccuucgugaaau

SEQ ID NO: 2792502 - RNA, 23 nt, Leptospira interrogans serovar lai str. 56601
aaaacgaaauuauacaaaacucu

SEQ ID NO: 2792503 - RNA, 21 nt, Leptospira interrogans serovar lai str. 56601
aaaacgagaaagaauuuccua

SEQ ID NO: 2792504 - RNA, 20 nt, Leptospira interrogans serovar lai str. 56601
aaaacgcgauccguaaaaaa

SEQ ID NO: 2792505 - RNA, 21 nt, Leptospira interrogans serovar lai str. 56601
aaaacgcgauccguaaaaaac

SEQ ID NO: 2792506 - RNA, 16 nt, Leptospira interrogans serovar lai str. 56601
aaaacgcucucuacgg

SEQ ID NO: 2792507 - RNA, 18 nt, Leptospira interrogans serovar lai str. 56601
aaaacgguaauuucauaa

SEQ ID NO: 2792508 - RNA, 23 nt, Leptospira interrogans serovar lai str. 56601
aaaacgguaauuucauaaaauuc

SEQ ID NO: 2792509 - RNA, 15 nt, Leptospira interrogans serovar lai str. 56601
aaaacgguaauuuua

SEQ ID NO: 2792510 - RNA, 16 nt, Leptospira interrogans serovar lai str. 56601
aaaacggugauuguuu

SEQ ID NO: 2792511 - RNA, 13 nt, Leptospira interrogans serovar lai str. 56601
aaaacgucuuuau

SEQ ID NO: 2792512 - RNA, 13 nt, Leptospira interrogans serovar lai str. 56601
aaaacguggauuu

SEQ ID NO: 2792513 - RNA, 20 nt, Leptospira interrogans serovar lai str. 56601
aaaacguggauuuuauguaa

SEQ ID NO: 2792514 - RNA, 19 nt, Leptospira interrogans serovar lai str. 56601
aaaacguuuuguugaguuu

SEQ ID NO: 2792515 - RNA, 13 nt, Leptospira interrogans serovar lai str. 56601
aaaacuaaaacga

SEQ ID NO: 2792516 - RNA, 15 nt, Leptospira interrogans serovar lai str. 56601
aaaacuaaaacgacu

SEQ ID NO: 2792517 - RNA, 13 nt, Leptospira interrogans serovar lai str. 56601
aaaacucaaagaa

SEQ ID NO: 2792518 - RNA, 22 nt, Leptospira interrogans serovar lai str. 56601
aaaacucaaaggaaaaugaaga

SEQ ID NO: 2792519 - RNA, 15 nt, Leptospira interrogans serovar lai str. 56601
aaaacucaacacaac

SEQ ID NO: 2792520 - RNA, 15 nt, Leptospira interrogans serovar lai str. 56601
aaaacucagcgaaua

SEQ ID NO: 2792521 - RNA, 14 nt, Leptospira interrogans serovar lai str. 56601
aaaacucaucacaa

SEQ ID NO: 2792522 - RNA, 15 nt, Leptospira interrogans serovar lai str. 56601
aaaacucaucacaac

SEQ ID NO: 2792523 - RNA, 12 nt, Leptospira interrogans serovar lai str. 56601
aaaacucuaaau

SEQ ID NO: 2792524 - RNA, 19 nt, Leptospira interrogans serovar lai str. 56601
aaaacucuaaauucagaaa

SEQ ID NO: 2792525 - RNA, 22 nt, Leptospira interrogans serovar lai str. 56601
aaaacucuaccuuuauuuaaaa

SEQ ID NO: 2792526 - RNA, 14 nt, Leptospira interrogans serovar lai str. 56601
aaaacucuuuaaaa

SEQ ID NO: 2792527 - RNA, 15 nt, Leptospira interrogans serovar lai str. 56601
aaaacucuuuaaaaa

SEQ ID NO: 2792528 - RNA, 17 nt, Leptospira interrogans serovar lai str. 56601
aaaacucuuuaaaaacu

SEQ ID NO: 2792529 - RNA, 16 nt, Leptospira interrogans serovar lai str. 56601
aaaacugaaacuugaa

SEQ ID NO: 2792530 - RNA, 13 nt, Leptospira interrogans serovar lai str. 56601
aaaacugauuaaa

SEQ ID NO: 2792531 - RNA, 15 nt, Leptospira interrogans serovar lai str. 56601
aaaacugauuaaaau

SEQ ID NO: 2792532 - RNA, 16 nt, Leptospira interrogans serovar lai str. 56601
aaaacugcuucaauug

SEQ ID NO: 2792533 - RNA, 16 nt, Leptospira interrogans serovar lai str. 56601
aaaacuguaaauuaga

SEQ ID NO: 2792534 - RNA, 14 nt, Leptospira interrogans serovar lai str. 56601
aaaacuuaaugaga

SEQ ID NO: 2792535 - RNA, 21 nt, Leptospira interrogans serovar lai str. 56601
aaaacuuaaugagauuaaaac

SEQ ID NO: 2792536 - RNA, 22 nt, Leptospira interrogans serovar lai str. 56601
aaaacuuaaugagauuaaaacu

SEQ ID NO: 2792537 - RNA, 14 nt, Leptospira interrogans serovar lai str. 56601
aaaacuucaaagaa

SEQ ID NO: 2792538 - RNA, 18 nt, Leptospira interrogans serovar lai str. 56601
aaaacuucaaagaaucuu

SEQ ID NO: 2792539 - RNA, 17 nt, Leptospira interrogans serovar lai str. 56601
aaaacuuccauuuuuua

SEQ ID NO: 2792540 - RNA, 17 nt, Leptospira interrogans serovar lai str. 56601
aaaacuugguuggauuc

SEQ ID NO: 2792541 - RNA, 23 nt, Leptospira interrogans serovar lai str. 56601
aaaacuugguuggauuccuuucu

SEQ ID NO: 2792542 - RNA, 19 nt, Leptospira interrogans serovar lai str. 56601
aaaacuugucccaaaauuu

SEQ ID NO: 2792543 - RNA, 18 nt, Leptospira interrogans serovar lai str. 56601
aaaacuuugaccauucuu

SEQ ID NO: 2792544 - RNA, 19 nt, Leptospira interrogans serovar lai str. 56601
aaaacuuugagauguggga

SEQ ID NO: 2792545 - RNA, 17 nt, Leptospira interrogans serovar lai str. 56601
aaaacuuugguuuguaa

SEQ ID NO: 2792546 - RNA, 13 nt, Leptospira interrogans serovar lai str. 56601
aaaacuuuuuaaa

SEQ ID NO: 2792547 - RNA, 11 nt, Leptospira interrogans serovar lai str. 56601
aaaagaaaaac

SEQ ID NO: 2792548 - RNA, 13 nt, Leptospira interrogans serovar lai str. 56601
aaaagaaaaacag

SEQ ID NO: 2792549 - RNA, 15 nt, Leptospira interrogans serovar lai str. 56601
aaaaguuugguccuu

SEQ ID NO: 2792550 - RNA, 22 nt, Leptospira interrogans serovar lai str. 56601
aaaaguuuguuuguaaagcaac

SEQ ID NO: 2792551 - RNA, 13 nt, Leptospira interrogans serovar lai str. 56601
aaaaguuuuacaa

SEQ ID NO: 2792552 - RNA, 14 nt, Leptospira interrogans serovar lai str. 56601
aaaaguuuuacaaa

SEQ ID NO: 2792553 - RNA, 16 nt, Leptospira interrogans serovar lai str. 56601
aaaaguuuuacaaaga

SEQ ID NO: 2792554 - RNA, 23 nt, Leptospira interrogans serovar lai str. 56601
aaaaguuuuacaaagaguuuaaa

SEQ ID NO: 2792555 - RNA, 13 nt, Leptospira interrogans serovar lai str. 56601
aaaaguuuuauaa

SEQ ID NO: 2792556 - RNA, 13 nt, Leptospira interrogans serovar lai str. 56601
aaaaguuuucaaa

SEQ ID NO: 2792557 - RNA, 15 nt, Leptospira interrogans serovar lai str. 56601
aaaaguuuucaaaaa

SEQ ID NO: 2792558 - RNA, 16 nt, Leptospira interrogans serovar lai str. 56601
aaaaguuuucucaaaa

SEQ ID NO: 2792559 - RNA, 14 nt, Leptospira interrogans serovar lai str. 56601
aaaaguuuuuaaaa

SEQ ID NO: 2792560 - RNA, 15 nt, Leptospira interrogans serovar lai str. 56601
aaaaguuuuucuaaa

SEQ ID NO: 2792561 - RNA, 14 nt, Leptospira interrogans serovar lai str. 56601
aaaauaaaaaaauu

SEQ ID NO: 2792562 - RNA, 17 nt, Leptospira interrogans serovar lai str. 56601
aaaauaaaaaaauucau

SEQ ID NO: 2792563 - RNA, 12 nt, Leptospira interrogans serovar lai str. 56601
aaaauaaaaaau

SEQ ID NO: 2792564 - RNA, 14 nt, Leptospira interrogans serovar lai str. 56601
aaaauaaaaaauuu

SEQ ID NO: 2792565 - RNA, 14 nt, Leptospira interrogans serovar lai str. 56601
aaaauaaaaaucau

SEQ ID NO: 2792566 - RNA, 13 nt, Leptospira interrogans serovar lai str. 56601
aaaauaaaaauuu

SEQ ID NO: 2792567 - RNA, 18 nt, Leptospira interrogans serovar lai str. 56601
aaaauaaaaauuucagau

SEQ ID NO: 2792568 - RNA, 13 nt, Leptospira interrogans serovar lai str. 56601
aaaauaaagaaac

SEQ ID NO: 2792569 - RNA, 22 nt, Leptospira interrogans serovar lai str. 56601
aaaauaaaggcccuuuguagaa

SEQ ID NO: 2792570 - RNA, 17 nt, Leptospira interrogans serovar lai str. 56601
aaaauaaauuccccaaa

SEQ ID NO: 2792571 - RNA, 22 nt, Leptospira interrogans serovar lai str. 56601
aaaauaacgauacuuaaaaaua

SEQ ID NO: 2792572 - RNA, 11 nt, Leptospira interrogans serovar lai str. 56601
aaaauaagaaa

SEQ ID NO: 2792573 - RNA, 13 nt, Leptospira interrogans serovar lai str. 56601
aaaauaagaaaau

SEQ ID NO: 2792574 - RNA, 19 nt, Leptospira interrogans serovar lai str. 56601
aaaauaagguuuuauaaaa

SEQ ID NO: 2792575 - RNA, 19 nt, Leptospira interrogans serovar lai str. 56601
aaaauaauacaauucugaa

SEQ ID NO: 2792576 - RNA, 14 nt, Leptospira interrogans serovar lai str. 56601
aaaauaauuuuuac

SEQ ID NO: 2792577 - RNA, 16 nt, Leptospira interrogans serovar lai str. 56601
aaaauacauaaaaaaa

SEQ ID NO: 2792578 - RNA, 13 nt, Leptospira interrogans serovar lai str. 56601
aaaauacauagga

SEQ ID NO: 2792579 - RNA, 15 nt, Leptospira interrogans serovar lai str. 56601
aaaauaccauaaauu

SEQ ID NO: 2792580 - RNA, 18 nt, Leptospira interrogans serovar lai str. 56601
aaaauacgcuucucuugc

SEQ ID NO: 2792581 - RNA, 22 nt, Leptospira interrogans serovar lai str. 56601
aaaauacggcacucaauuuuau

SEQ ID NO: 2792582 - RNA, 14 nt, Leptospira interrogans serovar lai str. 56601
aaaauacuaaauua

SEQ ID NO: 2792583 - RNA, 21 nt, Leptospira interrogans serovar lai str. 56601
aaaauacuggggacuuuauuu

SEQ ID NO: 2792584 - RNA, 16 nt, Leptospira interrogans serovar lai str. 56601
aaaauacuguuaauuu

SEQ ID NO: 2792585 - RNA, 16 nt, Leptospira interrogans serovar lai str. 56601
aaaauacuuuaucuuu

SEQ ID NO: 2792586 - RNA, 13 nt, Leptospira interrogans serovar lai str. 56601
aaaauacuuugaa

SEQ ID NO: 2792587 - RNA, 15 nt, Leptospira interrogans serovar lai str. 56601
aaaauacuuuuagaa

SEQ ID NO: 2792588 - RNA, 20 nt, Leptospira interrogans serovar lai str. 56601
aaaauacuuuuagaaaauua

SEQ ID NO: 2792589 - RNA, 22 nt, Leptospira interrogans serovar lai str. 56601
aaaauacuuuuagaaaauuaga

SEQ ID NO: 2792590 - RNA, 15 nt, Leptospira interrogans serovar lai str. 56601
aaaauacuuuugaaa

SEQ ID NO: 2792591 - RNA, 14 nt, Leptospira interrogans serovar lai str. 56601
aaaauagaaacaaa

SEQ ID NO: 2792592 - RNA, 14 nt, Leptospira interrogans serovar lai str. 56601
aaaauagaauaaau

SEQ ID NO: 2792593 - RNA, 16 nt, Leptospira interrogans serovar lai str. 56601
aaaauagaauaaauua

SEQ ID NO: 2792594 - RNA, 19 nt, Leptospira interrogans serovar lai str. 56601
aaaauagaauuguugaaaa

SEQ ID NO: 2792595 - RNA, 12 nt, Leptospira interrogans serovar lai str. 56601
aaaauagaauuu

SEQ ID NO: 2792596 - RNA, 18 nt, Leptospira interrogans serovar lai str. 56601
aaaauagauagagaauua

SEQ ID NO: 2792597 - RNA, 14 nt, Leptospira interrogans serovar lai str. 56601
aaaauagauccaaa

SEQ ID NO: 2792598 - RNA, 15 nt, Leptospira interrogans serovar lai str. 56601
aaaauagauccaaau

SEQ ID NO: 2792599 - RNA, 15 nt, Leptospira interrogans serovar lai str. 56601
aaaauagccuucaau

SEQ ID NO: 2792600 - RNA, 16 nt, Leptospira interrogans serovar lai str. 56601
aaaauaggaauucgaa

SEQ ID NO: 2792601 - RNA, 21 nt, Leptospira interrogans serovar lai str. 56601
aaaauaggaguuccuacauuu

SEQ ID NO: 2792602 - RNA, 18 nt, Leptospira interrogans serovar lai str. 56601
aaaauagggaaaacucaa

SEQ ID NO: 2792603 - RNA, 19 nt, Leptospira interrogans serovar lai str. 56601
aaaauagggaaaacucaac

SEQ ID NO: 2792604 - RNA, 20 nt, Leptospira interrogans serovar lai str. 56601
aaaauagggaaaacucaaca

SEQ ID NO: 2792605 - RNA, 19 nt, Leptospira interrogans serovar lai str. 56601
aaaauagggaaaacucauc

SEQ ID NO: 2792606 - RNA, 17 nt, Leptospira interrogans serovar lai str. 56601
aaaauaguauccaaaau

SEQ ID NO: 2792607 - RNA, 23 nt, Leptospira interrogans serovar lai str. 56601
aaaauauaaauugggcuuguaga

SEQ ID NO: 2792608 - RNA, 22 nt, Leptospira interrogans serovar lai str. 56601
aaaauauaauucuguaaaauaa

SEQ ID NO: 2792609 - RNA, 21 nt, Leptospira interrogans serovar lai str. 56601
aaaauauacaauaaaucaaaa

SEQ ID NO: 2792610 - RNA, 21 nt, Leptospira interrogans serovar lai str. 56601
aaaauauauucagaaaacaga

SEQ ID NO: 2792611 - RNA, 20 nt, Leptospira interrogans serovar lai str. 56601
aaaauaucagaucuauuucu

SEQ ID NO: 2792612 - RNA, 13 nt, Leptospira interrogans serovar lai str. 56601
aaaauaucuaaag

SEQ ID NO: 2792613 - RNA, 16 nt, Leptospira interrogans serovar lai str. 56601
aaaauaucuuagaaua

SEQ ID NO: 2792614 - RNA, 16 nt, Leptospira interrogans serovar lai str. 56601
aaaauaugauuuaaaa

SEQ ID NO: 2792615 - RNA, 14 nt, Leptospira interrogans serovar lai str. 56601
aaaauauuauauuu

SEQ ID NO: 2792616 - RNA, 13 nt, Leptospira interrogans serovar lai str. 56601
aaaauauucagaa

SEQ ID NO: 2792617 - RNA, 14 nt, Leptospira interrogans serovar lai str. 56601
aaaauauucagaaa

SEQ ID NO: 2792618 - RNA, 20 nt, Leptospira interrogans serovar lai str. 56601
aaaauauucgaucaaguaag

SEQ ID NO: 2792619 - RNA, 12 nt, Leptospira interrogans serovar lai str. 56601
aaaauauucgug

SEQ ID NO: 2792620 - RNA, 16 nt, Leptospira interrogans serovar lai str. 56601
aaaaucaaagauauuu

SEQ ID NO: 2792621 - RNA, 15 nt, Leptospira interrogans serovar lai str. 56601
aaaaucaaauauaca

SEQ ID NO: 2792622 - RNA, 17 nt, Leptospira interrogans serovar lai str. 56601
aaaaucaaguaccauaa

SEQ ID NO: 2792623 - RNA, 18 nt, Leptospira interrogans serovar lai str. 56601
aaaaucacaaaaaagaua

SEQ ID NO: 2792624 - RNA, 17 nt, Leptospira interrogans serovar lai str. 56601
aaaaucacguucuuagc

SEQ ID NO: 2792625 - RNA, 18 nt, Leptospira interrogans serovar lai str. 56601
aaaaucaggcuuuauaaa

SEQ ID NO: 2792626 - RNA, 19 nt, Leptospira interrogans serovar lai str. 56601
aaaaucaggcuuuauaaaa

SEQ ID NO: 2792627 - RNA, 21 nt, Leptospira interrogans serovar lai str. 56601
aaaaucagggccggagaaaau

SEQ ID NO: 2792628 - RNA, 18 nt, Leptospira interrogans serovar lai str. 56601
aaaaucagguuuuauaaa

SEQ ID NO: 2792629 - RNA, 22 nt, Leptospira interrogans serovar lai str. 56601
aaaaucagguuuuauaaaguga

SEQ ID NO: 2792630 - RNA, 19 nt, Leptospira interrogans serovar lai str. 56601
aaaaucaguuaauacaaaa

SEQ ID NO: 2792631 - RNA, 14 nt, Leptospira interrogans serovar lai str. 56601
aaaaucauaaaaca

SEQ ID NO: 2792632 - RNA, 18 nt, Leptospira interrogans serovar lai str. 56601
aaaaucauacuuuuaaaa

SEQ ID NO: 2792633 - RNA, 14 nt, Leptospira interrogans serovar lai str. 56601
aaaauuaaaaaauc

SEQ ID NO: 2792634 - RNA, 15 nt, Leptospira interrogans serovar lai str. 56601
aaaauuaaaaaaucu

SEQ ID NO: 2792635 - RNA, 13 nt, Leptospira interrogans serovar lai str. 56601
aaaauuaaaaauu

SEQ ID NO: 2792636 - RNA, 15 nt, Leptospira interrogans serovar lai str. 56601
aaaauuaaaaauuca

SEQ ID NO: 2792637 - RNA, 13 nt, Leptospira interrogans serovar lai str. 56601
aaaauuaacagua

SEQ ID NO: 2792638 - RNA, 16 nt, Leptospira interrogans serovar lai str. 56601
aaaauuaagaaucaau

SEQ ID NO: 2792639 - RNA, 16 nt, Leptospira interrogans serovar lai str. 56601
aaaauuaauccucuuu

SEQ ID NO: 2792640 - RNA, 15 nt, Leptospira interrogans serovar lai str. 56601
aaaauuaaugaauaa

SEQ ID NO: 2792641 - RNA, 14 nt, Leptospira interrogans serovar lai str. 56601
aaaauuaaugagga

SEQ ID NO: 2792642 - RNA, 22 nt, Leptospira interrogans serovar lai str. 56601
aaaauuaaugaggagaaaaaau

SEQ ID NO: 2792643 - RNA, 12 nt, Leptospira interrogans serovar lai str. 56601
aaaauuaauucu

SEQ ID NO: 2792644 - RNA, 24 nt, Leptospira interrogans serovar lai str. 56601
aaaauuaauucuccaucuguuucu

SEQ ID NO: 2792645 - RNA, 21 nt, Leptospira interrogans serovar lai str. 56601
aaaauuaauuuuucaacaacu

SEQ ID NO: 2792646 - RNA, 22 nt, Leptospira interrogans serovar lai str. 56601
aaaauuacgcugauuagaauuc

SEQ ID NO: 2792647 - RNA, 15 nt, Leptospira interrogans serovar lai str. 56601
aaaauuagaaagaau

SEQ ID NO: 2792648 - RNA, 18 nt, Leptospira interrogans serovar lai str. 56601
aaaauuagaauccuguuu

SEQ ID NO: 2792649 - RNA, 22 nt, Leptospira interrogans serovar lai str. 56601
aaaauuagaauccuguuugaaa

SEQ ID NO: 2792650 - RNA, 21 nt, Leptospira interrogans serovar lai str. 56601
aaaauuagagaaguuaaaaaa

SEQ ID NO: 2792651 - RNA, 22 nt, Leptospira interrogans serovar lai str. 56601
aaaauuagauuuauugaaaaau

SEQ ID NO: 2792652 - RNA, 19 nt, Leptospira interrogans serovar lai str. 56601
aaaauuaguuuucuucuau

SEQ ID NO: 2792653 - RNA, 15 nt, Leptospira interrogans serovar lai str. 56601
aaaauuauaaacaaa

SEQ ID NO: 2792654 - RNA, 19 nt, Leptospira interrogans serovar lai str. 56601
aaaauuauaaguagaaauu

SEQ ID NO: 2792655 - RNA, 20 nt, Leptospira interrogans serovar lai str. 56601
aaaauuauaggaacucauac

SEQ ID NO: 2792656 - RNA, 22 nt, Leptospira interrogans serovar lai str. 56601
aaaauuauccguuuauccuaau

SEQ ID NO: 2792657 - RNA, 14 nt, Leptospira interrogans serovar lai str. 56601
aaaauuauucugaa

SEQ ID NO: 2792658 - RNA, 17 nt, Leptospira interrogans serovar lai str. 56601
aaaauuauuuugaacca

SEQ ID NO: 2792659 - RNA, 16 nt, Leptospira interrogans serovar lai str. 56601
aaaauucaaaugucuu

SEQ ID NO: 2792660 - RNA, 17 nt, Leptospira interrogans serovar lai str. 56601
aaaauucaacuuguaaa

SEQ ID NO: 2792661 - RNA, 20 nt, Leptospira interrogans serovar lai str. 56601
aaaauucaacuuguaaaaca

SEQ ID NO: 2792662 - RNA, 22 nt, Leptospira interrogans serovar lai str. 56601
aaaauucaacuuguaaaacagc

SEQ ID NO: 2792663 - RNA, 19 nt, Leptospira interrogans serovar lai str. 56601
aaaauucauauugagauaa

SEQ ID NO: 2792664 - RNA, 17 nt, Leptospira interrogans serovar lai str. 56601
aaaauuccgaauucuaa

SEQ ID NO: 2792665 - RNA, 18 nt, Leptospira interrogans serovar lai str. 56601
aaaauuccgaauucuaaa

SEQ ID NO: 2792666 - RNA, 16 nt, Leptospira interrogans serovar lai str. 56601
aaaauuccuuuuugua

SEQ ID NO: 2792667 - RNA, 22 nt, Leptospira interrogans serovar lai str. 56601
aaaauucgauuucuacaaugga

SEQ ID NO: 2792668 - RNA, 23 nt, Leptospira interrogans serovar lai str. 56601
aaaauucguugagacgaaaagac

SEQ ID NO: 2792669 - RNA, 13 nt, Leptospira interrogans serovar lai str. 56601
aaaauucuaauau

SEQ ID NO: 2792670 - RNA, 13 nt, Leptospira interrogans serovar lai str. 56601
aaaauucuagaaa

SEQ ID NO: 2792671 - RNA, 18 nt, Leptospira interrogans serovar lai str. 56601
aaaauucuagaaagaauu

SEQ ID NO: 2792672 - RNA, 20 nt, Leptospira interrogans serovar lai str. 56601
aaaauucuauaguaaagauu

SEQ ID NO: 2792673 - RNA, 17 nt, Leptospira interrogans serovar lai str. 56601
aaaauucugaaagaguu

SEQ ID NO: 2792674 - RNA, 12 nt, Leptospira interrogans serovar lai str. 56601
aaaauucugcuc

SEQ ID NO: 2792675 - RNA, 15 nt, Leptospira interrogans serovar lai str. 56601
aaaauucuuaaaaaa

SEQ ID NO: 2792676 - RNA, 21 nt, Leptospira interrogans serovar lai str. 56601
aaaauucuuagaguaaaacuu

SEQ ID NO: 2792677 - RNA, 23 nt, Leptospira interrogans serovar lai str. 56601
aaaauucuucguuagaagacaau

SEQ ID NO: 2792678 - RNA, 20 nt, Leptospira interrogans serovar lai str. 56601
aaaauucuuuuuauuuuuac

SEQ ID NO: 2792679 - RNA, 13 nt, Leptospira interrogans serovar lai str. 56601
aaaauugaaacaa

SEQ ID NO: 2792680 - RNA, 14 nt, Leptospira interrogans serovar lai str. 56601
aaaauugaaacaau

SEQ ID NO: 2792681 - RNA, 16 nt, Leptospira interrogans serovar lai str. 56601
aaaauugaauuuaaaa

SEQ ID NO: 2792682 - RNA, 16 nt, Leptospira interrogans serovar lai str. 56601
aaaauugacaaagagu

SEQ ID NO: 2792683 - RNA, 17 nt, Leptospira interrogans serovar lai str. 56601
aaaauugacaaagaguu

SEQ ID NO: 2792684 - RNA, 17 nt, Leptospira interrogans serovar lai str. 56601
aaaauugaguaccauaa

SEQ ID NO: 2792685 - RNA, 23 nt, Leptospira interrogans serovar lai str. 56601
aaaauugaucucgauucugauaa

SEQ ID NO: 2792686 - RNA, 17 nt, Leptospira interrogans serovar lai str. 56601
aaaauugcauauuccuu

SEQ ID NO: 2792687 - RNA, 23 nt, Leptospira interrogans serovar lai str. 56601
aaaauugugauuugcgacaguuc

SEQ ID NO: 2792688 - RNA, 22 nt, Leptospira interrogans serovar lai str. 56601
aaaauuguguaugaguuccuac

SEQ ID NO: 2792689 - RNA, 13 nt, Leptospira interrogans serovar lai str. 56601
aaaauuuaaaaau

SEQ ID NO: 2792690 - RNA, 14 nt, Leptospira interrogans serovar lai str. 56601
aaaauuuaaaauac

SEQ ID NO: 2792691 - RNA, 13 nt, Leptospira interrogans serovar lai str. 56601
aaaauuuaaacaa

SEQ ID NO: 2792692 - RNA, 15 nt, Leptospira interrogans serovar lai str. 56601
aaaauuuaaacaaca

SEQ ID NO: 2792693 - RNA, 15 nt, Leptospira interrogans serovar lai str. 56601
aaaauuuaaagauuu

SEQ ID NO: 2792694 - RNA, 14 nt, Leptospira interrogans serovar lai str. 56601
aaaauuuaaauguu

SEQ ID NO: 2792695 - RNA, 13 nt, Leptospira interrogans serovar lai str. 56601
aaaauuuaaauuc

SEQ ID NO: 2792696 - RNA, 20 nt, Leptospira interrogans serovar lai str. 56601
aaaauuuaacgauauuagaa

SEQ ID NO: 2792697 - RNA, 14 nt, Leptospira interrogans serovar lai str. 56601
aaaauuuaauaaca

SEQ ID NO: 2792698 - RNA, 14 nt, Leptospira interrogans serovar lai str. 56601
aaaauuuagaaaua

SEQ ID NO: 2792699 - RNA, 13 nt, Leptospira interrogans serovar lai str. 56601
aaaauuuagaauu

SEQ ID NO: 2792700 - RNA, 15 nt, Leptospira interrogans serovar lai str. 56601
aaaauuuaucuguaa

SEQ ID NO: 2792701 - RNA, 20 nt, Leptospira interrogans serovar lai str. 56601
aaaauuucauuuuacugcuu

SEQ ID NO: 2792702 - RNA, 12 nt, Leptospira interrogans serovar lai str. 56601
aaaauuucuuaa

SEQ ID NO: 2792703 - RNA, 16 nt, Leptospira interrogans serovar lai str. 56601
aaaauuucuuaaaaga

SEQ ID NO: 2792704 - RNA, 14 nt, Leptospira interrogans serovar lai str. 56601
aaaauuucuuuguc

SEQ ID NO: 2792705 - RNA, 15 nt, Leptospira interrogans serovar lai str. 56601
aaaauuugaaaagaa

SEQ ID NO: 2792706 - RNA, 21 nt, Leptospira interrogans serovar lai str. 56601
aaaauuugaaaagaaaccaau

SEQ ID NO: 2792707 - RNA, 13 nt, Leptospira interrogans serovar lai str. 56601
aaaauuugaaagu

SEQ ID NO: 2792708 - RNA, 19 nt, Leptospira interrogans serovar lai str. 56601
aaaauuugaaaguaaaaaa

SEQ ID NO: 2792709 - RNA, 20 nt, Leptospira interrogans serovar lai str. 56601
aaaauuugaaaguaaaaaag

SEQ ID NO: 2792710 - RNA, 13 nt, Leptospira interrogans serovar lai str. 56601
aaaauuuggauuu

SEQ ID NO: 2792711 - RNA, 19 nt, Leptospira interrogans serovar lai str. 56601
aaaauuuguaggaacucau

SEQ ID NO: 2792712 - RNA, 11 nt, Leptospira interrogans serovar lai str. 56601
aaaauuuuaaa

SEQ ID NO: 2792713 - RNA, 20 nt, Leptospira interrogans serovar lai str. 56601
aaaauuuuacacgaucauuc

SEQ ID NO: 2792714 - RNA, 23 nt, Leptospira interrogans serovar lai str. 56601
aaaauuuuacccugguuucaaaa

SEQ ID NO: 2792715 - RNA, 14 nt, Leptospira interrogans serovar lai str. 56601
aaaauuuuauaaaa

SEQ ID NO: 2792716 - RNA, 15 nt, Leptospira interrogans serovar lai str. 56601
aaaccgaucuuaaaa

SEQ ID NO: 2792717 - RNA, 14 nt, Leptospira interrogans serovar lai str. 56601
aaaccgauuuuaau

SEQ ID NO: 2792718 - RNA, 19 nt, Leptospira interrogans serovar lai str. 56601
aaaccgcugaaaaaaaaau

SEQ ID NO: 2792719 - RNA, 18 nt, Leptospira interrogans serovar lai str. 56601
aaaccggagacaguauuu

SEQ ID NO: 2792720 - RNA, 22 nt, Leptospira interrogans serovar lai str. 56601
aaaccggagacaguauuuuccg

SEQ ID NO: 2792721 - RNA, 18 nt, Leptospira interrogans serovar lai str. 56601
aaaccgguaaaaaguaaa

SEQ ID NO: 2792722 - RNA, 22 nt, Leptospira interrogans serovar lai str. 56601
aaaccgucccaaaaucuuaaaa

SEQ ID NO: 2792723 - RNA, 13 nt, Leptospira interrogans serovar lai str. 56601
aaaccucaaaaaa

SEQ ID NO: 2792724 - RNA, 14 nt, Leptospira interrogans serovar lai str. 56601
aaaccucaaaaaau

SEQ ID NO: 2792725 - RNA, 12 nt, Leptospira interrogans serovar lai str. 56601
aaaccucgucua

SEQ ID NO: 2792726 - RNA, 15 nt, Leptospira interrogans serovar lai str. 56601
aaaccucucggaaua

SEQ ID NO: 2792727 - RNA, 19 nt, Leptospira interrogans serovar lai str. 56601
aaaccucucggaauauuuu

SEQ ID NO: 2792728 - RNA, 13 nt, Leptospira interrogans serovar lai str. 56601
aaaccuuccuuug

SEQ ID NO: 2792729 - RNA, 17 nt, Leptospira interrogans serovar lai str. 56601
aaaccuuuauagaauuc

SEQ ID NO: 2792730 - RNA, 23 nt, Leptospira interrogans serovar lai str. 56601
aaaccuuuauuuaauaaaauuuu

SEQ ID NO: 2792731 - RNA, 12 nt, Leptospira interrogans serovar lai str. 56601
aaaccuuuucua

SEQ ID NO: 2792732 - RNA, 21 nt, Leptospira interrogans serovar lai str. 56601
aaacgagauagcguaauacga

SEQ ID NO: 2792733 - RNA, 17 nt, Leptospira interrogans serovar lai str. 56601
aaacgaucagaaaaaca

SEQ ID NO: 2792734 - RNA, 18 nt, Leptospira interrogans serovar lai str. 56601
aaacgaucagaaaaacaa

SEQ ID NO: 2792735 - RNA, 22 nt, Leptospira interrogans serovar lai str. 56601
aaacgaucagaaaaacaaaaaa

SEQ ID NO: 2792736 - RNA, 19 nt, Leptospira interrogans serovar lai str. 56601
aaacgaucauacuuuagaa

SEQ ID NO: 2792737 - RNA, 22 nt, Leptospira interrogans serovar lai str. 56601
aaacgaucggaaggauuagcau

SEQ ID NO: 2792738 - RNA, 17 nt, Leptospira interrogans serovar lai str. 56601
aaacgauuaauccauuc

SEQ ID NO: 2792739 - RNA, 22 nt, Leptospira interrogans serovar lai str. 56601
aaacgauucucguucaacuuuc

SEQ ID NO: 2792740 - RNA, 13 nt, Leptospira interrogans serovar lai str. 56601
aaacgauuuuuca

SEQ ID NO: 2792741 - RNA, 15 nt, Leptospira interrogans serovar lai str. 56601
aaacgauuuuucaaa

SEQ ID NO: 2792742 - RNA, 18 nt, Leptospira interrogans serovar lai str. 56601
aaacgcgauccguagaga

SEQ ID NO: 2792743 - RNA, 18 nt, Leptospira interrogans serovar lai str. 56601
aaacgggcccaaauaaaa

SEQ ID NO: 2792744 - RNA, 15 nt, Leptospira interrogans serovar lai str. 56601
aaacgguaauuuuau

SEQ ID NO: 2792745 - RNA, 18 nt, Leptospira interrogans serovar lai str. 56601
aaacgguauuuaaaauua

SEQ ID NO: 2792746 - RNA, 17 nt, Leptospira interrogans serovar lai str. 56601
aaacggugcauuuaaaa

SEQ ID NO: 2792747 - RNA, 20 nt, Leptospira interrogans serovar lai str. 56601
aaacggugcauuuaaaaaau

SEQ ID NO: 2792748 - RNA, 13 nt, Leptospira interrogans serovar lai str. 56601
aaacgguuuuagu

SEQ ID NO: 2792749 - RNA, 17 nt, Leptospira interrogans serovar lai str. 56601
aaacgguuuuaguaaaa

SEQ ID NO: 2792750 - RNA, 22 nt, Leptospira interrogans serovar lai str. 56601
aaacgguuuuaguaaaauuuaa

SEQ ID NO: 2792751 - RNA, 14 nt, Leptospira interrogans serovar lai str. 56601
aaacgguuuucuaa

SEQ ID NO: 2792752 - RNA, 18 nt, Leptospira interrogans serovar lai str. 56601
aaacgguuuucuaauuua

SEQ ID NO: 2792753 - RNA, 14 nt, Leptospira interrogans serovar lai str. 56601
aaacguagauaauu

SEQ ID NO: 2792754 - RNA, 17 nt, Leptospira interrogans serovar lai str. 56601
aaacguauaaaaacagc

SEQ ID NO: 2792755 - RNA, 18 nt, Leptospira interrogans serovar lai str. 56601
aaacgucacuuuacaaau

SEQ ID NO: 2792756 - RNA, 23 nt, Leptospira interrogans serovar lai str. 56601
aaacgucauaguucccacaaauu

SEQ ID NO: 2792757 - RNA, 21 nt, Leptospira interrogans serovar lai str. 56601
aaacguggauuuuauguaaga

SEQ ID NO: 2792758 - RNA, 12 nt, Leptospira interrogans serovar lai str. 56601
aaacguuuucaa

SEQ ID NO: 2792759 - RNA, 12 nt, Leptospira interrogans serovar lai str. 56601
aaacuaaaaaaa

SEQ ID NO: 2792760 - RNA, 20 nt, Leptospira interrogans serovar lai str. 56601
aaacuaaauuuuucggaaau

SEQ ID NO: 2792761 - RNA, 12 nt, Leptospira interrogans serovar lai str. 56601
aaacuaauaauu

SEQ ID NO: 2792762 - RNA, 13 nt, Leptospira interrogans serovar lai str. 56601
aaacuaauaauua

SEQ ID NO: 2792763 - RNA, 17 nt, Leptospira interrogans serovar lai str. 56601
aaacuaauuuguaggaa

SEQ ID NO: 2792764 - RNA, 22 nt, Leptospira interrogans serovar lai str. 56601
aaacuaccacaaaucuaaauuu

SEQ ID NO: 2792765 - RNA, 21 nt, Leptospira interrogans serovar lai str. 56601
aaacuaccucaauuuuccauu

SEQ ID NO: 2792766 - RNA, 22 nt, Leptospira interrogans serovar lai str. 56601
aaacuacuuccgucuuuuguaa

SEQ ID NO: 2792767 - RNA, 16 nt, Leptospira interrogans serovar lai str. 56601
aaacuaggaacuccuu

SEQ ID NO: 2792768 - RNA, 17 nt, Leptospira interrogans serovar lai str. 56601
aaacuaggucgcauuua

SEQ ID NO: 2792769 - RNA, 21 nt, Leptospira interrogans serovar lai str. 56601
aaacuaggucgcauuuagcaa

SEQ ID NO: 2792770 - RNA, 15 nt, Leptospira interrogans serovar lai str. 56601
aaacuauaaaucauu

SEQ ID NO: 2792771 - RNA, 18 nt, Leptospira interrogans serovar lai str. 56601
aaacuauacuuucaaaaa

SEQ ID NO: 2792772 - RNA, 19 nt, Leptospira interrogans serovar lai str. 56601
aaacuauacuuucaaaaaa

SEQ ID NO: 2792773 - RNA, 20 nt, Leptospira interrogans serovar lai str. 56601
aaacuauacuuucaaaaaau

SEQ ID NO: 2792774 - RNA, 22 nt, Leptospira interrogans serovar lai str. 56601
aaacuauagagaaauccaauca

SEQ ID NO: 2792775 - RNA, 12 nt, Leptospira interrogans serovar lai str. 56601
aaacuaucacaa

SEQ ID NO: 2792776 - RNA, 13 nt, Leptospira interrogans serovar lai str. 56601
aaacuaucacaaa

SEQ ID NO: 2792777 - RNA, 22 nt, Leptospira interrogans serovar lai str. 56601
aaacuaucuauuagaacaucaa

SEQ ID NO: 2792778 - RNA, 21 nt, Leptospira interrogans serovar lai str. 56601
aaacuaucuuaaaaugauuuu

SEQ ID NO: 2792779 - RNA, 14 nt, Leptospira interrogans serovar lai str. 56601
aaacuauuacaaau

SEQ ID NO: 2792780 - RNA, 16 nt, Leptospira interrogans serovar lai str. 56601
aaacuauuauacuuua

SEQ ID NO: 2792781 - RNA, 21 nt, Leptospira interrogans serovar lai str. 56601
aaacuauugcagauaaguaag

SEQ ID NO: 2792782 - RNA, 17 nt, Leptospira interrogans serovar lai str. 56601
aaacucaaagaaauuuu

SEQ ID NO: 2792783 - RNA, 15 nt, Leptospira interrogans serovar lai str. 56601
aaacucaaagaauuu

SEQ ID NO: 2792784 - RNA, 22 nt, Leptospira interrogans serovar lai str. 56601
aaacucaaaggaaaaugaagaa

SEQ ID NO: 2792785 - RNA, 14 nt, Leptospira interrogans serovar lai str. 56601
aaacucaaaucuac

SEQ ID NO: 2792786 - RNA, 14 nt, Leptospira interrogans serovar lai str. 56601
aaacucaacacaac

SEQ ID NO: 2792787 - RNA, 13 nt, Leptospira interrogans serovar lai str. 56601
aaacucaagcgaa

SEQ ID NO: 2792788 - RNA, 15 nt, Leptospira interrogans serovar lai str. 56601
aaacucaaugcugcu

SEQ ID NO: 2792789 - RNA, 16 nt, Leptospira interrogans serovar lai str. 56601
aaacucaaugcugcuc

SEQ ID NO: 2792790 - RNA, 14 nt, Leptospira interrogans serovar lai str. 56601
aaacucaauguauc

SEQ ID NO: 2792791 - RNA, 19 nt, Leptospira interrogans serovar lai str. 56601
aaacucaauguguugucua

SEQ ID NO: 2792792 - RNA, 23 nt, Leptospira interrogans serovar lai str. 56601
aaacucacaucucuuuuuuauaa

SEQ ID NO: 2792793 - RNA, 18 nt, Leptospira interrogans serovar lai str. 56601
aaacucacgcuaaaauaa

SEQ ID NO: 2792794 - RNA, 12 nt, Leptospira interrogans serovar lai str. 56601
aaacucaguaaa

SEQ ID NO: 2792795 - RNA, 16 nt, Leptospira interrogans serovar lai str. 56601
aaacucaguaaaacgc

SEQ ID NO: 2792796 - RNA, 20 nt, Leptospira interrogans serovar lai str. 56601
aaacucaguaaaacgcucuc

SEQ ID NO: 2792797 - RNA, 22 nt, Leptospira interrogans serovar lai str. 56601
aaacucaguaaaacgcucucua

SEQ ID NO: 2792798 - RNA, 15 nt, Leptospira interrogans serovar lai str. 56601
aaacucaguaaacuc

SEQ ID NO: 2792799 - RNA, 19 nt, Leptospira interrogans serovar lai str. 56601
aaagaauuaucauguaaaa

SEQ ID NO: 2792800 - RNA, 16 nt, Leptospira interrogans serovar lai str. 56601
aaagaauugaaaucug

SEQ ID NO: 2792801 - RNA, 20 nt, Leptospira interrogans serovar lai str. 56601
aaagaauuuaauaaaaaaau

SEQ ID NO: 2792802 - RNA, 22 nt, Leptospira interrogans serovar lai str. 56601
aaagaauuucggcuugauaccu

SEQ ID NO: 2792803 - RNA, 14 nt, Leptospira interrogans serovar lai str. 56601
aaagaauuuuaaau

SEQ ID NO: 2792804 - RNA, 15 nt, Leptospira interrogans serovar lai str. 56601
aaagaauuuuuaaaa

SEQ ID NO: 2792805 - RNA, 21 nt, Leptospira interrogans serovar lai str. 56601
aaagaauuuuuacagaaaacc

SEQ ID NO: 2792806 - RNA, 15 nt, Leptospira interrogans serovar lai str. 56601
aaagaauuuuuggaa

SEQ ID NO: 2792807 - RNA, 18 nt, Leptospira interrogans serovar lai str. 56601
aaagacaaaguauuuucu

SEQ ID NO: 2792808 - RNA, 18 nt, Leptospira interrogans serovar lai str. 56601
aaagacaauauucuugau

SEQ ID NO: 2792809 - RNA, 17 nt, Leptospira interrogans serovar lai str. 56601
aaagacgauuccuaaaa

SEQ ID NO: 2792810 - RNA, 13 nt, Leptospira interrogans serovar lai str. 56601
aaagacuaaaaag

SEQ ID NO: 2792811 - RNA, 19 nt, Leptospira interrogans serovar lai str. 56601
aaagacucacaccuucuuu

SEQ ID NO: 2792812 - RNA, 16 nt, Leptospira interrogans serovar lai str. 56601
aaagacuuuucaucau

SEQ ID NO: 2792813 - RNA, 14 nt, Leptospira interrogans serovar lai str. 56601
aaagacuuuuccua

SEQ ID NO: 2792814 - RNA, 14 nt, Leptospira interrogans serovar lai str. 56601
aaagacuuuuuaug

SEQ ID NO: 2792815 - RNA, 17 nt, Leptospira interrogans serovar lai str. 56601
aaagagaaagaaaaaga

SEQ ID NO: 2792816 - RNA, 16 nt, Leptospira interrogans serovar lai str. 56601
aaagagacauugaaga

SEQ ID NO: 2792817 - RNA, 19 nt, Leptospira interrogans serovar lai str. 56601
aaagagcguuguguugagu

SEQ ID NO: 2792818 - RNA, 21 nt, Leptospira interrogans serovar lai str. 56601
aaagagcguuguguugaguuu

SEQ ID NO: 2792819 - RNA, 14 nt, Leptospira interrogans serovar lai str. 56601
aaagaguuuaaaaa

SEQ ID NO: 2792820 - RNA, 16 nt, Leptospira interrogans serovar lai str. 56601
aaagaguuuaaaaaau

SEQ ID NO: 2792821 - RNA, 15 nt, Leptospira interrogans serovar lai str. 56601
aaagauaaaaagaga

SEQ ID NO: 2792822 - RNA, 13 nt, Leptospira interrogans serovar lai str. 56601
aaagauaaaucgc

SEQ ID NO: 2792823 - RNA, 16 nt, Leptospira interrogans serovar lai str. 56601
aaagauaaaucgcaaa

SEQ ID NO: 2792824 - RNA, 20 nt, Leptospira interrogans serovar lai str. 56601
aaagauaaaucgcaaauaca

SEQ ID NO: 2792825 - RNA, 14 nt, Leptospira interrogans serovar lai str. 56601
aaagauaacaucuu

SEQ ID NO: 2792826 - RNA, 14 nt, Leptospira interrogans serovar lai str. 56601
aaagauagaaguuu

SEQ ID NO: 2792827 - RNA, 20 nt, Leptospira interrogans serovar lai str. 56601
aaagauagaaguuuauaaua

SEQ ID NO: 2792828 - RNA, 14 nt, Leptospira interrogans serovar lai str. 56601
aaagaucugaguuu

SEQ ID NO: 2792829 - RNA, 16 nt, Leptospira interrogans serovar lai str. 56601
aaagaucugaguuuac

SEQ ID NO: 2792830 - RNA, 15 nt, Leptospira interrogans serovar lai str. 56601
aaagaucuuauaauu

SEQ ID NO: 2792831 - RNA, 16 nt, Leptospira interrogans serovar lai str. 56601
aaagauuaaauucuau

SEQ ID NO: 2792832 - RNA, 15 nt, Leptospira interrogans serovar lai str. 56601
aaagauuagaaaaac

SEQ ID NO: 2792833 - RNA, 20 nt, Leptospira interrogans serovar lai str. 56601
aaagauucacuuagaaagau

SEQ ID NO: 2792834 - RNA, 17 nt, Leptospira interrogans serovar lai str. 56601
aaagauucuauuuugag

SEQ ID NO: 2792835 - RNA, 18 nt, Leptospira interrogans serovar lai str. 56601
aaagauucuauuuugaga

SEQ ID NO: 2792836 - RNA, 22 nt, Leptospira interrogans serovar lai str. 56601
aaagauucuauuuugagaaaau

SEQ ID NO: 2792837 - RNA, 17 nt, Leptospira interrogans serovar lai str. 56601
aaagauuugcucuuaau

SEQ ID NO: 2792838 - RNA, 17 nt, Leptospira interrogans serovar lai str. 56601
aaagauuuguuuuauaa

SEQ ID NO: 2792839 - RNA, 12 nt, Leptospira interrogans serovar lai str. 56601
aaagauuuuaaa

SEQ ID NO: 2792840 - RNA, 15 nt, Leptospira interrogans serovar lai str. 56601
aaagauuuuaaaaau

SEQ ID NO: 2792841 - RNA, 13 nt, Leptospira interrogans serovar lai str. 56601
aaagauuuuucuu

SEQ ID NO: 2792842 - RNA, 19 nt, Leptospira interrogans serovar lai str. 56601
aaagauuuuucuucuucau

SEQ ID NO: 2792843 - RNA, 16 nt, Leptospira interrogans serovar lai str. 56601
aaagcaaacuuuuuau

SEQ ID NO: 2792844 - RNA, 16 nt, Leptospira interrogans serovar lai str. 56601
aaagcaccuucuaaau

SEQ ID NO: 2792845 - RNA, 20 nt, Leptospira interrogans serovar lai str. 56601
aaagcagcuaaaaagaaagu

SEQ ID NO: 2792846 - RNA, 16 nt, Leptospira interrogans serovar lai str. 56601
aaagccagaauuuuga

SEQ ID NO: 2792847 - RNA, 22 nt, Leptospira interrogans serovar lai str. 56601
aaagccauuucaaaaauauauu

SEQ ID NO: 2792848 - RNA, 16 nt, Leptospira interrogans serovar lai str. 56601
aaagccccagaacaaa

SEQ ID NO: 2792849 - RNA, 21 nt, Leptospira interrogans serovar lai str. 56601
aaagccccagaacaaauccug

SEQ ID NO: 2792850 - RNA, 19 nt, Leptospira interrogans serovar lai str. 56601
aaagcgggaauuccgggaa

SEQ ID NO: 2792851 - RNA, 17 nt, Leptospira interrogans serovar lai str. 56601
aaagcgggauuuugauu

SEQ ID NO: 2792852 - RNA, 14 nt, Leptospira interrogans serovar lai str. 56601
aaagcgucaacuga

SEQ ID NO: 2792853 - RNA, 19 nt, Leptospira interrogans serovar lai str. 56601
aaagcgucaacugaaacuc

SEQ ID NO: 2792854 - RNA, 19 nt, Leptospira interrogans serovar lai str. 56601
aaagcgucucauuucuuga

SEQ ID NO: 2792855 - RNA, 20 nt, Leptospira interrogans serovar lai str. 56601
aaagcguuucguucuuuuuu

SEQ ID NO: 2792856 - RNA, 19 nt, Leptospira interrogans serovar lai str. 56601
aaagcuauaguuuuuaaca

SEQ ID NO: 2792857 - RNA, 15 nt, Leptospira interrogans serovar lai str. 56601
aaagcucaucucauc

SEQ ID NO: 2792858 - RNA, 17 nt, Leptospira interrogans serovar lai str. 56601
aaagcuccuuucaucuc

SEQ ID NO: 2792859 - RNA, 15 nt, Leptospira interrogans serovar lai str. 56601
aaagcuuauacuuua

SEQ ID NO: 2792860 - RNA, 19 nt, Leptospira interrogans serovar lai str. 56601
aaagcuugauuauuauuuu

SEQ ID NO: 2792861 - RNA, 20 nt, Leptospira interrogans serovar lai str. 56601
aaagcuugauuauuauuuug

SEQ ID NO: 2792862 - RNA, 21 nt, Leptospira interrogans serovar lai str. 56601
aaagcuuguuucaaaaguuag

SEQ ID NO: 2792863 - RNA, 14 nt, Leptospira interrogans serovar lai str. 56601
aaaggaaauaaaaa

SEQ ID NO: 2792864 - RNA, 18 nt, Leptospira interrogans serovar lai str. 56601
aaaggaagcacaagcuuc

SEQ ID NO: 2792865 - RNA, 20 nt, Leptospira interrogans serovar lai str. 56601
aaaggaagcacaagcuuccu

SEQ ID NO: 2792866 - RNA, 22 nt, Leptospira interrogans serovar lai str. 56601
aaaggaaggaguaucaauagaa

SEQ ID NO: 2792867 - RNA, 15 nt, Leptospira interrogans serovar lai str. 56601
aaaggaauccaugau

SEQ ID NO: 2792868 - RNA, 23 nt, Leptospira interrogans serovar lai str. 56601
aaaggaauccaugauucugaaaa

SEQ ID NO: 2792869 - RNA, 13 nt, Leptospira interrogans serovar lai str. 56601
aaaggcggagaaa

SEQ ID NO: 2792870 - RNA, 16 nt, Leptospira interrogans serovar lai str. 56601
aaaggcugucuucagc

SEQ ID NO: 2792871 - RNA, 16 nt, Leptospira interrogans serovar lai str. 56601
aaaggggaucaacaaa

SEQ ID NO: 2792872 - RNA, 13 nt, Leptospira interrogans serovar lai str. 56601
aaaggguuucugu

SEQ ID NO: 2792873 - RNA, 11 nt, Leptospira interrogans serovar lai str. 56601
aaaggguuuuu

SEQ ID NO: 2792874 - RNA, 21 nt, Leptospira interrogans serovar lai str. 56601
aaaggguuuuuacaauuaaau

SEQ ID NO: 2792875 - RNA, 16 nt, Leptospira interrogans serovar lai str. 56601
aaagguauaaaauaaa

SEQ ID NO: 2792876 - RNA, 21 nt, Leptospira interrogans serovar lai str. 56601
aaagguauauaggaauuuauc

SEQ ID NO: 2792877 - RNA, 17 nt, Leptospira interrogans serovar lai str. 56601
aaaggugaucuuagaaa

SEQ ID NO: 2792878 - RNA, 19 nt, Leptospira interrogans serovar lai str. 56601
aaaggugcaugaaaauaau

SEQ ID NO: 2792879 - RNA, 22 nt, Leptospira interrogans serovar lai str. 56601
aaagguugaguaguaaaaucuu

SEQ ID NO: 2792880 - RNA, 18 nt, Leptospira interrogans serovar lai str. 56601
aaagguuucacaaauuuu

SEQ ID NO: 2792881 - RNA, 12 nt, Leptospira interrogans serovar lai str. 56601
aaaguaaaugga

SEQ ID NO: 2792882 - RNA, 18 nt, Leptospira interrogans serovar lai str. 56601
aaauaaaugugggaacuc

SEQ ID NO: 2792883 - RNA, 19 nt, Leptospira interrogans serovar lai str. 56601
aaauaaauuccccaaaaug

SEQ ID NO: 2792884 - RNA, 12 nt, Leptospira interrogans serovar lai str. 56601
aaauaaauuuaa

SEQ ID NO: 2792885 - RNA, 19 nt, Leptospira interrogans serovar lai str. 56601
aaauaacgauacuuaaaaa

SEQ ID NO: 2792886 - RNA, 23 nt, Leptospira interrogans serovar lai str. 56601
aaauaagaaucgaaaaaauacaa

SEQ ID NO: 2792887 - RNA, 16 nt, Leptospira interrogans serovar lai str. 56601
aaauaagaauuuucua

SEQ ID NO: 2792888 - RNA, 18 nt, Leptospira interrogans serovar lai str. 56601
aaauaagcgcggauuuau

SEQ ID NO: 2792889 - RNA, 16 nt, Leptospira interrogans serovar lai str. 56601
aaauaagguuuuauaa

SEQ ID NO: 2792890 - RNA, 12 nt, Leptospira interrogans serovar lai str. 56601
aaauaauaaaac

SEQ ID NO: 2792891 - RNA, 13 nt, Leptospira interrogans serovar lai str. 56601
aaauaauaaaacu

SEQ ID NO: 2792892 - RNA, 17 nt, Leptospira interrogans serovar lai str. 56601
aaauaauaauauuuuua

SEQ ID NO: 2792893 - RNA, 19 nt, Leptospira interrogans serovar lai str. 56601
aaauaauaauauuuuuaug

SEQ ID NO: 2792894 - RNA, 12 nt, Leptospira interrogans serovar lai str. 56601
aaauaauaccaa

SEQ ID NO: 2792895 - RNA, 14 nt, Leptospira interrogans serovar lai str. 56601
aaauaauauuauaa

SEQ ID NO: 2792896 - RNA, 20 nt, Leptospira interrogans serovar lai str. 56601
aaauaaugauagaaauauuu

SEQ ID NO: 2792897 - RNA, 21 nt, Leptospira interrogans serovar lai str. 56601
aaauaaugauagaaauauuua

SEQ ID NO: 2792898 - RNA, 14 nt, Leptospira interrogans serovar lai str. 56601
aaauaauuccucca

SEQ ID NO: 2792899 - RNA, 20 nt, Leptospira interrogans serovar lai str. 56601
aaauaauugauuagaguuaa

SEQ ID NO: 2792900 - RNA, 12 nt, Leptospira interrogans serovar lai str. 56601
aaauaauuuuua

SEQ ID NO: 2792901 - RNA, 13 nt, Leptospira interrogans serovar lai str. 56601
aaauaauuuuuac

SEQ ID NO: 2792902 - RNA, 18 nt, Leptospira interrogans serovar lai str. 56601
aaauacaaaaacgauuau

SEQ ID NO: 2792903 - RNA, 15 nt, Leptospira interrogans serovar lai str. 56601
aaauacaaaaagaau

SEQ ID NO: 2792904 - RNA, 15 nt, Leptospira interrogans serovar lai str. 56601
aaauacaaaaauucu

SEQ ID NO: 2792905 - RNA, 16 nt, Leptospira interrogans serovar lai str. 56601
aaauacaaaguauucu

SEQ ID NO: 2792906 - RNA, 13 nt, Leptospira interrogans serovar lai str. 56601
aaauacaaaguuu

SEQ ID NO: 2792907 - RNA, 16 nt, Leptospira interrogans serovar lai str. 56601
aaauacaaaguuugua

SEQ ID NO: 2792908 - RNA, 21 nt, Leptospira interrogans serovar lai str. 56601
aaauacacggagauaaaaaag

SEQ ID NO: 2792909 - RNA, 16 nt, Leptospira interrogans serovar lai str. 56601
aaauacacucuuucaa

SEQ ID NO: 2792910 - RNA, 17 nt, Leptospira interrogans serovar lai str. 56601
aaauacagugucuugaa

SEQ ID NO: 2792911 - RNA, 22 nt, Leptospira interrogans serovar lai str. 56601
aaauacagugucuugaaauucu

SEQ ID NO: 2792912 - RNA, 18 nt, Leptospira interrogans serovar lai str. 56601
aaauacauaaacgauuau

SEQ ID NO: 2792913 - RNA, 19 nt, Leptospira interrogans serovar lai str. 56601
aaauacauacaaugaaaaa

SEQ ID NO: 2792914 - RNA, 21 nt, Leptospira interrogans serovar lai str. 56601
aaauacauacaaugaaaaagc

SEQ ID NO: 2792915 - RNA, 24 nt, Leptospira interrogans serovar lai str. 56601
aaauacaucucuuuuuuaaagccu

SEQ ID NO: 2792916 - RNA, 22 nt, Leptospira interrogans serovar lai str. 56601
aaauacauuaagauuauauuau

SEQ ID NO: 2792917 - RNA, 18 nt, Leptospira interrogans serovar lai str. 56601
aaauaccauaaauuuuga

SEQ ID NO: 2792918 - RNA, 15 nt, Leptospira interrogans serovar lai str. 56601
aaauaccgcacuuuu

SEQ ID NO: 2792919 - RNA, 13 nt, Leptospira interrogans serovar lai str. 56601
aaauaccgcgaaa

SEQ ID NO: 2792920 - RNA, 19 nt, Leptospira interrogans serovar lai str. 56601
aaauaccgcuggaaauauc

SEQ ID NO: 2792921 - RNA, 20 nt, Leptospira interrogans serovar lai str. 56601
aaauaccgcuggaaauauca

SEQ ID NO: 2792922 - RNA, 21 nt, Leptospira interrogans serovar lai str. 56601
aaauaccgcuggaaauaucaa

SEQ ID NO: 2792923 - RNA, 19 nt, Leptospira interrogans serovar lai str. 56601
aaauacgaucuaauuugua

SEQ ID NO: 2792924 - RNA, 13 nt, Leptospira interrogans serovar lai str. 56601
aaauacgauucga

SEQ ID NO: 2792925 - RNA, 22 nt, Leptospira interrogans serovar lai str. 56601
aaauacgauucgaaagauuuuu

SEQ ID NO: 2792926 - RNA, 14 nt, Leptospira interrogans serovar lai str. 56601
aaauacgcuucucu

SEQ ID NO: 2792927 - RNA, 15 nt, Leptospira interrogans serovar lai str. 56601
aaauacgcuucucuu

SEQ ID NO: 2792928 - RNA, 16 nt, Leptospira interrogans serovar lai str. 56601
aaauacgcuucucuug

SEQ ID NO: 2792929 - RNA, 20 nt, Leptospira interrogans serovar lai str. 56601
aaauacggcacucaauuuua

SEQ ID NO: 2792930 - RNA, 14 nt, Leptospira interrogans serovar lai str. 56601
aaauacuaaauuaa

SEQ ID NO: 2792931 - RNA, 22 nt, Leptospira interrogans serovar lai str. 56601
aaauacuaaauuaaguuuauuc

SEQ ID NO: 2792932 - RNA, 12 nt, Leptospira interrogans serovar lai str. 56601
aaauacuuaaaa

SEQ ID NO: 2792933 - RNA, 16 nt, Leptospira interrogans serovar lai str. 56601
aaauacuuaaaaaccc

SEQ ID NO: 2792934 - RNA, 16 nt, Leptospira interrogans serovar lai str. 56601
aaauacuuaaaaugag

SEQ ID NO: 2792935 - RNA, 14 nt, Leptospira interrogans serovar lai str. 56601
aaauacuuagaauu

SEQ ID NO: 2792936 - RNA, 23 nt, Leptospira interrogans serovar lai str. 56601
aaauacuuuaccgucaauuuuua

SEQ ID NO: 2792937 - RNA, 16 nt, Leptospira interrogans serovar lai str. 56601
aaauacuuuauuugua

SEQ ID NO: 2792938 - RNA, 18 nt, Leptospira interrogans serovar lai str. 56601
aaauacuuuauuuguauu

SEQ ID NO: 2792939 - RNA, 17 nt, Leptospira interrogans serovar lai str. 56601
aaauacuuuuagaaaau

SEQ ID NO: 2792940 - RNA, 23 nt, Leptospira interrogans serovar lai str. 56601
aaauacuuuuagaaaauuagaaa

SEQ ID NO: 2792941 - RNA, 13 nt, Leptospira interrogans serovar lai str. 56601
aaauacuuuugaa

SEQ ID NO: 2792942 - RNA, 15 nt, Leptospira interrogans serovar lai str. 56601
aaauagaaaccuuuc

SEQ ID NO: 2792943 - RNA, 20 nt, Leptospira interrogans serovar lai str. 56601
aaauagaaaccuuucaucua

SEQ ID NO: 2792944 - RNA, 19 nt, Leptospira interrogans serovar lai str. 56601
aaauagaaauaacuuagaa

SEQ ID NO: 2792945 - RNA, 20 nt, Leptospira interrogans serovar lai str. 56601
aaauagaauaaauuauacaa

SEQ ID NO: 2792946 - RNA, 22 nt, Leptospira interrogans serovar lai str. 56601
aaauagaauccuauaauaaaau

SEQ ID NO: 2792947 - RNA, 16 nt, Leptospira interrogans serovar lai str. 56601
aaauagaauuguugaa

SEQ ID NO: 2792948 - RNA, 15 nt, Leptospira interrogans serovar lai str. 56601
aaauagaauuuugca

SEQ ID NO: 2792949 - RNA, 22 nt, Leptospira interrogans serovar lai str. 56601
aaauagaauuuugcaaaaaaaa

SEQ ID NO: 2792950 - RNA, 16 nt, Leptospira interrogans serovar lai str. 56601
aaauagaauuuuugua

SEQ ID NO: 2792951 - RNA, 21 nt, Leptospira interrogans serovar lai str. 56601
aaauagagcuuuguaauaaaa

SEQ ID NO: 2792952 - RNA, 20 nt, Leptospira interrogans serovar lai str. 56601
aaauagaucugauauuuuaa

SEQ ID NO: 2792953 - RNA, 22 nt, Leptospira interrogans serovar lai str. 56601
aaauagaucugauauuuuaaau

SEQ ID NO: 2792954 - RNA, 23 nt, Leptospira interrogans serovar lai str. 56601
aaauagaucugauauuuuaaauu

SEQ ID NO: 2792955 - RNA, 19 nt, Leptospira interrogans serovar lai str. 56601
aaauagauggagaauuaau

SEQ ID NO: 2792956 - RNA, 20 nt, Leptospira interrogans serovar lai str. 56601
aaauagauggagaauuaauu

SEQ ID NO: 2792957 - RNA, 17 nt, Leptospira interrogans serovar lai str. 56601
aaauagauuaguuuaaa

SEQ ID NO: 2792958 - RNA, 18 nt, Leptospira interrogans serovar lai str. 56601
aaauagauuaguuuaaaa

SEQ ID NO: 2792959 - RNA, 22 nt, Leptospira interrogans serovar lai str. 56601
aaauagauucuaauuuuucaaa

SEQ ID NO: 2792960 - RNA, 19 nt, Leptospira interrogans serovar lai str. 56601
aaauagcgauacuuaaaaa

SEQ ID NO: 2792961 - RNA, 17 nt, Leptospira interrogans serovar lai str. 56601
aaauagggaaaacucaa

SEQ ID NO: 2792962 - RNA, 22 nt, Leptospira interrogans serovar lai str. 56601
aaauagggaaaacucaucacaa

SEQ ID NO: 2792963 - RNA, 22 nt, Leptospira interrogans serovar lai str. 56601
aaauaguauauuaacuuucauu

SEQ ID NO: 2792964 - RNA, 16 nt, Leptospira interrogans serovar lai str. 56601
aaauaguauccaaaau

SEQ ID NO: 2792965 - RNA, 14 nt, Leptospira interrogans serovar lai str. 56601
aaaucgaaaaccag

SEQ ID NO: 2792966 - RNA, 20 nt, Leptospira interrogans serovar lai str. 56601
aaaucgaaauuaaaauaaag

SEQ ID NO: 2792967 - RNA, 22 nt, Leptospira interrogans serovar lai str. 56601
aaaucgaagaugguacuuuacg

SEQ ID NO: 2792968 - RNA, 16 nt, Leptospira interrogans serovar lai str. 56601
aaaucgaaucgcuaaa

SEQ ID NO: 2792969 - RNA, 16 nt, Leptospira interrogans serovar lai str. 56601
aaaucgacgauuuuac

SEQ ID NO: 2792970 - RNA, 21 nt, Leptospira interrogans serovar lai str. 56601
aaaucgaguguaauaugaauu

SEQ ID NO: 2792971 - RNA, 20 nt, Leptospira interrogans serovar lai str. 56601
aaaucgaguuucacaaaaau

SEQ ID NO: 2792972 - RNA, 17 nt, Leptospira interrogans serovar lai str. 56601
aaaucgauccuguuuau

SEQ ID NO: 2792973 - RNA, 22 nt, Leptospira interrogans serovar lai str. 56601
aaaucgaugguuucaauuuaaa

SEQ ID NO: 2792974 - RNA, 23 nt, Leptospira interrogans serovar lai str. 56601
aaaucgaugguuucaauuuaaaa

SEQ ID NO: 2792975 - RNA, 23 nt, Leptospira interrogans serovar lai str. 56601
aaaucgauugaucuaucuuucca

SEQ ID NO: 2792976 - RNA, 15 nt, Leptospira interrogans serovar lai str. 56601
aaaucgauuucuaaa

SEQ ID NO: 2792977 - RNA, 19 nt, Leptospira interrogans serovar lai str. 56601
aaaucgauuugaucuacaa

SEQ ID NO: 2792978 - RNA, 21 nt, Leptospira interrogans serovar lai str. 56601
aaaucgauuugaucuacaaug

SEQ ID NO: 2792979 - RNA, 16 nt, Leptospira interrogans serovar lai str. 56601
aaaucgcgaagaaagg

SEQ ID NO: 2792980 - RNA, 22 nt, Leptospira interrogans serovar lai str. 56601
aaaucgcgaagaaagguaauau

SEQ ID NO: 2792981 - RNA, 22 nt, Leptospira interrogans serovar lai str. 56601
aaaucgcugguuuuauuucugc

SEQ ID NO: 2792982 - RNA, 21 nt, Leptospira interrogans serovar lai str. 56601
aaaucggcccgcguauauaaa

SEQ ID NO: 2792983 - RNA, 15 nt, Leptospira interrogans serovar lai str. 56601
aaaucuaaaaaaaau

SEQ ID NO: 2792984 - RNA, 16 nt, Leptospira interrogans serovar lai str. 56601
aaaucuaaaaaaaauc

SEQ ID NO: 2792985 - RNA, 20 nt, Leptospira interrogans serovar lai str. 56601
aaaucuaaaaaaacaauuaa

SEQ ID NO: 2792986 - RNA, 13 nt, Leptospira interrogans serovar lai str. 56601
aaaucuaaaagaa

SEQ ID NO: 2792987 - RNA, 15 nt, Leptospira interrogans serovar lai str. 56601
aaaucuaaauuugua

SEQ ID NO: 2792988 - RNA, 16 nt, Leptospira interrogans serovar lai str. 56601
aaaucuaaauuuguaa

SEQ ID NO: 2792989 - RNA, 14 nt, Leptospira interrogans serovar lai str. 56601
aaaucuaaauuuua

SEQ ID NO: 2792990 - RNA, 15 nt, Leptospira interrogans serovar lai str. 56601
aaaucuaaauuuuac

SEQ ID NO: 2792991 - RNA, 21 nt, Leptospira interrogans serovar lai str. 56601
aaaucuaaauuuuacaauuaa

SEQ ID NO: 2792992 - RNA, 16 nt, Leptospira interrogans serovar lai str. 56601
aaaucuauauuuuaca

SEQ ID NO: 2792993 - RNA, 16 nt, Leptospira interrogans serovar lai str. 56601
aaaucuaucucaaaaa

SEQ ID NO: 2792994 - RNA, 22 nt, Leptospira interrogans serovar lai str. 56601
aaaucucaaauucgucaaaacc

SEQ ID NO: 2792995 - RNA, 17 nt, Leptospira interrogans serovar lai str. 56601
aaaucucaauucaguaa

SEQ ID NO: 2792996 - RNA, 12 nt, Leptospira interrogans serovar lai str. 56601
aaaucucagaaa

SEQ ID NO: 2792997 - RNA, 18 nt, Leptospira interrogans serovar lai str. 56601
aaaucucagaaaauuuua

SEQ ID NO: 2792998 - RNA, 19 nt, Leptospira interrogans serovar lai str. 56601
aaaucucagaaaauuuuac

SEQ ID NO: 2792999 - RNA, 23 nt, Leptospira interrogans serovar lai str. 56601
aaaucucuuuuacgacuuuauuc

SEQ ID NO: 2793000 - RNA, 21 nt, Leptospira interrogans serovar lai str. 56601
aaaucugaaaaagagcaaagg

SEQ ID NO: 2793001 - RNA, 14 nt, Leptospira interrogans serovar lai str. 56601
aaaucugaaauuca

SEQ ID NO: 2793002 - RNA, 21 nt, Leptospira interrogans serovar lai str. 56601
aaaucugaacauaaaaucgau

SEQ ID NO: 2793003 - RNA, 20 nt, Leptospira interrogans serovar lai str. 56601
aaaucugaacuuugcagacu

SEQ ID NO: 2793004 - RNA, 17 nt, Leptospira interrogans serovar lai str. 56601
aaaucugaaucucuuuu

SEQ ID NO: 2793005 - RNA, 17 nt, Leptospira interrogans serovar lai str. 56601
aaaucugaauuuuacca

SEQ ID NO: 2793006 - RNA, 19 nt, Leptospira interrogans serovar lai str. 56601
aaaucugaauuuuaccaaa

SEQ ID NO: 2793007 - RNA, 11 nt, Leptospira interrogans serovar lai str. 56601
aaaucugaccu

SEQ ID NO: 2793008 - RNA, 19 nt, Leptospira interrogans serovar lai str. 56601
aaaucuguacuuaaauuuu

SEQ ID NO: 2793009 - RNA, 18 nt, Leptospira interrogans serovar lai str. 56601
aaaucuuaggaacuuuua

SEQ ID NO: 2793010 - RNA, 18 nt, Leptospira interrogans serovar lai str. 56601
aaaucuucaguucuuaua

SEQ ID NO: 2793011 - RNA, 18 nt, Leptospira interrogans serovar lai str. 56601
aaaucuucgguuuaauau

SEQ ID NO: 2793012 - RNA, 21 nt, Leptospira interrogans serovar lai str. 56601
aaaucuucgguuuaauauacu

SEQ ID NO: 2793013 - RNA, 19 nt, Leptospira interrogans serovar lai str. 56601
aaaucuuuaaaauacuuua

SEQ ID NO: 2793014 - RNA, 21 nt, Leptospira interrogans serovar lai str. 56601
aaaucuuuaagagccuuucac

SEQ ID NO: 2793015 - RNA, 18 nt, Leptospira interrogans serovar lai str. 56601
aaaucuuuagaauuuuuc

SEQ ID NO: 2793016 - RNA, 24 nt, Leptospira interrogans serovar lai str. 56601
aaaucuuuagaauuuuucgaaaca

SEQ ID NO: 2793017 - RNA, 15 nt, Leptospira interrogans serovar lai str. 56601
aaaucuuuuaaaaaa

SEQ ID NO: 2793018 - RNA, 16 nt, Leptospira interrogans serovar lai str. 56601
aaaucuuuuaaaaaag

SEQ ID NO: 2793019 - RNA, 17 nt, Leptospira interrogans serovar lai str. 56601
aaaugaaaaaaaacaaa

SEQ ID NO: 2793020 - RNA, 13 nt, Leptospira interrogans serovar lai str. 56601
aaaugaaaaaacu

SEQ ID NO: 2793021 - RNA, 22 nt, Leptospira interrogans serovar lai str. 56601
aaaugaaaaagaauuuuuaaaa

SEQ ID NO: 2793022 - RNA, 18 nt, Leptospira interrogans serovar lai str. 56601
aaaugaaaacgaugucuu

SEQ ID NO: 2793023 - RNA, 13 nt, Leptospira interrogans serovar lai str. 56601
aaaugaaaauuau

SEQ ID NO: 2793024 - RNA, 15 nt, Leptospira interrogans serovar lai str. 56601
aaaugaaaauuauaa

SEQ ID NO: 2793025 - RNA, 18 nt, Leptospira interrogans serovar lai str. 56601
aaaugaaaauuauaagua

SEQ ID NO: 2793026 - RNA, 19 nt, Leptospira interrogans serovar lai str. 56601
aaaugaaagguaauuuuga

SEQ ID NO: 2793027 - RNA, 15 nt, Leptospira interrogans serovar lai str. 56601
aaaugaaauguggga

SEQ ID NO: 2793028 - RNA, 14 nt, Leptospira interrogans serovar lai str. 56601
aaaugaacaaugaa

SEQ ID NO: 2793029 - RNA, 23 nt, Leptospira interrogans serovar lai str. 56601
aaaugaacaaugaauuuuuauaa

SEQ ID NO: 2793030 - RNA, 17 nt, Leptospira interrogans serovar lai str. 56601
aaaugaagaaacacuuu

SEQ ID NO: 2793031 - RNA, 16 nt, Leptospira interrogans serovar lai str. 56601
aaaugaauguuuaaaa

SEQ ID NO: 2793032 - RNA, 21 nt, Leptospira interrogans serovar lai str. 56601
aaaugaauguuuaaaauuuau

SEQ ID NO: 2793033 - RNA, 14 nt, Leptospira interrogans serovar lai str. 56601
aaaugaauuguaaa

SEQ ID NO: 2793034 - RNA, 15 nt, Leptospira interrogans serovar lai str. 56601
aaaugaauuguaaaa

SEQ ID NO: 2793035 - RNA, 18 nt, Leptospira interrogans serovar lai str. 56601
aaaugaauuuagaaaauu

SEQ ID NO: 2793036 - RNA, 23 nt, Leptospira interrogans serovar lai str. 56601
aaaugaauuuagaaaauuagaaa

SEQ ID NO: 2793037 - RNA, 23 nt, Leptospira interrogans serovar lai str. 56601
aaaugaauuuagcauuuuuaaga

SEQ ID NO: 2793038 - RNA, 12 nt, Leptospira interrogans serovar lai str. 56601
aaaugaccaaaa

SEQ ID NO: 2793039 - RNA, 19 nt, Leptospira interrogans serovar lai str. 56601
aaaugagaaagaauuucua

SEQ ID NO: 2793040 - RNA, 15 nt, Leptospira interrogans serovar lai str. 56601
aaaugagauuuuguc

SEQ ID NO: 2793041 - RNA, 20 nt, Leptospira interrogans serovar lai str. 56601
aaaugagauuuugucuccug

SEQ ID NO: 2793042 - RNA, 14 nt, Leptospira interrogans serovar lai str. 56601
aaaugaguaaacua

SEQ ID NO: 2793043 - RNA, 16 nt, Leptospira interrogans serovar lai str. 56601
aaaugaguaaacuauu

SEQ ID NO: 2793044 - RNA, 17 nt, Leptospira interrogans serovar lai str. 56601
aaaugaguaaacuauug

SEQ ID NO: 2793045 - RNA, 21 nt, Leptospira interrogans serovar lai str. 56601
aaaugaguuauaguaaaagaa

SEQ ID NO: 2793046 - RNA, 15 nt, Leptospira interrogans serovar lai str. 56601
aaaugaguuuuagaa

SEQ ID NO: 2793047 - RNA, 20 nt, Leptospira interrogans serovar lai str. 56601
aaauuauagauaauuuuuac

SEQ ID NO: 2793048 - RNA, 22 nt, Leptospira interrogans serovar lai str. 56601
aaauuauagauaauuuuuacuc

SEQ ID NO: 2793049 - RNA, 23 nt, Leptospira interrogans serovar lai str. 56601
aaauuauaguaacagaaaaaugu

SEQ ID NO: 2793050 - RNA, 23 nt, Leptospira interrogans serovar lai str. 56601
aaauuauauacaggaaagguuau

SEQ ID NO: 2793051 - RNA, 13 nt, Leptospira interrogans serovar lai str. 56601
aaauuauucugaa

SEQ ID NO: 2793052 - RNA, 13 nt, Leptospira interrogans serovar lai str. 56601
aaauuauuuucaa

SEQ ID NO: 2793053 - RNA, 18 nt, Leptospira interrogans serovar lai str. 56601
aaauuauuuucaaguaaa

SEQ ID NO: 2793054 - RNA, 12 nt, Leptospira interrogans serovar lai str. 56601
aaauuauuuuga

SEQ ID NO: 2793055 - RNA, 19 nt, Leptospira interrogans serovar lai str. 56601
aaauuauuuugaaccauau

SEQ ID NO: 2793056 - RNA, 22 nt, Leptospira interrogans serovar lai str. 56601
aaauuauuuuuuguuagauucu

SEQ ID NO: 2793057 - RNA, 17 nt, Leptospira interrogans serovar lai str. 56601
aaauucaaaauaagaaa

SEQ ID NO: 2793058 - RNA, 18 nt, Leptospira interrogans serovar lai str. 56601
aaauucaaaauaagaaaa

SEQ ID NO: 2793059 - RNA, 21 nt, Leptospira interrogans serovar lai str. 56601
aaauucaaagcaagaaaaucu

SEQ ID NO: 2793060 - RNA, 17 nt, Leptospira interrogans serovar lai str. 56601
aaauucaacuuguaaaa

SEQ ID NO: 2793061 - RNA, 23 nt, Leptospira interrogans serovar lai str. 56601
aaauucaaguggguuacuuugaa

SEQ ID NO: 2793062 - RNA, 17 nt, Leptospira interrogans serovar lai str. 56601
aaauucacauaaaguua

SEQ ID NO: 2793063 - RNA, 21 nt, Leptospira interrogans serovar lai str. 56601
aaauucacauuauauauuuau

SEQ ID NO: 2793064 - RNA, 22 nt, Leptospira interrogans serovar lai str. 56601
aaauucacgaccuuaaauaaua

SEQ ID NO: 2793065 - RNA, 18 nt, Leptospira interrogans serovar lai str. 56601
aaauucacguucaacaaa

SEQ ID NO: 2793066 - RNA, 21 nt, Leptospira interrogans serovar lai str. 56601
aaauucagaaaaaaaaagaau

SEQ ID NO: 2793067 - RNA, 15 nt, Leptospira interrogans serovar lai str. 56601
aaauucagauuucag

SEQ ID NO: 2793068 - RNA, 22 nt, Leptospira interrogans serovar lai str. 56601
aaauucagauuucagcuccaaa

SEQ ID NO: 2793069 - RNA, 23 nt, Leptospira interrogans serovar lai str. 56601
aaauucaggauaaacauccucaa

SEQ ID NO: 2793070 - RNA, 20 nt, Leptospira interrogans serovar lai str. 56601
aaauucaggugggaguuuag

SEQ ID NO: 2793071 - RNA, 23 nt, Leptospira interrogans serovar lai str. 56601
aaauucaggugggaguuuagaac

SEQ ID NO: 2793072 - RNA, 17 nt, Leptospira interrogans serovar lai str. 56601
aaauucauaaccuuacc

SEQ ID NO: 2793073 - RNA, 21 nt, Leptospira interrogans serovar lai str. 56601
aaauucauauugagauaaaaa

SEQ ID NO: 2793074 - RNA, 15 nt, Leptospira interrogans serovar lai str. 56601
aaauucaucaaauuu

SEQ ID NO: 2793075 - RNA, 17 nt, Leptospira interrogans serovar lai str. 56601
aaauucaucaaugaaua

SEQ ID NO: 2793076 - RNA, 20 nt, Leptospira interrogans serovar lai str. 56601
aaauucaucaauuuuggaaa

SEQ ID NO: 2793077 - RNA, 21 nt, Leptospira interrogans serovar lai str. 56601
aaauucauuccuauaaauaaa

SEQ ID NO: 2793078 - RNA, 12 nt, Leptospira interrogans serovar lai str. 56601
aaauucauuuuu

SEQ ID NO: 2793079 - RNA, 17 nt, Leptospira interrogans serovar lai str. 56601
aaauucauuuuucugaa

SEQ ID NO: 2793080 - RNA, 22 nt, Leptospira interrogans serovar lai str. 56601
aaauucauuuuucugaaaaaag

SEQ ID NO: 2793081 - RNA, 16 nt, Leptospira interrogans serovar lai str. 56601
aaauuccacuucucac

SEQ ID NO: 2793082 - RNA, 18 nt, Leptospira interrogans serovar lai str. 56601
aaauuccacuucucacaa

SEQ ID NO: 2793083 - RNA, 20 nt, Leptospira interrogans serovar lai str. 56601
aaauuccgaauucuaaaaua

SEQ ID NO: 2793084 - RNA, 22 nt, Leptospira interrogans serovar lai str. 56601
aaauuccgaauucuaaaauacu

SEQ ID NO: 2793085 - RNA, 15 nt, Leptospira interrogans serovar lai str. 56601
aaauuccguaaaauu

SEQ ID NO: 2793086 - RNA, 19 nt, Leptospira interrogans serovar lai str. 56601
aaauuccuaaaacaccuuc

SEQ ID NO: 2793087 - RNA, 22 nt, Leptospira interrogans serovar lai str. 56601
aaauuccuaaugcagcuucuuc

SEQ ID NO: 2793088 - RNA, 11 nt, Leptospira interrogans serovar lai str. 56601
aaauuccuuac

SEQ ID NO: 2793089 - RNA, 20 nt, Leptospira interrogans serovar lai str. 56601
aaauuccuuccaaguuuuug

SEQ ID NO: 2793090 - RNA, 20 nt, Leptospira interrogans serovar lai str. 56601
aaauucgauacugccaauga

SEQ ID NO: 2793091 - RNA, 19 nt, Leptospira interrogans serovar lai str. 56601
aaauucgauagaauccaau

SEQ ID NO: 2793092 - RNA, 22 nt, Leptospira interrogans serovar lai str. 56601
aaauucgccguaaaaaauccau

SEQ ID NO: 2793093 - RNA, 19 nt, Leptospira interrogans serovar lai str. 56601
aaauucguugagacgaaaa

SEQ ID NO: 2793094 - RNA, 16 nt, Leptospira interrogans serovar lai str. 56601
aaauucguuuuacuuc

SEQ ID NO: 2793095 - RNA, 14 nt, Leptospira interrogans serovar lai str. 56601
aaauucuaaaaaaa

SEQ ID NO: 2793096 - RNA, 15 nt, Leptospira interrogans serovar lai str. 56601
aaauucuaaaaaaau

SEQ ID NO: 2793097 - RNA, 22 nt, Leptospira interrogans serovar lai str. 56601
aaauucuaaacuuguaagacuc

SEQ ID NO: 2793098 - RNA, 21 nt, Leptospira interrogans serovar lai str. 56601
aaauucuaaucacgaaaaaug

SEQ ID NO: 2793099 - RNA, 17 nt, Leptospira interrogans serovar lai str. 56601
aaauucuaauuguggga

SEQ ID NO: 2793100 - RNA, 19 nt, Leptospira interrogans serovar lai str. 56601
aaauucuacaaauucuucu

SEQ ID NO: 2793101 - RNA, 21 nt, Leptospira interrogans serovar lai str. 56601
aaauucuacaaauucuucuuc

SEQ ID NO: 2793102 - RNA, 20 nt, Leptospira interrogans serovar lai str. 56601
aaauucuacaccuucuaaau

SEQ ID NO: 2793103 - RNA, 22 nt, Leptospira interrogans serovar lai str. 56601
aaauucuacaccuucuaaauca

SEQ ID NO: 2793104 - RNA, 20 nt, Leptospira interrogans serovar lai str. 56601
aaauucuaugggaauuuuug

SEQ ID NO: 2793105 - RNA, 22 nt, Leptospira interrogans serovar lai str. 56601
aaauucuaugggaauuuuugua

SEQ ID NO: 2793106 - RNA, 23 nt, Leptospira interrogans serovar lai str. 56601
aaauucuaugggaauuuuuguaa

SEQ ID NO: 2793107 - RNA, 20 nt, Leptospira interrogans serovar lai str. 56601
aaauucucuuuugaccaaaa

SEQ ID NO: 2793108 - RNA, 18 nt, Leptospira interrogans serovar lai str. 56601
aaauucugucucuuuaua

SEQ ID NO: 2793109 - RNA, 20 nt, Leptospira interrogans serovar lai str. 56601
aaauucugucucuuuauaua

SEQ ID NO: 2793110 - RNA, 23 nt, Leptospira interrogans serovar lai str. 56601
aaauucuuaaaaaauauuuucug

SEQ ID NO: 2793111 - RNA, 13 nt, Leptospira interrogans serovar lai str. 56601
aaauucuuaauau

SEQ ID NO: 2793112 - RNA, 21 nt, Leptospira interrogans serovar lai str. 56601
aaauucuuucguuuuuugcag

SEQ ID NO: 2793113 - RNA, 14 nt, Leptospira interrogans serovar lai str. 56601
aaauucuuucucgu

SEQ ID NO: 2793114 - RNA, 12 nt, Leptospira interrogans serovar lai str. 56601
aaauucuuuguc

SEQ ID NO: 2793115 - RNA, 19 nt, Leptospira interrogans serovar lai str. 56601
aaauucuuuuuauuuuuac

SEQ ID NO: 2793116 - RNA, 20 nt, Leptospira interrogans serovar lai str. 56601
aaauugaaacaauuuugcca

SEQ ID NO: 2793117 - RNA, 13 nt, Leptospira interrogans serovar lai str. 56601
aaauugaaacuau

SEQ ID NO: 2793118 - RNA, 15 nt, Leptospira interrogans serovar lai str. 56601
aaauugaacguaaua

SEQ ID NO: 2793119 - RNA, 13 nt, Leptospira interrogans serovar lai str. 56601
aaauugaauucuu

SEQ ID NO: 2793120 - RNA, 17 nt, Leptospira interrogans serovar lai str. 56601
aaauugaauucuuccuu

SEQ ID NO: 2793121 - RNA, 20 nt, Leptospira interrogans serovar lai str. 56601
aaauugaauucuuccuucuu

SEQ ID NO: 2793122 - RNA, 15 nt, Leptospira interrogans serovar lai str. 56601
aaauugaauuuaaaa

SEQ ID NO: 2793123 - RNA, 22 nt, Leptospira interrogans serovar lai str. 56601
aaauugaauuuaaaaguuuccc

SEQ ID NO: 2793124 - RNA, 23 nt, Leptospira interrogans serovar lai str. 56601
aaauugaauuugcaguaaaaggc

SEQ ID NO: 2793125 - RNA, 15 nt, Leptospira interrogans serovar lai str. 56601
aaauugacaaagagu

SEQ ID NO: 2793126 - RNA, 16 nt, Leptospira interrogans serovar lai str. 56601
aaauugacaaagaguu

SEQ ID NO: 2793127 - RNA, 22 nt, Leptospira interrogans serovar lai str. 56601
aaauugagaauuuguuuuaaaa

SEQ ID NO: 2793128 - RNA, 22 nt, Leptospira interrogans serovar lai str. 56601
aaauugagcuuguuuuuaaauu

SEQ ID NO: 2793129 - RNA, 14 nt, Leptospira interrogans serovar lai str. 56601
aaauuuuucucccu

SEQ ID NO: 2793130 - RNA, 14 nt, Leptospira interrogans serovar lai str. 56601
aaauuuuugcauaa

SEQ ID NO: 2793131 - RNA, 20 nt, Leptospira interrogans serovar lai str. 56601
aaauuuuuguguaaaauuac

SEQ ID NO: 2793132 - RNA, 16 nt, Leptospira interrogans serovar lai str. 56601
aaauuuuuuagaaauc

SEQ ID NO: 2793133 - RNA, 21 nt, Leptospira interrogans serovar lai str. 56601
aaauuuuuuauuuuaugaaua

SEQ ID NO: 2793134 - RNA, 22 nt, Leptospira interrogans serovar lai str. 56601
aaauuuuuuauuuuaugaauaa

SEQ ID NO: 2793135 - RNA, 13 nt, Leptospira interrogans serovar lai str. 56601
aaauuuuuuccuu

SEQ ID NO: 2793136 - RNA, 14 nt, Leptospira interrogans serovar lai str. 56601
aaauuuuuucucgu

SEQ ID NO: 2793137 - RNA, 12 nt, Leptospira interrogans serovar lai str. 56601
aaauuuuuucuu

SEQ ID NO: 2793138 - RNA, 13 nt, Leptospira interrogans serovar lai str. 56601
aaauuuuuucuuu

SEQ ID NO: 2793139 - RNA, 15 nt, Leptospira interrogans serovar lai str. 56601
aaauuuuuugaaguu

SEQ ID NO: 2793140 - RNA, 17 nt, Leptospira interrogans serovar lai str. 56601
aaauuuuuugaaguuuu

SEQ ID NO: 2793141 - RNA, 15 nt, Leptospira interrogans serovar lai str. 56601
aaauuuuuugcaaaa

SEQ ID NO: 2793142 - RNA, 21 nt, Leptospira interrogans serovar lai str. 56601
aaauuuuuugcaaaaaaauaa

SEQ ID NO: 2793143 - RNA, 22 nt, Leptospira interrogans serovar lai str. 56601
aaauuuuuugcaaaaaaauaaa

SEQ ID NO: 2793144 - RNA, 18 nt, Leptospira interrogans serovar lai str. 56601
aaauuuuuuuaaaaaugu

SEQ ID NO: 2793145 - RNA, 16 nt, Leptospira interrogans serovar lai str. 56601
aaauuuuuuuaagaau

SEQ ID NO: 2793146 - RNA, 18 nt, Leptospira interrogans serovar lai str. 56601
aaauuuuuuuaagaauuu

SEQ ID NO: 2793147 - RNA, 19 nt, Leptospira interrogans serovar lai str. 56601
aaauuuuuuucuaaaauau

SEQ ID NO: 2793148 - RNA, 21 nt, Leptospira interrogans serovar lai str. 56601
aaauuuuuuucuaaaauauag

SEQ ID NO: 2793149 - RNA, 19 nt, Leptospira interrogans serovar lai str. 56601
aaauuuuuuugauucaaaa

SEQ ID NO: 2793150 - RNA, 13 nt, Leptospira interrogans serovar lai str. 56601
aaauuuuuuugua

SEQ ID NO: 2793151 - RNA, 14 nt, Leptospira interrogans serovar lai str. 56601
aacaaaaaaacaac

SEQ ID NO: 2793152 - RNA, 14 nt, Leptospira interrogans serovar lai str. 56601
aacaaaaaugagaa

SEQ ID NO: 2793153 - RNA, 19 nt, Leptospira interrogans serovar lai str. 56601
aacaaaacguaagauaggu

SEQ ID NO: 2793154 - RNA, 21 nt, Leptospira interrogans serovar lai str. 56601
aacaaaacgugguaguuccca

SEQ ID NO: 2793155 - RNA, 11 nt, Leptospira interrogans serovar lai str. 56601
aacaaaacugc

SEQ ID NO: 2793156 - RNA, 17 nt, Leptospira interrogans serovar lai str. 56601
aacaaaaguggaagaga

SEQ ID NO: 2793157 - RNA, 23 nt, Leptospira interrogans serovar lai str. 56601
aacaaaaucaaagagcaacucug

SEQ ID NO: 2793158 - RNA, 22 nt, Leptospira interrogans serovar lai str. 56601
aacaaaaucaaagauauuucaa

SEQ ID NO: 2793159 - RNA, 17 nt, Leptospira interrogans serovar lai str. 56601
aacaaaauuacuucaau

SEQ ID NO: 2793160 - RNA, 19 nt, Leptospira interrogans serovar lai str. 56601
aacaaaauucaaaugucuu

SEQ ID NO: 2793161 - RNA, 22 nt, Leptospira interrogans serovar lai str. 56601
aacaaaauuuacgaaaauuuuu

SEQ ID NO: 2793162 - RNA, 13 nt, Leptospira interrogans serovar lai str. 56601
aacaaacaaauag

SEQ ID NO: 2793163 - RNA, 16 nt, Leptospira interrogans serovar lai str. 56601
aacaaacaaauagaaa

SEQ ID NO: 2793164 - RNA, 15 nt, Leptospira interrogans serovar lai str. 56601
aacaaacaccacaau

SEQ ID NO: 2793165 - RNA, 22 nt, Leptospira interrogans serovar lai str. 56601
aacaaagacaaaguauuuucua

SEQ ID NO: 2793166 - RNA, 16 nt, Leptospira interrogans serovar lai str. 56601
aacaaaguauuuaauu

SEQ ID NO: 2793167 - RNA, 15 nt, Leptospira interrogans serovar lai str. 56601
aacaaauaucaugau

SEQ ID NO: 2793168 - RNA, 16 nt, Leptospira interrogans serovar lai str. 56601
aacaaauuaaguuuaa

SEQ ID NO: 2793169 - RNA, 17 nt, Leptospira interrogans serovar lai str. 56601
aacaaauuaaguuuaaa

SEQ ID NO: 2793170 - RNA, 23 nt, Leptospira interrogans serovar lai str. 56601
aacaaauuccgaaauuguaggaa

SEQ ID NO: 2793171 - RNA, 18 nt, Leptospira interrogans serovar lai str. 56601
aacaaauucuaaacuugu

SEQ ID NO: 2793172 - RNA, 13 nt, Leptospira interrogans serovar lai str. 56601
aacaaauucuaca

SEQ ID NO: 2793173 - RNA, 15 nt, Leptospira interrogans serovar lai str. 56601
aacaaauucuacaau

SEQ ID NO: 2793174 - RNA, 16 nt, Leptospira interrogans serovar lai str. 56601
aacaacgauuucugua

SEQ ID NO: 2793175 - RNA, 14 nt, Leptospira interrogans serovar lai str. 56601
aacaacucuaauac

SEQ ID NO: 2793176 - RNA, 17 nt, Leptospira interrogans serovar lai str. 56601
aacaacucuaauacaaa

SEQ ID NO: 2793177 - RNA, 20 nt, Leptospira interrogans serovar lai str. 56601
aacaacucuauuauuauuuu

SEQ ID NO: 2793178 - RNA, 13 nt, Leptospira interrogans serovar lai str. 56601
aacaacucuauuu

SEQ ID NO: 2793179 - RNA, 14 nt, Leptospira interrogans serovar lai str. 56601
aacaacucuauuuc

SEQ ID NO: 2793180 - RNA, 13 nt, Leptospira interrogans serovar lai str. 56601
aacaacucuucuu

SEQ ID NO: 2793181 - RNA, 15 nt, Leptospira interrogans serovar lai str. 56601
aacaagauuaacaau

SEQ ID NO: 2793182 - RNA, 19 nt, Leptospira interrogans serovar lai str. 56601
aacaagauuaacaaucaau

SEQ ID NO: 2793183 - RNA, 18 nt, Leptospira interrogans serovar lai str. 56601
aacaagcucaauuuugaa

SEQ ID NO: 2793184 - RNA, 19 nt, Leptospira interrogans serovar lai str. 56601
aacaagcuuuggauuuuga

SEQ ID NO: 2793185 - RNA, 21 nt, Leptospira interrogans serovar lai str. 56601
aacaaggcuuuguaauaaaaa

SEQ ID NO: 2793186 - RNA, 22 nt, Leptospira interrogans serovar lai str. 56601
aacaaguuccaaauuacucuuu

SEQ ID NO: 2793187 - RNA, 19 nt, Leptospira interrogans serovar lai str. 56601
aacaauagcuucuuuaaaa

SEQ ID NO: 2793188 - RNA, 23 nt, Leptospira interrogans serovar lai str. 56601
aacaauagcuucuuuaaaaacuu

SEQ ID NO: 2793189 - RNA, 15 nt, Leptospira interrogans serovar lai str. 56601
aacaaucaauugaaa

SEQ ID NO: 2793190 - RNA, 19 nt, Leptospira interrogans serovar lai str. 56601
aacaaucguacgaaucaga

SEQ ID NO: 2793191 - RNA, 18 nt, Leptospira interrogans serovar lai str. 56601
aacaaucuucgguauuuu

SEQ ID NO: 2793192 - RNA, 16 nt, Leptospira interrogans serovar lai str. 56601
aacaaugaauuuuuau

SEQ ID NO: 2793193 - RNA, 19 nt, Leptospira interrogans serovar lai str. 56601
aacaauuaaucaaauuucu

SEQ ID NO: 2793194 - RNA, 16 nt, Leptospira interrogans serovar lai str. 56601
aacaauuacagaaggg

SEQ ID NO: 2793195 - RNA, 11 nt, Leptospira interrogans serovar lai str. 56601
aacaauucaga

SEQ ID NO: 2793196 - RNA, 21 nt, Leptospira interrogans serovar lai str. 56601
aacaauucucgauagaacaau

SEQ ID NO: 2793197 - RNA, 15 nt, Leptospira interrogans serovar lai str. 56601
aacaauuuaaaauaa

SEQ ID NO: 2793198 - RNA, 16 nt, Leptospira interrogans serovar lai str. 56601
aacaauuuaaaauaau

SEQ ID NO: 2793199 - RNA, 16 nt, Leptospira interrogans serovar lai str. 56601
aacaauuuuuugaaaa

SEQ ID NO: 2793200 - RNA, 22 nt, Leptospira interrogans serovar lai str. 56601
aacacaaaggaaucccaaauuc

SEQ ID NO: 2793201 - RNA, 17 nt, Leptospira interrogans serovar lai str. 56601
aacacaaauauuaagaa

SEQ ID NO: 2793202 - RNA, 20 nt, Leptospira interrogans serovar lai str. 56601
aacacaaauauuaagaauuc

SEQ ID NO: 2793203 - RNA, 19 nt, Leptospira interrogans serovar lai str. 56601
aacacaacgcucucuacgg

SEQ ID NO: 2793204 - RNA, 18 nt, Leptospira interrogans serovar lai str. 56601
aacacaguuugaauuuua

SEQ ID NO: 2793205 - RNA, 19 nt, Leptospira interrogans serovar lai str. 56601
aacacauuuucauucuaaa

SEQ ID NO: 2793206 - RNA, 23 nt, Leptospira interrogans serovar lai str. 56601
aacaccuucucuuuuaaaaacuu

SEQ ID NO: 2793207 - RNA, 23 nt, Leptospira interrogans serovar lai str. 56601
aacacgauacucaauauuuuguu

SEQ ID NO: 2793208 - RNA, 22 nt, Leptospira interrogans serovar lai str. 56601
aacacgggaauaaaaacaaaau

SEQ ID NO: 2793209 - RNA, 14 nt, Leptospira interrogans serovar lai str. 56601
aacacguuaacaau

SEQ ID NO: 2793210 - RNA, 18 nt, Leptospira interrogans serovar lai str. 56601
aacacuaaguaaaaaugc

SEQ ID NO: 2793211 - RNA, 23 nt, Leptospira interrogans serovar lai str. 56601
aacacuguuucgacguaaaaaua

SEQ ID NO: 2793212 - RNA, 23 nt, Leptospira interrogans serovar lai str. 56601
aaccucgucuaucuuuuuuaaaa

SEQ ID NO: 2793213 - RNA, 17 nt, Leptospira interrogans serovar lai str. 56601
aaccucuguaaauacaa

SEQ ID NO: 2793214 - RNA, 14 nt, Leptospira interrogans serovar lai str. 56601
aaccugauuuuucc

SEQ ID NO: 2793215 - RNA, 18 nt, Leptospira interrogans serovar lai str. 56601
aaccuuacccacaaauaa

SEQ ID NO: 2793216 - RNA, 20 nt, Leptospira interrogans serovar lai str. 56601
aaccuuacccacaaauaauu

SEQ ID NO: 2793217 - RNA, 14 nt, Leptospira interrogans serovar lai str. 56601
aaccuucuuuaaga

SEQ ID NO: 2793218 - RNA, 18 nt, Leptospira interrogans serovar lai str. 56601
aaccuuuaccauaaauuu

SEQ ID NO: 2793219 - RNA, 19 nt, Leptospira interrogans serovar lai str. 56601
aaccuuuaguuuccaaaaa

SEQ ID NO: 2793220 - RNA, 14 nt, Leptospira interrogans serovar lai str. 56601
aaccuuuauuuaau

SEQ ID NO: 2793221 - RNA, 15 nt, Leptospira interrogans serovar lai str. 56601
aaccuuuauuuaaua

SEQ ID NO: 2793222 - RNA, 17 nt, Leptospira interrogans serovar lai str. 56601
aaccuuugauagaacuc

SEQ ID NO: 2793223 - RNA, 11 nt, Leptospira interrogans serovar lai str. 56601
aaccuuuucua

SEQ ID NO: 2793224 - RNA, 16 nt, Leptospira interrogans serovar lai str. 56601
aacgaaauauauuaga

SEQ ID NO: 2793225 - RNA, 15 nt, Leptospira interrogans serovar lai str. 56601
aacgaaauuauacaa

SEQ ID NO: 2793226 - RNA, 16 nt, Leptospira interrogans serovar lai str. 56601
aacgaaauuauacaaa

SEQ ID NO: 2793227 - RNA, 19 nt, Leptospira interrogans serovar lai str. 56601
aacgaaauuauacaaaacu

SEQ ID NO: 2793228 - RNA, 21 nt, Leptospira interrogans serovar lai str. 56601
aacgaacuuuucuauaaaauc

SEQ ID NO: 2793229 - RNA, 13 nt, Leptospira interrogans serovar lai str. 56601
aacgaaucauauu

SEQ ID NO: 2793230 - RNA, 13 nt, Leptospira interrogans serovar lai str. 56601
aacgacauuuuag

SEQ ID NO: 2793231 - RNA, 21 nt, Leptospira interrogans serovar lai str. 56601
aacgacucauggagaauaaaa

SEQ ID NO: 2793232 - RNA, 22 nt, Leptospira interrogans serovar lai str. 56601
aacgacucauggagaauaaaac

SEQ ID NO: 2793233 - RNA, 14 nt, Leptospira interrogans serovar lai str. 56601
aacgagacgcugaa

SEQ ID NO: 2793234 - RNA, 17 nt, Leptospira interrogans serovar lai str. 56601
aacgauaagucucucuu

SEQ ID NO: 2793235 - RNA, 15 nt, Leptospira interrogans serovar lai str. 56601
aacgauacaaauucc

SEQ ID NO: 2793236 - RNA, 23 nt, Leptospira interrogans serovar lai str. 56601
aacgauaucgauagccaguguaa

SEQ ID NO: 2793237 - RNA, 13 nt, Leptospira interrogans serovar lai str. 56601
aacgauauuuuuu

SEQ ID NO: 2793238 - RNA, 21 nt, Leptospira interrogans serovar lai str. 56601
aacgaucauacuuuagaaauu

SEQ ID NO: 2793239 - RNA, 17 nt, Leptospira interrogans serovar lai str. 56601
aacgauguauugaguuu

SEQ ID NO: 2793240 - RNA, 21 nt, Leptospira interrogans serovar lai str. 56601
aacgauuaugauuuuuuugaa

SEQ ID NO: 2793241 - RNA, 15 nt, Leptospira interrogans serovar lai str. 56601
aacgauuauuuuuua

SEQ ID NO: 2793242 - RNA, 22 nt, Leptospira interrogans serovar lai str. 56601
aacgauuauuuuuuaaaaaucu

SEQ ID NO: 2793243 - RNA, 18 nt, Leptospira interrogans serovar lai str. 56601
aacgauucucguucaacu

SEQ ID NO: 2793244 - RNA, 19 nt, Leptospira interrogans serovar lai str. 56601
aacgauuguaaaaaaacau

SEQ ID NO: 2793245 - RNA, 18 nt, Leptospira interrogans serovar lai str. 56601
aacgauuucuauuuuucg

SEQ ID NO: 2793246 - RNA, 13 nt, Leptospira interrogans serovar lai str. 56601
aacgauuuuauac

SEQ ID NO: 2793247 - RNA, 16 nt, Leptospira interrogans serovar lai str. 56601
aacgcaaaaagccaga

SEQ ID NO: 2793248 - RNA, 15 nt, Leptospira interrogans serovar lai str. 56601
aacgcaugaaaauaa

SEQ ID NO: 2793249 - RNA, 16 nt, Leptospira interrogans serovar lai str. 56601
aacgcaugaaaauaau

SEQ ID NO: 2793250 - RNA, 17 nt, Leptospira interrogans serovar lai str. 56601
aacgcaugaaaauaaua

SEQ ID NO: 2793251 - RNA, 15 nt, Leptospira interrogans serovar lai str. 56601
aacgcgaacuuuuuu

SEQ ID NO: 2793252 - RNA, 22 nt, Leptospira interrogans serovar lai str. 56601
aacgcuaguuuaguguaagaaa

SEQ ID NO: 2793253 - RNA, 14 nt, Leptospira interrogans serovar lai str. 56601
aacgcucguuguaa

SEQ ID NO: 2793254 - RNA, 17 nt, Leptospira interrogans serovar lai str. 56601
aacgcucucuacggauc

SEQ ID NO: 2793255 - RNA, 18 nt, Leptospira interrogans serovar lai str. 56601
aacgcuuucguaaaaagc

SEQ ID NO: 2793256 - RNA, 13 nt, Leptospira interrogans serovar lai str. 56601
aacggaauuuuuc

SEQ ID NO: 2793257 - RNA, 18 nt, Leptospira interrogans serovar lai str. 56601
aacggaguuucucauuuu

SEQ ID NO: 2793258 - RNA, 15 nt, Leptospira interrogans serovar lai str. 56601
aacggccgauugaag

SEQ ID NO: 2793259 - RNA, 20 nt, Leptospira interrogans serovar lai str. 56601
aacggcgauccauagaaagc

SEQ ID NO: 2793260 - RNA, 17 nt, Leptospira interrogans serovar lai str. 56601
aacgguaaaaggagcca

SEQ ID NO: 2793261 - RNA, 18 nt, Leptospira interrogans serovar lai str. 56601
aacgguacucaauuuuac

SEQ ID NO: 2793262 - RNA, 16 nt, Leptospira interrogans serovar lai str. 56601
aacggucgauugaagc

SEQ ID NO: 2793263 - RNA, 19 nt, Leptospira interrogans serovar lai str. 56601
aacggugcauuuaaaaaau

SEQ ID NO: 2793264 - RNA, 23 nt, Leptospira interrogans serovar lai str. 56601
aacggugcuuuguucaaagaaau

SEQ ID NO: 2793265 - RNA, 14 nt, Leptospira interrogans serovar lai str. 56601
aacguaaauuuuua

SEQ ID NO: 2793266 - RNA, 16 nt, Leptospira interrogans serovar lai str. 56601
aacguaaguuaaauau

SEQ ID NO: 2793267 - RNA, 15 nt, Leptospira interrogans serovar lai str. 56601
aacguaauacgauau

SEQ ID NO: 2793268 - RNA, 21 nt, Leptospira interrogans serovar lai str. 56601
aacguaauacgauauuuuguu

SEQ ID NO: 2793269 - RNA, 19 nt, Leptospira interrogans serovar lai str. 56601
aacguagauaauuaaacaa

SEQ ID NO: 2793270 - RNA, 23 nt, Leptospira interrogans serovar lai str. 56601
aacguaggcuugucguaaaaaaa

SEQ ID NO: 2793271 - RNA, 19 nt, Leptospira interrogans serovar lai str. 56601
aacguaugauguaaggagc

SEQ ID NO: 2793272 - RNA, 20 nt, Leptospira interrogans serovar lai str. 56601
aacguaugauguaaggagcc

SEQ ID NO: 2793273 - RNA, 13 nt, Leptospira interrogans serovar lai str. 56601
aacguauuuuuac

SEQ ID NO: 2793274 - RNA, 23 nt, Leptospira interrogans serovar lai str. 56601
aacguauuuuuacccgaucuuuu

SEQ ID NO: 2793275 - RNA, 12 nt, Leptospira interrogans serovar lai str. 56601
aacgucaaaauu

SEQ ID NO: 2793276 - RNA, 15 nt, Leptospira interrogans serovar lai str. 56601
aacgucacuuuacaa

SEQ ID NO: 2793277 - RNA, 16 nt, Leptospira interrogans serovar lai str. 56601
aacgucauaguuccca

SEQ ID NO: 2793278 - RNA, 17 nt, Leptospira interrogans serovar lai str. 56601
aacgucuaguccucuuu

SEQ ID NO: 2793279 - RNA, 14 nt, Leptospira interrogans serovar lai str. 56601
aacgucuuuaucca

SEQ ID NO: 2793280 - RNA, 17 nt, Leptospira interrogans serovar lai str. 56601
aacgugaauugucauga

SEQ ID NO: 2793281 - RNA, 13 nt, Leptospira interrogans serovar lai str. 56601
aacgugagcucua

SEQ ID NO: 2793282 - RNA, 13 nt, Leptospira interrogans serovar lai str. 56601
aacgugaguucgu

SEQ ID NO: 2793283 - RNA, 23 nt, Leptospira interrogans serovar lai str. 56601
aacgugaguucguggagaaaacg

SEQ ID NO: 2793284 - RNA, 16 nt, Leptospira interrogans serovar lai str. 56601
aacguuacuuuuaaga

SEQ ID NO: 2793285 - RNA, 18 nt, Leptospira interrogans serovar lai str. 56601
aacguuauacaauauuuc

SEQ ID NO: 2793286 - RNA, 14 nt, Leptospira interrogans serovar lai str. 56601
aacguucaaacaac

SEQ ID NO: 2793287 - RNA, 14 nt, Leptospira interrogans serovar lai str. 56601
aacguuuucaaaaa

SEQ ID NO: 2793288 - RNA, 19 nt, Leptospira interrogans serovar lai str. 56601
aacguuuucaaaaaauuuc

SEQ ID NO: 2793289 - RNA, 21 nt, Leptospira interrogans serovar lai str. 56601
aacguuuugcguuuuuaaaca

SEQ ID NO: 2793290 - RNA, 14 nt, Leptospira interrogans serovar lai str. 56601
aacuaaaaaaaaua

SEQ ID NO: 2793291 - RNA, 18 nt, Leptospira interrogans serovar lai str. 56601
aacuaaauccuucuuuuc

SEQ ID NO: 2793292 - RNA, 13 nt, Leptospira interrogans serovar lai str. 56601
aacuaaauuuuuc

SEQ ID NO: 2793293 - RNA, 15 nt, Leptospira interrogans serovar lai str. 56601
aacuaacuaugauaa

SEQ ID NO: 2793294 - RNA, 16 nt, Leptospira interrogans serovar lai str. 56601
aacuaauaaaaacaau

SEQ ID NO: 2793295 - RNA, 22 nt, Leptospira interrogans serovar lai str. 56601
aagaaaaucugggcaaauuuag

SEQ ID NO: 2793296 - RNA, 17 nt, Leptospira interrogans serovar lai str. 56601
aagaaaauuuaaaauau

SEQ ID NO: 2793297 - RNA, 20 nt, Leptospira interrogans serovar lai str. 56601
aagaaaauuuaaaauauaaa

SEQ ID NO: 2793298 - RNA, 21 nt, Leptospira interrogans serovar lai str. 56601
aagaaacacuuugagaaagaa

SEQ ID NO: 2793299 - RNA, 14 nt, Leptospira interrogans serovar lai str. 56601
aagaaacaucaaaa

SEQ ID NO: 2793300 - RNA, 17 nt, Leptospira interrogans serovar lai str. 56601
aagaaaccgaucuuaaa

SEQ ID NO: 2793301 - RNA, 18 nt, Leptospira interrogans serovar lai str. 56601
aagaaaccgaucuuaaaa

SEQ ID NO: 2793302 - RNA, 21 nt, Leptospira interrogans serovar lai str. 56601
aagaaaccgaucuuaaaaacu

SEQ ID NO: 2793303 - RNA, 15 nt, Leptospira interrogans serovar lai str. 56601
aagaaacguuauaca

SEQ ID NO: 2793304 - RNA, 15 nt, Leptospira interrogans serovar lai str. 56601
aagaaacuguuuaau

SEQ ID NO: 2793305 - RNA, 16 nt, Leptospira interrogans serovar lai str. 56601
aagaaacuuaauaaaa

SEQ ID NO: 2793306 - RNA, 15 nt, Leptospira interrogans serovar lai str. 56601
aagaaagacuuuucc

SEQ ID NO: 2793307 - RNA, 15 nt, Leptospira interrogans serovar lai str. 56601
aagaaagcagcaaag

SEQ ID NO: 2793308 - RNA, 18 nt, Leptospira interrogans serovar lai str. 56601
aagaaagcagcaaagaag

SEQ ID NO: 2793309 - RNA, 16 nt, Leptospira interrogans serovar lai str. 56601
aagaaaguugcaaaga

SEQ ID NO: 2793310 - RNA, 18 nt, Leptospira interrogans serovar lai str. 56601
aagaaaguugcaaagaag

SEQ ID NO: 2793311 - RNA, 22 nt, Leptospira interrogans serovar lai str. 56601
aagaaaguuugggcgaauaaaa

SEQ ID NO: 2793312 - RNA, 21 nt, Leptospira interrogans serovar lai str. 56601
aagaaauacacggagauaaaa

SEQ ID NO: 2793313 - RNA, 22 nt, Leptospira interrogans serovar lai str. 56601
aagaaauacacggagauaaaaa

SEQ ID NO: 2793314 - RNA, 15 nt, Leptospira interrogans serovar lai str. 56601
aagaaauagaaaagc

SEQ ID NO: 2793315 - RNA, 17 nt, Leptospira interrogans serovar lai str. 56601
aagaaauagaaaagcau

SEQ ID NO: 2793316 - RNA, 20 nt, Leptospira interrogans serovar lai str. 56601
aagaaauagaucugauauuu

SEQ ID NO: 2793317 - RNA, 21 nt, Leptospira interrogans serovar lai str. 56601
aagaaauauuaaaaaaauaau

SEQ ID NO: 2793318 - RNA, 10 nt, Leptospira interrogans serovar lai str. 56601
aagaaauucu

SEQ ID NO: 2793319 - RNA, 11 nt, Leptospira interrogans serovar lai str. 56601
aagaaauucua

SEQ ID NO: 2793320 - RNA, 11 nt, Leptospira interrogans serovar lai str. 56601
aagaaauuuaa

SEQ ID NO: 2793321 - RNA, 15 nt, Leptospira interrogans serovar lai str. 56601
aagaaauuuaaguuu

SEQ ID NO: 2793322 - RNA, 16 nt, Leptospira interrogans serovar lai str. 56601
aagaaauuuaauacaa

SEQ ID NO: 2793323 - RNA, 9 nt, Leptospira interrogans serovar lai str. 56601
aagaacaac

SEQ ID NO: 2793324 - RNA, 22 nt, Leptospira interrogans serovar lai str. 56601
aagaacaacccccguuauuaaa

SEQ ID NO: 2793325 - RNA, 14 nt, Leptospira interrogans serovar lai str. 56601
aagaacaauuuaaa

SEQ ID NO: 2793326 - RNA, 15 nt, Leptospira interrogans serovar lai str. 56601
aagaacaauuuaaaa

SEQ ID NO: 2793327 - RNA, 22 nt, Leptospira interrogans serovar lai str. 56601
aagaacacugcauuuuauuaaa

SEQ ID NO: 2793328 - RNA, 23 nt, Leptospira interrogans serovar lai str. 56601
aagaacacugcauuuuauuaaaa

SEQ ID NO: 2793329 - RNA, 22 nt, Leptospira interrogans serovar lai str. 56601
aagaaccguaacugacauucca

SEQ ID NO: 2793330 - RNA, 18 nt, Leptospira interrogans serovar lai str. 56601
aagaacgauccguaaaaa

SEQ ID NO: 2793331 - RNA, 14 nt, Leptospira interrogans serovar lai str. 56601
aagaacgauuuuuu

SEQ ID NO: 2793332 - RNA, 21 nt, Leptospira interrogans serovar lai str. 56601
aagaacguuuccagaaagcuc

SEQ ID NO: 2793333 - RNA, 17 nt, Leptospira interrogans serovar lai str. 56601
aagaacuggauucaaaa

SEQ ID NO: 2793334 - RNA, 20 nt, Leptospira interrogans serovar lai str. 56601
aagaacuuucucgaaaaucu

SEQ ID NO: 2793335 - RNA, 22 nt, Leptospira interrogans serovar lai str. 56601
aagaacuuucucgaaaaucuca

SEQ ID NO: 2793336 - RNA, 16 nt, Leptospira interrogans serovar lai str. 56601
aagaagaaaagaaucu

SEQ ID NO: 2793337 - RNA, 14 nt, Leptospira interrogans serovar lai str. 56601
aagaagaaauaagu

SEQ ID NO: 2793338 - RNA, 20 nt, Leptospira interrogans serovar lai str. 56601
aagaagagccucaaguaaaa

SEQ ID NO: 2793339 - RNA, 14 nt, Leptospira interrogans serovar lai str. 56601
aagaagauaaaacu

SEQ ID NO: 2793340 - RNA, 20 nt, Leptospira interrogans serovar lai str. 56601
aagaagauaaaacucaaagg

SEQ ID NO: 2793341 - RNA, 18 nt, Leptospira interrogans serovar lai str. 56601
aagaagauagauuuauaa

SEQ ID NO: 2793342 - RNA, 19 nt, Leptospira interrogans serovar lai str. 56601
aagaagccaauuccaaaaa

SEQ ID NO: 2793343 - RNA, 17 nt, Leptospira interrogans serovar lai str. 56601
aagaagcuaaaauugaa

SEQ ID NO: 2793344 - RNA, 22 nt, Leptospira interrogans serovar lai str. 56601
aagaagggaugaaauuuuaaaa

SEQ ID NO: 2793345 - RNA, 21 nt, Leptospira interrogans serovar lai str. 56601
aagaaguuguaucagauguuu

SEQ ID NO: 2793346 - RNA, 11 nt, Leptospira interrogans serovar lai str. 56601
aagaauaaaag

SEQ ID NO: 2793347 - RNA, 13 nt, Leptospira interrogans serovar lai str. 56601
aagaauaaauccg

SEQ ID NO: 2793348 - RNA, 22 nt, Leptospira interrogans serovar lai str. 56601
aagaauaaauccggaaguaauu

SEQ ID NO: 2793349 - RNA, 13 nt, Leptospira interrogans serovar lai str. 56601
aagaauaauauuu

SEQ ID NO: 2793350 - RNA, 18 nt, Leptospira interrogans serovar lai str. 56601
aagaauaccaaaaaagua

SEQ ID NO: 2793351 - RNA, 13 nt, Leptospira interrogans serovar lai str. 56601
aagaauagauuaa

SEQ ID NO: 2793352 - RNA, 23 nt, Leptospira interrogans serovar lai str. 56601
aagaauaugucguuguauauaaa

SEQ ID NO: 2793353 - RNA, 14 nt, Leptospira interrogans serovar lai str. 56601
aagaauauuauaaa

SEQ ID NO: 2793354 - RNA, 16 nt, Leptospira interrogans serovar lai str. 56601
aagaauauuauuauau

SEQ ID NO: 2793355 - RNA, 17 nt, Leptospira interrogans serovar lai str. 56601
aagaauauuauuauauu

SEQ ID NO: 2793356 - RNA, 13 nt, Leptospira interrogans serovar lai str. 56601
aagaauccgaaaa

SEQ ID NO: 2793357 - RNA, 15 nt, Leptospira interrogans serovar lai str. 56601
aagaaucgaaaaaau

SEQ ID NO: 2793358 - RNA, 18 nt, Leptospira interrogans serovar lai str. 56601
aagaaucgaaaaaauaca

SEQ ID NO: 2793359 - RNA, 16 nt, Leptospira interrogans serovar lai str. 56601
aagaaucgauucagag

SEQ ID NO: 2793360 - RNA, 22 nt, Leptospira interrogans serovar lai str. 56601
aagaaucgucgcucaaucaaau

SEQ ID NO: 2793361 - RNA, 15 nt, Leptospira interrogans serovar lai str. 56601
aagaaucuuuuuaaa

SEQ ID NO: 2793362 - RNA, 18 nt, Leptospira interrogans serovar lai str. 56601
aagaaucuuuuuaaaagu

SEQ ID NO: 2793363 - RNA, 20 nt, Leptospira interrogans serovar lai str. 56601
aagaaugaucacguaaaacu

SEQ ID NO: 2793364 - RNA, 22 nt, Leptospira interrogans serovar lai str. 56601
aagaauguuuuccagaaaccau

SEQ ID NO: 2793365 - RNA, 14 nt, Leptospira interrogans serovar lai str. 56601
aagaauuaauuuuu

SEQ ID NO: 2793366 - RNA, 18 nt, Leptospira interrogans serovar lai str. 56601
aagaauuaucguguaaaa

SEQ ID NO: 2793367 - RNA, 21 nt, Leptospira interrogans serovar lai str. 56601
aagaauucuaaacacagaccu

SEQ ID NO: 2793368 - RNA, 19 nt, Leptospira interrogans serovar lai str. 56601
aagaauuuaauaaaaaaau

SEQ ID NO: 2793369 - RNA, 20 nt, Leptospira interrogans serovar lai str. 56601
aagaauuuauuucaaaauuu

SEQ ID NO: 2793370 - RNA, 17 nt, Leptospira interrogans serovar lai str. 56601
aagaauuuccuaaaagu

SEQ ID NO: 2793371 - RNA, 12 nt, Leptospira interrogans serovar lai str. 56601
aagaauuucuaa

SEQ ID NO: 2793372 - RNA, 14 nt, Leptospira interrogans serovar lai str. 56601
aagaauuucuaaaa

SEQ ID NO: 2793373 - RNA, 19 nt, Leptospira interrogans serovar lai str. 56601
aagaauuucuaaaaguaaa

SEQ ID NO: 2793374 - RNA, 12 nt, Leptospira interrogans serovar lai str. 56601
aagaauuuuaaa

SEQ ID NO: 2793375 - RNA, 16 nt, Leptospira interrogans serovar lai str. 56601
aagaauuuuaaaaaau

SEQ ID NO: 2793376 - RNA, 17 nt, Leptospira interrogans serovar lai str. 56601
aagaauuuuaaaaaaug

SEQ ID NO: 2793377 - RNA, 13 nt, Leptospira interrogans serovar lai str. 56601
aagaauuuucuaa

SEQ ID NO: 2793378 - RNA, 17 nt, Leptospira interrogans serovar lai str. 56601
aagcaaaguuucuuaua

SEQ ID NO: 2793379 - RNA, 20 nt, Leptospira interrogans serovar lai str. 56601
aagcaaaguuucuuauauaa

SEQ ID NO: 2793380 - RNA, 15 nt, Leptospira interrogans serovar lai str. 56601
aagcaauccauucaa

SEQ ID NO: 2793381 - RNA, 20 nt, Leptospira interrogans serovar lai str. 56601
aagcaauucuaagaccuaaa

SEQ ID NO: 2793382 - RNA, 13 nt, Leptospira interrogans serovar lai str. 56601
aagcacuguuuua

SEQ ID NO: 2793383 - RNA, 18 nt, Leptospira interrogans serovar lai str. 56601
aagcagcuaaaaagaaag

SEQ ID NO: 2793384 - RNA, 21 nt, Leptospira interrogans serovar lai str. 56601
aagcagcuaaaaagaaaguug

SEQ ID NO: 2793385 - RNA, 13 nt, Leptospira interrogans serovar lai str. 56601
aagcaguuuuguu

SEQ ID NO: 2793386 - RNA, 19 nt, Leptospira interrogans serovar lai str. 56601
aagcauaacgucuugauua

SEQ ID NO: 2793387 - RNA, 22 nt, Leptospira interrogans serovar lai str. 56601
aagcauucgcgacgauugauca

SEQ ID NO: 2793388 - RNA, 12 nt, Leptospira interrogans serovar lai str. 56601
aagccaaaacca

SEQ ID NO: 2793389 - RNA, 21 nt, Leptospira interrogans serovar lai str. 56601
aagccaaugugccuucguuua

SEQ ID NO: 2793390 - RNA, 21 nt, Leptospira interrogans serovar lai str. 56601
aagccaauuccaaaaaucuca

SEQ ID NO: 2793391 - RNA, 16 nt, Leptospira interrogans serovar lai str. 56601
aagccagaauuuugaa

SEQ ID NO: 2793392 - RNA, 13 nt, Leptospira interrogans serovar lai str. 56601
aagccaucguucu

SEQ ID NO: 2793393 - RNA, 21 nt, Leptospira interrogans serovar lai str. 56601
aagccauuuagguuguaacuc

SEQ ID NO: 2793394 - RNA, 15 nt, Leptospira interrogans serovar lai str. 56601
aagcccauaaaaacg

SEQ ID NO: 2793395 - RNA, 13 nt, Leptospira interrogans serovar lai str. 56601
aagcccuccuaug

SEQ ID NO: 2793396 - RNA, 18 nt, Leptospira interrogans serovar lai str. 56601
aagcgacccaauaagaag

SEQ ID NO: 2793397 - RNA, 22 nt, Leptospira interrogans serovar lai str. 56601
aagcgacgauagaagcgagaga

SEQ ID NO: 2793398 - RNA, 23 nt, Leptospira interrogans serovar lai str. 56601
aagcgugacuaaaauugacaaag

SEQ ID NO: 2793399 - RNA, 14 nt, Leptospira interrogans serovar lai str. 56601
aagcguuucguucu

SEQ ID NO: 2793400 - RNA, 20 nt, Leptospira interrogans serovar lai str. 56601
aagcguuuuguuaauuguug

SEQ ID NO: 2793401 - RNA, 15 nt, Leptospira interrogans serovar lai str. 56601
aagcuaugaagaggu

SEQ ID NO: 2793402 - RNA, 21 nt, Leptospira interrogans serovar lai str. 56601
aagcucaauuuugaagacuau

SEQ ID NO: 2793403 - RNA, 14 nt, Leptospira interrogans serovar lai str. 56601
aagcucaucucauc

SEQ ID NO: 2793404 - RNA, 16 nt, Leptospira interrogans serovar lai str. 56601
aagcuccuccaaccag

SEQ ID NO: 2793405 - RNA, 18 nt, Leptospira interrogans serovar lai str. 56601
aagcuccuccaaccagag

SEQ ID NO: 2793406 - RNA, 18 nt, Leptospira interrogans serovar lai str. 56601
aagcucuaauauuuuaaa

SEQ ID NO: 2793407 - RNA, 23 nt, Leptospira interrogans serovar lai str. 56601
aagcucuaauauuuuaaagaaac

SEQ ID NO: 2793408 - RNA, 16 nt, Leptospira interrogans serovar lai str. 56601
aagcucuccaucuuuu

SEQ ID NO: 2793409 - RNA, 15 nt, Leptospira interrogans serovar lai str. 56601
aagcugaaaauuuuc

SEQ ID NO: 2793410 - RNA, 18 nt, Leptospira interrogans serovar lai str. 56601
aagcugaaaauuuucccu

SEQ ID NO: 2793411 - RNA, 13 nt, Leptospira interrogans serovar lai str. 56601
aagcugaacaaac

SEQ ID NO: 2793412 - RNA, 17 nt, Leptospira interrogans serovar lai str. 56601
aagcugaacuuaaaauc

SEQ ID NO: 2793413 - RNA, 22 nt, Leptospira interrogans serovar lai str. 56601
aagcugaacuuaaaaucuauuc

SEQ ID NO: 2793414 - RNA, 20 nt, Leptospira interrogans serovar lai str. 56601
aagcuuauacuuuaagaaaa

SEQ ID NO: 2793415 - RNA, 15 nt, Leptospira interrogans serovar lai str. 56601
aagcuuuaaauucag

SEQ ID NO: 2793416 - RNA, 17 nt, Leptospira interrogans serovar lai str. 56601
aagcuuuagaaaauaau

SEQ ID NO: 2793417 - RNA, 21 nt, Leptospira interrogans serovar lai str. 56601
aagcuuuuaguuguacaaaaa

SEQ ID NO: 2793418 - RNA, 22 nt, Leptospira interrogans serovar lai str. 56601
aagcuuuuaguuguacaaaaau

SEQ ID NO: 2793419 - RNA, 16 nt, Leptospira interrogans serovar lai str. 56601
aaggaaaguucuauaa

SEQ ID NO: 2793420 - RNA, 14 nt, Leptospira interrogans serovar lai str. 56601
aaggaacacaugau

SEQ ID NO: 2793421 - RNA, 16 nt, Leptospira interrogans serovar lai str. 56601
aaggaaccaucaccaa

SEQ ID NO: 2793422 - RNA, 22 nt, Leptospira interrogans serovar lai str. 56601
aaggaaggaguaucaauagaaa

SEQ ID NO: 2793423 - RNA, 22 nt, Leptospira interrogans serovar lai str. 56601
aaggaauacaauugauuuaaaa

SEQ ID NO: 2793424 - RNA, 21 nt, Leptospira interrogans serovar lai str. 56601
aaggaauuggaauaucggaau

SEQ ID NO: 2793425 - RNA, 19 nt, Leptospira interrogans serovar lai str. 56601
aaggagaacucauucaagu

SEQ ID NO: 2793426 - RNA, 14 nt, Leptospira interrogans serovar lai str. 56601
aaggaguaauucua

SEQ ID NO: 2793427 - RNA, 12 nt, Leptospira interrogans serovar lai str. 56601
aaggaucaaauc

SEQ ID NO: 2793428 - RNA, 16 nt, Leptospira interrogans serovar lai str. 56601
aaggauccaauacaaa

SEQ ID NO: 2793429 - RNA, 13 nt, Leptospira interrogans serovar lai str. 56601
aaggcaaaagacu

SEQ ID NO: 2793430 - RNA, 23 nt, Leptospira interrogans serovar lai str. 56601
aaggcaaacuuuuuuagcaaaua

SEQ ID NO: 2793431 - RNA, 17 nt, Leptospira interrogans serovar lai str. 56601
aaggcagcuaagaaaaa

SEQ ID NO: 2793432 - RNA, 17 nt, Leptospira interrogans serovar lai str. 56601
aaggccgcuucuuuauu

SEQ ID NO: 2793433 - RNA, 19 nt, Leptospira interrogans serovar lai str. 56601
aaggcgguaaaacaaaaaa

SEQ ID NO: 2793434 - RNA, 18 nt, Leptospira interrogans serovar lai str. 56601
aaggcuaaagaauacauu

SEQ ID NO: 2793435 - RNA, 15 nt, Leptospira interrogans serovar lai str. 56601
aaggcucgaauuuuu

SEQ ID NO: 2793436 - RNA, 16 nt, Leptospira interrogans serovar lai str. 56601
aaggcucgaauuuuuu

SEQ ID NO: 2793437 - RNA, 19 nt, Leptospira interrogans serovar lai str. 56601
aaggcugucuucagcaguc

SEQ ID NO: 2793438 - RNA, 23 nt, Leptospira interrogans serovar lai str. 56601
aaggcugucuucagcagucugug

SEQ ID NO: 2793439 - RNA, 22 nt, Leptospira interrogans serovar lai str. 56601
aagggaagguuuuguaaaaauu

SEQ ID NO: 2793440 - RNA, 16 nt, Leptospira interrogans serovar lai str. 56601
aagggaguuuguaaag

SEQ ID NO: 2793441 - RNA, 17 nt, Leptospira interrogans serovar lai str. 56601
aaggggaucaacaaaau

SEQ ID NO: 2793442 - RNA, 14 nt, Leptospira interrogans serovar lai str. 56601
aagggugaauuuuu

SEQ ID NO: 2793443 - RNA, 10 nt, Leptospira interrogans serovar lai str. 56601
aaggguuuuu

SEQ ID NO: 2793444 - RNA, 14 nt, Leptospira interrogans serovar lai str. 56601
aagguauaaaauaa

SEQ ID NO: 2793445 - RNA, 15 nt, Leptospira interrogans serovar lai str. 56601
aagguauaaaauaaa

SEQ ID NO: 2793446 - RNA, 21 nt, Leptospira interrogans serovar lai str. 56601
aagguauaaaauaaaaauuuc

SEQ ID NO: 2793447 - RNA, 22 nt, Leptospira interrogans serovar lai str. 56601
aagguauaaaauaaaaauuuca

SEQ ID NO: 2793448 - RNA, 15 nt, Leptospira interrogans serovar lai str. 56601
aaggucucaacaacu

SEQ ID NO: 2793449 - RNA, 15 nt, Leptospira interrogans serovar lai str. 56601
aaggucugaaggaau

SEQ ID NO: 2793450 - RNA, 18 nt, Leptospira interrogans serovar lai str. 56601
aaggugcaugaaaauaau

SEQ ID NO: 2793451 - RNA, 18 nt, Leptospira interrogans serovar lai str. 56601
aagguguuuauaaaaacc

SEQ ID NO: 2793452 - RNA, 20 nt, Leptospira interrogans serovar lai str. 56601
aagguugaguaguaaaaucu

SEQ ID NO: 2793453 - RNA, 19 nt, Leptospira interrogans serovar lai str. 56601
aagguuuucgauuccgauc

SEQ ID NO: 2793454 - RNA, 14 nt, Leptospira interrogans serovar lai str. 56601
aaguaaaaaagagc

SEQ ID NO: 2793455 - RNA, 16 nt, Leptospira interrogans serovar lai str. 56601
aaguaaaaaagagcuu

SEQ ID NO: 2793456 - RNA, 19 nt, Leptospira interrogans serovar lai str. 56601
aaguaaaacguagauaauu

SEQ ID NO: 2793457 - RNA, 22 nt, Leptospira interrogans serovar lai str. 56601
aaguaaaacguagauaauuaaa

SEQ ID NO: 2793458 - RNA, 13 nt, Leptospira interrogans serovar lai str. 56601
aaguaaaauuaaa

SEQ ID NO: 2793459 - RNA, 13 nt, Leptospira interrogans serovar lai str. 56601
aaguaaagguuuc

SEQ ID NO: 2793460 - RNA, 13 nt, Leptospira interrogans serovar lai str. 56601
aaguaauccauuu

SEQ ID NO: 2793461 - RNA, 19 nt, Leptospira interrogans serovar lai str. 56601
aaguuagaaucuaaacuuu

SEQ ID NO: 2793462 - RNA, 20 nt, Leptospira interrogans serovar lai str. 56601
aaguuaggugauauuuucua

SEQ ID NO: 2793463 - RNA, 14 nt, Leptospira interrogans serovar lai str. 56601
aaguuauaaugaua

SEQ ID NO: 2793464 - RNA, 15 nt, Leptospira interrogans serovar lai str. 56601
aaguuauaaugauaa

SEQ ID NO: 2793465 - RNA, 16 nt, Leptospira interrogans serovar lai str. 56601
aaguuauaaugauaaa

SEQ ID NO: 2793466 - RNA, 17 nt, Leptospira interrogans serovar lai str. 56601
aaguuauaguaguuccc

SEQ ID NO: 2793467 - RNA, 21 nt, Leptospira interrogans serovar lai str. 56601
aaguuauauuagaguuuuuga

SEQ ID NO: 2793468 - RNA, 17 nt, Leptospira interrogans serovar lai str. 56601
aaguuauugaauagaau

SEQ ID NO: 2793469 - RNA, 22 nt, Leptospira interrogans serovar lai str. 56601
aaguuauugaauagaauuuggc

SEQ ID NO: 2793470 - RNA, 13 nt, Leptospira interrogans serovar lai str. 56601
aaguucaaaaaaa

SEQ ID NO: 2793471 - RNA, 14 nt, Leptospira interrogans serovar lai str. 56601
aaguucaaaaaaag

SEQ ID NO: 2793472 - RNA, 18 nt, Leptospira interrogans serovar lai str. 56601
aaguucaaaaaaaggauu

SEQ ID NO: 2793473 - RNA, 16 nt, Leptospira interrogans serovar lai str. 56601
aaguucacaaauugca

SEQ ID NO: 2793474 - RNA, 22 nt, Leptospira interrogans serovar lai str. 56601
aaguucaucuacguuucaauua

SEQ ID NO: 2793475 - RNA, 14 nt, Leptospira interrogans serovar lai str. 56601
aaguuccaaauuac

SEQ ID NO: 2793476 - RNA, 17 nt, Leptospira interrogans serovar lai str. 56601
aaguucccaaauugcca

SEQ ID NO: 2793477 - RNA, 15 nt, Leptospira interrogans serovar lai str. 56601
aaguucgauuaaaau

SEQ ID NO: 2793478 - RNA, 22 nt, Leptospira interrogans serovar lai str. 56601
aaguucgucgucuauaaauuca

SEQ ID NO: 2793479 - RNA, 14 nt, Leptospira interrogans serovar lai str. 56601
aaguucuauaaacu

SEQ ID NO: 2793480 - RNA, 15 nt, Leptospira interrogans serovar lai str. 56601
aaguucuuuucuuaa

SEQ ID NO: 2793481 - RNA, 11 nt, Leptospira interrogans serovar lai str. 56601
aaguugaauag

SEQ ID NO: 2793482 - RNA, 14 nt, Leptospira interrogans serovar lai str. 56601
aaguugaauaggau

SEQ ID NO: 2793483 - RNA, 16 nt, Leptospira interrogans serovar lai str. 56601
aaguugaauaggauuu

SEQ ID NO: 2793484 - RNA, 12 nt, Leptospira interrogans serovar lai str. 56601
aaguugaaugag

SEQ ID NO: 2793485 - RNA, 11 nt, Leptospira interrogans serovar lai str. 56601
aaguugauucu

SEQ ID NO: 2793486 - RNA, 18 nt, Leptospira interrogans serovar lai str. 56601
aaguugauugacguccuu

SEQ ID NO: 2793487 - RNA, 20 nt, Leptospira interrogans serovar lai str. 56601
aaguugauugacguccuuau

SEQ ID NO: 2793488 - RNA, 19 nt, Leptospira interrogans serovar lai str. 56601
aaguugcaaagaagaaaua

SEQ ID NO: 2793489 - RNA, 16 nt, Leptospira interrogans serovar lai str. 56601
aaguuggaaucugaau

SEQ ID NO: 2793490 - RNA, 23 nt, Leptospira interrogans serovar lai str. 56601
aaguuguauccccauaaacaaac

SEQ ID NO: 2793491 - RNA, 12 nt, Leptospira interrogans serovar lai str. 56601
aaguuuaaaaac

SEQ ID NO: 2793492 - RNA, 18 nt, Leptospira interrogans serovar lai str. 56601
aaguuuaauugugaaaau

SEQ ID NO: 2793493 - RNA, 23 nt, Leptospira interrogans serovar lai str. 56601
aaguuuacaauggaaaguguuag

SEQ ID NO: 2793494 - RNA, 14 nt, Leptospira interrogans serovar lai str. 56601
aaguuuacaucaaa

SEQ ID NO: 2793495 - RNA, 23 nt, Leptospira interrogans serovar lai str. 56601
aaguuuacaucaaaaacaaauua

SEQ ID NO: 2793496 - RNA, 20 nt, Leptospira interrogans serovar lai str. 56601
aaguuuaccacgaauuaaau

SEQ ID NO: 2793497 - RNA, 22 nt, Leptospira interrogans serovar lai str. 56601
aaguuuaggcuugauuggauug

SEQ ID NO: 2793498 - RNA, 13 nt, Leptospira interrogans serovar lai str. 56601
aaguuuaugaauu

SEQ ID NO: 2793499 - RNA, 15 nt, Leptospira interrogans serovar lai str. 56601
aaguuucaaguuuag

SEQ ID NO: 2793500 - RNA, 16 nt, Leptospira interrogans serovar lai str. 56601
aaguuucuuauauaaa

SEQ ID NO: 2793501 - RNA, 20 nt, Leptospira interrogans serovar lai str. 56601
aaguuugggauauucugaaa

SEQ ID NO: 2793502 - RNA, 22 nt, Leptospira interrogans serovar lai str. 56601
aaguuugggcgaauaaaaaacu

SEQ ID NO: 2793503 - RNA, 15 nt, Leptospira interrogans serovar lai str. 56601
aaguuugguccuuug

SEQ ID NO: 2793504 - RNA, 14 nt, Leptospira interrogans serovar lai str. 56601
aaguuugugagagu

SEQ ID NO: 2793505 - RNA, 18 nt, Leptospira interrogans serovar lai str. 56601
aaguuugugagaguuccc

SEQ ID NO: 2793506 - RNA, 20 nt, Leptospira interrogans serovar lai str. 56601
aaguuugugagaguucccac

SEQ ID NO: 2793507 - RNA, 16 nt, Leptospira interrogans serovar lai str. 56601
aaguuuguuuguaaag

SEQ ID NO: 2793508 - RNA, 22 nt, Leptospira interrogans serovar lai str. 56601
aaguuuuacaaagaguuuaaaa

SEQ ID NO: 2793509 - RNA, 18 nt, Leptospira interrogans serovar lai str. 56601
aaguuuuacagaggauuu

SEQ ID NO: 2793510 - RNA, 13 nt, Leptospira interrogans serovar lai str. 56601
aaguuuucaaaaa

SEQ ID NO: 2793511 - RNA, 16 nt, Leptospira interrogans serovar lai str. 56601
aaguuuucaaaaaaug

SEQ ID NO: 2793512 - RNA, 11 nt, Leptospira interrogans serovar lai str. 56601
aaguuuuccau

SEQ ID NO: 2793513 - RNA, 19 nt, Leptospira interrogans serovar lai str. 56601
aaguuuuccgguucgaauc

SEQ ID NO: 2793514 - RNA, 18 nt, Leptospira interrogans serovar lai str. 56601
aaguuuucuaguaaaaau

SEQ ID NO: 2793515 - RNA, 21 nt, Leptospira interrogans serovar lai str. 56601
aaguuuucuuuaucagaaaaa

SEQ ID NO: 2793516 - RNA, 16 nt, Leptospira interrogans serovar lai str. 56601
aaguuuugaauuuuag

SEQ ID NO: 2793517 - RNA, 22 nt, Leptospira interrogans serovar lai str. 56601
aaguuuugauagaaaaacucug

SEQ ID NO: 2793518 - RNA, 13 nt, Leptospira interrogans serovar lai str. 56601
aaguuuuggaaga

SEQ ID NO: 2793519 - RNA, 13 nt, Leptospira interrogans serovar lai str. 56601
aaguuuuuaaaua

SEQ ID NO: 2793520 - RNA, 19 nt, Leptospira interrogans serovar lai str. 56601
aaguuuuucuuaaaaaguu

SEQ ID NO: 2793521 - RNA, 13 nt, Leptospira interrogans serovar lai str. 56601
aaguuuuuuaaaa

SEQ ID NO: 2793522 - RNA, 15 nt, Leptospira interrogans serovar lai str. 56601
aaguuuuuuaaaaaa

SEQ ID NO: 2793523 - RNA, 19 nt, Leptospira interrogans serovar lai str. 56601
aauaaaaaacucaaugugu

SEQ ID NO: 2793524 - RNA, 17 nt, Leptospira interrogans serovar lai str. 56601
aauaaaaacuaauaauu

SEQ ID NO: 2793525 - RNA, 17 nt, Leptospira interrogans serovar lai str. 56601
aauaaaaauuagagaag

SEQ ID NO: 2793526 - RNA, 14 nt, Leptospira interrogans serovar lai str. 56601
aauaaaaauuuaaa

SEQ ID NO: 2793527 - RNA, 17 nt, Leptospira interrogans serovar lai str. 56601
aauaaaaauuuaaaaua

SEQ ID NO: 2793528 - RNA, 19 nt, Leptospira interrogans serovar lai str. 56601
aauaaaaccgcugaaaaaa

SEQ ID NO: 2793529 - RNA, 20 nt, Leptospira interrogans serovar lai str. 56601
aauaaaaccgcugaaaaaaa

SEQ ID NO: 2793530 - RNA, 11 nt, Leptospira interrogans serovar lai str. 56601
aauaaaaggag

SEQ ID NO: 2793531 - RNA, 15 nt, Leptospira interrogans serovar lai str. 56601
aauaaaauaaaaaaa

SEQ ID NO: 2793532 - RNA, 16 nt, Leptospira interrogans serovar lai str. 56601
aauaaaauaaaaaaau

SEQ ID NO: 2793533 - RNA, 23 nt, Leptospira interrogans serovar lai str. 56601
aauaaaauaccauaaauuuugaa

SEQ ID NO: 2793534 - RNA, 16 nt, Leptospira interrogans serovar lai str. 56601
aauaaaauaugaguuu

SEQ ID NO: 2793535 - RNA, 19 nt, Leptospira interrogans serovar lai str. 56601
aauaaaaucauauuuucaa

SEQ ID NO: 2793536 - RNA, 14 nt, Leptospira interrogans serovar lai str. 56601
aauaaaauuuuaua

SEQ ID NO: 2793537 - RNA, 13 nt, Leptospira interrogans serovar lai str. 56601
aauaaaauuuuca

SEQ ID NO: 2793538 - RNA, 19 nt, Leptospira interrogans serovar lai str. 56601
aauaaaauuuuuaaaaaau

SEQ ID NO: 2793539 - RNA, 14 nt, Leptospira interrogans serovar lai str. 56601
aauaaacaauaaaa

SEQ ID NO: 2793540 - RNA, 18 nt, Leptospira interrogans serovar lai str. 56601
aauaaaccgcauaaaaga

SEQ ID NO: 2793541 - RNA, 12 nt, Leptospira interrogans serovar lai str. 56601
aauaaacuuuca

SEQ ID NO: 2793542 - RNA, 17 nt, Leptospira interrogans serovar lai str. 56601
aauaaacuuucaaagaa

SEQ ID NO: 2793543 - RNA, 19 nt, Leptospira interrogans serovar lai str. 56601
aauaaacuuucaaagaaua

SEQ ID NO: 2793544 - RNA, 13 nt, Leptospira interrogans serovar lai str. 56601
aauacaaaaugaa

SEQ ID NO: 2793545 - RNA, 18 nt, Leptospira interrogans serovar lai str. 56601
aauacaaaauguuuuuau

SEQ ID NO: 2793546 - RNA, 16 nt, Leptospira interrogans serovar lai str. 56601
aauacaaaauuuuuuc

SEQ ID NO: 2793547 - RNA, 17 nt, Leptospira interrogans serovar lai str. 56601
aauacaaacagucaaaa

SEQ ID NO: 2793548 - RNA, 15 nt, Leptospira interrogans serovar lai str. 56601
aauacaaaguuugua

SEQ ID NO: 2793549 - RNA, 17 nt, Leptospira interrogans serovar lai str. 56601
aauacaacgaaaacaga

SEQ ID NO: 2793550 - RNA, 13 nt, Leptospira interrogans serovar lai str. 56601
aauacaauaaaaa

SEQ ID NO: 2793551 - RNA, 15 nt, Leptospira interrogans serovar lai str. 56601
aauacaauuugaucu

SEQ ID NO: 2793552 - RNA, 16 nt, Leptospira interrogans serovar lai str. 56601
aauacaccaugccauu

SEQ ID NO: 2793553 - RNA, 20 nt, Leptospira interrogans serovar lai str. 56601
aauacacggagauaaaaaag

SEQ ID NO: 2793554 - RNA, 23 nt, Leptospira interrogans serovar lai str. 56601
aauacacggagauaaaaaaggau

SEQ ID NO: 2793555 - RNA, 17 nt, Leptospira interrogans serovar lai str. 56601
aauacagaauucauuuu

SEQ ID NO: 2793556 - RNA, 20 nt, Leptospira interrogans serovar lai str. 56601
aauacaggcgguuuaaaagc

SEQ ID NO: 2793557 - RNA, 17 nt, Leptospira interrogans serovar lai str. 56601
aauacagugucuugaaa

SEQ ID NO: 2793558 - RNA, 15 nt, Leptospira interrogans serovar lai str. 56601
aauacauaaaaaaau

SEQ ID NO: 2793559 - RNA, 19 nt, Leptospira interrogans serovar lai str. 56601
aauacauaaaaaaauaaua

SEQ ID NO: 2793560 - RNA, 15 nt, Leptospira interrogans serovar lai str. 56601
aauacauaaaugaua

SEQ ID NO: 2793561 - RNA, 21 nt, Leptospira interrogans serovar lai str. 56601
aauacauacaaugaaaaagca

SEQ ID NO: 2793562 - RNA, 19 nt, Leptospira interrogans serovar lai str. 56601
aauacauaggaaccugauu

SEQ ID NO: 2793563 - RNA, 20 nt, Leptospira interrogans serovar lai str. 56601
aauacauuagaauuuuauga

SEQ ID NO: 2793564 - RNA, 18 nt, Leptospira interrogans serovar lai str. 56601
aauacauucuuauaaaga

SEQ ID NO: 2793565 - RNA, 13 nt, Leptospira interrogans serovar lai str. 56601
aauaccaaaccuc

SEQ ID NO: 2793566 - RNA, 15 nt, Leptospira interrogans serovar lai str. 56601
aauaccaauaacuua

SEQ ID NO: 2793567 - RNA, 23 nt, Leptospira interrogans serovar lai str. 56601
aauaccauucauuucauauccaa

SEQ ID NO: 2793568 - RNA, 21 nt, Leptospira interrogans serovar lai str. 56601
aauaccgauuucuauuuuaaa

SEQ ID NO: 2793569 - RNA, 20 nt, Leptospira interrogans serovar lai str. 56601
aauaccuauacaauucuuuc

SEQ ID NO: 2793570 - RNA, 23 nt, Leptospira interrogans serovar lai str. 56601
aauaccuguucggaguuguauaa

SEQ ID NO: 2793571 - RNA, 19 nt, Leptospira interrogans serovar lai str. 56601
aauacgaaaacaauuccaa

SEQ ID NO: 2793572 - RNA, 23 nt, Leptospira interrogans serovar lai str. 56601
aauacgaauuuaacuaguuccuu

SEQ ID NO: 2793573 - RNA, 18 nt, Leptospira interrogans serovar lai str. 56601
aauacgacagauucaauu

SEQ ID NO: 2793574 - RNA, 22 nt, Leptospira interrogans serovar lai str. 56601
aauacgacagauucaauuuuua

SEQ ID NO: 2793575 - RNA, 22 nt, Leptospira interrogans serovar lai str. 56601
aauacgauagauucaauuauua

SEQ ID NO: 2793576 - RNA, 18 nt, Leptospira interrogans serovar lai str. 56601
aauacgaucuaauuugua

SEQ ID NO: 2793577 - RNA, 22 nt, Leptospira interrogans serovar lai str. 56601
aauacgaucuaauuuguaagaa

SEQ ID NO: 2793578 - RNA, 21 nt, Leptospira interrogans serovar lai str. 56601
aauacggcacucaauuuuaua

SEQ ID NO: 2793579 - RNA, 16 nt, Leptospira interrogans serovar lai str. 56601
aauacguuuacuccaa

SEQ ID NO: 2793580 - RNA, 23 nt, Leptospira interrogans serovar lai str. 56601
aauacguuuacuccaauuuuacc

SEQ ID NO: 2793581 - RNA, 12 nt, Leptospira interrogans serovar lai str. 56601
aauacguuuuga

SEQ ID NO: 2793582 - RNA, 17 nt, Leptospira interrogans serovar lai str. 56601
aauacuaaauuaaguuu

SEQ ID NO: 2793583 - RNA, 23 nt, Leptospira interrogans serovar lai str. 56601
aauacuggggacuuuauuuuaua

SEQ ID NO: 2793584 - RNA, 18 nt, Leptospira interrogans serovar lai str. 56601
aauacuguuaauuuuuau

SEQ ID NO: 2793585 - RNA, 16 nt, Leptospira interrogans serovar lai str. 56601
aauacuuaaaaacccc

SEQ ID NO: 2793586 - RNA, 14 nt, Leptospira interrogans serovar lai str. 56601
aauacuuagaauuu

SEQ ID NO: 2793587 - RNA, 17 nt, Leptospira interrogans serovar lai str. 56601
aauacuucucuaaagau

SEQ ID NO: 2793588 - RNA, 23 nt, Leptospira interrogans serovar lai str. 56601
aauacuuuaccgucaauuuuuag

SEQ ID NO: 2793589 - RNA, 22 nt, Leptospira interrogans serovar lai str. 56601
aauacuuuacggucggcaagau

SEQ ID NO: 2793590 - RNA, 15 nt, Leptospira interrogans serovar lai str. 56601
aauacuuuauuugua

SEQ ID NO: 2793591 - RNA, 16 nt, Leptospira interrogans serovar lai str. 56601
aauacuuugauuauaa

SEQ ID NO: 2793592 - RNA, 17 nt, Leptospira interrogans serovar lai str. 56601
aauacuuuuagaaaauu

SEQ ID NO: 2793593 - RNA, 13 nt, Leptospira interrogans serovar lai str. 56601
aauacuuuuaugg

SEQ ID NO: 2793594 - RNA, 15 nt, Leptospira interrogans serovar lai str. 56601
aauacuuuucuuccc

SEQ ID NO: 2793595 - RNA, 16 nt, Leptospira interrogans serovar lai str. 56601
aauacuuuucuuccca

SEQ ID NO: 2793596 - RNA, 18 nt, Leptospira interrogans serovar lai str. 56601
aauacuuuugaaauagau

SEQ ID NO: 2793597 - RNA, 19 nt, Leptospira interrogans serovar lai str. 56601
aauagaaagacuuuucauc

SEQ ID NO: 2793598 - RNA, 11 nt, Leptospira interrogans serovar lai str. 56601
aauagaaauac

SEQ ID NO: 2793599 - RNA, 13 nt, Leptospira interrogans serovar lai str. 56601
aauagaaauacca

SEQ ID NO: 2793600 - RNA, 19 nt, Leptospira interrogans serovar lai str. 56601
aauagaaccuuuugaagua

SEQ ID NO: 2793601 - RNA, 19 nt, Leptospira interrogans serovar lai str. 56601
aauagaagcaauaaaauca

SEQ ID NO: 2793602 - RNA, 14 nt, Leptospira interrogans serovar lai str. 56601
aauagaauaaauua

SEQ ID NO: 2793603 - RNA, 11 nt, Leptospira interrogans serovar lai str. 56601
aauagaauccu

SEQ ID NO: 2793604 - RNA, 22 nt, Leptospira interrogans serovar lai str. 56601
aauagaauccuauaauaaaauu

SEQ ID NO: 2793605 - RNA, 22 nt, Leptospira interrogans serovar lai str. 56601
aauagaauuguguuaguuccca

SEQ ID NO: 2793606 - RNA, 15 nt, Leptospira interrogans serovar lai str. 56601
aauagaauuguugaa

SEQ ID NO: 2793607 - RNA, 22 nt, Leptospira interrogans serovar lai str. 56601
aauagaauuuugcaaaaaaaau

SEQ ID NO: 2793608 - RNA, 23 nt, Leptospira interrogans serovar lai str. 56601
aauagaauuuugcaaaaaaaaua

SEQ ID NO: 2793609 - RNA, 17 nt, Leptospira interrogans serovar lai str. 56601
aauagaauuuuuguaga

SEQ ID NO: 2793610 - RNA, 18 nt, Leptospira interrogans serovar lai str. 56601
aauagaauuuuuguagaa

SEQ ID NO: 2793611 - RNA, 22 nt, Leptospira interrogans serovar lai str. 56601
aauagaauuuuuguagaauuga

SEQ ID NO: 2793612 - RNA, 21 nt, Leptospira interrogans serovar lai str. 56601
aauagagcuuuguaauaaaaa

SEQ ID NO: 2793613 - RNA, 15 nt, Leptospira interrogans serovar lai str. 56601
aauagaggaugaauc

SEQ ID NO: 2793614 - RNA, 19 nt, Leptospira interrogans serovar lai str. 56601
aauagagugccaaaauuuu

SEQ ID NO: 2793615 - RNA, 17 nt, Leptospira interrogans serovar lai str. 56601
aauagaguuacagaaaa

SEQ ID NO: 2793616 - RNA, 16 nt, Leptospira interrogans serovar lai str. 56601
aauagaguuguugaaa

SEQ ID NO: 2793617 - RNA, 19 nt, Leptospira interrogans serovar lai str. 56601
aauagaguuguugaaaaau

SEQ ID NO: 2793618 - RNA, 19 nt, Leptospira interrogans serovar lai str. 56601
aauagaucugauauuuuaa

SEQ ID NO: 2793619 - RNA, 23 nt, Leptospira interrogans serovar lai str. 56601
aauagauggagaauuaauuuuuu

SEQ ID NO: 2793620 - RNA, 22 nt, Leptospira interrogans serovar lai str. 56601
aauagauggagaauucauuuuu

SEQ ID NO: 2793621 - RNA, 22 nt, Leptospira interrogans serovar lai str. 56601
aauagauucuaauuuuucaaaa

SEQ ID NO: 2793622 - RNA, 14 nt, Leptospira interrogans serovar lai str. 56601
aauagauucuuaau

SEQ ID NO: 2793623 - RNA, 12 nt, Leptospira interrogans serovar lai str. 56601
aauagauuucua

SEQ ID NO: 2793624 - RNA, 22 nt, Leptospira interrogans serovar lai str. 56601
aauagcagauuuucucaaaaaa

SEQ ID NO: 2793625 - RNA, 14 nt, Leptospira interrogans serovar lai str. 56601
aauagcuuaaaagu

SEQ ID NO: 2793626 - RNA, 16 nt, Leptospira interrogans serovar lai str. 56601
aauauuauuaaauuuu

SEQ ID NO: 2793627 - RNA, 18 nt, Leptospira interrogans serovar lai str. 56601
aauauuauuaaauuuuua

SEQ ID NO: 2793628 - RNA, 14 nt, Leptospira interrogans serovar lai str. 56601
aauauuauuauauu

SEQ ID NO: 2793629 - RNA, 15 nt, Leptospira interrogans serovar lai str. 56601
aauauuauuauauuu

SEQ ID NO: 2793630 - RNA, 18 nt, Leptospira interrogans serovar lai str. 56601
aauauuauuauauuuaaa

SEQ ID NO: 2793631 - RNA, 24 nt, Leptospira interrogans serovar lai str. 56601
aauauuauuauauuuaaauguuau

SEQ ID NO: 2793632 - RNA, 14 nt, Leptospira interrogans serovar lai str. 56601
aauauuauuuuaac

SEQ ID NO: 2793633 - RNA, 16 nt, Leptospira interrogans serovar lai str. 56601
aauauuauuuuaacuu

SEQ ID NO: 2793634 - RNA, 14 nt, Leptospira interrogans serovar lai str. 56601
aauauucaaauuuu

SEQ ID NO: 2793635 - RNA, 20 nt, Leptospira interrogans serovar lai str. 56601
aauauucaacuuuuugaaga

SEQ ID NO: 2793636 - RNA, 17 nt, Leptospira interrogans serovar lai str. 56601
aauauucacuuuuccaa

SEQ ID NO: 2793637 - RNA, 19 nt, Leptospira interrogans serovar lai str. 56601
aauauucagaaacuggaau

SEQ ID NO: 2793638 - RNA, 16 nt, Leptospira interrogans serovar lai str. 56601
aauauucguaagaaaa

SEQ ID NO: 2793639 - RNA, 19 nt, Leptospira interrogans serovar lai str. 56601
aauauucguaagaaaaaau

SEQ ID NO: 2793640 - RNA, 22 nt, Leptospira interrogans serovar lai str. 56601
aauauucguguucuauuauaua

SEQ ID NO: 2793641 - RNA, 20 nt, Leptospira interrogans serovar lai str. 56601
aauauucuaauuuuauaaau

SEQ ID NO: 2793642 - RNA, 14 nt, Leptospira interrogans serovar lai str. 56601
aauauucuugauug

SEQ ID NO: 2793643 - RNA, 14 nt, Leptospira interrogans serovar lai str. 56601
aauauucuuuuuag

SEQ ID NO: 2793644 - RNA, 22 nt, Leptospira interrogans serovar lai str. 56601
aauauuggguauuuauuauaua

SEQ ID NO: 2793645 - RNA, 22 nt, Leptospira interrogans serovar lai str. 56601
aauauuguauuacacuucuuuu

SEQ ID NO: 2793646 - RNA, 19 nt, Leptospira interrogans serovar lai str. 56601
aauauuuagaauaaaauuu

SEQ ID NO: 2793647 - RNA, 22 nt, Leptospira interrogans serovar lai str. 56601
aauauuuagaauaaaauuugau

SEQ ID NO: 2793648 - RNA, 14 nt, Leptospira interrogans serovar lai str. 56601
aauauuuaugcuuu

SEQ ID NO: 2793649 - RNA, 16 nt, Leptospira interrogans serovar lai str. 56601
aauauuuauuacaaag

SEQ ID NO: 2793650 - RNA, 14 nt, Leptospira interrogans serovar lai str. 56601
aauauuucaaaaau

SEQ ID NO: 2793651 - RNA, 13 nt, Leptospira interrogans serovar lai str. 56601
aauauuuccaaau

SEQ ID NO: 2793652 - RNA, 15 nt, Leptospira interrogans serovar lai str. 56601
aauauuucgucuuug

SEQ ID NO: 2793653 - RNA, 16 nt, Leptospira interrogans serovar lai str. 56601
aauauuucguuuuuag

SEQ ID NO: 2793654 - RNA, 21 nt, Leptospira interrogans serovar lai str. 56601
aauauuucguuuuuaguuuca

SEQ ID NO: 2793655 - RNA, 16 nt, Leptospira interrogans serovar lai str. 56601
aauauuucucuuugua

SEQ ID NO: 2793656 - RNA, 22 nt, Leptospira interrogans serovar lai str. 56601
aauauuucuucguuauuuuuau

SEQ ID NO: 2793657 - RNA, 15 nt, Leptospira interrogans serovar lai str. 56601
aauauuuuaaagaaa

SEQ ID NO: 2793658 - RNA, 17 nt, Leptospira interrogans serovar lai str. 56601
aauauuuuaaagaaacu

SEQ ID NO: 2793659 - RNA, 19 nt, Leptospira interrogans serovar lai str. 56601
aauauuuuccaaaaauuua

SEQ ID NO: 2793660 - RNA, 13 nt, Leptospira interrogans serovar lai str. 56601
aauauuuucuggu

SEQ ID NO: 2793661 - RNA, 17 nt, Leptospira interrogans serovar lai str. 56601
aauauuuugagcagauu

SEQ ID NO: 2793662 - RNA, 22 nt, Leptospira interrogans serovar lai str. 56601
aauauuuugagcagauucuaaa

SEQ ID NO: 2793663 - RNA, 21 nt, Leptospira interrogans serovar lai str. 56601
aauauuuugcaugaaaucagu

SEQ ID NO: 2793664 - RNA, 16 nt, Leptospira interrogans serovar lai str. 56601
aauauuuuguuuugaa

SEQ ID NO: 2793665 - RNA, 17 nt, Leptospira interrogans serovar lai str. 56601
aauauuuuguuuugaaa

SEQ ID NO: 2793666 - RNA, 17 nt, Leptospira interrogans serovar lai str. 56601
aauauuuuuaaacucau

SEQ ID NO: 2793667 - RNA, 20 nt, Leptospira interrogans serovar lai str. 56601
aauauuuuuauguauuuuaa

SEQ ID NO: 2793668 - RNA, 18 nt, Leptospira interrogans serovar lai str. 56601
aauauuuuuccagcgauu

SEQ ID NO: 2793669 - RNA, 22 nt, Leptospira interrogans serovar lai str. 56601
aauauuuuuuuuaaucauccaa

SEQ ID NO: 2793670 - RNA, 22 nt, Leptospira interrogans serovar lai str. 56601
aaucaaaaaaguccaaaacaaa

SEQ ID NO: 2793671 - RNA, 20 nt, Leptospira interrogans serovar lai str. 56601
aaucaaaagguauaaaauaa

SEQ ID NO: 2793672 - RNA, 12 nt, Leptospira interrogans serovar lai str. 56601
aaucaaaaugaa

SEQ ID NO: 2793673 - RNA, 18 nt, Leptospira interrogans serovar lai str. 56601
aaucaaaaugaacucaac

SEQ ID NO: 2793674 - RNA, 17 nt, Leptospira interrogans serovar lai str. 56601
aaucaaaauuucuuuuu

SEQ ID NO: 2793675 - RNA, 12 nt, Leptospira interrogans serovar lai str. 56601
aaucaaaggaaa

SEQ ID NO: 2793676 - RNA, 13 nt, Leptospira interrogans serovar lai str. 56601
aaucaaaggaaau

SEQ ID NO: 2793677 - RNA, 20 nt, Leptospira interrogans serovar lai str. 56601
aaucaaaggaaauaaaaaua

SEQ ID NO: 2793678 - RNA, 22 nt, Leptospira interrogans serovar lai str. 56601
aaucaaaggaaauaaaaauaua

SEQ ID NO: 2793679 - RNA, 13 nt, Leptospira interrogans serovar lai str. 56601
aaucaaauacaaa

SEQ ID NO: 2793680 - RNA, 19 nt, Leptospira interrogans serovar lai str. 56601
aaucaaauacaaaaacgau

SEQ ID NO: 2793681 - RNA, 12 nt, Leptospira interrogans serovar lai str. 56601
aaucaaauauac

SEQ ID NO: 2793682 - RNA, 23 nt, Leptospira interrogans serovar lai str. 56601
aaucaaauuuauaugauuuuaua

SEQ ID NO: 2793683 - RNA, 16 nt, Leptospira interrogans serovar lai str. 56601
aaucaaauuucugcau

SEQ ID NO: 2793684 - RNA, 17 nt, Leptospira interrogans serovar lai str. 56601
aaucaaauuucugcauc

SEQ ID NO: 2793685 - RNA, 22 nt, Leptospira interrogans serovar lai str. 56601
aaucaaauuucugcaugaaauu

SEQ ID NO: 2793686 - RNA, 14 nt, Leptospira interrogans serovar lai str. 56601
aaucaaauuuuuga

SEQ ID NO: 2793687 - RNA, 16 nt, Leptospira interrogans serovar lai str. 56601
aaucaaauuuuugaau

SEQ ID NO: 2793688 - RNA, 16 nt, Leptospira interrogans serovar lai str. 56601
aaucaaauuuuugcau

SEQ ID NO: 2793689 - RNA, 18 nt, Leptospira interrogans serovar lai str. 56601
aaucaacauuauguuaaa

SEQ ID NO: 2793690 - RNA, 12 nt, Leptospira interrogans serovar lai str. 56601
aaucaagagcug

SEQ ID NO: 2793691 - RNA, 21 nt, Leptospira interrogans serovar lai str. 56601
aaucaagugcaguaguuccua

SEQ ID NO: 2793692 - RNA, 23 nt, Leptospira interrogans serovar lai str. 56601
aaucaauaaauugcacaaaagaa

SEQ ID NO: 2793693 - RNA, 14 nt, Leptospira interrogans serovar lai str. 56601
aaucaauaggaaag

SEQ ID NO: 2793694 - RNA, 17 nt, Leptospira interrogans serovar lai str. 56601
aaucaaucauauuuuaa

SEQ ID NO: 2793695 - RNA, 23 nt, Leptospira interrogans serovar lai str. 56601
aaucaauggaaaauuaauuuuuc

SEQ ID NO: 2793696 - RNA, 12 nt, Leptospira interrogans serovar lai str. 56601
aaucacaaaaaa

SEQ ID NO: 2793697 - RNA, 13 nt, Leptospira interrogans serovar lai str. 56601
aaucacaauuuua

SEQ ID NO: 2793698 - RNA, 16 nt, Leptospira interrogans serovar lai str. 56601
aaucacaauuuuaaga

SEQ ID NO: 2793699 - RNA, 19 nt, Leptospira interrogans serovar lai str. 56601
aaucacaauuuuacaaaca

SEQ ID NO: 2793700 - RNA, 16 nt, Leptospira interrogans serovar lai str. 56601
aaucacgaaaaaugaa

SEQ ID NO: 2793701 - RNA, 21 nt, Leptospira interrogans serovar lai str. 56601
aaucacgauuuuacaaacaaa

SEQ ID NO: 2793702 - RNA, 16 nt, Leptospira interrogans serovar lai str. 56601
aaucacgauuuuacga

SEQ ID NO: 2793703 - RNA, 18 nt, Leptospira interrogans serovar lai str. 56601
aaucagaaugaacucaac

SEQ ID NO: 2793704 - RNA, 21 nt, Leptospira interrogans serovar lai str. 56601
aaucagagcaucauacaguaa

SEQ ID NO: 2793705 - RNA, 18 nt, Leptospira interrogans serovar lai str. 56601
aaucagagucuauuuaau

SEQ ID NO: 2793706 - RNA, 20 nt, Leptospira interrogans serovar lai str. 56601
aaucagguuuuauaaaguga

SEQ ID NO: 2793707 - RNA, 23 nt, Leptospira interrogans serovar lai str. 56601
aaucaguguuuugugauaaaauu

SEQ ID NO: 2793708 - RNA, 14 nt, Leptospira interrogans serovar lai str. 56601
aaucaguuaaaccc

SEQ ID NO: 2793709 - RNA, 21 nt, Leptospira interrogans serovar lai str. 56601
aaucuaaauuuuacaauuaaa

SEQ ID NO: 2793710 - RNA, 17 nt, Leptospira interrogans serovar lai str. 56601
aaucuaagaucaacaca

SEQ ID NO: 2793711 - RNA, 19 nt, Leptospira interrogans serovar lai str. 56601
aaucuaagaucaacacaaa

SEQ ID NO: 2793712 - RNA, 19 nt, Leptospira interrogans serovar lai str. 56601
aaucuaagauugaaugaaa

SEQ ID NO: 2793713 - RNA, 14 nt, Leptospira interrogans serovar lai str. 56601
aaucuaauucuucu

SEQ ID NO: 2793714 - RNA, 13 nt, Leptospira interrogans serovar lai str. 56601
aaucuacaaaacu

SEQ ID NO: 2793715 - RNA, 19 nt, Leptospira interrogans serovar lai str. 56601
aaucuacaaaacuuuacga

SEQ ID NO: 2793716 - RNA, 17 nt, Leptospira interrogans serovar lai str. 56601
aaucuaccccaucucuu

SEQ ID NO: 2793717 - RNA, 14 nt, Leptospira interrogans serovar lai str. 56601
aaucuaggaacugc

SEQ ID NO: 2793718 - RNA, 16 nt, Leptospira interrogans serovar lai str. 56601
aaucuaggaacugcuu

SEQ ID NO: 2793719 - RNA, 21 nt, Leptospira interrogans serovar lai str. 56601
aaucuaggaacugcuuccaaa

SEQ ID NO: 2793720 - RNA, 22 nt, Leptospira interrogans serovar lai str. 56601
aaucuaggaacugcuuccaaaa

SEQ ID NO: 2793721 - RNA, 21 nt, Leptospira interrogans serovar lai str. 56601
aaucuaggauauuugauauaa

SEQ ID NO: 2793722 - RNA, 17 nt, Leptospira interrogans serovar lai str. 56601
aaucuaguucaacguaa

SEQ ID NO: 2793723 - RNA, 12 nt, Leptospira interrogans serovar lai str. 56601
aaucuaguuuau

SEQ ID NO: 2793724 - RNA, 19 nt, Leptospira interrogans serovar lai str. 56601
aaucuaucucaaaaauacu

SEQ ID NO: 2793725 - RNA, 14 nt, Leptospira interrogans serovar lai str. 56601
aaucuauuaacuuu

SEQ ID NO: 2793726 - RNA, 23 nt, Leptospira interrogans serovar lai str. 56601
aaucuauucuuaaaauguaggaa

SEQ ID NO: 2793727 - RNA, 14 nt, Leptospira interrogans serovar lai str. 56601
aaucuauuguaaua

SEQ ID NO: 2793728 - RNA, 12 nt, Leptospira interrogans serovar lai str. 56601
aaucuauuuuug

SEQ ID NO: 2793729 - RNA, 13 nt, Leptospira interrogans serovar lai str. 56601
aaucuauuuuuga

SEQ ID NO: 2793730 - RNA, 21 nt, Leptospira interrogans serovar lai str. 56601
aaucuauuuuugauuuuagaa

SEQ ID NO: 2793731 - RNA, 19 nt, Leptospira interrogans serovar lai str. 56601
aaucucaauucaguaaauu

SEQ ID NO: 2793732 - RNA, 21 nt, Leptospira interrogans serovar lai str. 56601
aaucucaauucaguaaauuau

SEQ ID NO: 2793733 - RNA, 20 nt, Leptospira interrogans serovar lai str. 56601
aaucuccccaaaaucuuuag

SEQ ID NO: 2793734 - RNA, 18 nt, Leptospira interrogans serovar lai str. 56601
aaucucugauaauuuuuu

SEQ ID NO: 2793735 - RNA, 13 nt, Leptospira interrogans serovar lai str. 56601
aaucucuuucgga

SEQ ID NO: 2793736 - RNA, 12 nt, Leptospira interrogans serovar lai str. 56601
aaucugaaauag

SEQ ID NO: 2793737 - RNA, 15 nt, Leptospira interrogans serovar lai str. 56601
aaucugaaauucauc

SEQ ID NO: 2793738 - RNA, 21 nt, Leptospira interrogans serovar lai str. 56601
aaucugaacauaaaaucgauu

SEQ ID NO: 2793739 - RNA, 14 nt, Leptospira interrogans serovar lai str. 56601
aaucugaaccugca

SEQ ID NO: 2793740 - RNA, 23 nt, Leptospira interrogans serovar lai str. 56601
aaucugaauuuuaagaucuauuc

SEQ ID NO: 2793741 - RNA, 18 nt, Leptospira interrogans serovar lai str. 56601
aaucugauugagaaaaua

SEQ ID NO: 2793742 - RNA, 18 nt, Leptospira interrogans serovar lai str. 56601
aaucugcaaagcucagau

SEQ ID NO: 2793743 - RNA, 15 nt, Leptospira interrogans serovar lai str. 56601
aaucugcaucuuuuc

SEQ ID NO: 2793744 - RNA, 17 nt, Leptospira interrogans serovar lai str. 56601
aaucugccccaaaauuu

SEQ ID NO: 2793745 - RNA, 19 nt, Leptospira interrogans serovar lai str. 56601
aaucugccccaaaauuuag

SEQ ID NO: 2793746 - RNA, 21 nt, Leptospira interrogans serovar lai str. 56601
aaucugccccaaaauuuagaa

SEQ ID NO: 2793747 - RNA, 18 nt, Leptospira interrogans serovar lai str. 56601
aaucugcugaauuuaccu

SEQ ID NO: 2793748 - RNA, 19 nt, Leptospira interrogans serovar lai str. 56601
aaucugcugaauuuaccuc

SEQ ID NO: 2793749 - RNA, 19 nt, Leptospira interrogans serovar lai str. 56601
aaucuggaagccaaaacca

SEQ ID NO: 2793750 - RNA, 23 nt, Leptospira interrogans serovar lai str. 56601
aaucuguaaaucaacauuauguu

SEQ ID NO: 2793751 - RNA, 20 nt, Leptospira interrogans serovar lai str. 56601
aaucugugggaacuaucaca

SEQ ID NO: 2793752 - RNA, 22 nt, Leptospira interrogans serovar lai str. 56601
aaucugugggaacuaucacaaa

SEQ ID NO: 2793753 - RNA, 14 nt, Leptospira interrogans serovar lai str. 56601
aaucuguucuuacu

SEQ ID NO: 2793754 - RNA, 19 nt, Leptospira interrogans serovar lai str. 56601
aaucuguuuagaauauuuu

SEQ ID NO: 2793755 - RNA, 20 nt, Leptospira interrogans serovar lai str. 56601
aaucuguuuuaucuuagauc

SEQ ID NO: 2793756 - RNA, 12 nt, Leptospira interrogans serovar lai str. 56601
aaucuuaaaaag

SEQ ID NO: 2793757 - RNA, 16 nt, Leptospira interrogans serovar lai str. 56601
aaucuuaaaaagagua

SEQ ID NO: 2793758 - RNA, 18 nt, Leptospira interrogans serovar lai str. 56601
aaucuuaaaaagaguauu

SEQ ID NO: 2793759 - RNA, 18 nt, Leptospira interrogans serovar lai str. 56601
aaucuuaaauuagauauu

SEQ ID NO: 2793760 - RNA, 14 nt, Leptospira interrogans serovar lai str. 56601
aaucuuaacuuuaa

SEQ ID NO: 2793761 - RNA, 17 nt, Leptospira interrogans serovar lai str. 56601
aaucuuaauaaaauuuu

SEQ ID NO: 2793762 - RNA, 14 nt, Leptospira interrogans serovar lai str. 56601
aaucuuaauauuuc

SEQ ID NO: 2793763 - RNA, 21 nt, Leptospira interrogans serovar lai str. 56601
aaucuuaauuuguaagaguuc

SEQ ID NO: 2793764 - RNA, 19 nt, Leptospira interrogans serovar lai str. 56601
aaucuuauucaauaaaaua

SEQ ID NO: 2793765 - RNA, 23 nt, Leptospira interrogans serovar lai str. 56601
aaucuuauucaauaaaauaccau

SEQ ID NO: 2793766 - RNA, 18 nt, Leptospira interrogans serovar lai str. 56601
aaucuuccgcauuuuuau

SEQ ID NO: 2793767 - RNA, 23 nt, Leptospira interrogans serovar lai str. 56601
aaucuuccugggaaguuguaucc

SEQ ID NO: 2793768 - RNA, 22 nt, Leptospira interrogans serovar lai str. 56601
aaucuucgguuuaauauacuaa

SEQ ID NO: 2793769 - RNA, 18 nt, Leptospira interrogans serovar lai str. 56601
aaucuuggaucauccuuu

SEQ ID NO: 2793770 - RNA, 20 nt, Leptospira interrogans serovar lai str. 56601
aaucuuuaaaauacuuuacc

SEQ ID NO: 2793771 - RNA, 13 nt, Leptospira interrogans serovar lai str. 56601
aaucuuuaagagc

SEQ ID NO: 2793772 - RNA, 13 nt, Leptospira interrogans serovar lai str. 56601
aaucuuuaaguuu

SEQ ID NO: 2793773 - RNA, 14 nt, Leptospira interrogans serovar lai str. 56601
aaucuuuagaauuu

SEQ ID NO: 2793774 - RNA, 18 nt, Leptospira interrogans serovar lai str. 56601
aaucuuuagaauuuuucg

SEQ ID NO: 2793775 - RNA, 17 nt, Leptospira interrogans serovar lai str. 56601
aaucuuucacuuuaaaa

SEQ ID NO: 2793776 - RNA, 19 nt, Leptospira interrogans serovar lai str. 56601
aaucuuucacuuuaaaaca

SEQ ID NO: 2793777 - RNA, 20 nt, Leptospira interrogans serovar lai str. 56601
aaucuuucacuuuaaaacau

SEQ ID NO: 2793778 - RNA, 20 nt, Leptospira interrogans serovar lai str. 56601
aaucuuucauguauuacuca

SEQ ID NO: 2793779 - RNA, 23 nt, Leptospira interrogans serovar lai str. 56601
aaucuuuuaaaaaagguauauag

SEQ ID NO: 2793780 - RNA, 14 nt, Leptospira interrogans serovar lai str. 56601
aaucuuuuuaaaag

SEQ ID NO: 2793781 - RNA, 20 nt, Leptospira interrogans serovar lai str. 56601
aaucuuuuuaaaaguuugau

SEQ ID NO: 2793782 - RNA, 22 nt, Leptospira interrogans serovar lai str. 56601
aaucuuuuuaaaaguuugauuu

SEQ ID NO: 2793783 - RNA, 13 nt, Leptospira interrogans serovar lai str. 56601
aaucuuuuuaacg

SEQ ID NO: 2793784 - RNA, 10 nt, Leptospira interrogans serovar lai str. 56601
aaugaaaaaa

SEQ ID NO: 2793785 - RNA, 21 nt, Leptospira interrogans serovar lai str. 56601
aaugaaaaaacuauuuaauau

SEQ ID NO: 2793786 - RNA, 15 nt, Leptospira interrogans serovar lai str. 56601
aaugaaaaagaauuu

SEQ ID NO: 2793787 - RNA, 16 nt, Leptospira interrogans serovar lai str. 56601
aaugaaaauuauaagu

SEQ ID NO: 2793788 - RNA, 13 nt, Leptospira interrogans serovar lai str. 56601
aaugaaauuuuug

SEQ ID NO: 2793789 - RNA, 22 nt, Leptospira interrogans serovar lai str. 56601
aaugaaauuuuuguacaaaacc

SEQ ID NO: 2793790 - RNA, 16 nt, Leptospira interrogans serovar lai str. 56601
aaugaacaaugaauuu

SEQ ID NO: 2793791 - RNA, 13 nt, Leptospira interrogans serovar lai str. 56601
aaugaacucaaca

SEQ ID NO: 2793792 - RNA, 16 nt, Leptospira interrogans serovar lai str. 56601
aaugugggaacuacua

SEQ ID NO: 2793793 - RNA, 19 nt, Leptospira interrogans serovar lai str. 56601
aauguuauaaaauguauua

SEQ ID NO: 2793794 - RNA, 15 nt, Leptospira interrogans serovar lai str. 56601
aauguuauugauaaa

SEQ ID NO: 2793795 - RNA, 14 nt, Leptospira interrogans serovar lai str. 56601
aauguucaaauuca

SEQ ID NO: 2793796 - RNA, 14 nt, Leptospira interrogans serovar lai str. 56601
aauguuccaaagcc

SEQ ID NO: 2793797 - RNA, 16 nt, Leptospira interrogans serovar lai str. 56601
aauguuccaaagccaa

SEQ ID NO: 2793798 - RNA, 13 nt, Leptospira interrogans serovar lai str. 56601
aauguugaaugaa

SEQ ID NO: 2793799 - RNA, 15 nt, Leptospira interrogans serovar lai str. 56601
aauguugaaugaaac

SEQ ID NO: 2793800 - RNA, 15 nt, Leptospira interrogans serovar lai str. 56601
aauguugcuccuugc

SEQ ID NO: 2793801 - RNA, 16 nt, Leptospira interrogans serovar lai str. 56601
aauguuguuaaauuuu

SEQ ID NO: 2793802 - RNA, 18 nt, Leptospira interrogans serovar lai str. 56601
aauguuguuaaauuuuuc

SEQ ID NO: 2793803 - RNA, 14 nt, Leptospira interrogans serovar lai str. 56601
aauguuuaaagaau

SEQ ID NO: 2793804 - RNA, 22 nt, Leptospira interrogans serovar lai str. 56601
aauguuucccaguucuuaaaua

SEQ ID NO: 2793805 - RNA, 17 nt, Leptospira interrogans serovar lai str. 56601
aauguuugaauuuuuaa

SEQ ID NO: 2793806 - RNA, 19 nt, Leptospira interrogans serovar lai str. 56601
aauguuugaauuuuuaaga

SEQ ID NO: 2793807 - RNA, 19 nt, Leptospira interrogans serovar lai str. 56601
aauguuugagguuuuaaaa

SEQ ID NO: 2793808 - RNA, 21 nt, Leptospira interrogans serovar lai str. 56601
aauguuugagguuuuaaaagu

SEQ ID NO: 2793809 - RNA, 19 nt, Leptospira interrogans serovar lai str. 56601
aauguuuuccagaaaccau

SEQ ID NO: 2793810 - RNA, 23 nt, Leptospira interrogans serovar lai str. 56601
aauguuuuuauaucuuaauuaaa

SEQ ID NO: 2793811 - RNA, 19 nt, Leptospira interrogans serovar lai str. 56601
aauuaaaaaacuuuuuaaa

SEQ ID NO: 2793812 - RNA, 14 nt, Leptospira interrogans serovar lai str. 56601
aauuaaaaaagaga

SEQ ID NO: 2793813 - RNA, 20 nt, Leptospira interrogans serovar lai str. 56601
aauuaaaaaagagaaagaaa

SEQ ID NO: 2793814 - RNA, 15 nt, Leptospira interrogans serovar lai str. 56601
aauuaaaaaaucaua

SEQ ID NO: 2793815 - RNA, 18 nt, Leptospira interrogans serovar lai str. 56601
aauuaaaaaaucugcucu

SEQ ID NO: 2793816 - RNA, 13 nt, Leptospira interrogans serovar lai str. 56601
aauuaaaaagaua

SEQ ID NO: 2793817 - RNA, 16 nt, Leptospira interrogans serovar lai str. 56601
aauuaaaaauucaucu

SEQ ID NO: 2793818 - RNA, 17 nt, Leptospira interrogans serovar lai str. 56601
aauuaaaauucuagaaa

SEQ ID NO: 2793819 - RNA, 12 nt, Leptospira interrogans serovar lai str. 56601
aauuaaaauuua

SEQ ID NO: 2793820 - RNA, 22 nt, Leptospira interrogans serovar lai str. 56601
aauuaaacaaagaauaaauccg

SEQ ID NO: 2793821 - RNA, 19 nt, Leptospira interrogans serovar lai str. 56601
aauuaaacccauuuuagaa

SEQ ID NO: 2793822 - RNA, 19 nt, Leptospira interrogans serovar lai str. 56601
aauuaaacuucaaaaaaua

SEQ ID NO: 2793823 - RNA, 19 nt, Leptospira interrogans serovar lai str. 56601
aauuaaagcgucucauuuc

SEQ ID NO: 2793824 - RNA, 21 nt, Leptospira interrogans serovar lai str. 56601
aauuaaagcgucucauuucuu

SEQ ID NO: 2793825 - RNA, 13 nt, Leptospira interrogans serovar lai str. 56601
aauuaacaaaacu

SEQ ID NO: 2793826 - RNA, 16 nt, Leptospira interrogans serovar lai str. 56601
aauuaacaaaacuacu

SEQ ID NO: 2793827 - RNA, 15 nt, Leptospira interrogans serovar lai str. 56601
aauuaacaaaacugc

SEQ ID NO: 2793828 - RNA, 16 nt, Leptospira interrogans serovar lai str. 56601
aauuaacaaaacugcu

SEQ ID NO: 2793829 - RNA, 22 nt, Leptospira interrogans serovar lai str. 56601
aauuaacaguauucaauuuuua

SEQ ID NO: 2793830 - RNA, 14 nt, Leptospira interrogans serovar lai str. 56601
aauuaacuuugaua

SEQ ID NO: 2793831 - RNA, 20 nt, Leptospira interrogans serovar lai str. 56601
aauuaaguaguuuuuugauu

SEQ ID NO: 2793832 - RNA, 13 nt, Leptospira interrogans serovar lai str. 56601
aauuaaguuuaaa

SEQ ID NO: 2793833 - RNA, 15 nt, Leptospira interrogans serovar lai str. 56601
aauuaaguuuaaaaa

SEQ ID NO: 2793834 - RNA, 17 nt, Leptospira interrogans serovar lai str. 56601
aauuaaguuuaaaaaca

SEQ ID NO: 2793835 - RNA, 16 nt, Leptospira interrogans serovar lai str. 56601
aauuaaguuuauucaa

SEQ ID NO: 2793836 - RNA, 19 nt, Leptospira interrogans serovar lai str. 56601
aauuaaucaaauuucugca

SEQ ID NO: 2793837 - RNA, 22 nt, Leptospira interrogans serovar lai str. 56601
aauuaaucuguaaaguuuagau

SEQ ID NO: 2793838 - RNA, 23 nt, Leptospira interrogans serovar lai str. 56601
aauuaaugaauaacuuuacaaaa

SEQ ID NO: 2793839 - RNA, 21 nt, Leptospira interrogans serovar lai str. 56601
aauuaaugaggagaaaaaaua

SEQ ID NO: 2793840 - RNA, 15 nt, Leptospira interrogans serovar lai str. 56601
aauuaauuccuaacu

SEQ ID NO: 2793841 - RNA, 21 nt, Leptospira interrogans serovar lai str. 56601
aauuaauuccuaacuaauaaa

SEQ ID NO: 2793842 - RNA, 20 nt, Leptospira interrogans serovar lai str. 56601
aauuaauucuccaucuauuu

SEQ ID NO: 2793843 - RNA, 18 nt, Leptospira interrogans serovar lai str. 56601
aauuaauuucuaaacaau

SEQ ID NO: 2793844 - RNA, 22 nt, Leptospira interrogans serovar lai str. 56601
aauuaauuucuaaacaauuuua

SEQ ID NO: 2793845 - RNA, 23 nt, Leptospira interrogans serovar lai str. 56601
aauuaauuuguaauucugucuuu

SEQ ID NO: 2793846 - RNA, 16 nt, Leptospira interrogans serovar lai str. 56601
aauuaauuuuuuaaaa

SEQ ID NO: 2793847 - RNA, 20 nt, Leptospira interrogans serovar lai str. 56601
aauuaauuuuuuaaaaauuu

SEQ ID NO: 2793848 - RNA, 21 nt, Leptospira interrogans serovar lai str. 56601
aauuacaguuaauaaauugua

SEQ ID NO: 2793849 - RNA, 15 nt, Leptospira interrogans serovar lai str. 56601
aauuacauaguaaac

SEQ ID NO: 2793850 - RNA, 23 nt, Leptospira interrogans serovar lai str. 56601
aauuacccuaaagcuauuuucua

SEQ ID NO: 2793851 - RNA, 24 nt, Leptospira interrogans serovar lai str. 56601
aauuacccuaaagcuauuuucuag

SEQ ID NO: 2793852 - RNA, 13 nt, Leptospira interrogans serovar lai str. 56601
aauuacuacaaaa

SEQ ID NO: 2793853 - RNA, 23 nt, Leptospira interrogans serovar lai str. 56601
aauuacuacauuugauuaaaaau

SEQ ID NO: 2793854 - RNA, 23 nt, Leptospira interrogans serovar lai str. 56601
aauuacugauuucaaaaauaaau

SEQ ID NO: 2793855 - RNA, 19 nt, Leptospira interrogans serovar lai str. 56601
aauuacuucuagcaccuaa

SEQ ID NO: 2793856 - RNA, 21 nt, Leptospira interrogans serovar lai str. 56601
aauuagaaaauuauaaacaaa

SEQ ID NO: 2793857 - RNA, 19 nt, Leptospira interrogans serovar lai str. 56601
aauuagaaaugauuuuuua

SEQ ID NO: 2793858 - RNA, 22 nt, Leptospira interrogans serovar lai str. 56601
aauuagaauccuguuugaaaaa

SEQ ID NO: 2793859 - RNA, 17 nt, Leptospira interrogans serovar lai str. 56601
aauuagauuuauugaaa

SEQ ID NO: 2793860 - RNA, 21 nt, Leptospira interrogans serovar lai str. 56601
aauuagauuuauugaaaaaua

SEQ ID NO: 2793861 - RNA, 23 nt, Leptospira interrogans serovar lai str. 56601
aauuagcguguaugguaaaaaua

SEQ ID NO: 2793862 - RNA, 16 nt, Leptospira interrogans serovar lai str. 56601
aauuauaaaauuuuuc

SEQ ID NO: 2793863 - RNA, 18 nt, Leptospira interrogans serovar lai str. 56601
aauuauagauaauuuuua

SEQ ID NO: 2793864 - RNA, 13 nt, Leptospira interrogans serovar lai str. 56601
aauuauaguaaca

SEQ ID NO: 2793865 - RNA, 19 nt, Leptospira interrogans serovar lai str. 56601
aauuauaguuuuauuagaa

SEQ ID NO: 2793866 - RNA, 12 nt, Leptospira interrogans serovar lai str. 56601
aauuauauuaaa

SEQ ID NO: 2793867 - RNA, 14 nt, Leptospira interrogans serovar lai str. 56601
aauuauauuaaauu

SEQ ID NO: 2793868 - RNA, 16 nt, Leptospira interrogans serovar lai str. 56601
aauuauauucuuauau

SEQ ID NO: 2793869 - RNA, 14 nt, Leptospira interrogans serovar lai str. 56601
aauuauauuuugag

SEQ ID NO: 2793870 - RNA, 22 nt, Leptospira interrogans serovar lai str. 56601
aauuaucauguaaaauuuuuug

SEQ ID NO: 2793871 - RNA, 21 nt, Leptospira interrogans serovar lai str. 56601
aauuaucguguaaaauuuuuu

SEQ ID NO: 2793872 - RNA, 22 nt, Leptospira interrogans serovar lai str. 56601
aauuaucguguaaaauuuuuug

SEQ ID NO: 2793873 - RNA, 19 nt, Leptospira interrogans serovar lai str. 56601
aauuaugauuucacgaaca

SEQ ID NO: 2793874 - RNA, 18 nt, Leptospira interrogans serovar lai str. 56601
aauucuaaaauuguagaa

SEQ ID NO: 2793875 - RNA, 22 nt, Leptospira interrogans serovar lai str. 56601
aauucuaaaauuguagaaacuu

SEQ ID NO: 2793876 - RNA, 17 nt, Leptospira interrogans serovar lai str. 56601
aauucuaaaauuuguag

SEQ ID NO: 2793877 - RNA, 15 nt, Leptospira interrogans serovar lai str. 56601
aauucuaaacacaga

SEQ ID NO: 2793878 - RNA, 17 nt, Leptospira interrogans serovar lai str. 56601
aauucuaaagccauuua

SEQ ID NO: 2793879 - RNA, 22 nt, Leptospira interrogans serovar lai str. 56601
aauucuaaaguuguaggaacua

SEQ ID NO: 2793880 - RNA, 18 nt, Leptospira interrogans serovar lai str. 56601
aauucuaaguaauuuaaa

SEQ ID NO: 2793881 - RNA, 19 nt, Leptospira interrogans serovar lai str. 56601
aauucuaaguaauuuaaaa

SEQ ID NO: 2793882 - RNA, 21 nt, Leptospira interrogans serovar lai str. 56601
aauucuaauauaacauuucca

SEQ ID NO: 2793883 - RNA, 19 nt, Leptospira interrogans serovar lai str. 56601
aauucuaaucacgaaaaau

SEQ ID NO: 2793884 - RNA, 21 nt, Leptospira interrogans serovar lai str. 56601
aauucuagaaagaauuuaaua

SEQ ID NO: 2793885 - RNA, 23 nt, Leptospira interrogans serovar lai str. 56601
aauucuauaguaaagauuagaaa

SEQ ID NO: 2793886 - RNA, 14 nt, Leptospira interrogans serovar lai str. 56601
aauucucaaaaaau

SEQ ID NO: 2793887 - RNA, 22 nt, Leptospira interrogans serovar lai str. 56601
aauucuccacaaaaccaaaucg

SEQ ID NO: 2793888 - RNA, 23 nt, Leptospira interrogans serovar lai str. 56601
aauucuccguuaugcaugaauuu

SEQ ID NO: 2793889 - RNA, 21 nt, Leptospira interrogans serovar lai str. 56601
aauucuccuccugaaaauuuu

SEQ ID NO: 2793890 - RNA, 22 nt, Leptospira interrogans serovar lai str. 56601
aauucuccuccugaaaauuuuc

SEQ ID NO: 2793891 - RNA, 18 nt, Leptospira interrogans serovar lai str. 56601
aauucuccucuucaccaa

SEQ ID NO: 2793892 - RNA, 13 nt, Leptospira interrogans serovar lai str. 56601
aauucucuucguu

SEQ ID NO: 2793893 - RNA, 14 nt, Leptospira interrogans serovar lai str. 56601
aauucucuuuugac

SEQ ID NO: 2793894 - RNA, 15 nt, Leptospira interrogans serovar lai str. 56601
aauucugaaaaugua

SEQ ID NO: 2793895 - RNA, 17 nt, Leptospira interrogans serovar lai str. 56601
aauucugaaaauguaaa

SEQ ID NO: 2793896 - RNA, 19 nt, Leptospira interrogans serovar lai str. 56601
aauucugucucuuuauaua

SEQ ID NO: 2793897 - RNA, 13 nt, Leptospira interrogans serovar lai str. 56601
aauucuuaaaaaa

SEQ ID NO: 2793898 - RNA, 20 nt, Leptospira interrogans serovar lai str. 56601
aauucuuaaaaaauauuuuc

SEQ ID NO: 2793899 - RNA, 13 nt, Leptospira interrogans serovar lai str. 56601
aauucuuaaaaau

SEQ ID NO: 2793900 - RNA, 17 nt, Leptospira interrogans serovar lai str. 56601
aauucuuaaaaauuuau

SEQ ID NO: 2793901 - RNA, 11 nt, Leptospira interrogans serovar lai str. 56601
aauucuuaaua

SEQ ID NO: 2793902 - RNA, 17 nt, Leptospira interrogans serovar lai str. 56601
aauucuuaauauacuua

SEQ ID NO: 2793903 - RNA, 19 nt, Leptospira interrogans serovar lai str. 56601
aauucuuacaacuuuugaa

SEQ ID NO: 2793904 - RNA, 22 nt, Leptospira interrogans serovar lai str. 56601
aauucuucagggcucauagaac

SEQ ID NO: 2793905 - RNA, 17 nt, Leptospira interrogans serovar lai str. 56601
aauucuuccuucuugaa

SEQ ID NO: 2793906 - RNA, 18 nt, Leptospira interrogans serovar lai str. 56601
aauucuuccuucuugaaa

SEQ ID NO: 2793907 - RNA, 20 nt, Leptospira interrogans serovar lai str. 56601
aauucuucguuagaagacaa

SEQ ID NO: 2793908 - RNA, 15 nt, Leptospira interrogans serovar lai str. 56601
aauucuuuaaaauuu

SEQ ID NO: 2793909 - RNA, 18 nt, Leptospira interrogans serovar lai str. 56601
aauucuuuaaaauuuuua

SEQ ID NO: 2793910 - RNA, 12 nt, Leptospira interrogans serovar lai str. 56601
aauucuuuaaau

SEQ ID NO: 2793911 - RNA, 13 nt, Leptospira interrogans serovar lai str. 56601
aauucuuuaaaug

SEQ ID NO: 2793912 - RNA, 17 nt, Leptospira interrogans serovar lai str. 56601
aauucuuuagaaauuuu

SEQ ID NO: 2793913 - RNA, 20 nt, Leptospira interrogans serovar lai str. 56601
aauucuuuagaaauuuuuaa

SEQ ID NO: 2793914 - RNA, 22 nt, Leptospira interrogans serovar lai str. 56601
aauucuuuagaaauuuuuaauc

SEQ ID NO: 2793915 - RNA, 22 nt, Leptospira interrogans serovar lai str. 56601
aauucuuucguuuuuugcagau

SEQ ID NO: 2793916 - RNA, 14 nt, Leptospira interrogans serovar lai str. 56601
aauucuuugaacca

SEQ ID NO: 2793917 - RNA, 20 nt, Leptospira interrogans serovar lai str. 56601
aauucuuuggaaauuuuuaa

SEQ ID NO: 2793918 - RNA, 18 nt, Leptospira interrogans serovar lai str. 56601
aauucuuuuccaaaaacu

SEQ ID NO: 2793919 - RNA, 23 nt, Leptospira interrogans serovar lai str. 56601
aauucuuuugcauaguuuuaugu

SEQ ID NO: 2793920 - RNA, 18 nt, Leptospira interrogans serovar lai str. 56601
aauugaaacaauuuugcc

SEQ ID NO: 2793921 - RNA, 19 nt, Leptospira interrogans serovar lai str. 56601
aauugaaaguaaagaugau

SEQ ID NO: 2793922 - RNA, 22 nt, Leptospira interrogans serovar lai str. 56601
aauugaauucuuccuucuugaa

SEQ ID NO: 2793923 - RNA, 23 nt, Leptospira interrogans serovar lai str. 56601
aauugaauucuuccuucuugaaa

SEQ ID NO: 2793924 - RNA, 12 nt, Leptospira interrogans serovar lai str. 56601
aauugaauuuaa

SEQ ID NO: 2793925 - RNA, 17 nt, Leptospira interrogans serovar lai str. 56601
aauugagaauagaagca

SEQ ID NO: 2793926 - RNA, 22 nt, Leptospira interrogans serovar lai str. 56601
aauugagaauuuguuuuaaaau

SEQ ID NO: 2793927 - RNA, 14 nt, Leptospira interrogans serovar lai str. 56601
aauugauaaaaccg

SEQ ID NO: 2793928 - RNA, 21 nt, Leptospira interrogans serovar lai str. 56601
aauugauaaaaccguuuuaua

SEQ ID NO: 2793929 - RNA, 20 nt, Leptospira interrogans serovar lai str. 56601
aauugauuuuucaacaacuc

SEQ ID NO: 2793930 - RNA, 12 nt, Leptospira interrogans serovar lai str. 56601
aauugcacaaaa

SEQ ID NO: 2793931 - RNA, 17 nt, Leptospira interrogans serovar lai str. 56601
aauugcgguaguuccca

SEQ ID NO: 2793932 - RNA, 17 nt, Leptospira interrogans serovar lai str. 56601
aauuggaauaucggaau

SEQ ID NO: 2793933 - RNA, 15 nt, Leptospira interrogans serovar lai str. 56601
aauuggcagaugaaa

SEQ ID NO: 2793934 - RNA, 23 nt, Leptospira interrogans serovar lai str. 56601
aauuguaaaaaaccgucccaaaa

SEQ ID NO: 2793935 - RNA, 15 nt, Leptospira interrogans serovar lai str. 56601
aauuguagaauuuau

SEQ ID NO: 2793936 - RNA, 16 nt, Leptospira interrogans serovar lai str. 56601
aauuguaggaacuacu

SEQ ID NO: 2793937 - RNA, 16 nt, Leptospira interrogans serovar lai str. 56601
aauuguaggaguucau

SEQ ID NO: 2793938 - RNA, 21 nt, Leptospira interrogans serovar lai str. 56601
aauuguaggaguucauauuuu

SEQ ID NO: 2793939 - RNA, 12 nt, Leptospira interrogans serovar lai str. 56601
aauuguaugaaa

SEQ ID NO: 2793940 - RNA, 22 nt, Leptospira interrogans serovar lai str. 56601
aauuguaugaaagaaacauaau

SEQ ID NO: 2793941 - RNA, 13 nt, Leptospira interrogans serovar lai str. 56601
aauuguaugaaga

SEQ ID NO: 2793942 - RNA, 23 nt, Leptospira interrogans serovar lai str. 56601
aauugucaugauucauuuuuuga

SEQ ID NO: 2793943 - RNA, 15 nt, Leptospira interrogans serovar lai str. 56601
aauugugagaacuac

SEQ ID NO: 2793944 - RNA, 16 nt, Leptospira interrogans serovar lai str. 56601
aauugugagaacuacu

SEQ ID NO: 2793945 - RNA, 22 nt, Leptospira interrogans serovar lai str. 56601
aauugugggaacuauuacaaaa

SEQ ID NO: 2793946 - RNA, 18 nt, Leptospira interrogans serovar lai str. 56601
aauugugggaacucacac

SEQ ID NO: 2793947 - RNA, 21 nt, Leptospira interrogans serovar lai str. 56601
aauugugggacuauuaggaaa

SEQ ID NO: 2793948 - RNA, 18 nt, Leptospira interrogans serovar lai str. 56601
aauuguguaugaguuccu

SEQ ID NO: 2793949 - RNA, 19 nt, Leptospira interrogans serovar lai str. 56601
aauuguuccgaauuaaaaa

SEQ ID NO: 2793950 - RNA, 19 nt, Leptospira interrogans serovar lai str. 56601
aauuguucguuucuuaauu

SEQ ID NO: 2793951 - RNA, 23 nt, Leptospira interrogans serovar lai str. 56601
aauuguucguuucuuaauuuuac

SEQ ID NO: 2793952 - RNA, 13 nt, Leptospira interrogans serovar lai str. 56601
aauuguugaaaaa

SEQ ID NO: 2793953 - RNA, 14 nt, Leptospira interrogans serovar lai str. 56601
aauuguugaaaaau

SEQ ID NO: 2793954 - RNA, 15 nt, Leptospira interrogans serovar lai str. 56601
aauuguugaaaaauu

SEQ ID NO: 2793955 - RNA, 18 nt, Leptospira interrogans serovar lai str. 56601
aauuguugaaaaauuuau

SEQ ID NO: 2793956 - RNA, 14 nt, Leptospira interrogans serovar lai str. 56601
aauuucauaguuca

SEQ ID NO: 2793957 - RNA, 18 nt, Leptospira interrogans serovar lai str. 56601
aauuucauaguucaauua

SEQ ID NO: 2793958 - RNA, 17 nt, Leptospira interrogans serovar lai str. 56601
aauuucauuuuacugcu

SEQ ID NO: 2793959 - RNA, 21 nt, Leptospira interrogans serovar lai str. 56601
aauuuccaaacuacaaauuca

SEQ ID NO: 2793960 - RNA, 16 nt, Leptospira interrogans serovar lai str. 56601
aauuuccaaacucaau

SEQ ID NO: 2793961 - RNA, 16 nt, Leptospira interrogans serovar lai str. 56601
aauuuccacuucaaaa

SEQ ID NO: 2793962 - RNA, 20 nt, Leptospira interrogans serovar lai str. 56601
aauuuccacuucaaaaagac

SEQ ID NO: 2793963 - RNA, 20 nt, Leptospira interrogans serovar lai str. 56601
aauuuccaugauaugagagu

SEQ ID NO: 2793964 - RNA, 21 nt, Leptospira interrogans serovar lai str. 56601
aauuuccauuaauuacagaau

SEQ ID NO: 2793965 - RNA, 19 nt, Leptospira interrogans serovar lai str. 56601
aauuucccgauucucaaaa

SEQ ID NO: 2793966 - RNA, 17 nt, Leptospira interrogans serovar lai str. 56601
aauuuccgauaaagaaa

SEQ ID NO: 2793967 - RNA, 22 nt, Leptospira interrogans serovar lai str. 56601
aauuuccuuuuguuuuucuuua

SEQ ID NO: 2793968 - RNA, 13 nt, Leptospira interrogans serovar lai str. 56601
aauuucuaaaagu

SEQ ID NO: 2793969 - RNA, 19 nt, Leptospira interrogans serovar lai str. 56601
aauuucuaaaauucuuccg

SEQ ID NO: 2793970 - RNA, 18 nt, Leptospira interrogans serovar lai str. 56601
aauuucuauaaaaucuaa

SEQ ID NO: 2793971 - RNA, 15 nt, Leptospira interrogans serovar lai str. 56601
aauuucugaaacaau

SEQ ID NO: 2793972 - RNA, 14 nt, Leptospira interrogans serovar lai str. 56601
aauuucugcaugaa

SEQ ID NO: 2793973 - RNA, 18 nt, Leptospira interrogans serovar lai str. 56601
aauuucuuaaaagauucu

SEQ ID NO: 2793974 - RNA, 20 nt, Leptospira interrogans serovar lai str. 56601
aauuucuucauaucaaauuc

SEQ ID NO: 2793975 - RNA, 22 nt, Leptospira interrogans serovar lai str. 56601
aauuucuucauaucaaauucau

SEQ ID NO: 2793976 - RNA, 23 nt, Leptospira interrogans serovar lai str. 56601
aauuucuucauaucaaauucaug

SEQ ID NO: 2793977 - RNA, 20 nt, Leptospira interrogans serovar lai str. 56601
aauuugaaaagaaaccaauc

SEQ ID NO: 2793978 - RNA, 21 nt, Leptospira interrogans serovar lai str. 56601
aauuugaaaagaaaccaauca

SEQ ID NO: 2793979 - RNA, 17 nt, Leptospira interrogans serovar lai str. 56601
aauuugaauauaauaaa

SEQ ID NO: 2793980 - RNA, 18 nt, Leptospira interrogans serovar lai str. 56601
aauuugauuccaagauuu

SEQ ID NO: 2793981 - RNA, 14 nt, Leptospira interrogans serovar lai str. 56601
aauuugcgaaaaaa

SEQ ID NO: 2793982 - RNA, 16 nt, Leptospira interrogans serovar lai str. 56601
aauuugcgauauucua

SEQ ID NO: 2793983 - RNA, 14 nt, Leptospira interrogans serovar lai str. 56601
aauuugcuaaaaua

SEQ ID NO: 2793984 - RNA, 14 nt, Leptospira interrogans serovar lai str. 56601
aauuuguaaauucu

SEQ ID NO: 2793985 - RNA, 15 nt, Leptospira interrogans serovar lai str. 56601
aauuuguaggaacua

SEQ ID NO: 2793986 - RNA, 17 nt, Leptospira interrogans serovar lai str. 56601
aauuuguaggaacuacu

SEQ ID NO: 2793987 - RNA, 13 nt, Leptospira interrogans serovar lai str. 56601
aauuuguaggaau

SEQ ID NO: 2793988 - RNA, 15 nt, Leptospira interrogans serovar lai str. 56601
aauuugugaacuuuu

SEQ ID NO: 2793989 - RNA, 21 nt, Leptospira interrogans serovar lai str. 56601
aauuugugcucacuuaugauu

SEQ ID NO: 2793990 - RNA, 18 nt, Leptospira interrogans serovar lai str. 56601
aauuugugguaguuccua

SEQ ID NO: 2793991 - RNA, 12 nt, Leptospira interrogans serovar lai str. 56601
aauuuguucaua

SEQ ID NO: 2793992 - RNA, 13 nt, Leptospira interrogans serovar lai str. 56601
aauuuguucuuaa

SEQ ID NO: 2793993 - RNA, 22 nt, Leptospira interrogans serovar lai str. 56601
aauuuguuuguuauaagaauuu

SEQ ID NO: 2793994 - RNA, 20 nt, Leptospira interrogans serovar lai str. 56601
aauuuguuuuuggaaauguu

SEQ ID NO: 2793995 - RNA, 22 nt, Leptospira interrogans serovar lai str. 56601
aauuuguuuuuggaaauguuuu

SEQ ID NO: 2793996 - RNA, 14 nt, Leptospira interrogans serovar lai str. 56601
aauuuuaaaaccaa

SEQ ID NO: 2793997 - RNA, 19 nt, Leptospira interrogans serovar lai str. 56601
aauuuuaaagaaugaucaa

SEQ ID NO: 2793998 - RNA, 11 nt, Leptospira interrogans serovar lai str. 56601
aauuuuaaaua

SEQ ID NO: 2793999 - RNA, 12 nt, Leptospira interrogans serovar lai str. 56601
aauuuuaaauau

SEQ ID NO: 2794000 - RNA, 14 nt, Leptospira interrogans serovar lai str. 56601
aauuuuaagaacaa

SEQ ID NO: 2794001 - RNA, 15 nt, Leptospira interrogans serovar lai str. 56601
aauuuuaagaacaau

SEQ ID NO: 2794002 - RNA, 13 nt, Leptospira interrogans serovar lai str. 56601
aauuuuaaguuca

SEQ ID NO: 2794003 - RNA, 17 nt, Leptospira interrogans serovar lai str. 56601
aauuuuaaguucagauu

SEQ ID NO: 2794004 - RNA, 16 nt, Leptospira interrogans serovar lai str. 56601
aauuuuaauuguaaaa

SEQ ID NO: 2794005 - RNA, 16 nt, Leptospira interrogans serovar lai str. 56601
aauuuuacccugguuu

SEQ ID NO: 2794006 - RNA, 18 nt, Leptospira interrogans serovar lai str. 56601
aauuuuacgcaaucauuc

SEQ ID NO: 2794007 - RNA, 23 nt, Leptospira interrogans serovar lai str. 56601
aauuuuacgcaaucauucuuuag

SEQ ID NO: 2794008 - RNA, 14 nt, Leptospira interrogans serovar lai str. 56601
aauuuuacuuauac

SEQ ID NO: 2794009 - RNA, 20 nt, Leptospira interrogans serovar lai str. 56601
aauuuuagaauaucuuaaua

SEQ ID NO: 2794010 - RNA, 23 nt, Leptospira interrogans serovar lai str. 56601
aauuuuagaauuuguuuguaaaa

SEQ ID NO: 2794011 - RNA, 22 nt, Leptospira interrogans serovar lai str. 56601
aauuuuagacaaaaaauucuuu

SEQ ID NO: 2794012 - RNA, 21 nt, Leptospira interrogans serovar lai str. 56601
aauuuuauaaaaaucuaggaa

SEQ ID NO: 2794013 - RNA, 23 nt, Leptospira interrogans serovar lai str. 56601
aauuuuauaaaaaucuaggaacu

SEQ ID NO: 2794014 - RNA, 21 nt, Leptospira interrogans serovar lai str. 56601
aauuuuauagauugauucuuu

SEQ ID NO: 2794015 - RNA, 14 nt, Leptospira interrogans serovar lai str. 56601
aauuuuauaguaua

SEQ ID NO: 2794016 - RNA, 22 nt, Leptospira interrogans serovar lai str. 56601
aauuuuaucuuaauguaaaguu

SEQ ID NO: 2794017 - RNA, 20 nt, Leptospira interrogans serovar lai str. 56601
aauuuuaugauuuucuuuuc

SEQ ID NO: 2794018 - RNA, 14 nt, Leptospira interrogans serovar lai str. 56601
aauuuuauuaaaua

SEQ ID NO: 2794019 - RNA, 14 nt, Leptospira interrogans serovar lai str. 56601
aauuuuauuguguu

SEQ ID NO: 2794020 - RNA, 20 nt, Leptospira interrogans serovar lai str. 56601
aauuuucagugaauaaaaua

SEQ ID NO: 2794021 - RNA, 21 nt, Leptospira interrogans serovar lai str. 56601
aauuuuccggacuuuccagaa

SEQ ID NO: 2794022 - RNA, 22 nt, Leptospira interrogans serovar lai str. 56601
aauuuuccggacuuuccagaaa

SEQ ID NO: 2794023 - RNA, 13 nt, Leptospira interrogans serovar lai str. 56601
aauuuuccguuaa

SEQ ID NO: 2794024 - RNA, 18 nt, Leptospira interrogans serovar lai str. 56601
aauuuucgauuuaauaua

SEQ ID NO: 2794025 - RNA, 21 nt, Leptospira interrogans serovar lai str. 56601
aauuuucgauuuaauauauuu

SEQ ID NO: 2794026 - RNA, 19 nt, Leptospira interrogans serovar lai str. 56601
aauuuucguaauaguuccc

SEQ ID NO: 2794027 - RNA, 19 nt, Leptospira interrogans serovar lai str. 56601
aauuuucguuuuaguuccc

SEQ ID NO: 2794028 - RNA, 15 nt, Leptospira interrogans serovar lai str. 56601
aauuuucuaaaagua

SEQ ID NO: 2794029 - RNA, 14 nt, Leptospira interrogans serovar lai str. 56601
aauuuucuaaagau

SEQ ID NO: 2794030 - RNA, 16 nt, Leptospira interrogans serovar lai str. 56601
aauuuucucaaaaaau

SEQ ID NO: 2794031 - RNA, 18 nt, Leptospira interrogans serovar lai str. 56601
aauuuucuuaguuuugua

SEQ ID NO: 2794032 - RNA, 13 nt, Leptospira interrogans serovar lai str. 56601
aauuuucuuucua

SEQ ID NO: 2794033 - RNA, 14 nt, Leptospira interrogans serovar lai str. 56601
aauuuugaaacaaa

SEQ ID NO: 2794034 - RNA, 20 nt, Leptospira interrogans serovar lai str. 56601
aauuuugaacuacagaauuu

SEQ ID NO: 2794035 - RNA, 21 nt, Leptospira interrogans serovar lai str. 56601
aauuuugaaggaaauuuuguu

SEQ ID NO: 2794036 - RNA, 13 nt, Leptospira interrogans serovar lai str. 56601
aauuuugaauauu

SEQ ID NO: 2794037 - RNA, 19 nt, Leptospira interrogans serovar lai str. 56601
aauuuuguaggaauuagua

SEQ ID NO: 2794038 - RNA, 15 nt, Leptospira interrogans serovar lai str. 56601
aauuuuuaaaaaauu

SEQ ID NO: 2794039 - RNA, 22 nt, Leptospira interrogans serovar lai str. 56601
acaaaucacgauuuuacaaaca

SEQ ID NO: 2794040 - RNA, 16 nt, Leptospira interrogans serovar lai str. 56601
acaaaucagguuuuua

SEQ ID NO: 2794041 - RNA, 22 nt, Leptospira interrogans serovar lai str. 56601
acaaaucauaggauacaaaacu

SEQ ID NO: 2794042 - RNA, 22 nt, Leptospira interrogans serovar lai str. 56601
acaaaucaucccgcccaaagua

SEQ ID NO: 2794043 - RNA, 13 nt, Leptospira interrogans serovar lai str. 56601
acaaaucgaagau

SEQ ID NO: 2794044 - RNA, 18 nt, Leptospira interrogans serovar lai str. 56601
acaaaucgacgauuuuac

SEQ ID NO: 2794045 - RNA, 15 nt, Leptospira interrogans serovar lai str. 56601
acaaaucuaaauuuu

SEQ ID NO: 2794046 - RNA, 16 nt, Leptospira interrogans serovar lai str. 56601
acaaaucuaaauuuua

SEQ ID NO: 2794047 - RNA, 18 nt, Leptospira interrogans serovar lai str. 56601
acaaaucuaaauuuuaca

SEQ ID NO: 2794048 - RNA, 16 nt, Leptospira interrogans serovar lai str. 56601
acaaaugacauuuugu

SEQ ID NO: 2794049 - RNA, 11 nt, Leptospira interrogans serovar lai str. 56601
acaaauuaaau

SEQ ID NO: 2794050 - RNA, 15 nt, Leptospira interrogans serovar lai str. 56601
acaaauuaaguuuaa

SEQ ID NO: 2794051 - RNA, 17 nt, Leptospira interrogans serovar lai str. 56601
acaaauuaaguuuaaaa

SEQ ID NO: 2794052 - RNA, 19 nt, Leptospira interrogans serovar lai str. 56601
acaaauuaguauuuuucuu

SEQ ID NO: 2794053 - RNA, 18 nt, Leptospira interrogans serovar lai str. 56601
acaaauuaugauuucacg

SEQ ID NO: 2794054 - RNA, 22 nt, Leptospira interrogans serovar lai str. 56601
acaaauucuacaauuguaggaa

SEQ ID NO: 2794055 - RNA, 16 nt, Leptospira interrogans serovar lai str. 56601
acaaauucuucuuccu

SEQ ID NO: 2794056 - RNA, 21 nt, Leptospira interrogans serovar lai str. 56601
acaaauugaguuucuuuuugc

SEQ ID NO: 2794057 - RNA, 13 nt, Leptospira interrogans serovar lai str. 56601
acaaauugcaaaa

SEQ ID NO: 2794058 - RNA, 13 nt, Leptospira interrogans serovar lai str. 56601
acaaauuuuaaag

SEQ ID NO: 2794059 - RNA, 14 nt, Leptospira interrogans serovar lai str. 56601
acaaauuuuauaua

SEQ ID NO: 2794060 - RNA, 22 nt, Leptospira interrogans serovar lai str. 56601
acaacagaacaaaauuuacgaa

SEQ ID NO: 2794061 - RNA, 14 nt, Leptospira interrogans serovar lai str. 56601
acaacauugaguuu

SEQ ID NO: 2794062 - RNA, 12 nt, Leptospira interrogans serovar lai str. 56601
acaaccaaacag

SEQ ID NO: 2794063 - RNA, 21 nt, Leptospira interrogans serovar lai str. 56601
acaacgauuucuguagaaauu

SEQ ID NO: 2794064 - RNA, 14 nt, Leptospira interrogans serovar lai str. 56601
acaacgcucucuac

SEQ ID NO: 2794065 - RNA, 22 nt, Leptospira interrogans serovar lai str. 56601
acaacggcucucuccuauguuu

SEQ ID NO: 2794066 - RNA, 20 nt, Leptospira interrogans serovar lai str. 56601
acaacucuaauacaaaaaau

SEQ ID NO: 2794067 - RNA, 13 nt, Leptospira interrogans serovar lai str. 56601
acaacucuaauga

SEQ ID NO: 2794068 - RNA, 16 nt, Leptospira interrogans serovar lai str. 56601
acaacucuaaugaauu

SEQ ID NO: 2794069 - RNA, 13 nt, Leptospira interrogans serovar lai str. 56601
acaacucuauuua

SEQ ID NO: 2794070 - RNA, 19 nt, Leptospira interrogans serovar lai str. 56601
acaacucuauuuaaguacu

SEQ ID NO: 2794071 - RNA, 13 nt, Leptospira interrogans serovar lai str. 56601
acaacucuauuuc

SEQ ID NO: 2794072 - RNA, 13 nt, Leptospira interrogans serovar lai str. 56601
acaacucuauuuu

SEQ ID NO: 2794073 - RNA, 22 nt, Leptospira interrogans serovar lai str. 56601
acaacucuauuuuauuuuucuu

SEQ ID NO: 2794074 - RNA, 12 nt, Leptospira interrogans serovar lai str. 56601
acaacucuucuu

SEQ ID NO: 2794075 - RNA, 21 nt, Leptospira interrogans serovar lai str. 56601
acaacuuauaauuuucuuaau

SEQ ID NO: 2794076 - RNA, 19 nt, Leptospira interrogans serovar lai str. 56601
acaacuuugucguuuucag

SEQ ID NO: 2794077 - RNA, 21 nt, Leptospira interrogans serovar lai str. 56601
acaacuuuugaaacuauccaa

SEQ ID NO: 2794078 - RNA, 14 nt, Leptospira interrogans serovar lai str. 56601
acaagaauuuauuu

SEQ ID NO: 2794079 - RNA, 14 nt, Leptospira interrogans serovar lai str. 56601
acaagacaaacaaa

SEQ ID NO: 2794080 - RNA, 23 nt, Leptospira interrogans serovar lai str. 56601
acaagacgcuacucgaauuuaua

SEQ ID NO: 2794081 - RNA, 16 nt, Leptospira interrogans serovar lai str. 56601
acaagacuucuauacu

SEQ ID NO: 2794082 - RNA, 14 nt, Leptospira interrogans serovar lai str. 56601
acaagauuaacaau

SEQ ID NO: 2794083 - RNA, 22 nt, Leptospira interrogans serovar lai str. 56601
acaagcucaugauuauuacucg

SEQ ID NO: 2794084 - RNA, 13 nt, Leptospira interrogans serovar lai str. 56601
acaagcucuuuaa

SEQ ID NO: 2794085 - RNA, 17 nt, Leptospira interrogans serovar lai str. 56601
acaagcuuuaaauucag

SEQ ID NO: 2794086 - RNA, 14 nt, Leptospira interrogans serovar lai str. 56601
acaagcuuuggauu

SEQ ID NO: 2794087 - RNA, 21 nt, Leptospira interrogans serovar lai str. 56601
acaaggcuuuguaauaaaaau

SEQ ID NO: 2794088 - RNA, 22 nt, Leptospira interrogans serovar lai str. 56601
acaaggcuuuguaauaaaaauu

SEQ ID NO: 2794089 - RNA, 14 nt, Leptospira interrogans serovar lai str. 56601
acaaguuuaaauga

SEQ ID NO: 2794090 - RNA, 17 nt, Leptospira interrogans serovar lai str. 56601
acaaguuuaaaugaaau

SEQ ID NO: 2794091 - RNA, 18 nt, Leptospira interrogans serovar lai str. 56601
acaaguuuacacauuuau

SEQ ID NO: 2794092 - RNA, 13 nt, Leptospira interrogans serovar lai str. 56601
acaaguuucuuaa

SEQ ID NO: 2794093 - RNA, 15 nt, Leptospira interrogans serovar lai str. 56601
acaauaaaaacuuau

SEQ ID NO: 2794094 - RNA, 16 nt, Leptospira interrogans serovar lai str. 56601
acaauaaaaacuuaug

SEQ ID NO: 2794095 - RNA, 19 nt, Leptospira interrogans serovar lai str. 56601
acaauagaguuguugaaaa

SEQ ID NO: 2794096 - RNA, 12 nt, Leptospira interrogans serovar lai str. 56601
acaauagcuuaa

SEQ ID NO: 2794097 - RNA, 18 nt, Leptospira interrogans serovar lai str. 56601
acaauagcuuaaaaguga

SEQ ID NO: 2794098 - RNA, 20 nt, Leptospira interrogans serovar lai str. 56601
acaauaguucuauuuuauca

SEQ ID NO: 2794099 - RNA, 14 nt, Leptospira interrogans serovar lai str. 56601
acaauauauucagu

SEQ ID NO: 2794100 - RNA, 15 nt, Leptospira interrogans serovar lai str. 56601
acaauauucuaauuu

SEQ ID NO: 2794101 - RNA, 13 nt, Leptospira interrogans serovar lai str. 56601
acaaucaaauuuu

SEQ ID NO: 2794102 - RNA, 17 nt, Leptospira interrogans serovar lai str. 56601
acaaucaauaaauugca

SEQ ID NO: 2794103 - RNA, 15 nt, Leptospira interrogans serovar lai str. 56601
acaaucgaacggauu

SEQ ID NO: 2794104 - RNA, 16 nt, Leptospira interrogans serovar lai str. 56601
acaaucggguaaaaaa

SEQ ID NO: 2794105 - RNA, 20 nt, Leptospira interrogans serovar lai str. 56601
acaaucggguaaaaaauacu

SEQ ID NO: 2794106 - RNA, 15 nt, Leptospira interrogans serovar lai str. 56601
acaaucucugauaau

SEQ ID NO: 2794107 - RNA, 15 nt, Leptospira interrogans serovar lai str. 56601
acaaugaaaaagcau

SEQ ID NO: 2794108 - RNA, 19 nt, Leptospira interrogans serovar lai str. 56601
acaaugaauuuuuauaaaa

SEQ ID NO: 2794109 - RNA, 14 nt, Leptospira interrogans serovar lai str. 56601
acaauuaaacuuca

SEQ ID NO: 2794110 - RNA, 20 nt, Leptospira interrogans serovar lai str. 56601
acaauuaaacuucaaaaaau

SEQ ID NO: 2794111 - RNA, 18 nt, Leptospira interrogans serovar lai str. 56601
acaauuaaucaaauuucu

SEQ ID NO: 2794112 - RNA, 22 nt, Leptospira interrogans serovar lai str. 56601
acaauuaaucaaauuucugcau

SEQ ID NO: 2794113 - RNA, 22 nt, Leptospira interrogans serovar lai str. 56601
acaauuauacuauaaguuuaca

SEQ ID NO: 2794114 - RNA, 22 nt, Leptospira interrogans serovar lai str. 56601
acaauucagauuccguuuuuau

SEQ ID NO: 2794115 - RNA, 15 nt, Leptospira interrogans serovar lai str. 56601
acaauucaucaccaa

SEQ ID NO: 2794116 - RNA, 17 nt, Leptospira interrogans serovar lai str. 56601
acaauucucgauagaac

SEQ ID NO: 2794117 - RNA, 20 nt, Leptospira interrogans serovar lai str. 56601
acaauucucgauagaacaau

SEQ ID NO: 2794118 - RNA, 23 nt, Leptospira interrogans serovar lai str. 56601
acaauucucgauagaacaaucuc

SEQ ID NO: 2794119 - RNA, 15 nt, Leptospira interrogans serovar lai str. 56601
acaauucuuccuuuu

SEQ ID NO: 2794120 - RNA, 21 nt, Leptospira interrogans serovar lai str. 56601
acaauugauugcuuuuugaga

SEQ ID NO: 2794121 - RNA, 17 nt, Leptospira interrogans serovar lai str. 56601
acaauugauuuaaaaac

SEQ ID NO: 2794122 - RNA, 14 nt, Leptospira interrogans serovar lai str. 56601
acauaaaagaccuu

SEQ ID NO: 2794123 - RNA, 23 nt, Leptospira interrogans serovar lai str. 56601
acauaaacgauuauuuuuuaaaa

SEQ ID NO: 2794124 - RNA, 16 nt, Leptospira interrogans serovar lai str. 56601
acauaaaguuaauaca

SEQ ID NO: 2794125 - RNA, 20 nt, Leptospira interrogans serovar lai str. 56601
acauaagaaagaauuuucua

SEQ ID NO: 2794126 - RNA, 17 nt, Leptospira interrogans serovar lai str. 56601
acauaauaauacagaau

SEQ ID NO: 2794127 - RNA, 16 nt, Leptospira interrogans serovar lai str. 56601
acauaaugcugcaauu

SEQ ID NO: 2794128 - RNA, 15 nt, Leptospira interrogans serovar lai str. 56601
acauaauguuucaau

SEQ ID NO: 2794129 - RNA, 14 nt, Leptospira interrogans serovar lai str. 56601
acauacaaugaaaa

SEQ ID NO: 2794130 - RNA, 22 nt, Leptospira interrogans serovar lai str. 56601
acauacuuuuugcaaguaaaaa

SEQ ID NO: 2794131 - RNA, 22 nt, Leptospira interrogans serovar lai str. 56601
acauagaacucacguuauauua

SEQ ID NO: 2794132 - RNA, 17 nt, Leptospira interrogans serovar lai str. 56601
acauauauaauuuauuc

SEQ ID NO: 2794133 - RNA, 14 nt, Leptospira interrogans serovar lai str. 56601
acauaugcauccgu

SEQ ID NO: 2794134 - RNA, 14 nt, Leptospira interrogans serovar lai str. 56601
acaucaaaaacaaa

SEQ ID NO: 2794135 - RNA, 19 nt, Leptospira interrogans serovar lai str. 56601
acaucaauuauuuucguau

SEQ ID NO: 2794136 - RNA, 16 nt, Leptospira interrogans serovar lai str. 56601
acaucaauuuuauuuc

SEQ ID NO: 2794137 - RNA, 18 nt, Leptospira interrogans serovar lai str. 56601
acaucacuuccauuuuuu

SEQ ID NO: 2794138 - RNA, 17 nt, Leptospira interrogans serovar lai str. 56601
acaucagcauaaguauu

SEQ ID NO: 2794139 - RNA, 23 nt, Leptospira interrogans serovar lai str. 56601
acaucauauuauuuguaguuuca

SEQ ID NO: 2794140 - RNA, 21 nt, Leptospira interrogans serovar lai str. 56601
acaucauucucauauugaaau

SEQ ID NO: 2794141 - RNA, 16 nt, Leptospira interrogans serovar lai str. 56601
acauccaacccaaaca

SEQ ID NO: 2794142 - RNA, 18 nt, Leptospira interrogans serovar lai str. 56601
acauccaacccaaacaca

SEQ ID NO: 2794143 - RNA, 22 nt, Leptospira interrogans serovar lai str. 56601
acauccaacccaaacacaugag

SEQ ID NO: 2794144 - RNA, 22 nt, Leptospira interrogans serovar lai str. 56601
acauccaauuauaaaauuuuuc

SEQ ID NO: 2794145 - RNA, 16 nt, Leptospira interrogans serovar lai str. 56601
acauccgcauucucac

SEQ ID NO: 2794146 - RNA, 22 nt, Leptospira interrogans serovar lai str. 56601
acauccucaacggguucuucau

SEQ ID NO: 2794147 - RNA, 14 nt, Leptospira interrogans serovar lai str. 56601
acaucgaaaaaaca

SEQ ID NO: 2794148 - RNA, 16 nt, Leptospira interrogans serovar lai str. 56601
acaucgucuucuuuuu

SEQ ID NO: 2794149 - RNA, 15 nt, Leptospira interrogans serovar lai str. 56601
acaucguguaacaaa

SEQ ID NO: 2794150 - RNA, 17 nt, Leptospira interrogans serovar lai str. 56601
acaucuaaugauuucuu

SEQ ID NO: 2794151 - RNA, 15 nt, Leptospira interrogans serovar lai str. 56601
acaucuagauuuuac

SEQ ID NO: 2794152 - RNA, 14 nt, Leptospira interrogans serovar lai str. 56601
acaucucaaucaaa

SEQ ID NO: 2794153 - RNA, 13 nt, Leptospira interrogans serovar lai str. 56601
acaucuuaaaaaa

SEQ ID NO: 2794154 - RNA, 14 nt, Leptospira interrogans serovar lai str. 56601
acaucuuaaaaaau

SEQ ID NO: 2794155 - RNA, 14 nt, Leptospira interrogans serovar lai str. 56601
acaucuuaaaaacu

SEQ ID NO: 2794156 - RNA, 23 nt, Leptospira interrogans serovar lai str. 56601
acaucuuauuuuuacagaaaaau

SEQ ID NO: 2794157 - RNA, 12 nt, Leptospira interrogans serovar lai str. 56601
acaucuuuuuuc

SEQ ID NO: 2794158 - RNA, 13 nt, Leptospira interrogans serovar lai str. 56601
acaugaagaagcu

SEQ ID NO: 2794159 - RNA, 13 nt, Leptospira interrogans serovar lai str. 56601
acaugagcauucu

SEQ ID NO: 2794160 - RNA, 14 nt, Leptospira interrogans serovar lai str. 56601
acaugauucauuua

SEQ ID NO: 2794161 - RNA, 21 nt, Leptospira interrogans serovar lai str. 56601
acaugauucauuuaaaaauug

SEQ ID NO: 2794162 - RNA, 17 nt, Leptospira interrogans serovar lai str. 56601
acauguucaaaauuuau

SEQ ID NO: 2794163 - RNA, 18 nt, Leptospira interrogans serovar lai str. 56601
acauguuguuuguggauu

SEQ ID NO: 2794164 - RNA, 19 nt, Leptospira interrogans serovar lai str. 56601
acauguuguuuguggauua

SEQ ID NO: 2794165 - RNA, 22 nt, Leptospira interrogans serovar lai str. 56601
acauguuguuuguggauuauga

SEQ ID NO: 2794166 - RNA, 20 nt, Leptospira interrogans serovar lai str. 56601
acauuaaaauaggauuuaaa

SEQ ID NO: 2794167 - RNA, 16 nt, Leptospira interrogans serovar lai str. 56601
acauuacgaauuuuua

SEQ ID NO: 2794168 - RNA, 18 nt, Leptospira interrogans serovar lai str. 56601
acauuacgaauuuuuaaa

SEQ ID NO: 2794169 - RNA, 14 nt, Leptospira interrogans serovar lai str. 56601
acauuagaacuacu

SEQ ID NO: 2794170 - RNA, 21 nt, Leptospira interrogans serovar lai str. 56601
acauuagaguuguugaaaaau

SEQ ID NO: 2794171 - RNA, 16 nt, Leptospira interrogans serovar lai str. 56601
acauuaugaauuuuua

SEQ ID NO: 2794172 - RNA, 13 nt, Leptospira interrogans serovar lai str. 56601
acauucauuuuua

SEQ ID NO: 2794173 - RNA, 14 nt, Leptospira interrogans serovar lai str. 56601
acauucauuuuuau

SEQ ID NO: 2794174 - RNA, 17 nt, Leptospira interrogans serovar lai str. 56601
acauucauuuuuucuaa

SEQ ID NO: 2794175 - RNA, 15 nt, Leptospira interrogans serovar lai str. 56601
acauuccauaaugaa

SEQ ID NO: 2794176 - RNA, 18 nt, Leptospira interrogans serovar lai str. 56601
acauuccauaaugaagau

SEQ ID NO: 2794177 - RNA, 15 nt, Leptospira interrogans serovar lai str. 56601
acauucccauccgaa

SEQ ID NO: 2794178 - RNA, 17 nt, Leptospira interrogans serovar lai str. 56601
acauuccccaaguaaaa

SEQ ID NO: 2794179 - RNA, 22 nt, Leptospira interrogans serovar lai str. 56601
acauuccgcaaaaauuccuuuu

SEQ ID NO: 2794180 - RNA, 18 nt, Leptospira interrogans serovar lai str. 56601
acauuccgucaaaucauc

SEQ ID NO: 2794181 - RNA, 18 nt, Leptospira interrogans serovar lai str. 56601
acauucgggucgauagaa

SEQ ID NO: 2794182 - RNA, 18 nt, Leptospira interrogans serovar lai str. 56601
acauucugaaacuuuuca

SEQ ID NO: 2794183 - RNA, 14 nt, Leptospira interrogans serovar lai str. 56601
acauuggacgauuu

SEQ ID NO: 2794184 - RNA, 17 nt, Leptospira interrogans serovar lai str. 56601
acauuggacgauuuuga

SEQ ID NO: 2794185 - RNA, 17 nt, Leptospira interrogans serovar lai str. 56601
acauuggcaaauguuau

SEQ ID NO: 2794186 - RNA, 17 nt, Leptospira interrogans serovar lai str. 56601
acauuguguuuuuuaac

SEQ ID NO: 2794187 - RNA, 22 nt, Leptospira interrogans serovar lai str. 56601
acauuguguuuuuuaacauuug

SEQ ID NO: 2794188 - RNA, 18 nt, Leptospira interrogans serovar lai str. 56601
acauuguuuuacucuuau

SEQ ID NO: 2794189 - RNA, 15 nt, Leptospira interrogans serovar lai str. 56601
acauuuaaauuaauc

SEQ ID NO: 2794190 - RNA, 14 nt, Leptospira interrogans serovar lai str. 56601
acauuuauuuuuac

SEQ ID NO: 2794191 - RNA, 16 nt, Leptospira interrogans serovar lai str. 56601
acauuucaaaguuuug

SEQ ID NO: 2794192 - RNA, 15 nt, Leptospira interrogans serovar lai str. 56601
acauuucguuuuuau

SEQ ID NO: 2794193 - RNA, 18 nt, Leptospira interrogans serovar lai str. 56601
acauuugauuaaaaauuu

SEQ ID NO: 2794194 - RNA, 14 nt, Leptospira interrogans serovar lai str. 56601
acauuugauuuuca

SEQ ID NO: 2794195 - RNA, 20 nt, Leptospira interrogans serovar lai str. 56601
acauuugcuuugucauuuca

SEQ ID NO: 2794196 - RNA, 13 nt, Leptospira interrogans serovar lai str. 56601
acauuuuaaaaau

SEQ ID NO: 2794197 - RNA, 14 nt, Leptospira interrogans serovar lai str. 56601
acauuuuaaaaauu

SEQ ID NO: 2794198 - RNA, 24 nt, Leptospira interrogans serovar lai str. 56601
acauuuuaaaaauucaacuuguaa

SEQ ID NO: 2794199 - RNA, 11 nt, Leptospira interrogans serovar lai str. 56601
acauuuuaaag

SEQ ID NO: 2794200 - RNA, 12 nt, Leptospira interrogans serovar lai str. 56601
acauuuuagaaa

SEQ ID NO: 2794201 - RNA, 15 nt, Leptospira interrogans serovar lai str. 56601
acauuuuauuauaaa

SEQ ID NO: 2794202 - RNA, 20 nt, Leptospira interrogans serovar lai str. 56601
acauuuuauuauaaauuuau

SEQ ID NO: 2794203 - RNA, 16 nt, Leptospira interrogans serovar lai str. 56601
acauuuuauuuuuuau

SEQ ID NO: 2794204 - RNA, 15 nt, Leptospira interrogans serovar lai str. 56601
acauuuucauauaua

SEQ ID NO: 2794205 - RNA, 19 nt, Leptospira interrogans serovar lai str. 56601
accggguuccauucuaaga

SEQ ID NO: 2794206 - RNA, 14 nt, Leptospira interrogans serovar lai str. 56601
accguagauuuuaa

SEQ ID NO: 2794207 - RNA, 15 nt, Leptospira interrogans serovar lai str. 56601
accguuuauuuuuau

SEQ ID NO: 2794208 - RNA, 23 nt, Leptospira interrogans serovar lai str. 56601
accguuuccaugaaauagaaaac

SEQ ID NO: 2794209 - RNA, 15 nt, Leptospira interrogans serovar lai str. 56601
accguuuuauaaaua

SEQ ID NO: 2794210 - RNA, 17 nt, Leptospira interrogans serovar lai str. 56601
accuaaaaauauggaag

SEQ ID NO: 2794211 - RNA, 15 nt, Leptospira interrogans serovar lai str. 56601
accuaaaaugaaaaa

SEQ ID NO: 2794212 - RNA, 18 nt, Leptospira interrogans serovar lai str. 56601
accuaauauuuugcauga

SEQ ID NO: 2794213 - RNA, 16 nt, Leptospira interrogans serovar lai str. 56601
accuaauguuuuuuau

SEQ ID NO: 2794214 - RNA, 13 nt, Leptospira interrogans serovar lai str. 56601
accuacagaacac

SEQ ID NO: 2794215 - RNA, 18 nt, Leptospira interrogans serovar lai str. 56601
accuaguguuuaauuuua

SEQ ID NO: 2794216 - RNA, 16 nt, Leptospira interrogans serovar lai str. 56601
accucaaaaaauuuua

SEQ ID NO: 2794217 - RNA, 14 nt, Leptospira interrogans serovar lai str. 56601
accucaaagaaauu

SEQ ID NO: 2794218 - RNA, 21 nt, Leptospira interrogans serovar lai str. 56601
accucaacagaauguucuuag

SEQ ID NO: 2794219 - RNA, 22 nt, Leptospira interrogans serovar lai str. 56601
accucaacagaauguucuuaga

SEQ ID NO: 2794220 - RNA, 18 nt, Leptospira interrogans serovar lai str. 56601
accucaauuuuccauuuc

SEQ ID NO: 2794221 - RNA, 15 nt, Leptospira interrogans serovar lai str. 56601
accucauaucaaaaa

SEQ ID NO: 2794222 - RNA, 15 nt, Leptospira interrogans serovar lai str. 56601
accucguacuaauuc

SEQ ID NO: 2794223 - RNA, 17 nt, Leptospira interrogans serovar lai str. 56601
accucgucuaucuuuuu

SEQ ID NO: 2794224 - RNA, 17 nt, Leptospira interrogans serovar lai str. 56601
accucuauaaaaucuaa

SEQ ID NO: 2794225 - RNA, 18 nt, Leptospira interrogans serovar lai str. 56601
accucuauggaauuuuuu

SEQ ID NO: 2794226 - RNA, 19 nt, Leptospira interrogans serovar lai str. 56601
accucuauggaauuuuuua

SEQ ID NO: 2794227 - RNA, 22 nt, Leptospira interrogans serovar lai str. 56601
accucucggaauauuuuuucca

SEQ ID NO: 2794228 - RNA, 22 nt, Leptospira interrogans serovar lai str. 56601
accucuuuauacggaugugaau

SEQ ID NO: 2794229 - RNA, 22 nt, Leptospira interrogans serovar lai str. 56601
accugauuuuucuguaaaaaua

SEQ ID NO: 2794230 - RNA, 15 nt, Leptospira interrogans serovar lai str. 56601
accugcaaauuuuuu

SEQ ID NO: 2794231 - RNA, 19 nt, Leptospira interrogans serovar lai str. 56601
accugcaacaccaauucgg

SEQ ID NO: 2794232 - RNA, 19 nt, Leptospira interrogans serovar lai str. 56601
accugcuccauaaaagugu

SEQ ID NO: 2794233 - RNA, 23 nt, Leptospira interrogans serovar lai str. 56601
accuggauuuguaauaguuccca

SEQ ID NO: 2794234 - RNA, 23 nt, Leptospira interrogans serovar lai str. 56601
accuggcucucagcucugguuaa

SEQ ID NO: 2794235 - RNA, 22 nt, Leptospira interrogans serovar lai str. 56601
accuguuuuaguucaaaaacau

SEQ ID NO: 2794236 - RNA, 13 nt, Leptospira interrogans serovar lai str. 56601
accuuaaguuuca

SEQ ID NO: 2794237 - RNA, 15 nt, Leptospira interrogans serovar lai str. 56601
accuucucuuuuaaa

SEQ ID NO: 2794238 - RNA, 18 nt, Leptospira interrogans serovar lai str. 56601
accuucucuuuuaaaaac

SEQ ID NO: 2794239 - RNA, 17 nt, Leptospira interrogans serovar lai str. 56601
accuugaaacuuuuaau

SEQ ID NO: 2794240 - RNA, 16 nt, Leptospira interrogans serovar lai str. 56601
accuuuaguuuccaaa

SEQ ID NO: 2794241 - RNA, 17 nt, Leptospira interrogans serovar lai str. 56601
accuuuaguuuccaaaa

SEQ ID NO: 2794242 - RNA, 17 nt, Leptospira interrogans serovar lai str. 56601
accuuuauuuaaaaacc

SEQ ID NO: 2794243 - RNA, 19 nt, Leptospira interrogans serovar lai str. 56601
accuuuauuuaauaaaauu

SEQ ID NO: 2794244 - RNA, 17 nt, Leptospira interrogans serovar lai str. 56601
accuuugauagaacucu

SEQ ID NO: 2794245 - RNA, 20 nt, Leptospira interrogans serovar lai str. 56601
accuuuucuagacuuucuuu

SEQ ID NO: 2794246 - RNA, 21 nt, Leptospira interrogans serovar lai str. 56601
accuuuucuagacuuucuuug

SEQ ID NO: 2794247 - RNA, 23 nt, Leptospira interrogans serovar lai str. 56601
acgaaaacuuaaugagauuaaaa

SEQ ID NO: 2794248 - RNA, 14 nt, Leptospira interrogans serovar lai str. 56601
acgaaaauuaaaaa

SEQ ID NO: 2794249 - RNA, 23 nt, Leptospira interrogans serovar lai str. 56601
acgaaacuuuuagaauucuccac

SEQ ID NO: 2794250 - RNA, 18 nt, Leptospira interrogans serovar lai str. 56601
acgaacacauucuaaaau

SEQ ID NO: 2794251 - RNA, 19 nt, Leptospira interrogans serovar lai str. 56601
acgaacacauucuaaaauu

SEQ ID NO: 2794252 - RNA, 21 nt, Leptospira interrogans serovar lai str. 56601
acgaaguuccaacguaccaaa

SEQ ID NO: 2794253 - RNA, 23 nt, Leptospira interrogans serovar lai str. 56601
acgaaucacccaaucuuacaagu

SEQ ID NO: 2794254 - RNA, 21 nt, Leptospira interrogans serovar lai str. 56601
acgaaucgacguuauguggaa

SEQ ID NO: 2794255 - RNA, 14 nt, Leptospira interrogans serovar lai str. 56601
acgaaucuaauuua

SEQ ID NO: 2794256 - RNA, 13 nt, Leptospira interrogans serovar lai str. 56601
acgaaucuguucg

SEQ ID NO: 2794257 - RNA, 15 nt, Leptospira interrogans serovar lai str. 56601
acgaauuaaauacgu

SEQ ID NO: 2794258 - RNA, 22 nt, Leptospira interrogans serovar lai str. 56601
acgaauuacguagcgaagaaua

SEQ ID NO: 2794259 - RNA, 18 nt, Leptospira interrogans serovar lai str. 56601
acgaauugauaaaaccgu

SEQ ID NO: 2794260 - RNA, 21 nt, Leptospira interrogans serovar lai str. 56601
acgaauugcacauaaaagacc

SEQ ID NO: 2794261 - RNA, 14 nt, Leptospira interrogans serovar lai str. 56601
acgaauuuuuaaau

SEQ ID NO: 2794262 - RNA, 18 nt, Leptospira interrogans serovar lai str. 56601
acgaauuuuuuagaaacu

SEQ ID NO: 2794263 - RNA, 14 nt, Leptospira interrogans serovar lai str. 56601
acgacaaaucuucu

SEQ ID NO: 2794264 - RNA, 22 nt, Leptospira interrogans serovar lai str. 56601
acgacagauucaauuuuuauaa

SEQ ID NO: 2794265 - RNA, 15 nt, Leptospira interrogans serovar lai str. 56601
acgacauuagaacua

SEQ ID NO: 2794266 - RNA, 12 nt, Leptospira interrogans serovar lai str. 56601
acgacauuuuag

SEQ ID NO: 2794267 - RNA, 20 nt, Leptospira interrogans serovar lai str. 56601
acgacucguaauuaaauuuu

SEQ ID NO: 2794268 - RNA, 17 nt, Leptospira interrogans serovar lai str. 56601
acgacuuuauucaaaau

SEQ ID NO: 2794269 - RNA, 22 nt, Leptospira interrogans serovar lai str. 56601
acgacuuuauucaaaauagaau

SEQ ID NO: 2794270 - RNA, 14 nt, Leptospira interrogans serovar lai str. 56601
acgagaaagaauuu

SEQ ID NO: 2794271 - RNA, 20 nt, Leptospira interrogans serovar lai str. 56601
acgagcaucuuuagaaugag

SEQ ID NO: 2794272 - RNA, 22 nt, Leptospira interrogans serovar lai str. 56601
acgagucuuuuguuuaaaauuu

SEQ ID NO: 2794273 - RNA, 15 nt, Leptospira interrogans serovar lai str. 56601
acgauaauuuucuuu

SEQ ID NO: 2794274 - RNA, 17 nt, Leptospira interrogans serovar lai str. 56601
acgauaauuuucuuuag

SEQ ID NO: 2794275 - RNA, 15 nt, Leptospira interrogans serovar lai str. 56601
acgauacuuaaaaau

SEQ ID NO: 2794276 - RNA, 14 nt, Leptospira interrogans serovar lai str. 56601
acgaucagaaaaac

SEQ ID NO: 2794277 - RNA, 14 nt, Leptospira interrogans serovar lai str. 56601
acgaucuaaaagga

SEQ ID NO: 2794278 - RNA, 21 nt, Leptospira interrogans serovar lai str. 56601
acgaucugcuuuuuuaaaccu

SEQ ID NO: 2794279 - RNA, 22 nt, Leptospira interrogans serovar lai str. 56601
acgaucugcuuuuuuaaaccuu

SEQ ID NO: 2794280 - RNA, 22 nt, Leptospira interrogans serovar lai str. 56601
acgaugagccaucuuuuuuugc

SEQ ID NO: 2794281 - RNA, 16 nt, Leptospira interrogans serovar lai str. 56601
acgauuaaauuuugaa

SEQ ID NO: 2794282 - RNA, 14 nt, Leptospira interrogans serovar lai str. 56601
acgauuauuuuuua

SEQ ID NO: 2794283 - RNA, 19 nt, Leptospira interrogans serovar lai str. 56601
acgauuauuuuuuaaaaau

SEQ ID NO: 2794284 - RNA, 22 nt, Leptospira interrogans serovar lai str. 56601
acgauucaguuuuacuguaaaa

SEQ ID NO: 2794285 - RNA, 16 nt, Leptospira interrogans serovar lai str. 56601
acgauuccauuuuuua

SEQ ID NO: 2794286 - RNA, 21 nt, Leptospira interrogans serovar lai str. 56601
acgauucgaaagauuuuucau

SEQ ID NO: 2794287 - RNA, 19 nt, Leptospira interrogans serovar lai str. 56601
acguugaauaagauuuuag

SEQ ID NO: 2794288 - RNA, 18 nt, Leptospira interrogans serovar lai str. 56601
acguuuccagaaagcucu

SEQ ID NO: 2794289 - RNA, 22 nt, Leptospira interrogans serovar lai str. 56601
acguuuuaaucaugugaauuca

SEQ ID NO: 2794290 - RNA, 15 nt, Leptospira interrogans serovar lai str. 56601
acguuuuauuauaua

SEQ ID NO: 2794291 - RNA, 9 nt, Leptospira interrogans serovar lai str. 56601
acuaaaaaa

SEQ ID NO: 2794292 - RNA, 10 nt, Leptospira interrogans serovar lai str. 56601
acuaaaaaac

SEQ ID NO: 2794293 - RNA, 13 nt, Leptospira interrogans serovar lai str. 56601
acuaaaaaacaua

SEQ ID NO: 2794294 - RNA, 14 nt, Leptospira interrogans serovar lai str. 56601
acuaaaaaacauaa

SEQ ID NO: 2794295 - RNA, 14 nt, Leptospira interrogans serovar lai str. 56601
acuaaaauuuuaua

SEQ ID NO: 2794296 - RNA, 18 nt, Leptospira interrogans serovar lai str. 56601
acuaaaauuuuauaaaaa

SEQ ID NO: 2794297 - RNA, 22 nt, Leptospira interrogans serovar lai str. 56601
acuaaaccaccaaccgaaacuu

SEQ ID NO: 2794298 - RNA, 18 nt, Leptospira interrogans serovar lai str. 56601
acuaaacgauuuuauaca

SEQ ID NO: 2794299 - RNA, 11 nt, Leptospira interrogans serovar lai str. 56601
acuaaauuagu

SEQ ID NO: 2794300 - RNA, 15 nt, Leptospira interrogans serovar lai str. 56601
acuaaauuaguucuu

SEQ ID NO: 2794301 - RNA, 13 nt, Leptospira interrogans serovar lai str. 56601
acuaaauuuuucg

SEQ ID NO: 2794302 - RNA, 17 nt, Leptospira interrogans serovar lai str. 56601
acuaacgcucauuucca

SEQ ID NO: 2794303 - RNA, 12 nt, Leptospira interrogans serovar lai str. 56601
acuaaggcccac

SEQ ID NO: 2794304 - RNA, 19 nt, Leptospira interrogans serovar lai str. 56601
acuaaguaaaaaugcaaau

SEQ ID NO: 2794305 - RNA, 18 nt, Leptospira interrogans serovar lai str. 56601
acuaaguuaagcugaaaa

SEQ ID NO: 2794306 - RNA, 15 nt, Leptospira interrogans serovar lai str. 56601
acuaauaaaaacaau

SEQ ID NO: 2794307 - RNA, 13 nt, Leptospira interrogans serovar lai str. 56601
acuaauaaaaaug

SEQ ID NO: 2794308 - RNA, 14 nt, Leptospira interrogans serovar lai str. 56601
acuaauauguuuag

SEQ ID NO: 2794309 - RNA, 19 nt, Leptospira interrogans serovar lai str. 56601
acuaaucucuauaaaagua

SEQ ID NO: 2794310 - RNA, 15 nt, Leptospira interrogans serovar lai str. 56601
acuaaugcaaguucu

SEQ ID NO: 2794311 - RNA, 20 nt, Leptospira interrogans serovar lai str. 56601
acuaauucaauaaguuuaca

SEQ ID NO: 2794312 - RNA, 17 nt, Leptospira interrogans serovar lai str. 56601
acuaauucuuuugcaua

SEQ ID NO: 2794313 - RNA, 19 nt, Leptospira interrogans serovar lai str. 56601
acuaauucuuuugcauagu

SEQ ID NO: 2794314 - RNA, 16 nt, Leptospira interrogans serovar lai str. 56601
acuaauuuguaggaau

SEQ ID NO: 2794315 - RNA, 21 nt, Leptospira interrogans serovar lai str. 56601
acuaauuuguaggaauuacua

SEQ ID NO: 2794316 - RNA, 16 nt, Leptospira interrogans serovar lai str. 56601
acuaauuuuaguuuau

SEQ ID NO: 2794317 - RNA, 16 nt, Leptospira interrogans serovar lai str. 56601
acuacaagauuucguu

SEQ ID NO: 2794318 - RNA, 15 nt, Leptospira interrogans serovar lai str. 56601
acuacaaucacuuua

SEQ ID NO: 2794319 - RNA, 16 nt, Leptospira interrogans serovar lai str. 56601
acuacaauuuuagaau

SEQ ID NO: 2794320 - RNA, 21 nt, Leptospira interrogans serovar lai str. 56601
acuacacgagagcugcuugaa

SEQ ID NO: 2794321 - RNA, 15 nt, Leptospira interrogans serovar lai str. 56601
acuacagaauaaagu

SEQ ID NO: 2794322 - RNA, 21 nt, Leptospira interrogans serovar lai str. 56601
acuacagaauuuuuuaacaau

SEQ ID NO: 2794323 - RNA, 17 nt, Leptospira interrogans serovar lai str. 56601
acuacagcaaaucacga

SEQ ID NO: 2794324 - RNA, 17 nt, Leptospira interrogans serovar lai str. 56601
acuacaucgucuucuuu

SEQ ID NO: 2794325 - RNA, 19 nt, Leptospira interrogans serovar lai str. 56601
acuacauuugauuaaaaau

SEQ ID NO: 2794326 - RNA, 14 nt, Leptospira interrogans serovar lai str. 56601
acuaccacaaaacu

SEQ ID NO: 2794327 - RNA, 18 nt, Leptospira interrogans serovar lai str. 56601
acuaccaccaaaguauga

SEQ ID NO: 2794328 - RNA, 15 nt, Leptospira interrogans serovar lai str. 56601
acuaccgcaaaucaa

SEQ ID NO: 2794329 - RNA, 22 nt, Leptospira interrogans serovar lai str. 56601
acuaccuuuauuccuuuucuuu

SEQ ID NO: 2794330 - RNA, 12 nt, Leptospira interrogans serovar lai str. 56601
acuacuaauuua

SEQ ID NO: 2794331 - RNA, 15 nt, Leptospira interrogans serovar lai str. 56601
acuacuacaaaucac

SEQ ID NO: 2794332 - RNA, 16 nt, Leptospira interrogans serovar lai str. 56601
acuacuauaaauuacu

SEQ ID NO: 2794333 - RNA, 20 nt, Leptospira interrogans serovar lai str. 56601
acuacuauguuuuuggguuu

SEQ ID NO: 2794334 - RNA, 16 nt, Leptospira interrogans serovar lai str. 56601
acuacucacaaauugu

SEQ ID NO: 2794335 - RNA, 18 nt, Leptospira interrogans serovar lai str. 56601
acuacucacaaauuguca

SEQ ID NO: 2794336 - RNA, 14 nt, Leptospira interrogans serovar lai str. 56601
acuacuuuuagaaa

SEQ ID NO: 2794337 - RNA, 21 nt, Leptospira interrogans serovar lai str. 56601
acuacuuuuagaaaauuuuua

SEQ ID NO: 2794338 - RNA, 15 nt, Leptospira interrogans serovar lai str. 56601
acuagggaauuuuuc

SEQ ID NO: 2794339 - RNA, 11 nt, Leptospira interrogans serovar lai str. 56601
acuaguuccuu

SEQ ID NO: 2794340 - RNA, 22 nt, Leptospira interrogans serovar lai str. 56601
acuauaaauuacugauuucaaa

SEQ ID NO: 2794341 - RNA, 14 nt, Leptospira interrogans serovar lai str. 56601
acuauaauaacaaa

SEQ ID NO: 2794342 - RNA, 13 nt, Leptospira interrogans serovar lai str. 56601
acuauaauuuccg

SEQ ID NO: 2794343 - RNA, 14 nt, Leptospira interrogans serovar lai str. 56601
acuauacaaauaga

SEQ ID NO: 2794344 - RNA, 12 nt, Leptospira interrogans serovar lai str. 56601
acuauagagaaa

SEQ ID NO: 2794345 - RNA, 17 nt, Leptospira interrogans serovar lai str. 56601
acuauagagaaauccaa

SEQ ID NO: 2794346 - RNA, 20 nt, Leptospira interrogans serovar lai str. 56601
acuaucaacaagaaugaaaa

SEQ ID NO: 2794347 - RNA, 22 nt, Leptospira interrogans serovar lai str. 56601
acuaucacaaaaaugaaaaaac

SEQ ID NO: 2794348 - RNA, 16 nt, Leptospira interrogans serovar lai str. 56601
acuaucacaaaucuau

SEQ ID NO: 2794349 - RNA, 17 nt, Leptospira interrogans serovar lai str. 56601
acuaucuuaaaaugauu

SEQ ID NO: 2794350 - RNA, 21 nt, Leptospira interrogans serovar lai str. 56601
acuaugaaauacaaaaagaau

SEQ ID NO: 2794351 - RNA, 15 nt, Leptospira interrogans serovar lai str. 56601
acuaugaaauuuuuc

SEQ ID NO: 2794352 - RNA, 16 nt, Leptospira interrogans serovar lai str. 56601
acuaugaaauuuuuca

SEQ ID NO: 2794353 - RNA, 19 nt, Leptospira interrogans serovar lai str. 56601
acuaugaagucuuaucuca

SEQ ID NO: 2794354 - RNA, 20 nt, Leptospira interrogans serovar lai str. 56601
acuauggaauauaaaagaau

SEQ ID NO: 2794355 - RNA, 13 nt, Leptospira interrogans serovar lai str. 56601
acuauggaauuuu

SEQ ID NO: 2794356 - RNA, 15 nt, Leptospira interrogans serovar lai str. 56601
acuauggaauuuuuu

SEQ ID NO: 2794357 - RNA, 18 nt, Leptospira interrogans serovar lai str. 56601
acuauggaauuuuuuaac

SEQ ID NO: 2794358 - RNA, 21 nt, Leptospira interrogans serovar lai str. 56601
acuauuaaauugaguuuucca

SEQ ID NO: 2794359 - RNA, 21 nt, Leptospira interrogans serovar lai str. 56601
acuauuacaaaucgacgauuu

SEQ ID NO: 2794360 - RNA, 14 nt, Leptospira interrogans serovar lai str. 56601
acuauuauaaaaua

SEQ ID NO: 2794361 - RNA, 23 nt, Leptospira interrogans serovar lai str. 56601
acuauuaucuuucgauuuuaaau

SEQ ID NO: 2794362 - RNA, 16 nt, Leptospira interrogans serovar lai str. 56601
acuauuuauaaaauaa

SEQ ID NO: 2794363 - RNA, 13 nt, Leptospira interrogans serovar lai str. 56601
acuauuucuucca

SEQ ID NO: 2794364 - RNA, 14 nt, Leptospira interrogans serovar lai str. 56601
acuauuuuauuaca

SEQ ID NO: 2794365 - RNA, 21 nt, Leptospira interrogans serovar lai str. 56601
acuauuuuauuacaauuuuau

SEQ ID NO: 2794366 - RNA, 23 nt, Leptospira interrogans serovar lai str. 56601
acucaacacaacggcucucuccu

SEQ ID NO: 2794367 - RNA, 17 nt, Leptospira interrogans serovar lai str. 56601
acucaacgauaagaaua

SEQ ID NO: 2794368 - RNA, 23 nt, Leptospira interrogans serovar lai str. 56601
acucaauccgaauaguuuacaua

SEQ ID NO: 2794369 - RNA, 18 nt, Leptospira interrogans serovar lai str. 56601
acucacaccuucuuuuuu

SEQ ID NO: 2794370 - RNA, 13 nt, Leptospira interrogans serovar lai str. 56601
acuuaaaaugaga

SEQ ID NO: 2794371 - RNA, 21 nt, Leptospira interrogans serovar lai str. 56601
acuuaaauucggaaauuuuaa

SEQ ID NO: 2794372 - RNA, 18 nt, Leptospira interrogans serovar lai str. 56601
acuuaaucugugggaacu

SEQ ID NO: 2794373 - RNA, 21 nt, Leptospira interrogans serovar lai str. 56601
acuuaaucugugggaacucuc

SEQ ID NO: 2794374 - RNA, 22 nt, Leptospira interrogans serovar lai str. 56601
acuuaaugagauuaaaacugcu

SEQ ID NO: 2794375 - RNA, 13 nt, Leptospira interrogans serovar lai str. 56601
acuuaauuuuucu

SEQ ID NO: 2794376 - RNA, 17 nt, Leptospira interrogans serovar lai str. 56601
acuuacagauugauuuu

SEQ ID NO: 2794377 - RNA, 23 nt, Leptospira interrogans serovar lai str. 56601
acuuacagauugauuuuuuaaau

SEQ ID NO: 2794378 - RNA, 19 nt, Leptospira interrogans serovar lai str. 56601
acuuaccccgaaauacaua

SEQ ID NO: 2794379 - RNA, 20 nt, Leptospira interrogans serovar lai str. 56601
acuuacugaaagcuugaaag

SEQ ID NO: 2794380 - RNA, 21 nt, Leptospira interrogans serovar lai str. 56601
acuuagaaagauagagaauga

SEQ ID NO: 2794381 - RNA, 14 nt, Leptospira interrogans serovar lai str. 56601
acuuagaauuuuuu

SEQ ID NO: 2794382 - RNA, 22 nt, Leptospira interrogans serovar lai str. 56601
acuuaggauaaaacggauuucu

SEQ ID NO: 2794383 - RNA, 23 nt, Leptospira interrogans serovar lai str. 56601
acuuagguuuguacguaaaaaug

SEQ ID NO: 2794384 - RNA, 14 nt, Leptospira interrogans serovar lai str. 56601
acuuagucuuuguu

SEQ ID NO: 2794385 - RNA, 12 nt, Leptospira interrogans serovar lai str. 56601
acuuauaagaca

SEQ ID NO: 2794386 - RNA, 15 nt, Leptospira interrogans serovar lai str. 56601
acuuauaauaaaauc

SEQ ID NO: 2794387 - RNA, 16 nt, Leptospira interrogans serovar lai str. 56601
acuuauaauuuucuua

SEQ ID NO: 2794388 - RNA, 21 nt, Leptospira interrogans serovar lai str. 56601
acuuaucacgaaaauuaaaaa

SEQ ID NO: 2794389 - RNA, 22 nt, Leptospira interrogans serovar lai str. 56601
acuuaucacgaaaauuaaaaaa

SEQ ID NO: 2794390 - RNA, 15 nt, Leptospira interrogans serovar lai str. 56601
acuucaaaaaauaua

SEQ ID NO: 2794391 - RNA, 13 nt, Leptospira interrogans serovar lai str. 56601
acuucagccgcuu

SEQ ID NO: 2794392 - RNA, 19 nt, Leptospira interrogans serovar lai str. 56601
acuucauccgggcuuuucu

SEQ ID NO: 2794393 - RNA, 23 nt, Leptospira interrogans serovar lai str. 56601
acuucauucggcuuuaagugaac

SEQ ID NO: 2794394 - RNA, 15 nt, Leptospira interrogans serovar lai str. 56601
acuucauuguuugaa

SEQ ID NO: 2794395 - RNA, 17 nt, Leptospira interrogans serovar lai str. 56601
acuuccaucagaauaga

SEQ ID NO: 2794396 - RNA, 15 nt, Leptospira interrogans serovar lai str. 56601
acuucggaacauaag

SEQ ID NO: 2794397 - RNA, 13 nt, Leptospira interrogans serovar lai str. 56601
acuucguugaaaa

SEQ ID NO: 2794398 - RNA, 20 nt, Leptospira interrogans serovar lai str. 56601
acuucuaaaaaauucuuucu

SEQ ID NO: 2794399 - RNA, 13 nt, Leptospira interrogans serovar lai str. 56601
acuucucacaaau

SEQ ID NO: 2794400 - RNA, 16 nt, Leptospira interrogans serovar lai str. 56601
acuucucacaaaucau

SEQ ID NO: 2794401 - RNA, 13 nt, Leptospira interrogans serovar lai str. 56601
acuucucauucuu

SEQ ID NO: 2794402 - RNA, 17 nt, Leptospira interrogans serovar lai str. 56601
acuucucuuaaaauuua

SEQ ID NO: 2794403 - RNA, 18 nt, Leptospira interrogans serovar lai str. 56601
acuucucuuaaaauuuag

SEQ ID NO: 2794404 - RNA, 17 nt, Leptospira interrogans serovar lai str. 56601
acuucugguuuuuuaau

SEQ ID NO: 2794405 - RNA, 13 nt, Leptospira interrogans serovar lai str. 56601
acuucuucaucuu

SEQ ID NO: 2794406 - RNA, 17 nt, Leptospira interrogans serovar lai str. 56601
acuucuuccauucuaaa

SEQ ID NO: 2794407 - RNA, 23 nt, Leptospira interrogans serovar lai str. 56601
acuucuuuuuuguaaguuuugaa

SEQ ID NO: 2794408 - RNA, 17 nt, Leptospira interrogans serovar lai str. 56601
acuugaaaauaaaaauc

SEQ ID NO: 2794409 - RNA, 20 nt, Leptospira interrogans serovar lai str. 56601
acuugaaaauaaaaaucaua

SEQ ID NO: 2794410 - RNA, 22 nt, Leptospira interrogans serovar lai str. 56601
acuugaaaauaaaaaucauaaa

SEQ ID NO: 2794411 - RNA, 14 nt, Leptospira interrogans serovar lai str. 56601
acuugaacuguuua

SEQ ID NO: 2794412 - RNA, 19 nt, Leptospira interrogans serovar lai str. 56601
acuugauauuucuggaaau

SEQ ID NO: 2794413 - RNA, 22 nt, Leptospira interrogans serovar lai str. 56601
acuugauuuuaccguuuuuaaa

SEQ ID NO: 2794414 - RNA, 23 nt, Leptospira interrogans serovar lai str. 56601
acuugauuuuaccguuuuuaaau

SEQ ID NO: 2794415 - RNA, 15 nt, Leptospira interrogans serovar lai str. 56601
acuugcaaaaaguau

SEQ ID NO: 2794416 - RNA, 16 nt, Leptospira interrogans serovar lai str. 56601
acuugccauggaaauu

SEQ ID NO: 2794417 - RNA, 22 nt, Leptospira interrogans serovar lai str. 56601
acuugccauggaaauuuuuccg

SEQ ID NO: 2794418 - RNA, 14 nt, Leptospira interrogans serovar lai str. 56601
acuuguaaaacagc

SEQ ID NO: 2794419 - RNA, 14 nt, Leptospira interrogans serovar lai str. 56601
acuugucccaaaau

SEQ ID NO: 2794420 - RNA, 16 nt, Leptospira interrogans serovar lai str. 56601
acuugucccaaaauuu

SEQ ID NO: 2794421 - RNA, 13 nt, Leptospira interrogans serovar lai str. 56601
acuugucucagaa

SEQ ID NO: 2794422 - RNA, 14 nt, Leptospira interrogans serovar lai str. 56601
acuugucucagaac

SEQ ID NO: 2794423 - RNA, 17 nt, Leptospira interrogans serovar lai str. 56601
acuugucuuuagaacuu

SEQ ID NO: 2794424 - RNA, 12 nt, Leptospira interrogans serovar lai str. 56601
acuuuaaaaaau

SEQ ID NO: 2794425 - RNA, 15 nt, Leptospira interrogans serovar lai str. 56601
acuuuaaaaaauaag

SEQ ID NO: 2794426 - RNA, 12 nt, Leptospira interrogans serovar lai str. 56601
acuuuaaaacau

SEQ ID NO: 2794427 - RNA, 17 nt, Leptospira interrogans serovar lai str. 56601
acuuuaaauacuuuaua

SEQ ID NO: 2794428 - RNA, 14 nt, Leptospira interrogans serovar lai str. 56601
acuuuaauaauaua

SEQ ID NO: 2794429 - RNA, 16 nt, Leptospira interrogans serovar lai str. 56601
acuuuaauaauaugaa

SEQ ID NO: 2794430 - RNA, 18 nt, Leptospira interrogans serovar lai str. 56601
acuuuaaucauuuucaau

SEQ ID NO: 2794431 - RNA, 14 nt, Leptospira interrogans serovar lai str. 56601
acuuuaauuuuagu

SEQ ID NO: 2794432 - RNA, 23 nt, Leptospira interrogans serovar lai str. 56601
acuuuaauuuucuuaguuuugua

SEQ ID NO: 2794433 - RNA, 20 nt, Leptospira interrogans serovar lai str. 56601
acuuuacacgauaauuuuua

SEQ ID NO: 2794434 - RNA, 20 nt, Leptospira interrogans serovar lai str. 56601
acuuuacagaucaauucuuu

SEQ ID NO: 2794435 - RNA, 14 nt, Leptospira interrogans serovar lai str. 56601
acuuuacauuuuua

SEQ ID NO: 2794436 - RNA, 15 nt, Leptospira interrogans serovar lai str. 56601
acuuuacauuuuuau

SEQ ID NO: 2794437 - RNA, 18 nt, Leptospira interrogans serovar lai str. 56601
acuuuacgaaaguugaaa

SEQ ID NO: 2794438 - RNA, 15 nt, Leptospira interrogans serovar lai str. 56601
acuuuacgaguuuaa

SEQ ID NO: 2794439 - RNA, 16 nt, Leptospira interrogans serovar lai str. 56601
acuuuacgaguuuaac

SEQ ID NO: 2794440 - RNA, 22 nt, Leptospira interrogans serovar lai str. 56601
acuuuacggucggcaagaucuu

SEQ ID NO: 2794441 - RNA, 16 nt, Leptospira interrogans serovar lai str. 56601
acuuuagaaaaauauu

SEQ ID NO: 2794442 - RNA, 18 nt, Leptospira interrogans serovar lai str. 56601
acuuuagagcaguucaau

SEQ ID NO: 2794443 - RNA, 13 nt, Leptospira interrogans serovar lai str. 56601
acuuuauaaaagu

SEQ ID NO: 2794444 - RNA, 13 nt, Leptospira interrogans serovar lai str. 56601
acuuuauagaaaa

SEQ ID NO: 2794445 - RNA, 21 nt, Leptospira interrogans serovar lai str. 56601
acuuuaucuuuucuuaaaauu

SEQ ID NO: 2794446 - RNA, 16 nt, Leptospira interrogans serovar lai str. 56601
acuuuauucaaaauag

SEQ ID NO: 2794447 - RNA, 14 nt, Leptospira interrogans serovar lai str. 56601
acuuuauuuacagu

SEQ ID NO: 2794448 - RNA, 21 nt, Leptospira interrogans serovar lai str. 56601
acuuuauuuacaguucugagu

SEQ ID NO: 2794449 - RNA, 22 nt, Leptospira interrogans serovar lai str. 56601
acuuuauuuguauucaagagca

SEQ ID NO: 2794450 - RNA, 23 nt, Leptospira interrogans serovar lai str. 56601
acuuuauuuguauucaagagcaa

SEQ ID NO: 2794451 - RNA, 13 nt, Leptospira interrogans serovar lai str. 56601
acuuucaaaaaau

SEQ ID NO: 2794452 - RNA, 14 nt, Leptospira interrogans serovar lai str. 56601
acuuucagcuacaa

SEQ ID NO: 2794453 - RNA, 21 nt, Leptospira interrogans serovar lai str. 56601
agaaacguaauacgauauuuu

SEQ ID NO: 2794454 - RNA, 22 nt, Leptospira interrogans serovar lai str. 56601
agaaacguuauacaauauuucg

SEQ ID NO: 2794455 - RNA, 15 nt, Leptospira interrogans serovar lai str. 56601
agaaacuaaugcaag

SEQ ID NO: 2794456 - RNA, 17 nt, Leptospira interrogans serovar lai str. 56601
agaaacuauuauacuuu

SEQ ID NO: 2794457 - RNA, 18 nt, Leptospira interrogans serovar lai str. 56601
agaaacuauuauacuuua

SEQ ID NO: 2794458 - RNA, 22 nt, Leptospira interrogans serovar lai str. 56601
agaaacucauuuuucuaaaaaa

SEQ ID NO: 2794459 - RNA, 15 nt, Leptospira interrogans serovar lai str. 56601
agaaacuuauacuuu

SEQ ID NO: 2794460 - RNA, 13 nt, Leptospira interrogans serovar lai str. 56601
agaaagaacaaga

SEQ ID NO: 2794461 - RNA, 17 nt, Leptospira interrogans serovar lai str. 56601
agaaagaauuucuaaaa

SEQ ID NO: 2794462 - RNA, 20 nt, Leptospira interrogans serovar lai str. 56601
agaaagaauuuguucauaaa

SEQ ID NO: 2794463 - RNA, 18 nt, Leptospira interrogans serovar lai str. 56601
agaaagaauuuucuaaaa

SEQ ID NO: 2794464 - RNA, 11 nt, Leptospira interrogans serovar lai str. 56601
agaaagcagca

SEQ ID NO: 2794465 - RNA, 15 nt, Leptospira interrogans serovar lai str. 56601
agaaagcagcaaaga

SEQ ID NO: 2794466 - RNA, 16 nt, Leptospira interrogans serovar lai str. 56601
agaaagcagcaaagaa

SEQ ID NO: 2794467 - RNA, 17 nt, Leptospira interrogans serovar lai str. 56601
agaaagcagcaaagaag

SEQ ID NO: 2794468 - RNA, 22 nt, Leptospira interrogans serovar lai str. 56601
agaaagcccguucuguugaguu

SEQ ID NO: 2794469 - RNA, 18 nt, Leptospira interrogans serovar lai str. 56601
agaaagcgugacuaaaau

SEQ ID NO: 2794470 - RNA, 22 nt, Leptospira interrogans serovar lai str. 56601
agaaagcgugacuaaaauugac

SEQ ID NO: 2794471 - RNA, 19 nt, Leptospira interrogans serovar lai str. 56601
agaaaggaacuaaguuuaa

SEQ ID NO: 2794472 - RNA, 16 nt, Leptospira interrogans serovar lai str. 56601
agaaaggagaacucau

SEQ ID NO: 2794473 - RNA, 18 nt, Leptospira interrogans serovar lai str. 56601
agaaagguauagaaguuc

SEQ ID NO: 2794474 - RNA, 18 nt, Leptospira interrogans serovar lai str. 56601
agaaaguugcaaagaaga

SEQ ID NO: 2794475 - RNA, 14 nt, Leptospira interrogans serovar lai str. 56601
agaaaguuuauaaa

SEQ ID NO: 2794476 - RNA, 15 nt, Leptospira interrogans serovar lai str. 56601
agaaaguuuauaaag

SEQ ID NO: 2794477 - RNA, 16 nt, Leptospira interrogans serovar lai str. 56601
agaaauaaguaaaucu

SEQ ID NO: 2794478 - RNA, 14 nt, Leptospira interrogans serovar lai str. 56601
agaaauacuuaaaa

SEQ ID NO: 2794479 - RNA, 18 nt, Leptospira interrogans serovar lai str. 56601
agaaauacuuaaaaugag

SEQ ID NO: 2794480 - RNA, 19 nt, Leptospira interrogans serovar lai str. 56601
agaaauauggcaucuccga

SEQ ID NO: 2794481 - RNA, 17 nt, Leptospira interrogans serovar lai str. 56601
agaaauauuaaaaaaau

SEQ ID NO: 2794482 - RNA, 14 nt, Leptospira interrogans serovar lai str. 56601
agaaauauuuagaa

SEQ ID NO: 2794483 - RNA, 20 nt, Leptospira interrogans serovar lai str. 56601
agaaaucaauggaaaauuaa

SEQ ID NO: 2794484 - RNA, 18 nt, Leptospira interrogans serovar lai str. 56601
agaaaucaauucuucuuu

SEQ ID NO: 2794485 - RNA, 17 nt, Leptospira interrogans serovar lai str. 56601
agaaaucauauggauua

SEQ ID NO: 2794486 - RNA, 18 nt, Leptospira interrogans serovar lai str. 56601
agaaaucgauuuguaaaa

SEQ ID NO: 2794487 - RNA, 23 nt, Leptospira interrogans serovar lai str. 56601
agaaaucgauuuguaaaauucag

SEQ ID NO: 2794488 - RNA, 22 nt, Leptospira interrogans serovar lai str. 56601
agaaaugugggaacucccacuu

SEQ ID NO: 2794489 - RNA, 21 nt, Leptospira interrogans serovar lai str. 56601
agaaauuaaaguauccauucg

SEQ ID NO: 2794490 - RNA, 14 nt, Leptospira interrogans serovar lai str. 56601
agaaauuaauuucu

SEQ ID NO: 2794491 - RNA, 22 nt, Leptospira interrogans serovar lai str. 56601
agaaauuaauuucuaaacaauu

SEQ ID NO: 2794492 - RNA, 21 nt, Leptospira interrogans serovar lai str. 56601
agaaauuauaguaacagaaaa

SEQ ID NO: 2794493 - RNA, 20 nt, Leptospira interrogans serovar lai str. 56601
agaaauugauuaaucuguaa

SEQ ID NO: 2794494 - RNA, 17 nt, Leptospira interrogans serovar lai str. 56601
agaaauuucuaauaaaa

SEQ ID NO: 2794495 - RNA, 19 nt, Leptospira interrogans serovar lai str. 56601
agaaauuucuaauaaaaua

SEQ ID NO: 2794496 - RNA, 21 nt, Leptospira interrogans serovar lai str. 56601
agaaauuuuacacguaauucu

SEQ ID NO: 2794497 - RNA, 14 nt, Leptospira interrogans serovar lai str. 56601
agaaauuuucaaaa

SEQ ID NO: 2794498 - RNA, 22 nt, Leptospira interrogans serovar lai str. 56601
agaaauuuucaaaaaauaucau

SEQ ID NO: 2794499 - RNA, 12 nt, Leptospira interrogans serovar lai str. 56601
agaaauuuuuaa

SEQ ID NO: 2794500 - RNA, 15 nt, Leptospira interrogans serovar lai str. 56601
agaaauuuuuaauaa

SEQ ID NO: 2794501 - RNA, 19 nt, Leptospira interrogans serovar lai str. 56601
agaaauuuuuaauaaaaug

SEQ ID NO: 2794502 - RNA, 20 nt, Leptospira interrogans serovar lai str. 56601
agaaauuuuuaauaaaaugc

SEQ ID NO: 2794503 - RNA, 23 nt, Leptospira interrogans serovar lai str. 56601
agaaauuuuuaauaaaauguagu

SEQ ID NO: 2794504 - RNA, 15 nt, Leptospira interrogans serovar lai str. 56601
agaaauuuuuaauca

SEQ ID NO: 2794505 - RNA, 17 nt, Leptospira interrogans serovar lai str. 56601
agaaauuuuuaaucaaa

SEQ ID NO: 2794506 - RNA, 18 nt, Leptospira interrogans serovar lai str. 56601
agaaauuuuuaaucaaau

SEQ ID NO: 2794507 - RNA, 13 nt, Leptospira interrogans serovar lai str. 56601
agaacaaaauuua

SEQ ID NO: 2794508 - RNA, 21 nt, Leptospira interrogans serovar lai str. 56601
agaacaacccccguuauuaaa

SEQ ID NO: 2794509 - RNA, 17 nt, Leptospira interrogans serovar lai str. 56601
agaacaagauuaacaau

SEQ ID NO: 2794510 - RNA, 20 nt, Leptospira interrogans serovar lai str. 56601
agaaccaucucaaaaauauc

SEQ ID NO: 2794511 - RNA, 19 nt, Leptospira interrogans serovar lai str. 56601
agaacccaauaaaaacuaa

SEQ ID NO: 2794512 - RNA, 18 nt, Leptospira interrogans serovar lai str. 56601
agaaccgaauaucggaau

SEQ ID NO: 2794513 - RNA, 18 nt, Leptospira interrogans serovar lai str. 56601
agaaccgggcaauaaugu

SEQ ID NO: 2794514 - RNA, 14 nt, Leptospira interrogans serovar lai str. 56601
agaaccuaaaaaua

SEQ ID NO: 2794515 - RNA, 22 nt, Leptospira interrogans serovar lai str. 56601
agaaccuaauguugaaugaaac

SEQ ID NO: 2794516 - RNA, 17 nt, Leptospira interrogans serovar lai str. 56601
agaaccuggaaaagaau

SEQ ID NO: 2794517 - RNA, 19 nt, Leptospira interrogans serovar lai str. 56601
agaaccuuuaguuuccaaa

SEQ ID NO: 2794518 - RNA, 13 nt, Leptospira interrogans serovar lai str. 56601
agaacgaacuaau

SEQ ID NO: 2794519 - RNA, 16 nt, Leptospira interrogans serovar lai str. 56601
agaacgauccguaaaa

SEQ ID NO: 2794520 - RNA, 21 nt, Leptospira interrogans serovar lai str. 56601
agaacgcgaacuuuuuuauaa

SEQ ID NO: 2794521 - RNA, 15 nt, Leptospira interrogans serovar lai str. 56601
agaacgggcuuucua

SEQ ID NO: 2794522 - RNA, 20 nt, Leptospira interrogans serovar lai str. 56601
agaacgugucauguuuuaau

SEQ ID NO: 2794523 - RNA, 18 nt, Leptospira interrogans serovar lai str. 56601
agaacuacuuuuauaaaa

SEQ ID NO: 2794524 - RNA, 19 nt, Leptospira interrogans serovar lai str. 56601
agaacuacuuuuauaaaaa

SEQ ID NO: 2794525 - RNA, 20 nt, Leptospira interrogans serovar lai str. 56601
agaacuacuuuuauaaaaag

SEQ ID NO: 2794526 - RNA, 21 nt, Leptospira interrogans serovar lai str. 56601
agaacuacuuuuauaaaaagu

SEQ ID NO: 2794527 - RNA, 18 nt, Leptospira interrogans serovar lai str. 56601
agaacuauuaucuuucga

SEQ ID NO: 2794528 - RNA, 22 nt, Leptospira interrogans serovar lai str. 56601
agaacucauucaaguaacgagu

SEQ ID NO: 2794529 - RNA, 23 nt, Leptospira interrogans serovar lai str. 56601
agaacucuuuuaccuuaccaccg

SEQ ID NO: 2794530 - RNA, 21 nt, Leptospira interrogans serovar lai str. 56601
agaacugagagaaaguaaaga

SEQ ID NO: 2794531 - RNA, 22 nt, Leptospira interrogans serovar lai str. 56601
agaacugcaguaguucccgcag

SEQ ID NO: 2794532 - RNA, 18 nt, Leptospira interrogans serovar lai str. 56601
agaacuggauucaaaauu

SEQ ID NO: 2794533 - RNA, 20 nt, Leptospira interrogans serovar lai str. 56601
agaacuuaccccgaaauaca

SEQ ID NO: 2794534 - RNA, 16 nt, Leptospira interrogans serovar lai str. 56601
agaacuugucucagaa

SEQ ID NO: 2794535 - RNA, 23 nt, Leptospira interrogans serovar lai str. 56601
agaauugaaagaagauagauuua

SEQ ID NO: 2794536 - RNA, 16 nt, Leptospira interrogans serovar lai str. 56601
agaauugaaaucugaa

SEQ ID NO: 2794537 - RNA, 20 nt, Leptospira interrogans serovar lai str. 56601
agaauugaguuuuuuauucc

SEQ ID NO: 2794538 - RNA, 18 nt, Leptospira interrogans serovar lai str. 56601
agaauuguugaaaaacuc

SEQ ID NO: 2794539 - RNA, 20 nt, Leptospira interrogans serovar lai str. 56601
agaauuguugaaaaacucca

SEQ ID NO: 2794540 - RNA, 16 nt, Leptospira interrogans serovar lai str. 56601
agaauuguugaaaaau

SEQ ID NO: 2794541 - RNA, 17 nt, Leptospira interrogans serovar lai str. 56601
agaauuguugaaaaauu

SEQ ID NO: 2794542 - RNA, 20 nt, Leptospira interrogans serovar lai str. 56601
agaauuguugaaaaauuaau

SEQ ID NO: 2794543 - RNA, 19 nt, Leptospira interrogans serovar lai str. 56601
agaauuguugaaaaauuua

SEQ ID NO: 2794544 - RNA, 21 nt, Leptospira interrogans serovar lai str. 56601
agaauuguuugaaaguuccca

SEQ ID NO: 2794545 - RNA, 18 nt, Leptospira interrogans serovar lai str. 56601
agaauuuaucauuucuuu

SEQ ID NO: 2794546 - RNA, 18 nt, Leptospira interrogans serovar lai str. 56601
agaauuuauuucaaaauu

SEQ ID NO: 2794547 - RNA, 16 nt, Leptospira interrogans serovar lai str. 56601
agaauuuauuuguaaa

SEQ ID NO: 2794548 - RNA, 18 nt, Leptospira interrogans serovar lai str. 56601
agaauuuauuuguaaaau

SEQ ID NO: 2794549 - RNA, 14 nt, Leptospira interrogans serovar lai str. 56601
agaauuuauuuuca

SEQ ID NO: 2794550 - RNA, 21 nt, Leptospira interrogans serovar lai str. 56601
agaauuuauuuucauaggaaa

SEQ ID NO: 2794551 - RNA, 15 nt, Leptospira interrogans serovar lai str. 56601
agaauuuauuuuuca

SEQ ID NO: 2794552 - RNA, 16 nt, Leptospira interrogans serovar lai str. 56601
agaauuucuaaaagua

SEQ ID NO: 2794553 - RNA, 18 nt, Leptospira interrogans serovar lai str. 56601
agaauuucuauaaaaucu

SEQ ID NO: 2794554 - RNA, 16 nt, Leptospira interrogans serovar lai str. 56601
agaauuucuuucucuc

SEQ ID NO: 2794555 - RNA, 21 nt, Leptospira interrogans serovar lai str. 56601
agaauuuguucuuaaaauugu

SEQ ID NO: 2794556 - RNA, 17 nt, Leptospira interrogans serovar lai str. 56601
agaauuuguuuguaaaa

SEQ ID NO: 2794557 - RNA, 19 nt, Leptospira interrogans serovar lai str. 56601
agaauuuguuuguaaaaua

SEQ ID NO: 2794558 - RNA, 22 nt, Leptospira interrogans serovar lai str. 56601
agaauuuguuugucuuuuucua

SEQ ID NO: 2794559 - RNA, 17 nt, Leptospira interrogans serovar lai str. 56601
agaauuuguuuuuaaaa

SEQ ID NO: 2794560 - RNA, 21 nt, Leptospira interrogans serovar lai str. 56601
agaauuuguuuuuaaaauugu

SEQ ID NO: 2794561 - RNA, 14 nt, Leptospira interrogans serovar lai str. 56601
agaauuuuaaaaaa

SEQ ID NO: 2794562 - RNA, 20 nt, Leptospira interrogans serovar lai str. 56601
agaauuuuaugauuuucuuu

SEQ ID NO: 2794563 - RNA, 23 nt, Leptospira interrogans serovar lai str. 56601
agaauuuuauuguguuuuuucuu

SEQ ID NO: 2794564 - RNA, 16 nt, Leptospira interrogans serovar lai str. 56601
agaauuuucaucaaau

SEQ ID NO: 2794565 - RNA, 18 nt, Leptospira interrogans serovar lai str. 56601
agaauuuucaucaaauac

SEQ ID NO: 2794566 - RNA, 18 nt, Leptospira interrogans serovar lai str. 56601
agaauuuucuaaaaguau

SEQ ID NO: 2794567 - RNA, 19 nt, Leptospira interrogans serovar lai str. 56601
agaauuuucuaaaaguaug

SEQ ID NO: 2794568 - RNA, 18 nt, Leptospira interrogans serovar lai str. 56601
agaauuuucuaaagauuc

SEQ ID NO: 2794569 - RNA, 18 nt, Leptospira interrogans serovar lai str. 56601
agaauuuuguuucuaaaa

SEQ ID NO: 2794570 - RNA, 15 nt, Leptospira interrogans serovar lai str. 56601
agaauuuuuaaaaau

SEQ ID NO: 2794571 - RNA, 16 nt, Leptospira interrogans serovar lai str. 56601
agaauuuuuaaaaaua

SEQ ID NO: 2794572 - RNA, 18 nt, Leptospira interrogans serovar lai str. 56601
agaauuuuucgaaacaaa

SEQ ID NO: 2794573 - RNA, 19 nt, Leptospira interrogans serovar lai str. 56601
agaauuuuucgaaacaaaa

SEQ ID NO: 2794574 - RNA, 16 nt, Leptospira interrogans serovar lai str. 56601
agaauuuuuuaacaau

SEQ ID NO: 2794575 - RNA, 20 nt, Leptospira interrogans serovar lai str. 56601
agacaaacuuuuagauaaga

SEQ ID NO: 2794576 - RNA, 17 nt, Leptospira interrogans serovar lai str. 56601
agacaaauauuucgaca

SEQ ID NO: 2794577 - RNA, 15 nt, Leptospira interrogans serovar lai str. 56601
agacaagaagaaaag

SEQ ID NO: 2794578 - RNA, 16 nt, Leptospira interrogans serovar lai str. 56601
agacaagaagaaaaga

SEQ ID NO: 2794579 - RNA, 15 nt, Leptospira interrogans serovar lai str. 56601
agacauaaaaaaauu

SEQ ID NO: 2794580 - RNA, 20 nt, Leptospira interrogans serovar lai str. 56601
agacauaaaaaaauuaaaaa

SEQ ID NO: 2794581 - RNA, 23 nt, Leptospira interrogans serovar lai str. 56601
agacaugauucauuuuucugaaa

SEQ ID NO: 2794582 - RNA, 18 nt, Leptospira interrogans serovar lai str. 56601
agacauugaagaaaaaaa

SEQ ID NO: 2794583 - RNA, 20 nt, Leptospira interrogans serovar lai str. 56601
agacauugaagaaaaaaaga

SEQ ID NO: 2794584 - RNA, 12 nt, Leptospira interrogans serovar lai str. 56601
agaccaauuuuu

SEQ ID NO: 2794585 - RNA, 18 nt, Leptospira interrogans serovar lai str. 56601
agaccaauuuuuuuguaa

SEQ ID NO: 2794586 - RNA, 20 nt, Leptospira interrogans serovar lai str. 56601
agaccaauuuuuuuguaaaa

SEQ ID NO: 2794587 - RNA, 23 nt, Leptospira interrogans serovar lai str. 56601
agaccaauuuuuuuguaaaaaaa

SEQ ID NO: 2794588 - RNA, 15 nt, Leptospira interrogans serovar lai str. 56601
agaccacaguaggcu

SEQ ID NO: 2794589 - RNA, 22 nt, Leptospira interrogans serovar lai str. 56601
agaccacaguaggcuauuuuac

SEQ ID NO: 2794590 - RNA, 18 nt, Leptospira interrogans serovar lai str. 56601
agaccaguaguauguuuu

SEQ ID NO: 2794591 - RNA, 19 nt, Leptospira interrogans serovar lai str. 56601
agaccagugccauuuuucu

SEQ ID NO: 2794592 - RNA, 14 nt, Leptospira interrogans serovar lai str. 56601
agaccauuuuccuu

SEQ ID NO: 2794593 - RNA, 15 nt, Leptospira interrogans serovar lai str. 56601
agacccuaaaaaauu

SEQ ID NO: 2794594 - RNA, 16 nt, Leptospira interrogans serovar lai str. 56601
agaccucaaauaacuu

SEQ ID NO: 2794595 - RNA, 16 nt, Leptospira interrogans serovar lai str. 56601
agacgaaaaacucagu

SEQ ID NO: 2794596 - RNA, 22 nt, Leptospira interrogans serovar lai str. 56601
agacgaaaagaccauuuuccuu

SEQ ID NO: 2794597 - RNA, 19 nt, Leptospira interrogans serovar lai str. 56601
agacgauuccuaaaaauug

SEQ ID NO: 2794598 - RNA, 14 nt, Leptospira interrogans serovar lai str. 56601
agacgccauguuuu

SEQ ID NO: 2794599 - RNA, 19 nt, Leptospira interrogans serovar lai str. 56601
agacgcugaguuaaccuac

SEQ ID NO: 2794600 - RNA, 17 nt, Leptospira interrogans serovar lai str. 56601
agacguaggaaaugaaa

SEQ ID NO: 2794601 - RNA, 18 nt, Leptospira interrogans serovar lai str. 56601
agacguauuauccauuuc

SEQ ID NO: 2794602 - RNA, 16 nt, Leptospira interrogans serovar lai str. 56601
agacuaaaaaaaugaa

SEQ ID NO: 2794603 - RNA, 18 nt, Leptospira interrogans serovar lai str. 56601
agacugacugaaaaaaac

SEQ ID NO: 2794604 - RNA, 22 nt, Leptospira interrogans serovar lai str. 56601
agacugauuuuuuaaauguggg

SEQ ID NO: 2794605 - RNA, 23 nt, Leptospira interrogans serovar lai str. 56601
agacugauuuuuuaaauguggga

SEQ ID NO: 2794606 - RNA, 23 nt, Leptospira interrogans serovar lai str. 56601
agacuuaaaagaagauuuuucuu

SEQ ID NO: 2794607 - RNA, 18 nt, Leptospira interrogans serovar lai str. 56601
agacuuccacgaauuaca

SEQ ID NO: 2794608 - RNA, 23 nt, Leptospira interrogans serovar lai str. 56601
agacuucucuuuucgaaaauucu

SEQ ID NO: 2794609 - RNA, 17 nt, Leptospira interrogans serovar lai str. 56601
agacuugauuugagaau

SEQ ID NO: 2794610 - RNA, 12 nt, Leptospira interrogans serovar lai str. 56601
agacuuuuccua

SEQ ID NO: 2794611 - RNA, 17 nt, Leptospira interrogans serovar lai str. 56601
agacuuuuccuaaaauu

SEQ ID NO: 2794612 - RNA, 14 nt, Leptospira interrogans serovar lai str. 56601
agagaaagaaaaag

SEQ ID NO: 2794613 - RNA, 15 nt, Leptospira interrogans serovar lai str. 56601
agagaagccuauauu

SEQ ID NO: 2794614 - RNA, 17 nt, Leptospira interrogans serovar lai str. 56601
agagaagccuauauuuu

SEQ ID NO: 2794615 - RNA, 20 nt, Leptospira interrogans serovar lai str. 56601
agagaagccuauauuuugau

SEQ ID NO: 2794616 - RNA, 15 nt, Leptospira interrogans serovar lai str. 56601
agagaaugaucaaua

SEQ ID NO: 2794617 - RNA, 19 nt, Leptospira interrogans serovar lai str. 56601
agauccguaaaccaagaau

SEQ ID NO: 2794618 - RNA, 21 nt, Leptospira interrogans serovar lai str. 56601
agauccuacacucuaaguuuu

SEQ ID NO: 2794619 - RNA, 17 nt, Leptospira interrogans serovar lai str. 56601
agaucgauucuuuaaau

SEQ ID NO: 2794620 - RNA, 20 nt, Leptospira interrogans serovar lai str. 56601
agaucuacgaaaauucugaa

SEQ ID NO: 2794621 - RNA, 22 nt, Leptospira interrogans serovar lai str. 56601
agaucuacggaagcuaaaacua

SEQ ID NO: 2794622 - RNA, 23 nt, Leptospira interrogans serovar lai str. 56601
agaucuaugauucugaaaaaaau

SEQ ID NO: 2794623 - RNA, 18 nt, Leptospira interrogans serovar lai str. 56601
agaucuauuccuaaaaug

SEQ ID NO: 2794624 - RNA, 20 nt, Leptospira interrogans serovar lai str. 56601
agaucuccacuuaauuuuuc

SEQ ID NO: 2794625 - RNA, 14 nt, Leptospira interrogans serovar lai str. 56601
agaucugauauuuu

SEQ ID NO: 2794626 - RNA, 23 nt, Leptospira interrogans serovar lai str. 56601
agaucugauauuuuaaauugaaa

SEQ ID NO: 2794627 - RNA, 18 nt, Leptospira interrogans serovar lai str. 56601
agaucuugagauccaauu

SEQ ID NO: 2794628 - RNA, 19 nt, Leptospira interrogans serovar lai str. 56601
agaucuuuuauaauguuug

SEQ ID NO: 2794629 - RNA, 13 nt, Leptospira interrogans serovar lai str. 56601
agaugaaauuaac

SEQ ID NO: 2794630 - RNA, 14 nt, Leptospira interrogans serovar lai str. 56601
agaugaauugaauu

SEQ ID NO: 2794631 - RNA, 22 nt, Leptospira interrogans serovar lai str. 56601
agaugaauugaauuuuuuaaau

SEQ ID NO: 2794632 - RNA, 16 nt, Leptospira interrogans serovar lai str. 56601
agaugagcaaaauuug

SEQ ID NO: 2794633 - RNA, 17 nt, Leptospira interrogans serovar lai str. 56601
agaugauuuuguuaauu

SEQ ID NO: 2794634 - RNA, 23 nt, Leptospira interrogans serovar lai str. 56601
agaugcucggcuucuucaauguu

SEQ ID NO: 2794635 - RNA, 11 nt, Leptospira interrogans serovar lai str. 56601
agaugcugaaa

SEQ ID NO: 2794636 - RNA, 14 nt, Leptospira interrogans serovar lai str. 56601
agaugcuuucucuu

SEQ ID NO: 2794637 - RNA, 20 nt, Leptospira interrogans serovar lai str. 56601
agauggagaauuaauuuuuc

SEQ ID NO: 2794638 - RNA, 20 nt, Leptospira interrogans serovar lai str. 56601
agauggagaauuaauuuuuu

SEQ ID NO: 2794639 - RNA, 20 nt, Leptospira interrogans serovar lai str. 56601
agauggagaauucauuuuuc

SEQ ID NO: 2794640 - RNA, 12 nt, Leptospira interrogans serovar lai str. 56601
agauguuuuaaa

SEQ ID NO: 2794641 - RNA, 18 nt, Leptospira interrogans serovar lai str. 56601
agauguuuuaaaaguuuu

SEQ ID NO: 2794642 - RNA, 13 nt, Leptospira interrogans serovar lai str. 56601
agauuaaaaagaa

SEQ ID NO: 2794643 - RNA, 14 nt, Leptospira interrogans serovar lai str. 56601
agauuaaagauuug

SEQ ID NO: 2794644 - RNA, 22 nt, Leptospira interrogans serovar lai str. 56601
agauuaaauguauauucguugu

SEQ ID NO: 2794645 - RNA, 17 nt, Leptospira interrogans serovar lai str. 56601
agauuaaccguagauuu

SEQ ID NO: 2794646 - RNA, 13 nt, Leptospira interrogans serovar lai str. 56601
agauuaacugcug

SEQ ID NO: 2794647 - RNA, 18 nt, Leptospira interrogans serovar lai str. 56601
agauuacauuuuucuaaa

SEQ ID NO: 2794648 - RNA, 21 nt, Leptospira interrogans serovar lai str. 56601
agauuacauuuuucuaaauua

SEQ ID NO: 2794649 - RNA, 15 nt, Leptospira interrogans serovar lai str. 56601
agauuacuaugaaaa

SEQ ID NO: 2794650 - RNA, 18 nt, Leptospira interrogans serovar lai str. 56601
agauuacucuacuauaaa

SEQ ID NO: 2794651 - RNA, 16 nt, Leptospira interrogans serovar lai str. 56601
agauuauuuacauaua

SEQ ID NO: 2794652 - RNA, 13 nt, Leptospira interrogans serovar lai str. 56601
agauuauuuuuga

SEQ ID NO: 2794653 - RNA, 16 nt, Leptospira interrogans serovar lai str. 56601
agauucaucgcuuuua

SEQ ID NO: 2794654 - RNA, 18 nt, Leptospira interrogans serovar lai str. 56601
agauucaucgcuuuuaaa

SEQ ID NO: 2794655 - RNA, 22 nt, Leptospira interrogans serovar lai str. 56601
agauucccuuuugaucuuuaaa

SEQ ID NO: 2794656 - RNA, 14 nt, Leptospira interrogans serovar lai str. 56601
agauucuaaaaaaa

SEQ ID NO: 2794657 - RNA, 16 nt, Leptospira interrogans serovar lai str. 56601
agauucuaaaaaaagu

SEQ ID NO: 2794658 - RNA, 20 nt, Leptospira interrogans serovar lai str. 56601
agauucuaauuuuucaaaaa

SEQ ID NO: 2794659 - RNA, 22 nt, Leptospira interrogans serovar lai str. 56601
agauucuaauuuuucaaaaacu

SEQ ID NO: 2794660 - RNA, 22 nt, Leptospira interrogans serovar lai str. 56601
agauucuucuccucuuccggaa

SEQ ID NO: 2794661 - RNA, 14 nt, Leptospira interrogans serovar lai str. 56601
agauucuugauaaa

SEQ ID NO: 2794662 - RNA, 15 nt, Leptospira interrogans serovar lai str. 56601
agauugaaugaaauc

SEQ ID NO: 2794663 - RNA, 14 nt, Leptospira interrogans serovar lai str. 56601
agauugaauuuuua

SEQ ID NO: 2794664 - RNA, 17 nt, Leptospira interrogans serovar lai str. 56601
agauugaguuucacaaa

SEQ ID NO: 2794665 - RNA, 21 nt, Leptospira interrogans serovar lai str. 56601
agauugaguuucacaaaaugc

SEQ ID NO: 2794666 - RNA, 18 nt, Leptospira interrogans serovar lai str. 56601
agauugauucuuuaaaug

SEQ ID NO: 2794667 - RNA, 15 nt, Leptospira interrogans serovar lai str. 56601
agauugauuuaaaug

SEQ ID NO: 2794668 - RNA, 17 nt, Leptospira interrogans serovar lai str. 56601
agauugauuuuucuaag

SEQ ID NO: 2794669 - RNA, 16 nt, Leptospira interrogans serovar lai str. 56601
agauugcuuuuuaaaa

SEQ ID NO: 2794670 - RNA, 17 nt, Leptospira interrogans serovar lai str. 56601
agauugcuuuuuaaaag

SEQ ID NO: 2794671 - RNA, 18 nt, Leptospira interrogans serovar lai str. 56601
agauugcuuuuuaaaaga

SEQ ID NO: 2794672 - RNA, 21 nt, Leptospira interrogans serovar lai str. 56601
agauuggagggcaaucgauuu

SEQ ID NO: 2794673 - RNA, 14 nt, Leptospira interrogans serovar lai str. 56601
agauuguuuucuag

SEQ ID NO: 2794674 - RNA, 21 nt, Leptospira interrogans serovar lai str. 56601
agauuguuuucuaguuuuccu

SEQ ID NO: 2794675 - RNA, 22 nt, Leptospira interrogans serovar lai str. 56601
agauuuagagccaaauuuuuag

SEQ ID NO: 2794676 - RNA, 18 nt, Leptospira interrogans serovar lai str. 56601
agauuuauaauaaaucaa

SEQ ID NO: 2794677 - RNA, 23 nt, Leptospira interrogans serovar lai str. 56601
agauuuaugacagcuugaagauu

SEQ ID NO: 2794678 - RNA, 15 nt, Leptospira interrogans serovar lai str. 56601
agauuuauuuuagaa

SEQ ID NO: 2794679 - RNA, 18 nt, Leptospira interrogans serovar lai str. 56601
agauuuauuuuagaaugu

SEQ ID NO: 2794680 - RNA, 20 nt, Leptospira interrogans serovar lai str. 56601
agauuucagcuccaaaaaaa

SEQ ID NO: 2794681 - RNA, 21 nt, Leptospira interrogans serovar lai str. 56601
agauuucagcuccaaaaaaau

SEQ ID NO: 2794682 - RNA, 15 nt, Leptospira interrogans serovar lai str. 56601
agauuucgaaaaaaa

SEQ ID NO: 2794683 - RNA, 20 nt, Leptospira interrogans serovar lai str. 56601
agauuucggauucuucccca

SEQ ID NO: 2794684 - RNA, 23 nt, Leptospira interrogans serovar lai str. 56601
agauuucguucggaaaaaauaug

SEQ ID NO: 2794685 - RNA, 17 nt, Leptospira interrogans serovar lai str. 56601
agauuucuauauucaaa

SEQ ID NO: 2794686 - RNA, 23 nt, Leptospira interrogans serovar lai str. 56601
agauuucuuguuuuuuagaaaau

SEQ ID NO: 2794687 - RNA, 16 nt, Leptospira interrogans serovar lai str. 56601
agauuugcucuuaaug

SEQ ID NO: 2794688 - RNA, 15 nt, Leptospira interrogans serovar lai str. 56601
agauuuguaaaauug

SEQ ID NO: 2794689 - RNA, 19 nt, Leptospira interrogans serovar lai str. 56601
agauuuguguuaguuccca

SEQ ID NO: 2794690 - RNA, 14 nt, Leptospira interrogans serovar lai str. 56601
agauuuguugaaaa

SEQ ID NO: 2794691 - RNA, 13 nt, Leptospira interrogans serovar lai str. 56601
agauuuuaaaaau

SEQ ID NO: 2794692 - RNA, 19 nt, Leptospira interrogans serovar lai str. 56601
agauuuuaagacaaacuuu

SEQ ID NO: 2794693 - RNA, 15 nt, Leptospira interrogans serovar lai str. 56601
agauuuuauuuugau

SEQ ID NO: 2794694 - RNA, 21 nt, Leptospira interrogans serovar lai str. 56601
agauuuucgucuucuuuacaa

SEQ ID NO: 2794695 - RNA, 14 nt, Leptospira interrogans serovar lai str. 56601
agauuuucucaaaa

SEQ ID NO: 2794696 - RNA, 17 nt, Leptospira interrogans serovar lai str. 56601
agauuuucucaaaaaaa

SEQ ID NO: 2794697 - RNA, 21 nt, Leptospira interrogans serovar lai str. 56601
agauuuucuuugauugaauua

SEQ ID NO: 2794698 - RNA, 20 nt, Leptospira interrogans serovar lai str. 56601
agauuuugcacguaaacauu

SEQ ID NO: 2794699 - RNA, 16 nt, Leptospira interrogans serovar lai str. 56601
agcgcuugaaaauucu

SEQ ID NO: 2794700 - RNA, 12 nt, Leptospira interrogans serovar lai str. 56601
agcgggaauuua

SEQ ID NO: 2794701 - RNA, 22 nt, Leptospira interrogans serovar lai str. 56601
agcguaagguguuuauaaaaac

SEQ ID NO: 2794702 - RNA, 17 nt, Leptospira interrogans serovar lai str. 56601
agcguccgcaauauccc

SEQ ID NO: 2794703 - RNA, 18 nt, Leptospira interrogans serovar lai str. 56601
agcgucucacuccccaug

SEQ ID NO: 2794704 - RNA, 23 nt, Leptospira interrogans serovar lai str. 56601
agcguuucguucuuuuuuccuuc

SEQ ID NO: 2794705 - RNA, 14 nt, Leptospira interrogans serovar lai str. 56601
agcguuuugcugag

SEQ ID NO: 2794706 - RNA, 19 nt, Leptospira interrogans serovar lai str. 56601
agcguuuuguuaauuguug

SEQ ID NO: 2794707 - RNA, 12 nt, Leptospira interrogans serovar lai str. 56601
agcuaaaaagaa

SEQ ID NO: 2794708 - RNA, 13 nt, Leptospira interrogans serovar lai str. 56601
agcuaaaaagaaa

SEQ ID NO: 2794709 - RNA, 16 nt, Leptospira interrogans serovar lai str. 56601
agcuaagcauaaaauu

SEQ ID NO: 2794710 - RNA, 20 nt, Leptospira interrogans serovar lai str. 56601
agcuaagcauaaaauucuaa

SEQ ID NO: 2794711 - RNA, 16 nt, Leptospira interrogans serovar lai str. 56601
agcuaauaaucgauuu

SEQ ID NO: 2794712 - RNA, 12 nt, Leptospira interrogans serovar lai str. 56601
agcuauaaaaua

SEQ ID NO: 2794713 - RNA, 23 nt, Leptospira interrogans serovar lai str. 56601
agcuaugaagagguacagaaaca

SEQ ID NO: 2794714 - RNA, 14 nt, Leptospira interrogans serovar lai str. 56601
agcuauuuucagaa

SEQ ID NO: 2794715 - RNA, 21 nt, Leptospira interrogans serovar lai str. 56601
agcuauuuucagaaaaaugaa

SEQ ID NO: 2794716 - RNA, 22 nt, Leptospira interrogans serovar lai str. 56601
agcuauuuuugagaugauuuau

SEQ ID NO: 2794717 - RNA, 23 nt, Leptospira interrogans serovar lai str. 56601
agcuauuuuuuucgcaaauucua

SEQ ID NO: 2794718 - RNA, 16 nt, Leptospira interrogans serovar lai str. 56601
agcucagauuccaacu

SEQ ID NO: 2794719 - RNA, 16 nt, Leptospira interrogans serovar lai str. 56601
agcucaucauucugaa

SEQ ID NO: 2794720 - RNA, 17 nt, Leptospira interrogans serovar lai str. 56601
agcuccaaaaaaauaaa

SEQ ID NO: 2794721 - RNA, 18 nt, Leptospira interrogans serovar lai str. 56601
agcuccaaaaaaauaaau

SEQ ID NO: 2794722 - RNA, 22 nt, Leptospira interrogans serovar lai str. 56601
agcuccaaaaaaauaaaucaug

SEQ ID NO: 2794723 - RNA, 16 nt, Leptospira interrogans serovar lai str. 56601
agcuccagucaaguua

SEQ ID NO: 2794724 - RNA, 13 nt, Leptospira interrogans serovar lai str. 56601
agcucccucacgu

SEQ ID NO: 2794725 - RNA, 18 nt, Leptospira interrogans serovar lai str. 56601
agcucgaauaaaaacaaa

SEQ ID NO: 2794726 - RNA, 15 nt, Leptospira interrogans serovar lai str. 56601
agcucuccaucuuuu

SEQ ID NO: 2794727 - RNA, 13 nt, Leptospira interrogans serovar lai str. 56601
agcucuugaauaa

SEQ ID NO: 2794728 - RNA, 13 nt, Leptospira interrogans serovar lai str. 56601
agcugaaacuaau

SEQ ID NO: 2794729 - RNA, 14 nt, Leptospira interrogans serovar lai str. 56601
agcugaacuuaaaa

SEQ ID NO: 2794730 - RNA, 16 nt, Leptospira interrogans serovar lai str. 56601
agcugcauaauagauu

SEQ ID NO: 2794731 - RNA, 20 nt, Leptospira interrogans serovar lai str. 56601
agcuggaugaagcuaugaag

SEQ ID NO: 2794732 - RNA, 21 nt, Leptospira interrogans serovar lai str. 56601
agcuuauacuuuaagaaaauu

SEQ ID NO: 2794733 - RNA, 23 nt, Leptospira interrogans serovar lai str. 56601
agcuuauacuuuaagaaaauuua

SEQ ID NO: 2794734 - RNA, 12 nt, Leptospira interrogans serovar lai str. 56601
agcuuccuuuuu

SEQ ID NO: 2794735 - RNA, 11 nt, Leptospira interrogans serovar lai str. 56601
agcuucuucca

SEQ ID NO: 2794736 - RNA, 16 nt, Leptospira interrogans serovar lai str. 56601
agcuucuuccaaaguc

SEQ ID NO: 2794737 - RNA, 22 nt, Leptospira interrogans serovar lai str. 56601
agcuuguuucaaaaguuagaau

SEQ ID NO: 2794738 - RNA, 14 nt, Leptospira interrogans serovar lai str. 56601
agcuuguuuuuaaa

SEQ ID NO: 2794739 - RNA, 14 nt, Leptospira interrogans serovar lai str. 56601
agcuuuagaaaaua

SEQ ID NO: 2794740 - RNA, 20 nt, Leptospira interrogans serovar lai str. 56601
agcuuuuaguuguacaaaaa

SEQ ID NO: 2794741 - RNA, 23 nt, Leptospira interrogans serovar lai str. 56601
agcuuuuaguuguacaaaaaugu

SEQ ID NO: 2794742 - RNA, 16 nt, Leptospira interrogans serovar lai str. 56601
agcuuuuuuagaaaaa

SEQ ID NO: 2794743 - RNA, 17 nt, Leptospira interrogans serovar lai str. 56601
agcuuuuuuagaaaaag

SEQ ID NO: 2794744 - RNA, 22 nt, Leptospira interrogans serovar lai str. 56601
aggaaauaaaaauauacaauaa

SEQ ID NO: 2794745 - RNA, 13 nt, Leptospira interrogans serovar lai str. 56601
aggaaauacaaaa

SEQ ID NO: 2794746 - RNA, 16 nt, Leptospira interrogans serovar lai str. 56601
aggaaauacaaaaaga

SEQ ID NO: 2794747 - RNA, 18 nt, Leptospira interrogans serovar lai str. 56601
aggaaaugaaaaagaauu

SEQ ID NO: 2794748 - RNA, 19 nt, Leptospira interrogans serovar lai str. 56601
aggaaauucuuuuccaaaa

SEQ ID NO: 2794749 - RNA, 19 nt, Leptospira interrogans serovar lai str. 56601
aggaacucaugauucugaa

SEQ ID NO: 2794750 - RNA, 22 nt, Leptospira interrogans serovar lai str. 56601
aggaacugcuuccaaaaaaagu

SEQ ID NO: 2794751 - RNA, 14 nt, Leptospira interrogans serovar lai str. 56601
aggaacuuuuauaa

SEQ ID NO: 2794752 - RNA, 19 nt, Leptospira interrogans serovar lai str. 56601
aggaacuuuuauaauucaa

SEQ ID NO: 2794753 - RNA, 17 nt, Leptospira interrogans serovar lai str. 56601
aggaaggaguaucaaua

SEQ ID NO: 2794754 - RNA, 14 nt, Leptospira interrogans serovar lai str. 56601
aggaagucuauuca

SEQ ID NO: 2794755 - RNA, 17 nt, Leptospira interrogans serovar lai str. 56601
aggaaguguuugcugag

SEQ ID NO: 2794756 - RNA, 15 nt, Leptospira interrogans serovar lai str. 56601
aggaauauucauuca

SEQ ID NO: 2794757 - RNA, 19 nt, Leptospira interrogans serovar lai str. 56601
aggaauccaugauucugaa

SEQ ID NO: 2794758 - RNA, 22 nt, Leptospira interrogans serovar lai str. 56601
aggaaucguuuguaaaaucgua

SEQ ID NO: 2794759 - RNA, 19 nt, Leptospira interrogans serovar lai str. 56601
aggaauucauaauucugaa

SEQ ID NO: 2794760 - RNA, 20 nt, Leptospira interrogans serovar lai str. 56601
aggaauucauacuuuuaaaa

SEQ ID NO: 2794761 - RNA, 23 nt, Leptospira interrogans serovar lai str. 56601
aggaauucauacuuuuaaaaagu

SEQ ID NO: 2794762 - RNA, 14 nt, Leptospira interrogans serovar lai str. 56601
aggaauuuuuaaaa

SEQ ID NO: 2794763 - RNA, 19 nt, Leptospira interrogans serovar lai str. 56601
aggaauuuuuaaaaagaau

SEQ ID NO: 2794764 - RNA, 15 nt, Leptospira interrogans serovar lai str. 56601
aggaauuuuuuaaac

SEQ ID NO: 2794765 - RNA, 17 nt, Leptospira interrogans serovar lai str. 56601
aggaccugcuuugguuu

SEQ ID NO: 2794766 - RNA, 19 nt, Leptospira interrogans serovar lai str. 56601
aggaccugcuuugguuuuc

SEQ ID NO: 2794767 - RNA, 20 nt, Leptospira interrogans serovar lai str. 56601
aggagaaggauaaagucuau

SEQ ID NO: 2794768 - RNA, 16 nt, Leptospira interrogans serovar lai str. 56601
aggagcucaucauucu

SEQ ID NO: 2794769 - RNA, 18 nt, Leptospira interrogans serovar lai str. 56601
aggagcucaucauucuga

SEQ ID NO: 2794770 - RNA, 17 nt, Leptospira interrogans serovar lai str. 56601
aggaggauuagaagaau

SEQ ID NO: 2794771 - RNA, 15 nt, Leptospira interrogans serovar lai str. 56601
aggagguggaaaagu

SEQ ID NO: 2794772 - RNA, 22 nt, Leptospira interrogans serovar lai str. 56601
aggagguggaaaaguuuucuuu

SEQ ID NO: 2794773 - RNA, 13 nt, Leptospira interrogans serovar lai str. 56601
aggaguaucaaua

SEQ ID NO: 2794774 - RNA, 20 nt, Leptospira interrogans serovar lai str. 56601
aggaguaucaauagaaauac

SEQ ID NO: 2794775 - RNA, 19 nt, Leptospira interrogans serovar lai str. 56601
aggauaaaacggauuucuu

SEQ ID NO: 2794776 - RNA, 14 nt, Leptospira interrogans serovar lai str. 56601
aggauaaacuguaa

SEQ ID NO: 2794777 - RNA, 16 nt, Leptospira interrogans serovar lai str. 56601
aggauaaccuaaaauu

SEQ ID NO: 2794778 - RNA, 20 nt, Leptospira interrogans serovar lai str. 56601
aggauaaccuaaaauuucca

SEQ ID NO: 2794779 - RNA, 15 nt, Leptospira interrogans serovar lai str. 56601
aggauauuugauaua

SEQ ID NO: 2794780 - RNA, 17 nt, Leptospira interrogans serovar lai str. 56601
aggaugaauccggggac

SEQ ID NO: 2794781 - RNA, 14 nt, Leptospira interrogans serovar lai str. 56601
aggauguaauucca

SEQ ID NO: 2794782 - RNA, 14 nt, Leptospira interrogans serovar lai str. 56601
aguaaguucaaauu

SEQ ID NO: 2794783 - RNA, 20 nt, Leptospira interrogans serovar lai str. 56601
aguaauauuucucucaaauu

SEQ ID NO: 2794784 - RNA, 16 nt, Leptospira interrogans serovar lai str. 56601
aguaauccauuuuucc

SEQ ID NO: 2794785 - RNA, 16 nt, Leptospira interrogans serovar lai str. 56601
aguaaucguuuaaaga

SEQ ID NO: 2794786 - RNA, 18 nt, Leptospira interrogans serovar lai str. 56601
aguaaucguuuaaagauu

SEQ ID NO: 2794787 - RNA, 18 nt, Leptospira interrogans serovar lai str. 56601
aguaaucuuuuuaaaagu

SEQ ID NO: 2794788 - RNA, 19 nt, Leptospira interrogans serovar lai str. 56601
aguaaucuuuuuaaaaguu

SEQ ID NO: 2794789 - RNA, 20 nt, Leptospira interrogans serovar lai str. 56601
aguaaugccuacaaaucaaa

SEQ ID NO: 2794790 - RNA, 12 nt, Leptospira interrogans serovar lai str. 56601
aguaauucuaaa

SEQ ID NO: 2794791 - RNA, 21 nt, Leptospira interrogans serovar lai str. 56601
aguaauucuaaagccauuuag

SEQ ID NO: 2794792 - RNA, 18 nt, Leptospira interrogans serovar lai str. 56601
aguaauucuaaguaauuu

SEQ ID NO: 2794793 - RNA, 15 nt, Leptospira interrogans serovar lai str. 56601
aguaauuuaaaaaaa

SEQ ID NO: 2794794 - RNA, 21 nt, Leptospira interrogans serovar lai str. 56601
aguaauuuaauauauuaaaau

SEQ ID NO: 2794795 - RNA, 20 nt, Leptospira interrogans serovar lai str. 56601
aguaauuuucgaauucuuuc

SEQ ID NO: 2794796 - RNA, 12 nt, Leptospira interrogans serovar lai str. 56601
aguaauuuugaa

SEQ ID NO: 2794797 - RNA, 15 nt, Leptospira interrogans serovar lai str. 56601
aguacaagaaucaaa

SEQ ID NO: 2794798 - RNA, 15 nt, Leptospira interrogans serovar lai str. 56601
aguacuucuaccuga

SEQ ID NO: 2794799 - RNA, 20 nt, Leptospira interrogans serovar lai str. 56601
aguagaaagauuaaauucua

SEQ ID NO: 2794800 - RNA, 13 nt, Leptospira interrogans serovar lai str. 56601
aguagaagccaau

SEQ ID NO: 2794801 - RNA, 19 nt, Leptospira interrogans serovar lai str. 56601
aguagacauuuaaaugucu

SEQ ID NO: 2794802 - RNA, 13 nt, Leptospira interrogans serovar lai str. 56601
aguagauuccuac

SEQ ID NO: 2794803 - RNA, 15 nt, Leptospira interrogans serovar lai str. 56601
aguagauuccuacau

SEQ ID NO: 2794804 - RNA, 18 nt, Leptospira interrogans serovar lai str. 56601
aguagccuuuuuaacucc

SEQ ID NO: 2794805 - RNA, 14 nt, Leptospira interrogans serovar lai str. 56601
aguaggcuauuuua

SEQ ID NO: 2794806 - RNA, 17 nt, Leptospira interrogans serovar lai str. 56601
aguaggugguugggaac

SEQ ID NO: 2794807 - RNA, 12 nt, Leptospira interrogans serovar lai str. 56601
aguaguagaaaa

SEQ ID NO: 2794808 - RNA, 16 nt, Leptospira interrogans serovar lai str. 56601
aguaguagaaaaugug

SEQ ID NO: 2794809 - RNA, 15 nt, Leptospira interrogans serovar lai str. 56601
aguaguaguucccac

SEQ ID NO: 2794810 - RNA, 17 nt, Leptospira interrogans serovar lai str. 56601
aguagucauauaaaagu

SEQ ID NO: 2794811 - RNA, 22 nt, Leptospira interrogans serovar lai str. 56601
aguagucccacauuuuugugaa

SEQ ID NO: 2794812 - RNA, 19 nt, Leptospira interrogans serovar lai str. 56601
aguagucuuacaauuuuag

SEQ ID NO: 2794813 - RNA, 14 nt, Leptospira interrogans serovar lai str. 56601
aguaguucccacag

SEQ ID NO: 2794814 - RNA, 23 nt, Leptospira interrogans serovar lai str. 56601
aguaguuccuacauuuuaaaaau

SEQ ID NO: 2794815 - RNA, 19 nt, Leptospira interrogans serovar lai str. 56601
aguaguuccuacauuuuuu

SEQ ID NO: 2794816 - RNA, 21 nt, Leptospira interrogans serovar lai str. 56601
aguauaacccaaaacuaaaac

SEQ ID NO: 2794817 - RNA, 14 nt, Leptospira interrogans serovar lai str. 56601
aguauaaucaaaua

SEQ ID NO: 2794818 - RNA, 20 nt, Leptospira interrogans serovar lai str. 56601
aguauaaucaaauacaaaaa

SEQ ID NO: 2794819 - RNA, 15 nt, Leptospira interrogans serovar lai str. 56601
aguauauauuaaagu

SEQ ID NO: 2794820 - RNA, 15 nt, Leptospira interrogans serovar lai str. 56601
aguauauuaacuuuc

SEQ ID NO: 2794821 - RNA, 18 nt, Leptospira interrogans serovar lai str. 56601
aguauauuauaauuuuaa

SEQ ID NO: 2794822 - RNA, 15 nt, Leptospira interrogans serovar lai str. 56601
aguauccaaaauuaa

SEQ ID NO: 2794823 - RNA, 13 nt, Leptospira interrogans serovar lai str. 56601
aguaucuaaaagu

SEQ ID NO: 2794824 - RNA, 15 nt, Leptospira interrogans serovar lai str. 56601
aguaucuaaaaguuu

SEQ ID NO: 2794825 - RNA, 22 nt, Leptospira interrogans serovar lai str. 56601
aguaugauuuuaccgauaaguc

SEQ ID NO: 2794826 - RNA, 15 nt, Leptospira interrogans serovar lai str. 56601
aguauguuuuucuaa

SEQ ID NO: 2794827 - RNA, 17 nt, Leptospira interrogans serovar lai str. 56601
aguauguuuuucuaaua

SEQ ID NO: 2794828 - RNA, 18 nt, Leptospira interrogans serovar lai str. 56601
aguauguuuuuuugauaa

SEQ ID NO: 2794829 - RNA, 16 nt, Leptospira interrogans serovar lai str. 56601
aguauuaauuuaauca

SEQ ID NO: 2794830 - RNA, 18 nt, Leptospira interrogans serovar lai str. 56601
aguauuaauuuuccuauu

SEQ ID NO: 2794831 - RNA, 13 nt, Leptospira interrogans serovar lai str. 56601
aguauuauaaaca

SEQ ID NO: 2794832 - RNA, 17 nt, Leptospira interrogans serovar lai str. 56601
aguauuauaaacagucg

SEQ ID NO: 2794833 - RNA, 16 nt, Leptospira interrogans serovar lai str. 56601
aguauuauuuuccuuu

SEQ ID NO: 2794834 - RNA, 17 nt, Leptospira interrogans serovar lai str. 56601
aguauuauuuuccuuua

SEQ ID NO: 2794835 - RNA, 14 nt, Leptospira interrogans serovar lai str. 56601
aguauucaauucca

SEQ ID NO: 2794836 - RNA, 15 nt, Leptospira interrogans serovar lai str. 56601
aguauucaauuuuua

SEQ ID NO: 2794837 - RNA, 20 nt, Leptospira interrogans serovar lai str. 56601
aguauucaauuuuuauagau

SEQ ID NO: 2794838 - RNA, 17 nt, Leptospira interrogans serovar lai str. 56601
aguauuuguaaaaauga

SEQ ID NO: 2794839 - RNA, 23 nt, Leptospira interrogans serovar lai str. 56601
aguauuuuccguaccccaaagau

SEQ ID NO: 2794840 - RNA, 19 nt, Leptospira interrogans serovar lai str. 56601
aguauuuucuagauagguu

SEQ ID NO: 2794841 - RNA, 19 nt, Leptospira interrogans serovar lai str. 56601
aguauuuugcacugaaaua

SEQ ID NO: 2794842 - RNA, 12 nt, Leptospira interrogans serovar lai str. 56601
aguauuuuuaag

SEQ ID NO: 2794843 - RNA, 14 nt, Leptospira interrogans serovar lai str. 56601
aguauuuuuaagau

SEQ ID NO: 2794844 - RNA, 13 nt, Leptospira interrogans serovar lai str. 56601
aguauuuuucuua

SEQ ID NO: 2794845 - RNA, 15 nt, Leptospira interrogans serovar lai str. 56601
agucaaaaggcggga

SEQ ID NO: 2794846 - RNA, 16 nt, Leptospira interrogans serovar lai str. 56601
agucaagcagauuugu

SEQ ID NO: 2794847 - RNA, 20 nt, Leptospira interrogans serovar lai str. 56601
agucaauaaauuguauaaaa

SEQ ID NO: 2794848 - RNA, 22 nt, Leptospira interrogans serovar lai str. 56601
agucaaugguugcaaaaaagaa

SEQ ID NO: 2794849 - RNA, 13 nt, Leptospira interrogans serovar lai str. 56601
agucaauuaaauu

SEQ ID NO: 2794850 - RNA, 12 nt, Leptospira interrogans serovar lai str. 56601
agucaauugaag

SEQ ID NO: 2794851 - RNA, 23 nt, Leptospira interrogans serovar lai str. 56601
agucacauuacgaauuuuuaaau

SEQ ID NO: 2794852 - RNA, 16 nt, Leptospira interrogans serovar lai str. 56601
agucaccucuauaaaa

SEQ ID NO: 2794853 - RNA, 20 nt, Leptospira interrogans serovar lai str. 56601
agucagguuuuaucaaauaa

SEQ ID NO: 2794854 - RNA, 22 nt, Leptospira interrogans serovar lai str. 56601
agucagguuuuaucaaauaaag

SEQ ID NO: 2794855 - RNA, 22 nt, Leptospira interrogans serovar lai str. 56601
agucaguuuuuucguaaaaaau

SEQ ID NO: 2794856 - RNA, 12 nt, Leptospira interrogans serovar lai str. 56601
agucauauaaaa

SEQ ID NO: 2794857 - RNA, 12 nt, Leptospira interrogans serovar lai str. 56601
agucauucugua

SEQ ID NO: 2794858 - RNA, 14 nt, Leptospira interrogans serovar lai str. 56601
agucauuuccucca

SEQ ID NO: 2794859 - RNA, 18 nt, Leptospira interrogans serovar lai str. 56601
agucauuuccuccaaaca

SEQ ID NO: 2794860 - RNA, 13 nt, Leptospira interrogans serovar lai str. 56601
aguccaaaacaaa

SEQ ID NO: 2794861 - RNA, 17 nt, Leptospira interrogans serovar lai str. 56601
agucccauuuagcaauu

SEQ ID NO: 2794862 - RNA, 22 nt, Leptospira interrogans serovar lai str. 56601
agucccuacaauuuuagaauuu

SEQ ID NO: 2794863 - RNA, 20 nt, Leptospira interrogans serovar lai str. 56601
aguccuccaaacaauuuuuu

SEQ ID NO: 2794864 - RNA, 13 nt, Leptospira interrogans serovar lai str. 56601
aguccuuuucuua

SEQ ID NO: 2794865 - RNA, 19 nt, Leptospira interrogans serovar lai str. 56601
aguucagguaguaguugca

SEQ ID NO: 2794866 - RNA, 15 nt, Leptospira interrogans serovar lai str. 56601
aguucauauuuuaac

SEQ ID NO: 2794867 - RNA, 16 nt, Leptospira interrogans serovar lai str. 56601
aguucauauuuuaacg

SEQ ID NO: 2794868 - RNA, 13 nt, Leptospira interrogans serovar lai str. 56601
aguucauucugau

SEQ ID NO: 2794869 - RNA, 15 nt, Leptospira interrogans serovar lai str. 56601
aguuccaacguacca

SEQ ID NO: 2794870 - RNA, 19 nt, Leptospira interrogans serovar lai str. 56601
aguuccaacguaccaaaac

SEQ ID NO: 2794871 - RNA, 21 nt, Leptospira interrogans serovar lai str. 56601
aguuccaauuaacaaaacugc

SEQ ID NO: 2794872 - RNA, 20 nt, Leptospira interrogans serovar lai str. 56601
aguuccacauuuuaaagguu

SEQ ID NO: 2794873 - RNA, 18 nt, Leptospira interrogans serovar lai str. 56601
aguuccacuuuaaaaaug

SEQ ID NO: 2794874 - RNA, 17 nt, Leptospira interrogans serovar lai str. 56601
aguucccacaaauucug

SEQ ID NO: 2794875 - RNA, 15 nt, Leptospira interrogans serovar lai str. 56601
aguucccacauuuca

SEQ ID NO: 2794876 - RNA, 17 nt, Leptospira interrogans serovar lai str. 56601
aguucccacauuuuaaa

SEQ ID NO: 2794877 - RNA, 18 nt, Leptospira interrogans serovar lai str. 56601
aguucccacauuuuagaa

SEQ ID NO: 2794878 - RNA, 17 nt, Leptospira interrogans serovar lai str. 56601
aguucccacauuuugaa

SEQ ID NO: 2794879 - RNA, 21 nt, Leptospira interrogans serovar lai str. 56601
aguucccacauuuugaagguu

SEQ ID NO: 2794880 - RNA, 17 nt, Leptospira interrogans serovar lai str. 56601
aguucccacauuuugug

SEQ ID NO: 2794881 - RNA, 19 nt, Leptospira interrogans serovar lai str. 56601
aguucccacauuuugugaa

SEQ ID NO: 2794882 - RNA, 22 nt, Leptospira interrogans serovar lai str. 56601
aguucccacauuuugugaaacu

SEQ ID NO: 2794883 - RNA, 21 nt, Leptospira interrogans serovar lai str. 56601
aguucccaccuuuuuuuauga

SEQ ID NO: 2794884 - RNA, 21 nt, Leptospira interrogans serovar lai str. 56601
aguucccacguuuuaaagguu

SEQ ID NO: 2794885 - RNA, 14 nt, Leptospira interrogans serovar lai str. 56601
aguuccgaaaauuu

SEQ ID NO: 2794886 - RNA, 18 nt, Leptospira interrogans serovar lai str. 56601
aguuccgaaaauuugaaa

SEQ ID NO: 2794887 - RNA, 15 nt, Leptospira interrogans serovar lai str. 56601
aguuccgcgauugaa

SEQ ID NO: 2794888 - RNA, 21 nt, Leptospira interrogans serovar lai str. 56601
aguuccuaacuuugaaaauuu

SEQ ID NO: 2794889 - RNA, 22 nt, Leptospira interrogans serovar lai str. 56601
aguuccuaacuuugaaaauuuu

SEQ ID NO: 2794890 - RNA, 18 nt, Leptospira interrogans serovar lai str. 56601
aguuccuacauuuuaaaa

SEQ ID NO: 2794891 - RNA, 22 nt, Leptospira interrogans serovar lai str. 56601
aguuccuauauuuuaaauucaa

SEQ ID NO: 2794892 - RNA, 21 nt, Leptospira interrogans serovar lai str. 56601
aguuccuuaaaaguauccauc

SEQ ID NO: 2794893 - RNA, 17 nt, Leptospira interrogans serovar lai str. 56601
aguucgacauaagaaag

SEQ ID NO: 2794894 - RNA, 20 nt, Leptospira interrogans serovar lai str. 56601
aguucgacguaaagaauuca

SEQ ID NO: 2794895 - RNA, 22 nt, Leptospira interrogans serovar lai str. 56601
aguucgacguaaagaauucauu

SEQ ID NO: 2794896 - RNA, 16 nt, Leptospira interrogans serovar lai str. 56601
aguucgauuaaaauaa

SEQ ID NO: 2794897 - RNA, 17 nt, Leptospira interrogans serovar lai str. 56601
aguucgauuaaaauaaa

SEQ ID NO: 2794898 - RNA, 16 nt, Leptospira interrogans serovar lai str. 56601
aguucggaagauuuuu

SEQ ID NO: 2794899 - RNA, 18 nt, Leptospira interrogans serovar lai str. 56601
aguucggaagauuuuuca

SEQ ID NO: 2794900 - RNA, 24 nt, Leptospira interrogans serovar lai str. 56601
aguucggaagauuuuucaaucuaa

SEQ ID NO: 2794901 - RNA, 16 nt, Leptospira interrogans serovar lai str. 56601
aguucggcguaagaaa

SEQ ID NO: 2794902 - RNA, 15 nt, Leptospira interrogans serovar lai str. 56601
aguucgguguaaaaa

SEQ ID NO: 2794903 - RNA, 20 nt, Leptospira interrogans serovar lai str. 56601
aguucgguguaaggaauuca

SEQ ID NO: 2794904 - RNA, 23 nt, Leptospira interrogans serovar lai str. 56601
aguucgugaagaaauuuaaguuu

SEQ ID NO: 2794905 - RNA, 21 nt, Leptospira interrogans serovar lai str. 56601
aguucuaaccggaauuuccaa

SEQ ID NO: 2794906 - RNA, 18 nt, Leptospira interrogans serovar lai str. 56601
aguucuaauguuguuaaa

SEQ ID NO: 2794907 - RNA, 16 nt, Leptospira interrogans serovar lai str. 56601
aguucuccuacuuggu

SEQ ID NO: 2794908 - RNA, 18 nt, Leptospira interrogans serovar lai str. 56601
aguucucuucauccagau

SEQ ID NO: 2794909 - RNA, 17 nt, Leptospira interrogans serovar lai str. 56601
aguucuggguaaaaaaa

SEQ ID NO: 2794910 - RNA, 16 nt, Leptospira interrogans serovar lai str. 56601
aguucuuaaauaaaau

SEQ ID NO: 2794911 - RNA, 18 nt, Leptospira interrogans serovar lai str. 56601
aguucuuaaauaaaauuu

SEQ ID NO: 2794912 - RNA, 19 nt, Leptospira interrogans serovar lai str. 56601
aguucuuacuuuuugagua

SEQ ID NO: 2794913 - RNA, 13 nt, Leptospira interrogans serovar lai str. 56601
aguucuucaaaau

SEQ ID NO: 2794914 - RNA, 23 nt, Leptospira interrogans serovar lai str. 56601
aguucuucaaaaucguuuuaaaa

SEQ ID NO: 2794915 - RNA, 23 nt, Leptospira interrogans serovar lai str. 56601
aguucuucggcguugaguuuuug

SEQ ID NO: 2794916 - RNA, 14 nt, Leptospira interrogans serovar lai str. 56601
aguugaaaguuuuu

SEQ ID NO: 2794917 - RNA, 22 nt, Leptospira interrogans serovar lai str. 56601
aguugaaaucugaauuuaaaga

SEQ ID NO: 2794918 - RNA, 14 nt, Leptospira interrogans serovar lai str. 56601
aguugaauaggauu

SEQ ID NO: 2794919 - RNA, 18 nt, Leptospira interrogans serovar lai str. 56601
aguugaauaggauuuuag

SEQ ID NO: 2794920 - RNA, 17 nt, Leptospira interrogans serovar lai str. 56601
aguugagaguuuuucua

SEQ ID NO: 2794921 - RNA, 22 nt, Leptospira interrogans serovar lai str. 56601
aguugauuucagaucauaaagg

SEQ ID NO: 2794922 - RNA, 22 nt, Leptospira interrogans serovar lai str. 56601
aguugcuaagaaaaaagcagcu

SEQ ID NO: 2794923 - RNA, 16 nt, Leptospira interrogans serovar lai str. 56601
aguuggggggaauaua

SEQ ID NO: 2794924 - RNA, 13 nt, Leptospira interrogans serovar lai str. 56601
aguuguacaaaaa

SEQ ID NO: 2794925 - RNA, 21 nt, Leptospira interrogans serovar lai str. 56601
aguuguacaaaaaugugggaa

SEQ ID NO: 2794926 - RNA, 22 nt, Leptospira interrogans serovar lai str. 56601
aguuguaucagauguuuuaaaa

SEQ ID NO: 2794927 - RNA, 15 nt, Leptospira interrogans serovar lai str. 56601
aguuguauccccaua

SEQ ID NO: 2794928 - RNA, 16 nt, Leptospira interrogans serovar lai str. 56601
aguuguauccccauaa

SEQ ID NO: 2794929 - RNA, 23 nt, Leptospira interrogans serovar lai str. 56601
aguuguuaaaaguggagauuagc

SEQ ID NO: 2794930 - RNA, 23 nt, Leptospira interrogans serovar lai str. 56601
aguuguuauaaaccaauaaccaa

SEQ ID NO: 2794931 - RNA, 20 nt, Leptospira interrogans serovar lai str. 56601
aguuguugaaaaauuccaua

SEQ ID NO: 2794932 - RNA, 19 nt, Leptospira interrogans serovar lai str. 56601
aguuguugaaaaauuuuau

SEQ ID NO: 2794933 - RNA, 19 nt, Leptospira interrogans serovar lai str. 56601
aguuguugaacauuccaua

SEQ ID NO: 2794934 - RNA, 17 nt, Leptospira interrogans serovar lai str. 56601
aguuuaacuguaaaucc

SEQ ID NO: 2794935 - RNA, 17 nt, Leptospira interrogans serovar lai str. 56601
aguuuaagaaacucagu

SEQ ID NO: 2794936 - RNA, 15 nt, Leptospira interrogans serovar lai str. 56601
aguuuaauugugaaa

SEQ ID NO: 2794937 - RNA, 18 nt, Leptospira interrogans serovar lai str. 56601
aguuuacaucaaaaacaa

SEQ ID NO: 2794938 - RNA, 12 nt, Leptospira interrogans serovar lai str. 56601
aguuuagaacug

SEQ ID NO: 2794939 - RNA, 22 nt, Leptospira interrogans serovar lai str. 56601
aguuuagaacugagagaaagua

SEQ ID NO: 2794940 - RNA, 15 nt, Leptospira interrogans serovar lai str. 56601
aguuuagauuuuaac

SEQ ID NO: 2794941 - RNA, 22 nt, Leptospira interrogans serovar lai str. 56601
aguuuaguguaagaaagaagug

SEQ ID NO: 2794942 - RNA, 15 nt, Leptospira interrogans serovar lai str. 56601
aguuuauaaagcaaa

SEQ ID NO: 2794943 - RNA, 19 nt, Leptospira interrogans serovar lai str. 56601
aguuuaugugaguucccau

SEQ ID NO: 2794944 - RNA, 20 nt, Leptospira interrogans serovar lai str. 56601
aguuuaugugaguucccaua

SEQ ID NO: 2794945 - RNA, 21 nt, Leptospira interrogans serovar lai str. 56601
aguuuauuuuaaaaaaauuuu

SEQ ID NO: 2794946 - RNA, 23 nt, Leptospira interrogans serovar lai str. 56601
aguuuauuuuaaaaaaauuuuua

SEQ ID NO: 2794947 - RNA, 19 nt, Leptospira interrogans serovar lai str. 56601
auaaaaacgguauuuaaaa

SEQ ID NO: 2794948 - RNA, 13 nt, Leptospira interrogans serovar lai str. 56601
auaaaaacuacau

SEQ ID NO: 2794949 - RNA, 12 nt, Leptospira interrogans serovar lai str. 56601
auaaaaagaaga

SEQ ID NO: 2794950 - RNA, 17 nt, Leptospira interrogans serovar lai str. 56601
auaaaaauaaagaaacu

SEQ ID NO: 2794951 - RNA, 19 nt, Leptospira interrogans serovar lai str. 56601
auaaaaauaaagaaacugu

SEQ ID NO: 2794952 - RNA, 20 nt, Leptospira interrogans serovar lai str. 56601
auaaaaauuagaaaugauuu

SEQ ID NO: 2794953 - RNA, 14 nt, Leptospira interrogans serovar lai str. 56601
auaaaaauuuaaaa

SEQ ID NO: 2794954 - RNA, 21 nt, Leptospira interrogans serovar lai str. 56601
auaaaaauuucagauuuuauu

SEQ ID NO: 2794955 - RNA, 16 nt, Leptospira interrogans serovar lai str. 56601
auaaaaauuuuuuaaa

SEQ ID NO: 2794956 - RNA, 20 nt, Leptospira interrogans serovar lai str. 56601
auaaaaccgcugaaaaaaaa

SEQ ID NO: 2794957 - RNA, 22 nt, Leptospira interrogans serovar lai str. 56601
auaaaaccgcugaaaaaaaaau

SEQ ID NO: 2794958 - RNA, 18 nt, Leptospira interrogans serovar lai str. 56601
auaaaaccugauuuuucu

SEQ ID NO: 2794959 - RNA, 16 nt, Leptospira interrogans serovar lai str. 56601
auaaaaccuuuauuua

SEQ ID NO: 2794960 - RNA, 18 nt, Leptospira interrogans serovar lai str. 56601
auaaaaccuuuauuuaau

SEQ ID NO: 2794961 - RNA, 22 nt, Leptospira interrogans serovar lai str. 56601
auaaaacguggauuuuauguaa

SEQ ID NO: 2794962 - RNA, 22 nt, Leptospira interrogans serovar lai str. 56601
auaaaacucuaaauucagaaaa

SEQ ID NO: 2794963 - RNA, 20 nt, Leptospira interrogans serovar lai str. 56601
auaaaacuguaaauuagauu

SEQ ID NO: 2794964 - RNA, 23 nt, Leptospira interrogans serovar lai str. 56601
auaaaacuguaaauuagauuauu

SEQ ID NO: 2794965 - RNA, 17 nt, Leptospira interrogans serovar lai str. 56601
auaaaacuucuccuuuc

SEQ ID NO: 2794966 - RNA, 16 nt, Leptospira interrogans serovar lai str. 56601
auaaaagaccuucgga

SEQ ID NO: 2794967 - RNA, 17 nt, Leptospira interrogans serovar lai str. 56601
auaaaaggaguaauucu

SEQ ID NO: 2794968 - RNA, 19 nt, Leptospira interrogans serovar lai str. 56601
auaaaaguaacguaaauuu

SEQ ID NO: 2794969 - RNA, 13 nt, Leptospira interrogans serovar lai str. 56601
auaaaagugaaca

SEQ ID NO: 2794970 - RNA, 21 nt, Leptospira interrogans serovar lai str. 56601
auaaaagugaacagucuuuuu

SEQ ID NO: 2794971 - RNA, 13 nt, Leptospira interrogans serovar lai str. 56601
auaaaauaaaaaa

SEQ ID NO: 2794972 - RNA, 14 nt, Leptospira interrogans serovar lai str. 56601
auaaaauaaaaaaa

SEQ ID NO: 2794973 - RNA, 15 nt, Leptospira interrogans serovar lai str. 56601
auaaaauaaaaaaau

SEQ ID NO: 2794974 - RNA, 16 nt, Leptospira interrogans serovar lai str. 56601
auaaaauaaaaaaauu

SEQ ID NO: 2794975 - RNA, 14 nt, Leptospira interrogans serovar lai str. 56601
auaaaauaaaaauu

SEQ ID NO: 2794976 - RNA, 23 nt, Leptospira interrogans serovar lai str. 56601
auaaaauaccauaaauuuugaaa

SEQ ID NO: 2794977 - RNA, 17 nt, Leptospira interrogans serovar lai str. 56601
auaaaauagaaacaaau

SEQ ID NO: 2794978 - RNA, 21 nt, Leptospira interrogans serovar lai str. 56601
auaaaauauagugguuuguaa

SEQ ID NO: 2794979 - RNA, 18 nt, Leptospira interrogans serovar lai str. 56601
auaaaauauaguuaaauu

SEQ ID NO: 2794980 - RNA, 19 nt, Leptospira interrogans serovar lai str. 56601
auaaaaucauauuuucaaa

SEQ ID NO: 2794981 - RNA, 16 nt, Leptospira interrogans serovar lai str. 56601
auaaaaucgauuacuc

SEQ ID NO: 2794982 - RNA, 13 nt, Leptospira interrogans serovar lai str. 56601
auaaaaucuaaaa

SEQ ID NO: 2794983 - RNA, 15 nt, Leptospira interrogans serovar lai str. 56601
auaaaaucuaaaaaa

SEQ ID NO: 2794984 - RNA, 16 nt, Leptospira interrogans serovar lai str. 56601
auaaaaucuaaaaaaa

SEQ ID NO: 2794985 - RNA, 18 nt, Leptospira interrogans serovar lai str. 56601
auaaaaucuaaaaaaaau

SEQ ID NO: 2794986 - RNA, 20 nt, Leptospira interrogans serovar lai str. 56601
auaaaaucuaaaaaaaauca

SEQ ID NO: 2794987 - RNA, 17 nt, Leptospira interrogans serovar lai str. 56601
auaaaaucuaaaaagaa

SEQ ID NO: 2794988 - RNA, 17 nt, Leptospira interrogans serovar lai str. 56601
auaaaaucuaaaaauaa

SEQ ID NO: 2794989 - RNA, 19 nt, Leptospira interrogans serovar lai str. 56601
auaaaaucuaaaagaaacc

SEQ ID NO: 2794990 - RNA, 23 nt, Leptospira interrogans serovar lai str. 56601
auaaaaucuagguauuaucuaaa

SEQ ID NO: 2794991 - RNA, 12 nt, Leptospira interrogans serovar lai str. 56601
auaaaaucuuaa

SEQ ID NO: 2794992 - RNA, 18 nt, Leptospira interrogans serovar lai str. 56601
auaaaaucuuaaauuaga

SEQ ID NO: 2794993 - RNA, 20 nt, Leptospira interrogans serovar lai str. 56601
auaaaaucuuaaauuagaua

SEQ ID NO: 2794994 - RNA, 12 nt, Leptospira interrogans serovar lai str. 56601
auaaaaugcaau

SEQ ID NO: 2794995 - RNA, 13 nt, Leptospira interrogans serovar lai str. 56601
auaaaaugcaaua

SEQ ID NO: 2794996 - RNA, 22 nt, Leptospira interrogans serovar lai str. 56601
auaaaaugcaguaguuccuaua

SEQ ID NO: 2794997 - RNA, 20 nt, Leptospira interrogans serovar lai str. 56601
auaaaauggguuuuuaauuu

SEQ ID NO: 2794998 - RNA, 20 nt, Leptospira interrogans serovar lai str. 56601
auaaaauuauuaacuaauuu

SEQ ID NO: 2794999 - RNA, 22 nt, Leptospira interrogans serovar lai str. 56601
auaaaauuccuagcaguauuuu

SEQ ID NO: 2795000 - RNA, 18 nt, Leptospira interrogans serovar lai str. 56601
auaaaauucuaaucacga

SEQ ID NO: 2795001 - RNA, 23 nt, Leptospira interrogans serovar lai str. 56601
auaaaauucuaaucacgaaaaau

SEQ ID NO: 2795002 - RNA, 21 nt, Leptospira interrogans serovar lai str. 56601
auaaaauucuuagaguaaaac

SEQ ID NO: 2795003 - RNA, 12 nt, Leptospira interrogans serovar lai str. 56601
auaaaauugagu

SEQ ID NO: 2795004 - RNA, 20 nt, Leptospira interrogans serovar lai str. 56601
auaaaauugaguuucuauaa

SEQ ID NO: 2795005 - RNA, 17 nt, Leptospira interrogans serovar lai str. 56601
auaaaauuggaaagaac

SEQ ID NO: 2795006 - RNA, 13 nt, Leptospira interrogans serovar lai str. 56601
auaaaauuugaaa

SEQ ID NO: 2795007 - RNA, 18 nt, Leptospira interrogans serovar lai str. 56601
auaaaauuugaaaguaaa

SEQ ID NO: 2795008 - RNA, 12 nt, Leptospira interrogans serovar lai str. 56601
auaaaauuuuag

SEQ ID NO: 2795009 - RNA, 20 nt, Leptospira interrogans serovar lai str. 56601
auaaaauuuuagauacguuu

SEQ ID NO: 2795010 - RNA, 14 nt, Leptospira interrogans serovar lai str. 56601
auaaaauuuuauaa

SEQ ID NO: 2795011 - RNA, 15 nt, Leptospira interrogans serovar lai str. 56601
auaaaauuuuuaaaa

SEQ ID NO: 2795012 - RNA, 20 nt, Leptospira interrogans serovar lai str. 56601
auaaaauuuuuaaaaaauua

SEQ ID NO: 2795013 - RNA, 14 nt, Leptospira interrogans serovar lai str. 56601
auaaacaaaauuca

SEQ ID NO: 2795014 - RNA, 16 nt, Leptospira interrogans serovar lai str. 56601
auaaacaauaaaauaa

SEQ ID NO: 2795015 - RNA, 19 nt, Leptospira interrogans serovar lai str. 56601
auaaacaauaaaauaacua

SEQ ID NO: 2795016 - RNA, 16 nt, Leptospira interrogans serovar lai str. 56601
auaaacaauaugaaag

SEQ ID NO: 2795017 - RNA, 19 nt, Leptospira interrogans serovar lai str. 56601
auaaacaauaugaaaggaa

SEQ ID NO: 2795018 - RNA, 15 nt, Leptospira interrogans serovar lai str. 56601
auaaaccaauaacca

SEQ ID NO: 2795019 - RNA, 19 nt, Leptospira interrogans serovar lai str. 56601
auaaaccaucucaaaaaca

SEQ ID NO: 2795020 - RNA, 13 nt, Leptospira interrogans serovar lai str. 56601
auaaaccgauuuu

SEQ ID NO: 2795021 - RNA, 17 nt, Leptospira interrogans serovar lai str. 56601
auaaaccgauuuuccca

SEQ ID NO: 2795022 - RNA, 21 nt, Leptospira interrogans serovar lai str. 56601
auaaaccgauuuucccaaaca

SEQ ID NO: 2795023 - RNA, 20 nt, Leptospira interrogans serovar lai str. 56601
auaaacgauuauuuuuuaaa

SEQ ID NO: 2795024 - RNA, 16 nt, Leptospira interrogans serovar lai str. 56601
auaaacucaaagaauu

SEQ ID NO: 2795025 - RNA, 16 nt, Leptospira interrogans serovar lai str. 56601
auaaacuguaaacuug

SEQ ID NO: 2795026 - RNA, 15 nt, Leptospira interrogans serovar lai str. 56601
auaaacugucggaau

SEQ ID NO: 2795027 - RNA, 19 nt, Leptospira interrogans serovar lai str. 56601
auaaacuucuauuuuauaa

SEQ ID NO: 2795028 - RNA, 19 nt, Leptospira interrogans serovar lai str. 56601
auaaacuucucaaauugaa

SEQ ID NO: 2795029 - RNA, 19 nt, Leptospira interrogans serovar lai str. 56601
auaaacuucucuuaaaauu

SEQ ID NO: 2795030 - RNA, 17 nt, Leptospira interrogans serovar lai str. 56601
auaaccuuugauagaac

SEQ ID NO: 2795031 - RNA, 23 nt, Leptospira interrogans serovar lai str. 56601
auaacgauuccauuuuuuagaau

SEQ ID NO: 2795032 - RNA, 16 nt, Leptospira interrogans serovar lai str. 56601
auaacgucuugauuau

SEQ ID NO: 2795033 - RNA, 22 nt, Leptospira interrogans serovar lai str. 56601
auaacgugacaaacuaaauuuu

SEQ ID NO: 2795034 - RNA, 17 nt, Leptospira interrogans serovar lai str. 56601
auaacuaauaaaaacaa

SEQ ID NO: 2795035 - RNA, 17 nt, Leptospira interrogans serovar lai str. 56601
auaacuauauaauaucu

SEQ ID NO: 2795036 - RNA, 14 nt, Leptospira interrogans serovar lai str. 56601
auaacucaguuguu

SEQ ID NO: 2795037 - RNA, 21 nt, Leptospira interrogans serovar lai str. 56601
auaacuuagaaucuaucucaa

SEQ ID NO: 2795038 - RNA, 20 nt, Leptospira interrogans serovar lai str. 56601
auaacuuagucuuuguuuau

SEQ ID NO: 2795039 - RNA, 17 nt, Leptospira interrogans serovar lai str. 56601
auaacuugacucugcau

SEQ ID NO: 2795040 - RNA, 15 nt, Leptospira interrogans serovar lai str. 56601
auaacuuuaaaaaau

SEQ ID NO: 2795041 - RNA, 17 nt, Leptospira interrogans serovar lai str. 56601
auaacuuuaaaaaauaa

SEQ ID NO: 2795042 - RNA, 16 nt, Leptospira interrogans serovar lai str. 56601
auaacuuuacaaaaau

SEQ ID NO: 2795043 - RNA, 15 nt, Leptospira interrogans serovar lai str. 56601
auaagaaaaauugaa

SEQ ID NO: 2795044 - RNA, 23 nt, Leptospira interrogans serovar lai str. 56601
auaagaaucgaaaaaauacaaac

SEQ ID NO: 2795045 - RNA, 18 nt, Leptospira interrogans serovar lai str. 56601
auaagacauuggcaaaug

SEQ ID NO: 2795046 - RNA, 21 nt, Leptospira interrogans serovar lai str. 56601
auaagacuucauuguuugaaa

SEQ ID NO: 2795047 - RNA, 15 nt, Leptospira interrogans serovar lai str. 56601
auaagagacaaauau

SEQ ID NO: 2795048 - RNA, 19 nt, Leptospira interrogans serovar lai str. 56601
auaagagugcagauuaaaa

SEQ ID NO: 2795049 - RNA, 20 nt, Leptospira interrogans serovar lai str. 56601
auaagagugcagauuaaaaa

SEQ ID NO: 2795050 - RNA, 23 nt, Leptospira interrogans serovar lai str. 56601
auaagagugcagauuaaaaaaua

SEQ ID NO: 2795051 - RNA, 15 nt, Leptospira interrogans serovar lai str. 56601
auaagauuuguugaa

SEQ ID NO: 2795052 - RNA, 15 nt, Leptospira interrogans serovar lai str. 56601
auaagauuuuagaau

SEQ ID NO: 2795053 - RNA, 20 nt, Leptospira interrogans serovar lai str. 56601
auaagcaaaaauaaaguauu

SEQ ID NO: 2795054 - RNA, 11 nt, Leptospira interrogans serovar lai str. 56601
auaagcaugag

SEQ ID NO: 2795055 - RNA, 16 nt, Leptospira interrogans serovar lai str. 56601
auaaggcaaaagacuc

SEQ ID NO: 2795056 - RNA, 22 nt, Leptospira interrogans serovar lai str. 56601
auaaggcgguaaaacaaaaaaa

SEQ ID NO: 2795057 - RNA, 19 nt, Leptospira interrogans serovar lai str. 56601
auaagucgaucuacuaaau

SEQ ID NO: 2795058 - RNA, 22 nt, Leptospira interrogans serovar lai str. 56601
auaagucgaucuacuaaaucag

SEQ ID NO: 2795059 - RNA, 19 nt, Leptospira interrogans serovar lai str. 56601
auaagucuaacgugagcuc

SEQ ID NO: 2795060 - RNA, 17 nt, Leptospira interrogans serovar lai str. 56601
auaaguuaaauuuuuug

SEQ ID NO: 2795061 - RNA, 21 nt, Leptospira interrogans serovar lai str. 56601
auaaguuaagugaaaauuaca

SEQ ID NO: 2795062 - RNA, 15 nt, Leptospira interrogans serovar lai str. 56601
auaaguuguuauaaa

SEQ ID NO: 2795063 - RNA, 16 nt, Leptospira interrogans serovar lai str. 56601
auaaguuguuauaaac

SEQ ID NO: 2795064 - RNA, 19 nt, Leptospira interrogans serovar lai str. 56601
auaaguuguuauaaaccaa

SEQ ID NO: 2795065 - RNA, 21 nt, Leptospira interrogans serovar lai str. 56601
auaaguuuucuaguaaaaaug

SEQ ID NO: 2795066 - RNA, 23 nt, Leptospira interrogans serovar lai str. 56601
auaaguuuugauagaaaaacucu

SEQ ID NO: 2795067 - RNA, 18 nt, Leptospira interrogans serovar lai str. 56601
auaaguuuuuauuauaaa

SEQ ID NO: 2795068 - RNA, 19 nt, Leptospira interrogans serovar lai str. 56601
auaaguuuuuauuauaaaa

SEQ ID NO: 2795069 - RNA, 12 nt, Leptospira interrogans serovar lai str. 56601
auaauaaaacuu

SEQ ID NO: 2795070 - RNA, 13 nt, Leptospira interrogans serovar lai str. 56601
auaauaaaauuaa

SEQ ID NO: 2795071 - RNA, 18 nt, Leptospira interrogans serovar lai str. 56601
auaauaaaauuauuaacu

SEQ ID NO: 2795072 - RNA, 15 nt, Leptospira interrogans serovar lai str. 56601
auaauaaaguaccua

SEQ ID NO: 2795073 - RNA, 13 nt, Leptospira interrogans serovar lai str. 56601
auaauaaauugaa

SEQ ID NO: 2795074 - RNA, 21 nt, Leptospira interrogans serovar lai str. 56601
auaauaaauuuuucuggaaaa

SEQ ID NO: 2795075 - RNA, 14 nt, Leptospira interrogans serovar lai str. 56601
auaauaacaaaaaa

SEQ ID NO: 2795076 - RNA, 18 nt, Leptospira interrogans serovar lai str. 56601
auaauaacaaaaaaugcu

SEQ ID NO: 2795077 - RNA, 20 nt, Leptospira interrogans serovar lai str. 56601
auaauaaucgcuuucgcauu

SEQ ID NO: 2795078 - RNA, 22 nt, Leptospira interrogans serovar lai str. 56601
auaauacaauucugaaauuguu

SEQ ID NO: 2795079 - RNA, 13 nt, Leptospira interrogans serovar lai str. 56601
auaauacaugaau

SEQ ID NO: 2795080 - RNA, 16 nt, Leptospira interrogans serovar lai str. 56601
auaauaccaaguuauu

SEQ ID NO: 2795081 - RNA, 18 nt, Leptospira interrogans serovar lai str. 56601
auaauaguuacgacauuu

SEQ ID NO: 2795082 - RNA, 17 nt, Leptospira interrogans serovar lai str. 56601
auaauauacuaaauuau

SEQ ID NO: 2795083 - RNA, 15 nt, Leptospira interrogans serovar lai str. 56601
auaauaucaaaauga

SEQ ID NO: 2795084 - RNA, 15 nt, Leptospira interrogans serovar lai str. 56601
auaauaugauguaaa

SEQ ID NO: 2795085 - RNA, 18 nt, Leptospira interrogans serovar lai str. 56601
auaauaugauguaaauuu

SEQ ID NO: 2795086 - RNA, 13 nt, Leptospira interrogans serovar lai str. 56601
auaauauucuuau

SEQ ID NO: 2795087 - RNA, 13 nt, Leptospira interrogans serovar lai str. 56601
auaauauuuauuu

SEQ ID NO: 2795088 - RNA, 12 nt, Leptospira interrogans serovar lai str. 56601
auaauauuuuua

SEQ ID NO: 2795089 - RNA, 17 nt, Leptospira interrogans serovar lai str. 56601
auaaucaaauacaaaaa

SEQ ID NO: 2795090 - RNA, 20 nt, Leptospira interrogans serovar lai str. 56601
auaaucauggccuucuggaa

SEQ ID NO: 2795091 - RNA, 17 nt, Leptospira interrogans serovar lai str. 56601
auaaucgaauuuccauu

SEQ ID NO: 2795092 - RNA, 18 nt, Leptospira interrogans serovar lai str. 56601
auaaucgaauuuccauuu

SEQ ID NO: 2795093 - RNA, 20 nt, Leptospira interrogans serovar lai str. 56601
auaaucuaagacgaaaagaa

SEQ ID NO: 2795094 - RNA, 19 nt, Leptospira interrogans serovar lai str. 56601
auaaucuaagaucaacaca

SEQ ID NO: 2795095 - RNA, 19 nt, Leptospira interrogans serovar lai str. 56601
auaaucuaccccaucucuu

SEQ ID NO: 2795096 - RNA, 20 nt, Leptospira interrogans serovar lai str. 56601
auaaucuaccccaucucuuc

SEQ ID NO: 2795097 - RNA, 21 nt, Leptospira interrogans serovar lai str. 56601
auaaucugauugagaaaauaa

SEQ ID NO: 2795098 - RNA, 17 nt, Leptospira interrogans serovar lai str. 56601
auaaucuguaauaguua

SEQ ID NO: 2795099 - RNA, 17 nt, Leptospira interrogans serovar lai str. 56601
auaaucuuaaauaucga

SEQ ID NO: 2795100 - RNA, 13 nt, Leptospira interrogans serovar lai str. 56601
auaaucuuaauau

SEQ ID NO: 2795101 - RNA, 18 nt, Leptospira interrogans serovar lai str. 56601
auaaucuuuugaguauuu

SEQ ID NO: 2795102 - RNA, 11 nt, Leptospira interrogans serovar lai str. 56601
auaaugaagac

SEQ ID NO: 2795103 - RNA, 15 nt, Leptospira interrogans serovar lai str. 56601
auaaugaaucguaaa

SEQ ID NO: 2795104 - RNA, 18 nt, Leptospira interrogans serovar lai str. 56601
auaaugaaucguaaaaaa

SEQ ID NO: 2795105 - RNA, 23 nt, Leptospira interrogans serovar lai str. 56601
auaauguccgaaauuuuuuuaaa

SEQ ID NO: 2795106 - RNA, 18 nt, Leptospira interrogans serovar lai str. 56601
auaaugucggaucauaau

SEQ ID NO: 2795107 - RNA, 18 nt, Leptospira interrogans serovar lai str. 56601
auaauguuugaauuuuua

SEQ ID NO: 2795108 - RNA, 19 nt, Leptospira interrogans serovar lai str. 56601
auaauguuugaauuuuuaa

SEQ ID NO: 2795109 - RNA, 21 nt, Leptospira interrogans serovar lai str. 56601
auaauguuugaauuuuuaaga

SEQ ID NO: 2795110 - RNA, 22 nt, Leptospira interrogans serovar lai str. 56601
auaauguuugaauuuuuaagaa

SEQ ID NO: 2795111 - RNA, 17 nt, Leptospira interrogans serovar lai str. 56601
auaauuaaacaaagaau

SEQ ID NO: 2795112 - RNA, 19 nt, Leptospira interrogans serovar lai str. 56601
auaauuagcucuuguuaaa

SEQ ID NO: 2795113 - RNA, 19 nt, Leptospira interrogans serovar lai str. 56601
auacguuauuuccgucguu

SEQ ID NO: 2795114 - RNA, 17 nt, Leptospira interrogans serovar lai str. 56601
auacguuccuucuacaa

SEQ ID NO: 2795115 - RNA, 14 nt, Leptospira interrogans serovar lai str. 56601
auacguuuacucca

SEQ ID NO: 2795116 - RNA, 15 nt, Leptospira interrogans serovar lai str. 56601
auacuaaaauuauuc

SEQ ID NO: 2795117 - RNA, 24 nt, Leptospira interrogans serovar lai str. 56601
auacuaaauuaaguuuauucaauu

SEQ ID NO: 2795118 - RNA, 17 nt, Leptospira interrogans serovar lai str. 56601
auacuauuaauuuacuu

SEQ ID NO: 2795119 - RNA, 14 nt, Leptospira interrogans serovar lai str. 56601
auacucaauauuuu

SEQ ID NO: 2795120 - RNA, 21 nt, Leptospira interrogans serovar lai str. 56601
auacucgaaaccauacaauaa

SEQ ID NO: 2795121 - RNA, 22 nt, Leptospira interrogans serovar lai str. 56601
auacucgaaaccauacaauaaa

SEQ ID NO: 2795122 - RNA, 17 nt, Leptospira interrogans serovar lai str. 56601
auacucuaauuuuuuau

SEQ ID NO: 2795123 - RNA, 12 nt, Leptospira interrogans serovar lai str. 56601
auacucuuaaaa

SEQ ID NO: 2795124 - RNA, 17 nt, Leptospira interrogans serovar lai str. 56601
auacugacagauugaua

SEQ ID NO: 2795125 - RNA, 17 nt, Leptospira interrogans serovar lai str. 56601
auacuguuaauuuuuau

SEQ ID NO: 2795126 - RNA, 13 nt, Leptospira interrogans serovar lai str. 56601
auacuuaaaaaua

SEQ ID NO: 2795127 - RNA, 13 nt, Leptospira interrogans serovar lai str. 56601
auacuuaauuuca

SEQ ID NO: 2795128 - RNA, 19 nt, Leptospira interrogans serovar lai str. 56601
auacuuagaauuuuuucgu

SEQ ID NO: 2795129 - RNA, 20 nt, Leptospira interrogans serovar lai str. 56601
auacuuaucacgaaaauuaa

SEQ ID NO: 2795130 - RNA, 22 nt, Leptospira interrogans serovar lai str. 56601
auacuuaucacgaaaauuaaaa

SEQ ID NO: 2795131 - RNA, 12 nt, Leptospira interrogans serovar lai str. 56601
auacuucaaaau

SEQ ID NO: 2795132 - RNA, 14 nt, Leptospira interrogans serovar lai str. 56601
auacuucuaaaaaa

SEQ ID NO: 2795133 - RNA, 16 nt, Leptospira interrogans serovar lai str. 56601
auacuucuaaaaaauu

SEQ ID NO: 2795134 - RNA, 13 nt, Leptospira interrogans serovar lai str. 56601
auacuucucuaaa

SEQ ID NO: 2795135 - RNA, 17 nt, Leptospira interrogans serovar lai str. 56601
auacuuguuucuaauuc

SEQ ID NO: 2795136 - RNA, 20 nt, Leptospira interrogans serovar lai str. 56601
auacuuuaaaaaauaucuua

SEQ ID NO: 2795137 - RNA, 20 nt, Leptospira interrogans serovar lai str. 56601
auacuuuaagaaaauuuaaa

SEQ ID NO: 2795138 - RNA, 16 nt, Leptospira interrogans serovar lai str. 56601
auacuuuaauaauaua

SEQ ID NO: 2795139 - RNA, 21 nt, Leptospira interrogans serovar lai str. 56601
auacuuuauagguucuggauu

SEQ ID NO: 2795140 - RNA, 22 nt, Leptospira interrogans serovar lai str. 56601
auacuuuauuuguauucaagag

SEQ ID NO: 2795141 - RNA, 16 nt, Leptospira interrogans serovar lai str. 56601
auacuuucaaaaaaua

SEQ ID NO: 2795142 - RNA, 14 nt, Leptospira interrogans serovar lai str. 56601
auacuuuuaaaaaa

SEQ ID NO: 2795143 - RNA, 22 nt, Leptospira interrogans serovar lai str. 56601
auacuuuuaaaaaguucucuuc

SEQ ID NO: 2795144 - RNA, 21 nt, Leptospira interrogans serovar lai str. 56601
auacuuuuagaaaauuagaaa

SEQ ID NO: 2795145 - RNA, 13 nt, Leptospira interrogans serovar lai str. 56601
auacuuuuagaag

SEQ ID NO: 2795146 - RNA, 20 nt, Leptospira interrogans serovar lai str. 56601
auacuuuuagauaauuauuc

SEQ ID NO: 2795147 - RNA, 22 nt, Leptospira interrogans serovar lai str. 56601
auacuuuuagauaauuauucuc

SEQ ID NO: 2795148 - RNA, 21 nt, Leptospira interrogans serovar lai str. 56601
auacuuuuugcaaguaaaaag

SEQ ID NO: 2795149 - RNA, 23 nt, Leptospira interrogans serovar lai str. 56601
auacuuuuugcaaguaaaaagac

SEQ ID NO: 2795150 - RNA, 21 nt, Leptospira interrogans serovar lai str. 56601
auagaaaaaauacauaaaaaa

SEQ ID NO: 2795151 - RNA, 12 nt, Leptospira interrogans serovar lai str. 56601
auagaaaagcau

SEQ ID NO: 2795152 - RNA, 14 nt, Leptospira interrogans serovar lai str. 56601
auagaaaauuuuuu

SEQ ID NO: 2795153 - RNA, 16 nt, Leptospira interrogans serovar lai str. 56601
auagaaacaaauggag

SEQ ID NO: 2795154 - RNA, 15 nt, Leptospira interrogans serovar lai str. 56601
auagaaaccgauuuu

SEQ ID NO: 2795155 - RNA, 17 nt, Leptospira interrogans serovar lai str. 56601
auagaaagacuuuucau

SEQ ID NO: 2795156 - RNA, 13 nt, Leptospira interrogans serovar lai str. 56601
auagaaauaacuu

SEQ ID NO: 2795157 - RNA, 17 nt, Leptospira interrogans serovar lai str. 56601
auagaaauacuucucca

SEQ ID NO: 2795158 - RNA, 16 nt, Leptospira interrogans serovar lai str. 56601
auagaaauauuuagaa

SEQ ID NO: 2795159 - RNA, 15 nt, Leptospira interrogans serovar lai str. 56601
auagaacaguuuguu

SEQ ID NO: 2795160 - RNA, 23 nt, Leptospira interrogans serovar lai str. 56601
auagaaccaucucaaaaauaucu

SEQ ID NO: 2795161 - RNA, 15 nt, Leptospira interrogans serovar lai str. 56601
auagaaccugcucca

SEQ ID NO: 2795162 - RNA, 15 nt, Leptospira interrogans serovar lai str. 56601
auagaacgcgauuug

SEQ ID NO: 2795163 - RNA, 23 nt, Leptospira interrogans serovar lai str. 56601
auagaacucuuuuaccuuaccac

SEQ ID NO: 2795164 - RNA, 21 nt, Leptospira interrogans serovar lai str. 56601
auagaagcgagacgaaaaacu

SEQ ID NO: 2795165 - RNA, 19 nt, Leptospira interrogans serovar lai str. 56601
auagaaguggguuguuaug

SEQ ID NO: 2795166 - RNA, 14 nt, Leptospira interrogans serovar lai str. 56601
auagaaguucggaa

SEQ ID NO: 2795167 - RNA, 18 nt, Leptospira interrogans serovar lai str. 56601
auagaauaaauuauacaa

SEQ ID NO: 2795168 - RNA, 22 nt, Leptospira interrogans serovar lai str. 56601
auagaauaaauuauacaauuua

SEQ ID NO: 2795169 - RNA, 14 nt, Leptospira interrogans serovar lai str. 56601
auagaauccaaugc

SEQ ID NO: 2795170 - RNA, 19 nt, Leptospira interrogans serovar lai str. 56601
auagaauuguguuaguucc

SEQ ID NO: 2795171 - RNA, 13 nt, Leptospira interrogans serovar lai str. 56601
auagaauuguuga

SEQ ID NO: 2795172 - RNA, 14 nt, Leptospira interrogans serovar lai str. 56601
auagaauuguugaa

SEQ ID NO: 2795173 - RNA, 20 nt, Leptospira interrogans serovar lai str. 56601
auagaauuguugaaaaauua

SEQ ID NO: 2795174 - RNA, 13 nt, Leptospira interrogans serovar lai str. 56601
auagaauuuugca

SEQ ID NO: 2795175 - RNA, 19 nt, Leptospira interrogans serovar lai str. 56601
auagaauuuugcaaaaaaa

SEQ ID NO: 2795176 - RNA, 13 nt, Leptospira interrogans serovar lai str. 56601
auagaauuuuugu

SEQ ID NO: 2795177 - RNA, 17 nt, Leptospira interrogans serovar lai str. 56601
auagaauuuuuguagaa

SEQ ID NO: 2795178 - RNA, 22 nt, Leptospira interrogans serovar lai str. 56601
auagacuaacgauuguaaaaaa

SEQ ID NO: 2795179 - RNA, 14 nt, Leptospira interrogans serovar lai str. 56601
auagagaauuaauu

SEQ ID NO: 2795180 - RNA, 17 nt, Leptospira interrogans serovar lai str. 56601
auagaggcuuuacauuu

SEQ ID NO: 2795181 - RNA, 20 nt, Leptospira interrogans serovar lai str. 56601
auagaggucgucucaaaaau

SEQ ID NO: 2795182 - RNA, 18 nt, Leptospira interrogans serovar lai str. 56601
auagaguaccauaaauuu

SEQ ID NO: 2795183 - RNA, 14 nt, Leptospira interrogans serovar lai str. 56601
auagaguucugaaa

SEQ ID NO: 2795184 - RNA, 13 nt, Leptospira interrogans serovar lai str. 56601
auagauagagaau

SEQ ID NO: 2795185 - RNA, 14 nt, Leptospira interrogans serovar lai str. 56601
auagaucaguuaua

SEQ ID NO: 2795186 - RNA, 17 nt, Leptospira interrogans serovar lai str. 56601
auagaucaguuauaagu

SEQ ID NO: 2795187 - RNA, 12 nt, Leptospira interrogans serovar lai str. 56601
auagauccaaau

SEQ ID NO: 2795188 - RNA, 21 nt, Leptospira interrogans serovar lai str. 56601
auagaucgauucuuuaaaugu

SEQ ID NO: 2795189 - RNA, 23 nt, Leptospira interrogans serovar lai str. 56601
auagaucuugagauccaauuauu

SEQ ID NO: 2795190 - RNA, 18 nt, Leptospira interrogans serovar lai str. 56601
auagaugcugaaaauggu

SEQ ID NO: 2795191 - RNA, 19 nt, Leptospira interrogans serovar lai str. 56601
auagauggagaauucauuu

SEQ ID NO: 2795192 - RNA, 16 nt, Leptospira interrogans serovar lai str. 56601
auagauugauuuaaau

SEQ ID NO: 2795193 - RNA, 17 nt, Leptospira interrogans serovar lai str. 56601
auagauuguaaguuuuu

SEQ ID NO: 2795194 - RNA, 17 nt, Leptospira interrogans serovar lai str. 56601
auagcaacaauuaacaa

SEQ ID NO: 2795195 - RNA, 20 nt, Leptospira interrogans serovar lai str. 56601
auagcagauuuucucaaaaa

SEQ ID NO: 2795196 - RNA, 15 nt, Leptospira interrogans serovar lai str. 56601
auauacguaaaaaua

SEQ ID NO: 2795197 - RNA, 21 nt, Leptospira interrogans serovar lai str. 56601
auauacgugaccaggaauacu

SEQ ID NO: 2795198 - RNA, 19 nt, Leptospira interrogans serovar lai str. 56601
auauacuuauaaagaauuu

SEQ ID NO: 2795199 - RNA, 21 nt, Leptospira interrogans serovar lai str. 56601
auauacuuauaaagaauuuua

SEQ ID NO: 2795200 - RNA, 23 nt, Leptospira interrogans serovar lai str. 56601
auauacuuauaaagaauuuuaaa

SEQ ID NO: 2795201 - RNA, 15 nt, Leptospira interrogans serovar lai str. 56601
auauacuuuucaaac

SEQ ID NO: 2795202 - RNA, 13 nt, Leptospira interrogans serovar lai str. 56601
auauagaaauuau

SEQ ID NO: 2795203 - RNA, 14 nt, Leptospira interrogans serovar lai str. 56601
auauagaaauuaua

SEQ ID NO: 2795204 - RNA, 13 nt, Leptospira interrogans serovar lai str. 56601
auauagaaauuuu

SEQ ID NO: 2795205 - RNA, 17 nt, Leptospira interrogans serovar lai str. 56601
auauagaaauuuucaaa

SEQ ID NO: 2795206 - RNA, 18 nt, Leptospira interrogans serovar lai str. 56601
auauagaaauuuucaaaa

SEQ ID NO: 2795207 - RNA, 23 nt, Leptospira interrogans serovar lai str. 56601
auauagaaccaucucaaaaauau

SEQ ID NO: 2795208 - RNA, 12 nt, Leptospira interrogans serovar lai str. 56601
auauagaacuuu

SEQ ID NO: 2795209 - RNA, 17 nt, Leptospira interrogans serovar lai str. 56601
auauagaacuuuucugg

SEQ ID NO: 2795210 - RNA, 15 nt, Leptospira interrogans serovar lai str. 56601
auauagcucuugaau

SEQ ID NO: 2795211 - RNA, 21 nt, Leptospira interrogans serovar lai str. 56601
auauaggaacuaccacagaaa

SEQ ID NO: 2795212 - RNA, 14 nt, Leptospira interrogans serovar lai str. 56601
auauaggaauuuau

SEQ ID NO: 2795213 - RNA, 21 nt, Leptospira interrogans serovar lai str. 56601
auauagguucuugcaaaaaua

SEQ ID NO: 2795214 - RNA, 20 nt, Leptospira interrogans serovar lai str. 56601
auauaguauaaauucgcaaa

SEQ ID NO: 2795215 - RNA, 23 nt, Leptospira interrogans serovar lai str. 56601
auauagucguauauuagauuuau

SEQ ID NO: 2795216 - RNA, 15 nt, Leptospira interrogans serovar lai str. 56601
auauaguuaaauuuu

SEQ ID NO: 2795217 - RNA, 23 nt, Leptospira interrogans serovar lai str. 56601
auauaguuccuacaauuuuagaa

SEQ ID NO: 2795218 - RNA, 14 nt, Leptospira interrogans serovar lai str. 56601
auauaguuuugaga

SEQ ID NO: 2795219 - RNA, 14 nt, Leptospira interrogans serovar lai str. 56601
auauauaauuuauu

SEQ ID NO: 2795220 - RNA, 23 nt, Leptospira interrogans serovar lai str. 56601
auauauaguuuugagcauaaaaa

SEQ ID NO: 2795221 - RNA, 15 nt, Leptospira interrogans serovar lai str. 56601
auauaucuucuuugg

SEQ ID NO: 2795222 - RNA, 15 nt, Leptospira interrogans serovar lai str. 56601
auauauuaaaguauu

SEQ ID NO: 2795223 - RNA, 18 nt, Leptospira interrogans serovar lai str. 56601
auauauuagaauauacaa

SEQ ID NO: 2795224 - RNA, 22 nt, Leptospira interrogans serovar lai str. 56601
auauauuagaauuguugaaaaa

SEQ ID NO: 2795225 - RNA, 14 nt, Leptospira interrogans serovar lai str. 56601
auauauuauaauaa

SEQ ID NO: 2795226 - RNA, 16 nt, Leptospira interrogans serovar lai str. 56601
auauauucaaaagauu

SEQ ID NO: 2795227 - RNA, 13 nt, Leptospira interrogans serovar lai str. 56601
auauauucaguau

SEQ ID NO: 2795228 - RNA, 13 nt, Leptospira interrogans serovar lai str. 56601
auauauuuuuaau

SEQ ID NO: 2795229 - RNA, 15 nt, Leptospira interrogans serovar lai str. 56601
auaucaaacuuauaa

SEQ ID NO: 2795230 - RNA, 16 nt, Leptospira interrogans serovar lai str. 56601
auaucaacaaucggag

SEQ ID NO: 2795231 - RNA, 20 nt, Leptospira interrogans serovar lai str. 56601
auaucaauccuguaaauuca

SEQ ID NO: 2795232 - RNA, 23 nt, Leptospira interrogans serovar lai str. 56601
auaucaaugaucauauccgaaag

SEQ ID NO: 2795233 - RNA, 15 nt, Leptospira interrogans serovar lai str. 56601
auaucacaaauuuua

SEQ ID NO: 2795234 - RNA, 15 nt, Leptospira interrogans serovar lai str. 56601
auaucagaucuauuu

SEQ ID NO: 2795235 - RNA, 16 nt, Leptospira interrogans serovar lai str. 56601
auaucagaucuauuuc

SEQ ID NO: 2795236 - RNA, 19 nt, Leptospira interrogans serovar lai str. 56601
auaucagauugauacugca

SEQ ID NO: 2795237 - RNA, 16 nt, Leptospira interrogans serovar lai str. 56601
auaucauaaauuuuua

SEQ ID NO: 2795238 - RNA, 15 nt, Leptospira interrogans serovar lai str. 56601
auaucauaacaaaua

SEQ ID NO: 2795239 - RNA, 21 nt, Leptospira interrogans serovar lai str. 56601
auaucauaacaaauaaaagga

SEQ ID NO: 2795240 - RNA, 22 nt, Leptospira interrogans serovar lai str. 56601
auaucauauuguuuaauaccua

SEQ ID NO: 2795241 - RNA, 13 nt, Leptospira interrogans serovar lai str. 56601
auauccgaaagau

SEQ ID NO: 2795242 - RNA, 18 nt, Leptospira interrogans serovar lai str. 56601
auauccgaaagauaaauc

SEQ ID NO: 2795243 - RNA, 21 nt, Leptospira interrogans serovar lai str. 56601
auauccgaaagauaaaucgca

SEQ ID NO: 2795244 - RNA, 16 nt, Leptospira interrogans serovar lai str. 56601
auaucgaauacauuua

SEQ ID NO: 2795245 - RNA, 19 nt, Leptospira interrogans serovar lai str. 56601
auaucggaauaacuuucuu

SEQ ID NO: 2795246 - RNA, 18 nt, Leptospira interrogans serovar lai str. 56601
auaucgugaaacuuucca

SEQ ID NO: 2795247 - RNA, 17 nt, Leptospira interrogans serovar lai str. 56601
auaucuaauauuuuucc

SEQ ID NO: 2795248 - RNA, 18 nt, Leptospira interrogans serovar lai str. 56601
auaucuaauauuuuucca

SEQ ID NO: 2795249 - RNA, 18 nt, Leptospira interrogans serovar lai str. 56601
auaucuaaucuuuugaaa

SEQ ID NO: 2795250 - RNA, 14 nt, Leptospira interrogans serovar lai str. 56601
auaucuacaaaaga

SEQ ID NO: 2795251 - RNA, 20 nt, Leptospira interrogans serovar lai str. 56601
auaucuacaaaagauuuuua

SEQ ID NO: 2795252 - RNA, 21 nt, Leptospira interrogans serovar lai str. 56601
auaucuacaaaagauuuuuau

SEQ ID NO: 2795253 - RNA, 18 nt, Leptospira interrogans serovar lai str. 56601
auaucuacgacuaacaaa

SEQ ID NO: 2795254 - RNA, 13 nt, Leptospira interrogans serovar lai str. 56601
auaucuccaaaau

SEQ ID NO: 2795255 - RNA, 17 nt, Leptospira interrogans serovar lai str. 56601
auaucuccaaaaucauu

SEQ ID NO: 2795256 - RNA, 21 nt, Leptospira interrogans serovar lai str. 56601
auaucucguauugaauuuuuu

SEQ ID NO: 2795257 - RNA, 22 nt, Leptospira interrogans serovar lai str. 56601
auaucucguauugaauuuuuuc

SEQ ID NO: 2795258 - RNA, 15 nt, Leptospira interrogans serovar lai str. 56601
auaucugaauuuuua

SEQ ID NO: 2795259 - RNA, 16 nt, Leptospira interrogans serovar lai str. 56601
auaucugaauuuuuau

SEQ ID NO: 2795260 - RNA, 20 nt, Leptospira interrogans serovar lai str. 56601
auaucugaauuuuuauaagu

SEQ ID NO: 2795261 - RNA, 14 nt, Leptospira interrogans serovar lai str. 56601
auaucuuaagaauu

SEQ ID NO: 2795262 - RNA, 16 nt, Leptospira interrogans serovar lai str. 56601
auaucuuaauuaaaaa

SEQ ID NO: 2795263 - RNA, 18 nt, Leptospira interrogans serovar lai str. 56601
auaucuuaauuaaaaaau

SEQ ID NO: 2795264 - RNA, 21 nt, Leptospira interrogans serovar lai str. 56601
auaucuuauguucccaaauga

SEQ ID NO: 2795265 - RNA, 19 nt, Leptospira interrogans serovar lai str. 56601
auaucuuuauuuaauacga

SEQ ID NO: 2795266 - RNA, 20 nt, Leptospira interrogans serovar lai str. 56601
auaugaacguauucuuuaau

SEQ ID NO: 2795267 - RNA, 21 nt, Leptospira interrogans serovar lai str. 56601
auaugaauuaauuuguaauuc

SEQ ID NO: 2795268 - RNA, 12 nt, Leptospira interrogans serovar lai str. 56601
auaugagagucu

SEQ ID NO: 2795269 - RNA, 15 nt, Leptospira interrogans serovar lai str. 56601
auaugagugaaugga

SEQ ID NO: 2795270 - RNA, 23 nt, Leptospira interrogans serovar lai str. 56601
auaugaguucccacaaauuccug

SEQ ID NO: 2795271 - RNA, 22 nt, Leptospira interrogans serovar lai str. 56601
auaugaguucccacauuuuuaa

SEQ ID NO: 2795272 - RNA, 20 nt, Leptospira interrogans serovar lai str. 56601
auaugauuuaaaaucacaaa

SEQ ID NO: 2795273 - RNA, 22 nt, Leptospira interrogans serovar lai str. 56601
auaugauuuaaaaucacaaaaa

SEQ ID NO: 2795274 - RNA, 21 nt, Leptospira interrogans serovar lai str. 56601
auaugauuuuauaccuugggc

SEQ ID NO: 2795275 - RNA, 13 nt, Leptospira interrogans serovar lai str. 56601
auauggaaacuac

SEQ ID NO: 2795276 - RNA, 19 nt, Leptospira interrogans serovar lai str. 56601
auauggaguucuaaauuau

SEQ ID NO: 2795277 - RNA, 20 nt, Leptospira interrogans serovar lai str. 56601
auauggauuauccaaaacaa

SEQ ID NO: 2795278 - RNA, 23 nt, Leptospira interrogans serovar lai str. 56601
auauggguuuuuacgcaaguaau

SEQ ID NO: 2795279 - RNA, 14 nt, Leptospira interrogans serovar lai str. 56601
auauuuuaaagaaa

SEQ ID NO: 2795280 - RNA, 22 nt, Leptospira interrogans serovar lai str. 56601
auauuuuaauuuucuaauauaa

SEQ ID NO: 2795281 - RNA, 19 nt, Leptospira interrogans serovar lai str. 56601
auauuuuacaguaaaacuu

SEQ ID NO: 2795282 - RNA, 13 nt, Leptospira interrogans serovar lai str. 56601
auauuuucaaaaa

SEQ ID NO: 2795283 - RNA, 15 nt, Leptospira interrogans serovar lai str. 56601
auauuuucaaaaaau

SEQ ID NO: 2795284 - RNA, 19 nt, Leptospira interrogans serovar lai str. 56601
auauuuucaaaaaauaaaa

SEQ ID NO: 2795285 - RNA, 15 nt, Leptospira interrogans serovar lai str. 56601
auauuuucaggcaua

SEQ ID NO: 2795286 - RNA, 22 nt, Leptospira interrogans serovar lai str. 56601
auauuuucgccgaaacauucgg

SEQ ID NO: 2795287 - RNA, 14 nt, Leptospira interrogans serovar lai str. 56601
auauuuucuauuua

SEQ ID NO: 2795288 - RNA, 16 nt, Leptospira interrogans serovar lai str. 56601
auauuuucuauuuaac

SEQ ID NO: 2795289 - RNA, 21 nt, Leptospira interrogans serovar lai str. 56601
auauuuugagcagauucuaaa

SEQ ID NO: 2795290 - RNA, 18 nt, Leptospira interrogans serovar lai str. 56601
auauuuugcaugaaauca

SEQ ID NO: 2795291 - RNA, 20 nt, Leptospira interrogans serovar lai str. 56601
auauuuuuauguauuuuaaa

SEQ ID NO: 2795292 - RNA, 19 nt, Leptospira interrogans serovar lai str. 56601
auauuuuugugaaacucaa

SEQ ID NO: 2795293 - RNA, 20 nt, Leptospira interrogans serovar lai str. 56601
auauuuuugugaaacucaau

SEQ ID NO: 2795294 - RNA, 16 nt, Leptospira interrogans serovar lai str. 56601
auauuuuuuaaaaaua

SEQ ID NO: 2795295 - RNA, 19 nt, Leptospira interrogans serovar lai str. 56601
auauuuuuuaaaaauauaa

SEQ ID NO: 2795296 - RNA, 20 nt, Leptospira interrogans serovar lai str. 56601
auauuuuuuaaaaauauaaa

SEQ ID NO: 2795297 - RNA, 15 nt, Leptospira interrogans serovar lai str. 56601
auauuuuuuccaaaa

SEQ ID NO: 2795298 - RNA, 16 nt, Leptospira interrogans serovar lai str. 56601
auauuuuuugaaauca

SEQ ID NO: 2795299 - RNA, 15 nt, Leptospira interrogans serovar lai str. 56601
aucaaaaaauugcau

SEQ ID NO: 2795300 - RNA, 12 nt, Leptospira interrogans serovar lai str. 56601
aucaaaaacaaa

SEQ ID NO: 2795301 - RNA, 18 nt, Leptospira interrogans serovar lai str. 56601
aucaaaacgguuuucuaa

SEQ ID NO: 2795302 - RNA, 22 nt, Leptospira interrogans serovar lai str. 56601
aucaaaacuuaaaucccauuuu

SEQ ID NO: 2795303 - RNA, 17 nt, Leptospira interrogans serovar lai str. 56601
aucaaaauuuuuuugaa

SEQ ID NO: 2795304 - RNA, 14 nt, Leptospira interrogans serovar lai str. 56601
aucaaaccuuucuu

SEQ ID NO: 2795305 - RNA, 19 nt, Leptospira interrogans serovar lai str. 56601
aucaaaccuuucuuucuga

SEQ ID NO: 2795306 - RNA, 21 nt, Leptospira interrogans serovar lai str. 56601
aucaaaccuuucuuucugaua

SEQ ID NO: 2795307 - RNA, 17 nt, Leptospira interrogans serovar lai str. 56601
aucaaacggucuuucuu

SEQ ID NO: 2795308 - RNA, 22 nt, Leptospira interrogans serovar lai str. 56601
aucaaacuuauaacugcaagaa

SEQ ID NO: 2795309 - RNA, 16 nt, Leptospira interrogans serovar lai str. 56601
aucaaagagaugauuu

SEQ ID NO: 2795310 - RNA, 23 nt, Leptospira interrogans serovar lai str. 56601
aucaaagauauuucaauauaaaa

SEQ ID NO: 2795311 - RNA, 18 nt, Leptospira interrogans serovar lai str. 56601
aucaaagcaaaguuucuu

SEQ ID NO: 2795312 - RNA, 16 nt, Leptospira interrogans serovar lai str. 56601
aucaaaggaaauaaaa

SEQ ID NO: 2795313 - RNA, 13 nt, Leptospira interrogans serovar lai str. 56601
aucaaaguuauuu

SEQ ID NO: 2795314 - RNA, 14 nt, Leptospira interrogans serovar lai str. 56601
aucaaauaaaguuu

SEQ ID NO: 2795315 - RNA, 22 nt, Leptospira interrogans serovar lai str. 56601
aucaaauaagcgcggauuuauu

SEQ ID NO: 2795316 - RNA, 17 nt, Leptospira interrogans serovar lai str. 56601
aucaaauacaaaaacga

SEQ ID NO: 2795317 - RNA, 21 nt, Leptospira interrogans serovar lai str. 56601
aucaaauagaguaccauaaau

SEQ ID NO: 2795318 - RNA, 14 nt, Leptospira interrogans serovar lai str. 56601
aucaaauauacaaa

SEQ ID NO: 2795319 - RNA, 17 nt, Leptospira interrogans serovar lai str. 56601
aucaaauauacaaaguu

SEQ ID NO: 2795320 - RNA, 20 nt, Leptospira interrogans serovar lai str. 56601
aucaaauauacaaaguuuau

SEQ ID NO: 2795321 - RNA, 13 nt, Leptospira interrogans serovar lai str. 56601
aucaaauccgaaa

SEQ ID NO: 2795322 - RNA, 22 nt, Leptospira interrogans serovar lai str. 56601
aucaaaucugaaauucaucaaa

SEQ ID NO: 2795323 - RNA, 17 nt, Leptospira interrogans serovar lai str. 56601
aucaaaugcaguaaugc

SEQ ID NO: 2795324 - RNA, 22 nt, Leptospira interrogans serovar lai str. 56601
aucaaauucacauaaaguuaau

SEQ ID NO: 2795325 - RNA, 20 nt, Leptospira interrogans serovar lai str. 56601
aucaaauucaugauaguuaa

SEQ ID NO: 2795326 - RNA, 13 nt, Leptospira interrogans serovar lai str. 56601
aucaaauuucugc

SEQ ID NO: 2795327 - RNA, 21 nt, Leptospira interrogans serovar lai str. 56601
aucaaauuucugcaucaaauc

SEQ ID NO: 2795328 - RNA, 20 nt, Leptospira interrogans serovar lai str. 56601
aucaaauuuuugcauaaaau

SEQ ID NO: 2795329 - RNA, 21 nt, Leptospira interrogans serovar lai str. 56601
aucaaauuuuugcauaaaauc

SEQ ID NO: 2795330 - RNA, 15 nt, Leptospira interrogans serovar lai str. 56601
aucaacaaaauuacu

SEQ ID NO: 2795331 - RNA, 19 nt, Leptospira interrogans serovar lai str. 56601
aucaacaagaaugaaaaaa

SEQ ID NO: 2795332 - RNA, 21 nt, Leptospira interrogans serovar lai str. 56601
aucaacaaguuuacacauuua

SEQ ID NO: 2795333 - RNA, 16 nt, Leptospira interrogans serovar lai str. 56601
aucaacaucacgcaca

SEQ ID NO: 2795334 - RNA, 15 nt, Leptospira interrogans serovar lai str. 56601
aucaacuacuaaucu

SEQ ID NO: 2795335 - RNA, 12 nt, Leptospira interrogans serovar lai str. 56601
aucaacucaucu

SEQ ID NO: 2795336 - RNA, 21 nt, Leptospira interrogans serovar lai str. 56601
aucaacucaucuaguuuuuga

SEQ ID NO: 2795337 - RNA, 18 nt, Leptospira interrogans serovar lai str. 56601
aucaacucuguaaauuca

SEQ ID NO: 2795338 - RNA, 19 nt, Leptospira interrogans serovar lai str. 56601
aucaacucuguaaauucaa

SEQ ID NO: 2795339 - RNA, 17 nt, Leptospira interrogans serovar lai str. 56601
aucaacuuuuggaacaa

SEQ ID NO: 2795340 - RNA, 15 nt, Leptospira interrogans serovar lai str. 56601
aucaagaagagucaa

SEQ ID NO: 2795341 - RNA, 11 nt, Leptospira interrogans serovar lai str. 56601
aucaagaauua

SEQ ID NO: 2795342 - RNA, 13 nt, Leptospira interrogans serovar lai str. 56601
aucaagaauuaau

SEQ ID NO: 2795343 - RNA, 20 nt, Leptospira interrogans serovar lai str. 56601
aucaagagaacucauuaacu

SEQ ID NO: 2795344 - RNA, 23 nt, Leptospira interrogans serovar lai str. 56601
aucaauaaauugcacaaaagaaa

SEQ ID NO: 2795345 - RNA, 18 nt, Leptospira interrogans serovar lai str. 56601
aucaauaccgauuucuau

SEQ ID NO: 2795346 - RNA, 13 nt, Leptospira interrogans serovar lai str. 56601
aucaauagaaaua

SEQ ID NO: 2795347 - RNA, 14 nt, Leptospira interrogans serovar lai str. 56601
aucaauagaaauac

SEQ ID NO: 2795348 - RNA, 14 nt, Leptospira interrogans serovar lai str. 56601
aucaauagaauugu

SEQ ID NO: 2795349 - RNA, 17 nt, Leptospira interrogans serovar lai str. 56601
aucaauccucuuugaaa

SEQ ID NO: 2795350 - RNA, 23 nt, Leptospira interrogans serovar lai str. 56601
aucaauccuguaaauucaaaaua

SEQ ID NO: 2795351 - RNA, 16 nt, Leptospira interrogans serovar lai str. 56601
aucaaucuacuugaau

SEQ ID NO: 2795352 - RNA, 13 nt, Leptospira interrogans serovar lai str. 56601
aucaaucugcaaa

SEQ ID NO: 2795353 - RNA, 18 nt, Leptospira interrogans serovar lai str. 56601
aucaaugucaaaaaaaau

SEQ ID NO: 2795354 - RNA, 21 nt, Leptospira interrogans serovar lai str. 56601
aucaauguugugauaaagagu

SEQ ID NO: 2795355 - RNA, 14 nt, Leptospira interrogans serovar lai str. 56601
aucaauucugaaaa

SEQ ID NO: 2795356 - RNA, 14 nt, Leptospira interrogans serovar lai str. 56601
aucaauucuuaaaa

SEQ ID NO: 2795357 - RNA, 23 nt, Leptospira interrogans serovar lai str. 56601
aucaauucuucuuucguuugagg

SEQ ID NO: 2795358 - RNA, 21 nt, Leptospira interrogans serovar lai str. 56601
aucaauuuguuccuaaaaaau

SEQ ID NO: 2795359 - RNA, 23 nt, Leptospira interrogans serovar lai str. 56601
aucaauuuguuccuaaaaaauaa

SEQ ID NO: 2795360 - RNA, 13 nt, Leptospira interrogans serovar lai str. 56601
aucaauuuuagaa

SEQ ID NO: 2795361 - RNA, 15 nt, Leptospira interrogans serovar lai str. 56601
aucacaaaucacaau

SEQ ID NO: 2795362 - RNA, 12 nt, Leptospira interrogans serovar lai str. 56601
auccauuuuucc

SEQ ID NO: 2795363 - RNA, 17 nt, Leptospira interrogans serovar lai str. 56601
auccauuuuucugaaaa

SEQ ID NO: 2795364 - RNA, 18 nt, Leptospira interrogans serovar lai str. 56601
aucccaaauucuuuccuu

SEQ ID NO: 2795365 - RNA, 20 nt, Leptospira interrogans serovar lai str. 56601
aucccaguugagaguuuuuc

SEQ ID NO: 2795366 - RNA, 16 nt, Leptospira interrogans serovar lai str. 56601
aucccggaucguuuuu

SEQ ID NO: 2795367 - RNA, 13 nt, Leptospira interrogans serovar lai str. 56601
aucccguaaaacu

SEQ ID NO: 2795368 - RNA, 22 nt, Leptospira interrogans serovar lai str. 56601
aucccuaagacuuggaguucuu

SEQ ID NO: 2795369 - RNA, 23 nt, Leptospira interrogans serovar lai str. 56601
aucccuaagacuuggaguucuua

SEQ ID NO: 2795370 - RNA, 22 nt, Leptospira interrogans serovar lai str. 56601
aucccuuccuuccgaucccaac

SEQ ID NO: 2795371 - RNA, 11 nt, Leptospira interrogans serovar lai str. 56601
aucccuuuggc

SEQ ID NO: 2795372 - RNA, 21 nt, Leptospira interrogans serovar lai str. 56601
aucccuuuugcauugaaauca

SEQ ID NO: 2795373 - RNA, 15 nt, Leptospira interrogans serovar lai str. 56601
auccgaaaaauucca

SEQ ID NO: 2795374 - RNA, 13 nt, Leptospira interrogans serovar lai str. 56601
auccgaaaaugua

SEQ ID NO: 2795375 - RNA, 15 nt, Leptospira interrogans serovar lai str. 56601
auccgaaagauaaau

SEQ ID NO: 2795376 - RNA, 12 nt, Leptospira interrogans serovar lai str. 56601
auccgcauucuc

SEQ ID NO: 2795377 - RNA, 14 nt, Leptospira interrogans serovar lai str. 56601
auccgcauucucac

SEQ ID NO: 2795378 - RNA, 21 nt, Leptospira interrogans serovar lai str. 56601
auccguaaaaaacguuuuguu

SEQ ID NO: 2795379 - RNA, 24 nt, Leptospira interrogans serovar lai str. 56601
auccguagccgcuucaaaguugau

SEQ ID NO: 2795380 - RNA, 23 nt, Leptospira interrogans serovar lai str. 56601
auccuaaagucgaauuuuuucac

SEQ ID NO: 2795381 - RNA, 16 nt, Leptospira interrogans serovar lai str. 56601
auccuaaugaaaaaga

SEQ ID NO: 2795382 - RNA, 18 nt, Leptospira interrogans serovar lai str. 56601
auccuaaugaaaaagaaa

SEQ ID NO: 2795383 - RNA, 17 nt, Leptospira interrogans serovar lai str. 56601
auccuauaauaaaauua

SEQ ID NO: 2795384 - RNA, 19 nt, Leptospira interrogans serovar lai str. 56601
auccucacuccgauacauu

SEQ ID NO: 2795385 - RNA, 23 nt, Leptospira interrogans serovar lai str. 56601
auccucugaacuucaucaauggu

SEQ ID NO: 2795386 - RNA, 15 nt, Leptospira interrogans serovar lai str. 56601
auccucuucuuuguc

SEQ ID NO: 2795387 - RNA, 21 nt, Leptospira interrogans serovar lai str. 56601
auccugcuaacugauuauaaa

SEQ ID NO: 2795388 - RNA, 15 nt, Leptospira interrogans serovar lai str. 56601
auccuguaaauucaa

SEQ ID NO: 2795389 - RNA, 18 nt, Leptospira interrogans serovar lai str. 56601
auccuguaaauucaaaau

SEQ ID NO: 2795390 - RNA, 20 nt, Leptospira interrogans serovar lai str. 56601
auccuguaaauucaaaauaa

SEQ ID NO: 2795391 - RNA, 22 nt, Leptospira interrogans serovar lai str. 56601
auccuuacgaugucuuuucaau

SEQ ID NO: 2795392 - RNA, 17 nt, Leptospira interrogans serovar lai str. 56601
auccuuacuuaccucua

SEQ ID NO: 2795393 - RNA, 21 nt, Leptospira interrogans serovar lai str. 56601
auccuuaugaaagcaauccau

SEQ ID NO: 2795394 - RNA, 21 nt, Leptospira interrogans serovar lai str. 56601
auccuucaaacuuuucggaac

SEQ ID NO: 2795395 - RNA, 14 nt, Leptospira interrogans serovar lai str. 56601
auccuucuuuucuu

SEQ ID NO: 2795396 - RNA, 23 nt, Leptospira interrogans serovar lai str. 56601
auccuugggauaaauauucucua

SEQ ID NO: 2795397 - RNA, 18 nt, Leptospira interrogans serovar lai str. 56601
auccuugugcaauaauuu

SEQ ID NO: 2795398 - RNA, 20 nt, Leptospira interrogans serovar lai str. 56601
auccuuucauguuauaucga

SEQ ID NO: 2795399 - RNA, 23 nt, Leptospira interrogans serovar lai str. 56601
auccuuuccgggucgauuuugau

SEQ ID NO: 2795400 - RNA, 13 nt, Leptospira interrogans serovar lai str. 56601
auccuuuuucuuc

SEQ ID NO: 2795401 - RNA, 14 nt, Leptospira interrogans serovar lai str. 56601
aucgaaaaaacaaa

SEQ ID NO: 2795402 - RNA, 14 nt, Leptospira interrogans serovar lai str. 56601
aucgaaaaaauaca

SEQ ID NO: 2795403 - RNA, 15 nt, Leptospira interrogans serovar lai str. 56601
aucgaaguugauuuc

SEQ ID NO: 2795404 - RNA, 15 nt, Leptospira interrogans serovar lai str. 56601
aucgaauaagaaauu

SEQ ID NO: 2795405 - RNA, 13 nt, Leptospira interrogans serovar lai str. 56601
aucgaaucuuuug

SEQ ID NO: 2795406 - RNA, 22 nt, Leptospira interrogans serovar lai str. 56601
aucgaauggaaaucuuuuaaaa

SEQ ID NO: 2795407 - RNA, 17 nt, Leptospira interrogans serovar lai str. 56601
aucgaauuuauguuuca

SEQ ID NO: 2795408 - RNA, 21 nt, Leptospira interrogans serovar lai str. 56601
aucgaauuucuucauaaaauc

SEQ ID NO: 2795409 - RNA, 23 nt, Leptospira interrogans serovar lai str. 56601
aucgacgauuuuacgaacaaauu

SEQ ID NO: 2795410 - RNA, 15 nt, Leptospira interrogans serovar lai str. 56601
aucgaggaaauucua

SEQ ID NO: 2795411 - RNA, 18 nt, Leptospira interrogans serovar lai str. 56601
aucgaggaaauucuaugu

SEQ ID NO: 2795412 - RNA, 17 nt, Leptospira interrogans serovar lai str. 56601
aucgaguguaauaugaa

SEQ ID NO: 2795413 - RNA, 16 nt, Leptospira interrogans serovar lai str. 56601
aucgauaacuugauuu

SEQ ID NO: 2795414 - RNA, 19 nt, Leptospira interrogans serovar lai str. 56601
aucgauaacuugauuuuac

SEQ ID NO: 2795415 - RNA, 21 nt, Leptospira interrogans serovar lai str. 56601
aucgauaggaguauaagucga

SEQ ID NO: 2795416 - RNA, 13 nt, Leptospira interrogans serovar lai str. 56601
aucgaucuguaaa

SEQ ID NO: 2795417 - RNA, 18 nt, Leptospira interrogans serovar lai str. 56601
aucgaugugauagaaagg

SEQ ID NO: 2795418 - RNA, 22 nt, Leptospira interrogans serovar lai str. 56601
aucgauuacucuuugagaaacg

SEQ ID NO: 2795419 - RNA, 14 nt, Leptospira interrogans serovar lai str. 56601
aucgauucagagug

SEQ ID NO: 2795420 - RNA, 16 nt, Leptospira interrogans serovar lai str. 56601
aucgauuuacuuuaaa

SEQ ID NO: 2795421 - RNA, 19 nt, Leptospira interrogans serovar lai str. 56601
aucgauuuacuuuaaaauu

SEQ ID NO: 2795422 - RNA, 14 nt, Leptospira interrogans serovar lai str. 56601
aucgcaaauacagu

SEQ ID NO: 2795423 - RNA, 17 nt, Leptospira interrogans serovar lai str. 56601
aucgcacgucccacaaa

SEQ ID NO: 2795424 - RNA, 19 nt, Leptospira interrogans serovar lai str. 56601
aucgcagguugcaauccaa

SEQ ID NO: 2795425 - RNA, 22 nt, Leptospira interrogans serovar lai str. 56601
aucgcauuuggcaauuugugaa

SEQ ID NO: 2795426 - RNA, 21 nt, Leptospira interrogans serovar lai str. 56601
aucgccguucugggcucaaaa

SEQ ID NO: 2795427 - RNA, 23 nt, Leptospira interrogans serovar lai str. 56601
aucgccguucugggcuccaaaag

SEQ ID NO: 2795428 - RNA, 14 nt, Leptospira interrogans serovar lai str. 56601
aucgcgaagaaagg

SEQ ID NO: 2795429 - RNA, 19 nt, Leptospira interrogans serovar lai str. 56601
aucgcuaaacuaucuauua

SEQ ID NO: 2795430 - RNA, 15 nt, Leptospira interrogans serovar lai str. 56601
aucgcucgcaaauuu

SEQ ID NO: 2795431 - RNA, 19 nt, Leptospira interrogans serovar lai str. 56601
aucgcugguuuuauuucug

SEQ ID NO: 2795432 - RNA, 13 nt, Leptospira interrogans serovar lai str. 56601
aucgcuucuaugg

SEQ ID NO: 2795433 - RNA, 23 nt, Leptospira interrogans serovar lai str. 56601
aucgcuuugugacuaucaacaag

SEQ ID NO: 2795434 - RNA, 18 nt, Leptospira interrogans serovar lai str. 56601
aucggaaaauugaauauu

SEQ ID NO: 2795435 - RNA, 13 nt, Leptospira interrogans serovar lai str. 56601
aucggaaauagug

SEQ ID NO: 2795436 - RNA, 14 nt, Leptospira interrogans serovar lai str. 56601
aucggaaccaaagg

SEQ ID NO: 2795437 - RNA, 18 nt, Leptospira interrogans serovar lai str. 56601
aucggaaccaaaggauaa

SEQ ID NO: 2795438 - RNA, 17 nt, Leptospira interrogans serovar lai str. 56601
aucggaauaacuuucuu

SEQ ID NO: 2795439 - RNA, 14 nt, Leptospira interrogans serovar lai str. 56601
aucggagaauuuaa

SEQ ID NO: 2795440 - RNA, 14 nt, Leptospira interrogans serovar lai str. 56601
aucggagucauaac

SEQ ID NO: 2795441 - RNA, 19 nt, Leptospira interrogans serovar lai str. 56601
aucggcauaagcaaaaaua

SEQ ID NO: 2795442 - RNA, 23 nt, Leptospira interrogans serovar lai str. 56601
aucggcuccauauuccagaagua

SEQ ID NO: 2795443 - RNA, 22 nt, Leptospira interrogans serovar lai str. 56601
aucgggauggagauuacuuuuu

SEQ ID NO: 2795444 - RNA, 14 nt, Leptospira interrogans serovar lai str. 56601
aucgguaaauacga

SEQ ID NO: 2795445 - RNA, 23 nt, Leptospira interrogans serovar lai str. 56601
aucugaauuuuaccaaauuguuu

SEQ ID NO: 2795446 - RNA, 13 nt, Leptospira interrogans serovar lai str. 56601
aucugaauuuuua

SEQ ID NO: 2795447 - RNA, 16 nt, Leptospira interrogans serovar lai str. 56601
aucugauauuuuaaau

SEQ ID NO: 2795448 - RNA, 17 nt, Leptospira interrogans serovar lai str. 56601
aucugauauuuuaaauu

SEQ ID NO: 2795449 - RNA, 19 nt, Leptospira interrogans serovar lai str. 56601
aucugauauuuuaaauuga

SEQ ID NO: 2795450 - RNA, 14 nt, Leptospira interrogans serovar lai str. 56601
aucugcaucuuuuc

SEQ ID NO: 2795451 - RNA, 16 nt, Leptospira interrogans serovar lai str. 56601
aucugcaucuuuucua

SEQ ID NO: 2795452 - RNA, 14 nt, Leptospira interrogans serovar lai str. 56601
aucugcgauuaaag

SEQ ID NO: 2795453 - RNA, 23 nt, Leptospira interrogans serovar lai str. 56601
aucugcgauuaaagauuuuucuu

SEQ ID NO: 2795454 - RNA, 15 nt, Leptospira interrogans serovar lai str. 56601
aucugcugaauuuac

SEQ ID NO: 2795455 - RNA, 15 nt, Leptospira interrogans serovar lai str. 56601
aucugcuuuuuuaaa

SEQ ID NO: 2795456 - RNA, 20 nt, Leptospira interrogans serovar lai str. 56601
aucugcuuuuuuaaaccuuc

SEQ ID NO: 2795457 - RNA, 20 nt, Leptospira interrogans serovar lai str. 56601
aucuggaacuuuaauuauug

SEQ ID NO: 2795458 - RNA, 21 nt, Leptospira interrogans serovar lai str. 56601
aucuggaagccaaaaccaauu

SEQ ID NO: 2795459 - RNA, 16 nt, Leptospira interrogans serovar lai str. 56601
aucugggcaaauuuag

SEQ ID NO: 2795460 - RNA, 17 nt, Leptospira interrogans serovar lai str. 56601
aucuggucggaauuacg

SEQ ID NO: 2795461 - RNA, 14 nt, Leptospira interrogans serovar lai str. 56601
aucuguaaaaugau

SEQ ID NO: 2795462 - RNA, 23 nt, Leptospira interrogans serovar lai str. 56601
aucuguaaaaugauguaggaacu

SEQ ID NO: 2795463 - RNA, 22 nt, Leptospira interrogans serovar lai str. 56601
aucuguaaaaugaugugggaac

SEQ ID NO: 2795464 - RNA, 15 nt, Leptospira interrogans serovar lai str. 56601
aucuguaauuuuaca

SEQ ID NO: 2795465 - RNA, 19 nt, Leptospira interrogans serovar lai str. 56601
aucuguacuuaaauuuuau

SEQ ID NO: 2795466 - RNA, 20 nt, Leptospira interrogans serovar lai str. 56601
aucugucgagcguccauaga

SEQ ID NO: 2795467 - RNA, 14 nt, Leptospira interrogans serovar lai str. 56601
aucugucggaauua

SEQ ID NO: 2795468 - RNA, 14 nt, Leptospira interrogans serovar lai str. 56601
aucugugggaacua

SEQ ID NO: 2795469 - RNA, 21 nt, Leptospira interrogans serovar lai str. 56601
aucugugggaacuaccacaaa

SEQ ID NO: 2795470 - RNA, 22 nt, Leptospira interrogans serovar lai str. 56601
aucugugggaacucucacaaau

SEQ ID NO: 2795471 - RNA, 20 nt, Leptospira interrogans serovar lai str. 56601
aucuguuuagaauauuuucu

SEQ ID NO: 2795472 - RNA, 15 nt, Leptospira interrogans serovar lai str. 56601
aucuguuucuugccc

SEQ ID NO: 2795473 - RNA, 12 nt, Leptospira interrogans serovar lai str. 56601
aucuguuuucuu

SEQ ID NO: 2795474 - RNA, 15 nt, Leptospira interrogans serovar lai str. 56601
aucuuaaaaaauaca

SEQ ID NO: 2795475 - RNA, 13 nt, Leptospira interrogans serovar lai str. 56601
aucuuaaaaacuu

SEQ ID NO: 2795476 - RNA, 19 nt, Leptospira interrogans serovar lai str. 56601
aucuuaaaagaaaaucaca

SEQ ID NO: 2795477 - RNA, 13 nt, Leptospira interrogans serovar lai str. 56601
aucuuaaaaugau

SEQ ID NO: 2795478 - RNA, 14 nt, Leptospira interrogans serovar lai str. 56601
aucuuaaauaucga

SEQ ID NO: 2795479 - RNA, 21 nt, Leptospira interrogans serovar lai str. 56601
aucuuaaauaucgaauuucuu

SEQ ID NO: 2795480 - RNA, 19 nt, Leptospira interrogans serovar lai str. 56601
aucuuaaaucuuuaaaaua

SEQ ID NO: 2795481 - RNA, 13 nt, Leptospira interrogans serovar lai str. 56601
aucuuaauaaaau

SEQ ID NO: 2795482 - RNA, 18 nt, Leptospira interrogans serovar lai str. 56601
aucuuaauaaaauuuuca

SEQ ID NO: 2795483 - RNA, 20 nt, Leptospira interrogans serovar lai str. 56601
aucuuaauauaauaauuccg

SEQ ID NO: 2795484 - RNA, 13 nt, Leptospira interrogans serovar lai str. 56601
aucuuaauauuuc

SEQ ID NO: 2795485 - RNA, 14 nt, Leptospira interrogans serovar lai str. 56601
aucuuaauuaaaaa

SEQ ID NO: 2795486 - RNA, 15 nt, Leptospira interrogans serovar lai str. 56601
aucuuaauuaaaaaa

SEQ ID NO: 2795487 - RNA, 22 nt, Leptospira interrogans serovar lai str. 56601
aucuuaauuuguaagaguucca

SEQ ID NO: 2795488 - RNA, 22 nt, Leptospira interrogans serovar lai str. 56601
aucuuacaaguuaugauuucau

SEQ ID NO: 2795489 - RNA, 21 nt, Leptospira interrogans serovar lai str. 56601
aucuuagaaaaccauuuuguu

SEQ ID NO: 2795490 - RNA, 13 nt, Leptospira interrogans serovar lai str. 56601
aucuuagaauaau

SEQ ID NO: 2795491 - RNA, 18 nt, Leptospira interrogans serovar lai str. 56601
aucuuagaauaauaggaa

SEQ ID NO: 2795492 - RNA, 19 nt, Leptospira interrogans serovar lai str. 56601
aucuuagaauaauaggaau

SEQ ID NO: 2795493 - RNA, 19 nt, Leptospira interrogans serovar lai str. 56601
aucuuagaaugugggaacu

SEQ ID NO: 2795494 - RNA, 15 nt, Leptospira interrogans serovar lai str. 56601
aucuuagauucacuu

SEQ ID NO: 2795495 - RNA, 18 nt, Leptospira interrogans serovar lai str. 56601
aucuuaggacggauuuua

SEQ ID NO: 2795496 - RNA, 22 nt, Leptospira interrogans serovar lai str. 56601
aucuuaggacggauuuuagauu

SEQ ID NO: 2795497 - RNA, 18 nt, Leptospira interrogans serovar lai str. 56601
aucuuauacucuuaaaau

SEQ ID NO: 2795498 - RNA, 20 nt, Leptospira interrogans serovar lai str. 56601
aucuuauacucuuaaaauua

SEQ ID NO: 2795499 - RNA, 21 nt, Leptospira interrogans serovar lai str. 56601
aucuuauggacucuauuauga

SEQ ID NO: 2795500 - RNA, 17 nt, Leptospira interrogans serovar lai str. 56601
aucuuauucaauaaaau

SEQ ID NO: 2795501 - RNA, 12 nt, Leptospira interrogans serovar lai str. 56601
aucuuauuucca

SEQ ID NO: 2795502 - RNA, 22 nt, Leptospira interrogans serovar lai str. 56601
aucuucaaacgucacuuuacaa

SEQ ID NO: 2795503 - RNA, 14 nt, Leptospira interrogans serovar lai str. 56601
aucuucaguucuua

SEQ ID NO: 2795504 - RNA, 17 nt, Leptospira interrogans serovar lai str. 56601
aucuucauuaauuuuug

SEQ ID NO: 2795505 - RNA, 23 nt, Leptospira interrogans serovar lai str. 56601
aucuucauuuugggauuuuauug

SEQ ID NO: 2795506 - RNA, 17 nt, Leptospira interrogans serovar lai str. 56601
aucuuccgcauuuuuau

SEQ ID NO: 2795507 - RNA, 22 nt, Leptospira interrogans serovar lai str. 56601
aucuucgggcuuauuuuuuuau

SEQ ID NO: 2795508 - RNA, 22 nt, Leptospira interrogans serovar lai str. 56601
aucuucuccagcaccuucugaa

SEQ ID NO: 2795509 - RNA, 15 nt, Leptospira interrogans serovar lai str. 56601
aucuucucuagaaac

SEQ ID NO: 2795510 - RNA, 20 nt, Leptospira interrogans serovar lai str. 56601
aucuucucuagaaacugcau

SEQ ID NO: 2795511 - RNA, 16 nt, Leptospira interrogans serovar lai str. 56601
aucuucuguaaaacuu

SEQ ID NO: 2795512 - RNA, 23 nt, Leptospira interrogans serovar lai str. 56601
aucuucuucauccuggauauaua

SEQ ID NO: 2795513 - RNA, 13 nt, Leptospira interrogans serovar lai str. 56601
aucuugaauacua

SEQ ID NO: 2795514 - RNA, 17 nt, Leptospira interrogans serovar lai str. 56601
aucuugcguuaaaacgg

SEQ ID NO: 2795515 - RNA, 19 nt, Leptospira interrogans serovar lai str. 56601
aucuuuaagagccuuucac

SEQ ID NO: 2795516 - RNA, 22 nt, Leptospira interrogans serovar lai str. 56601
aucuuuaagagccuuucacauc

SEQ ID NO: 2795517 - RNA, 12 nt, Leptospira interrogans serovar lai str. 56601
aucuuuaaguuu

SEQ ID NO: 2795518 - RNA, 17 nt, Leptospira interrogans serovar lai str. 56601
aucuuuagaauuuuucg

SEQ ID NO: 2795519 - RNA, 16 nt, Leptospira interrogans serovar lai str. 56601
aucuuuauaaaaauga

SEQ ID NO: 2795520 - RNA, 16 nt, Leptospira interrogans serovar lai str. 56601
aucuuuauauuauaua

SEQ ID NO: 2795521 - RNA, 13 nt, Leptospira interrogans serovar lai str. 56601
aucuuuauuuaau

SEQ ID NO: 2795522 - RNA, 17 nt, Leptospira interrogans serovar lai str. 56601
aucuuuauuuaauacga

SEQ ID NO: 2795523 - RNA, 16 nt, Leptospira interrogans serovar lai str. 56601
aucuuucacuuuaaaa

SEQ ID NO: 2795524 - RNA, 19 nt, Leptospira interrogans serovar lai str. 56601
aucuuucacuuuaaaacau

SEQ ID NO: 2795525 - RNA, 16 nt, Leptospira interrogans serovar lai str. 56601
aucuuucgauuuuaaa

SEQ ID NO: 2795526 - RNA, 18 nt, Leptospira interrogans serovar lai str. 56601
aucuuucgauuuuaaaua

SEQ ID NO: 2795527 - RNA, 18 nt, Leptospira interrogans serovar lai str. 56601
aucuuugcgauuuuuccg

SEQ ID NO: 2795528 - RNA, 16 nt, Leptospira interrogans serovar lai str. 56601
augagucccuacaauu

SEQ ID NO: 2795529 - RNA, 15 nt, Leptospira interrogans serovar lai str. 56601
augaguuauaguaaa

SEQ ID NO: 2795530 - RNA, 23 nt, Leptospira interrogans serovar lai str. 56601
augaguucacuucuugaaaggug

SEQ ID NO: 2795531 - RNA, 12 nt, Leptospira interrogans serovar lai str. 56601
augaguucccac

SEQ ID NO: 2795532 - RNA, 23 nt, Leptospira interrogans serovar lai str. 56601
augaguucccacaaauuccugcc

SEQ ID NO: 2795533 - RNA, 14 nt, Leptospira interrogans serovar lai str. 56601
augaguucccacau

SEQ ID NO: 2795534 - RNA, 21 nt, Leptospira interrogans serovar lai str. 56601
augaguucccacauuugauuu

SEQ ID NO: 2795535 - RNA, 23 nt, Leptospira interrogans serovar lai str. 56601
augaguucccacauuuuuaaaag

SEQ ID NO: 2795536 - RNA, 19 nt, Leptospira interrogans serovar lai str. 56601
augaguuuuagaauauuaa

SEQ ID NO: 2795537 - RNA, 12 nt, Leptospira interrogans serovar lai str. 56601
augauaaaaaac

SEQ ID NO: 2795538 - RNA, 15 nt, Leptospira interrogans serovar lai str. 56601
augauaaaaauuguu

SEQ ID NO: 2795539 - RNA, 20 nt, Leptospira interrogans serovar lai str. 56601
augauaaauuguuucauaaa

SEQ ID NO: 2795540 - RNA, 22 nt, Leptospira interrogans serovar lai str. 56601
augauaaauuguuucauaaaau

SEQ ID NO: 2795541 - RNA, 23 nt, Leptospira interrogans serovar lai str. 56601
augauaauaauuagaaaaauauu

SEQ ID NO: 2795542 - RNA, 18 nt, Leptospira interrogans serovar lai str. 56601
augauagaaauauuuaga

SEQ ID NO: 2795543 - RNA, 19 nt, Leptospira interrogans serovar lai str. 56601
augauagacugaucgucaa

SEQ ID NO: 2795544 - RNA, 21 nt, Leptospira interrogans serovar lai str. 56601
augauauaccaguuaaauuca

SEQ ID NO: 2795545 - RNA, 12 nt, Leptospira interrogans serovar lai str. 56601
augaucaaauuc

SEQ ID NO: 2795546 - RNA, 13 nt, Leptospira interrogans serovar lai str. 56601
augaucaaauuca

SEQ ID NO: 2795547 - RNA, 23 nt, Leptospira interrogans serovar lai str. 56601
augaucaaauucacauaaaguua

SEQ ID NO: 2795548 - RNA, 19 nt, Leptospira interrogans serovar lai str. 56601
augaucaacuacuaaucuc

SEQ ID NO: 2795549 - RNA, 22 nt, Leptospira interrogans serovar lai str. 56601
augaucauauccgaaagauaaa

SEQ ID NO: 2795550 - RNA, 15 nt, Leptospira interrogans serovar lai str. 56601
augaucgauuuuuua

SEQ ID NO: 2795551 - RNA, 19 nt, Leptospira interrogans serovar lai str. 56601
augaucgcguaauauuuca

SEQ ID NO: 2795552 - RNA, 15 nt, Leptospira interrogans serovar lai str. 56601
augaucuaagauuuu

SEQ ID NO: 2795553 - RNA, 16 nt, Leptospira interrogans serovar lai str. 56601
augaugcauuucugcc

SEQ ID NO: 2795554 - RNA, 16 nt, Leptospira interrogans serovar lai str. 56601
augauguaggaacuac

SEQ ID NO: 2795555 - RNA, 17 nt, Leptospira interrogans serovar lai str. 56601
augauucauuuaaaaau

SEQ ID NO: 2795556 - RNA, 22 nt, Leptospira interrogans serovar lai str. 56601
augauucauuuuucuaaaaaaa

SEQ ID NO: 2795557 - RNA, 16 nt, Leptospira interrogans serovar lai str. 56601
augauucauuuuucug

SEQ ID NO: 2795558 - RNA, 21 nt, Leptospira interrogans serovar lai str. 56601
augauucuaacuuuugcaauc

SEQ ID NO: 2795559 - RNA, 14 nt, Leptospira interrogans serovar lai str. 56601
augauucuauaaua

SEQ ID NO: 2795560 - RNA, 15 nt, Leptospira interrogans serovar lai str. 56601
augauucugaaaaaa

SEQ ID NO: 2795561 - RNA, 16 nt, Leptospira interrogans serovar lai str. 56601
augauucugaaaaaaa

SEQ ID NO: 2795562 - RNA, 17 nt, Leptospira interrogans serovar lai str. 56601
augauucugaaaaaaau

SEQ ID NO: 2795563 - RNA, 19 nt, Leptospira interrogans serovar lai str. 56601
augauucugaaaaaaguua

SEQ ID NO: 2795564 - RNA, 16 nt, Leptospira interrogans serovar lai str. 56601
augauugauuguuaau

SEQ ID NO: 2795565 - RNA, 17 nt, Leptospira interrogans serovar lai str. 56601
augauuuaguaaaauuu

SEQ ID NO: 2795566 - RNA, 13 nt, Leptospira interrogans serovar lai str. 56601
augauuuguaaua

SEQ ID NO: 2795567 - RNA, 12 nt, Leptospira interrogans serovar lai str. 56601
augauuuucuuu

SEQ ID NO: 2795568 - RNA, 13 nt, Leptospira interrogans serovar lai str. 56601
augauuuuuuaaa

SEQ ID NO: 2795569 - RNA, 17 nt, Leptospira interrogans serovar lai str. 56601
augauuuuuuaaaauaa

SEQ ID NO: 2795570 - RNA, 21 nt, Leptospira interrogans serovar lai str. 56601
augcaaaaguuuucaaaaaug

SEQ ID NO: 2795571 - RNA, 13 nt, Leptospira interrogans serovar lai str. 56601
augcaaauacaac

SEQ ID NO: 2795572 - RNA, 14 nt, Leptospira interrogans serovar lai str. 56601
augcaaauacaacu

SEQ ID NO: 2795573 - RNA, 15 nt, Leptospira interrogans serovar lai str. 56601
augcaaccuuacugc

SEQ ID NO: 2795574 - RNA, 17 nt, Leptospira interrogans serovar lai str. 56601
augcaacgaaaucaaug

SEQ ID NO: 2795575 - RNA, 18 nt, Leptospira interrogans serovar lai str. 56601
augcaacgaaaucaaugu

SEQ ID NO: 2795576 - RNA, 21 nt, Leptospira interrogans serovar lai str. 56601
augcaaguucuggguaaaaaa

SEQ ID NO: 2795577 - RNA, 14 nt, Leptospira interrogans serovar lai str. 56601
augcaauaguuccu

SEQ ID NO: 2795578 - RNA, 17 nt, Leptospira interrogans serovar lai str. 56601
augcaauuuauugacug

SEQ ID NO: 2795579 - RNA, 15 nt, Leptospira interrogans serovar lai str. 56601
augcagcuauuuuuu

SEQ ID NO: 2795580 - RNA, 20 nt, Leptospira interrogans serovar lai str. 56601
augcaguaaugccuacaaau

SEQ ID NO: 2795581 - RNA, 19 nt, Leptospira interrogans serovar lai str. 56601
augcaguaguuccuacaau

SEQ ID NO: 2795582 - RNA, 14 nt, Leptospira interrogans serovar lai str. 56601
augcauaaauagaa

SEQ ID NO: 2795583 - RNA, 18 nt, Leptospira interrogans serovar lai str. 56601
augcauccaaucaugaau

SEQ ID NO: 2795584 - RNA, 22 nt, Leptospira interrogans serovar lai str. 56601
augcaugaauuuguuuuucuug

SEQ ID NO: 2795585 - RNA, 18 nt, Leptospira interrogans serovar lai str. 56601
augccauuuuuaguuuua

SEQ ID NO: 2795586 - RNA, 16 nt, Leptospira interrogans serovar lai str. 56601
augccccauucuuuuu

SEQ ID NO: 2795587 - RNA, 20 nt, Leptospira interrogans serovar lai str. 56601
augccgaauucacguuauuu

SEQ ID NO: 2795588 - RNA, 14 nt, Leptospira interrogans serovar lai str. 56601
augcgaguaauauu

SEQ ID NO: 2795589 - RNA, 15 nt, Leptospira interrogans serovar lai str. 56601
augcgaguaauauuu

SEQ ID NO: 2795590 - RNA, 19 nt, Leptospira interrogans serovar lai str. 56601
augcgcaaucucaagugau

SEQ ID NO: 2795591 - RNA, 19 nt, Leptospira interrogans serovar lai str. 56601
augcuauuuaauuuuguag

SEQ ID NO: 2795592 - RNA, 22 nt, Leptospira interrogans serovar lai str. 56601
augcugccuaugccccauucuu

SEQ ID NO: 2795593 - RNA, 21 nt, Leptospira interrogans serovar lai str. 56601
augcuguaacucauauagaaa

SEQ ID NO: 2795594 - RNA, 20 nt, Leptospira interrogans serovar lai str. 56601
augcuucauauaauaaaaau

SEQ ID NO: 2795595 - RNA, 19 nt, Leptospira interrogans serovar lai str. 56601
augcuuuccaaaaggaaag

SEQ ID NO: 2795596 - RNA, 13 nt, Leptospira interrogans serovar lai str. 56601
auggaaaaaagau

SEQ ID NO: 2795597 - RNA, 12 nt, Leptospira interrogans serovar lai str. 56601
auggaaaaugaa

SEQ ID NO: 2795598 - RNA, 21 nt, Leptospira interrogans serovar lai str. 56601
auggaaacuacccauuaacua

SEQ ID NO: 2795599 - RNA, 18 nt, Leptospira interrogans serovar lai str. 56601
auggaaaguguuaguucc

SEQ ID NO: 2795600 - RNA, 17 nt, Leptospira interrogans serovar lai str. 56601
auggaaaucuuuuaaaa

SEQ ID NO: 2795601 - RNA, 15 nt, Leptospira interrogans serovar lai str. 56601
auggaagcuaacaca

SEQ ID NO: 2795602 - RNA, 20 nt, Leptospira interrogans serovar lai str. 56601
auggaauauaaaagaaucau

SEQ ID NO: 2795603 - RNA, 20 nt, Leptospira interrogans serovar lai str. 56601
auggaauuccgacccagaaa

SEQ ID NO: 2795604 - RNA, 14 nt, Leptospira interrogans serovar lai str. 56601
auggaauuguugaa

SEQ ID NO: 2795605 - RNA, 19 nt, Leptospira interrogans serovar lai str. 56601
auggaauuuauuauaucga

SEQ ID NO: 2795606 - RNA, 13 nt, Leptospira interrogans serovar lai str. 56601
auggaauuuuuca

SEQ ID NO: 2795607 - RNA, 17 nt, Leptospira interrogans serovar lai str. 56601
auggaauuuuuuaacaa

SEQ ID NO: 2795608 - RNA, 21 nt, Leptospira interrogans serovar lai str. 56601
auggaauuuuuuaacaacucu

SEQ ID NO: 2795609 - RNA, 20 nt, Leptospira interrogans serovar lai str. 56601
auggaauuuuuuaauaacuc

SEQ ID NO: 2795610 - RNA, 18 nt, Leptospira interrogans serovar lai str. 56601
auggacagaauccuucca

SEQ ID NO: 2795611 - RNA, 14 nt, Leptospira interrogans serovar lai str. 56601
auguuauaaaaugu

SEQ ID NO: 2795612 - RNA, 13 nt, Leptospira interrogans serovar lai str. 56601
auguucaaaauuu

SEQ ID NO: 2795613 - RNA, 22 nt, Leptospira interrogans serovar lai str. 56601
auguucguucccacaaauuaag

SEQ ID NO: 2795614 - RNA, 22 nt, Leptospira interrogans serovar lai str. 56601
auguucuuagacucaguauguu

SEQ ID NO: 2795615 - RNA, 18 nt, Leptospira interrogans serovar lai str. 56601
auguuguuaaauuuuucu

SEQ ID NO: 2795616 - RNA, 15 nt, Leptospira interrogans serovar lai str. 56601
auguuuaaagaauuu

SEQ ID NO: 2795617 - RNA, 18 nt, Leptospira interrogans serovar lai str. 56601
auguuuaaagaauuuuua

SEQ ID NO: 2795618 - RNA, 16 nt, Leptospira interrogans serovar lai str. 56601
auguuuacuugaaaau

SEQ ID NO: 2795619 - RNA, 21 nt, Leptospira interrogans serovar lai str. 56601
auguuuacuugaaaauaaaaa

SEQ ID NO: 2795620 - RNA, 17 nt, Leptospira interrogans serovar lai str. 56601
auguuuagaguauuaua

SEQ ID NO: 2795621 - RNA, 23 nt, Leptospira interrogans serovar lai str. 56601
auguuucaagacaacagaacaaa

SEQ ID NO: 2795622 - RNA, 16 nt, Leptospira interrogans serovar lai str. 56601
auguuucuugugucaa

SEQ ID NO: 2795623 - RNA, 22 nt, Leptospira interrogans serovar lai str. 56601
auguuucuugugucaagcccuc

SEQ ID NO: 2795624 - RNA, 17 nt, Leptospira interrogans serovar lai str. 56601
auguuucuuuuguaaaa

SEQ ID NO: 2795625 - RNA, 16 nt, Leptospira interrogans serovar lai str. 56601
auguuuguccuagauc

SEQ ID NO: 2795626 - RNA, 17 nt, Leptospira interrogans serovar lai str. 56601
auguuuuguuaugauau

SEQ ID NO: 2795627 - RNA, 18 nt, Leptospira interrogans serovar lai str. 56601
auguuuuuaaaaucuucu

SEQ ID NO: 2795628 - RNA, 14 nt, Leptospira interrogans serovar lai str. 56601
auguuuuucugaua

SEQ ID NO: 2795629 - RNA, 16 nt, Leptospira interrogans serovar lai str. 56601
auguuuuuuauuuaaa

SEQ ID NO: 2795630 - RNA, 19 nt, Leptospira interrogans serovar lai str. 56601
auuaaaaaacuuuuuaaaa

SEQ ID NO: 2795631 - RNA, 14 nt, Leptospira interrogans serovar lai str. 56601
auuaaaaaaucaua

SEQ ID NO: 2795632 - RNA, 12 nt, Leptospira interrogans serovar lai str. 56601
auuaaaaagaac

SEQ ID NO: 2795633 - RNA, 12 nt, Leptospira interrogans serovar lai str. 56601
auuaaaaaguuu

SEQ ID NO: 2795634 - RNA, 22 nt, Leptospira interrogans serovar lai str. 56601
auuaaaaauaucuaaagaauga

SEQ ID NO: 2795635 - RNA, 14 nt, Leptospira interrogans serovar lai str. 56601
auuaaaaauuuuua

SEQ ID NO: 2795636 - RNA, 15 nt, Leptospira interrogans serovar lai str. 56601
auuaaaaauuuuuaa

SEQ ID NO: 2795637 - RNA, 18 nt, Leptospira interrogans serovar lai str. 56601
auuaaaaccguuccauaa

SEQ ID NO: 2795638 - RNA, 21 nt, Leptospira interrogans serovar lai str. 56601
auuaaaacgaauugauaaaac

SEQ ID NO: 2795639 - RNA, 13 nt, Leptospira interrogans serovar lai str. 56601
auuaaaacugcuc

SEQ ID NO: 2795640 - RNA, 13 nt, Leptospira interrogans serovar lai str. 56601
auuaaaauaggau

SEQ ID NO: 2795641 - RNA, 21 nt, Leptospira interrogans serovar lai str. 56601
auuaaaauucuagaaagaauu

SEQ ID NO: 2795642 - RNA, 11 nt, Leptospira interrogans serovar lai str. 56601
auuaaaauuuc

SEQ ID NO: 2795643 - RNA, 16 nt, Leptospira interrogans serovar lai str. 56601
auuaaacaauuuuuca

SEQ ID NO: 2795644 - RNA, 20 nt, Leptospira interrogans serovar lai str. 56601
auuaaaccgguaaaaaguaa

SEQ ID NO: 2795645 - RNA, 16 nt, Leptospira interrogans serovar lai str. 56601
auuaaacuucaaaaaa

SEQ ID NO: 2795646 - RNA, 17 nt, Leptospira interrogans serovar lai str. 56601
auuaaacuucaaaaaau

SEQ ID NO: 2795647 - RNA, 19 nt, Leptospira interrogans serovar lai str. 56601
auuaaacuuuuauaaaauc

SEQ ID NO: 2795648 - RNA, 15 nt, Leptospira interrogans serovar lai str. 56601
auuaaagauuuuucu

SEQ ID NO: 2795649 - RNA, 16 nt, Leptospira interrogans serovar lai str. 56601
auuaaagcgucucauu

SEQ ID NO: 2795650 - RNA, 16 nt, Leptospira interrogans serovar lai str. 56601
auuaaaguauccauuc

SEQ ID NO: 2795651 - RNA, 16 nt, Leptospira interrogans serovar lai str. 56601
auuaaaguauuaauuu

SEQ ID NO: 2795652 - RNA, 15 nt, Leptospira interrogans serovar lai str. 56601
auuaaaguuguugaa

SEQ ID NO: 2795653 - RNA, 21 nt, Leptospira interrogans serovar lai str. 56601
auuaaaguuguugaaaaauua

SEQ ID NO: 2795654 - RNA, 20 nt, Leptospira interrogans serovar lai str. 56601
auuaaauaaagguuuuauag

SEQ ID NO: 2795655 - RNA, 14 nt, Leptospira interrogans serovar lai str. 56601
auuaaaucuuaugg

SEQ ID NO: 2795656 - RNA, 13 nt, Leptospira interrogans serovar lai str. 56601
auuaaauucuaca

SEQ ID NO: 2795657 - RNA, 15 nt, Leptospira interrogans serovar lai str. 56601
auuaaauuuugaaaa

SEQ ID NO: 2795658 - RNA, 21 nt, Leptospira interrogans serovar lai str. 56601
auuaaauuuuuauaaaauacc

SEQ ID NO: 2795659 - RNA, 18 nt, Leptospira interrogans serovar lai str. 56601
auuaaauuuuuauacuuu

SEQ ID NO: 2795660 - RNA, 15 nt, Leptospira interrogans serovar lai str. 56601
auuaacaaaacugcu

SEQ ID NO: 2795661 - RNA, 16 nt, Leptospira interrogans serovar lai str. 56601
auuaacaaauuuaaaa

SEQ ID NO: 2795662 - RNA, 17 nt, Leptospira interrogans serovar lai str. 56601
auuaacaaauuuaaaau

SEQ ID NO: 2795663 - RNA, 14 nt, Leptospira interrogans serovar lai str. 56601
auuaacaaucaauu

SEQ ID NO: 2795664 - RNA, 14 nt, Leptospira interrogans serovar lai str. 56601
auuaacggccaaau

SEQ ID NO: 2795665 - RNA, 14 nt, Leptospira interrogans serovar lai str. 56601
auuaacuacccuua

SEQ ID NO: 2795666 - RNA, 22 nt, Leptospira interrogans serovar lai str. 56601
auuaacugcuguucuuuuauau

SEQ ID NO: 2795667 - RNA, 13 nt, Leptospira interrogans serovar lai str. 56601
auuaacuuucauu

SEQ ID NO: 2795668 - RNA, 22 nt, Leptospira interrogans serovar lai str. 56601
auuaacuuucuucgauuucuuu

SEQ ID NO: 2795669 - RNA, 19 nt, Leptospira interrogans serovar lai str. 56601
auuaagaaaaauuaaaauu

SEQ ID NO: 2795670 - RNA, 15 nt, Leptospira interrogans serovar lai str. 56601
auuaagaaagacuuu

SEQ ID NO: 2795671 - RNA, 19 nt, Leptospira interrogans serovar lai str. 56601
auuaagaacuuucucgaaa

SEQ ID NO: 2795672 - RNA, 19 nt, Leptospira interrogans serovar lai str. 56601
auuaagaauucuaaacaca

SEQ ID NO: 2795673 - RNA, 21 nt, Leptospira interrogans serovar lai str. 56601
auuaaguauuguuaagauaaa

SEQ ID NO: 2795674 - RNA, 18 nt, Leptospira interrogans serovar lai str. 56601
auuaaguuacauuaugaa

SEQ ID NO: 2795675 - RNA, 15 nt, Leptospira interrogans serovar lai str. 56601
auuaaguuuuuuaaa

SEQ ID NO: 2795676 - RNA, 16 nt, Leptospira interrogans serovar lai str. 56601
auuaaguuuuuuaaau

SEQ ID NO: 2795677 - RNA, 19 nt, Leptospira interrogans serovar lai str. 56601
auuaaguuuuuuaaauuua

SEQ ID NO: 2795678 - RNA, 20 nt, Leptospira interrogans serovar lai str. 56601
auuaauagcuugucacuauu

SEQ ID NO: 2795679 - RNA, 12 nt, Leptospira interrogans serovar lai str. 56601
auuaauauuuau

SEQ ID NO: 2795680 - RNA, 14 nt, Leptospira interrogans serovar lai str. 56601
auuaauauuuauaa

SEQ ID NO: 2795681 - RNA, 20 nt, Leptospira interrogans serovar lai str. 56601
auuaaucagauuuuugcaca

SEQ ID NO: 2795682 - RNA, 22 nt, Leptospira interrogans serovar lai str. 56601
auuaaugcgaaaauuuaacuac

SEQ ID NO: 2795683 - RNA, 19 nt, Leptospira interrogans serovar lai str. 56601
auuaauuacagaauugauu

SEQ ID NO: 2795684 - RNA, 13 nt, Leptospira interrogans serovar lai str. 56601
auuaauuauaugg

SEQ ID NO: 2795685 - RNA, 22 nt, Leptospira interrogans serovar lai str. 56601
auuaauucccaaugaugaauuc

SEQ ID NO: 2795686 - RNA, 15 nt, Leptospira interrogans serovar lai str. 56601
auuaauucuccauuu

SEQ ID NO: 2795687 - RNA, 16 nt, Leptospira interrogans serovar lai str. 56601
auuaauuuaaaaacaa

SEQ ID NO: 2795688 - RNA, 17 nt, Leptospira interrogans serovar lai str. 56601
auuaauuuaaucaaaau

SEQ ID NO: 2795689 - RNA, 21 nt, Leptospira interrogans serovar lai str. 56601
auuaauuuaaucaaaauuucu

SEQ ID NO: 2795690 - RNA, 14 nt, Leptospira interrogans serovar lai str. 56601
auuaauuuacuuau

SEQ ID NO: 2795691 - RNA, 16 nt, Leptospira interrogans serovar lai str. 56601
auuaauuugaauauaa

SEQ ID NO: 2795692 - RNA, 22 nt, Leptospira interrogans serovar lai str. 56601
auuaauuuuccuauuuucgaaa

SEQ ID NO: 2795693 - RNA, 12 nt, Leptospira interrogans serovar lai str. 56601
auuaauuuuuca

SEQ ID NO: 2795694 - RNA, 22 nt, Leptospira interrogans serovar lai str. 56601
auuauacaaaacucuuuaaaaa

SEQ ID NO: 2795695 - RNA, 20 nt, Leptospira interrogans serovar lai str. 56601
auuauaggaacgagaaggcu

SEQ ID NO: 2795696 - RNA, 20 nt, Leptospira interrogans serovar lai str. 56601
auuauaguuuuauuagaacu

SEQ ID NO: 2795697 - RNA, 17 nt, Leptospira interrogans serovar lai str. 56601
auuauaguuuuuucaaa

SEQ ID NO: 2795698 - RNA, 18 nt, Leptospira interrogans serovar lai str. 56601
auuauaguuuuuucaaaa

SEQ ID NO: 2795699 - RNA, 20 nt, Leptospira interrogans serovar lai str. 56601
auuauaguuuuuucaaaaau

SEQ ID NO: 2795700 - RNA, 14 nt, Leptospira interrogans serovar lai str. 56601
auuauauaaguauu

SEQ ID NO: 2795701 - RNA, 15 nt, Leptospira interrogans serovar lai str. 56601
auuauauaaucugau

SEQ ID NO: 2795702 - RNA, 15 nt, Leptospira interrogans serovar lai str. 56601
auuauauaauuuuua

SEQ ID NO: 2795703 - RNA, 16 nt, Leptospira interrogans serovar lai str. 56601
auuauauaauuuuuaa

SEQ ID NO: 2795704 - RNA, 22 nt, Leptospira interrogans serovar lai str. 56601
auuauauaguuaugaauaaaaa

SEQ ID NO: 2795705 - RNA, 13 nt, Leptospira interrogans serovar lai str. 56601
auuauauucuuau

SEQ ID NO: 2795706 - RNA, 19 nt, Leptospira interrogans serovar lai str. 56601
auuauauucuuauauaucu

SEQ ID NO: 2795707 - RNA, 21 nt, Leptospira interrogans serovar lai str. 56601
auuauauuuugagguauuuua

SEQ ID NO: 2795708 - RNA, 23 nt, Leptospira interrogans serovar lai str. 56601
auuauauuuugagguauuuuaga

SEQ ID NO: 2795709 - RNA, 15 nt, Leptospira interrogans serovar lai str. 56601
auuauauuuuuaaaa

SEQ ID NO: 2795710 - RNA, 24 nt, Leptospira interrogans serovar lai str. 56601
auuaucaaaauuuaaaucccauuu

SEQ ID NO: 2795711 - RNA, 20 nt, Leptospira interrogans serovar lai str. 56601
auuauccauuucuauaaauu

SEQ ID NO: 2795712 - RNA, 23 nt, Leptospira interrogans serovar lai str. 56601
auuaucccaguugagaguuuuuc

SEQ ID NO: 2795713 - RNA, 18 nt, Leptospira interrogans serovar lai str. 56601
auuauccguuuauccuaa

SEQ ID NO: 2795714 - RNA, 14 nt, Leptospira interrogans serovar lai str. 56601
auuaucuaaagcuu

SEQ ID NO: 2795715 - RNA, 15 nt, Leptospira interrogans serovar lai str. 56601
auuaucuauuccaau

SEQ ID NO: 2795716 - RNA, 18 nt, Leptospira interrogans serovar lai str. 56601
auuaucuucuaauuaaau

SEQ ID NO: 2795717 - RNA, 22 nt, Leptospira interrogans serovar lai str. 56601
auuaucuucuaauuaaauucua

SEQ ID NO: 2795718 - RNA, 17 nt, Leptospira interrogans serovar lai str. 56601
auuaucuuguguuucau

SEQ ID NO: 2795719 - RNA, 16 nt, Leptospira interrogans serovar lai str. 56601
auuaucuuuauauuau

SEQ ID NO: 2795720 - RNA, 14 nt, Leptospira interrogans serovar lai str. 56601
auuaugaagaauga

SEQ ID NO: 2795721 - RNA, 23 nt, Leptospira interrogans serovar lai str. 56601
auuaugaauuuuuaaacauuuau

SEQ ID NO: 2795722 - RNA, 18 nt, Leptospira interrogans serovar lai str. 56601
auuaugauuuuuuugaaa

SEQ ID NO: 2795723 - RNA, 14 nt, Leptospira interrogans serovar lai str. 56601
auuauguaguuuug

SEQ ID NO: 2795724 - RNA, 16 nt, Leptospira interrogans serovar lai str. 56601
auuaugugacuuuaau

SEQ ID NO: 2795725 - RNA, 15 nt, Leptospira interrogans serovar lai str. 56601
auuauuaaauuuuua

SEQ ID NO: 2795726 - RNA, 16 nt, Leptospira interrogans serovar lai str. 56601
auuauuaaauuuuuau

SEQ ID NO: 2795727 - RNA, 21 nt, Leptospira interrogans serovar lai str. 56601
auuauuacucggauguauaaa

SEQ ID NO: 2795728 - RNA, 22 nt, Leptospira interrogans serovar lai str. 56601
auuauuagaguuguugaaaaau

SEQ ID NO: 2795729 - RNA, 21 nt, Leptospira interrogans serovar lai str. 56601
auuauuaguuauguuuuaaaa

SEQ ID NO: 2795730 - RNA, 14 nt, Leptospira interrogans serovar lai str. 56601
auuauuauauuuaa

SEQ ID NO: 2795731 - RNA, 12 nt, Leptospira interrogans serovar lai str. 56601
auuauuuacuuu

SEQ ID NO: 2795732 - RNA, 20 nt, Leptospira interrogans serovar lai str. 56601
auuauuuauuucaauacaac

SEQ ID NO: 2795733 - RNA, 14 nt, Leptospira interrogans serovar lai str. 56601
auuauuucaaaaau

SEQ ID NO: 2795734 - RNA, 20 nt, Leptospira interrogans serovar lai str. 56601
auuauuucaaugcaaaaaau

SEQ ID NO: 2795735 - RNA, 13 nt, Leptospira interrogans serovar lai str. 56601
auuauuugaaaaa

SEQ ID NO: 2795736 - RNA, 18 nt, Leptospira interrogans serovar lai str. 56601
auuauuuguaguuucaau

SEQ ID NO: 2795737 - RNA, 16 nt, Leptospira interrogans serovar lai str. 56601
auuauuuuaggauuuu

SEQ ID NO: 2795738 - RNA, 15 nt, Leptospira interrogans serovar lai str. 56601
auuauuuucaaguaa

SEQ ID NO: 2795739 - RNA, 11 nt, Leptospira interrogans serovar lai str. 56601
auuauuuuuga

SEQ ID NO: 2795740 - RNA, 14 nt, Leptospira interrogans serovar lai str. 56601
auuauuuuuuaaaa

SEQ ID NO: 2795741 - RNA, 20 nt, Leptospira interrogans serovar lai str. 56601
auuauuuuuuaaaaaucucu

SEQ ID NO: 2795742 - RNA, 21 nt, Leptospira interrogans serovar lai str. 56601
auuauuuuuuguuagauucua

SEQ ID NO: 2795743 - RNA, 15 nt, Leptospira interrogans serovar lai str. 56601
auucaaaaacuaaaa

SEQ ID NO: 2795744 - RNA, 17 nt, Leptospira interrogans serovar lai str. 56601
auucaaaaacuaaaaua

SEQ ID NO: 2795745 - RNA, 14 nt, Leptospira interrogans serovar lai str. 56601
auucaaaaagaauc

SEQ ID NO: 2795746 - RNA, 15 nt, Leptospira interrogans serovar lai str. 56601
auucaaaacuauuaa

SEQ ID NO: 2795747 - RNA, 21 nt, Leptospira interrogans serovar lai str. 56601
auucaaaacuauuaaauugag

SEQ ID NO: 2795748 - RNA, 12 nt, Leptospira interrogans serovar lai str. 56601
auucaaaagucu

SEQ ID NO: 2795749 - RNA, 13 nt, Leptospira interrogans serovar lai str. 56601
auucaaaauaaau

SEQ ID NO: 2795750 - RNA, 20 nt, Leptospira interrogans serovar lai str. 56601
auucaaaauaagaaaauaaa

SEQ ID NO: 2795751 - RNA, 13 nt, Leptospira interrogans serovar lai str. 56601
auucaaaauagaa

SEQ ID NO: 2795752 - RNA, 15 nt, Leptospira interrogans serovar lai str. 56601
auucaaaauagaaua

SEQ ID NO: 2795753 - RNA, 19 nt, Leptospira interrogans serovar lai str. 56601
auucaaaauaucuuaagaa

SEQ ID NO: 2795754 - RNA, 11 nt, Leptospira interrogans serovar lai str. 56601
auucaaaauug

SEQ ID NO: 2795755 - RNA, 16 nt, Leptospira interrogans serovar lai str. 56601
auucaaaugucuuuuu

SEQ ID NO: 2795756 - RNA, 19 nt, Leptospira interrogans serovar lai str. 56601
auucaaauuuacucuuaua

SEQ ID NO: 2795757 - RNA, 21 nt, Leptospira interrogans serovar lai str. 56601
auucaaauuuacucuuauaaa

SEQ ID NO: 2795758 - RNA, 19 nt, Leptospira interrogans serovar lai str. 56601
auucaaauuucugaaacaa

SEQ ID NO: 2795759 - RNA, 20 nt, Leptospira interrogans serovar lai str. 56601
auucaaccgcaaauuuuuuc

SEQ ID NO: 2795760 - RNA, 22 nt, Leptospira interrogans serovar lai str. 56601
auucaacuuagaacuuguccca

SEQ ID NO: 2795761 - RNA, 15 nt, Leptospira interrogans serovar lai str. 56601
auucaacuuuuugaa

SEQ ID NO: 2795762 - RNA, 15 nt, Leptospira interrogans serovar lai str. 56601
auucaagacuuuaua

SEQ ID NO: 2795763 - RNA, 18 nt, Leptospira interrogans serovar lai str. 56601
auucaaguggguuacuuu

SEQ ID NO: 2795764 - RNA, 20 nt, Leptospira interrogans serovar lai str. 56601
auucaauaaaauaccauaaa

SEQ ID NO: 2795765 - RNA, 13 nt, Leptospira interrogans serovar lai str. 56601
auucaauucggaa

SEQ ID NO: 2795766 - RNA, 14 nt, Leptospira interrogans serovar lai str. 56601
auucaauuuauaaa

SEQ ID NO: 2795767 - RNA, 13 nt, Leptospira interrogans serovar lai str. 56601
auucaauuucuuu

SEQ ID NO: 2795768 - RNA, 16 nt, Leptospira interrogans serovar lai str. 56601
auucaauuucuuuaau

SEQ ID NO: 2795769 - RNA, 16 nt, Leptospira interrogans serovar lai str. 56601
auucaauuuuuauaaa

SEQ ID NO: 2795770 - RNA, 18 nt, Leptospira interrogans serovar lai str. 56601
auucaauuuuuauagauc

SEQ ID NO: 2795771 - RNA, 22 nt, Leptospira interrogans serovar lai str. 56601
auucacauaaaguuaauacaaa

SEQ ID NO: 2795772 - RNA, 17 nt, Leptospira interrogans serovar lai str. 56601
auucacauuaaaauagg

SEQ ID NO: 2795773 - RNA, 18 nt, Leptospira interrogans serovar lai str. 56601
auucaccuuccaaagauu

SEQ ID NO: 2795774 - RNA, 17 nt, Leptospira interrogans serovar lai str. 56601
auucacguuaacuaacu

SEQ ID NO: 2795775 - RNA, 13 nt, Leptospira interrogans serovar lai str. 56601
auucacguucaac

SEQ ID NO: 2795776 - RNA, 14 nt, Leptospira interrogans serovar lai str. 56601
auucacucuuaaau

SEQ ID NO: 2795777 - RNA, 12 nt, Leptospira interrogans serovar lai str. 56601
auuccuuucugc

SEQ ID NO: 2795778 - RNA, 19 nt, Leptospira interrogans serovar lai str. 56601
auuccuuuucuuuuuuaaa

SEQ ID NO: 2795779 - RNA, 15 nt, Leptospira interrogans serovar lai str. 56601
auuccuuuuucuaau

SEQ ID NO: 2795780 - RNA, 16 nt, Leptospira interrogans serovar lai str. 56601
auuccuuuuuguaagg

SEQ ID NO: 2795781 - RNA, 15 nt, Leptospira interrogans serovar lai str. 56601
auucgaaauuuucag

SEQ ID NO: 2795782 - RNA, 16 nt, Leptospira interrogans serovar lai str. 56601
auucgaaucauuuugu

SEQ ID NO: 2795783 - RNA, 15 nt, Leptospira interrogans serovar lai str. 56601
auucgaguccuuuuu

SEQ ID NO: 2795784 - RNA, 22 nt, Leptospira interrogans serovar lai str. 56601
auucgauauggcaaucggaaau

SEQ ID NO: 2795785 - RNA, 23 nt, Leptospira interrogans serovar lai str. 56601
auucgccguaaaaaauccaugau

SEQ ID NO: 2795786 - RNA, 19 nt, Leptospira interrogans serovar lai str. 56601
auucgcuccgauaauugua

SEQ ID NO: 2795787 - RNA, 14 nt, Leptospira interrogans serovar lai str. 56601
auucggaaauuuua

SEQ ID NO: 2795788 - RNA, 20 nt, Leptospira interrogans serovar lai str. 56601
auucguaaaaaccgcaaauu

SEQ ID NO: 2795789 - RNA, 23 nt, Leptospira interrogans serovar lai str. 56601
auucguaaaaaccgcaaauuuua

SEQ ID NO: 2795790 - RNA, 14 nt, Leptospira interrogans serovar lai str. 56601
auucguaagaaaaa

SEQ ID NO: 2795791 - RNA, 17 nt, Leptospira interrogans serovar lai str. 56601
auucguucauagagaua

SEQ ID NO: 2795792 - RNA, 16 nt, Leptospira interrogans serovar lai str. 56601
auucguuccaaauaca

SEQ ID NO: 2795793 - RNA, 16 nt, Leptospira interrogans serovar lai str. 56601
auucguugagacgaaa

SEQ ID NO: 2795794 - RNA, 17 nt, Leptospira interrogans serovar lai str. 56601
auucguuuuauaaaaac

SEQ ID NO: 2795795 - RNA, 15 nt, Leptospira interrogans serovar lai str. 56601
auucguuuuuuaaaa

SEQ ID NO: 2795796 - RNA, 12 nt, Leptospira interrogans serovar lai str. 56601
auucuaaaaaug

SEQ ID NO: 2795797 - RNA, 14 nt, Leptospira interrogans serovar lai str. 56601
auucuaaaaucaua

SEQ ID NO: 2795798 - RNA, 16 nt, Leptospira interrogans serovar lai str. 56601
auucuaaaauccuauu

SEQ ID NO: 2795799 - RNA, 18 nt, Leptospira interrogans serovar lai str. 56601
auucuaaaauccuauuca

SEQ ID NO: 2795800 - RNA, 20 nt, Leptospira interrogans serovar lai str. 56601
auucuaaaauuauaggaacu

SEQ ID NO: 2795801 - RNA, 12 nt, Leptospira interrogans serovar lai str. 56601
auucuaaaauug

SEQ ID NO: 2795802 - RNA, 13 nt, Leptospira interrogans serovar lai str. 56601
auucuaaaauuug

SEQ ID NO: 2795803 - RNA, 13 nt, Leptospira interrogans serovar lai str. 56601
auucuaaacaaaa

SEQ ID NO: 2795804 - RNA, 13 nt, Leptospira interrogans serovar lai str. 56601
auucuaaagaagg

SEQ ID NO: 2795805 - RNA, 20 nt, Leptospira interrogans serovar lai str. 56601
auucuaaaguuguaggaacu

SEQ ID NO: 2795806 - RNA, 13 nt, Leptospira interrogans serovar lai str. 56601
auucuaaauuauu

SEQ ID NO: 2795807 - RNA, 14 nt, Leptospira interrogans serovar lai str. 56601
auucuaaauuauuu

SEQ ID NO: 2795808 - RNA, 18 nt, Leptospira interrogans serovar lai str. 56601
auucuaacugguuuuucu

SEQ ID NO: 2795809 - RNA, 19 nt, Leptospira interrogans serovar lai str. 56601
auucuaaguaauuuaaaaa

SEQ ID NO: 2795810 - RNA, 16 nt, Leptospira interrogans serovar lai str. 56601
auucuaauauuauuuu

SEQ ID NO: 2795811 - RNA, 21 nt, Leptospira interrogans serovar lai str. 56601
auucuaaucacgaaaaaugaa

SEQ ID NO: 2795812 - RNA, 18 nt, Leptospira interrogans serovar lai str. 56601
auucuaauugugggaacu

SEQ ID NO: 2795813 - RNA, 23 nt, Leptospira interrogans serovar lai str. 56601
auucuaauugugggaacucacac

SEQ ID NO: 2795814 - RNA, 22 nt, Leptospira interrogans serovar lai str. 56601
auucuaauuuuauaaauuauuu

SEQ ID NO: 2795815 - RNA, 17 nt, Leptospira interrogans serovar lai str. 56601
auucuaauuuuauucca

SEQ ID NO: 2795816 - RNA, 13 nt, Leptospira interrogans serovar lai str. 56601
auucuaauuuuua

SEQ ID NO: 2795817 - RNA, 21 nt, Leptospira interrogans serovar lai str. 56601
auucuacaaauucuucuuccu

SEQ ID NO: 2795818 - RNA, 17 nt, Leptospira interrogans serovar lai str. 56601
auucuacaccuucuaaa

SEQ ID NO: 2795819 - RNA, 18 nt, Leptospira interrogans serovar lai str. 56601
auucuacaccuucuaaau

SEQ ID NO: 2795820 - RNA, 15 nt, Leptospira interrogans serovar lai str. 56601
auucuacagauaaaa

SEQ ID NO: 2795821 - RNA, 16 nt, Leptospira interrogans serovar lai str. 56601
auucuacagauaaaaa

SEQ ID NO: 2795822 - RNA, 12 nt, Leptospira interrogans serovar lai str. 56601
auucuacaugau

SEQ ID NO: 2795823 - RNA, 23 nt, Leptospira interrogans serovar lai str. 56601
auucuacauucugaaacuuuuca

SEQ ID NO: 2795824 - RNA, 23 nt, Leptospira interrogans serovar lai str. 56601
auucuacauuuguagagauugau

SEQ ID NO: 2795825 - RNA, 13 nt, Leptospira interrogans serovar lai str. 56601
auucuacgaauuu

SEQ ID NO: 2795826 - RNA, 14 nt, Leptospira interrogans serovar lai str. 56601
auucuacuauuaau

SEQ ID NO: 2795827 - RNA, 15 nt, Leptospira interrogans serovar lai str. 56601
auucuacuuacagcc

SEQ ID NO: 2795828 - RNA, 15 nt, Leptospira interrogans serovar lai str. 56601
auucuagaaagaauu

SEQ ID NO: 2795829 - RNA, 23 nt, Leptospira interrogans serovar lai str. 56601
auucuagaaagaauuuaauaaaa

SEQ ID NO: 2795830 - RNA, 15 nt, Leptospira interrogans serovar lai str. 56601
auucuagaagaguuu

SEQ ID NO: 2795831 - RNA, 18 nt, Leptospira interrogans serovar lai str. 56601
auucuagaauauaaccgu

SEQ ID NO: 2795832 - RNA, 15 nt, Leptospira interrogans serovar lai str. 56601
auucuagcgucuaaa

SEQ ID NO: 2795833 - RNA, 15 nt, Leptospira interrogans serovar lai str. 56601
auucuaggcauuuca

SEQ ID NO: 2795834 - RNA, 16 nt, Leptospira interrogans serovar lai str. 56601
auucuaguuuguuuau

SEQ ID NO: 2795835 - RNA, 15 nt, Leptospira interrogans serovar lai str. 56601
auucuauaaaguuga

SEQ ID NO: 2795836 - RNA, 21 nt, Leptospira interrogans serovar lai str. 56601
auucuauaauacaugaauucu

SEQ ID NO: 2795837 - RNA, 20 nt, Leptospira interrogans serovar lai str. 56601
auucuauaguaaagauuaga

SEQ ID NO: 2795838 - RNA, 18 nt, Leptospira interrogans serovar lai str. 56601
auucuauauauugaaaua

SEQ ID NO: 2795839 - RNA, 22 nt, Leptospira interrogans serovar lai str. 56601
auucuaugaaacgaaauauauu

SEQ ID NO: 2795840 - RNA, 23 nt, Leptospira interrogans serovar lai str. 56601
auucuaugaaacgaaauauauua

SEQ ID NO: 2795841 - RNA, 14 nt, Leptospira interrogans serovar lai str. 56601
auucuauuagaaua

SEQ ID NO: 2795842 - RNA, 21 nt, Leptospira interrogans serovar lai str. 56601
auucuauuagaauaguaguuu

SEQ ID NO: 2795843 - RNA, 13 nt, Leptospira interrogans serovar lai str. 56601
auucuauuaguuu

SEQ ID NO: 2795844 - RNA, 17 nt, Leptospira interrogans serovar lai str. 56601
auucuauuaguuuuuau

SEQ ID NO: 2795845 - RNA, 22 nt, Leptospira interrogans serovar lai str. 56601
auucuauuaguuuuuaugccuu

SEQ ID NO: 2795846 - RNA, 19 nt, Leptospira interrogans serovar lai str. 56601
auucuauuauauacauggg

SEQ ID NO: 2795847 - RNA, 18 nt, Leptospira interrogans serovar lai str. 56601
auucuauucguauuuuau

SEQ ID NO: 2795848 - RNA, 15 nt, Leptospira interrogans serovar lai str. 56601
auucuauugugggaa

SEQ ID NO: 2795849 - RNA, 22 nt, Leptospira interrogans serovar lai str. 56601
auucuauugugggaacuacuac

SEQ ID NO: 2795850 - RNA, 23 nt, Leptospira interrogans serovar lai str. 56601
auucuauuuuagggaucgaucug

SEQ ID NO: 2795851 - RNA, 23 nt, Leptospira interrogans serovar lai str. 56601
auucucacaaaucacauccaacc

SEQ ID NO: 2795852 - RNA, 23 nt, Leptospira interrogans serovar lai str. 56601
auucuccaucuauuuuguuuuau

SEQ ID NO: 2795853 - RNA, 17 nt, Leptospira interrogans serovar lai str. 56601
auucuccaucuguuucu

SEQ ID NO: 2795854 - RNA, 18 nt, Leptospira interrogans serovar lai str. 56601
auucuccaucuguuuucu

SEQ ID NO: 2795855 - RNA, 19 nt, Leptospira interrogans serovar lai str. 56601
auucuccauuuguuucuau

SEQ ID NO: 2795856 - RNA, 21 nt, Leptospira interrogans serovar lai str. 56601
auucuccauuuguuucuauuu

SEQ ID NO: 2795857 - RNA, 19 nt, Leptospira interrogans serovar lai str. 56601
auucucccccaacugaaaa

SEQ ID NO: 2795858 - RNA, 20 nt, Leptospira interrogans serovar lai str. 56601
auucucccccaacugaaaau

SEQ ID NO: 2795859 - RNA, 22 nt, Leptospira interrogans serovar lai str. 56601
auucuccguuaugcaugaauuu

SEQ ID NO: 2795860 - RNA, 20 nt, Leptospira interrogans serovar lai str. 56601
auugaguguuuuuaguuuuc

SEQ ID NO: 2795861 - RNA, 19 nt, Leptospira interrogans serovar lai str. 56601
auugaguuaauuuucgauu

SEQ ID NO: 2795862 - RNA, 21 nt, Leptospira interrogans serovar lai str. 56601
auugaguuacgcugaguuuga

SEQ ID NO: 2795863 - RNA, 20 nt, Leptospira interrogans serovar lai str. 56601
auugaguuuaagaaacucag

SEQ ID NO: 2795864 - RNA, 19 nt, Leptospira interrogans serovar lai str. 56601
auugaguuucacaaaaaua

SEQ ID NO: 2795865 - RNA, 21 nt, Leptospira interrogans serovar lai str. 56601
auugaguuucuugaacucaau

SEQ ID NO: 2795866 - RNA, 23 nt, Leptospira interrogans serovar lai str. 56601
auugaguuuuuuauucccaaaaa

SEQ ID NO: 2795867 - RNA, 18 nt, Leptospira interrogans serovar lai str. 56601
auugauaaaaaaauguuu

SEQ ID NO: 2795868 - RNA, 15 nt, Leptospira interrogans serovar lai str. 56601
auugauaauuuuugu

SEQ ID NO: 2795869 - RNA, 17 nt, Leptospira interrogans serovar lai str. 56601
auugauauuucuuaaau

SEQ ID NO: 2795870 - RNA, 19 nt, Leptospira interrogans serovar lai str. 56601
auugauccagauuccuucg

SEQ ID NO: 2795871 - RNA, 21 nt, Leptospira interrogans serovar lai str. 56601
auugaucucuauaaaaucaag

SEQ ID NO: 2795872 - RNA, 19 nt, Leptospira interrogans serovar lai str. 56601
auugaugacaagaagagau

SEQ ID NO: 2795873 - RNA, 21 nt, Leptospira interrogans serovar lai str. 56601
auugauucuauauauugaaau

SEQ ID NO: 2795874 - RNA, 23 nt, Leptospira interrogans serovar lai str. 56601
auugauucuuuaaauguagaaac

SEQ ID NO: 2795875 - RNA, 12 nt, Leptospira interrogans serovar lai str. 56601
auugauuuuuca

SEQ ID NO: 2795876 - RNA, 20 nt, Leptospira interrogans serovar lai str. 56601
auugcaacuuugguuaucau

SEQ ID NO: 2795877 - RNA, 23 nt, Leptospira interrogans serovar lai str. 56601
auugcagaauguuuucuacaaau

SEQ ID NO: 2795878 - RNA, 15 nt, Leptospira interrogans serovar lai str. 56601
auugcauaaaagaaa

SEQ ID NO: 2795879 - RNA, 20 nt, Leptospira interrogans serovar lai str. 56601
auugccaaaacuaccucaau

SEQ ID NO: 2795880 - RNA, 19 nt, Leptospira interrogans serovar lai str. 56601
auugccuaaauuccuucca

SEQ ID NO: 2795881 - RNA, 15 nt, Leptospira interrogans serovar lai str. 56601
auugccucuacaagu

SEQ ID NO: 2795882 - RNA, 15 nt, Leptospira interrogans serovar lai str. 56601
auugcuuuuuaaaag

SEQ ID NO: 2795883 - RNA, 16 nt, Leptospira interrogans serovar lai str. 56601
auugcuuuuugagaga

SEQ ID NO: 2795884 - RNA, 19 nt, Leptospira interrogans serovar lai str. 56601
auuggaaagaaggauugau

SEQ ID NO: 2795885 - RNA, 19 nt, Leptospira interrogans serovar lai str. 56601
auuggacgauguuguuuaa

SEQ ID NO: 2795886 - RNA, 18 nt, Leptospira interrogans serovar lai str. 56601
auuggaguuuuuuaaaau

SEQ ID NO: 2795887 - RNA, 17 nt, Leptospira interrogans serovar lai str. 56601
auuggauaauuccacac

SEQ ID NO: 2795888 - RNA, 18 nt, Leptospira interrogans serovar lai str. 56601
auuggguauaagaagauu

SEQ ID NO: 2795889 - RNA, 14 nt, Leptospira interrogans serovar lai str. 56601
auuggguuugauuu

SEQ ID NO: 2795890 - RNA, 15 nt, Leptospira interrogans serovar lai str. 56601
auugguagauugcuu

SEQ ID NO: 2795891 - RNA, 22 nt, Leptospira interrogans serovar lai str. 56601
auugguguuguguuaguuccca

SEQ ID NO: 2795892 - RNA, 14 nt, Leptospira interrogans serovar lai str. 56601
auugguuauaccaa

SEQ ID NO: 2795893 - RNA, 21 nt, Leptospira interrogans serovar lai str. 56601
auugguuuccgcuguaugaaa

SEQ ID NO: 2795894 - RNA, 22 nt, Leptospira interrogans serovar lai str. 56601
auuguagaaacuuauacuuuau

SEQ ID NO: 2795895 - RNA, 19 nt, Leptospira interrogans serovar lai str. 56601
auuguagaauuuauuuuca

SEQ ID NO: 2795896 - RNA, 14 nt, Leptospira interrogans serovar lai str. 56601
auuguagauucuuu

SEQ ID NO: 2795897 - RNA, 16 nt, Leptospira interrogans serovar lai str. 56601
auuguaguucuacauu

SEQ ID NO: 2795898 - RNA, 15 nt, Leptospira interrogans serovar lai str. 56601
auuguaugaagaaaa

SEQ ID NO: 2795899 - RNA, 23 nt, Leptospira interrogans serovar lai str. 56601
auuguaugaagaaaaccuaaaau

SEQ ID NO: 2795900 - RNA, 20 nt, Leptospira interrogans serovar lai str. 56601
auuguauuuucccgaaagaa

SEQ ID NO: 2795901 - RNA, 13 nt, Leptospira interrogans serovar lai str. 56601
auuguccauuuca

SEQ ID NO: 2795902 - RNA, 15 nt, Leptospira interrogans serovar lai str. 56601
auugucuauuuuaau

SEQ ID NO: 2795903 - RNA, 20 nt, Leptospira interrogans serovar lai str. 56601
auugucuauuuuaauggaaa

SEQ ID NO: 2795904 - RNA, 16 nt, Leptospira interrogans serovar lai str. 56601
auugucucaaaauuaa

SEQ ID NO: 2795905 - RNA, 14 nt, Leptospira interrogans serovar lai str. 56601
auugucuugaauua

SEQ ID NO: 2795906 - RNA, 14 nt, Leptospira interrogans serovar lai str. 56601
auugugaauauuuc

SEQ ID NO: 2795907 - RNA, 22 nt, Leptospira interrogans serovar lai str. 56601
auugugagaacuacuuuuauaa

SEQ ID NO: 2795908 - RNA, 16 nt, Leptospira interrogans serovar lai str. 56601
auuguggagauuuguc

SEQ ID NO: 2795909 - RNA, 21 nt, Leptospira interrogans serovar lai str. 56601
auugugggaacuauuauaaaa

SEQ ID NO: 2795910 - RNA, 12 nt, Leptospira interrogans serovar lai str. 56601
auuguguuuuuu

SEQ ID NO: 2795911 - RNA, 18 nt, Leptospira interrogans serovar lai str. 56601
auuguuaagauaaauuua

SEQ ID NO: 2795912 - RNA, 18 nt, Leptospira interrogans serovar lai str. 56601
auuguuaucugugaauuc

SEQ ID NO: 2795913 - RNA, 22 nt, Leptospira interrogans serovar lai str. 56601
auuguucguuucuuaauuuuac

SEQ ID NO: 2795914 - RNA, 13 nt, Leptospira interrogans serovar lai str. 56601
auuguugaaaaac

SEQ ID NO: 2795915 - RNA, 12 nt, Leptospira interrogans serovar lai str. 56601
auuguugaagaa

SEQ ID NO: 2795916 - RNA, 15 nt, Leptospira interrogans serovar lai str. 56601
auuguugaagaauua

SEQ ID NO: 2795917 - RNA, 21 nt, Leptospira interrogans serovar lai str. 56601
auuguugaagaauuaauucuc

SEQ ID NO: 2795918 - RNA, 22 nt, Leptospira interrogans serovar lai str. 56601
auuguugaauaucuaauauuuu

SEQ ID NO: 2795919 - RNA, 19 nt, Leptospira interrogans serovar lai str. 56601
auuguuggcuuuuuuaugu

SEQ ID NO: 2795920 - RNA, 17 nt, Leptospira interrogans serovar lai str. 56601
auuguuguuauggaauu

SEQ ID NO: 2795921 - RNA, 20 nt, Leptospira interrogans serovar lai str. 56601
auuguuuaaauagauucaaa

SEQ ID NO: 2795922 - RNA, 18 nt, Leptospira interrogans serovar lai str. 56601
auuguuuacaaacuuaca

SEQ ID NO: 2795923 - RNA, 21 nt, Leptospira interrogans serovar lai str. 56601
auuguuucauaaaauucuccg

SEQ ID NO: 2795924 - RNA, 17 nt, Leptospira interrogans serovar lai str. 56601
auuguuuguuuuuucca

SEQ ID NO: 2795925 - RNA, 23 nt, Leptospira interrogans serovar lai str. 56601
auuguuuucuaaaggaaaacgau

SEQ ID NO: 2795926 - RNA, 15 nt, Leptospira interrogans serovar lai str. 56601
auuguuuucuaguuu

SEQ ID NO: 2795927 - RNA, 17 nt, Leptospira interrogans serovar lai str. 56601
auuguuuucuaguuuuc

SEQ ID NO: 2795928 - RNA, 19 nt, Leptospira interrogans serovar lai str. 56601
auuguuuucuaguuuuccu

SEQ ID NO: 2795929 - RNA, 22 nt, Leptospira interrogans serovar lai str. 56601
auuguuuugcucaauagauuuu

SEQ ID NO: 2795930 - RNA, 13 nt, Leptospira interrogans serovar lai str. 56601
auuguuuuuaaau

SEQ ID NO: 2795931 - RNA, 11 nt, Leptospira interrogans serovar lai str. 56601
auuuaaaaagu

SEQ ID NO: 2795932 - RNA, 18 nt, Leptospira interrogans serovar lai str. 56601
auuuaaaaauaguauuuu

SEQ ID NO: 2795933 - RNA, 22 nt, Leptospira interrogans serovar lai str. 56601
auuuaaaacuugucccaaaauu

SEQ ID NO: 2795934 - RNA, 19 nt, Leptospira interrogans serovar lai str. 56601
auuuaaaauacucaauccg

SEQ ID NO: 2795935 - RNA, 22 nt, Leptospira interrogans serovar lai str. 56601
auuuaaaaucacaaaaaagaua

SEQ ID NO: 2795936 - RNA, 14 nt, Leptospira interrogans serovar lai str. 56601
auuuaaacuuuuca

SEQ ID NO: 2795937 - RNA, 19 nt, Leptospira interrogans serovar lai str. 56601
auuuaaagcaaauaccaaa

SEQ ID NO: 2795938 - RNA, 11 nt, Leptospira interrogans serovar lai str. 56601
auuuaaauccc

SEQ ID NO: 2795939 - RNA, 16 nt, Leptospira interrogans serovar lai str. 56601
auuuaaaucccauuuu

SEQ ID NO: 2795940 - RNA, 22 nt, Leptospira interrogans serovar lai str. 56601
auuuaaauguuauuuuguauaa

SEQ ID NO: 2795941 - RNA, 16 nt, Leptospira interrogans serovar lai str. 56601
auuuaaauguuuuugu

SEQ ID NO: 2795942 - RNA, 14 nt, Leptospira interrogans serovar lai str. 56601
auuuauuuuaaaga

SEQ ID NO: 2795943 - RNA, 23 nt, Leptospira interrogans serovar lai str. 56601
auuuauuuucauaggaaauucuu

SEQ ID NO: 2795944 - RNA, 21 nt, Leptospira interrogans serovar lai str. 56601
auuuauuuuuuacgaaaaaau

SEQ ID NO: 2795945 - RNA, 16 nt, Leptospira interrogans serovar lai str. 56601
auuuauuuuuuuuaau

SEQ ID NO: 2795946 - RNA, 18 nt, Leptospira interrogans serovar lai str. 56601
auuucaaaaaacuuucuu

SEQ ID NO: 2795947 - RNA, 14 nt, Leptospira interrogans serovar lai str. 56601
auuucaaaaauaaa

SEQ ID NO: 2795948 - RNA, 14 nt, Leptospira interrogans serovar lai str. 56601
auuucaaaaauaua

SEQ ID NO: 2795949 - RNA, 16 nt, Leptospira interrogans serovar lai str. 56601
auuucaaaaauauauu

SEQ ID NO: 2795950 - RNA, 17 nt, Leptospira interrogans serovar lai str. 56601
auuucaaaaauauauua

SEQ ID NO: 2795951 - RNA, 13 nt, Leptospira interrogans serovar lai str. 56601
auuucaaaaauuu

SEQ ID NO: 2795952 - RNA, 12 nt, Leptospira interrogans serovar lai str. 56601
auuucaaaauuu

SEQ ID NO: 2795953 - RNA, 14 nt, Leptospira interrogans serovar lai str. 56601
auuucaaaauuuuu

SEQ ID NO: 2795954 - RNA, 15 nt, Leptospira interrogans serovar lai str. 56601
auuucaaaauuuuuu

SEQ ID NO: 2795955 - RNA, 16 nt, Leptospira interrogans serovar lai str. 56601
auuucaacuuuuuuca

SEQ ID NO: 2795956 - RNA, 15 nt, Leptospira interrogans serovar lai str. 56601
auuucaaguuuucuu

SEQ ID NO: 2795957 - RNA, 23 nt, Leptospira interrogans serovar lai str. 56601
auuucaaguuuucuuuuuuucuc

SEQ ID NO: 2795958 - RNA, 20 nt, Leptospira interrogans serovar lai str. 56601
auuucaauacaauaaaaaca

SEQ ID NO: 2795959 - RNA, 14 nt, Leptospira interrogans serovar lai str. 56601
auuucaauauaaaa

SEQ ID NO: 2795960 - RNA, 17 nt, Leptospira interrogans serovar lai str. 56601
auuucaauauaaaaauu

SEQ ID NO: 2795961 - RNA, 16 nt, Leptospira interrogans serovar lai str. 56601
auuucaaugcaaaaaa

SEQ ID NO: 2795962 - RNA, 21 nt, Leptospira interrogans serovar lai str. 56601
auuucaauuccuguaguauuu

SEQ ID NO: 2795963 - RNA, 15 nt, Leptospira interrogans serovar lai str. 56601
auuucaauuuucuca

SEQ ID NO: 2795964 - RNA, 17 nt, Leptospira interrogans serovar lai str. 56601
auuucagcuccaaaaaa

SEQ ID NO: 2795965 - RNA, 22 nt, Leptospira interrogans serovar lai str. 56601
auuucagcuccaaaaaaauaaa

SEQ ID NO: 2795966 - RNA, 14 nt, Leptospira interrogans serovar lai str. 56601
auuucaguucugag

SEQ ID NO: 2795967 - RNA, 16 nt, Leptospira interrogans serovar lai str. 56601
auuucauaaaauucuu

SEQ ID NO: 2795968 - RNA, 18 nt, Leptospira interrogans serovar lai str. 56601
auuucauaguucaauuaa

SEQ ID NO: 2795969 - RNA, 15 nt, Leptospira interrogans serovar lai str. 56601
auuucauauccaaaa

SEQ ID NO: 2795970 - RNA, 16 nt, Leptospira interrogans serovar lai str. 56601
auuucauaucuaaaau

SEQ ID NO: 2795971 - RNA, 18 nt, Leptospira interrogans serovar lai str. 56601
auuucauccaugucuucu

SEQ ID NO: 2795972 - RNA, 24 nt, Leptospira interrogans serovar lai str. 56601
auuucauccaugucuucuaaaucu

SEQ ID NO: 2795973 - RNA, 18 nt, Leptospira interrogans serovar lai str. 56601
auuucaugcaaaaauuua

SEQ ID NO: 2795974 - RNA, 19 nt, Leptospira interrogans serovar lai str. 56601
auuucaugcaaaaauuuaa

SEQ ID NO: 2795975 - RNA, 20 nt, Leptospira interrogans serovar lai str. 56601
auuucaugcaaaaauuuaau

SEQ ID NO: 2795976 - RNA, 21 nt, Leptospira interrogans serovar lai str. 56601
auuucaugcaaaaauuuaauu

SEQ ID NO: 2795977 - RNA, 15 nt, Leptospira interrogans serovar lai str. 56601
auuucauuucuauga

SEQ ID NO: 2795978 - RNA, 16 nt, Leptospira interrogans serovar lai str. 56601
auuucauuuuuuucga

SEQ ID NO: 2795979 - RNA, 15 nt, Leptospira interrogans serovar lai str. 56601
auuuccaaacucaau

SEQ ID NO: 2795980 - RNA, 15 nt, Leptospira interrogans serovar lai str. 56601
auuuccaaauuguau

SEQ ID NO: 2795981 - RNA, 18 nt, Leptospira interrogans serovar lai str. 56601
auuuccaaauuguaugaa

SEQ ID NO: 2795982 - RNA, 17 nt, Leptospira interrogans serovar lai str. 56601
auuuccaacgaaguucc

SEQ ID NO: 2795983 - RNA, 19 nt, Leptospira interrogans serovar lai str. 56601
auuuccaacuguuuauaua

SEQ ID NO: 2795984 - RNA, 19 nt, Leptospira interrogans serovar lai str. 56601
auuuccaccggaguaaggc

SEQ ID NO: 2795985 - RNA, 18 nt, Leptospira interrogans serovar lai str. 56601
auuuccacuacaaucacu

SEQ ID NO: 2795986 - RNA, 23 nt, Leptospira interrogans serovar lai str. 56601
auuuccaucuuuauaucuugaac

SEQ ID NO: 2795987 - RNA, 19 nt, Leptospira interrogans serovar lai str. 56601
auuuccauuaauuacagaa

SEQ ID NO: 2795988 - RNA, 12 nt, Leptospira interrogans serovar lai str. 56601
auuuccauuucu

SEQ ID NO: 2795989 - RNA, 16 nt, Leptospira interrogans serovar lai str. 56601
auuucccaaaauuuca

SEQ ID NO: 2795990 - RNA, 17 nt, Leptospira interrogans serovar lai str. 56601
auuucccauaaaaagag

SEQ ID NO: 2795991 - RNA, 21 nt, Leptospira interrogans serovar lai str. 56601
auuucccauaaaaagagccau

SEQ ID NO: 2795992 - RNA, 22 nt, Leptospira interrogans serovar lai str. 56601
auuucccuaguuccaauuaaca

SEQ ID NO: 2795993 - RNA, 22 nt, Leptospira interrogans serovar lai str. 56601
auuuccgauaaagaaaguaauu

SEQ ID NO: 2795994 - RNA, 23 nt, Leptospira interrogans serovar lai str. 56601
auuuccgauaaagaaaguaauuu

SEQ ID NO: 2795995 - RNA, 15 nt, Leptospira interrogans serovar lai str. 56601
auuuccggaaaacga

SEQ ID NO: 2795996 - RNA, 16 nt, Leptospira interrogans serovar lai str. 56601
auuuccggaaaacgaa

SEQ ID NO: 2795997 - RNA, 21 nt, Leptospira interrogans serovar lai str. 56601
auuuccggaaaacgaauauca

SEQ ID NO: 2795998 - RNA, 23 nt, Leptospira interrogans serovar lai str. 56601
auuuccggaaaacgaauaucaua

SEQ ID NO: 2795999 - RNA, 19 nt, Leptospira interrogans serovar lai str. 56601
auuuccgucguuugcaucc

SEQ ID NO: 2796000 - RNA, 13 nt, Leptospira interrogans serovar lai str. 56601
auuuccuaaaagu

SEQ ID NO: 2796001 - RNA, 20 nt, Leptospira interrogans serovar lai str. 56601
auuuccuaaaauugugggaa

SEQ ID NO: 2796002 - RNA, 21 nt, Leptospira interrogans serovar lai str. 56601
auuuccuuuucgacuauuucu

SEQ ID NO: 2796003 - RNA, 22 nt, Leptospira interrogans serovar lai str. 56601
auuuccuuuucgacuauuucuu

SEQ ID NO: 2796004 - RNA, 24 nt, Leptospira interrogans serovar lai str. 56601
auuuccuuuucgacuauuucuucc

SEQ ID NO: 2796005 - RNA, 20 nt, Leptospira interrogans serovar lai str. 56601
auuuccuuuuguuuuucuuu

SEQ ID NO: 2796006 - RNA, 22 nt, Leptospira interrogans serovar lai str. 56601
auuucgaguuuguucuaaaaac

SEQ ID NO: 2796007 - RNA, 19 nt, Leptospira interrogans serovar lai str. 56601
auuucggauucuuccccac

SEQ ID NO: 2796008 - RNA, 17 nt, Leptospira interrogans serovar lai str. 56601
auuucguucggaaaaaa

SEQ ID NO: 2796009 - RNA, 19 nt, Leptospira interrogans serovar lai str. 56601
auuucguucggaaaaagua

SEQ ID NO: 2796010 - RNA, 22 nt, Leptospira interrogans serovar lai str. 56601
auuucguucggaaaaaguauaa

SEQ ID NO: 2796011 - RNA, 14 nt, Leptospira interrogans serovar lai str. 56601
auuucguuucccau

SEQ ID NO: 2796012 - RNA, 17 nt, Leptospira interrogans serovar lai str. 56601
auuucguuucccucuuc

SEQ ID NO: 2796013 - RNA, 13 nt, Leptospira interrogans serovar lai str. 56601
auuucguuuuuuu

SEQ ID NO: 2796014 - RNA, 16 nt, Leptospira interrogans serovar lai str. 56601
auuucuaaaagaagau

SEQ ID NO: 2796015 - RNA, 12 nt, Leptospira interrogans serovar lai str. 56601
auuucuaaaagu

SEQ ID NO: 2796016 - RNA, 12 nt, Leptospira interrogans serovar lai str. 56601
auuucuaaaaua

SEQ ID NO: 2796017 - RNA, 18 nt, Leptospira interrogans serovar lai str. 56601
auuucuaaaauucuuccg

SEQ ID NO: 2796018 - RNA, 17 nt, Leptospira interrogans serovar lai str. 56601
auuucuaaagaauuauc

SEQ ID NO: 2796019 - RNA, 14 nt, Leptospira interrogans serovar lai str. 56601
auuucuaaauugug

SEQ ID NO: 2796020 - RNA, 15 nt, Leptospira interrogans serovar lai str. 56601
auuucuaaauuguga

SEQ ID NO: 2796021 - RNA, 13 nt, Leptospira interrogans serovar lai str. 56601
auuucuaauagau

SEQ ID NO: 2796022 - RNA, 20 nt, Leptospira interrogans serovar lai str. 56601
auuucuaauauuaaaaacac

SEQ ID NO: 2796023 - RNA, 14 nt, Leptospira interrogans serovar lai str. 56601
auuucuaguuugaa

SEQ ID NO: 2796024 - RNA, 19 nt, Leptospira interrogans serovar lai str. 56601
auuucuaguuugaauuuag

SEQ ID NO: 2796025 - RNA, 17 nt, Leptospira interrogans serovar lai str. 56601
auuuguuugucuuuuuc

SEQ ID NO: 2796026 - RNA, 21 nt, Leptospira interrogans serovar lai str. 56601
auuuguuuguuauaagaauuu

SEQ ID NO: 2796027 - RNA, 22 nt, Leptospira interrogans serovar lai str. 56601
auuuguuuguuauaagaauuuu

SEQ ID NO: 2796028 - RNA, 17 nt, Leptospira interrogans serovar lai str. 56601
auuuguuuuaaaauuua

SEQ ID NO: 2796029 - RNA, 11 nt, Leptospira interrogans serovar lai str. 56601
auuuguuuuau

SEQ ID NO: 2796030 - RNA, 19 nt, Leptospira interrogans serovar lai str. 56601
auuuguuuuuaaaauugug

SEQ ID NO: 2796031 - RNA, 21 nt, Leptospira interrogans serovar lai str. 56601
auuuguuuuuaaaauugugau

SEQ ID NO: 2796032 - RNA, 15 nt, Leptospira interrogans serovar lai str. 56601
auuuuaaaaaaauuu

SEQ ID NO: 2796033 - RNA, 17 nt, Leptospira interrogans serovar lai str. 56601
auuuuaaaaaaauuuuu

SEQ ID NO: 2796034 - RNA, 15 nt, Leptospira interrogans serovar lai str. 56601
auuuuaaaaaauuua

SEQ ID NO: 2796035 - RNA, 14 nt, Leptospira interrogans serovar lai str. 56601
auuuuaaaaauuca

SEQ ID NO: 2796036 - RNA, 13 nt, Leptospira interrogans serovar lai str. 56601
auuuuaaaaauuu

SEQ ID NO: 2796037 - RNA, 22 nt, Leptospira interrogans serovar lai str. 56601
auuuuaaaaggcucucuuuuga

SEQ ID NO: 2796038 - RNA, 15 nt, Leptospira interrogans serovar lai str. 56601
auuuuaaagguugag

SEQ ID NO: 2796039 - RNA, 18 nt, Leptospira interrogans serovar lai str. 56601
auuuuaaauaaaaagaag

SEQ ID NO: 2796040 - RNA, 19 nt, Leptospira interrogans serovar lai str. 56601
auuuuaaauauuaauuaua

SEQ ID NO: 2796041 - RNA, 20 nt, Leptospira interrogans serovar lai str. 56601
auuuuaaauuagcuuaagaa

SEQ ID NO: 2796042 - RNA, 14 nt, Leptospira interrogans serovar lai str. 56601
auuuuaacgugagu

SEQ ID NO: 2796043 - RNA, 14 nt, Leptospira interrogans serovar lai str. 56601
auuuuaacuugagu

SEQ ID NO: 2796044 - RNA, 16 nt, Leptospira interrogans serovar lai str. 56601
auuuuaagaacaauuu

SEQ ID NO: 2796045 - RNA, 22 nt, Leptospira interrogans serovar lai str. 56601
auuuuaagaacaauuuaaaaua

SEQ ID NO: 2796046 - RNA, 23 nt, Leptospira interrogans serovar lai str. 56601
auuuuaagaacaauuuaaaauaa

SEQ ID NO: 2796047 - RNA, 13 nt, Leptospira interrogans serovar lai str. 56601
auuuuaagaaucg

SEQ ID NO: 2796048 - RNA, 16 nt, Leptospira interrogans serovar lai str. 56601
auuuuaagaucuauuc

SEQ ID NO: 2796049 - RNA, 22 nt, Leptospira interrogans serovar lai str. 56601
auuuuaagaucuauuccuaaaa

SEQ ID NO: 2796050 - RNA, 14 nt, Leptospira interrogans serovar lai str. 56601
auuuuaauggaaau

SEQ ID NO: 2796051 - RNA, 12 nt, Leptospira interrogans serovar lai str. 56601
auuuuacaaaca

SEQ ID NO: 2796052 - RNA, 22 nt, Leptospira interrogans serovar lai str. 56601
auuuuacagacguauuuuuaaa

SEQ ID NO: 2796053 - RNA, 23 nt, Leptospira interrogans serovar lai str. 56601
auuuuacagacguauuuuuaaau

SEQ ID NO: 2796054 - RNA, 14 nt, Leptospira interrogans serovar lai str. 56601
auuuuacagauuga

SEQ ID NO: 2796055 - RNA, 19 nt, Leptospira interrogans serovar lai str. 56601
auuuuacagauugauucuu

SEQ ID NO: 2796056 - RNA, 21 nt, Leptospira interrogans serovar lai str. 56601
auuuuacccugguuucaaaaa

SEQ ID NO: 2796057 - RNA, 21 nt, Leptospira interrogans serovar lai str. 56601
auuuuaccgauaagucuagaa

SEQ ID NO: 2796058 - RNA, 23 nt, Leptospira interrogans serovar lai str. 56601
auuuuaccgauaagucuagaaau

SEQ ID NO: 2796059 - RNA, 21 nt, Leptospira interrogans serovar lai str. 56601
auuuuacgaacaaauucuaca

SEQ ID NO: 2796060 - RNA, 21 nt, Leptospira interrogans serovar lai str. 56601
auuuuacgaaccaauucuaaa

SEQ ID NO: 2796061 - RNA, 22 nt, Leptospira interrogans serovar lai str. 56601
auuuuacgaaccaauucuaaaa

SEQ ID NO: 2796062 - RNA, 21 nt, Leptospira interrogans serovar lai str. 56601
auuuuacgaacgaauucuaaa

SEQ ID NO: 2796063 - RNA, 23 nt, Leptospira interrogans serovar lai str. 56601
auuuuacgaaucuaauuuauaaa

SEQ ID NO: 2796064 - RNA, 14 nt, Leptospira interrogans serovar lai str. 56601
auuuuacgauuaaa

SEQ ID NO: 2796065 - RNA, 14 nt, Leptospira interrogans serovar lai str. 56601
auuuuacugcuuga

SEQ ID NO: 2796066 - RNA, 12 nt, Leptospira interrogans serovar lai str. 56601
auuuuagaaauc

SEQ ID NO: 2796067 - RNA, 23 nt, Leptospira interrogans serovar lai str. 56601
auuuuagaaaucgauuuguaaaa

SEQ ID NO: 2796068 - RNA, 14 nt, Leptospira interrogans serovar lai str. 56601
auuuuagaauaucu

SEQ ID NO: 2796069 - RNA, 17 nt, Leptospira interrogans serovar lai str. 56601
auuuuagaaucaaaaug

SEQ ID NO: 2796070 - RNA, 19 nt, Leptospira interrogans serovar lai str. 56601
auuuuagaaucaaaaugaa

SEQ ID NO: 2796071 - RNA, 18 nt, Leptospira interrogans serovar lai str. 56601
auuuuagaaucagaauga

SEQ ID NO: 2796072 - RNA, 13 nt, Leptospira interrogans serovar lai str. 56601
auuuuagaauuua

SEQ ID NO: 2796073 - RNA, 14 nt, Leptospira interrogans serovar lai str. 56601
auuuuagaauuuau

SEQ ID NO: 2796074 - RNA, 23 nt, Leptospira interrogans serovar lai str. 56601
auuuuagagaaacuuuaaauacu

SEQ ID NO: 2796075 - RNA, 18 nt, Leptospira interrogans serovar lai str. 56601
auuuuagauacguuuuau

SEQ ID NO: 2796076 - RNA, 13 nt, Leptospira interrogans serovar lai str. 56601
auuuuaggaauca

SEQ ID NO: 2796077 - RNA, 14 nt, Leptospira interrogans serovar lai str. 56601
auuuuaggaaucaa

SEQ ID NO: 2796078 - RNA, 15 nt, Leptospira interrogans serovar lai str. 56601
auuuuaggaaucgau

SEQ ID NO: 2796079 - RNA, 14 nt, Leptospira interrogans serovar lai str. 56601
auuuuaggauuuuu

SEQ ID NO: 2796080 - RNA, 21 nt, Leptospira interrogans serovar lai str. 56601
auuuuagggaucgaucuguaa

SEQ ID NO: 2796081 - RNA, 21 nt, Leptospira interrogans serovar lai str. 56601
auuuuagggccgucuauaaaa

SEQ ID NO: 2796082 - RNA, 23 nt, Leptospira interrogans serovar lai str. 56601
auuuuagggccgucuauaaaauu

SEQ ID NO: 2796083 - RNA, 18 nt, Leptospira interrogans serovar lai str. 56601
auuuuaguucucucgaaa

SEQ ID NO: 2796084 - RNA, 18 nt, Leptospira interrogans serovar lai str. 56601
auuuuaguuuauuuuaaa

SEQ ID NO: 2796085 - RNA, 20 nt, Leptospira interrogans serovar lai str. 56601
auuuuaguuuauuuuaaaaa

SEQ ID NO: 2796086 - RNA, 12 nt, Leptospira interrogans serovar lai str. 56601
auuuuauaaaau

SEQ ID NO: 2796087 - RNA, 17 nt, Leptospira interrogans serovar lai str. 56601
auuuuauaaauuauuuu

SEQ ID NO: 2796088 - RNA, 10 nt, Leptospira interrogans serovar lai str. 56601
auuuuauaau

SEQ ID NO: 2796089 - RNA, 16 nt, Leptospira interrogans serovar lai str. 56601
auuuuauaauucugaa

SEQ ID NO: 2796090 - RNA, 22 nt, Leptospira interrogans serovar lai str. 56601
auuuuauagaaauacuuaaaau

SEQ ID NO: 2796091 - RNA, 18 nt, Leptospira interrogans serovar lai str. 56601
auuuuaucagauguguaa

SEQ ID NO: 2796092 - RNA, 19 nt, Leptospira interrogans serovar lai str. 56601
auuuuaucgaauaagaaau

SEQ ID NO: 2796093 - RNA, 16 nt, Leptospira interrogans serovar lai str. 56601
auuuuaugaauaaaaa

SEQ ID NO: 2796094 - RNA, 19 nt, Leptospira interrogans serovar lai str. 56601
auuuuauguaaaucggcaa

SEQ ID NO: 2796095 - RNA, 17 nt, Leptospira interrogans serovar lai str. 56601
auuuuauguuauauauu

SEQ ID NO: 2796096 - RNA, 20 nt, Leptospira interrogans serovar lai str. 56601
auuuuauucacugaaaauuu

SEQ ID NO: 2796097 - RNA, 17 nt, Leptospira interrogans serovar lai str. 56601
auuuuauugaagauauu

SEQ ID NO: 2796098 - RNA, 22 nt, Leptospira interrogans serovar lai str. 56601
auuuuauugaagauauuuuccu

SEQ ID NO: 2796099 - RNA, 19 nt, Leptospira interrogans serovar lai str. 56601
auuuuauuguguuuuuucu

SEQ ID NO: 2796100 - RNA, 12 nt, Leptospira interrogans serovar lai str. 56601
auuuuauuucua

SEQ ID NO: 2796101 - RNA, 12 nt, Leptospira interrogans serovar lai str. 56601
auuuuauuuuua

SEQ ID NO: 2796102 - RNA, 13 nt, Leptospira interrogans serovar lai str. 56601
auuuuauuuuugg

SEQ ID NO: 2796103 - RNA, 19 nt, Leptospira interrogans serovar lai str. 56601
auuuuauuuuuuaugaaaa

SEQ ID NO: 2796104 - RNA, 11 nt, Leptospira interrogans serovar lai str. 56601
auuuucaaaaa

SEQ ID NO: 2796105 - RNA, 13 nt, Leptospira interrogans serovar lai str. 56601
auuuucaaaaaau

SEQ ID NO: 2796106 - RNA, 16 nt, Leptospira interrogans serovar lai str. 56601
auuuucaaaaaauauc

SEQ ID NO: 2796107 - RNA, 14 nt, Leptospira interrogans serovar lai str. 56601
auuuucaaaaucua

SEQ ID NO: 2796108 - RNA, 22 nt, Leptospira interrogans serovar lai str. 56601
auuuuuaagauuacauuuuucu

SEQ ID NO: 2796109 - RNA, 16 nt, Leptospira interrogans serovar lai str. 56601
auuuuuaauaaaaugc

SEQ ID NO: 2796110 - RNA, 14 nt, Leptospira interrogans serovar lai str. 56601
auuuuuaaucaaau

SEQ ID NO: 2796111 - RNA, 15 nt, Leptospira interrogans serovar lai str. 56601
auuuuuaaucaaaug

SEQ ID NO: 2796112 - RNA, 15 nt, Leptospira interrogans serovar lai str. 56601
auuuuuaaucaagug

SEQ ID NO: 2796113 - RNA, 16 nt, Leptospira interrogans serovar lai str. 56601
auuuuuacaaaaaaau

SEQ ID NO: 2796114 - RNA, 16 nt, Leptospira interrogans serovar lai str. 56601
auuuuuacagaaaaau

SEQ ID NO: 2796115 - RNA, 18 nt, Leptospira interrogans serovar lai str. 56601
auuuuuacagaaaaauca

SEQ ID NO: 2796116 - RNA, 20 nt, Leptospira interrogans serovar lai str. 56601
auuuuuacgacccaagauuu

SEQ ID NO: 2796117 - RNA, 22 nt, Leptospira interrogans serovar lai str. 56601
auuuuuacgcguaauuuuuugg

SEQ ID NO: 2796118 - RNA, 19 nt, Leptospira interrogans serovar lai str. 56601
auuuuuacucaaagaaucg

SEQ ID NO: 2796119 - RNA, 13 nt, Leptospira interrogans serovar lai str. 56601
auuuuuagaauuu

SEQ ID NO: 2796120 - RNA, 20 nt, Leptospira interrogans serovar lai str. 56601
auuuuuagucauuuccucca

SEQ ID NO: 2796121 - RNA, 18 nt, Leptospira interrogans serovar lai str. 56601
auuuuuaguuuuaauaua

SEQ ID NO: 2796122 - RNA, 13 nt, Leptospira interrogans serovar lai str. 56601
auuuuuauaaaaa

SEQ ID NO: 2796123 - RNA, 18 nt, Leptospira interrogans serovar lai str. 56601
auuuuuauaaagauaaau

SEQ ID NO: 2796124 - RNA, 19 nt, Leptospira interrogans serovar lai str. 56601
auuuuuauaauuuagaguu

SEQ ID NO: 2796125 - RNA, 14 nt, Leptospira interrogans serovar lai str. 56601
auuuuuaucauaaa

SEQ ID NO: 2796126 - RNA, 18 nt, Leptospira interrogans serovar lai str. 56601
auuuuuaucauaaaacac

SEQ ID NO: 2796127 - RNA, 15 nt, Leptospira interrogans serovar lai str. 56601
auuuuuaucgcaaaa

SEQ ID NO: 2796128 - RNA, 23 nt, Leptospira interrogans serovar lai str. 56601
auuuuuauguaauauuucuuucg

SEQ ID NO: 2796129 - RNA, 16 nt, Leptospira interrogans serovar lai str. 56601
auuuuuauguauuuua

SEQ ID NO: 2796130 - RNA, 17 nt, Leptospira interrogans serovar lai str. 56601
auuuuuauuggaaaaag

SEQ ID NO: 2796131 - RNA, 12 nt, Leptospira interrogans serovar lai str. 56601
auuuuuauuugc

SEQ ID NO: 2796132 - RNA, 13 nt, Leptospira interrogans serovar lai str. 56601
auuuuucaaauuu

SEQ ID NO: 2796133 - RNA, 16 nt, Leptospira interrogans serovar lai str. 56601
auuuuucaacaacucu

SEQ ID NO: 2796134 - RNA, 17 nt, Leptospira interrogans serovar lai str. 56601
auuuuucaacaacucua

SEQ ID NO: 2796135 - RNA, 19 nt, Leptospira interrogans serovar lai str. 56601
auuuuucaacaacucuaau

SEQ ID NO: 2796136 - RNA, 23 nt, Leptospira interrogans serovar lai str. 56601
auuuuucaacaacucuaaugaau

SEQ ID NO: 2796137 - RNA, 18 nt, Leptospira interrogans serovar lai str. 56601
auuuuucaacaacucuau

SEQ ID NO: 2796138 - RNA, 23 nt, Leptospira interrogans serovar lai str. 56601
auuuuucaacaacucuauuuuau

SEQ ID NO: 2796139 - RNA, 23 nt, Leptospira interrogans serovar lai str. 56601
auuuuucaagagugguuuucaaa

SEQ ID NO: 2796140 - RNA, 14 nt, Leptospira interrogans serovar lai str. 56601
auuuuucaauaauu

SEQ ID NO: 2796141 - RNA, 18 nt, Leptospira interrogans serovar lai str. 56601
auuuuuccagcgauucua

SEQ ID NO: 2796142 - RNA, 22 nt, Leptospira interrogans serovar lai str. 56601
auuuuuccgauggucgaagaua

SEQ ID NO: 2796143 - RNA, 13 nt, Leptospira interrogans serovar lai str. 56601
auuuuucuaaaaa

SEQ ID NO: 2796144 - RNA, 14 nt, Leptospira interrogans serovar lai str. 56601
auuuuucuaaaaaa

SEQ ID NO: 2796145 - RNA, 22 nt, Leptospira interrogans serovar lai str. 56601
auuuuucuaaaaaaaauguaau

SEQ ID NO: 2796146 - RNA, 22 nt, Leptospira interrogans serovar lai str. 56601
auuuuucuaaaaaaacgcgaau

SEQ ID NO: 2796147 - RNA, 18 nt, Leptospira interrogans serovar lai str. 56601
auuuuucuacaauuauau

SEQ ID NO: 2796148 - RNA, 21 nt, Leptospira interrogans serovar lai str. 56601
auuuuucucuaucagaaaaac

SEQ ID NO: 2796149 - RNA, 20 nt, Leptospira interrogans serovar lai str. 56601
auuuuucugaaaaaguugga

SEQ ID NO: 2796150 - RNA, 23 nt, Leptospira interrogans serovar lai str. 56601
auuuuucuggaaaaguuuuuaaa

SEQ ID NO: 2796151 - RNA, 23 nt, Leptospira interrogans serovar lai str. 56601
auuuuucuuaaaaaaauugugau

SEQ ID NO: 2796152 - RNA, 20 nt, Leptospira interrogans serovar lai str. 56601
auuuuucuucuucaugauuu

SEQ ID NO: 2796153 - RNA, 12 nt, Leptospira interrogans serovar lai str. 56601
auuuuucuuugc

SEQ ID NO: 2796154 - RNA, 12 nt, Leptospira interrogans serovar lai str. 56601
auuuuucuuuua

SEQ ID NO: 2796155 - RNA, 15 nt, Leptospira interrogans serovar lai str. 56601
auuuuucuuuuaaaa

SEQ ID NO: 2796156 - RNA, 16 nt, Leptospira interrogans serovar lai str. 56601
auuuuucuuuuaaaau

SEQ ID NO: 2796157 - RNA, 20 nt, Leptospira interrogans serovar lai str. 56601
auuuuugaaucuauuuuuga

SEQ ID NO: 2796158 - RNA, 15 nt, Leptospira interrogans serovar lai str. 56601
auuuuugaauuuuuu

SEQ ID NO: 2796159 - RNA, 16 nt, Leptospira interrogans serovar lai str. 56601
auuuuugaauuuuuua

SEQ ID NO: 2796160 - RNA, 14 nt, Leptospira interrogans serovar lai str. 56601
auuuuugauuuuag

SEQ ID NO: 2796161 - RNA, 19 nt, Leptospira interrogans serovar lai str. 56601
auuuuugcaccaaauugca

SEQ ID NO: 2796162 - RNA, 15 nt, Leptospira interrogans serovar lai str. 56601
auuuuuguacaaaac

SEQ ID NO: 2796163 - RNA, 14 nt, Leptospira interrogans serovar lai str. 56601
auuuuugugaaacu

SEQ ID NO: 2796164 - RNA, 20 nt, Leptospira interrogans serovar lai str. 56601
auuuuuguguaaaauuacac

SEQ ID NO: 2796165 - RNA, 21 nt, Leptospira interrogans serovar lai str. 56601
auuuuuguuaaacaacgugaa

SEQ ID NO: 2796166 - RNA, 15 nt, Leptospira interrogans serovar lai str. 56601
auuuuuuaaaaauuu

SEQ ID NO: 2796167 - RNA, 14 nt, Leptospira interrogans serovar lai str. 56601
auuuuuuaaaauaa

SEQ ID NO: 2796168 - RNA, 23 nt, Leptospira interrogans serovar lai str. 56601
auuuuuuaaacuuuguuuuugcu

SEQ ID NO: 2796169 - RNA, 14 nt, Leptospira interrogans serovar lai str. 56601
auuuuuuaaauuua

SEQ ID NO: 2796170 - RNA, 16 nt, Leptospira interrogans serovar lai str. 56601
auuuuuuaacaacucu

SEQ ID NO: 2796171 - RNA, 17 nt, Leptospira interrogans serovar lai str. 56601
auuuuuuaauaacucua

SEQ ID NO: 2796172 - RNA, 15 nt, Leptospira interrogans serovar lai str. 56601
auuuuuuaaucaaug

SEQ ID NO: 2796173 - RNA, 20 nt, Leptospira interrogans serovar lai str. 56601
auuuuuuagaaaucaauucu

SEQ ID NO: 2796174 - RNA, 21 nt, Leptospira interrogans serovar lai str. 56601
auuuuuuagaaaucaauucuu

SEQ ID NO: 2796175 - RNA, 12 nt, Leptospira interrogans serovar lai str. 56601
auuuuuuaucaa

SEQ ID NO: 2796176 - RNA, 18 nt, Leptospira interrogans serovar lai str. 56601
auuuuuuauguugaguuu

SEQ ID NO: 2796177 - RNA, 18 nt, Leptospira interrogans serovar lai str. 56601
auuuuuuauuaagaacuu

SEQ ID NO: 2796178 - RNA, 18 nt, Leptospira interrogans serovar lai str. 56601
auuuuuuauuuuugucua

SEQ ID NO: 2796179 - RNA, 20 nt, Leptospira interrogans serovar lai str. 56601
auuuuuucaaaaacucuauu

SEQ ID NO: 2796180 - RNA, 18 nt, Leptospira interrogans serovar lai str. 56601
auuuuuucacaaaaccac

SEQ ID NO: 2796181 - RNA, 17 nt, Leptospira interrogans serovar lai str. 56601
auuuuuuccaaaaagaa

SEQ ID NO: 2796182 - RNA, 10 nt, Leptospira interrogans serovar lai str. 56601
auuuuuuccc

SEQ ID NO: 2796183 - RNA, 22 nt, Leptospira interrogans serovar lai str. 56601
auuuuuucuaaauuagaauuuu

SEQ ID NO: 2796184 - RNA, 14 nt, Leptospira interrogans serovar lai str. 56601
auuuuuucuuccgg

SEQ ID NO: 2796185 - RNA, 13 nt, Leptospira interrogans serovar lai str. 56601
auuuuuugaaaaa

SEQ ID NO: 2796186 - RNA, 18 nt, Leptospira interrogans serovar lai str. 56601
auuuuuugaaaaagaaua

SEQ ID NO: 2796187 - RNA, 12 nt, Leptospira interrogans serovar lai str. 56601
auuuuuugcaaa

SEQ ID NO: 2796188 - RNA, 17 nt, Leptospira interrogans serovar lai str. 56601
auuuuuuggaaauuuuu

SEQ ID NO: 2796189 - RNA, 18 nt, Leptospira interrogans serovar lai str. 56601
auuuuuuggaaauuuuua

SEQ ID NO: 2796190 - RNA, 17 nt, Leptospira interrogans serovar lai str. 56601
auuuuuuguaugaguuc

SEQ ID NO: 2796191 - RNA, 22 nt, Leptospira interrogans serovar lai str. 56601
caaaaucgauugaucuaucuuu

SEQ ID NO: 2796192 - RNA, 20 nt, Leptospira interrogans serovar lai str. 56601
caaaaucggcgccugcauuu

SEQ ID NO: 2796193 - RNA, 20 nt, Leptospira interrogans serovar lai str. 56601
caaaaucguccaauguggca

SEQ ID NO: 2796194 - RNA, 19 nt, Leptospira interrogans serovar lai str. 56601
caaaaucuuaaaagaaaau

SEQ ID NO: 2796195 - RNA, 20 nt, Leptospira interrogans serovar lai str. 56601
caaaaugaacaaugaauuuu

SEQ ID NO: 2796196 - RNA, 22 nt, Leptospira interrogans serovar lai str. 56601
caaaaugaacaaugaauuuuua

SEQ ID NO: 2796197 - RNA, 15 nt, Leptospira interrogans serovar lai str. 56601
caaaaugaacucaac

SEQ ID NO: 2796198 - RNA, 16 nt, Leptospira interrogans serovar lai str. 56601
caaaaugaacucaaca

SEQ ID NO: 2796199 - RNA, 16 nt, Leptospira interrogans serovar lai str. 56601
caaaaugaauuguaaa

SEQ ID NO: 2796200 - RNA, 19 nt, Leptospira interrogans serovar lai str. 56601
caaaaugaauuguaaaaaa

SEQ ID NO: 2796201 - RNA, 20 nt, Leptospira interrogans serovar lai str. 56601
caaaaugaguuauaguaaaa

SEQ ID NO: 2796202 - RNA, 16 nt, Leptospira interrogans serovar lai str. 56601
caaaauguuuuuauau

SEQ ID NO: 2796203 - RNA, 14 nt, Leptospira interrogans serovar lai str. 56601
caaaauuaagaauc

SEQ ID NO: 2796204 - RNA, 17 nt, Leptospira interrogans serovar lai str. 56601
caaaauuaagaaucaau

SEQ ID NO: 2796205 - RNA, 18 nt, Leptospira interrogans serovar lai str. 56601
caaaauuaagaaucaaua

SEQ ID NO: 2796206 - RNA, 15 nt, Leptospira interrogans serovar lai str. 56601
caaaauucaaauguc

SEQ ID NO: 2796207 - RNA, 23 nt, Leptospira interrogans serovar lai str. 56601
caaaauucaaaugucuuuuuaga

SEQ ID NO: 2796208 - RNA, 17 nt, Leptospira interrogans serovar lai str. 56601
caaaauucuuaaaaaau

SEQ ID NO: 2796209 - RNA, 14 nt, Leptospira interrogans serovar lai str. 56601
caaaauuuaaaaau

SEQ ID NO: 2796210 - RNA, 15 nt, Leptospira interrogans serovar lai str. 56601
caaaauuuaaaaaug

SEQ ID NO: 2796211 - RNA, 16 nt, Leptospira interrogans serovar lai str. 56601
caaaauuuaaauccua

SEQ ID NO: 2796212 - RNA, 15 nt, Leptospira interrogans serovar lai str. 56601
caaaauuuagaauug

SEQ ID NO: 2796213 - RNA, 16 nt, Leptospira interrogans serovar lai str. 56601
caaaauuuagaauugu

SEQ ID NO: 2796214 - RNA, 20 nt, Leptospira interrogans serovar lai str. 56601
caaaauuuagaauuguuauc

SEQ ID NO: 2796215 - RNA, 18 nt, Leptospira interrogans serovar lai str. 56601
caaaauuuaucuguaaaa

SEQ ID NO: 2796216 - RNA, 20 nt, Leptospira interrogans serovar lai str. 56601
caaaauuuaucuguaaaauu

SEQ ID NO: 2796217 - RNA, 18 nt, Leptospira interrogans serovar lai str. 56601
caaaauuucagauauuuu

SEQ ID NO: 2796218 - RNA, 20 nt, Leptospira interrogans serovar lai str. 56601
caaaauuuugcuucugaaca

SEQ ID NO: 2796219 - RNA, 16 nt, Leptospira interrogans serovar lai str. 56601
caaaauuuuuuccuuu

SEQ ID NO: 2796220 - RNA, 14 nt, Leptospira interrogans serovar lai str. 56601
caaaauuuuuuuaa

SEQ ID NO: 2796221 - RNA, 15 nt, Leptospira interrogans serovar lai str. 56601
caaacaaauagaaau

SEQ ID NO: 2796222 - RNA, 16 nt, Leptospira interrogans serovar lai str. 56601
caaacaacaaaaaaua

SEQ ID NO: 2796223 - RNA, 17 nt, Leptospira interrogans serovar lai str. 56601
caaacaacaaaaaauau

SEQ ID NO: 2796224 - RNA, 13 nt, Leptospira interrogans serovar lai str. 56601
caaacacaugagc

SEQ ID NO: 2796225 - RNA, 18 nt, Leptospira interrogans serovar lai str. 56601
caaacacuaaguaaaaau

SEQ ID NO: 2796226 - RNA, 19 nt, Leptospira interrogans serovar lai str. 56601
caaacacuaaguaaaaaug

SEQ ID NO: 2796227 - RNA, 21 nt, Leptospira interrogans serovar lai str. 56601
caaacacuaaguaaaaaugca

SEQ ID NO: 2796228 - RNA, 17 nt, Leptospira interrogans serovar lai str. 56601
caaacacuaauaaaaau

SEQ ID NO: 2796229 - RNA, 18 nt, Leptospira interrogans serovar lai str. 56601
caaacacuaauaaaaaug

SEQ ID NO: 2796230 - RNA, 18 nt, Leptospira interrogans serovar lai str. 56601
caaacaggaaaauuuaaa

SEQ ID NO: 2796231 - RNA, 19 nt, Leptospira interrogans serovar lai str. 56601
caaacaggaaaauuuaaau

SEQ ID NO: 2796232 - RNA, 18 nt, Leptospira interrogans serovar lai str. 56601
caaacccaaugauucuaa

SEQ ID NO: 2796233 - RNA, 16 nt, Leptospira interrogans serovar lai str. 56601
caaaccucguacuaau

SEQ ID NO: 2796234 - RNA, 19 nt, Leptospira interrogans serovar lai str. 56601
caaacgguuuuaguaaaau

SEQ ID NO: 2796235 - RNA, 21 nt, Leptospira interrogans serovar lai str. 56601
caaacuaggucgcauuuagca

SEQ ID NO: 2796236 - RNA, 19 nt, Leptospira interrogans serovar lai str. 56601
caaacuauacuuguuucua

SEQ ID NO: 2796237 - RNA, 23 nt, Leptospira interrogans serovar lai str. 56601
caaacuauucuauuaguuuuuau

SEQ ID NO: 2796238 - RNA, 18 nt, Leptospira interrogans serovar lai str. 56601
caaacucuuaaucugcug

SEQ ID NO: 2796239 - RNA, 19 nt, Leptospira interrogans serovar lai str. 56601
caaacucuuuuucuucugc

SEQ ID NO: 2796240 - RNA, 23 nt, Leptospira interrogans serovar lai str. 56601
caaacucuuuuucuucugcugca

SEQ ID NO: 2796241 - RNA, 20 nt, Leptospira interrogans serovar lai str. 56601
caaacuuagguuuuguaaua

SEQ ID NO: 2796242 - RNA, 15 nt, Leptospira interrogans serovar lai str. 56601
caaacuuuuagauaa

SEQ ID NO: 2796243 - RNA, 17 nt, Leptospira interrogans serovar lai str. 56601
caaacuuuuaucgaaug

SEQ ID NO: 2796244 - RNA, 15 nt, Leptospira interrogans serovar lai str. 56601
caaacuuuuguaaua

SEQ ID NO: 2796245 - RNA, 21 nt, Leptospira interrogans serovar lai str. 56601
caaacuuuuguaauaaaaauu

SEQ ID NO: 2796246 - RNA, 17 nt, Leptospira interrogans serovar lai str. 56601
caaacuuuuuauaaaaa

SEQ ID NO: 2796247 - RNA, 19 nt, Leptospira interrogans serovar lai str. 56601
caaacuuuuuauaaaaagc

SEQ ID NO: 2796248 - RNA, 22 nt, Leptospira interrogans serovar lai str. 56601
caaagaaacguuauacaauauu

SEQ ID NO: 2796249 - RNA, 18 nt, Leptospira interrogans serovar lai str. 56601
caaagaaauuuuacucga

SEQ ID NO: 2796250 - RNA, 15 nt, Leptospira interrogans serovar lai str. 56601
caaagaauaccaaaa

SEQ ID NO: 2796251 - RNA, 15 nt, Leptospira interrogans serovar lai str. 56601
caaagaauauaaaau

SEQ ID NO: 2796252 - RNA, 13 nt, Leptospira interrogans serovar lai str. 56601
caaagaaucauuu

SEQ ID NO: 2796253 - RNA, 19 nt, Leptospira interrogans serovar lai str. 56601
caaagaauuucggcuugau

SEQ ID NO: 2796254 - RNA, 14 nt, Leptospira interrogans serovar lai str. 56601
caaagaguuguuua

SEQ ID NO: 2796255 - RNA, 16 nt, Leptospira interrogans serovar lai str. 56601
caaagaguuguuuauc

SEQ ID NO: 2796256 - RNA, 17 nt, Leptospira interrogans serovar lai str. 56601
caaagaguuuaaaaaau

SEQ ID NO: 2796257 - RNA, 20 nt, Leptospira interrogans serovar lai str. 56601
caaagaguuuaaaaaauccg

SEQ ID NO: 2796258 - RNA, 15 nt, Leptospira interrogans serovar lai str. 56601
caaagauaaaaaaga

SEQ ID NO: 2796259 - RNA, 19 nt, Leptospira interrogans serovar lai str. 56601
caaagauaaaaaagaaagc

SEQ ID NO: 2796260 - RNA, 16 nt, Leptospira interrogans serovar lai str. 56601
caaagauaaaauauag

SEQ ID NO: 2796261 - RNA, 21 nt, Leptospira interrogans serovar lai str. 56601
caaagauauuucaauauaaaa

SEQ ID NO: 2796262 - RNA, 14 nt, Leptospira interrogans serovar lai str. 56601
caaagauuuuaaaa

SEQ ID NO: 2796263 - RNA, 16 nt, Leptospira interrogans serovar lai str. 56601
caaagauuuuaaaaau

SEQ ID NO: 2796264 - RNA, 18 nt, Leptospira interrogans serovar lai str. 56601
caaagccgcacaaaccaa

SEQ ID NO: 2796265 - RNA, 22 nt, Leptospira interrogans serovar lai str. 56601
caaagccggauucgcucaaauu

SEQ ID NO: 2796266 - RNA, 17 nt, Leptospira interrogans serovar lai str. 56601
caaagccuuaaaucaau

SEQ ID NO: 2796267 - RNA, 13 nt, Leptospira interrogans serovar lai str. 56601
caaagcucagauu

SEQ ID NO: 2796268 - RNA, 16 nt, Leptospira interrogans serovar lai str. 56601
caaaguaaguucaaau

SEQ ID NO: 2796269 - RNA, 17 nt, Leptospira interrogans serovar lai str. 56601
caaaguaaguucaaauu

SEQ ID NO: 2796270 - RNA, 13 nt, Leptospira interrogans serovar lai str. 56601
caaaguaugauuu

SEQ ID NO: 2796271 - RNA, 19 nt, Leptospira interrogans serovar lai str. 56601
caaaguauuuaauuuuaag

SEQ ID NO: 2796272 - RNA, 22 nt, Leptospira interrogans serovar lai str. 56601
caaagucaaaggagaaggauaa

SEQ ID NO: 2796273 - RNA, 22 nt, Leptospira interrogans serovar lai str. 56601
caaagucuugaacuuucuuauc

SEQ ID NO: 2796274 - RNA, 14 nt, Leptospira interrogans serovar lai str. 56601
caacaucacgcaca

SEQ ID NO: 2796275 - RNA, 12 nt, Leptospira interrogans serovar lai str. 56601
caacauccuuca

SEQ ID NO: 2796276 - RNA, 21 nt, Leptospira interrogans serovar lai str. 56601
caacaucucaaucaaaauuuu

SEQ ID NO: 2796277 - RNA, 16 nt, Leptospira interrogans serovar lai str. 56601
caacauugaguuugag

SEQ ID NO: 2796278 - RNA, 19 nt, Leptospira interrogans serovar lai str. 56601
caaccagagcauauaauua

SEQ ID NO: 2796279 - RNA, 21 nt, Leptospira interrogans serovar lai str. 56601
caaccagagccguaaauauuu

SEQ ID NO: 2796280 - RNA, 13 nt, Leptospira interrogans serovar lai str. 56601
caacccaaacaca

SEQ ID NO: 2796281 - RNA, 24 nt, Leptospira interrogans serovar lai str. 56601
caacccaaacacaugagcauucuu

SEQ ID NO: 2796282 - RNA, 18 nt, Leptospira interrogans serovar lai str. 56601
caaccccacaaguuaaua

SEQ ID NO: 2796283 - RNA, 18 nt, Leptospira interrogans serovar lai str. 56601
caacccccguuauuaaaa

SEQ ID NO: 2796284 - RNA, 16 nt, Leptospira interrogans serovar lai str. 56601
caaccgcaccaucuaa

SEQ ID NO: 2796285 - RNA, 23 nt, Leptospira interrogans serovar lai str. 56601
caacgaaaauagauagagaauua

SEQ ID NO: 2796286 - RNA, 12 nt, Leptospira interrogans serovar lai str. 56601
caacgaaaucaa

SEQ ID NO: 2796287 - RNA, 18 nt, Leptospira interrogans serovar lai str. 56601
caacgauuucuguagaaa

SEQ ID NO: 2796288 - RNA, 18 nt, Leptospira interrogans serovar lai str. 56601
caacgcgauccauagagu

SEQ ID NO: 2796289 - RNA, 14 nt, Leptospira interrogans serovar lai str. 56601
caacggauuccucc

SEQ ID NO: 2796290 - RNA, 16 nt, Leptospira interrogans serovar lai str. 56601
caacggauuccuccag

SEQ ID NO: 2796291 - RNA, 18 nt, Leptospira interrogans serovar lai str. 56601
caacggauuccuccagug

SEQ ID NO: 2796292 - RNA, 18 nt, Leptospira interrogans serovar lai str. 56601
caacgguaacgagcaucu

SEQ ID NO: 2796293 - RNA, 21 nt, Leptospira interrogans serovar lai str. 56601
caacgguaacgagcaucuuua

SEQ ID NO: 2796294 - RNA, 13 nt, Leptospira interrogans serovar lai str. 56601
caacguaaauaaa

SEQ ID NO: 2796295 - RNA, 13 nt, Leptospira interrogans serovar lai str. 56601
caacguaagaaaa

SEQ ID NO: 2796296 - RNA, 17 nt, Leptospira interrogans serovar lai str. 56601
caacgucccuauuguau

SEQ ID NO: 2796297 - RNA, 13 nt, Leptospira interrogans serovar lai str. 56601
caacguuacuuuu

SEQ ID NO: 2796298 - RNA, 17 nt, Leptospira interrogans serovar lai str. 56601
caacguucaaacaacaa

SEQ ID NO: 2796299 - RNA, 20 nt, Leptospira interrogans serovar lai str. 56601
caacuaaauccuucuuuucu

SEQ ID NO: 2796300 - RNA, 15 nt, Leptospira interrogans serovar lai str. 56601
caacuauaauuuccg

SEQ ID NO: 2796301 - RNA, 13 nt, Leptospira interrogans serovar lai str. 56601
caacucagaugaa

SEQ ID NO: 2796302 - RNA, 17 nt, Leptospira interrogans serovar lai str. 56601
caacucuaauacaaaaa

SEQ ID NO: 2796303 - RNA, 17 nt, Leptospira interrogans serovar lai str. 56601
caacucuauuacuaaac

SEQ ID NO: 2796304 - RNA, 22 nt, Leptospira interrogans serovar lai str. 56601
caacucuauucauaaaugauaa

SEQ ID NO: 2796305 - RNA, 20 nt, Leptospira interrogans serovar lai str. 56601
caacucuauuuuauuuuucu

SEQ ID NO: 2796306 - RNA, 14 nt, Leptospira interrogans serovar lai str. 56601
caacucuucuucua

SEQ ID NO: 2796307 - RNA, 17 nt, Leptospira interrogans serovar lai str. 56601
caacucuucuucuagau

SEQ ID NO: 2796308 - RNA, 14 nt, Leptospira interrogans serovar lai str. 56601
caacuguuuauaua

SEQ ID NO: 2796309 - RNA, 13 nt, Leptospira interrogans serovar lai str. 56601
caacuuaaaacug

SEQ ID NO: 2796310 - RNA, 17 nt, Leptospira interrogans serovar lai str. 56601
caacuuaaggaaauuca

SEQ ID NO: 2796311 - RNA, 21 nt, Leptospira interrogans serovar lai str. 56601
caacuuagaacuugucccaaa

SEQ ID NO: 2796312 - RNA, 21 nt, Leptospira interrogans serovar lai str. 56601
caacuuauaauuuucuuaaua

SEQ ID NO: 2796313 - RNA, 20 nt, Leptospira interrogans serovar lai str. 56601
caacuuuagaaaaauauuau

SEQ ID NO: 2796314 - RNA, 13 nt, Leptospira interrogans serovar lai str. 56601
caacuuuccuuuu

SEQ ID NO: 2796315 - RNA, 20 nt, Leptospira interrogans serovar lai str. 56601
caacuuucgcauuuguugua

SEQ ID NO: 2796316 - RNA, 16 nt, Leptospira interrogans serovar lai str. 56601
caacuuugucguuuuc

SEQ ID NO: 2796317 - RNA, 14 nt, Leptospira interrogans serovar lai str. 56601
caacuuuuccagaa

SEQ ID NO: 2796318 - RNA, 17 nt, Leptospira interrogans serovar lai str. 56601
caacuuuuucagaaaaa

SEQ ID NO: 2796319 - RNA, 18 nt, Leptospira interrogans serovar lai str. 56601
caacuuuuugaagaaaca

SEQ ID NO: 2796320 - RNA, 18 nt, Leptospira interrogans serovar lai str. 56601
caagaacuggauucaaaa

SEQ ID NO: 2796321 - RNA, 19 nt, Leptospira interrogans serovar lai str. 56601
caagaacuggauucaaaau

SEQ ID NO: 2796322 - RNA, 15 nt, Leptospira interrogans serovar lai str. 56601
caagaagaaaagaau

SEQ ID NO: 2796323 - RNA, 17 nt, Leptospira interrogans serovar lai str. 56601
caagaaugaaaaaacua

SEQ ID NO: 2796324 - RNA, 20 nt, Leptospira interrogans serovar lai str. 56601
caagaaugagucuuuuuacu

SEQ ID NO: 2796325 - RNA, 18 nt, Leptospira interrogans serovar lai str. 56601
caagacgucuacagauaa

SEQ ID NO: 2796326 - RNA, 18 nt, Leptospira interrogans serovar lai str. 56601
caagacuucuauacucuu

SEQ ID NO: 2796327 - RNA, 17 nt, Leptospira interrogans serovar lai str. 56601
caagaggaacaauuugu

SEQ ID NO: 2796328 - RNA, 18 nt, Leptospira interrogans serovar lai str. 56601
caagaggaacaauuugua

SEQ ID NO: 2796329 - RNA, 16 nt, Leptospira interrogans serovar lai str. 56601
caagagugguuuucaa

SEQ ID NO: 2796330 - RNA, 18 nt, Leptospira interrogans serovar lai str. 56601
caagagugguuuucaaau

SEQ ID NO: 2796331 - RNA, 14 nt, Leptospira interrogans serovar lai str. 56601
caagauuaacaauc

SEQ ID NO: 2796332 - RNA, 21 nt, Leptospira interrogans serovar lai str. 56601
caagauucauuucguaaaauc

SEQ ID NO: 2796333 - RNA, 22 nt, Leptospira interrogans serovar lai str. 56601
caagauucauuucguaaaaucc

SEQ ID NO: 2796334 - RNA, 17 nt, Leptospira interrogans serovar lai str. 56601
caagauugucuuuauuc

SEQ ID NO: 2796335 - RNA, 20 nt, Leptospira interrogans serovar lai str. 56601
caagauuucguucggaaaaa

SEQ ID NO: 2796336 - RNA, 23 nt, Leptospira interrogans serovar lai str. 56601
caagauuucguucggaaaaaaua

SEQ ID NO: 2796337 - RNA, 16 nt, Leptospira interrogans serovar lai str. 56601
caagcacauccgcauu

SEQ ID NO: 2796338 - RNA, 20 nt, Leptospira interrogans serovar lai str. 56601
caagcuccuccaaccagagc

SEQ ID NO: 2796339 - RNA, 16 nt, Leptospira interrogans serovar lai str. 56601
caagcucuuuaagagu

SEQ ID NO: 2796340 - RNA, 16 nt, Leptospira interrogans serovar lai str. 56601
caagcuuccuuuuuua

SEQ ID NO: 2796341 - RNA, 18 nt, Leptospira interrogans serovar lai str. 56601
caagcuuuggauuuugau

SEQ ID NO: 2796342 - RNA, 20 nt, Leptospira interrogans serovar lai str. 56601
caaggcuuuguaauaaaaau

SEQ ID NO: 2796343 - RNA, 22 nt, Leptospira interrogans serovar lai str. 56601
caagggaagguuuuguaaaaau

SEQ ID NO: 2796344 - RNA, 22 nt, Leptospira interrogans serovar lai str. 56601
caagggcggcuuuuuuuacuuc

SEQ ID NO: 2796345 - RNA, 22 nt, Leptospira interrogans serovar lai str. 56601
caagguuucacuuuuuuaaagu

SEQ ID NO: 2796346 - RNA, 21 nt, Leptospira interrogans serovar lai str. 56601
caaguaaagaacgauuuuuua

SEQ ID NO: 2796347 - RNA, 16 nt, Leptospira interrogans serovar lai str. 56601
caaguaaaucugagga

SEQ ID NO: 2796348 - RNA, 20 nt, Leptospira interrogans serovar lai str. 56601
caaguaacgaguagaauucu

SEQ ID NO: 2796349 - RNA, 22 nt, Leptospira interrogans serovar lai str. 56601
caaguaacgaguagaauucuca

SEQ ID NO: 2796350 - RNA, 13 nt, Leptospira interrogans serovar lai str. 56601
caaguaauacuua

SEQ ID NO: 2796351 - RNA, 18 nt, Leptospira interrogans serovar lai str. 56601
caaguagagagugaaaaa

SEQ ID NO: 2796352 - RNA, 18 nt, Leptospira interrogans serovar lai str. 56601
caaguaggaauuggagga

SEQ ID NO: 2796353 - RNA, 17 nt, Leptospira interrogans serovar lai str. 56601
caagugcaguaguuccu

SEQ ID NO: 2796354 - RNA, 21 nt, Leptospira interrogans serovar lai str. 56601
caaguguuccgacaagaauga

SEQ ID NO: 2796355 - RNA, 22 nt, Leptospira interrogans serovar lai str. 56601
caaguuaagaguuuguuccaaa

SEQ ID NO: 2796356 - RNA, 17 nt, Leptospira interrogans serovar lai str. 56601
caaguuaauagaguugu

SEQ ID NO: 2796357 - RNA, 16 nt, Leptospira interrogans serovar lai str. 56601
caauuauaaaauuuuu

SEQ ID NO: 2796358 - RNA, 14 nt, Leptospira interrogans serovar lai str. 56601
caauuauauuaaau

SEQ ID NO: 2796359 - RNA, 21 nt, Leptospira interrogans serovar lai str. 56601
caauuauuuuaggauuuuugg

SEQ ID NO: 2796360 - RNA, 16 nt, Leptospira interrogans serovar lai str. 56601
caauucaguaaauuau

SEQ ID NO: 2796361 - RNA, 19 nt, Leptospira interrogans serovar lai str. 56601
caauucaguaaauuaugga

SEQ ID NO: 2796362 - RNA, 22 nt, Leptospira interrogans serovar lai str. 56601
caauuccaccuuggaaagaaaa

SEQ ID NO: 2796363 - RNA, 17 nt, Leptospira interrogans serovar lai str. 56601
caauuccacuaugaaag

SEQ ID NO: 2796364 - RNA, 15 nt, Leptospira interrogans serovar lai str. 56601
caauuccauuucugu

SEQ ID NO: 2796365 - RNA, 19 nt, Leptospira interrogans serovar lai str. 56601
caauucccauuaaagucca

SEQ ID NO: 2796366 - RNA, 17 nt, Leptospira interrogans serovar lai str. 56601
caauuccuaaaugccgc

SEQ ID NO: 2796367 - RNA, 20 nt, Leptospira interrogans serovar lai str. 56601
caauuccuguaguauuucca

SEQ ID NO: 2796368 - RNA, 19 nt, Leptospira interrogans serovar lai str. 56601
caauuccuucggaauuucu

SEQ ID NO: 2796369 - RNA, 15 nt, Leptospira interrogans serovar lai str. 56601
caauucuaagaccua

SEQ ID NO: 2796370 - RNA, 20 nt, Leptospira interrogans serovar lai str. 56601
caauucuaagaccuaaaccc

SEQ ID NO: 2796371 - RNA, 22 nt, Leptospira interrogans serovar lai str. 56601
caauucuaagaccuaaacccug

SEQ ID NO: 2796372 - RNA, 14 nt, Leptospira interrogans serovar lai str. 56601
caauucuaauuuuu

SEQ ID NO: 2796373 - RNA, 23 nt, Leptospira interrogans serovar lai str. 56601
caauucuauuagaauaguaguuu

SEQ ID NO: 2796374 - RNA, 22 nt, Leptospira interrogans serovar lai str. 56601
caauucuauugugggaacuacu

SEQ ID NO: 2796375 - RNA, 18 nt, Leptospira interrogans serovar lai str. 56601
caauucugaaaauguaaa

SEQ ID NO: 2796376 - RNA, 18 nt, Leptospira interrogans serovar lai str. 56601
caauucuuccuuuuucau

SEQ ID NO: 2796377 - RNA, 16 nt, Leptospira interrogans serovar lai str. 56601
caauucuuuaaaugug

SEQ ID NO: 2796378 - RNA, 23 nt, Leptospira interrogans serovar lai str. 56601
caauugaagcaguuuuguuaauc

SEQ ID NO: 2796379 - RNA, 16 nt, Leptospira interrogans serovar lai str. 56601
caauugaauauaaaau

SEQ ID NO: 2796380 - RNA, 22 nt, Leptospira interrogans serovar lai str. 56601
caauugaauauaaaauuuuuau

SEQ ID NO: 2796381 - RNA, 14 nt, Leptospira interrogans serovar lai str. 56601
caauugacuuucug

SEQ ID NO: 2796382 - RNA, 22 nt, Leptospira interrogans serovar lai str. 56601
caauugauugcuuuuugagaga

SEQ ID NO: 2796383 - RNA, 14 nt, Leptospira interrogans serovar lai str. 56601
caauugauuuaaaa

SEQ ID NO: 2796384 - RNA, 17 nt, Leptospira interrogans serovar lai str. 56601
caauugauuuaaaaacc

SEQ ID NO: 2796385 - RNA, 15 nt, Leptospira interrogans serovar lai str. 56601
caauuguccauuuca

SEQ ID NO: 2796386 - RNA, 16 nt, Leptospira interrogans serovar lai str. 56601
caauuguccauuucca

SEQ ID NO: 2796387 - RNA, 16 nt, Leptospira interrogans serovar lai str. 56601
caauuuacgaacuuuc

SEQ ID NO: 2796388 - RNA, 10 nt, Leptospira interrogans serovar lai str. 56601
caauuuagaa

SEQ ID NO: 2796389 - RNA, 18 nt, Leptospira interrogans serovar lai str. 56601
caauuuagaauaaagaga

SEQ ID NO: 2796390 - RNA, 14 nt, Leptospira interrogans serovar lai str. 56601
caauuuauaaacgg

SEQ ID NO: 2796391 - RNA, 14 nt, Leptospira interrogans serovar lai str. 56601
caauuuauaaaguu

SEQ ID NO: 2796392 - RNA, 19 nt, Leptospira interrogans serovar lai str. 56601
caauuuauaaaguuuaacu

SEQ ID NO: 2796393 - RNA, 19 nt, Leptospira interrogans serovar lai str. 56601
caauuuaucuaaaacacau

SEQ ID NO: 2796394 - RNA, 18 nt, Leptospira interrogans serovar lai str. 56601
caauuuauugaccagagc

SEQ ID NO: 2796395 - RNA, 20 nt, Leptospira interrogans serovar lai str. 56601
caauuucagaaacauuggaa

SEQ ID NO: 2796396 - RNA, 14 nt, Leptospira interrogans serovar lai str. 56601
caauuucuucuuuu

SEQ ID NO: 2796397 - RNA, 16 nt, Leptospira interrogans serovar lai str. 56601
caauuugugaacuuuc

SEQ ID NO: 2796398 - RNA, 19 nt, Leptospira interrogans serovar lai str. 56601
caauuuguuccuaaaaaau

SEQ ID NO: 2796399 - RNA, 16 nt, Leptospira interrogans serovar lai str. 56601
caauuuuaagaacaau

SEQ ID NO: 2796400 - RNA, 14 nt, Leptospira interrogans serovar lai str. 56601
caauuuuauuucua

SEQ ID NO: 2796401 - RNA, 14 nt, Leptospira interrogans serovar lai str. 56601
caauuuuccagauc

SEQ ID NO: 2796402 - RNA, 17 nt, Leptospira interrogans serovar lai str. 56601
caauuuucucaaaaaau

SEQ ID NO: 2796403 - RNA, 21 nt, Leptospira interrogans serovar lai str. 56601
caauuuugagaccuuaaguuu

SEQ ID NO: 2796404 - RNA, 13 nt, Leptospira interrogans serovar lai str. 56601
caauuuuuauaaa

SEQ ID NO: 2796405 - RNA, 21 nt, Leptospira interrogans serovar lai str. 56601
caauuuuucugaaaaguuuau

SEQ ID NO: 2796406 - RNA, 17 nt, Leptospira interrogans serovar lai str. 56601
caauuuuuugaaaaaga

SEQ ID NO: 2796407 - RNA, 11 nt, Leptospira interrogans serovar lai str. 56601
cacaaaaaaau

SEQ ID NO: 2796408 - RNA, 14 nt, Leptospira interrogans serovar lai str. 56601
cacaaaaacaaauu

SEQ ID NO: 2796409 - RNA, 14 nt, Leptospira interrogans serovar lai str. 56601
cacaaaacgaucau

SEQ ID NO: 2796410 - RNA, 13 nt, Leptospira interrogans serovar lai str. 56601
cacaaaggcaccg

SEQ ID NO: 2796411 - RNA, 13 nt, Leptospira interrogans serovar lai str. 56601
cacaaauauuaag

SEQ ID NO: 2796412 - RNA, 13 nt, Leptospira interrogans serovar lai str. 56601
cacaaaucuaaau

SEQ ID NO: 2796413 - RNA, 13 nt, Leptospira interrogans serovar lai str. 56601
cacaaauuccaau

SEQ ID NO: 2796414 - RNA, 20 nt, Leptospira interrogans serovar lai str. 56601
cacaaauuccaauuuuucug

SEQ ID NO: 2796415 - RNA, 14 nt, Leptospira interrogans serovar lai str. 56601
cacaaauucuaaag

SEQ ID NO: 2796416 - RNA, 15 nt, Leptospira interrogans serovar lai str. 56601
cacaacauuaugaau

SEQ ID NO: 2796417 - RNA, 21 nt, Leptospira interrogans serovar lai str. 56601
cacaacgcucucuccuauguu

SEQ ID NO: 2796418 - RNA, 20 nt, Leptospira interrogans serovar lai str. 56601
cacaacggcucucuccuaug

SEQ ID NO: 2796419 - RNA, 22 nt, Leptospira interrogans serovar lai str. 56601
cacaacggcucucuccuauguu

SEQ ID NO: 2796420 - RNA, 13 nt, Leptospira interrogans serovar lai str. 56601
cacaagacaaaca

SEQ ID NO: 2796421 - RNA, 21 nt, Leptospira interrogans serovar lai str. 56601
cacaagacaaacaaacaugca

SEQ ID NO: 2796422 - RNA, 14 nt, Leptospira interrogans serovar lai str. 56601
cacaagcuuccuuu

SEQ ID NO: 2796423 - RNA, 15 nt, Leptospira interrogans serovar lai str. 56601
cacaagcuuccuuuu

SEQ ID NO: 2796424 - RNA, 18 nt, Leptospira interrogans serovar lai str. 56601
cacaaucgucaucucgaa

SEQ ID NO: 2796425 - RNA, 15 nt, Leptospira interrogans serovar lai str. 56601
cacaauuuacaacca

SEQ ID NO: 2796426 - RNA, 16 nt, Leptospira interrogans serovar lai str. 56601
cacaauuuuuuuagaa

SEQ ID NO: 2796427 - RNA, 22 nt, Leptospira interrogans serovar lai str. 56601
cacacauuccgcaaaaauuccu

SEQ ID NO: 2796428 - RNA, 22 nt, Leptospira interrogans serovar lai str. 56601
cacacccuugaccucauaucaa

SEQ ID NO: 2796429 - RNA, 22 nt, Leptospira interrogans serovar lai str. 56601
cacacguugaauaagauuuuag

SEQ ID NO: 2796430 - RNA, 13 nt, Leptospira interrogans serovar lai str. 56601
cacacuuuauaaa

SEQ ID NO: 2796431 - RNA, 14 nt, Leptospira interrogans serovar lai str. 56601
cacagacuucuuuu

SEQ ID NO: 2796432 - RNA, 21 nt, Leptospira interrogans serovar lai str. 56601
cacagaguacauacugacaga

SEQ ID NO: 2796433 - RNA, 17 nt, Leptospira interrogans serovar lai str. 56601
cacaguuccuaaaauua

SEQ ID NO: 2796434 - RNA, 20 nt, Leptospira interrogans serovar lai str. 56601
cacauaaaagaccuucggau

SEQ ID NO: 2796435 - RNA, 14 nt, Leptospira interrogans serovar lai str. 56601
cacauaaaguuaau

SEQ ID NO: 2796436 - RNA, 19 nt, Leptospira interrogans serovar lai str. 56601
cacauaaaguuaauacaaa

SEQ ID NO: 2796437 - RNA, 13 nt, Leptospira interrogans serovar lai str. 56601
cacauccaaccca

SEQ ID NO: 2796438 - RNA, 19 nt, Leptospira interrogans serovar lai str. 56601
cacauccaacccaaacaca

SEQ ID NO: 2796439 - RNA, 17 nt, Leptospira interrogans serovar lai str. 56601
cacaucguaucuugaau

SEQ ID NO: 2796440 - RNA, 17 nt, Leptospira interrogans serovar lai str. 56601
cagaaauauauucuuuu

SEQ ID NO: 2796441 - RNA, 12 nt, Leptospira interrogans serovar lai str. 56601
cagaacaaaacg

SEQ ID NO: 2796442 - RNA, 20 nt, Leptospira interrogans serovar lai str. 56601
cagaaccucaaagaaauuuu

SEQ ID NO: 2796443 - RNA, 21 nt, Leptospira interrogans serovar lai str. 56601
cagaacgggcuuucuauggau

SEQ ID NO: 2796444 - RNA, 14 nt, Leptospira interrogans serovar lai str. 56601
cagaacuauuaucu

SEQ ID NO: 2796445 - RNA, 15 nt, Leptospira interrogans serovar lai str. 56601
cagaagcuuuauuaa

SEQ ID NO: 2796446 - RNA, 16 nt, Leptospira interrogans serovar lai str. 56601
cagaagggagaauauc

SEQ ID NO: 2796447 - RNA, 23 nt, Leptospira interrogans serovar lai str. 56601
cagaagggagaauaucuacuuua

SEQ ID NO: 2796448 - RNA, 11 nt, Leptospira interrogans serovar lai str. 56601
cagaauaaagu

SEQ ID NO: 2796449 - RNA, 13 nt, Leptospira interrogans serovar lai str. 56601
cagaauaaaguac

SEQ ID NO: 2796450 - RNA, 13 nt, Leptospira interrogans serovar lai str. 56601
cagaauaaauaca

SEQ ID NO: 2796451 - RNA, 12 nt, Leptospira interrogans serovar lai str. 56601
cagaaucaaagg

SEQ ID NO: 2796452 - RNA, 22 nt, Leptospira interrogans serovar lai str. 56601
cagaaucaaaggaaauaaaaau

SEQ ID NO: 2796453 - RNA, 23 nt, Leptospira interrogans serovar lai str. 56601
cagaaucaaaggaaauaaaaaua

SEQ ID NO: 2796454 - RNA, 15 nt, Leptospira interrogans serovar lai str. 56601
cagaaugaacucaac

SEQ ID NO: 2796455 - RNA, 18 nt, Leptospira interrogans serovar lai str. 56601
cagaaugucuuagaauuu

SEQ ID NO: 2796456 - RNA, 16 nt, Leptospira interrogans serovar lai str. 56601
cagaauguuuucuaca

SEQ ID NO: 2796457 - RNA, 14 nt, Leptospira interrogans serovar lai str. 56601
cagaauuaaaaauu

SEQ ID NO: 2796458 - RNA, 23 nt, Leptospira interrogans serovar lai str. 56601
cagaauuagauuaaauuuuuaua

SEQ ID NO: 2796459 - RNA, 14 nt, Leptospira interrogans serovar lai str. 56601
cagaauuuugaaca

SEQ ID NO: 2796460 - RNA, 15 nt, Leptospira interrogans serovar lai str. 56601
cagaauuuuuuaaca

SEQ ID NO: 2796461 - RNA, 16 nt, Leptospira interrogans serovar lai str. 56601
cagaauuuuuuaacaa

SEQ ID NO: 2796462 - RNA, 21 nt, Leptospira interrogans serovar lai str. 56601
cagacaauccuauaucaacaa

SEQ ID NO: 2796463 - RNA, 15 nt, Leptospira interrogans serovar lai str. 56601
cagacguauuuuuaa

SEQ ID NO: 2796464 - RNA, 12 nt, Leptospira interrogans serovar lai str. 56601
cagacugauucu

SEQ ID NO: 2796465 - RNA, 18 nt, Leptospira interrogans serovar lai str. 56601
cagacugauuuuuuaaau

SEQ ID NO: 2796466 - RNA, 14 nt, Leptospira interrogans serovar lai str. 56601
cagagagcgaccau

SEQ ID NO: 2796467 - RNA, 14 nt, Leptospira interrogans serovar lai str. 56601
cagagaucauuaau

SEQ ID NO: 2796468 - RNA, 13 nt, Leptospira interrogans serovar lai str. 56601
cagagauuccgau

SEQ ID NO: 2796469 - RNA, 17 nt, Leptospira interrogans serovar lai str. 56601
cagagauuccgauucuc

SEQ ID NO: 2796470 - RNA, 23 nt, Leptospira interrogans serovar lai str. 56601
cagagauuguccuccagaaccuc

SEQ ID NO: 2796471 - RNA, 19 nt, Leptospira interrogans serovar lai str. 56601
cagagcaucauacaguaaa

SEQ ID NO: 2796472 - RNA, 19 nt, Leptospira interrogans serovar lai str. 56601
cagagcgauauaauaaaau

SEQ ID NO: 2796473 - RNA, 20 nt, Leptospira interrogans serovar lai str. 56601
cagagcgauauaauaaaauc

SEQ ID NO: 2796474 - RNA, 17 nt, Leptospira interrogans serovar lai str. 56601
cagagcuuuacaauaaa

SEQ ID NO: 2796475 - RNA, 16 nt, Leptospira interrogans serovar lai str. 56601
cagagucuauaaaaua

SEQ ID NO: 2796476 - RNA, 22 nt, Leptospira interrogans serovar lai str. 56601
cagauaaaaauaguauccaaaa

SEQ ID NO: 2796477 - RNA, 23 nt, Leptospira interrogans serovar lai str. 56601
cagauacucaauuugauaugaau

SEQ ID NO: 2796478 - RNA, 17 nt, Leptospira interrogans serovar lai str. 56601
cagauaugacaauuucu

SEQ ID NO: 2796479 - RNA, 13 nt, Leptospira interrogans serovar lai str. 56601
cagaucaagaauu

SEQ ID NO: 2796480 - RNA, 15 nt, Leptospira interrogans serovar lai str. 56601
cagaucaauucuuaa

SEQ ID NO: 2796481 - RNA, 12 nt, Leptospira interrogans serovar lai str. 56601
cagaugaaacua

SEQ ID NO: 2796482 - RNA, 20 nt, Leptospira interrogans serovar lai str. 56601
cagaugaauugaauuuuuua

SEQ ID NO: 2796483 - RNA, 23 nt, Leptospira interrogans serovar lai str. 56601
cagaugagcauuuuuuuaauaca

SEQ ID NO: 2796484 - RNA, 18 nt, Leptospira interrogans serovar lai str. 56601
cagauggagaauuaauuu

SEQ ID NO: 2796485 - RNA, 14 nt, Leptospira interrogans serovar lai str. 56601
cagauggagaauug

SEQ ID NO: 2796486 - RNA, 19 nt, Leptospira interrogans serovar lai str. 56601
cagauggagaauugauuuu

SEQ ID NO: 2796487 - RNA, 14 nt, Leptospira interrogans serovar lai str. 56601
cagauguuuuaaaa

SEQ ID NO: 2796488 - RNA, 22 nt, Leptospira interrogans serovar lai str. 56601
cagauucagucucauuucaaau

SEQ ID NO: 2796489 - RNA, 17 nt, Leptospira interrogans serovar lai str. 56601
cagauuuaauuuuucug

SEQ ID NO: 2796490 - RNA, 19 nt, Leptospira interrogans serovar lai str. 56601
cagauuuaauuuuucugau

SEQ ID NO: 2796491 - RNA, 21 nt, Leptospira interrogans serovar lai str. 56601
cagauuucagcuccaaaaaaa

SEQ ID NO: 2796492 - RNA, 16 nt, Leptospira interrogans serovar lai str. 56601
cagauuuuauuuugau

SEQ ID NO: 2796493 - RNA, 19 nt, Leptospira interrogans serovar lai str. 56601
cagauuuugcacaaaaccu

SEQ ID NO: 2796494 - RNA, 19 nt, Leptospira interrogans serovar lai str. 56601
cagcaaaacacuuuccuua

SEQ ID NO: 2796495 - RNA, 20 nt, Leptospira interrogans serovar lai str. 56601
cagcaaaacacuuuccuuaa

SEQ ID NO: 2796496 - RNA, 12 nt, Leptospira interrogans serovar lai str. 56601
cagcaaaaccuu

SEQ ID NO: 2796497 - RNA, 13 nt, Leptospira interrogans serovar lai str. 56601
cagcaaagaaggc

SEQ ID NO: 2796498 - RNA, 21 nt, Leptospira interrogans serovar lai str. 56601
cagcacuaaaagcuaauaauc

SEQ ID NO: 2796499 - RNA, 17 nt, Leptospira interrogans serovar lai str. 56601
cagcauaauaaucgcuu

SEQ ID NO: 2796500 - RNA, 20 nt, Leptospira interrogans serovar lai str. 56601
cagcaucgaauauccuugaa

SEQ ID NO: 2796501 - RNA, 15 nt, Leptospira interrogans serovar lai str. 56601
cagccaauuccaaac

SEQ ID NO: 2796502 - RNA, 17 nt, Leptospira interrogans serovar lai str. 56601
cagcccauucuuucccc

SEQ ID NO: 2796503 - RNA, 21 nt, Leptospira interrogans serovar lai str. 56601
cagccgaauuugcgaaaaaaa

SEQ ID NO: 2796504 - RNA, 22 nt, Leptospira interrogans serovar lai str. 56601
cagccugauaaauuccguaaaa

SEQ ID NO: 2796505 - RNA, 23 nt, Leptospira interrogans serovar lai str. 56601
cagcuaaaaagaaaguugcaaag

SEQ ID NO: 2796506 - RNA, 15 nt, Leptospira interrogans serovar lai str. 56601
cagcuagaaaaggaa

SEQ ID NO: 2796507 - RNA, 17 nt, Leptospira interrogans serovar lai str. 56601
cagcuccaaaaaaauaa

SEQ ID NO: 2796508 - RNA, 19 nt, Leptospira interrogans serovar lai str. 56601
cagcuccaaaaaaauaaau

SEQ ID NO: 2796509 - RNA, 18 nt, Leptospira interrogans serovar lai str. 56601
cagcucuggucaaguuau

SEQ ID NO: 2796510 - RNA, 14 nt, Leptospira interrogans serovar lai str. 56601
cagcucuuuugcuu

SEQ ID NO: 2796511 - RNA, 12 nt, Leptospira interrogans serovar lai str. 56601
cagcugaaacua

SEQ ID NO: 2796512 - RNA, 20 nt, Leptospira interrogans serovar lai str. 56601
cagcuuuuuuaaauuuuuau

SEQ ID NO: 2796513 - RNA, 15 nt, Leptospira interrogans serovar lai str. 56601
caggaaacauuauau

SEQ ID NO: 2796514 - RNA, 22 nt, Leptospira interrogans serovar lai str. 56601
caggacggauguaacaguaaga

SEQ ID NO: 2796515 - RNA, 20 nt, Leptospira interrogans serovar lai str. 56601
caggauagguuccaauucca

SEQ ID NO: 2796516 - RNA, 22 nt, Leptospira interrogans serovar lai str. 56601
caggaugaaucgaauaaaaaag

SEQ ID NO: 2796517 - RNA, 20 nt, Leptospira interrogans serovar lai str. 56601
cagggagugauacgcugagu

SEQ ID NO: 2796518 - RNA, 15 nt, Leptospira interrogans serovar lai str. 56601
cagggccggagaaaa

SEQ ID NO: 2796519 - RNA, 20 nt, Leptospira interrogans serovar lai str. 56601
caggggcuuugauuggauuc

SEQ ID NO: 2796520 - RNA, 20 nt, Leptospira interrogans serovar lai str. 56601
caggucccaaacuuucuuuu

SEQ ID NO: 2796521 - RNA, 17 nt, Leptospira interrogans serovar lai str. 56601
cagguugguauuuaaaa

SEQ ID NO: 2796522 - RNA, 18 nt, Leptospira interrogans serovar lai str. 56601
cagguuuuauaaagugaa

SEQ ID NO: 2796523 - RNA, 18 nt, Leptospira interrogans serovar lai str. 56601
cauaaguauuauuuuuau

SEQ ID NO: 2796524 - RNA, 20 nt, Leptospira interrogans serovar lai str. 56601
cauaaguguaugaaaaguca

SEQ ID NO: 2796525 - RNA, 19 nt, Leptospira interrogans serovar lai str. 56601
cauaaguuccuuaaaagua

SEQ ID NO: 2796526 - RNA, 23 nt, Leptospira interrogans serovar lai str. 56601
cauaaguuccuuaaaaguaucca

SEQ ID NO: 2796527 - RNA, 19 nt, Leptospira interrogans serovar lai str. 56601
cauaauaauacagaauuca

SEQ ID NO: 2796528 - RNA, 17 nt, Leptospira interrogans serovar lai str. 56601
cauaauccuaugaaaau

SEQ ID NO: 2796529 - RNA, 12 nt, Leptospira interrogans serovar lai str. 56601
cauaaugaagau

SEQ ID NO: 2796530 - RNA, 13 nt, Leptospira interrogans serovar lai str. 56601
cauacaaugaaaa

SEQ ID NO: 2796531 - RNA, 16 nt, Leptospira interrogans serovar lai str. 56601
cauaccgaacucacgu

SEQ ID NO: 2796532 - RNA, 21 nt, Leptospira interrogans serovar lai str. 56601
cauaccuguuuuaguucaaaa

SEQ ID NO: 2796533 - RNA, 16 nt, Leptospira interrogans serovar lai str. 56601
cauacuaaucuaugga

SEQ ID NO: 2796534 - RNA, 20 nt, Leptospira interrogans serovar lai str. 56601
cauacuuaauuucaaucuau

SEQ ID NO: 2796535 - RNA, 19 nt, Leptospira interrogans serovar lai str. 56601
cauacuuuagaaauuucua

SEQ ID NO: 2796536 - RNA, 13 nt, Leptospira interrogans serovar lai str. 56601
cauacuuuuaaaa

SEQ ID NO: 2796537 - RNA, 18 nt, Leptospira interrogans serovar lai str. 56601
cauacuuuuagaagauuu

SEQ ID NO: 2796538 - RNA, 22 nt, Leptospira interrogans serovar lai str. 56601
cauacuuuuagaagauuuuuac

SEQ ID NO: 2796539 - RNA, 17 nt, Leptospira interrogans serovar lai str. 56601
cauagaaccuaauguug

SEQ ID NO: 2796540 - RNA, 22 nt, Leptospira interrogans serovar lai str. 56601
cauagaagugaagcgcuugagu

SEQ ID NO: 2796541 - RNA, 19 nt, Leptospira interrogans serovar lai str. 56601
cauagagaacgcgaacuuu

SEQ ID NO: 2796542 - RNA, 18 nt, Leptospira interrogans serovar lai str. 56601
cauagauacauaaacugu

SEQ ID NO: 2796543 - RNA, 13 nt, Leptospira interrogans serovar lai str. 56601
cauagcaacaauu

SEQ ID NO: 2796544 - RNA, 16 nt, Leptospira interrogans serovar lai str. 56601
cauaggaaauucuuuu

SEQ ID NO: 2796545 - RNA, 17 nt, Leptospira interrogans serovar lai str. 56601
cauaggaaauucuuuuc

SEQ ID NO: 2796546 - RNA, 16 nt, Leptospira interrogans serovar lai str. 56601
cauaggauacaaaacu

SEQ ID NO: 2796547 - RNA, 14 nt, Leptospira interrogans serovar lai str. 56601
cauaggugauuaaa

SEQ ID NO: 2796548 - RNA, 13 nt, Leptospira interrogans serovar lai str. 56601
cauaguucaauua

SEQ ID NO: 2796549 - RNA, 16 nt, Leptospira interrogans serovar lai str. 56601
cauaguucccacaaau

SEQ ID NO: 2796550 - RNA, 23 nt, Leptospira interrogans serovar lai str. 56601
cauaguuucuaaguguaaaauua

SEQ ID NO: 2796551 - RNA, 22 nt, Leptospira interrogans serovar lai str. 56601
cauaguuuguuaucaauagaaa

SEQ ID NO: 2796552 - RNA, 22 nt, Leptospira interrogans serovar lai str. 56601
cauauacggauuucuauaaaau

SEQ ID NO: 2796553 - RNA, 16 nt, Leptospira interrogans serovar lai str. 56601
cauauacguaaaaaua

SEQ ID NO: 2796554 - RNA, 18 nt, Leptospira interrogans serovar lai str. 56601
cauauacguaaaaauaau

SEQ ID NO: 2796555 - RNA, 18 nt, Leptospira interrogans serovar lai str. 56601
cauauagaaauuauagua

SEQ ID NO: 2796556 - RNA, 21 nt, Leptospira interrogans serovar lai str. 56601
cauauaggacggugcaugcau

SEQ ID NO: 2796557 - RNA, 17 nt, Leptospira interrogans serovar lai str. 56601
cauauauaauuuauucu

SEQ ID NO: 2796558 - RNA, 14 nt, Leptospira interrogans serovar lai str. 56601
cauaucauauuguu

SEQ ID NO: 2796559 - RNA, 16 nt, Leptospira interrogans serovar lai str. 56601
cauaucauauuguuua

SEQ ID NO: 2796560 - RNA, 18 nt, Leptospira interrogans serovar lai str. 56601
cauauccaauuucaauuu

SEQ ID NO: 2796561 - RNA, 17 nt, Leptospira interrogans serovar lai str. 56601
cauauccgaaagauaaa

SEQ ID NO: 2796562 - RNA, 19 nt, Leptospira interrogans serovar lai str. 56601
cauauccgaaagauaaauc

SEQ ID NO: 2796563 - RNA, 13 nt, Leptospira interrogans serovar lai str. 56601
cauaucuacaaaa

SEQ ID NO: 2796564 - RNA, 20 nt, Leptospira interrogans serovar lai str. 56601
cauauuauuuguaguuucaa

SEQ ID NO: 2796565 - RNA, 16 nt, Leptospira interrogans serovar lai str. 56601
cauauugagauaaaaa

SEQ ID NO: 2796566 - RNA, 18 nt, Leptospira interrogans serovar lai str. 56601
cauauugagauaaaaagu

SEQ ID NO: 2796567 - RNA, 15 nt, Leptospira interrogans serovar lai str. 56601
cauauuuucaaaaaa

SEQ ID NO: 2796568 - RNA, 16 nt, Leptospira interrogans serovar lai str. 56601
cauauuuucaaaaaau

SEQ ID NO: 2796569 - RNA, 12 nt, Leptospira interrogans serovar lai str. 56601
caucaaaaacaa

SEQ ID NO: 2796570 - RNA, 16 nt, Leptospira interrogans serovar lai str. 56601
caucaaacggucuuuc

SEQ ID NO: 2796571 - RNA, 21 nt, Leptospira interrogans serovar lai str. 56601
caucaaauacaaaauuuuuuc

SEQ ID NO: 2796572 - RNA, 22 nt, Leptospira interrogans serovar lai str. 56601
caucaaauaccgcgaaauaaaa

SEQ ID NO: 2796573 - RNA, 21 nt, Leptospira interrogans serovar lai str. 56601
caucaaaucgcuguuuugugg

SEQ ID NO: 2796574 - RNA, 13 nt, Leptospira interrogans serovar lai str. 56601
caucaaauuugcu

SEQ ID NO: 2796575 - RNA, 19 nt, Leptospira interrogans serovar lai str. 56601
caucaaauuugcuucaaca

SEQ ID NO: 2796576 - RNA, 17 nt, Leptospira interrogans serovar lai str. 56601
caucaacucuguaaauu

SEQ ID NO: 2796577 - RNA, 19 nt, Leptospira interrogans serovar lai str. 56601
caucaacucuguaaauuca

SEQ ID NO: 2796578 - RNA, 12 nt, Leptospira interrogans serovar lai str. 56601
caucauaaaggu

SEQ ID NO: 2796579 - RNA, 14 nt, Leptospira interrogans serovar lai str. 56601
caucauaaaggugc

SEQ ID NO: 2796580 - RNA, 20 nt, Leptospira interrogans serovar lai str. 56601
caucauaaaggugcaugaaa

SEQ ID NO: 2796581 - RNA, 16 nt, Leptospira interrogans serovar lai str. 56601
caucauucugaaaaaa

SEQ ID NO: 2796582 - RNA, 19 nt, Leptospira interrogans serovar lai str. 56601
caucauucugaaaaaaguu

SEQ ID NO: 2796583 - RNA, 12 nt, Leptospira interrogans serovar lai str. 56601
caucauucuuua

SEQ ID NO: 2796584 - RNA, 21 nt, Leptospira interrogans serovar lai str. 56601
cauccaaacucuuaaucugcu

SEQ ID NO: 2796585 - RNA, 17 nt, Leptospira interrogans serovar lai str. 56601
cauccaacccaaacaca

SEQ ID NO: 2796586 - RNA, 19 nt, Leptospira interrogans serovar lai str. 56601
cauccaaccuccgaucacg

SEQ ID NO: 2796587 - RNA, 21 nt, Leptospira interrogans serovar lai str. 56601
cauccaauuauaaaauuuuuc

SEQ ID NO: 2796588 - RNA, 20 nt, Leptospira interrogans serovar lai str. 56601
caucccagaacaaaacguua

SEQ ID NO: 2796589 - RNA, 19 nt, Leptospira interrogans serovar lai str. 56601
caucccuaagacuuggagu

SEQ ID NO: 2796590 - RNA, 17 nt, Leptospira interrogans serovar lai str. 56601
cauccgaaaucccaaaa

SEQ ID NO: 2796591 - RNA, 18 nt, Leptospira interrogans serovar lai str. 56601
cauccgaauugaucucau

SEQ ID NO: 2796592 - RNA, 16 nt, Leptospira interrogans serovar lai str. 56601
cauccgcauucucaca

SEQ ID NO: 2796593 - RNA, 13 nt, Leptospira interrogans serovar lai str. 56601
cauccuucaaacu

SEQ ID NO: 2796594 - RNA, 19 nt, Leptospira interrogans serovar lai str. 56601
caucgaauauccuugaagu

SEQ ID NO: 2796595 - RNA, 16 nt, Leptospira interrogans serovar lai str. 56601
caucgauuuacuuuaa

SEQ ID NO: 2796596 - RNA, 16 nt, Leptospira interrogans serovar lai str. 56601
caucgcuucuaugguc

SEQ ID NO: 2796597 - RNA, 18 nt, Leptospira interrogans serovar lai str. 56601
caucguaucuugaauacu

SEQ ID NO: 2796598 - RNA, 22 nt, Leptospira interrogans serovar lai str. 56601
caucguuuauuuuucuaaaaaa

SEQ ID NO: 2796599 - RNA, 21 nt, Leptospira interrogans serovar lai str. 56601
caucuacagaacccaauaaaa

SEQ ID NO: 2796600 - RNA, 22 nt, Leptospira interrogans serovar lai str. 56601
caucuacagaacccaauaaaaa

SEQ ID NO: 2796601 - RNA, 13 nt, Leptospira interrogans serovar lai str. 56601
caucucaaaaaca

SEQ ID NO: 2796602 - RNA, 18 nt, Leptospira interrogans serovar lai str. 56601
caucucaggcaaaguauc

SEQ ID NO: 2796603 - RNA, 13 nt, Leptospira interrogans serovar lai str. 56601
caucugagaauuu

SEQ ID NO: 2796604 - RNA, 17 nt, Leptospira interrogans serovar lai str. 56601
caucuuauuuuuacaga

SEQ ID NO: 2796605 - RNA, 20 nt, Leptospira interrogans serovar lai str. 56601
caucuuuuaaaaucaagagc

SEQ ID NO: 2796606 - RNA, 15 nt, Leptospira interrogans serovar lai str. 56601
cauugaagaaaaaaa

SEQ ID NO: 2796607 - RNA, 18 nt, Leptospira interrogans serovar lai str. 56601
cauugaguuacgcugagu

SEQ ID NO: 2796608 - RNA, 19 nt, Leptospira interrogans serovar lai str. 56601
cauugaguuacgcugaguu

SEQ ID NO: 2796609 - RNA, 13 nt, Leptospira interrogans serovar lai str. 56601
cauugaguuugag

SEQ ID NO: 2796610 - RNA, 14 nt, Leptospira interrogans serovar lai str. 56601
cauugaguuuuuua

SEQ ID NO: 2796611 - RNA, 17 nt, Leptospira interrogans serovar lai str. 56601
cauugauaauuucuagu

SEQ ID NO: 2796612 - RNA, 22 nt, Leptospira interrogans serovar lai str. 56601
cauugauaauuucuaguuugaa

SEQ ID NO: 2796613 - RNA, 16 nt, Leptospira interrogans serovar lai str. 56601
cauugauuuucauuuu

SEQ ID NO: 2796614 - RNA, 16 nt, Leptospira interrogans serovar lai str. 56601
cauuggaguuaagccc

SEQ ID NO: 2796615 - RNA, 14 nt, Leptospira interrogans serovar lai str. 56601
cauuggaguuuuuu

SEQ ID NO: 2796616 - RNA, 19 nt, Leptospira interrogans serovar lai str. 56601
cauuggauucugcucuucu

SEQ ID NO: 2796617 - RNA, 15 nt, Leptospira interrogans serovar lai str. 56601
cauuggcaaauguua

SEQ ID NO: 2796618 - RNA, 13 nt, Leptospira interrogans serovar lai str. 56601
cauugucuauuuu

SEQ ID NO: 2796619 - RNA, 19 nt, Leptospira interrogans serovar lai str. 56601
cauugugaauguauauuuu

SEQ ID NO: 2796620 - RNA, 11 nt, Leptospira interrogans serovar lai str. 56601
cauuguuugaa

SEQ ID NO: 2796621 - RNA, 14 nt, Leptospira interrogans serovar lai str. 56601
cauuuaaaaauuga

SEQ ID NO: 2796622 - RNA, 12 nt, Leptospira interrogans serovar lai str. 56601
cauuuaaaacuc

SEQ ID NO: 2796623 - RNA, 13 nt, Leptospira interrogans serovar lai str. 56601
cauuuaaacuuuu

SEQ ID NO: 2796624 - RNA, 22 nt, Leptospira interrogans serovar lai str. 56601
cauuuaaaugucuacuugucuu

SEQ ID NO: 2796625 - RNA, 13 nt, Leptospira interrogans serovar lai str. 56601
cauuuacucaaau

SEQ ID NO: 2796626 - RNA, 19 nt, Leptospira interrogans serovar lai str. 56601
cauuuagaagauugaggau

SEQ ID NO: 2796627 - RNA, 18 nt, Leptospira interrogans serovar lai str. 56601
cauuuagcaauuugugaa

SEQ ID NO: 2796628 - RNA, 13 nt, Leptospira interrogans serovar lai str. 56601
cauuuauuuuuua

SEQ ID NO: 2796629 - RNA, 14 nt, Leptospira interrogans serovar lai str. 56601
cauuucaaguuuuc

SEQ ID NO: 2796630 - RNA, 16 nt, Leptospira interrogans serovar lai str. 56601
cauuucaaguuuucuu

SEQ ID NO: 2796631 - RNA, 19 nt, Leptospira interrogans serovar lai str. 56601
cauuucaaguuuucuuuuu

SEQ ID NO: 2796632 - RNA, 17 nt, Leptospira interrogans serovar lai str. 56601
cauuucauauccaaaac

SEQ ID NO: 2796633 - RNA, 14 nt, Leptospira interrogans serovar lai str. 56601
cauuucauuuuuuu

SEQ ID NO: 2796634 - RNA, 16 nt, Leptospira interrogans serovar lai str. 56601
cauuuccaaucgccuc

SEQ ID NO: 2796635 - RNA, 14 nt, Leptospira interrogans serovar lai str. 56601
cauuuccacauucc

SEQ ID NO: 2796636 - RNA, 18 nt, Leptospira interrogans serovar lai str. 56601
cauuuccacauuccguca

SEQ ID NO: 2796637 - RNA, 20 nt, Leptospira interrogans serovar lai str. 56601
cauuucguaaaauccaugau

SEQ ID NO: 2796638 - RNA, 12 nt, Leptospira interrogans serovar lai str. 56601
cauuucuaaaau

SEQ ID NO: 2796639 - RNA, 24 nt, Leptospira interrogans serovar lai str. 56601
cauuucuaugauauggaauuccga

SEQ ID NO: 2796640 - RNA, 22 nt, Leptospira interrogans serovar lai str. 56601
cauuucuguaacauccaaacuc

SEQ ID NO: 2796641 - RNA, 13 nt, Leptospira interrogans serovar lai str. 56601
cauuugaauacga

SEQ ID NO: 2796642 - RNA, 15 nt, Leptospira interrogans serovar lai str. 56601
cauuugaauuuauag

SEQ ID NO: 2796643 - RNA, 19 nt, Leptospira interrogans serovar lai str. 56601
cauuugauuaaaaauuucu

SEQ ID NO: 2796644 - RNA, 23 nt, Leptospira interrogans serovar lai str. 56601
cauuuggaucuguaauuggaaug

SEQ ID NO: 2796645 - RNA, 18 nt, Leptospira interrogans serovar lai str. 56601
cauuugguaauuugugaa

SEQ ID NO: 2796646 - RNA, 14 nt, Leptospira interrogans serovar lai str. 56601
cauuuguagagauu

SEQ ID NO: 2796647 - RNA, 22 nt, Leptospira interrogans serovar lai str. 56601
cauuugugcuauauucaaaaaa

SEQ ID NO: 2796648 - RNA, 16 nt, Leptospira interrogans serovar lai str. 56601
cauuuguuucuauuuu

SEQ ID NO: 2796649 - RNA, 18 nt, Leptospira interrogans serovar lai str. 56601
cauuuguuucuauuuuau

SEQ ID NO: 2796650 - RNA, 19 nt, Leptospira interrogans serovar lai str. 56601
cauuuguuuuuuauaauuu

SEQ ID NO: 2796651 - RNA, 15 nt, Leptospira interrogans serovar lai str. 56601
cauuuuaaaaauuca

SEQ ID NO: 2796652 - RNA, 15 nt, Leptospira interrogans serovar lai str. 56601
cauuuuaagaaucga

SEQ ID NO: 2796653 - RNA, 13 nt, Leptospira interrogans serovar lai str. 56601
cauuuuaauaauc

SEQ ID NO: 2796654 - RNA, 14 nt, Leptospira interrogans serovar lai str. 56601
cauuuuacagaaua

SEQ ID NO: 2796655 - RNA, 19 nt, Leptospira interrogans serovar lai str. 56601
cauuuuacagaauauuaaa

SEQ ID NO: 2796656 - RNA, 14 nt, Leptospira interrogans serovar lai str. 56601
cauuuuauacuuau

SEQ ID NO: 2796657 - RNA, 13 nt, Leptospira interrogans serovar lai str. 56601
cauuuuauuaaaa

SEQ ID NO: 2796658 - RNA, 19 nt, Leptospira interrogans serovar lai str. 56601
cauuuuauuauaaauuuau

SEQ ID NO: 2796659 - RNA, 20 nt, Leptospira interrogans serovar lai str. 56601
cauuuuauuuuuacaaaaaa

SEQ ID NO: 2796660 - RNA, 14 nt, Leptospira interrogans serovar lai str. 56601
cauuuucaauuuuu

SEQ ID NO: 2796661 - RNA, 16 nt, Leptospira interrogans serovar lai str. 56601
cauuuucaauuuuuau

SEQ ID NO: 2796662 - RNA, 22 nt, Leptospira interrogans serovar lai str. 56601
cauuuucauaauaaauuuuucu

SEQ ID NO: 2796663 - RNA, 19 nt, Leptospira interrogans serovar lai str. 56601
cauuuucauucuaaagaag

SEQ ID NO: 2796664 - RNA, 15 nt, Leptospira interrogans serovar lai str. 56601
cauuuuccuuuuucc

SEQ ID NO: 2796665 - RNA, 21 nt, Leptospira interrogans serovar lai str. 56601
cauuuucuauaguuguuaaaa

SEQ ID NO: 2796666 - RNA, 20 nt, Leptospira interrogans serovar lai str. 56601
cauuuugaguagccaauuga

SEQ ID NO: 2796667 - RNA, 21 nt, Leptospira interrogans serovar lai str. 56601
cauuuugcccuauugcuuuau

SEQ ID NO: 2796668 - RNA, 23 nt, Leptospira interrogans serovar lai str. 56601
cauuuugcuaaggugcugagaag

SEQ ID NO: 2796669 - RNA, 11 nt, Leptospira interrogans serovar lai str. 56601
cauuuuuaaaa

SEQ ID NO: 2796670 - RNA, 16 nt, Leptospira interrogans serovar lai str. 56601
cauuuuuacaauaacc

SEQ ID NO: 2796671 - RNA, 17 nt, Leptospira interrogans serovar lai str. 56601
cauuuuuccauaaaaaa

SEQ ID NO: 2796672 - RNA, 22 nt, Leptospira interrogans serovar lai str. 56601
cauuuuuccguaaaaaguuaau

SEQ ID NO: 2796673 - RNA, 14 nt, Leptospira interrogans serovar lai str. 56601
cauuuuucuaaaaa

SEQ ID NO: 2796674 - RNA, 15 nt, Leptospira interrogans serovar lai str. 56601
cauuuuucuuaaaaa

SEQ ID NO: 2796675 - RNA, 17 nt, Leptospira interrogans serovar lai str. 56601
cauuuuucuuaaaaaaa

SEQ ID NO: 2796676 - RNA, 16 nt, Leptospira interrogans serovar lai str. 56601
cauuuuugugaaacuc

SEQ ID NO: 2796677 - RNA, 16 nt, Leptospira interrogans serovar lai str. 56601
cauuuuugugaaacuu

SEQ ID NO: 2796678 - RNA, 23 nt, Leptospira interrogans serovar lai str. 56601
cauuuuugugaaguuaaaacauu

SEQ ID NO: 2796679 - RNA, 15 nt, Leptospira interrogans serovar lai str. 56601
cauuuuuuaaauuua

SEQ ID NO: 2796680 - RNA, 13 nt, Leptospira interrogans serovar lai str. 56601
cauuuuuucauac

SEQ ID NO: 2796681 - RNA, 21 nt, Leptospira interrogans serovar lai str. 56601
cauuuuuuucgaauugaguuu

SEQ ID NO: 2796682 - RNA, 14 nt, Leptospira interrogans serovar lai str. 56601
ccaaaaaaauaaau

SEQ ID NO: 2796683 - RNA, 15 nt, Leptospira interrogans serovar lai str. 56601
ccaaaaagaaaaaca

SEQ ID NO: 2796684 - RNA, 21 nt, Leptospira interrogans serovar lai str. 56601
ccaaaaagaaaaacagguaaa

SEQ ID NO: 2796685 - RNA, 21 nt, Leptospira interrogans serovar lai str. 56601
ccaaaaauagggaaaacucau

SEQ ID NO: 2796686 - RNA, 22 nt, Leptospira interrogans serovar lai str. 56601
ccaaaaaugcaaaaguuuucaa

SEQ ID NO: 2796687 - RNA, 13 nt, Leptospira interrogans serovar lai str. 56601
ccaaaaccaauuu

SEQ ID NO: 2796688 - RNA, 18 nt, Leptospira interrogans serovar lai str. 56601
ccaaaaccucaaaaaauu

SEQ ID NO: 2796689 - RNA, 17 nt, Leptospira interrogans serovar lai str. 56601
ccacuucucacaaauca

SEQ ID NO: 2796690 - RNA, 18 nt, Leptospira interrogans serovar lai str. 56601
ccacuucucacaaaucau

SEQ ID NO: 2796691 - RNA, 15 nt, Leptospira interrogans serovar lai str. 56601
ccacuugaauagaac

SEQ ID NO: 2796692 - RNA, 14 nt, Leptospira interrogans serovar lai str. 56601
ccagaaaaaaccuc

SEQ ID NO: 2796693 - RNA, 19 nt, Leptospira interrogans serovar lai str. 56601
ccagaaaccauaaaauaaa

SEQ ID NO: 2796694 - RNA, 20 nt, Leptospira interrogans serovar lai str. 56601
ccagaaaccauaaaauaaaa

SEQ ID NO: 2796695 - RNA, 21 nt, Leptospira interrogans serovar lai str. 56601
ccagaaagcucuccaucuuuu

SEQ ID NO: 2796696 - RNA, 18 nt, Leptospira interrogans serovar lai str. 56601
ccagaacgcgauccauag

SEQ ID NO: 2796697 - RNA, 22 nt, Leptospira interrogans serovar lai str. 56601
ccagaauuuugaacauuuucau

SEQ ID NO: 2796698 - RNA, 22 nt, Leptospira interrogans serovar lai str. 56601
ccagagcauauaauuaaaaaga

SEQ ID NO: 2796699 - RNA, 21 nt, Leptospira interrogans serovar lai str. 56601
ccagagccguaaauauuuuuu

SEQ ID NO: 2796700 - RNA, 13 nt, Leptospira interrogans serovar lai str. 56601
ccagaucaauucu

SEQ ID NO: 2796701 - RNA, 17 nt, Leptospira interrogans serovar lai str. 56601
ccagauuuaauuuuucu

SEQ ID NO: 2796702 - RNA, 14 nt, Leptospira interrogans serovar lai str. 56601
ccagcaaaacacuu

SEQ ID NO: 2796703 - RNA, 20 nt, Leptospira interrogans serovar lai str. 56601
ccagcaccuucugaaaguag

SEQ ID NO: 2796704 - RNA, 13 nt, Leptospira interrogans serovar lai str. 56601
ccagcauuuagaa

SEQ ID NO: 2796705 - RNA, 17 nt, Leptospira interrogans serovar lai str. 56601
ccagcgauucuaggauc

SEQ ID NO: 2796706 - RNA, 22 nt, Leptospira interrogans serovar lai str. 56601
ccagcuucuugcgcuaucuuca

SEQ ID NO: 2796707 - RNA, 19 nt, Leptospira interrogans serovar lai str. 56601
ccagcuuuuuucagaauca

SEQ ID NO: 2796708 - RNA, 22 nt, Leptospira interrogans serovar lai str. 56601
ccaguauuuuacgcuuaaauag

SEQ ID NO: 2796709 - RNA, 22 nt, Leptospira interrogans serovar lai str. 56601
ccaguuaaaucaccuuuuacuu

SEQ ID NO: 2796710 - RNA, 20 nt, Leptospira interrogans serovar lai str. 56601
ccaguucuuaaauaaaauuu

SEQ ID NO: 2796711 - RNA, 14 nt, Leptospira interrogans serovar lai str. 56601
ccauaaaaaaugaa

SEQ ID NO: 2796712 - RNA, 11 nt, Leptospira interrogans serovar lai str. 56601
ccauaaaaacg

SEQ ID NO: 2796713 - RNA, 16 nt, Leptospira interrogans serovar lai str. 56601
ccauaaaauagaaaca

SEQ ID NO: 2796714 - RNA, 17 nt, Leptospira interrogans serovar lai str. 56601
ccauaaauucuacaaau

SEQ ID NO: 2796715 - RNA, 18 nt, Leptospira interrogans serovar lai str. 56601
ccauaaauucuacaaauu

SEQ ID NO: 2796716 - RNA, 14 nt, Leptospira interrogans serovar lai str. 56601
ccauaaauuuugau

SEQ ID NO: 2796717 - RNA, 22 nt, Leptospira interrogans serovar lai str. 56601
ccauaaguuccuuaaaaguauc

SEQ ID NO: 2796718 - RNA, 14 nt, Leptospira interrogans serovar lai str. 56601
ccauaaucaacccc

SEQ ID NO: 2796719 - RNA, 17 nt, Leptospira interrogans serovar lai str. 56601
ccauacaaaauuuaaaa

SEQ ID NO: 2796720 - RNA, 18 nt, Leptospira interrogans serovar lai str. 56601
ccauacaaaauuuaaaaa

SEQ ID NO: 2796721 - RNA, 17 nt, Leptospira interrogans serovar lai str. 56601
ccauagaguguuguguu

SEQ ID NO: 2796722 - RNA, 18 nt, Leptospira interrogans serovar lai str. 56601
ccauaggcgcggaaaaau

SEQ ID NO: 2796723 - RNA, 21 nt, Leptospira interrogans serovar lai str. 56601
ccaucaaauacaaaauuuuuu

SEQ ID NO: 2796724 - RNA, 22 nt, Leptospira interrogans serovar lai str. 56601
ccaucagaauagauucuuaaug

SEQ ID NO: 2796725 - RNA, 14 nt, Leptospira interrogans serovar lai str. 56601
ccaucgauuuacuu

SEQ ID NO: 2796726 - RNA, 19 nt, Leptospira interrogans serovar lai str. 56601
ccaucgauuuacuuuaaaa

SEQ ID NO: 2796727 - RNA, 20 nt, Leptospira interrogans serovar lai str. 56601
ccaucgauuuacuuuaaaau

SEQ ID NO: 2796728 - RNA, 16 nt, Leptospira interrogans serovar lai str. 56601
ccaucuacagaaccca

SEQ ID NO: 2796729 - RNA, 13 nt, Leptospira interrogans serovar lai str. 56601
ccaucucaaaaau

SEQ ID NO: 2796730 - RNA, 19 nt, Leptospira interrogans serovar lai str. 56601
ccaucuuuauaucuugaac

SEQ ID NO: 2796731 - RNA, 18 nt, Leptospira interrogans serovar lai str. 56601
ccaucuuugauauuugga

SEQ ID NO: 2796732 - RNA, 13 nt, Leptospira interrogans serovar lai str. 56601
ccaucuuuuuuug

SEQ ID NO: 2796733 - RNA, 15 nt, Leptospira interrogans serovar lai str. 56601
ccaucuuuuuuuucu

SEQ ID NO: 2796734 - RNA, 22 nt, Leptospira interrogans serovar lai str. 56601
ccaugauucugaaaaaaguuag

SEQ ID NO: 2796735 - RNA, 13 nt, Leptospira interrogans serovar lai str. 56601
ccaugccaaacac

SEQ ID NO: 2796736 - RNA, 19 nt, Leptospira interrogans serovar lai str. 56601
ccauggcuuugaaaaaggu

SEQ ID NO: 2796737 - RNA, 15 nt, Leptospira interrogans serovar lai str. 56601
ccaugguuuuuucaa

SEQ ID NO: 2796738 - RNA, 19 nt, Leptospira interrogans serovar lai str. 56601
ccauuaacuauauaauaaa

SEQ ID NO: 2796739 - RNA, 21 nt, Leptospira interrogans serovar lai str. 56601
ccauuaggugcuacugcaaga

SEQ ID NO: 2796740 - RNA, 23 nt, Leptospira interrogans serovar lai str. 56601
ccauucaaaaaaucaaauauaca

SEQ ID NO: 2796741 - RNA, 20 nt, Leptospira interrogans serovar lai str. 56601
ccauucuagaaccuggaaaa

SEQ ID NO: 2796742 - RNA, 20 nt, Leptospira interrogans serovar lai str. 56601
ccauucucacucgaacuucg

SEQ ID NO: 2796743 - RNA, 18 nt, Leptospira interrogans serovar lai str. 56601
ccauucuuuuugccaauu

SEQ ID NO: 2796744 - RNA, 12 nt, Leptospira interrogans serovar lai str. 56601
ccauugauuuuc

SEQ ID NO: 2796745 - RNA, 19 nt, Leptospira interrogans serovar lai str. 56601
ccauuuagcaauuugugaa

SEQ ID NO: 2796746 - RNA, 15 nt, Leptospira interrogans serovar lai str. 56601
ccauuucaaaaauau

SEQ ID NO: 2796747 - RNA, 17 nt, Leptospira interrogans serovar lai str. 56601
ccauuucguuucccucu

SEQ ID NO: 2796748 - RNA, 17 nt, Leptospira interrogans serovar lai str. 56601
ccauuucuguaacaucc

SEQ ID NO: 2796749 - RNA, 23 nt, Leptospira interrogans serovar lai str. 56601
ccauuuuguugcguuuaaaaaca

SEQ ID NO: 2796750 - RNA, 19 nt, Leptospira interrogans serovar lai str. 56601
ccauuuuuagucauuuccu

SEQ ID NO: 2796751 - RNA, 12 nt, Leptospira interrogans serovar lai str. 56601
ccauuuuucuuc

SEQ ID NO: 2796752 - RNA, 23 nt, Leptospira interrogans serovar lai str. 56601
ccauuuuuuucuccuuuuuuacu

SEQ ID NO: 2796753 - RNA, 19 nt, Leptospira interrogans serovar lai str. 56601
cccaaaaccgaaucuggaa

SEQ ID NO: 2796754 - RNA, 11 nt, Leptospira interrogans serovar lai str. 56601
cccaaaaugaa

SEQ ID NO: 2796755 - RNA, 15 nt, Leptospira interrogans serovar lai str. 56601
cccaaagauuucuau

SEQ ID NO: 2796756 - RNA, 23 nt, Leptospira interrogans serovar lai str. 56601
cccaacgguaacgagcaucuuua

SEQ ID NO: 2796757 - RNA, 12 nt, Leptospira interrogans serovar lai str. 56601
cccaacugaaaa

SEQ ID NO: 2796758 - RNA, 23 nt, Leptospira interrogans serovar lai str. 56601
cccacauuuaaauuaaucuguaa

SEQ ID NO: 2796759 - RNA, 12 nt, Leptospira interrogans serovar lai str. 56601
cccacauuuauu

SEQ ID NO: 2796760 - RNA, 21 nt, Leptospira interrogans serovar lai str. 56601
cccacauuucaaaguuuugcu

SEQ ID NO: 2796761 - RNA, 11 nt, Leptospira interrogans serovar lai str. 56601
cccacauuuua

SEQ ID NO: 2796762 - RNA, 15 nt, Leptospira interrogans serovar lai str. 56601
cccacauuuuagaaa

SEQ ID NO: 2796763 - RNA, 11 nt, Leptospira interrogans serovar lai str. 56601
cccacauuuug

SEQ ID NO: 2796764 - RNA, 21 nt, Leptospira interrogans serovar lai str. 56601
cccacauuuugaagguugagc

SEQ ID NO: 2796765 - RNA, 11 nt, Leptospira interrogans serovar lai str. 56601
cccacauuuuu

SEQ ID NO: 2796766 - RNA, 13 nt, Leptospira interrogans serovar lai str. 56601
cccacauuuuuaa

SEQ ID NO: 2796767 - RNA, 13 nt, Leptospira interrogans serovar lai str. 56601
cccacauuuuugu

SEQ ID NO: 2796768 - RNA, 19 nt, Leptospira interrogans serovar lai str. 56601
cccacguuuugaagguuga

SEQ ID NO: 2796769 - RNA, 20 nt, Leptospira interrogans serovar lai str. 56601
cccacugaucaaagcgggaa

SEQ ID NO: 2796770 - RNA, 20 nt, Leptospira interrogans serovar lai str. 56601
cccacuucugguuuuuuaau

SEQ ID NO: 2796771 - RNA, 12 nt, Leptospira interrogans serovar lai str. 56601
cccagaaaaaac

SEQ ID NO: 2796772 - RNA, 16 nt, Leptospira interrogans serovar lai str. 56601
ccuaaugaaaaagaaa

SEQ ID NO: 2796773 - RNA, 13 nt, Leptospira interrogans serovar lai str. 56601
ccuaauguugaau

SEQ ID NO: 2796774 - RNA, 14 nt, Leptospira interrogans serovar lai str. 56601
ccuaauuuuagaga

SEQ ID NO: 2796775 - RNA, 19 nt, Leptospira interrogans serovar lai str. 56601
ccuacaaaucaaaucgcau

SEQ ID NO: 2796776 - RNA, 18 nt, Leptospira interrogans serovar lai str. 56601
ccuacaauuuuagaauuu

SEQ ID NO: 2796777 - RNA, 20 nt, Leptospira interrogans serovar lai str. 56601
ccuacacucuaaguuuuuaa

SEQ ID NO: 2796778 - RNA, 21 nt, Leptospira interrogans serovar lai str. 56601
ccuacacuguguucuuuuuga

SEQ ID NO: 2796779 - RNA, 17 nt, Leptospira interrogans serovar lai str. 56601
ccuacaucauuuguaga

SEQ ID NO: 2796780 - RNA, 17 nt, Leptospira interrogans serovar lai str. 56601
ccuacauucauuuuuau

SEQ ID NO: 2796781 - RNA, 17 nt, Leptospira interrogans serovar lai str. 56601
ccuacauuuauuuuuac

SEQ ID NO: 2796782 - RNA, 21 nt, Leptospira interrogans serovar lai str. 56601
ccuacauuuuauuuuuuauga

SEQ ID NO: 2796783 - RNA, 17 nt, Leptospira interrogans serovar lai str. 56601
ccuacauuuuuuaucaa

SEQ ID NO: 2796784 - RNA, 20 nt, Leptospira interrogans serovar lai str. 56601
ccuacuccggcuaaaaaacu

SEQ ID NO: 2796785 - RNA, 20 nt, Leptospira interrogans serovar lai str. 56601
ccuacuuauuucuauaaaau

SEQ ID NO: 2796786 - RNA, 21 nt, Leptospira interrogans serovar lai str. 56601
ccuacuuauuucuauaaaauu

SEQ ID NO: 2796787 - RNA, 22 nt, Leptospira interrogans serovar lai str. 56601
ccuacuuauuucuauaaaauug

SEQ ID NO: 2796788 - RNA, 20 nt, Leptospira interrogans serovar lai str. 56601
ccuaguguuuaauuuuaaag

SEQ ID NO: 2796789 - RNA, 18 nt, Leptospira interrogans serovar lai str. 56601
ccuauauuuuaaauucaa

SEQ ID NO: 2796790 - RNA, 17 nt, Leptospira interrogans serovar lai str. 56601
ccuauauuuugauaaag

SEQ ID NO: 2796791 - RNA, 12 nt, Leptospira interrogans serovar lai str. 56601
ccuauguuucuu

SEQ ID NO: 2796792 - RNA, 19 nt, Leptospira interrogans serovar lai str. 56601
ccuauucaguuuccacucu

SEQ ID NO: 2796793 - RNA, 11 nt, Leptospira interrogans serovar lai str. 56601
ccuauuuuugg

SEQ ID NO: 2796794 - RNA, 15 nt, Leptospira interrogans serovar lai str. 56601
ccucaaaaaauuuua

SEQ ID NO: 2796795 - RNA, 21 nt, Leptospira interrogans serovar lai str. 56601
ccucaaagauuacauaauaaa

SEQ ID NO: 2796796 - RNA, 17 nt, Leptospira interrogans serovar lai str. 56601
ccucaacucugguuauu

SEQ ID NO: 2796797 - RNA, 16 nt, Leptospira interrogans serovar lai str. 56601
ccucauaucaaaaauu

SEQ ID NO: 2796798 - RNA, 18 nt, Leptospira interrogans serovar lai str. 56601
ccuccuauguuucuugug

SEQ ID NO: 2796799 - RNA, 19 nt, Leptospira interrogans serovar lai str. 56601
ccuccugaaaauuuuccuu

SEQ ID NO: 2796800 - RNA, 20 nt, Leptospira interrogans serovar lai str. 56601
ccuccugaaaauuuuccuuu

SEQ ID NO: 2796801 - RNA, 13 nt, Leptospira interrogans serovar lai str. 56601
ccuccuugaguuu

SEQ ID NO: 2796802 - RNA, 14 nt, Leptospira interrogans serovar lai str. 56601
ccuccuuuuucaaa

SEQ ID NO: 2796803 - RNA, 22 nt, Leptospira interrogans serovar lai str. 56601
ccucgaaaucugaccucuaucc

SEQ ID NO: 2796804 - RNA, 18 nt, Leptospira interrogans serovar lai str. 56601
ccucguacuaauucuuuu

SEQ ID NO: 2796805 - RNA, 23 nt, Leptospira interrogans serovar lai str. 56601
ccucuacaaguucauaagauugg

SEQ ID NO: 2796806 - RNA, 19 nt, Leptospira interrogans serovar lai str. 56601
ccucuauaaaaucuaaaaa

SEQ ID NO: 2796807 - RNA, 22 nt, Leptospira interrogans serovar lai str. 56601
ccucuauaaaugaauuuuaaau

SEQ ID NO: 2796808 - RNA, 17 nt, Leptospira interrogans serovar lai str. 56601
ccucuauccacuaaaau

SEQ ID NO: 2796809 - RNA, 18 nt, Leptospira interrogans serovar lai str. 56601
ccucuaugaaacuuaguu

SEQ ID NO: 2796810 - RNA, 14 nt, Leptospira interrogans serovar lai str. 56601
ccucuauggaauuu

SEQ ID NO: 2796811 - RNA, 20 nt, Leptospira interrogans serovar lai str. 56601
ccucucacuucuugaacuca

SEQ ID NO: 2796812 - RNA, 16 nt, Leptospira interrogans serovar lai str. 56601
ccucucgccaaaauau

SEQ ID NO: 2796813 - RNA, 18 nt, Leptospira interrogans serovar lai str. 56601
ccucucuuuuaauuucag

SEQ ID NO: 2796814 - RNA, 17 nt, Leptospira interrogans serovar lai str. 56601
ccucuucuagcaaucuu

SEQ ID NO: 2796815 - RNA, 20 nt, Leptospira interrogans serovar lai str. 56601
ccucuucuagcaaucuuccu

SEQ ID NO: 2796816 - RNA, 18 nt, Leptospira interrogans serovar lai str. 56601
ccucuucugauuguaaca

SEQ ID NO: 2796817 - RNA, 19 nt, Leptospira interrogans serovar lai str. 56601
ccugaaaauuuuccuuuaa

SEQ ID NO: 2796818 - RNA, 21 nt, Leptospira interrogans serovar lai str. 56601
ccugaaucuauuguaauaaau

SEQ ID NO: 2796819 - RNA, 19 nt, Leptospira interrogans serovar lai str. 56601
ccugacugcccguuucaau

SEQ ID NO: 2796820 - RNA, 21 nt, Leptospira interrogans serovar lai str. 56601
ccugauuuggaaucugcaucu

SEQ ID NO: 2796821 - RNA, 12 nt, Leptospira interrogans serovar lai str. 56601
ccugauuuuucc

SEQ ID NO: 2796822 - RNA, 17 nt, Leptospira interrogans serovar lai str. 56601
ccuggcucucagcucug

SEQ ID NO: 2796823 - RNA, 15 nt, Leptospira interrogans serovar lai str. 56601
ccugucaauuuucca

SEQ ID NO: 2796824 - RNA, 20 nt, Leptospira interrogans serovar lai str. 56601
ccuuaagacccuaaaaaauu

SEQ ID NO: 2796825 - RNA, 14 nt, Leptospira interrogans serovar lai str. 56601
ccuuacauuuuuuu

SEQ ID NO: 2796826 - RNA, 15 nt, Leptospira interrogans serovar lai str. 56601
ccuuaccaccccacc

SEQ ID NO: 2796827 - RNA, 18 nt, Leptospira interrogans serovar lai str. 56601
ccuuaccuccuuuuucaa

SEQ ID NO: 2796828 - RNA, 18 nt, Leptospira interrogans serovar lai str. 56601
ccuuacgaucuaaaagga

SEQ ID NO: 2796829 - RNA, 21 nt, Leptospira interrogans serovar lai str. 56601
ccuuagacgccauguuuuuaa

SEQ ID NO: 2796830 - RNA, 16 nt, Leptospira interrogans serovar lai str. 56601
ccuuagucugaaauaa

SEQ ID NO: 2796831 - RNA, 23 nt, Leptospira interrogans serovar lai str. 56601
ccuucaaaacuaggaucuccuug

SEQ ID NO: 2796832 - RNA, 20 nt, Leptospira interrogans serovar lai str. 56601
ccuuccaaagauuuuaaaaa

SEQ ID NO: 2796833 - RNA, 19 nt, Leptospira interrogans serovar lai str. 56601
ccuucguuuuuguuuucuu

SEQ ID NO: 2796834 - RNA, 22 nt, Leptospira interrogans serovar lai str. 56601
ccuucuacaauccucgcuuuua

SEQ ID NO: 2796835 - RNA, 17 nt, Leptospira interrogans serovar lai str. 56601
ccuucucgcaacggauu

SEQ ID NO: 2796836 - RNA, 13 nt, Leptospira interrogans serovar lai str. 56601
ccuucucuuuuaa

SEQ ID NO: 2796837 - RNA, 12 nt, Leptospira interrogans serovar lai str. 56601
ccuucugaaagu

SEQ ID NO: 2796838 - RNA, 11 nt, Leptospira interrogans serovar lai str. 56601
ccuucuugaaa

SEQ ID NO: 2796839 - RNA, 13 nt, Leptospira interrogans serovar lai str. 56601
ccuucuuuacagu

SEQ ID NO: 2796840 - RNA, 16 nt, Leptospira interrogans serovar lai str. 56601
ccuucuuuuuucuaaa

SEQ ID NO: 2796841 - RNA, 20 nt, Leptospira interrogans serovar lai str. 56601
ccuugaguuugagaaaucau

SEQ ID NO: 2796842 - RNA, 17 nt, Leptospira interrogans serovar lai str. 56601
ccuugggauaaauauuc

SEQ ID NO: 2796843 - RNA, 21 nt, Leptospira interrogans serovar lai str. 56601
ccuugggcugaauuguuugau

SEQ ID NO: 2796844 - RNA, 17 nt, Leptospira interrogans serovar lai str. 56601
ccuuguucauaaaaacg

SEQ ID NO: 2796845 - RNA, 16 nt, Leptospira interrogans serovar lai str. 56601
ccuuuaaauugaauuc

SEQ ID NO: 2796846 - RNA, 14 nt, Leptospira interrogans serovar lai str. 56601
ccuuuaauuacagu

SEQ ID NO: 2796847 - RNA, 16 nt, Leptospira interrogans serovar lai str. 56601
ccuuuaguuuuuuagc

SEQ ID NO: 2796848 - RNA, 16 nt, Leptospira interrogans serovar lai str. 56601
ccuuuauuuaaaaacc

SEQ ID NO: 2796849 - RNA, 16 nt, Leptospira interrogans serovar lai str. 56601
ccuuucacaucuccac

SEQ ID NO: 2796850 - RNA, 23 nt, Leptospira interrogans serovar lai str. 56601
ccuuucaucuacauaaaaaagga

SEQ ID NO: 2796851 - RNA, 13 nt, Leptospira interrogans serovar lai str. 56601
ccuuucaucucua

SEQ ID NO: 2796852 - RNA, 22 nt, Leptospira interrogans serovar lai str. 56601
ccuuucauguuauaucgaauuc

SEQ ID NO: 2796853 - RNA, 17 nt, Leptospira interrogans serovar lai str. 56601
ccuuuccuugaaaaaaa

SEQ ID NO: 2796854 - RNA, 15 nt, Leptospira interrogans serovar lai str. 56601
ccuuucuaaaaauuu

SEQ ID NO: 2796855 - RNA, 21 nt, Leptospira interrogans serovar lai str. 56601
cgaccguuuccaugaaauaga

SEQ ID NO: 2796856 - RNA, 13 nt, Leptospira interrogans serovar lai str. 56601
cgaccuuaaauaa

SEQ ID NO: 2796857 - RNA, 14 nt, Leptospira interrogans serovar lai str. 56601
cgaccuuaaauaau

SEQ ID NO: 2796858 - RNA, 15 nt, Leptospira interrogans serovar lai str. 56601
cgaccuuaaauaaua

SEQ ID NO: 2796859 - RNA, 20 nt, Leptospira interrogans serovar lai str. 56601
cgacguaaagaauucauuuu

SEQ ID NO: 2796860 - RNA, 15 nt, Leptospira interrogans serovar lai str. 56601
cgacuauuucuucca

SEQ ID NO: 2796861 - RNA, 18 nt, Leptospira interrogans serovar lai str. 56601
cgacucauggagaauaaa

SEQ ID NO: 2796862 - RNA, 12 nt, Leptospira interrogans serovar lai str. 56601
cgacuucuuuuu

SEQ ID NO: 2796863 - RNA, 22 nt, Leptospira interrogans serovar lai str. 56601
cgacuuuauucaaaauagaaua

SEQ ID NO: 2796864 - RNA, 15 nt, Leptospira interrogans serovar lai str. 56601
cgacuuugacuugaa

SEQ ID NO: 2796865 - RNA, 16 nt, Leptospira interrogans serovar lai str. 56601
cgagagacgcugaguu

SEQ ID NO: 2796866 - RNA, 18 nt, Leptospira interrogans serovar lai str. 56601
cgagccauucuaauuuca

SEQ ID NO: 2796867 - RNA, 17 nt, Leptospira interrogans serovar lai str. 56601
cgagcgaaagccgccuu

SEQ ID NO: 2796868 - RNA, 16 nt, Leptospira interrogans serovar lai str. 56601
cgaguguaauaugaau

SEQ ID NO: 2796869 - RNA, 23 nt, Leptospira interrogans serovar lai str. 56601
cgauaacggucuccuuagaaagc

SEQ ID NO: 2796870 - RNA, 22 nt, Leptospira interrogans serovar lai str. 56601
cgauaauuuuuagaaauuuuua

SEQ ID NO: 2796871 - RNA, 19 nt, Leptospira interrogans serovar lai str. 56601
cgauagaagcgagagacgc

SEQ ID NO: 2796872 - RNA, 13 nt, Leptospira interrogans serovar lai str. 56601
cgauagauucaau

SEQ ID NO: 2796873 - RNA, 21 nt, Leptospira interrogans serovar lai str. 56601
cgauagccaucggaauuccuc

SEQ ID NO: 2796874 - RNA, 22 nt, Leptospira interrogans serovar lai str. 56601
cgauagccaugguaagaagaag

SEQ ID NO: 2796875 - RNA, 12 nt, Leptospira interrogans serovar lai str. 56601
cgauauuuuuua

SEQ ID NO: 2796876 - RNA, 13 nt, Leptospira interrogans serovar lai str. 56601
cgaucauucuuua

SEQ ID NO: 2796877 - RNA, 14 nt, Leptospira interrogans serovar lai str. 56601
cgauccgaugcauu

SEQ ID NO: 2796878 - RNA, 13 nt, Leptospira interrogans serovar lai str. 56601
cgaucuauagaga

SEQ ID NO: 2796879 - RNA, 18 nt, Leptospira interrogans serovar lai str. 56601
cgaucuguaaaauucaga

SEQ ID NO: 2796880 - RNA, 21 nt, Leptospira interrogans serovar lai str. 56601
cgaugagcuuuuuuagaaaaa

SEQ ID NO: 2796881 - RNA, 17 nt, Leptospira interrogans serovar lai str. 56601
cgaugcgaggucaauaa

SEQ ID NO: 2796882 - RNA, 22 nt, Leptospira interrogans serovar lai str. 56601
cgaugguuucaauuuaaaauau

SEQ ID NO: 2796883 - RNA, 15 nt, Leptospira interrogans serovar lai str. 56601
cgaugucguuuaaca

SEQ ID NO: 2796884 - RNA, 18 nt, Leptospira interrogans serovar lai str. 56601
cgauuauguaauauacaa

SEQ ID NO: 2796885 - RNA, 19 nt, Leptospira interrogans serovar lai str. 56601
cgauucagagugguuucuu

SEQ ID NO: 2796886 - RNA, 18 nt, Leptospira interrogans serovar lai str. 56601
cgauuccauuuuugucau

SEQ ID NO: 2796887 - RNA, 19 nt, Leptospira interrogans serovar lai str. 56601
cgauucuaaauuauuuaac

SEQ ID NO: 2796888 - RNA, 18 nt, Leptospira interrogans serovar lai str. 56601
cgauucuaggaucuaugu

SEQ ID NO: 2796889 - RNA, 21 nt, Leptospira interrogans serovar lai str. 56601
cgauucucguucaacuuuccu

SEQ ID NO: 2796890 - RNA, 12 nt, Leptospira interrogans serovar lai str. 56601
cgauuuaaaaac

SEQ ID NO: 2796891 - RNA, 24 nt, Leptospira interrogans serovar lai str. 56601
cgauuucauccaugucuucuaaau

SEQ ID NO: 2796892 - RNA, 21 nt, Leptospira interrogans serovar lai str. 56601
cgauuucuauccauucuagaa

SEQ ID NO: 2796893 - RNA, 16 nt, Leptospira interrogans serovar lai str. 56601
cgauuucuauuuuucg

SEQ ID NO: 2796894 - RNA, 15 nt, Leptospira interrogans serovar lai str. 56601
cgauuucuguagaaa

SEQ ID NO: 2796895 - RNA, 16 nt, Leptospira interrogans serovar lai str. 56601
cgauuucuguagaaau

SEQ ID NO: 2796896 - RNA, 12 nt, Leptospira interrogans serovar lai str. 56601
cgauuuguaaaa

SEQ ID NO: 2796897 - RNA, 15 nt, Leptospira interrogans serovar lai str. 56601
cgauuuuaaauaaaa

SEQ ID NO: 2796898 - RNA, 20 nt, Leptospira interrogans serovar lai str. 56601
cgauuuuacaaacaaauucu

SEQ ID NO: 2796899 - RNA, 21 nt, Leptospira interrogans serovar lai str. 56601
cgauuuucccaaacaggaaaa

SEQ ID NO: 2796900 - RNA, 12 nt, Leptospira interrogans serovar lai str. 56601
cgauuuuuuagc

SEQ ID NO: 2796901 - RNA, 11 nt, Leptospira interrogans serovar lai str. 56601
cgcaaaaaaaa

SEQ ID NO: 2796902 - RNA, 15 nt, Leptospira interrogans serovar lai str. 56601
cgcaaaaaaaauucg

SEQ ID NO: 2796903 - RNA, 14 nt, Leptospira interrogans serovar lai str. 56601
cgcaacacacacuu

SEQ ID NO: 2796904 - RNA, 12 nt, Leptospira interrogans serovar lai str. 56601
cgcaacauaaug

SEQ ID NO: 2796905 - RNA, 17 nt, Leptospira interrogans serovar lai str. 56601
cgcaacauaauguuuca

SEQ ID NO: 2796906 - RNA, 19 nt, Leptospira interrogans serovar lai str. 56601
cgcaaguucgguagaaaga

SEQ ID NO: 2796907 - RNA, 15 nt, Leptospira interrogans serovar lai str. 56601
cgcaaugaaaauucc

SEQ ID NO: 2796908 - RNA, 22 nt, Leptospira interrogans serovar lai str. 56601
cgcauaaaagaaauuuaauaca

SEQ ID NO: 2796909 - RNA, 18 nt, Leptospira interrogans serovar lai str. 56601
cgcauuuagcaauuugcg

SEQ ID NO: 2796910 - RNA, 12 nt, Leptospira interrogans serovar lai str. 56601
cgcauuuuccuu

SEQ ID NO: 2796911 - RNA, 16 nt, Leptospira interrogans serovar lai str. 56601
cgcauuuuuauuugca

SEQ ID NO: 2796912 - RNA, 15 nt, Leptospira interrogans serovar lai str. 56601
cgccaucgucaggga

SEQ ID NO: 2796913 - RNA, 16 nt, Leptospira interrogans serovar lai str. 56601
cgccauguuuuuaaaa

SEQ ID NO: 2796914 - RNA, 13 nt, Leptospira interrogans serovar lai str. 56601
cgcccaaacccca

SEQ ID NO: 2796915 - RNA, 22 nt, Leptospira interrogans serovar lai str. 56601
cgccguaaaaaauccaugauuc

SEQ ID NO: 2796916 - RNA, 20 nt, Leptospira interrogans serovar lai str. 56601
cgcgauccguagagagcguu

SEQ ID NO: 2796917 - RNA, 20 nt, Leptospira interrogans serovar lai str. 56601
cgcgaucuauagagagcguu

SEQ ID NO: 2796918 - RNA, 19 nt, Leptospira interrogans serovar lai str. 56601
cgcgauuauguaauauaca

SEQ ID NO: 2796919 - RNA, 19 nt, Leptospira interrogans serovar lai str. 56601
cgcgauucauaaagagcgu

SEQ ID NO: 2796920 - RNA, 15 nt, Leptospira interrogans serovar lai str. 56601
cgcgcucaaaauucu

SEQ ID NO: 2796921 - RNA, 13 nt, Leptospira interrogans serovar lai str. 56601
cgcggaaaaauua

SEQ ID NO: 2796922 - RNA, 14 nt, Leptospira interrogans serovar lai str. 56601
cgcguugaaaacca

SEQ ID NO: 2796923 - RNA, 13 nt, Leptospira interrogans serovar lai str. 56601
cgcuaaaaguacu

SEQ ID NO: 2796924 - RNA, 14 nt, Leptospira interrogans serovar lai str. 56601
cgcuaaaaguacuu

SEQ ID NO: 2796925 - RNA, 19 nt, Leptospira interrogans serovar lai str. 56601
cgcuagaaguuauaaugau

SEQ ID NO: 2796926 - RNA, 13 nt, Leptospira interrogans serovar lai str. 56601
cgcucaaaauucu

SEQ ID NO: 2796927 - RNA, 21 nt, Leptospira interrogans serovar lai str. 56601
cgcucuauuuccaccggagua

SEQ ID NO: 2796928 - RNA, 13 nt, Leptospira interrogans serovar lai str. 56601
cgcugaguuugag

SEQ ID NO: 2796929 - RNA, 18 nt, Leptospira interrogans serovar lai str. 56601
cgcugaguuugagagagc

SEQ ID NO: 2796930 - RNA, 16 nt, Leptospira interrogans serovar lai str. 56601
cgcuggaaauaucaau

SEQ ID NO: 2796931 - RNA, 13 nt, Leptospira interrogans serovar lai str. 56601
cgcuugauuccaa

SEQ ID NO: 2796932 - RNA, 21 nt, Leptospira interrogans serovar lai str. 56601
cgcuuggaaauaucuaaucuu

SEQ ID NO: 2796933 - RNA, 18 nt, Leptospira interrogans serovar lai str. 56601
cgcuuuggaauuggcuuc

SEQ ID NO: 2796934 - RNA, 22 nt, Leptospira interrogans serovar lai str. 56601
cgcuuuggucgaucguuuuuug

SEQ ID NO: 2796935 - RNA, 14 nt, Leptospira interrogans serovar lai str. 56601
cgcuuuuaguuuuu

SEQ ID NO: 2796936 - RNA, 18 nt, Leptospira interrogans serovar lai str. 56601
cggaaaauugaauauuca

SEQ ID NO: 2796937 - RNA, 22 nt, Leptospira interrogans serovar lai str. 56601
cggaaaauuuuuuugauucaaa

SEQ ID NO: 2796938 - RNA, 19 nt, Leptospira interrogans serovar lai str. 56601
cggaaauucucaaaaaauu

SEQ ID NO: 2796939 - RNA, 20 nt, Leptospira interrogans serovar lai str. 56601
cggaacaauuacagaaggga

SEQ ID NO: 2796940 - RNA, 15 nt, Leptospira interrogans serovar lai str. 56601
cggaauacuuuucuu

SEQ ID NO: 2796941 - RNA, 16 nt, Leptospira interrogans serovar lai str. 56601
cggaauauuuuuucca

SEQ ID NO: 2796942 - RNA, 23 nt, Leptospira interrogans serovar lai str. 56601
cggaaucuuuuugggaaauuuga

SEQ ID NO: 2796943 - RNA, 16 nt, Leptospira interrogans serovar lai str. 56601
cggagaaaauuuaaac

SEQ ID NO: 2796944 - RNA, 20 nt, Leptospira interrogans serovar lai str. 56601
cggagaaagcgcagacucuu

SEQ ID NO: 2796945 - RNA, 21 nt, Leptospira interrogans serovar lai str. 56601
cggagaaauuaauuucuaaac

SEQ ID NO: 2796946 - RNA, 16 nt, Leptospira interrogans serovar lai str. 56601
cggauaaccaaaaacg

SEQ ID NO: 2796947 - RNA, 13 nt, Leptospira interrogans serovar lai str. 56601
cggauaguuuaaa

SEQ ID NO: 2796948 - RNA, 16 nt, Leptospira interrogans serovar lai str. 56601
cggaugauccgcuuca

SEQ ID NO: 2796949 - RNA, 22 nt, Leptospira interrogans serovar lai str. 56601
cggauugccuaaauuccuucca

SEQ ID NO: 2796950 - RNA, 19 nt, Leptospira interrogans serovar lai str. 56601
cggauuucguuucuuuuuc

SEQ ID NO: 2796951 - RNA, 18 nt, Leptospira interrogans serovar lai str. 56601
cggauuuuagauuucgaa

SEQ ID NO: 2796952 - RNA, 14 nt, Leptospira interrogans serovar lai str. 56601
cggcauuaauauaa

SEQ ID NO: 2796953 - RNA, 15 nt, Leptospira interrogans serovar lai str. 56601
cggcccucugggauc

SEQ ID NO: 2796954 - RNA, 20 nt, Leptospira interrogans serovar lai str. 56601
cggcgaccuuucuaaaaauu

SEQ ID NO: 2796955 - RNA, 23 nt, Leptospira interrogans serovar lai str. 56601
cggcuuuaguuugaaagaacguu

SEQ ID NO: 2796956 - RNA, 14 nt, Leptospira interrogans serovar lai str. 56601
cgggaaaaucuuuu

SEQ ID NO: 2796957 - RNA, 16 nt, Leptospira interrogans serovar lai str. 56601
cgggaauaaaaacaaa

SEQ ID NO: 2796958 - RNA, 20 nt, Leptospira interrogans serovar lai str. 56601
cgggagcgcuugaaaauucu

SEQ ID NO: 2796959 - RNA, 16 nt, Leptospira interrogans serovar lai str. 56601
cggguuccauucuaag

SEQ ID NO: 2796960 - RNA, 15 nt, Leptospira interrogans serovar lai str. 56601
cgguaaaacaaaaaa

SEQ ID NO: 2796961 - RNA, 21 nt, Leptospira interrogans serovar lai str. 56601
cgguaaaagaauauuauuaua

SEQ ID NO: 2796962 - RNA, 13 nt, Leptospira interrogans serovar lai str. 56601
cgguaaaaucuuu

SEQ ID NO: 2796963 - RNA, 18 nt, Leptospira interrogans serovar lai str. 56601
cgguaaaaucuuuaaguu

SEQ ID NO: 2796964 - RNA, 18 nt, Leptospira interrogans serovar lai str. 56601
cgguaaauuuuuuagaaa

SEQ ID NO: 2796965 - RNA, 21 nt, Leptospira interrogans serovar lai str. 56601
cgguaaauuuuuuagaaauca

SEQ ID NO: 2796966 - RNA, 20 nt, Leptospira interrogans serovar lai str. 56601
cgguaauuucauaaaauucu

SEQ ID NO: 2796967 - RNA, 23 nt, Leptospira interrogans serovar lai str. 56601
cgguacaaucggguaaaaaauac

SEQ ID NO: 2796968 - RNA, 14 nt, Leptospira interrogans serovar lai str. 56601
cggugcauuuaaaa

SEQ ID NO: 2796969 - RNA, 18 nt, Leptospira interrogans serovar lai str. 56601
cggugcauuuaaaaaauu

SEQ ID NO: 2796970 - RNA, 17 nt, Leptospira interrogans serovar lai str. 56601
cgguggcuuuuguaaau

SEQ ID NO: 2796971 - RNA, 20 nt, Leptospira interrogans serovar lai str. 56601
cgguuauugugaauauuucu

SEQ ID NO: 2796972 - RNA, 20 nt, Leptospira interrogans serovar lai str. 56601
cgguucuaguauuauuuucc

SEQ ID NO: 2796973 - RNA, 23 nt, Leptospira interrogans serovar lai str. 56601
cgguuguuuugcucuaaaauaau

SEQ ID NO: 2796974 - RNA, 14 nt, Leptospira interrogans serovar lai str. 56601
cguaaaaaaauaag

SEQ ID NO: 2796975 - RNA, 12 nt, Leptospira interrogans serovar lai str. 56601
cguaaaaaaauc

SEQ ID NO: 2796976 - RNA, 17 nt, Leptospira interrogans serovar lai str. 56601
cguaaaaaguuaauucu

SEQ ID NO: 2796977 - RNA, 14 nt, Leptospira interrogans serovar lai str. 56601
cguaaaaauauugg

SEQ ID NO: 2796978 - RNA, 18 nt, Leptospira interrogans serovar lai str. 56601
cguaaacaaaaguggaag

SEQ ID NO: 2796979 - RNA, 14 nt, Leptospira interrogans serovar lai str. 56601
cguaaagaagaggu

SEQ ID NO: 2796980 - RNA, 23 nt, Leptospira interrogans serovar lai str. 56601
cguaaagaauucauuuuucugaa

SEQ ID NO: 2796981 - RNA, 18 nt, Leptospira interrogans serovar lai str. 56601
cguaaauauuuuuuuuaa

SEQ ID NO: 2796982 - RNA, 15 nt, Leptospira interrogans serovar lai str. 56601
cguaacuuucuuuua

SEQ ID NO: 2796983 - RNA, 14 nt, Leptospira interrogans serovar lai str. 56601
cguaagaaaaccau

SEQ ID NO: 2796984 - RNA, 15 nt, Leptospira interrogans serovar lai str. 56601
cguaauaguucccac

SEQ ID NO: 2796985 - RNA, 14 nt, Leptospira interrogans serovar lai str. 56601
cguaauaucuaaaa

SEQ ID NO: 2796986 - RNA, 17 nt, Leptospira interrogans serovar lai str. 56601
cguaauaucuaaaaccu

SEQ ID NO: 2796987 - RNA, 17 nt, Leptospira interrogans serovar lai str. 56601
cguaauucguuccaaau

SEQ ID NO: 2796988 - RNA, 23 nt, Leptospira interrogans serovar lai str. 56601
cguaauucuuuggaaauuuuuaa

SEQ ID NO: 2796989 - RNA, 16 nt, Leptospira interrogans serovar lai str. 56601
cguaccccaaagauuu

SEQ ID NO: 2796990 - RNA, 22 nt, Leptospira interrogans serovar lai str. 56601
cguacggauugccuaaauuccu

SEQ ID NO: 2796991 - RNA, 21 nt, Leptospira interrogans serovar lai str. 56601
cguagauaauuaaacaaagaa

SEQ ID NO: 2796992 - RNA, 16 nt, Leptospira interrogans serovar lai str. 56601
cguagaucuuuuauaa

SEQ ID NO: 2796993 - RNA, 22 nt, Leptospira interrogans serovar lai str. 56601
cguagauuacuaugaaaauucu

SEQ ID NO: 2796994 - RNA, 14 nt, Leptospira interrogans serovar lai str. 56601
cguagauuuuaaca

SEQ ID NO: 2796995 - RNA, 23 nt, Leptospira interrogans serovar lai str. 56601
cguaggcuugucguaaaaaaaua

SEQ ID NO: 2796996 - RNA, 21 nt, Leptospira interrogans serovar lai str. 56601
cguauaaaaacgguauuuaaa

SEQ ID NO: 2796997 - RNA, 17 nt, Leptospira interrogans serovar lai str. 56601
cguauaacgaaacuuua

SEQ ID NO: 2796998 - RNA, 13 nt, Leptospira interrogans serovar lai str. 56601
cguauacuuuaaa

SEQ ID NO: 2796999 - RNA, 12 nt, Leptospira interrogans serovar lai str. 56601
cguauauaaaaa

SEQ ID NO: 2797000 - RNA, 16 nt, Leptospira interrogans serovar lai str. 56601
cguauuggauuauauc

SEQ ID NO: 2797001 - RNA, 16 nt, Leptospira interrogans serovar lai str. 56601
cguauuuuuaaaugua

SEQ ID NO: 2797002 - RNA, 21 nt, Leptospira interrogans serovar lai str. 56601
cgucacuuuacaaauuuacua

SEQ ID NO: 2797003 - RNA, 13 nt, Leptospira interrogans serovar lai str. 56601
cgucauaguuccc

SEQ ID NO: 2797004 - RNA, 17 nt, Leptospira interrogans serovar lai str. 56601
cgucaucucgaagaaca

SEQ ID NO: 2797005 - RNA, 21 nt, Leptospira interrogans serovar lai str. 56601
cgucauguauauaaauuuaua

SEQ ID NO: 2797006 - RNA, 17 nt, Leptospira interrogans serovar lai str. 56601
cgucggaagccauaauc

SEQ ID NO: 2797007 - RNA, 15 nt, Leptospira interrogans serovar lai str. 56601
cgucguuaaauuugc

SEQ ID NO: 2797008 - RNA, 16 nt, Leptospira interrogans serovar lai str. 56601
cgucguuaaauuugcg

SEQ ID NO: 2797009 - RNA, 13 nt, Leptospira interrogans serovar lai str. 56601
cgucuaucuuuuu

SEQ ID NO: 2797010 - RNA, 20 nt, Leptospira interrogans serovar lai str. 56601
cgucucacuccccauggguc

SEQ ID NO: 2797011 - RNA, 15 nt, Leptospira interrogans serovar lai str. 56601
cgucuguaaaagaaa

SEQ ID NO: 2797012 - RNA, 14 nt, Leptospira interrogans serovar lai str. 56601
cgucuuaaauucua

SEQ ID NO: 2797013 - RNA, 22 nt, Leptospira interrogans serovar lai str. 56601
cgucuucuuuuuuuaccgaaga

SEQ ID NO: 2797014 - RNA, 20 nt, Leptospira interrogans serovar lai str. 56601
cgugaaacuuuccacuuuuc

SEQ ID NO: 2797015 - RNA, 17 nt, Leptospira interrogans serovar lai str. 56601
cgugaaaugguaccaua

SEQ ID NO: 2797016 - RNA, 15 nt, Leptospira interrogans serovar lai str. 56601
cgugacaaacuaaau

SEQ ID NO: 2797017 - RNA, 15 nt, Leptospira interrogans serovar lai str. 56601
cgugacuaaaauuga

SEQ ID NO: 2797018 - RNA, 15 nt, Leptospira interrogans serovar lai str. 56601
cgugaguucaaugua

SEQ ID NO: 2797019 - RNA, 19 nt, Leptospira interrogans serovar lai str. 56601
cgugaguucgguauacgaa

SEQ ID NO: 2797020 - RNA, 18 nt, Leptospira interrogans serovar lai str. 56601
cgugaucuccuaaaauaa

SEQ ID NO: 2797021 - RNA, 19 nt, Leptospira interrogans serovar lai str. 56601
cuaaaaugaaaaaaaacaa

SEQ ID NO: 2797022 - RNA, 11 nt, Leptospira interrogans serovar lai str. 56601
cuaaaauguag

SEQ ID NO: 2797023 - RNA, 21 nt, Leptospira interrogans serovar lai str. 56601
cuaaaauuacgcugauuagaa

SEQ ID NO: 2797024 - RNA, 18 nt, Leptospira interrogans serovar lai str. 56601
cuaaaauucaguuucaaa

SEQ ID NO: 2797025 - RNA, 21 nt, Leptospira interrogans serovar lai str. 56601
cuaaaauugacaaagaguugu

SEQ ID NO: 2797026 - RNA, 18 nt, Leptospira interrogans serovar lai str. 56601
cuaaaauuguaggaacua

SEQ ID NO: 2797027 - RNA, 15 nt, Leptospira interrogans serovar lai str. 56601
cuaaaauuucauuuc

SEQ ID NO: 2797028 - RNA, 14 nt, Leptospira interrogans serovar lai str. 56601
cuaaaauuuuauaa

SEQ ID NO: 2797029 - RNA, 18 nt, Leptospira interrogans serovar lai str. 56601
cuaaaauuuuauaaaaau

SEQ ID NO: 2797030 - RNA, 14 nt, Leptospira interrogans serovar lai str. 56601
cuaaacaauuuuau

SEQ ID NO: 2797031 - RNA, 15 nt, Leptospira interrogans serovar lai str. 56601
cuaaacccugagaau

SEQ ID NO: 2797032 - RNA, 17 nt, Leptospira interrogans serovar lai str. 56601
cuaaacgaguuuuuguu

SEQ ID NO: 2797033 - RNA, 17 nt, Leptospira interrogans serovar lai str. 56601
cuaaacuaaaaaaaaua

SEQ ID NO: 2797034 - RNA, 22 nt, Leptospira interrogans serovar lai str. 56601
cuaaacuaucuauuagaacauc

SEQ ID NO: 2797035 - RNA, 13 nt, Leptospira interrogans serovar lai str. 56601
cuaaacucauuuu

SEQ ID NO: 2797036 - RNA, 20 nt, Leptospira interrogans serovar lai str. 56601
cuaaacucucguuguaacua

SEQ ID NO: 2797037 - RNA, 18 nt, Leptospira interrogans serovar lai str. 56601
cuaaacuuugcaaaucga

SEQ ID NO: 2797038 - RNA, 16 nt, Leptospira interrogans serovar lai str. 56601
cuaaagaauacauuuu

SEQ ID NO: 2797039 - RNA, 23 nt, Leptospira interrogans serovar lai str. 56601
cuaaagaaugaucgcauaaaauu

SEQ ID NO: 2797040 - RNA, 19 nt, Leptospira interrogans serovar lai str. 56601
cuaaagcuugauuauuauu

SEQ ID NO: 2797041 - RNA, 15 nt, Leptospira interrogans serovar lai str. 56601
cuaaagucgaauuuu

SEQ ID NO: 2797042 - RNA, 19 nt, Leptospira interrogans serovar lai str. 56601
cuaaauauuuauuacaaag

SEQ ID NO: 2797043 - RNA, 14 nt, Leptospira interrogans serovar lai str. 56601
cuaaauccuucaaa

SEQ ID NO: 2797044 - RNA, 15 nt, Leptospira interrogans serovar lai str. 56601
cuaaauccuucuuuu

SEQ ID NO: 2797045 - RNA, 16 nt, Leptospira interrogans serovar lai str. 56601
cuaaauccuucuuuuc

SEQ ID NO: 2797046 - RNA, 17 nt, Leptospira interrogans serovar lai str. 56601
cuaaauccuucuuuucu

SEQ ID NO: 2797047 - RNA, 23 nt, Leptospira interrogans serovar lai str. 56601
cuaaaucucaauucaguaaauua

SEQ ID NO: 2797048 - RNA, 13 nt, Leptospira interrogans serovar lai str. 56601
cuaaaugaguuuu

SEQ ID NO: 2797049 - RNA, 22 nt, Leptospira interrogans serovar lai str. 56601
cuaaauuaaguuuauucaauuu

SEQ ID NO: 2797050 - RNA, 22 nt, Leptospira interrogans serovar lai str. 56601
cuaaauuaauauuuauaaaaca

SEQ ID NO: 2797051 - RNA, 15 nt, Leptospira interrogans serovar lai str. 56601
cuaaauuauuuucaa

SEQ ID NO: 2797052 - RNA, 17 nt, Leptospira interrogans serovar lai str. 56601
cuaaauuauuuucaagu

SEQ ID NO: 2797053 - RNA, 21 nt, Leptospira interrogans serovar lai str. 56601
cuaaauuauuuucaaguaaau

SEQ ID NO: 2797054 - RNA, 23 nt, Leptospira interrogans serovar lai str. 56601
cuaaauucagaaaaaaaaagaau

SEQ ID NO: 2797055 - RNA, 20 nt, Leptospira interrogans serovar lai str. 56601
cuaaauugaaacuaaagacg

SEQ ID NO: 2797056 - RNA, 17 nt, Leptospira interrogans serovar lai str. 56601
cuaaauugugagaacua

SEQ ID NO: 2797057 - RNA, 17 nt, Leptospira interrogans serovar lai str. 56601
cuaaauuuguaauaguu

SEQ ID NO: 2797058 - RNA, 17 nt, Leptospira interrogans serovar lai str. 56601
cuaaauuuuauaaaauu

SEQ ID NO: 2797059 - RNA, 21 nt, Leptospira interrogans serovar lai str. 56601
cuaacaaaaaguguuuauaau

SEQ ID NO: 2797060 - RNA, 21 nt, Leptospira interrogans serovar lai str. 56601
cuaacaauuuuagaauuuauu

SEQ ID NO: 2797061 - RNA, 18 nt, Leptospira interrogans serovar lai str. 56601
cuaacgauccuuaggaag

SEQ ID NO: 2797062 - RNA, 18 nt, Leptospira interrogans serovar lai str. 56601
cuaacgauuguaaaaaaa

SEQ ID NO: 2797063 - RNA, 21 nt, Leptospira interrogans serovar lai str. 56601
cuaacgauuguaaaaaaacau

SEQ ID NO: 2797064 - RNA, 20 nt, Leptospira interrogans serovar lai str. 56601
cuaacgcaaguuccgcgauu

SEQ ID NO: 2797065 - RNA, 14 nt, Leptospira interrogans serovar lai str. 56601
cuaacgugagcucu

SEQ ID NO: 2797066 - RNA, 17 nt, Leptospira interrogans serovar lai str. 56601
cuaacugauuauaaaaa

SEQ ID NO: 2797067 - RNA, 24 nt, Leptospira interrogans serovar lai str. 56601
cuaacugguuuuucuuuaaugcug

SEQ ID NO: 2797068 - RNA, 23 nt, Leptospira interrogans serovar lai str. 56601
cuaacuuauaagacauuggcaaa

SEQ ID NO: 2797069 - RNA, 14 nt, Leptospira interrogans serovar lai str. 56601
cuaagaaaaaagca

SEQ ID NO: 2797070 - RNA, 14 nt, Leptospira interrogans serovar lai str. 56601
cuaagaaaaaaguu

SEQ ID NO: 2797071 - RNA, 15 nt, Leptospira interrogans serovar lai str. 56601
cuaagaaaaaaguug

SEQ ID NO: 2797072 - RNA, 18 nt, Leptospira interrogans serovar lai str. 56601
cuaagaaucuugggguuu

SEQ ID NO: 2797073 - RNA, 17 nt, Leptospira interrogans serovar lai str. 56601
cuaagaucaacacaaau

SEQ ID NO: 2797074 - RNA, 21 nt, Leptospira interrogans serovar lai str. 56601
cuaagauccaaauuuuuuaca

SEQ ID NO: 2797075 - RNA, 23 nt, Leptospira interrogans serovar lai str. 56601
cuaaggauccaauacaaaacaag

SEQ ID NO: 2797076 - RNA, 13 nt, Leptospira interrogans serovar lai str. 56601
cuaaguaaaaaug

SEQ ID NO: 2797077 - RNA, 20 nt, Leptospira interrogans serovar lai str. 56601
cuaaguaauuuaaaaaaauc

SEQ ID NO: 2797078 - RNA, 15 nt, Leptospira interrogans serovar lai str. 56601
cuaaguccuuuucuu

SEQ ID NO: 2797079 - RNA, 20 nt, Leptospira interrogans serovar lai str. 56601
cuaaguuuuacagaggauuu

SEQ ID NO: 2797080 - RNA, 21 nt, Leptospira interrogans serovar lai str. 56601
cuaaguuuuacagaggauuug

SEQ ID NO: 2797081 - RNA, 15 nt, Leptospira interrogans serovar lai str. 56601
cuaaguuuuuaaaua

SEQ ID NO: 2797082 - RNA, 14 nt, Leptospira interrogans serovar lai str. 56601
cuaauaaacaaaau

SEQ ID NO: 2797083 - RNA, 21 nt, Leptospira interrogans serovar lai str. 56601
cuaauaaacaaaauucaaaug

SEQ ID NO: 2797084 - RNA, 20 nt, Leptospira interrogans serovar lai str. 56601
cuaauagccgcuauggaagg

SEQ ID NO: 2797085 - RNA, 18 nt, Leptospira interrogans serovar lai str. 56601
cuaauauaaaaaccacaa

SEQ ID NO: 2797086 - RNA, 23 nt, Leptospira interrogans serovar lai str. 56601
cuaauauaaaaaccacaaaaaca

SEQ ID NO: 2797087 - RNA, 14 nt, Leptospira interrogans serovar lai str. 56601
cuaauauaaaaucu

SEQ ID NO: 2797088 - RNA, 16 nt, Leptospira interrogans serovar lai str. 56601
cuaauauaucagauug

SEQ ID NO: 2797089 - RNA, 12 nt, Leptospira interrogans serovar lai str. 56601
cuaauauuaaaa

SEQ ID NO: 2797090 - RNA, 19 nt, Leptospira interrogans serovar lai str. 56601
cuaauauuauuuuuuucua

SEQ ID NO: 2797091 - RNA, 17 nt, Leptospira interrogans serovar lai str. 56601
cuaauauuuuaaagaaa

SEQ ID NO: 2797092 - RNA, 13 nt, Leptospira interrogans serovar lai str. 56601
cuaaucagauuuu

SEQ ID NO: 2797093 - RNA, 20 nt, Leptospira interrogans serovar lai str. 56601
cuaaugaaggaauuggaaua

SEQ ID NO: 2797094 - RNA, 13 nt, Leptospira interrogans serovar lai str. 56601
cuaaugauuucuu

SEQ ID NO: 2797095 - RNA, 17 nt, Leptospira interrogans serovar lai str. 56601
cuaaugcagcuucuucc

SEQ ID NO: 2797096 - RNA, 17 nt, Leptospira interrogans serovar lai str. 56601
cuaauuacgauuuuuug

SEQ ID NO: 2797097 - RNA, 17 nt, Leptospira interrogans serovar lai str. 56601
cuaauucgaaagcgauu

SEQ ID NO: 2797098 - RNA, 20 nt, Leptospira interrogans serovar lai str. 56601
cuaauucuaaaaauuuuuuu

SEQ ID NO: 2797099 - RNA, 22 nt, Leptospira interrogans serovar lai str. 56601
cuaauucuaaaaauuuuuuuaa

SEQ ID NO: 2797100 - RNA, 23 nt, Leptospira interrogans serovar lai str. 56601
cuaauucuaaaaauuuuuuuaaa

SEQ ID NO: 2797101 - RNA, 14 nt, Leptospira interrogans serovar lai str. 56601
cuaauuuacuacau

SEQ ID NO: 2797102 - RNA, 22 nt, Leptospira interrogans serovar lai str. 56601
cuaauuuacuacaucuaaugau

SEQ ID NO: 2797103 - RNA, 21 nt, Leptospira interrogans serovar lai str. 56601
cuauaaccacaagacaaacaa

SEQ ID NO: 2797104 - RNA, 16 nt, Leptospira interrogans serovar lai str. 56601
cuauaacuuuaaaaaa

SEQ ID NO: 2797105 - RNA, 17 nt, Leptospira interrogans serovar lai str. 56601
cuauaacuuuaaaaaau

SEQ ID NO: 2797106 - RNA, 19 nt, Leptospira interrogans serovar lai str. 56601
cuauaacuuuaaaaaauaa

SEQ ID NO: 2797107 - RNA, 17 nt, Leptospira interrogans serovar lai str. 56601
cuauaauaagauuuguu

SEQ ID NO: 2797108 - RNA, 22 nt, Leptospira interrogans serovar lai str. 56601
cuauaauaagauuuguugaaaa

SEQ ID NO: 2797109 - RNA, 14 nt, Leptospira interrogans serovar lai str. 56601
cuauaauuuccgga

SEQ ID NO: 2797110 - RNA, 17 nt, Leptospira interrogans serovar lai str. 56601
cuauacuagaacaauaa

SEQ ID NO: 2797111 - RNA, 16 nt, Leptospira interrogans serovar lai str. 56601
cuauacuuucaaaaaa

SEQ ID NO: 2797112 - RNA, 17 nt, Leptospira interrogans serovar lai str. 56601
cuauacuuucaaaaaau

SEQ ID NO: 2797113 - RNA, 18 nt, Leptospira interrogans serovar lai str. 56601
cuauacuuucaaaaaaua

SEQ ID NO: 2797114 - RNA, 14 nt, Leptospira interrogans serovar lai str. 56601
cuauaguuuuuaac

SEQ ID NO: 2797115 - RNA, 12 nt, Leptospira interrogans serovar lai str. 56601
cuauauauccuu

SEQ ID NO: 2797116 - RNA, 18 nt, Leptospira interrogans serovar lai str. 56601
cuauauauugaaauauua

SEQ ID NO: 2797117 - RNA, 13 nt, Leptospira interrogans serovar lai str. 56601
cuauauucaaaaa

SEQ ID NO: 2797118 - RNA, 14 nt, Leptospira interrogans serovar lai str. 56601
cuauauucaaaaaa

SEQ ID NO: 2797119 - RNA, 23 nt, Leptospira interrogans serovar lai str. 56601
cuauauucaaaaaaguuuauacu

SEQ ID NO: 2797120 - RNA, 17 nt, Leptospira interrogans serovar lai str. 56601
cuauauucaaaaaaugg

SEQ ID NO: 2797121 - RNA, 17 nt, Leptospira interrogans serovar lai str. 56601
cuauauuuuacaguaaa

SEQ ID NO: 2797122 - RNA, 21 nt, Leptospira interrogans serovar lai str. 56601
cuauauuuuacaguaaaacuu

SEQ ID NO: 2797123 - RNA, 12 nt, Leptospira interrogans serovar lai str. 56601
cuauauuuugau

SEQ ID NO: 2797124 - RNA, 16 nt, Leptospira interrogans serovar lai str. 56601
cuaucaacaagaauga

SEQ ID NO: 2797125 - RNA, 16 nt, Leptospira interrogans serovar lai str. 56601
cuaucagaaaaacaua

SEQ ID NO: 2797126 - RNA, 21 nt, Leptospira interrogans serovar lai str. 56601
cuauccaauugaauauaaaau

SEQ ID NO: 2797127 - RNA, 14 nt, Leptospira interrogans serovar lai str. 56601
cuaucgcaaauaau

SEQ ID NO: 2797128 - RNA, 23 nt, Leptospira interrogans serovar lai str. 56601
cuaucgcuaaacggcacuuugug

SEQ ID NO: 2797129 - RNA, 16 nt, Leptospira interrogans serovar lai str. 56601
cuaucuauuagaacau

SEQ ID NO: 2797130 - RNA, 12 nt, Leptospira interrogans serovar lai str. 56601
cuaucucaaaaa

SEQ ID NO: 2797131 - RNA, 17 nt, Leptospira interrogans serovar lai str. 56601
cuaucucaaaaauacuu

SEQ ID NO: 2797132 - RNA, 16 nt, Leptospira interrogans serovar lai str. 56601
cuaugaaaauucuuuc

SEQ ID NO: 2797133 - RNA, 18 nt, Leptospira interrogans serovar lai str. 56601
cuaugaaacgaaauauau

SEQ ID NO: 2797134 - RNA, 20 nt, Leptospira interrogans serovar lai str. 56601
cuaugaaauacaaaaagaau

SEQ ID NO: 2797135 - RNA, 17 nt, Leptospira interrogans serovar lai str. 56601
cuaugaagagguacaga

SEQ ID NO: 2797136 - RNA, 17 nt, Leptospira interrogans serovar lai str. 56601
cuaugauucugaaaaaa

SEQ ID NO: 2797137 - RNA, 18 nt, Leptospira interrogans serovar lai str. 56601
cuaugauucugaaaaaaa

SEQ ID NO: 2797138 - RNA, 20 nt, Leptospira interrogans serovar lai str. 56601
cuauggaauuuuucaacaac

SEQ ID NO: 2797139 - RNA, 14 nt, Leptospira interrogans serovar lai str. 56601
cuauggaucgccgu

SEQ ID NO: 2797140 - RNA, 15 nt, Leptospira interrogans serovar lai str. 56601
cuaugggaauuuuug

SEQ ID NO: 2797141 - RNA, 13 nt, Leptospira interrogans serovar lai str. 56601
cuauguaagaaaa

SEQ ID NO: 2797142 - RNA, 18 nt, Leptospira interrogans serovar lai str. 56601
cuauguccuuuuuuucuu

SEQ ID NO: 2797143 - RNA, 22 nt, Leptospira interrogans serovar lai str. 56601
cuaugucgaaaugguuccgaua

SEQ ID NO: 2797144 - RNA, 15 nt, Leptospira interrogans serovar lai str. 56601
cuauguuucuugugu

SEQ ID NO: 2797145 - RNA, 18 nt, Leptospira interrogans serovar lai str. 56601
cuauguuucuugugucaa

SEQ ID NO: 2797146 - RNA, 11 nt, Leptospira interrogans serovar lai str. 56601
cuauuaagaau

SEQ ID NO: 2797147 - RNA, 14 nt, Leptospira interrogans serovar lai str. 56601
cuauuacaaaacuu

SEQ ID NO: 2797148 - RNA, 12 nt, Leptospira interrogans serovar lai str. 56601
cuauuacaaaau

SEQ ID NO: 2797149 - RNA, 18 nt, Leptospira interrogans serovar lai str. 56601
cuauuacaaaaucugaau

SEQ ID NO: 2797150 - RNA, 15 nt, Leptospira interrogans serovar lai str. 56601
cuauuacguaaugug

SEQ ID NO: 2797151 - RNA, 16 nt, Leptospira interrogans serovar lai str. 56601
cuauuacuuuuuaaac

SEQ ID NO: 2797152 - RNA, 19 nt, Leptospira interrogans serovar lai str. 56601
cuauuaggaaauacaaaaa

SEQ ID NO: 2797153 - RNA, 23 nt, Leptospira interrogans serovar lai str. 56601
cuauuaggaaauacaaaaagaau

SEQ ID NO: 2797154 - RNA, 14 nt, Leptospira interrogans serovar lai str. 56601
cuauuaucuuucga

SEQ ID NO: 2797155 - RNA, 17 nt, Leptospira interrogans serovar lai str. 56601
cuauucaguuuccacuc

SEQ ID NO: 2797156 - RNA, 17 nt, Leptospira interrogans serovar lai str. 56601
cuauucauaaaugauaa

SEQ ID NO: 2797157 - RNA, 20 nt, Leptospira interrogans serovar lai str. 56601
cuauuccguacuguuuuuga

SEQ ID NO: 2797158 - RNA, 20 nt, Leptospira interrogans serovar lai str. 56601
cuauucuauuaguuuuuaug

SEQ ID NO: 2797159 - RNA, 17 nt, Leptospira interrogans serovar lai str. 56601
cuauucucguuucuaau

SEQ ID NO: 2797160 - RNA, 22 nt, Leptospira interrogans serovar lai str. 56601
cuauugaaacaaaaaugagaau

SEQ ID NO: 2797161 - RNA, 17 nt, Leptospira interrogans serovar lai str. 56601
cuauugcagauaaguaa

SEQ ID NO: 2797162 - RNA, 16 nt, Leptospira interrogans serovar lai str. 56601
cuauuuaauuuuguag

SEQ ID NO: 2797163 - RNA, 21 nt, Leptospira interrogans serovar lai str. 56601
cuauuuauaaaauaaaaaaau

SEQ ID NO: 2797164 - RNA, 14 nt, Leptospira interrogans serovar lai str. 56601
cuauuucccaaaau

SEQ ID NO: 2797165 - RNA, 15 nt, Leptospira interrogans serovar lai str. 56601
cuauuucccaaaauu

SEQ ID NO: 2797166 - RNA, 16 nt, Leptospira interrogans serovar lai str. 56601
cuauuucccaaaauuu

SEQ ID NO: 2797167 - RNA, 16 nt, Leptospira interrogans serovar lai str. 56601
cuauuucuuccagaga

SEQ ID NO: 2797168 - RNA, 16 nt, Leptospira interrogans serovar lai str. 56601
cuauuuggauuuuaua

SEQ ID NO: 2797169 - RNA, 16 nt, Leptospira interrogans serovar lai str. 56601
cuauuuuaauggaaau

SEQ ID NO: 2797170 - RNA, 12 nt, Leptospira interrogans serovar lai str. 56601
cuauuuuauaaa

SEQ ID NO: 2797171 - RNA, 12 nt, Leptospira interrogans serovar lai str. 56601
cuauuuuauacu

SEQ ID NO: 2797172 - RNA, 17 nt, Leptospira interrogans serovar lai str. 56601
cuauuuuauuacaauuu

SEQ ID NO: 2797173 - RNA, 20 nt, Leptospira interrogans serovar lai str. 56601
cuauuuucagaaaaaugaau

SEQ ID NO: 2797174 - RNA, 18 nt, Leptospira interrogans serovar lai str. 56601
cuauuuucuuugaaaaaa

SEQ ID NO: 2797175 - RNA, 19 nt, Leptospira interrogans serovar lai str. 56601
cuauuuucuuugaaaaaau

SEQ ID NO: 2797176 - RNA, 20 nt, Leptospira interrogans serovar lai str. 56601
cuauuuucuuugaaaaaauu

SEQ ID NO: 2797177 - RNA, 18 nt, Leptospira interrogans serovar lai str. 56601
cuauuuuuuuaaaaaauu

SEQ ID NO: 2797178 - RNA, 22 nt, Leptospira interrogans serovar lai str. 56601
cuauuuuuuuaaaaaauuucuu

SEQ ID NO: 2797179 - RNA, 14 nt, Leptospira interrogans serovar lai str. 56601
cucaaaaaaaguaa

SEQ ID NO: 2797180 - RNA, 14 nt, Leptospira interrogans serovar lai str. 56601
cucaaaaaauuuua

SEQ ID NO: 2797181 - RNA, 14 nt, Leptospira interrogans serovar lai str. 56601
cucaaaaaauuuuu

SEQ ID NO: 2797182 - RNA, 21 nt, Leptospira interrogans serovar lai str. 56601
cucaaaaaggcacauuuuuca

SEQ ID NO: 2797183 - RNA, 22 nt, Leptospira interrogans serovar lai str. 56601
cucaaaaaggcacauuuuucaa

SEQ ID NO: 2797184 - RNA, 14 nt, Leptospira interrogans serovar lai str. 56601
cucaaaauacuuua

SEQ ID NO: 2797185 - RNA, 13 nt, Leptospira interrogans serovar lai str. 56601
cucaaaaucuuaa

SEQ ID NO: 2797186 - RNA, 21 nt, Leptospira interrogans serovar lai str. 56601
cuccuucucucguauaacgaa

SEQ ID NO: 2797187 - RNA, 23 nt, Leptospira interrogans serovar lai str. 56601
cuccuuuagagugaauuuguaau

SEQ ID NO: 2797188 - RNA, 20 nt, Leptospira interrogans serovar lai str. 56601
cuccuuuuucaaaauaagaa

SEQ ID NO: 2797189 - RNA, 19 nt, Leptospira interrogans serovar lai str. 56601
cucgaacgcaugaaaauaa

SEQ ID NO: 2797190 - RNA, 18 nt, Leptospira interrogans serovar lai str. 56601
cucgaacuucguuggaaa

SEQ ID NO: 2797191 - RNA, 16 nt, Leptospira interrogans serovar lai str. 56601
cucgaaguaacucagc

SEQ ID NO: 2797192 - RNA, 24 nt, Leptospira interrogans serovar lai str. 56601
cucgaauuuauauaguaaauaccu

SEQ ID NO: 2797193 - RNA, 13 nt, Leptospira interrogans serovar lai str. 56601
cucgacaaaacac

SEQ ID NO: 2797194 - RNA, 17 nt, Leptospira interrogans serovar lai str. 56601
cucgacaaucaaaacuu

SEQ ID NO: 2797195 - RNA, 20 nt, Leptospira interrogans serovar lai str. 56601
cucgacaaucaaaacuuuuu

SEQ ID NO: 2797196 - RNA, 17 nt, Leptospira interrogans serovar lai str. 56601
cucgauagaacaaucuc

SEQ ID NO: 2797197 - RNA, 20 nt, Leptospira interrogans serovar lai str. 56601
cucgcaacggauuccuccag

SEQ ID NO: 2797198 - RNA, 14 nt, Leptospira interrogans serovar lai str. 56601
cucgcaaugaaaau

SEQ ID NO: 2797199 - RNA, 14 nt, Leptospira interrogans serovar lai str. 56601
cucgcauuuuccuu

SEQ ID NO: 2797200 - RNA, 22 nt, Leptospira interrogans serovar lai str. 56601
cucgcguucauaucccaauaag

SEQ ID NO: 2797201 - RNA, 14 nt, Leptospira interrogans serovar lai str. 56601
cucgggaaaaaauu

SEQ ID NO: 2797202 - RNA, 13 nt, Leptospira interrogans serovar lai str. 56601
cucgguaaaaaga

SEQ ID NO: 2797203 - RNA, 15 nt, Leptospira interrogans serovar lai str. 56601
cucgguguaaaaaaa

SEQ ID NO: 2797204 - RNA, 18 nt, Leptospira interrogans serovar lai str. 56601
cucguacuaauucuuuug

SEQ ID NO: 2797205 - RNA, 19 nt, Leptospira interrogans serovar lai str. 56601
cucguauugaauuuuuucg

SEQ ID NO: 2797206 - RNA, 21 nt, Leptospira interrogans serovar lai str. 56601
cucgugcaaagguucucccaa

SEQ ID NO: 2797207 - RNA, 21 nt, Leptospira interrogans serovar lai str. 56601
cucguuugaauuugaggagaa

SEQ ID NO: 2797208 - RNA, 14 nt, Leptospira interrogans serovar lai str. 56601
cucguuuuuaggau

SEQ ID NO: 2797209 - RNA, 12 nt, Leptospira interrogans serovar lai str. 56601
cucuaaaucuua

SEQ ID NO: 2797210 - RNA, 20 nt, Leptospira interrogans serovar lai str. 56601
cucuaagcuuuagaaaauaa

SEQ ID NO: 2797211 - RNA, 13 nt, Leptospira interrogans serovar lai str. 56601
cucuaauguacaa

SEQ ID NO: 2797212 - RNA, 23 nt, Leptospira interrogans serovar lai str. 56601
cucuaauguacaacauccuucaa

SEQ ID NO: 2797213 - RNA, 18 nt, Leptospira interrogans serovar lai str. 56601
cucuaauguaggaacuau

SEQ ID NO: 2797214 - RNA, 18 nt, Leptospira interrogans serovar lai str. 56601
cucuaauuuuuuauuuuu

SEQ ID NO: 2797215 - RNA, 18 nt, Leptospira interrogans serovar lai str. 56601
cucuaccuuuauuuaaaa

SEQ ID NO: 2797216 - RNA, 15 nt, Leptospira interrogans serovar lai str. 56601
cucuacggaucgcgu

SEQ ID NO: 2797217 - RNA, 17 nt, Leptospira interrogans serovar lai str. 56601
cucuacgguuaucaaua

SEQ ID NO: 2797218 - RNA, 14 nt, Leptospira interrogans serovar lai str. 56601
cucuacucuugaag

SEQ ID NO: 2797219 - RNA, 17 nt, Leptospira interrogans serovar lai str. 56601
cucuaguaaagaaacuc

SEQ ID NO: 2797220 - RNA, 13 nt, Leptospira interrogans serovar lai str. 56601
cucuauaaaauca

SEQ ID NO: 2797221 - RNA, 20 nt, Leptospira interrogans serovar lai str. 56601
cucuauaaaaucuaaaaaaa

SEQ ID NO: 2797222 - RNA, 14 nt, Leptospira interrogans serovar lai str. 56601
cucuauaaaauuaa

SEQ ID NO: 2797223 - RNA, 20 nt, Leptospira interrogans serovar lai str. 56601
cucuaugaaacuuaguuccu

SEQ ID NO: 2797224 - RNA, 21 nt, Leptospira interrogans serovar lai str. 56601
cucuauuauauaguuaucagu

SEQ ID NO: 2797225 - RNA, 14 nt, Leptospira interrogans serovar lai str. 56601
cucuauuauuauuu

SEQ ID NO: 2797226 - RNA, 22 nt, Leptospira interrogans serovar lai str. 56601
cucuauucauaaaugauaauaa

SEQ ID NO: 2797227 - RNA, 13 nt, Leptospira interrogans serovar lai str. 56601
cucucaaacucag

SEQ ID NO: 2797228 - RNA, 16 nt, Leptospira interrogans serovar lai str. 56601
cucucaaauucuucag

SEQ ID NO: 2797229 - RNA, 15 nt, Leptospira interrogans serovar lai str. 56601
cucuccaucuuuuuu

SEQ ID NO: 2797230 - RNA, 20 nt, Leptospira interrogans serovar lai str. 56601
cucuccuauguuucuugugu

SEQ ID NO: 2797231 - RNA, 18 nt, Leptospira interrogans serovar lai str. 56601
cucuccuuuuuuauuuua

SEQ ID NO: 2797232 - RNA, 23 nt, Leptospira interrogans serovar lai str. 56601
cucuccuuuuuuauuuuaacaga

SEQ ID NO: 2797233 - RNA, 19 nt, Leptospira interrogans serovar lai str. 56601
cucucguaauaucuaaaac

SEQ ID NO: 2797234 - RNA, 18 nt, Leptospira interrogans serovar lai str. 56601
cucucguauaacgaaacu

SEQ ID NO: 2797235 - RNA, 19 nt, Leptospira interrogans serovar lai str. 56601
cucucuacggaucgcguuu

SEQ ID NO: 2797236 - RNA, 13 nt, Leptospira interrogans serovar lai str. 56601
cucugaaguaucu

SEQ ID NO: 2797237 - RNA, 12 nt, Leptospira interrogans serovar lai str. 56601
cucugaauucac

SEQ ID NO: 2797238 - RNA, 17 nt, Leptospira interrogans serovar lai str. 56601
cucugaguagaaaguua

SEQ ID NO: 2797239 - RNA, 16 nt, Leptospira interrogans serovar lai str. 56601
cucugauaauuuuuua

SEQ ID NO: 2797240 - RNA, 19 nt, Leptospira interrogans serovar lai str. 56601
cucugauaauuuuuuaaaa

SEQ ID NO: 2797241 - RNA, 20 nt, Leptospira interrogans serovar lai str. 56601
cucugauaauuuuuuaaaaa

SEQ ID NO: 2797242 - RNA, 21 nt, Leptospira interrogans serovar lai str. 56601
cucugauaauuuuuuaaaaaa

SEQ ID NO: 2797243 - RNA, 22 nt, Leptospira interrogans serovar lai str. 56601
cucugauaauuuuuuaaaaaaa

SEQ ID NO: 2797244 - RNA, 22 nt, Leptospira interrogans serovar lai str. 56601
cucugcaucgaucccuuuugca

SEQ ID NO: 2797245 - RNA, 17 nt, Leptospira interrogans serovar lai str. 56601
cucuggucaaguuauug

SEQ ID NO: 2797246 - RNA, 13 nt, Leptospira interrogans serovar lai str. 56601
cucuguucagugu

SEQ ID NO: 2797247 - RNA, 13 nt, Leptospira interrogans serovar lai str. 56601
cucuuaaaauuua

SEQ ID NO: 2797248 - RNA, 18 nt, Leptospira interrogans serovar lai str. 56601
cucuuaaguugaguucuu

SEQ ID NO: 2797249 - RNA, 14 nt, Leptospira interrogans serovar lai str. 56601
cucuuaauggauca

SEQ ID NO: 2797250 - RNA, 12 nt, Leptospira interrogans serovar lai str. 56601
cucuuacauuuu

SEQ ID NO: 2797251 - RNA, 15 nt, Leptospira interrogans serovar lai str. 56601
cucuuacauuuugag

SEQ ID NO: 2797252 - RNA, 19 nt, Leptospira interrogans serovar lai str. 56601
cucuuacgcaugauaaaaa

SEQ ID NO: 2797253 - RNA, 20 nt, Leptospira interrogans serovar lai str. 56601
cucuuagccccaguaaauaa

SEQ ID NO: 2797254 - RNA, 13 nt, Leptospira interrogans serovar lai str. 56601
cucuuauaaaauu

SEQ ID NO: 2797255 - RNA, 23 nt, Leptospira interrogans serovar lai str. 56601
cucuuauaaaauuuuagauacgu

SEQ ID NO: 2797256 - RNA, 20 nt, Leptospira interrogans serovar lai str. 56601
cucuuauuuauauuucuaaa

SEQ ID NO: 2797257 - RNA, 20 nt, Leptospira interrogans serovar lai str. 56601
cucuuccgguggauuuuuuu

SEQ ID NO: 2797258 - RNA, 18 nt, Leptospira interrogans serovar lai str. 56601
cucuucgucucaccaaca

SEQ ID NO: 2797259 - RNA, 17 nt, Leptospira interrogans serovar lai str. 56601
cucuucuaauucaguuu

SEQ ID NO: 2797260 - RNA, 18 nt, Leptospira interrogans serovar lai str. 56601
cucuugcgguucuugcuu

SEQ ID NO: 2797261 - RNA, 18 nt, Leptospira interrogans serovar lai str. 56601
cucuugcuaaaauuuuuu

SEQ ID NO: 2797262 - RNA, 19 nt, Leptospira interrogans serovar lai str. 56601
cucuugcuaaaauuuuuuu

SEQ ID NO: 2797263 - RNA, 20 nt, Leptospira interrogans serovar lai str. 56601
cucuuguaguucaauagaau

SEQ ID NO: 2797264 - RNA, 11 nt, Leptospira interrogans serovar lai str. 56601
cucuuuaaaaa

SEQ ID NO: 2797265 - RNA, 22 nt, Leptospira interrogans serovar lai str. 56601
cucuuuaagagucauuuuuaaa

SEQ ID NO: 2797266 - RNA, 16 nt, Leptospira interrogans serovar lai str. 56601
cucuuugaaaucucua

SEQ ID NO: 2797267 - RNA, 15 nt, Leptospira interrogans serovar lai str. 56601
cucuuugagaaccga

SEQ ID NO: 2797268 - RNA, 17 nt, Leptospira interrogans serovar lai str. 56601
cucuuuuacgacuuuau

SEQ ID NO: 2797269 - RNA, 14 nt, Leptospira interrogans serovar lai str. 56601
cugcuuuuuuaaac

SEQ ID NO: 2797270 - RNA, 13 nt, Leptospira interrogans serovar lai str. 56601
cuggaaaaauucc

SEQ ID NO: 2797271 - RNA, 16 nt, Leptospira interrogans serovar lai str. 56601
cuggaaaaauuccuaa

SEQ ID NO: 2797272 - RNA, 12 nt, Leptospira interrogans serovar lai str. 56601
cuggaaaagaau

SEQ ID NO: 2797273 - RNA, 21 nt, Leptospira interrogans serovar lai str. 56601
cuggaaaagaaucguuuuuuu

SEQ ID NO: 2797274 - RNA, 18 nt, Leptospira interrogans serovar lai str. 56601
cuggaaaaguuuuuaaaa

SEQ ID NO: 2797275 - RNA, 17 nt, Leptospira interrogans serovar lai str. 56601
cuggaauauucuuuuua

SEQ ID NO: 2797276 - RNA, 15 nt, Leptospira interrogans serovar lai str. 56601
cuggaauucuuuuuu

SEQ ID NO: 2797277 - RNA, 17 nt, Leptospira interrogans serovar lai str. 56601
cuggauaggauuccauu

SEQ ID NO: 2797278 - RNA, 20 nt, Leptospira interrogans serovar lai str. 56601
cuggaugaagcuaugaagag

SEQ ID NO: 2797279 - RNA, 16 nt, Leptospira interrogans serovar lai str. 56601
cugggaucggaaccaa

SEQ ID NO: 2797280 - RNA, 22 nt, Leptospira interrogans serovar lai str. 56601
cugguuucaaaaaaucgacuuu

SEQ ID NO: 2797281 - RNA, 15 nt, Leptospira interrogans serovar lai str. 56601
cugguuuuauuucug

SEQ ID NO: 2797282 - RNA, 17 nt, Leptospira interrogans serovar lai str. 56601
cugguuuuauuucugcu

SEQ ID NO: 2797283 - RNA, 20 nt, Leptospira interrogans serovar lai str. 56601
cugguuuuauuucugcugcu

SEQ ID NO: 2797284 - RNA, 13 nt, Leptospira interrogans serovar lai str. 56601
cuguaaaaaauaa

SEQ ID NO: 2797285 - RNA, 14 nt, Leptospira interrogans serovar lai str. 56601
cuguaaaagaaaaa

SEQ ID NO: 2797286 - RNA, 17 nt, Leptospira interrogans serovar lai str. 56601
cuguaaaaguuuuugaa

SEQ ID NO: 2797287 - RNA, 19 nt, Leptospira interrogans serovar lai str. 56601
cuguaaaauaaauuuauaa

SEQ ID NO: 2797288 - RNA, 23 nt, Leptospira interrogans serovar lai str. 56601
cuguaaaauaaauuuauaauuca

SEQ ID NO: 2797289 - RNA, 22 nt, Leptospira interrogans serovar lai str. 56601
cuguaaaaugaugugggaacuc

SEQ ID NO: 2797290 - RNA, 13 nt, Leptospira interrogans serovar lai str. 56601
cuguaaacuugau

SEQ ID NO: 2797291 - RNA, 22 nt, Leptospira interrogans serovar lai str. 56601
cuguaaaguuuagauuuuaacu

SEQ ID NO: 2797292 - RNA, 17 nt, Leptospira interrogans serovar lai str. 56601
cuguaaauacaaaauga

SEQ ID NO: 2797293 - RNA, 15 nt, Leptospira interrogans serovar lai str. 56601
cuguaaauucaaaau

SEQ ID NO: 2797294 - RNA, 17 nt, Leptospira interrogans serovar lai str. 56601
cuguaaauucaaagcaa

SEQ ID NO: 2797295 - RNA, 22 nt, Leptospira interrogans serovar lai str. 56601
cuguaacauccaaacucuuaau

SEQ ID NO: 2797296 - RNA, 19 nt, Leptospira interrogans serovar lai str. 56601
cuguaagauuucguucgga

SEQ ID NO: 2797297 - RNA, 23 nt, Leptospira interrogans serovar lai str. 56601
cuguagaaauucuauuuuauuga

SEQ ID NO: 2797298 - RNA, 19 nt, Leptospira interrogans serovar lai str. 56601
cuguagaaccuggauuugu

SEQ ID NO: 2797299 - RNA, 14 nt, Leptospira interrogans serovar lai str. 56601
cuguagcucaaggu

SEQ ID NO: 2797300 - RNA, 14 nt, Leptospira interrogans serovar lai str. 56601
cuguaucauagaau

SEQ ID NO: 2797301 - RNA, 22 nt, Leptospira interrogans serovar lai str. 56601
cugucaguagguuuuuaauuuc

SEQ ID NO: 2797302 - RNA, 14 nt, Leptospira interrogans serovar lai str. 56601
cugucccaaaaucu

SEQ ID NO: 2797303 - RNA, 20 nt, Leptospira interrogans serovar lai str. 56601
cugucucuuuauauaaaauu

SEQ ID NO: 2797304 - RNA, 22 nt, Leptospira interrogans serovar lai str. 56601
cugucuucagcagucugugauu

SEQ ID NO: 2797305 - RNA, 13 nt, Leptospira interrogans serovar lai str. 56601
cugugaaacucag

SEQ ID NO: 2797306 - RNA, 19 nt, Leptospira interrogans serovar lai str. 56601
cugugaucagaauuaaaaa

SEQ ID NO: 2797307 - RNA, 19 nt, Leptospira interrogans serovar lai str. 56601
cugugggaacuaucacaaa

SEQ ID NO: 2797308 - RNA, 13 nt, Leptospira interrogans serovar lai str. 56601
cuguuaauuuuua

SEQ ID NO: 2797309 - RNA, 20 nt, Leptospira interrogans serovar lai str. 56601
cuguuaauuuuuauuggaaa

SEQ ID NO: 2797310 - RNA, 17 nt, Leptospira interrogans serovar lai str. 56601
cuguuauccgauuuuug

SEQ ID NO: 2797311 - RNA, 21 nt, Leptospira interrogans serovar lai str. 56601
cuguuauccgauuuuuguuuu

SEQ ID NO: 2797312 - RNA, 18 nt, Leptospira interrogans serovar lai str. 56601
cuguucuuagucuaaaaa

SEQ ID NO: 2797313 - RNA, 18 nt, Leptospira interrogans serovar lai str. 56601
cuguugaguucauucuga

SEQ ID NO: 2797314 - RNA, 21 nt, Leptospira interrogans serovar lai str. 56601
cuguugaguucauucugauuc

SEQ ID NO: 2797315 - RNA, 17 nt, Leptospira interrogans serovar lai str. 56601
cuguuguuauagaugaa

SEQ ID NO: 2797316 - RNA, 15 nt, Leptospira interrogans serovar lai str. 56601
cuguuuaauaaagau

SEQ ID NO: 2797317 - RNA, 20 nt, Leptospira interrogans serovar lai str. 56601
cuguuucuuacucgacaaaa

SEQ ID NO: 2797318 - RNA, 19 nt, Leptospira interrogans serovar lai str. 56601
cuguuuuguggucaacauc

SEQ ID NO: 2797319 - RNA, 17 nt, Leptospira interrogans serovar lai str. 56601
cuguuuuguuuccuucu

SEQ ID NO: 2797320 - RNA, 13 nt, Leptospira interrogans serovar lai str. 56601
cuguuuuugaaac

SEQ ID NO: 2797321 - RNA, 12 nt, Leptospira interrogans serovar lai str. 56601
cuuaaaaaaauu

SEQ ID NO: 2797322 - RNA, 20 nt, Leptospira interrogans serovar lai str. 56601
cuuaaaaacuugaaucgagc

SEQ ID NO: 2797323 - RNA, 11 nt, Leptospira interrogans serovar lai str. 56601
cuuaaaaauac

SEQ ID NO: 2797324 - RNA, 14 nt, Leptospira interrogans serovar lai str. 56601
cuuaaaaauuuaua

SEQ ID NO: 2797325 - RNA, 19 nt, Leptospira interrogans serovar lai str. 56601
cuuaaaaguauccaucgua

SEQ ID NO: 2797326 - RNA, 13 nt, Leptospira interrogans serovar lai str. 56601
cuuaaaagugauu

SEQ ID NO: 2797327 - RNA, 15 nt, Leptospira interrogans serovar lai str. 56601
cuuaaaauguaggaa

SEQ ID NO: 2797328 - RNA, 15 nt, Leptospira interrogans serovar lai str. 56601
cuuaaaaugugggaa

SEQ ID NO: 2797329 - RNA, 15 nt, Leptospira interrogans serovar lai str. 56601
cuuaaaauuuagaaa

SEQ ID NO: 2797330 - RNA, 18 nt, Leptospira interrogans serovar lai str. 56601
cuuaaagcauuaaaaaag

SEQ ID NO: 2797331 - RNA, 19 nt, Leptospira interrogans serovar lai str. 56601
cuuaaagcauuaaaaaaga

SEQ ID NO: 2797332 - RNA, 13 nt, Leptospira interrogans serovar lai str. 56601
cuuaaauauaucu

SEQ ID NO: 2797333 - RNA, 23 nt, Leptospira interrogans serovar lai str. 56601
cuuaaauaucgaauuucuucaua

SEQ ID NO: 2797334 - RNA, 19 nt, Leptospira interrogans serovar lai str. 56601
cuuaaaucuuagauucacu

SEQ ID NO: 2797335 - RNA, 22 nt, Leptospira interrogans serovar lai str. 56601
cuuaaaucuuagauucacuuuu

SEQ ID NO: 2797336 - RNA, 17 nt, Leptospira interrogans serovar lai str. 56601
cuuaaaucuuuaaaaua

SEQ ID NO: 2797337 - RNA, 20 nt, Leptospira interrogans serovar lai str. 56601
cuuaaaucuuuaaaauacuu

SEQ ID NO: 2797338 - RNA, 15 nt, Leptospira interrogans serovar lai str. 56601
cuuaaauucuaauug

SEQ ID NO: 2797339 - RNA, 15 nt, Leptospira interrogans serovar lai str. 56601
cuuaaauuuuuuuuc

SEQ ID NO: 2797340 - RNA, 15 nt, Leptospira interrogans serovar lai str. 56601
cuuaagaauugaucu

SEQ ID NO: 2797341 - RNA, 19 nt, Leptospira interrogans serovar lai str. 56601
cuuaagacccuaaaaaauu

SEQ ID NO: 2797342 - RNA, 20 nt, Leptospira interrogans serovar lai str. 56601
cuuaagacccuaaaaaauuu

SEQ ID NO: 2797343 - RNA, 22 nt, Leptospira interrogans serovar lai str. 56601
cuuaagagaaccucuauaaaau

SEQ ID NO: 2797344 - RNA, 18 nt, Leptospira interrogans serovar lai str. 56601
cuuaagauagccuaauuu

SEQ ID NO: 2797345 - RNA, 21 nt, Leptospira interrogans serovar lai str. 56601
cuuaagauagccuaauuuacu

SEQ ID NO: 2797346 - RNA, 17 nt, Leptospira interrogans serovar lai str. 56601
cuuaagcucuaauauuu

SEQ ID NO: 2797347 - RNA, 20 nt, Leptospira interrogans serovar lai str. 56601
cuuaaguuugucuguaaaau

SEQ ID NO: 2797348 - RNA, 17 nt, Leptospira interrogans serovar lai str. 56601
cuuaaucugcugaauuu

SEQ ID NO: 2797349 - RNA, 19 nt, Leptospira interrogans serovar lai str. 56601
cuuaaucugugggaacuau

SEQ ID NO: 2797350 - RNA, 19 nt, Leptospira interrogans serovar lai str. 56601
cuuaauguaaaguucuuuu

SEQ ID NO: 2797351 - RNA, 21 nt, Leptospira interrogans serovar lai str. 56601
cuuaauguaaaguucuuuucu

SEQ ID NO: 2797352 - RNA, 17 nt, Leptospira interrogans serovar lai str. 56601
cuuuaagaucauuuaaa

SEQ ID NO: 2797353 - RNA, 20 nt, Leptospira interrogans serovar lai str. 56601
cuuuaagcaaagauuaagua

SEQ ID NO: 2797354 - RNA, 12 nt, Leptospira interrogans serovar lai str. 56601
cuuuaauaauau

SEQ ID NO: 2797355 - RNA, 21 nt, Leptospira interrogans serovar lai str. 56601
cuuuaaucauuuucaauuuuu

SEQ ID NO: 2797356 - RNA, 22 nt, Leptospira interrogans serovar lai str. 56601
cuuuaaugcugauuuuucuuua

SEQ ID NO: 2797357 - RNA, 21 nt, Leptospira interrogans serovar lai str. 56601
cuuuaaugcuucauauaauaa

SEQ ID NO: 2797358 - RNA, 20 nt, Leptospira interrogans serovar lai str. 56601
cuuuaauuacaguuaauaaa

SEQ ID NO: 2797359 - RNA, 14 nt, Leptospira interrogans serovar lai str. 56601
cuuuaauuucaaua

SEQ ID NO: 2797360 - RNA, 20 nt, Leptospira interrogans serovar lai str. 56601
cuuuaauuucaauaacuuga

SEQ ID NO: 2797361 - RNA, 17 nt, Leptospira interrogans serovar lai str. 56601
cuuuacaauaaaaauua

SEQ ID NO: 2797362 - RNA, 20 nt, Leptospira interrogans serovar lai str. 56601
cuuuacacgauaauuuuuag

SEQ ID NO: 2797363 - RNA, 22 nt, Leptospira interrogans serovar lai str. 56601
cuuuacagacugauuuuuuaaa

SEQ ID NO: 2797364 - RNA, 22 nt, Leptospira interrogans serovar lai str. 56601
cuuuacagaucaauucuuuaaa

SEQ ID NO: 2797365 - RNA, 15 nt, Leptospira interrogans serovar lai str. 56601
cuuuacaguuuuuaa

SEQ ID NO: 2797366 - RNA, 12 nt, Leptospira interrogans serovar lai str. 56601
cuuuacauuuuu

SEQ ID NO: 2797367 - RNA, 19 nt, Leptospira interrogans serovar lai str. 56601
cuuuaccauaaauuuuuug

SEQ ID NO: 2797368 - RNA, 21 nt, Leptospira interrogans serovar lai str. 56601
cuuuaccggguuccauucuaa

SEQ ID NO: 2797369 - RNA, 22 nt, Leptospira interrogans serovar lai str. 56601
cuuuaccggguuccauucuaag

SEQ ID NO: 2797370 - RNA, 19 nt, Leptospira interrogans serovar lai str. 56601
cuuuaccgucaauuuuuag

SEQ ID NO: 2797371 - RNA, 18 nt, Leptospira interrogans serovar lai str. 56601
cuuuacgaaaguugaaag

SEQ ID NO: 2797372 - RNA, 15 nt, Leptospira interrogans serovar lai str. 56601
cuuuacguauguauu

SEQ ID NO: 2797373 - RNA, 11 nt, Leptospira interrogans serovar lai str. 56601
cuuuagaaaaa

SEQ ID NO: 2797374 - RNA, 14 nt, Leptospira interrogans serovar lai str. 56601
cuuuagaaaaauau

SEQ ID NO: 2797375 - RNA, 12 nt, Leptospira interrogans serovar lai str. 56601
cuuuagaaauuu

SEQ ID NO: 2797376 - RNA, 15 nt, Leptospira interrogans serovar lai str. 56601
cuuuagaaauuucua

SEQ ID NO: 2797377 - RNA, 15 nt, Leptospira interrogans serovar lai str. 56601
cuuuagaaauuuuua

SEQ ID NO: 2797378 - RNA, 18 nt, Leptospira interrogans serovar lai str. 56601
cuuuagaaauuuuuaaua

SEQ ID NO: 2797379 - RNA, 16 nt, Leptospira interrogans serovar lai str. 56601
cuuuagacauuguuuu

SEQ ID NO: 2797380 - RNA, 13 nt, Leptospira interrogans serovar lai str. 56601
cuuuaguuugaaa

SEQ ID NO: 2797381 - RNA, 21 nt, Leptospira interrogans serovar lai str. 56601
cuuuauaaaaguauaauauuu

SEQ ID NO: 2797382 - RNA, 18 nt, Leptospira interrogans serovar lai str. 56601
cuuuauaauugaacauuu

SEQ ID NO: 2797383 - RNA, 23 nt, Leptospira interrogans serovar lai str. 56601
cuuuauaauugaacauuuuuaaa

SEQ ID NO: 2797384 - RNA, 17 nt, Leptospira interrogans serovar lai str. 56601
cuuuauagaucgauucu

SEQ ID NO: 2797385 - RNA, 15 nt, Leptospira interrogans serovar lai str. 56601
cuuuauauaaaauuu

SEQ ID NO: 2797386 - RNA, 13 nt, Leptospira interrogans serovar lai str. 56601
cuuuauauugguu

SEQ ID NO: 2797387 - RNA, 21 nt, Leptospira interrogans serovar lai str. 56601
cuuuaucuuuauaaaaaugau

SEQ ID NO: 2797388 - RNA, 16 nt, Leptospira interrogans serovar lai str. 56601
cuuuauuaaauuauau

SEQ ID NO: 2797389 - RNA, 18 nt, Leptospira interrogans serovar lai str. 56601
cuuuauuaaauuauauuu

SEQ ID NO: 2797390 - RNA, 19 nt, Leptospira interrogans serovar lai str. 56601
cuuuauuaaauuauauuuu

SEQ ID NO: 2797391 - RNA, 15 nt, Leptospira interrogans serovar lai str. 56601
cuuuauuaagaauuu

SEQ ID NO: 2797392 - RNA, 22 nt, Leptospira interrogans serovar lai str. 56601
cuuuauucaaaauagaauaaau

SEQ ID NO: 2797393 - RNA, 23 nt, Leptospira interrogans serovar lai str. 56601
cuuuauucaaaauagaauaaauu

SEQ ID NO: 2797394 - RNA, 16 nt, Leptospira interrogans serovar lai str. 56601
cuuuauuccuuuucuu

SEQ ID NO: 2797395 - RNA, 18 nt, Leptospira interrogans serovar lai str. 56601
cuuuauuuguauucaaga

SEQ ID NO: 2797396 - RNA, 19 nt, Leptospira interrogans serovar lai str. 56601
cuuuauuuguauucaagag

SEQ ID NO: 2797397 - RNA, 20 nt, Leptospira interrogans serovar lai str. 56601
cuuuauuuuauaauucugaa

SEQ ID NO: 2797398 - RNA, 22 nt, Leptospira interrogans serovar lai str. 56601
cuuuauuuuauaauucugaaua

SEQ ID NO: 2797399 - RNA, 14 nt, Leptospira interrogans serovar lai str. 56601
cuuucaaaaaauau

SEQ ID NO: 2797400 - RNA, 22 nt, Leptospira interrogans serovar lai str. 56601
cuuucaaagcuauaguuuuuaa

SEQ ID NO: 2797401 - RNA, 13 nt, Leptospira interrogans serovar lai str. 56601
cuuucaagaauuu

SEQ ID NO: 2797402 - RNA, 15 nt, Leptospira interrogans serovar lai str. 56601
cuuucaagaauuuau

SEQ ID NO: 2797403 - RNA, 16 nt, Leptospira interrogans serovar lai str. 56601
cuuucaagaauuuauu

SEQ ID NO: 2797404 - RNA, 16 nt, Leptospira interrogans serovar lai str. 56601
cuuucacaucuccacu

SEQ ID NO: 2797405 - RNA, 17 nt, Leptospira interrogans serovar lai str. 56601
cuuucaccagaauuuag

SEQ ID NO: 2797406 - RNA, 23 nt, Leptospira interrogans serovar lai str. 56601
cuuucagcuacaaucaauaaauu

SEQ ID NO: 2797407 - RNA, 17 nt, Leptospira interrogans serovar lai str. 56601
cuuucaucuacauaaaa

SEQ ID NO: 2797408 - RNA, 18 nt, Leptospira interrogans serovar lai str. 56601
cuuucaucucuauaaauu

SEQ ID NO: 2797409 - RNA, 23 nt, Leptospira interrogans serovar lai str. 56601
cuuuccagaaagaaguuguauca

SEQ ID NO: 2797410 - RNA, 17 nt, Leptospira interrogans serovar lai str. 56601
cuuuccgauuucuuuca

SEQ ID NO: 2797411 - RNA, 19 nt, Leptospira interrogans serovar lai str. 56601
cuuuccgauuucuuucaaa

SEQ ID NO: 2797412 - RNA, 18 nt, Leptospira interrogans serovar lai str. 56601
cuuuccuaaucuuauuca

SEQ ID NO: 2797413 - RNA, 16 nt, Leptospira interrogans serovar lai str. 56601
cuuuccuugaaaaaaa

SEQ ID NO: 2797414 - RNA, 18 nt, Leptospira interrogans serovar lai str. 56601
cuuucgaccuuaacucuu

SEQ ID NO: 2797415 - RNA, 15 nt, Leptospira interrogans serovar lai str. 56601
cuuucgauuuuaaau

SEQ ID NO: 2797416 - RNA, 19 nt, Leptospira interrogans serovar lai str. 56601
cuuucgauuuuaaauaaaa

SEQ ID NO: 2797417 - RNA, 19 nt, Leptospira interrogans serovar lai str. 56601
cuuucgcgguuuucuuuuu

SEQ ID NO: 2797418 - RNA, 11 nt, Leptospira interrogans serovar lai str. 56601
cuuucuaaucc

SEQ ID NO: 2797419 - RNA, 13 nt, Leptospira interrogans serovar lai str. 56601
cuuucuccuuccc

SEQ ID NO: 2797420 - RNA, 16 nt, Leptospira interrogans serovar lai str. 56601
cuuucucugaauucac

SEQ ID NO: 2797421 - RNA, 15 nt, Leptospira interrogans serovar lai str. 56601
cuuucucuuuuuaga

SEQ ID NO: 2797422 - RNA, 15 nt, Leptospira interrogans serovar lai str. 56601
cuuucugaaauaaaa

SEQ ID NO: 2797423 - RNA, 15 nt, Leptospira interrogans serovar lai str. 56601
cuuucuuaaauuuuu

SEQ ID NO: 2797424 - RNA, 16 nt, Leptospira interrogans serovar lai str. 56601
cuuucuuauuaauucu

SEQ ID NO: 2797425 - RNA, 17 nt, Leptospira interrogans serovar lai str. 56601
cuuucuuccaauuguuc

SEQ ID NO: 2797426 - RNA, 17 nt, Leptospira interrogans serovar lai str. 56601
cuuucuuugaacuuuuu

SEQ ID NO: 2797427 - RNA, 14 nt, Leptospira interrogans serovar lai str. 56601
cuuugaaaauugug

SEQ ID NO: 2797428 - RNA, 22 nt, Leptospira interrogans serovar lai str. 56601
cuuugaaaauugugggaacuau

SEQ ID NO: 2797429 - RNA, 14 nt, Leptospira interrogans serovar lai str. 56601
cuuugaaaauuuuu

SEQ ID NO: 2797430 - RNA, 22 nt, Leptospira interrogans serovar lai str. 56601
cuuugaaacaucacuuccauuu

SEQ ID NO: 2797431 - RNA, 23 nt, Leptospira interrogans serovar lai str. 56601
cuuugaacuuguccuaaaauuuu

SEQ ID NO: 2797432 - RNA, 15 nt, Leptospira interrogans serovar lai str. 56601
cuuugaauaaaaccg

SEQ ID NO: 2797433 - RNA, 21 nt, Leptospira interrogans serovar lai str. 56601
cuuugaaugcaacgaaaucaa

SEQ ID NO: 2797434 - RNA, 23 nt, Leptospira interrogans serovar lai str. 56601
cuuugacccauaaaaauacuuua

SEQ ID NO: 2797435 - RNA, 17 nt, Leptospira interrogans serovar lai str. 56601
cuuuuuuagaaaaagca

SEQ ID NO: 2797436 - RNA, 23 nt, Leptospira interrogans serovar lai str. 56601
cuuuuuuaucgaguguaaucuua

SEQ ID NO: 2797437 - RNA, 14 nt, Leptospira interrogans serovar lai str. 56601
cuuuuuuccuucuu

SEQ ID NO: 2797438 - RNA, 22 nt, Leptospira interrogans serovar lai str. 56601
cuuuuuuccuucuuuacaguuu

SEQ ID NO: 2797439 - RNA, 22 nt, Leptospira interrogans serovar lai str. 56601
cuuuuuucggagucauacauuu

SEQ ID NO: 2797440 - RNA, 21 nt, Leptospira interrogans serovar lai str. 56601
cuuuuuucucagucaccucua

SEQ ID NO: 2797441 - RNA, 22 nt, Leptospira interrogans serovar lai str. 56601
cuuuuuuguaaguuuugaauuu

SEQ ID NO: 2797442 - RNA, 12 nt, Leptospira interrogans serovar lai str. 56601
cuuuuuuuaaac

SEQ ID NO: 2797443 - RNA, 13 nt, Leptospira interrogans serovar lai str. 56601
cuuuuuuuaaaca

SEQ ID NO: 2797444 - RNA, 16 nt, Leptospira interrogans serovar lai str. 56601
cuuuuuuuaaacagag

SEQ ID NO: 2797445 - RNA, 19 nt, Leptospira interrogans serovar lai str. 56601
cuuuuuuuacgcggaacau

SEQ ID NO: 2797446 - RNA, 15 nt, Leptospira interrogans serovar lai str. 56601
cuuuuuuuaugaaaa

SEQ ID NO: 2797447 - RNA, 20 nt, Leptospira interrogans serovar lai str. 56601
cuuuuuuuucuaaaauauuu

SEQ ID NO: 2797448 - RNA, 16 nt, Leptospira interrogans serovar lai str. 56601
gaaaaaaaacaaagag

SEQ ID NO: 2797449 - RNA, 23 nt, Leptospira interrogans serovar lai str. 56601
gaaaaaaaguauauauuaaagua

SEQ ID NO: 2797450 - RNA, 14 nt, Leptospira interrogans serovar lai str. 56601
gaaaaaaauaacga

SEQ ID NO: 2797451 - RNA, 15 nt, Leptospira interrogans serovar lai str. 56601
gaaaaaaauuagaau

SEQ ID NO: 2797452 - RNA, 17 nt, Leptospira interrogans serovar lai str. 56601
gaaaaaacuuucuaaaa

SEQ ID NO: 2797453 - RNA, 20 nt, Leptospira interrogans serovar lai str. 56601
gaaaaaacuuucuaaaaaua

SEQ ID NO: 2797454 - RNA, 19 nt, Leptospira interrogans serovar lai str. 56601
gaaaaaagcugaacuuaaa

SEQ ID NO: 2797455 - RNA, 22 nt, Leptospira interrogans serovar lai str. 56601
gaaaaaagcugaacuuaaaauc

SEQ ID NO: 2797456 - RNA, 16 nt, Leptospira interrogans serovar lai str. 56601
gaaaaaaguuagaauc

SEQ ID NO: 2797457 - RNA, 16 nt, Leptospira interrogans serovar lai str. 56601
gaaaaaaguuagaauu

SEQ ID NO: 2797458 - RNA, 12 nt, Leptospira interrogans serovar lai str. 56601
gaaaaaaguugc

SEQ ID NO: 2797459 - RNA, 17 nt, Leptospira interrogans serovar lai str. 56601
gaaaaaaguuggaauuu

SEQ ID NO: 2797460 - RNA, 14 nt, Leptospira interrogans serovar lai str. 56601
gaaaaaauaacaau

SEQ ID NO: 2797461 - RNA, 12 nt, Leptospira interrogans serovar lai str. 56601
gaaaaaauguaa

SEQ ID NO: 2797462 - RNA, 11 nt, Leptospira interrogans serovar lai str. 56601
gaaaaaauuca

SEQ ID NO: 2797463 - RNA, 12 nt, Leptospira interrogans serovar lai str. 56601
gaaaaacauacu

SEQ ID NO: 2797464 - RNA, 22 nt, Leptospira interrogans serovar lai str. 56601
gaaaaacggugcuuuguucaaa

SEQ ID NO: 2797465 - RNA, 17 nt, Leptospira interrogans serovar lai str. 56601
gaaaaacuuuucuaaaa

SEQ ID NO: 2797466 - RNA, 21 nt, Leptospira interrogans serovar lai str. 56601
gaaaaacuuuucuaaaaguau

SEQ ID NO: 2797467 - RNA, 11 nt, Leptospira interrogans serovar lai str. 56601
gaaaaagaaac

SEQ ID NO: 2797468 - RNA, 15 nt, Leptospira interrogans serovar lai str. 56601
gaaaaagaaacggaa

SEQ ID NO: 2797469 - RNA, 22 nt, Leptospira interrogans serovar lai str. 56601
gaaaaagguuggaaucuaaacu

SEQ ID NO: 2797470 - RNA, 16 nt, Leptospira interrogans serovar lai str. 56601
gaaaaaguccuuuuga

SEQ ID NO: 2797471 - RNA, 15 nt, Leptospira interrogans serovar lai str. 56601
gaaaaaguuagaauc

SEQ ID NO: 2797472 - RNA, 20 nt, Leptospira interrogans serovar lai str. 56601
gaaaaaguuagaaucugaac

SEQ ID NO: 2797473 - RNA, 21 nt, Leptospira interrogans serovar lai str. 56601
gaaaaaguuggaaucuaaacu

SEQ ID NO: 2797474 - RNA, 21 nt, Leptospira interrogans serovar lai str. 56601
gaaaaaucagguuuuauaaag

SEQ ID NO: 2797475 - RNA, 15 nt, Leptospira interrogans serovar lai str. 56601
gaaaaaugaaaggua

SEQ ID NO: 2797476 - RNA, 11 nt, Leptospira interrogans serovar lai str. 56601
gaaaaaugaau

SEQ ID NO: 2797477 - RNA, 18 nt, Leptospira interrogans serovar lai str. 56601
gaaaaaugaaucaugaau

SEQ ID NO: 2797478 - RNA, 14 nt, Leptospira interrogans serovar lai str. 56601
gaaaaaugaauucc

SEQ ID NO: 2797479 - RNA, 20 nt, Leptospira interrogans serovar lai str. 56601
gaaaaauguuaaaaaacuau

SEQ ID NO: 2797480 - RNA, 21 nt, Leptospira interrogans serovar lai str. 56601
gaaaaauuaaaauucuagaaa

SEQ ID NO: 2797481 - RNA, 15 nt, Leptospira interrogans serovar lai str. 56601
gaaaaauuaauuccu

SEQ ID NO: 2797482 - RNA, 13 nt, Leptospira interrogans serovar lai str. 56601
gaaaaauuccacu

SEQ ID NO: 2797483 - RNA, 23 nt, Leptospira interrogans serovar lai str. 56601
gaaaaauuucccuaguuccaauu

SEQ ID NO: 2797484 - RNA, 20 nt, Leptospira interrogans serovar lai str. 56601
gaaaaauuuuauaguagaua

SEQ ID NO: 2797485 - RNA, 22 nt, Leptospira interrogans serovar lai str. 56601
gaaaaccagauguaaucuauaa

SEQ ID NO: 2797486 - RNA, 18 nt, Leptospira interrogans serovar lai str. 56601
gaaaaccaugauucugaa

SEQ ID NO: 2797487 - RNA, 16 nt, Leptospira interrogans serovar lai str. 56601
gaaaaccuaaaauaga

SEQ ID NO: 2797488 - RNA, 18 nt, Leptospira interrogans serovar lai str. 56601
gaaaacucaaaucuacaa

SEQ ID NO: 2797489 - RNA, 11 nt, Leptospira interrogans serovar lai str. 56601
gaaaacucaac

SEQ ID NO: 2797490 - RNA, 15 nt, Leptospira interrogans serovar lai str. 56601
gaaaacucaacacaa

SEQ ID NO: 2797491 - RNA, 22 nt, Leptospira interrogans serovar lai str. 56601
gaaaacucaacacaacgcucuc

SEQ ID NO: 2797492 - RNA, 23 nt, Leptospira interrogans serovar lai str. 56601
gaaaacuuguuuuagaaucuaga

SEQ ID NO: 2797493 - RNA, 12 nt, Leptospira interrogans serovar lai str. 56601
gaaaacuuucuu

SEQ ID NO: 2797494 - RNA, 15 nt, Leptospira interrogans serovar lai str. 56601
gaaaagaaacaguau

SEQ ID NO: 2797495 - RNA, 15 nt, Leptospira interrogans serovar lai str. 56601
gaaaagaaaccaauc

SEQ ID NO: 2797496 - RNA, 22 nt, Leptospira interrogans serovar lai str. 56601
gaaaagaaaccgaucuuaaaaa

SEQ ID NO: 2797497 - RNA, 14 nt, Leptospira interrogans serovar lai str. 56601
gaaaagaaauauua

SEQ ID NO: 2797498 - RNA, 13 nt, Leptospira interrogans serovar lai str. 56601
gaaaagaaucugc

SEQ ID NO: 2797499 - RNA, 14 nt, Leptospira interrogans serovar lai str. 56601
gaaaagaaucugca

SEQ ID NO: 2797500 - RNA, 21 nt, Leptospira interrogans serovar lai str. 56601
gaaaagaauugaaaucugaac

SEQ ID NO: 2797501 - RNA, 21 nt, Leptospira interrogans serovar lai str. 56601
gaaaaggcugucuucagcagu

SEQ ID NO: 2797502 - RNA, 16 nt, Leptospira interrogans serovar lai str. 56601
gaaaagguuaaaaauu

SEQ ID NO: 2797503 - RNA, 16 nt, Leptospira interrogans serovar lai str. 56601
gaaaagucaaaaaaug

SEQ ID NO: 2797504 - RNA, 17 nt, Leptospira interrogans serovar lai str. 56601
gaaaagucaaaaaaugg

SEQ ID NO: 2797505 - RNA, 22 nt, Leptospira interrogans serovar lai str. 56601
gaaaagucagguuuuaucaaau

SEQ ID NO: 2797506 - RNA, 14 nt, Leptospira interrogans serovar lai str. 56601
gaaaauaaaaauca

SEQ ID NO: 2797507 - RNA, 12 nt, Leptospira interrogans serovar lai str. 56601
gaaaauaauaau

SEQ ID NO: 2797508 - RNA, 14 nt, Leptospira interrogans serovar lai str. 56601
gaaaauaauaauau

SEQ ID NO: 2797509 - RNA, 14 nt, Leptospira interrogans serovar lai str. 56601
gaaaauaauaccaa

SEQ ID NO: 2797510 - RNA, 16 nt, Leptospira interrogans serovar lai str. 56601
gaaaauacuucucuaa

SEQ ID NO: 2797511 - RNA, 18 nt, Leptospira interrogans serovar lai str. 56601
gaaaauccagucaaguaa

SEQ ID NO: 2797512 - RNA, 22 nt, Leptospira interrogans serovar lai str. 56601
gaaaaucgucccgaucauccaa

SEQ ID NO: 2797513 - RNA, 13 nt, Leptospira interrogans serovar lai str. 56601
gaaaaucucagaa

SEQ ID NO: 2797514 - RNA, 17 nt, Leptospira interrogans serovar lai str. 56601
gaaaaucucagaaaauu

SEQ ID NO: 2797515 - RNA, 20 nt, Leptospira interrogans serovar lai str. 56601
gaaaaucuuuucuauaaucu

SEQ ID NO: 2797516 - RNA, 9 nt, Leptospira interrogans serovar lai str. 56601
gaaaaugaa

SEQ ID NO: 2797517 - RNA, 22 nt, Leptospira interrogans serovar lai str. 56601
gaaaaugaccaaaauuuccaac

SEQ ID NO: 2797518 - RNA, 14 nt, Leptospira interrogans serovar lai str. 56601
gaaaauguaaaagc

SEQ ID NO: 2797519 - RNA, 19 nt, Leptospira interrogans serovar lai str. 56601
gaaaauguagccaaaaauu

SEQ ID NO: 2797520 - RNA, 14 nt, Leptospira interrogans serovar lai str. 56601
gaaaauuaaaaaau

SEQ ID NO: 2797521 - RNA, 12 nt, Leptospira interrogans serovar lai str. 56601
gaaaauuaacaa

SEQ ID NO: 2797522 - RNA, 10 nt, Leptospira interrogans serovar lai str. 56601
gaaaauuaga

SEQ ID NO: 2797523 - RNA, 12 nt, Leptospira interrogans serovar lai str. 56601
gaaaauuauaag

SEQ ID NO: 2797524 - RNA, 17 nt, Leptospira interrogans serovar lai str. 56601
gaaaauuauagauaauu

SEQ ID NO: 2797525 - RNA, 13 nt, Leptospira interrogans serovar lai str. 56601
gaaaauucaaagg

SEQ ID NO: 2797526 - RNA, 12 nt, Leptospira interrogans serovar lai str. 56601
gaaaauucugaa

SEQ ID NO: 2797527 - RNA, 15 nt, Leptospira interrogans serovar lai str. 56601
gaaaauucugaaaga

SEQ ID NO: 2797528 - RNA, 16 nt, Leptospira interrogans serovar lai str. 56601
gaaaauucugaaagag

SEQ ID NO: 2797529 - RNA, 16 nt, Leptospira interrogans serovar lai str. 56601
gaaaauugaaacaauu

SEQ ID NO: 2797530 - RNA, 12 nt, Leptospira interrogans serovar lai str. 56601
gaaaauugaauu

SEQ ID NO: 2797531 - RNA, 12 nt, Leptospira interrogans serovar lai str. 56601
gaaaauuuaaaa

SEQ ID NO: 2797532 - RNA, 23 nt, Leptospira interrogans serovar lai str. 56601
gaaaauuuaacaacauuagaauu

SEQ ID NO: 2797533 - RNA, 18 nt, Leptospira interrogans serovar lai str. 56601
gaaaauuuaacgauauua

SEQ ID NO: 2797534 - RNA, 18 nt, Leptospira interrogans serovar lai str. 56601
gaaaauuuggacgaaucc

SEQ ID NO: 2797535 - RNA, 15 nt, Leptospira interrogans serovar lai str. 56601
gaaaauuuuaaguuc

SEQ ID NO: 2797536 - RNA, 12 nt, Leptospira interrogans serovar lai str. 56601
gaaaauuuuccc

SEQ ID NO: 2797537 - RNA, 15 nt, Leptospira interrogans serovar lai str. 56601
gaaaauuuuccuuua

SEQ ID NO: 2797538 - RNA, 17 nt, Leptospira interrogans serovar lai str. 56601
gaaaauuuuccuuuaaa

SEQ ID NO: 2797539 - RNA, 15 nt, Leptospira interrogans serovar lai str. 56601
gaaaauuuuuuugua

SEQ ID NO: 2797540 - RNA, 16 nt, Leptospira interrogans serovar lai str. 56601
gaaaauuuuuuuguaa

SEQ ID NO: 2797541 - RNA, 15 nt, Leptospira interrogans serovar lai str. 56601
gaaacaaaaaugaga

SEQ ID NO: 2797542 - RNA, 17 nt, Leptospira interrogans serovar lai str. 56601
gaaacaaaaucaaagag

SEQ ID NO: 2797543 - RNA, 12 nt, Leptospira interrogans serovar lai str. 56601
gaaacaaauucu

SEQ ID NO: 2797544 - RNA, 19 nt, Leptospira interrogans serovar lai str. 56601
gaaacaaauucucauuuag

SEQ ID NO: 2797545 - RNA, 17 nt, Leptospira interrogans serovar lai str. 56601
gaaacaacauugaguuu

SEQ ID NO: 2797546 - RNA, 18 nt, Leptospira interrogans serovar lai str. 56601
gaaacaaguuccaaauua

SEQ ID NO: 2797547 - RNA, 15 nt, Leptospira interrogans serovar lai str. 56601
gaaacaauucuuccu

SEQ ID NO: 2797548 - RNA, 18 nt, Leptospira interrogans serovar lai str. 56601
gaaacaauucuuccuuuu

SEQ ID NO: 2797549 - RNA, 21 nt, Leptospira interrogans serovar lai str. 56601
gaaacaauuuugccaauucca

SEQ ID NO: 2797550 - RNA, 18 nt, Leptospira interrogans serovar lai str. 56601
gaaacagauggaaaguua

SEQ ID NO: 2797551 - RNA, 16 nt, Leptospira interrogans serovar lai str. 56601
gaaacaucacuuccau

SEQ ID NO: 2797552 - RNA, 17 nt, Leptospira interrogans serovar lai str. 56601
gaaacaucacuuccauu

SEQ ID NO: 2797553 - RNA, 14 nt, Leptospira interrogans serovar lai str. 56601
gaaacccaaaaaug

SEQ ID NO: 2797554 - RNA, 22 nt, Leptospira interrogans serovar lai str. 56601
gaaaccucgucuaucuuuuuua

SEQ ID NO: 2797555 - RNA, 17 nt, Leptospira interrogans serovar lai str. 56601
gaaaccuugacaauuua

SEQ ID NO: 2797556 - RNA, 15 nt, Leptospira interrogans serovar lai str. 56601
gaaaccuuuauagaa

SEQ ID NO: 2797557 - RNA, 18 nt, Leptospira interrogans serovar lai str. 56601
gaaaccuuuauagaauuc

SEQ ID NO: 2797558 - RNA, 20 nt, Leptospira interrogans serovar lai str. 56601
gaaacgaguguuucaugucc

SEQ ID NO: 2797559 - RNA, 13 nt, Leptospira interrogans serovar lai str. 56601
gaaacgauacaaa

SEQ ID NO: 2797560 - RNA, 20 nt, Leptospira interrogans serovar lai str. 56601
gaaacgauguauugaguuua

SEQ ID NO: 2797561 - RNA, 16 nt, Leptospira interrogans serovar lai str. 56601
gaaacggaagaaaauu

SEQ ID NO: 2797562 - RNA, 18 nt, Leptospira interrogans serovar lai str. 56601
gaaacggccgauugaagc

SEQ ID NO: 2797563 - RNA, 18 nt, Leptospira interrogans serovar lai str. 56601
gaaacggugcauuuaaaa

SEQ ID NO: 2797564 - RNA, 17 nt, Leptospira interrogans serovar lai str. 56601
gaaacuaaugcaaguuc

SEQ ID NO: 2797565 - RNA, 14 nt, Leptospira interrogans serovar lai str. 56601
gaaacuaauuugua

SEQ ID NO: 2797566 - RNA, 15 nt, Leptospira interrogans serovar lai str. 56601
gaaacuauacuuuca

SEQ ID NO: 2797567 - RNA, 16 nt, Leptospira interrogans serovar lai str. 56601
gaaacuauacuuucaa

SEQ ID NO: 2797568 - RNA, 23 nt, Leptospira interrogans serovar lai str. 56601
gaaacuauccaaaaguuuauaaa

SEQ ID NO: 2797569 - RNA, 17 nt, Leptospira interrogans serovar lai str. 56601
gaaacuauuacaaauag

SEQ ID NO: 2797570 - RNA, 22 nt, Leptospira interrogans serovar lai str. 56601
gaaacucaguaaaacgcucucu

SEQ ID NO: 2797571 - RNA, 17 nt, Leptospira interrogans serovar lai str. 56601
gaaacucaguaaacuca

SEQ ID NO: 2797572 - RNA, 19 nt, Leptospira interrogans serovar lai str. 56601
gaaacucaguaaacucaau

SEQ ID NO: 2797573 - RNA, 18 nt, Leptospira interrogans serovar lai str. 56601
gaaacucauaaaauaacu

SEQ ID NO: 2797574 - RNA, 19 nt, Leptospira interrogans serovar lai str. 56601
gaaacucauuuuucuaaaa

SEQ ID NO: 2797575 - RNA, 21 nt, Leptospira interrogans serovar lai str. 56601
gaaacucauuuuucuaaaaaa

SEQ ID NO: 2797576 - RNA, 21 nt, Leptospira interrogans serovar lai str. 56601
gaaacuggaauauucuuuuua

SEQ ID NO: 2797577 - RNA, 15 nt, Leptospira interrogans serovar lai str. 56601
gaaacuuaaaucuca

SEQ ID NO: 2797578 - RNA, 16 nt, Leptospira interrogans serovar lai str. 56601
gaaacuuuuaauaaaa

SEQ ID NO: 2797579 - RNA, 21 nt, Leptospira interrogans serovar lai str. 56601
gaaacuuuuaauaaaacgugg

SEQ ID NO: 2797580 - RNA, 16 nt, Leptospira interrogans serovar lai str. 56601
gaaagaaaaagagaug

SEQ ID NO: 2797581 - RNA, 22 nt, Leptospira interrogans serovar lai str. 56601
gaaagaagauagauuuauaaua

SEQ ID NO: 2797582 - RNA, 18 nt, Leptospira interrogans serovar lai str. 56601
gaaagaaucuuuuuaaaa

SEQ ID NO: 2797583 - RNA, 22 nt, Leptospira interrogans serovar lai str. 56601
gaaagaauuuaauaaaaaaaug

SEQ ID NO: 2797584 - RNA, 13 nt, Leptospira interrogans serovar lai str. 56601
gaaagaauuuuug

SEQ ID NO: 2797585 - RNA, 23 nt, Leptospira interrogans serovar lai str. 56601
gaaagaauuuuuggaacgaagaa

SEQ ID NO: 2797586 - RNA, 18 nt, Leptospira interrogans serovar lai str. 56601
gaaagacuuuucaucauu

SEQ ID NO: 2797587 - RNA, 13 nt, Leptospira interrogans serovar lai str. 56601
gaaagaucaugaa

SEQ ID NO: 2797588 - RNA, 13 nt, Leptospira interrogans serovar lai str. 56601
gaaagauuaaauu

SEQ ID NO: 2797589 - RNA, 12 nt, Leptospira interrogans serovar lai str. 56601
gaaagauuuucg

SEQ ID NO: 2797590 - RNA, 15 nt, Leptospira interrogans serovar lai str. 56601
gaaagcagcaaagaa

SEQ ID NO: 2797591 - RNA, 21 nt, Leptospira interrogans serovar lai str. 56601
gaaagcauaacgucuugauua

SEQ ID NO: 2797592 - RNA, 21 nt, Leptospira interrogans serovar lai str. 56601
gaaagccccagaacaaauccu

SEQ ID NO: 2797593 - RNA, 16 nt, Leptospira interrogans serovar lai str. 56601
gaaaguaaaaaagagc

SEQ ID NO: 2797594 - RNA, 22 nt, Leptospira interrogans serovar lai str. 56601
gaaaguaaucuuuuuaaaaguu

SEQ ID NO: 2797595 - RNA, 11 nt, Leptospira interrogans serovar lai str. 56601
gaaagugaaag

SEQ ID NO: 2797596 - RNA, 21 nt, Leptospira interrogans serovar lai str. 56601
gaaagugauccaacaaauuga

SEQ ID NO: 2797597 - RNA, 15 nt, Leptospira interrogans serovar lai str. 56601
gaaaguguuaguucc

SEQ ID NO: 2797598 - RNA, 15 nt, Leptospira interrogans serovar lai str. 56601
gaaaguucguaaacu

SEQ ID NO: 2797599 - RNA, 12 nt, Leptospira interrogans serovar lai str. 56601
gaaaguugcaaa

SEQ ID NO: 2797600 - RNA, 18 nt, Leptospira interrogans serovar lai str. 56601
gaaaguugcaaagaagaa

SEQ ID NO: 2797601 - RNA, 17 nt, Leptospira interrogans serovar lai str. 56601
gaacuauacaaauagag

SEQ ID NO: 2797602 - RNA, 23 nt, Leptospira interrogans serovar lai str. 56601
gaacuauuacaaaucgacgauuu

SEQ ID NO: 2797603 - RNA, 22 nt, Leptospira interrogans serovar lai str. 56601
gaacuauuaucuuucgauuuua

SEQ ID NO: 2797604 - RNA, 17 nt, Leptospira interrogans serovar lai str. 56601
gaacuauuuauaaaaua

SEQ ID NO: 2797605 - RNA, 19 nt, Leptospira interrogans serovar lai str. 56601
gaacuauuuauaaaauaaa

SEQ ID NO: 2797606 - RNA, 15 nt, Leptospira interrogans serovar lai str. 56601
gaacucacacaaaau

SEQ ID NO: 2797607 - RNA, 23 nt, Leptospira interrogans serovar lai str. 56601
gaacucacguuauuuuaacuuga

SEQ ID NO: 2797608 - RNA, 22 nt, Leptospira interrogans serovar lai str. 56601
gaacucauauuuuuagaaaauu

SEQ ID NO: 2797609 - RNA, 20 nt, Leptospira interrogans serovar lai str. 56601
gaacuccauucuuacuccau

SEQ ID NO: 2797610 - RNA, 15 nt, Leptospira interrogans serovar lai str. 56601
gaacucccacaauuu

SEQ ID NO: 2797611 - RNA, 18 nt, Leptospira interrogans serovar lai str. 56601
gaacucccacaauuuuga

SEQ ID NO: 2797612 - RNA, 19 nt, Leptospira interrogans serovar lai str. 56601
gaacucccacaauuuugaa

SEQ ID NO: 2797613 - RNA, 20 nt, Leptospira interrogans serovar lai str. 56601
gaacucuauauaaagaaaaa

SEQ ID NO: 2797614 - RNA, 22 nt, Leptospira interrogans serovar lai str. 56601
gaacucucacaaaucaugauuu

SEQ ID NO: 2797615 - RNA, 15 nt, Leptospira interrogans serovar lai str. 56601
gaacucuuacaaaau

SEQ ID NO: 2797616 - RNA, 17 nt, Leptospira interrogans serovar lai str. 56601
gaacucuuacaauuuca

SEQ ID NO: 2797617 - RNA, 22 nt, Leptospira interrogans serovar lai str. 56601
gaacuguguuucuaauuuucuu

SEQ ID NO: 2797618 - RNA, 16 nt, Leptospira interrogans serovar lai str. 56601
gaacuguugaaaaaau

SEQ ID NO: 2797619 - RNA, 20 nt, Leptospira interrogans serovar lai str. 56601
gaacuuaccccgaaauacau

SEQ ID NO: 2797620 - RNA, 18 nt, Leptospira interrogans serovar lai str. 56601
gaacuuguuccaaaacua

SEQ ID NO: 2797621 - RNA, 21 nt, Leptospira interrogans serovar lai str. 56601
gaacuuuacagacugauuuuu

SEQ ID NO: 2797622 - RNA, 21 nt, Leptospira interrogans serovar lai str. 56601
gaacuuuaccggguuccauuc

SEQ ID NO: 2797623 - RNA, 23 nt, Leptospira interrogans serovar lai str. 56601
gaacuuucucgaaaaucucagaa

SEQ ID NO: 2797624 - RNA, 22 nt, Leptospira interrogans serovar lai str. 56601
gaacuuucuuaucggaaagcca

SEQ ID NO: 2797625 - RNA, 20 nt, Leptospira interrogans serovar lai str. 56601
gaacuuugcagacugauucu

SEQ ID NO: 2797626 - RNA, 15 nt, Leptospira interrogans serovar lai str. 56601
gaacuuuuuaucauu

SEQ ID NO: 2797627 - RNA, 19 nt, Leptospira interrogans serovar lai str. 56601
gaacuuuuuuuagaaucau

SEQ ID NO: 2797628 - RNA, 13 nt, Leptospira interrogans serovar lai str. 56601
gaagaaaaaaaga

SEQ ID NO: 2797629 - RNA, 14 nt, Leptospira interrogans serovar lai str. 56601
gaagaaaaggcugu

SEQ ID NO: 2797630 - RNA, 24 nt, Leptospira interrogans serovar lai str. 56601
gaagaaaaggcugucuucagcagu

SEQ ID NO: 2797631 - RNA, 16 nt, Leptospira interrogans serovar lai str. 56601
gaagaaauaaguaaau

SEQ ID NO: 2797632 - RNA, 18 nt, Leptospira interrogans serovar lai str. 56601
gaagaauaugucguugua

SEQ ID NO: 2797633 - RNA, 16 nt, Leptospira interrogans serovar lai str. 56601
gaagaauccgaaaaac

SEQ ID NO: 2797634 - RNA, 21 nt, Leptospira interrogans serovar lai str. 56601
gaagaauuauuuacuuuuucc

SEQ ID NO: 2797635 - RNA, 24 nt, Leptospira interrogans serovar lai str. 56601
gaagacgcuuaaaaaugagucuuu

SEQ ID NO: 2797636 - RNA, 15 nt, Leptospira interrogans serovar lai str. 56601
gaagagucaaacacu

SEQ ID NO: 2797637 - RNA, 17 nt, Leptospira interrogans serovar lai str. 56601
gaagauauaaucuaaga

SEQ ID NO: 2797638 - RNA, 15 nt, Leptospira interrogans serovar lai str. 56601
gaagaugagcaaaau

SEQ ID NO: 2797639 - RNA, 23 nt, Leptospira interrogans serovar lai str. 56601
gaagcaacguagucguguuguuu

SEQ ID NO: 2797640 - RNA, 16 nt, Leptospira interrogans serovar lai str. 56601
gaagcaguuuuccccg

SEQ ID NO: 2797641 - RNA, 13 nt, Leptospira interrogans serovar lai str. 56601
gaagcaguuuugc

SEQ ID NO: 2797642 - RNA, 22 nt, Leptospira interrogans serovar lai str. 56601
gaagccaaugugccuucguuua

SEQ ID NO: 2797643 - RNA, 15 nt, Leptospira interrogans serovar lai str. 56601
gaagccugaguuuga

SEQ ID NO: 2797644 - RNA, 21 nt, Leptospira interrogans serovar lai str. 56601
gaagccuuccaucaaauacaa

SEQ ID NO: 2797645 - RNA, 14 nt, Leptospira interrogans serovar lai str. 56601
gaagcgagagacgc

SEQ ID NO: 2797646 - RNA, 20 nt, Leptospira interrogans serovar lai str. 56601
gaagcgagagacgcugaguu

SEQ ID NO: 2797647 - RNA, 13 nt, Leptospira interrogans serovar lai str. 56601
gaagcuaaaacua

SEQ ID NO: 2797648 - RNA, 15 nt, Leptospira interrogans serovar lai str. 56601
gaagcuaaaauugaa

SEQ ID NO: 2797649 - RNA, 20 nt, Leptospira interrogans serovar lai str. 56601
gaagcuuuuaguuguacaaa

SEQ ID NO: 2797650 - RNA, 18 nt, Leptospira interrogans serovar lai str. 56601
gaaggcagcuaagaaaaa

SEQ ID NO: 2797651 - RNA, 14 nt, Leptospira interrogans serovar lai str. 56601
gaagggaugaaauu

SEQ ID NO: 2797652 - RNA, 15 nt, Leptospira interrogans serovar lai str. 56601
gaagguugagcagua

SEQ ID NO: 2797653 - RNA, 18 nt, Leptospira interrogans serovar lai str. 56601
gaaguaguaguucccaca

SEQ ID NO: 2797654 - RNA, 18 nt, Leptospira interrogans serovar lai str. 56601
gaagucacguauuccaag

SEQ ID NO: 2797655 - RNA, 17 nt, Leptospira interrogans serovar lai str. 56601
gaaguguuugcugaguu

SEQ ID NO: 2797656 - RNA, 21 nt, Leptospira interrogans serovar lai str. 56601
gaaguuccaacguaccaaaac

SEQ ID NO: 2797657 - RNA, 18 nt, Leptospira interrogans serovar lai str. 56601
gaaguucggaagauuuuu

SEQ ID NO: 2797658 - RNA, 21 nt, Leptospira interrogans serovar lai str. 56601
gaaguucggaagauuuuucaa

SEQ ID NO: 2797659 - RNA, 23 nt, Leptospira interrogans serovar lai str. 56601
gaaguuguauccccauaaacaaa

SEQ ID NO: 2797660 - RNA, 14 nt, Leptospira interrogans serovar lai str. 56601
gaauaaaaacaaaa

SEQ ID NO: 2797661 - RNA, 14 nt, Leptospira interrogans serovar lai str. 56601
gaauaaaaacuuga

SEQ ID NO: 2797662 - RNA, 17 nt, Leptospira interrogans serovar lai str. 56601
gaauaaaaucauauuuu

SEQ ID NO: 2797663 - RNA, 13 nt, Leptospira interrogans serovar lai str. 56601
gaauaaagagaag

SEQ ID NO: 2797664 - RNA, 17 nt, Leptospira interrogans serovar lai str. 56601
gaauaaagagaagauug

SEQ ID NO: 2797665 - RNA, 18 nt, Leptospira interrogans serovar lai str. 56601
gaauaaauaaugaaaacu

SEQ ID NO: 2797666 - RNA, 20 nt, Leptospira interrogans serovar lai str. 56601
gaauaacuuuacaaaaaugu

SEQ ID NO: 2797667 - RNA, 15 nt, Leptospira interrogans serovar lai str. 56601
gaauaauuuaaacuu

SEQ ID NO: 2797668 - RNA, 21 nt, Leptospira interrogans serovar lai str. 56601
gaauacauuuaaacuuuucau

SEQ ID NO: 2797669 - RNA, 14 nt, Leptospira interrogans serovar lai str. 56601
gaauaccguucuua

SEQ ID NO: 2797670 - RNA, 16 nt, Leptospira interrogans serovar lai str. 56601
gaauacgauagauuca

SEQ ID NO: 2797671 - RNA, 20 nt, Leptospira interrogans serovar lai str. 56601
gaauacgauuuaaucuagga

SEQ ID NO: 2797672 - RNA, 15 nt, Leptospira interrogans serovar lai str. 56601
gaauacguuauucua

SEQ ID NO: 2797673 - RNA, 20 nt, Leptospira interrogans serovar lai str. 56601
gaauacuugccguuacauaa

SEQ ID NO: 2797674 - RNA, 20 nt, Leptospira interrogans serovar lai str. 56601
gaauagaacgaguuccgaaa

SEQ ID NO: 2797675 - RNA, 18 nt, Leptospira interrogans serovar lai str. 56601
gaauaggaucagaauuuc

SEQ ID NO: 2797676 - RNA, 17 nt, Leptospira interrogans serovar lai str. 56601
gaauaggauuuuagaau

SEQ ID NO: 2797677 - RNA, 21 nt, Leptospira interrogans serovar lai str. 56601
gaauaggauuuuagaaucaaa

SEQ ID NO: 2797678 - RNA, 23 nt, Leptospira interrogans serovar lai str. 56601
gaauagucaaugguugcaaaaaa

SEQ ID NO: 2797679 - RNA, 13 nt, Leptospira interrogans serovar lai str. 56601
gaauaguuuacau

SEQ ID NO: 2797680 - RNA, 16 nt, Leptospira interrogans serovar lai str. 56601
gaauaguuuacauauc

SEQ ID NO: 2797681 - RNA, 14 nt, Leptospira interrogans serovar lai str. 56601
gaauauaaaaucuu

SEQ ID NO: 2797682 - RNA, 20 nt, Leptospira interrogans serovar lai str. 56601
gaauauaaaaucuuaaauua

SEQ ID NO: 2797683 - RNA, 20 nt, Leptospira interrogans serovar lai str. 56601
gaauuuaaaaguuuccccaa

SEQ ID NO: 2797684 - RNA, 16 nt, Leptospira interrogans serovar lai str. 56601
gaauuuaggaaauuuu

SEQ ID NO: 2797685 - RNA, 15 nt, Leptospira interrogans serovar lai str. 56601
gaauuuauagauaua

SEQ ID NO: 2797686 - RNA, 16 nt, Leptospira interrogans serovar lai str. 56601
gaauuuauuuguaaaa

SEQ ID NO: 2797687 - RNA, 15 nt, Leptospira interrogans serovar lai str. 56601
gaauuucauagucaa

SEQ ID NO: 2797688 - RNA, 17 nt, Leptospira interrogans serovar lai str. 56601
gaauuuccaaacucaau

SEQ ID NO: 2797689 - RNA, 14 nt, Leptospira interrogans serovar lai str. 56601
gaauuuccauuucu

SEQ ID NO: 2797690 - RNA, 11 nt, Leptospira interrogans serovar lai str. 56601
gaauuuccuuu

SEQ ID NO: 2797691 - RNA, 17 nt, Leptospira interrogans serovar lai str. 56601
gaauuucuaaaauucuu

SEQ ID NO: 2797692 - RNA, 20 nt, Leptospira interrogans serovar lai str. 56601
gaauuucuaaaauucuuccg

SEQ ID NO: 2797693 - RNA, 13 nt, Leptospira interrogans serovar lai str. 56601
gaauuucuuucuc

SEQ ID NO: 2797694 - RNA, 15 nt, Leptospira interrogans serovar lai str. 56601
gaauuugcaguaaaa

SEQ ID NO: 2797695 - RNA, 17 nt, Leptospira interrogans serovar lai str. 56601
gaauuugcaguaaaagg

SEQ ID NO: 2797696 - RNA, 18 nt, Leptospira interrogans serovar lai str. 56601
gaauuuguaauucuucaa

SEQ ID NO: 2797697 - RNA, 21 nt, Leptospira interrogans serovar lai str. 56601
gaauuuguguuguauguggua

SEQ ID NO: 2797698 - RNA, 18 nt, Leptospira interrogans serovar lai str. 56601
gaauuuguucuuaaaauu

SEQ ID NO: 2797699 - RNA, 16 nt, Leptospira interrogans serovar lai str. 56601
gaauuuguuuguaaaa

SEQ ID NO: 2797700 - RNA, 20 nt, Leptospira interrogans serovar lai str. 56601
gaauuuguuugucuuuuucu

SEQ ID NO: 2797701 - RNA, 21 nt, Leptospira interrogans serovar lai str. 56601
gaauuuguuuuuaaaauugug

SEQ ID NO: 2797702 - RNA, 19 nt, Leptospira interrogans serovar lai str. 56601
gaauuuuaauuguaaaagg

SEQ ID NO: 2797703 - RNA, 22 nt, Leptospira interrogans serovar lai str. 56601
gaauuuuaccaaauuguuuucu

SEQ ID NO: 2797704 - RNA, 18 nt, Leptospira interrogans serovar lai str. 56601
gaauuuuacgugauaauu

SEQ ID NO: 2797705 - RNA, 20 nt, Leptospira interrogans serovar lai str. 56601
gaauuuuaguucucucgaaa

SEQ ID NO: 2797706 - RNA, 20 nt, Leptospira interrogans serovar lai str. 56601
gaauuuucgcuacaaucgcu

SEQ ID NO: 2797707 - RNA, 16 nt, Leptospira interrogans serovar lai str. 56601
gaauuuucuaaugcau

SEQ ID NO: 2797708 - RNA, 22 nt, Leptospira interrogans serovar lai str. 56601
gaauuuugaacauuuucauaua

SEQ ID NO: 2797709 - RNA, 16 nt, Leptospira interrogans serovar lai str. 56601
gaauuuuguuugaauc

SEQ ID NO: 2797710 - RNA, 13 nt, Leptospira interrogans serovar lai str. 56601
gaauuuuuauaaa

SEQ ID NO: 2797711 - RNA, 16 nt, Leptospira interrogans serovar lai str. 56601
gaauuuuucaacaacu

SEQ ID NO: 2797712 - RNA, 18 nt, Leptospira interrogans serovar lai str. 56601
gaauuuuucgaaacaaaa

SEQ ID NO: 2797713 - RNA, 22 nt, Leptospira interrogans serovar lai str. 56601
gaauuuuuuauuaagaacuuuc

SEQ ID NO: 2797714 - RNA, 18 nt, Leptospira interrogans serovar lai str. 56601
gaauuuuuuuguauauaa

SEQ ID NO: 2797715 - RNA, 19 nt, Leptospira interrogans serovar lai str. 56601
gaauuuuuuuguauauaaa

SEQ ID NO: 2797716 - RNA, 20 nt, Leptospira interrogans serovar lai str. 56601
gaauuuuuuuguauauaaau

SEQ ID NO: 2797717 - RNA, 22 nt, Leptospira interrogans serovar lai str. 56601
gacaaagaguuguuuaucuucu

SEQ ID NO: 2797718 - RNA, 17 nt, Leptospira interrogans serovar lai str. 56601
gacaaaguauuuucuag

SEQ ID NO: 2797719 - RNA, 17 nt, Leptospira interrogans serovar lai str. 56601
gacaacguuacuuuuaa

SEQ ID NO: 2797720 - RNA, 15 nt, Leptospira interrogans serovar lai str. 56601
gacaacuuauaauuu

SEQ ID NO: 2797721 - RNA, 17 nt, Leptospira interrogans serovar lai str. 56601
gacaacuuauaauuuuc

SEQ ID NO: 2797722 - RNA, 17 nt, Leptospira interrogans serovar lai str. 56601
gacaagaagagauaacu

SEQ ID NO: 2797723 - RNA, 17 nt, Leptospira interrogans serovar lai str. 56601
gacaagaaugagucuuu

SEQ ID NO: 2797724 - RNA, 21 nt, Leptospira interrogans serovar lai str. 56601
gacaaucguaggcacguggaa

SEQ ID NO: 2797725 - RNA, 18 nt, Leptospira interrogans serovar lai str. 56601
gacaaucucugauaauuu

SEQ ID NO: 2797726 - RNA, 23 nt, Leptospira interrogans serovar lai str. 56601
gacaccguugcuauaaaaaggau

SEQ ID NO: 2797727 - RNA, 22 nt, Leptospira interrogans serovar lai str. 56601
gacacugaaaacauuuugccuu

SEQ ID NO: 2797728 - RNA, 22 nt, Leptospira interrogans serovar lai str. 56601
gacaguucccacauuuuagaaa

SEQ ID NO: 2797729 - RNA, 19 nt, Leptospira interrogans serovar lai str. 56601
gacauaaaaaaauuaaaaa

SEQ ID NO: 2797730 - RNA, 23 nt, Leptospira interrogans serovar lai str. 56601
gacauaaaaaaauuaaaaaagag

SEQ ID NO: 2797731 - RNA, 19 nt, Leptospira interrogans serovar lai str. 56601
gacaugauucauuuuucug

SEQ ID NO: 2797732 - RNA, 14 nt, Leptospira interrogans serovar lai str. 56601
gacauuagaacuac

SEQ ID NO: 2797733 - RNA, 13 nt, Leptospira interrogans serovar lai str. 56601
gacauucuaaaca

SEQ ID NO: 2797734 - RNA, 15 nt, Leptospira interrogans serovar lai str. 56601
gacauuguuuuacuc

SEQ ID NO: 2797735 - RNA, 22 nt, Leptospira interrogans serovar lai str. 56601
gaccaaaucuuucacuuuaaaa

SEQ ID NO: 2797736 - RNA, 19 nt, Leptospira interrogans serovar lai str. 56601
gaccaauuuuuuuguaaaa

SEQ ID NO: 2797737 - RNA, 10 nt, Leptospira interrogans serovar lai str. 56601
gaccagagcu

SEQ ID NO: 2797738 - RNA, 20 nt, Leptospira interrogans serovar lai str. 56601
gaccagcguuuugcugaguu

SEQ ID NO: 2797739 - RNA, 14 nt, Leptospira interrogans serovar lai str. 56601
gaccauucuuuguu

SEQ ID NO: 2797740 - RNA, 17 nt, Leptospira interrogans serovar lai str. 56601
gacccuaaaaaauuuuu

SEQ ID NO: 2797741 - RNA, 14 nt, Leptospira interrogans serovar lai str. 56601
gaccgaacucacaa

SEQ ID NO: 2797742 - RNA, 22 nt, Leptospira interrogans serovar lai str. 56601
gaccgaagucacguuauugaau

SEQ ID NO: 2797743 - RNA, 19 nt, Leptospira interrogans serovar lai str. 56601
gaccgcagacuguaucaua

SEQ ID NO: 2797744 - RNA, 13 nt, Leptospira interrogans serovar lai str. 56601
gaccuaaacccug

SEQ ID NO: 2797745 - RNA, 13 nt, Leptospira interrogans serovar lai str. 56601
gaccucaaauaac

SEQ ID NO: 2797746 - RNA, 19 nt, Leptospira interrogans serovar lai str. 56601
gaccucuauaauuaauaaa

SEQ ID NO: 2797747 - RNA, 21 nt, Leptospira interrogans serovar lai str. 56601
gaccucuauccacuaaaauac

SEQ ID NO: 2797748 - RNA, 15 nt, Leptospira interrogans serovar lai str. 56601
gaccuuaacucuuaa

SEQ ID NO: 2797749 - RNA, 20 nt, Leptospira interrogans serovar lai str. 56601
gaccuuucuaaaaauuuccg

SEQ ID NO: 2797750 - RNA, 13 nt, Leptospira interrogans serovar lai str. 56601
gacgaaaaacuca

SEQ ID NO: 2797751 - RNA, 14 nt, Leptospira interrogans serovar lai str. 56601
gacgaauccugcua

SEQ ID NO: 2797752 - RNA, 21 nt, Leptospira interrogans serovar lai str. 56601
gacgaauugcaccaguuaaau

SEQ ID NO: 2797753 - RNA, 17 nt, Leptospira interrogans serovar lai str. 56601
gacgaauuuuuuagaaa

SEQ ID NO: 2797754 - RNA, 19 nt, Leptospira interrogans serovar lai str. 56601
gacgauaccuaaaauggau

SEQ ID NO: 2797755 - RNA, 16 nt, Leptospira interrogans serovar lai str. 56601
gacgauugaucagacu

SEQ ID NO: 2797756 - RNA, 14 nt, Leptospira interrogans serovar lai str. 56601
gacgauuuucuccu

SEQ ID NO: 2797757 - RNA, 18 nt, Leptospira interrogans serovar lai str. 56601
gacgccauguuuuuaaaa

SEQ ID NO: 2797758 - RNA, 17 nt, Leptospira interrogans serovar lai str. 56601
gacgcugaguuugaaag

SEQ ID NO: 2797759 - RNA, 13 nt, Leptospira interrogans serovar lai str. 56601
gacguaaaaaaau

SEQ ID NO: 2797760 - RNA, 18 nt, Leptospira interrogans serovar lai str. 56601
gacguaaaggaauccaug

SEQ ID NO: 2797761 - RNA, 21 nt, Leptospira interrogans serovar lai str. 56601
gacguaaaggaauccaugauu

SEQ ID NO: 2797762 - RNA, 13 nt, Leptospira interrogans serovar lai str. 56601
gacguaguucuuc

SEQ ID NO: 2797763 - RNA, 23 nt, Leptospira interrogans serovar lai str. 56601
gacguuucuucggauucacaaac

SEQ ID NO: 2797764 - RNA, 12 nt, Leptospira interrogans serovar lai str. 56601
gacguuuugacc

SEQ ID NO: 2797765 - RNA, 17 nt, Leptospira interrogans serovar lai str. 56601
gacuaacgauuguaaaa

SEQ ID NO: 2797766 - RNA, 14 nt, Leptospira interrogans serovar lai str. 56601
gauagaaguuuaua

SEQ ID NO: 2797767 - RNA, 16 nt, Leptospira interrogans serovar lai str. 56601
gauagaaguuuauaau

SEQ ID NO: 2797768 - RNA, 14 nt, Leptospira interrogans serovar lai str. 56601
gauagagaaaaauu

SEQ ID NO: 2797769 - RNA, 19 nt, Leptospira interrogans serovar lai str. 56601
gauagagaaaaauuuuccg

SEQ ID NO: 2797770 - RNA, 19 nt, Leptospira interrogans serovar lai str. 56601
gauagauucaauuauuaua

SEQ ID NO: 2797771 - RNA, 20 nt, Leptospira interrogans serovar lai str. 56601
gauagauucaauuauuauaa

SEQ ID NO: 2797772 - RNA, 14 nt, Leptospira interrogans serovar lai str. 56601
gauagauuuauaau

SEQ ID NO: 2797773 - RNA, 21 nt, Leptospira interrogans serovar lai str. 56601
gauagauuuauaauaaaucaa

SEQ ID NO: 2797774 - RNA, 22 nt, Leptospira interrogans serovar lai str. 56601
gauagcguaauacgaugauaaa

SEQ ID NO: 2797775 - RNA, 15 nt, Leptospira interrogans serovar lai str. 56601
gauaggauuccauug

SEQ ID NO: 2797776 - RNA, 17 nt, Leptospira interrogans serovar lai str. 56601
gauagguucuuagaacu

SEQ ID NO: 2797777 - RNA, 11 nt, Leptospira interrogans serovar lai str. 56601
gauauaauaua

SEQ ID NO: 2797778 - RNA, 20 nt, Leptospira interrogans serovar lai str. 56601
gauauaaucuuaauauuucu

SEQ ID NO: 2797779 - RNA, 17 nt, Leptospira interrogans serovar lai str. 56601
gauauaccaguuaaauu

SEQ ID NO: 2797780 - RNA, 14 nt, Leptospira interrogans serovar lai str. 56601
gauauacugguuuu

SEQ ID NO: 2797781 - RNA, 20 nt, Leptospira interrogans serovar lai str. 56601
gauauaguuuugagauuaca

SEQ ID NO: 2797782 - RNA, 18 nt, Leptospira interrogans serovar lai str. 56601
gauaucacaaauuuuaaa

SEQ ID NO: 2797783 - RNA, 12 nt, Leptospira interrogans serovar lai str. 56601
gauauggaauuc

SEQ ID NO: 2797784 - RNA, 12 nt, Leptospira interrogans serovar lai str. 56601
gauauuaaaaug

SEQ ID NO: 2797785 - RNA, 17 nt, Leptospira interrogans serovar lai str. 56601
gauauuuauaaugaauu

SEQ ID NO: 2797786 - RNA, 20 nt, Leptospira interrogans serovar lai str. 56601
gauauuucuguaaaaaauaa

SEQ ID NO: 2797787 - RNA, 12 nt, Leptospira interrogans serovar lai str. 56601
gauauuuuccuu

SEQ ID NO: 2797788 - RNA, 18 nt, Leptospira interrogans serovar lai str. 56601
gauauuuucucauucuac

SEQ ID NO: 2797789 - RNA, 12 nt, Leptospira interrogans serovar lai str. 56601
gaucaaaaccau

SEQ ID NO: 2797790 - RNA, 17 nt, Leptospira interrogans serovar lai str. 56601
gaucaaaaccauuuuug

SEQ ID NO: 2797791 - RNA, 13 nt, Leptospira interrogans serovar lai str. 56601
gaucaaauacuug

SEQ ID NO: 2797792 - RNA, 22 nt, Leptospira interrogans serovar lai str. 56601
gaucaacacaaauauuaagaau

SEQ ID NO: 2797793 - RNA, 17 nt, Leptospira interrogans serovar lai str. 56601
gaucaauucugaaaaug

SEQ ID NO: 2797794 - RNA, 21 nt, Leptospira interrogans serovar lai str. 56601
gaucacaauuuuuuuagaauc

SEQ ID NO: 2797795 - RNA, 16 nt, Leptospira interrogans serovar lai str. 56601
gaucacguaaaacuuc

SEQ ID NO: 2797796 - RNA, 15 nt, Leptospira interrogans serovar lai str. 56601
gaucagaauuucuuu

SEQ ID NO: 2797797 - RNA, 20 nt, Leptospira interrogans serovar lai str. 56601
gaucagaauuucuuucucuc

SEQ ID NO: 2797798 - RNA, 14 nt, Leptospira interrogans serovar lai str. 56601
gaucaguaguucuc

SEQ ID NO: 2797799 - RNA, 15 nt, Leptospira interrogans serovar lai str. 56601
gaucauacuuuagaa

SEQ ID NO: 2797800 - RNA, 14 nt, Leptospira interrogans serovar lai str. 56601
gaucauuuaaaacu

SEQ ID NO: 2797801 - RNA, 17 nt, Leptospira interrogans serovar lai str. 56601
gauccaaacccaaugau

SEQ ID NO: 2797802 - RNA, 13 nt, Leptospira interrogans serovar lai str. 56601
gauccaaauuuuu

SEQ ID NO: 2797803 - RNA, 18 nt, Leptospira interrogans serovar lai str. 56601
gauccaauuguuccgaau

SEQ ID NO: 2797804 - RNA, 14 nt, Leptospira interrogans serovar lai str. 56601
gauccccuugauuc

SEQ ID NO: 2797805 - RNA, 23 nt, Leptospira interrogans serovar lai str. 56601
gauccguaaaaaacguuuuguug

SEQ ID NO: 2797806 - RNA, 22 nt, Leptospira interrogans serovar lai str. 56601
gauccuuauacuuuccgucuuu

SEQ ID NO: 2797807 - RNA, 12 nt, Leptospira interrogans serovar lai str. 56601
gaucgacauucc

SEQ ID NO: 2797808 - RNA, 20 nt, Leptospira interrogans serovar lai str. 56601
gaucgacuguaauuaauuca

SEQ ID NO: 2797809 - RNA, 19 nt, Leptospira interrogans serovar lai str. 56601
gaucgcagcauaauaaucg

SEQ ID NO: 2797810 - RNA, 22 nt, Leptospira interrogans serovar lai str. 56601
gaucgcagcauaauaaucgcuu

SEQ ID NO: 2797811 - RNA, 23 nt, Leptospira interrogans serovar lai str. 56601
gaucgcagcauaauaaucgcuuu

SEQ ID NO: 2797812 - RNA, 16 nt, Leptospira interrogans serovar lai str. 56601
gaucgcguuuuauaau

SEQ ID NO: 2797813 - RNA, 13 nt, Leptospira interrogans serovar lai str. 56601
gaucggaaccaaa

SEQ ID NO: 2797814 - RNA, 24 nt, Leptospira interrogans serovar lai str. 56601
gaucggcauucagggagugauacg

SEQ ID NO: 2797815 - RNA, 19 nt, Leptospira interrogans serovar lai str. 56601
gaucggcauuuaggaagua

SEQ ID NO: 2797816 - RNA, 15 nt, Leptospira interrogans serovar lai str. 56601
gaucgguuuuagaau

SEQ ID NO: 2797817 - RNA, 14 nt, Leptospira interrogans serovar lai str. 56601
gaucguaaaauuuu

SEQ ID NO: 2797818 - RNA, 22 nt, Leptospira interrogans serovar lai str. 56601
gaucguaacuuucuuuuagaaa

SEQ ID NO: 2797819 - RNA, 16 nt, Leptospira interrogans serovar lai str. 56601
gaucguguucuaaauu

SEQ ID NO: 2797820 - RNA, 18 nt, Leptospira interrogans serovar lai str. 56601
gaucguguucuaaauuga

SEQ ID NO: 2797821 - RNA, 23 nt, Leptospira interrogans serovar lai str. 56601
gaucguguucuaaauugaaacua

SEQ ID NO: 2797822 - RNA, 21 nt, Leptospira interrogans serovar lai str. 56601
gaucguuggccucgaaaguuu

SEQ ID NO: 2797823 - RNA, 20 nt, Leptospira interrogans serovar lai str. 56601
gaucguuucauucccuucuc

SEQ ID NO: 2797824 - RNA, 21 nt, Leptospira interrogans serovar lai str. 56601
gaucuaaccgacuugagauuc

SEQ ID NO: 2797825 - RNA, 13 nt, Leptospira interrogans serovar lai str. 56601
gaucuaagaaauc

SEQ ID NO: 2797826 - RNA, 21 nt, Leptospira interrogans serovar lai str. 56601
gaucuaauuuguaagaacacu

SEQ ID NO: 2797827 - RNA, 23 nt, Leptospira interrogans serovar lai str. 56601
gaucuacuaaaucagaauaaucu

SEQ ID NO: 2797828 - RNA, 18 nt, Leptospira interrogans serovar lai str. 56601
gaucuacuaagauuucuu

SEQ ID NO: 2797829 - RNA, 23 nt, Leptospira interrogans serovar lai str. 56601
gaucuauaucgugaaacuuucca

SEQ ID NO: 2797830 - RNA, 22 nt, Leptospira interrogans serovar lai str. 56601
gaucuaucuuuccaguauaaua

SEQ ID NO: 2797831 - RNA, 21 nt, Leptospira interrogans serovar lai str. 56601
gaucuauguccuuuuuuucuu

SEQ ID NO: 2797832 - RNA, 18 nt, Leptospira interrogans serovar lai str. 56601
gaucuauuccuaaaaugu

SEQ ID NO: 2797833 - RNA, 18 nt, Leptospira interrogans serovar lai str. 56601
gaucugacuuggugauaa

SEQ ID NO: 2797834 - RNA, 18 nt, Leptospira interrogans serovar lai str. 56601
gaucugauauuuuaaauu

SEQ ID NO: 2797835 - RNA, 21 nt, Leptospira interrogans serovar lai str. 56601
gaucugcuuuuuuaaaccuuc

SEQ ID NO: 2797836 - RNA, 19 nt, Leptospira interrogans serovar lai str. 56601
gaucuuauacucuuaaaau

SEQ ID NO: 2797837 - RNA, 14 nt, Leptospira interrogans serovar lai str. 56601
gaucuuguauaaga

SEQ ID NO: 2797838 - RNA, 12 nt, Leptospira interrogans serovar lai str. 56601
gaucuuuauaaa

SEQ ID NO: 2797839 - RNA, 13 nt, Leptospira interrogans serovar lai str. 56601
gaucuuuuauaau

SEQ ID NO: 2797840 - RNA, 17 nt, Leptospira interrogans serovar lai str. 56601
gaucuuuuugauaaaau

SEQ ID NO: 2797841 - RNA, 19 nt, Leptospira interrogans serovar lai str. 56601
gaucuuuuuuaauuauguu

SEQ ID NO: 2797842 - RNA, 13 nt, Leptospira interrogans serovar lai str. 56601
gaucuuuuuuucu

SEQ ID NO: 2797843 - RNA, 16 nt, Leptospira interrogans serovar lai str. 56601
gaugaaaguuugggau

SEQ ID NO: 2797844 - RNA, 15 nt, Leptospira interrogans serovar lai str. 56601
gaugaaauuuuaaaa

SEQ ID NO: 2797845 - RNA, 19 nt, Leptospira interrogans serovar lai str. 56601
gaugaaauuuuaaaacccg

SEQ ID NO: 2797846 - RNA, 13 nt, Leptospira interrogans serovar lai str. 56601
gaugaauugaauu

SEQ ID NO: 2797847 - RNA, 21 nt, Leptospira interrogans serovar lai str. 56601
gaugagcaaaauuugcuucca

SEQ ID NO: 2797848 - RNA, 20 nt, Leptospira interrogans serovar lai str. 56601
gaugaugggaccaagagugu

SEQ ID NO: 2797849 - RNA, 19 nt, Leptospira interrogans serovar lai str. 56601
gauugauauuucuuaaauu

SEQ ID NO: 2797850 - RNA, 13 nt, Leptospira interrogans serovar lai str. 56601
gauugauugaagc

SEQ ID NO: 2797851 - RNA, 15 nt, Leptospira interrogans serovar lai str. 56601
gauugauuuuggaaa

SEQ ID NO: 2797852 - RNA, 16 nt, Leptospira interrogans serovar lai str. 56601
gauuggacuaaaccac

SEQ ID NO: 2797853 - RNA, 21 nt, Leptospira interrogans serovar lai str. 56601
gauugguguuguguuaguucc

SEQ ID NO: 2797854 - RNA, 23 nt, Leptospira interrogans serovar lai str. 56601
gauuguaaaaaaacaugaagaag

SEQ ID NO: 2797855 - RNA, 22 nt, Leptospira interrogans serovar lai str. 56601
gauuguuuucuaguuuuccuuc

SEQ ID NO: 2797856 - RNA, 20 nt, Leptospira interrogans serovar lai str. 56601
gauuuaaaaacuaucaguuu

SEQ ID NO: 2797857 - RNA, 20 nt, Leptospira interrogans serovar lai str. 56601
gauuuaaaaucacaaaaaag

SEQ ID NO: 2797858 - RNA, 13 nt, Leptospira interrogans serovar lai str. 56601
gauuuaaauuuug

SEQ ID NO: 2797859 - RNA, 20 nt, Leptospira interrogans serovar lai str. 56601
gauuuacuacgucuucuaaa

SEQ ID NO: 2797860 - RNA, 14 nt, Leptospira interrogans serovar lai str. 56601
gauuuacuuuaaaa

SEQ ID NO: 2797861 - RNA, 18 nt, Leptospira interrogans serovar lai str. 56601
gauuuagagccaaauuuu

SEQ ID NO: 2797862 - RNA, 15 nt, Leptospira interrogans serovar lai str. 56601
gauuuagauucuaaa

SEQ ID NO: 2797863 - RNA, 14 nt, Leptospira interrogans serovar lai str. 56601
gauuuauaacuuac

SEQ ID NO: 2797864 - RNA, 15 nt, Leptospira interrogans serovar lai str. 56601
gauuuauaauucccg

SEQ ID NO: 2797865 - RNA, 15 nt, Leptospira interrogans serovar lai str. 56601
gauuuauauguuucu

SEQ ID NO: 2797866 - RNA, 20 nt, Leptospira interrogans serovar lai str. 56601
gauuuauguucguucccaca

SEQ ID NO: 2797867 - RNA, 14 nt, Leptospira interrogans serovar lai str. 56601
gauuuauugaaaaa

SEQ ID NO: 2797868 - RNA, 17 nt, Leptospira interrogans serovar lai str. 56601
gauuuauugaaaaauag

SEQ ID NO: 2797869 - RNA, 20 nt, Leptospira interrogans serovar lai str. 56601
gauuuauugaaaaauagaau

SEQ ID NO: 2797870 - RNA, 15 nt, Leptospira interrogans serovar lai str. 56601
gauuuauuuuagaau

SEQ ID NO: 2797871 - RNA, 16 nt, Leptospira interrogans serovar lai str. 56601
gauuuauuuuagaaug

SEQ ID NO: 2797872 - RNA, 14 nt, Leptospira interrogans serovar lai str. 56601
gauuucaaaaauaa

SEQ ID NO: 2797873 - RNA, 21 nt, Leptospira interrogans serovar lai str. 56601
gauuucaacuuuuuucagaaa

SEQ ID NO: 2797874 - RNA, 24 nt, Leptospira interrogans serovar lai str. 56601
gauuucacgacgucuaugacgaau

SEQ ID NO: 2797875 - RNA, 12 nt, Leptospira interrogans serovar lai str. 56601
gauuucagauuc

SEQ ID NO: 2797876 - RNA, 22 nt, Leptospira interrogans serovar lai str. 56601
gauuucagcuccaaaaaaauaa

SEQ ID NO: 2797877 - RNA, 14 nt, Leptospira interrogans serovar lai str. 56601
gauuucauccaugu

SEQ ID NO: 2797878 - RNA, 23 nt, Leptospira interrogans serovar lai str. 56601
gauuucauccaugucuucuaaau

SEQ ID NO: 2797879 - RNA, 21 nt, Leptospira interrogans serovar lai str. 56601
gauuucguucggaaaaaguau

SEQ ID NO: 2797880 - RNA, 15 nt, Leptospira interrogans serovar lai str. 56601
gauuucuaaauugug

SEQ ID NO: 2797881 - RNA, 19 nt, Leptospira interrogans serovar lai str. 56601
gauuucuaguuuaaacguu

SEQ ID NO: 2797882 - RNA, 15 nt, Leptospira interrogans serovar lai str. 56601
gauuucuauaaaauu

SEQ ID NO: 2797883 - RNA, 21 nt, Leptospira interrogans serovar lai str. 56601
gauuucuuacaccgaauucaa

SEQ ID NO: 2797884 - RNA, 15 nt, Leptospira interrogans serovar lai str. 56601
gauuucuuucaaagc

SEQ ID NO: 2797885 - RNA, 18 nt, Leptospira interrogans serovar lai str. 56601
gauuugcggaucguuuuu

SEQ ID NO: 2797886 - RNA, 16 nt, Leptospira interrogans serovar lai str. 56601
gauuuguccgaaucca

SEQ ID NO: 2797887 - RNA, 14 nt, Leptospira interrogans serovar lai str. 56601
gauuugucucaaaa

SEQ ID NO: 2797888 - RNA, 19 nt, Leptospira interrogans serovar lai str. 56601
gauuugugcaaaaauuuuu

SEQ ID NO: 2797889 - RNA, 13 nt, Leptospira interrogans serovar lai str. 56601
gauuuguugaaaa

SEQ ID NO: 2797890 - RNA, 17 nt, Leptospira interrogans serovar lai str. 56601
gauuuguugaaaaguga

SEQ ID NO: 2797891 - RNA, 19 nt, Leptospira interrogans serovar lai str. 56601
gauuuguuuaggaauuuuu

SEQ ID NO: 2797892 - RNA, 15 nt, Leptospira interrogans serovar lai str. 56601
gauuuguuuuauaaa

SEQ ID NO: 2797893 - RNA, 13 nt, Leptospira interrogans serovar lai str. 56601
gauuuuaaaaauu

SEQ ID NO: 2797894 - RNA, 16 nt, Leptospira interrogans serovar lai str. 56601
gauuuuaaaaauuuug

SEQ ID NO: 2797895 - RNA, 14 nt, Leptospira interrogans serovar lai str. 56601
gauuuuaaauaaaa

SEQ ID NO: 2797896 - RNA, 15 nt, Leptospira interrogans serovar lai str. 56601
gauuuuaaauaaaaa

SEQ ID NO: 2797897 - RNA, 18 nt, Leptospira interrogans serovar lai str. 56601
gauuuuaaauaaaaagaa

SEQ ID NO: 2797898 - RNA, 13 nt, Leptospira interrogans serovar lai str. 56601
gauuuuacaaaca

SEQ ID NO: 2797899 - RNA, 15 nt, Leptospira interrogans serovar lai str. 56601
gauuuuacgaacaaa

SEQ ID NO: 2797900 - RNA, 16 nt, Leptospira interrogans serovar lai str. 56601
gauuuuacgaacaaau

SEQ ID NO: 2797901 - RNA, 21 nt, Leptospira interrogans serovar lai str. 56601
gauuuuacgaacaaauucuaa

SEQ ID NO: 2797902 - RNA, 22 nt, Leptospira interrogans serovar lai str. 56601
gauuuuacgaacaaauucuaaa

SEQ ID NO: 2797903 - RNA, 21 nt, Leptospira interrogans serovar lai str. 56601
gauuuuacgaacacauucuaa

SEQ ID NO: 2797904 - RNA, 22 nt, Leptospira interrogans serovar lai str. 56601
gauuuuacgaacacauucuaaa

SEQ ID NO: 2797905 - RNA, 22 nt, Leptospira interrogans serovar lai str. 56601
gauuuuacgaacgaauucuaaa

SEQ ID NO: 2797906 - RNA, 17 nt, Leptospira interrogans serovar lai str. 56601
gauuuuagaaucagaau

SEQ ID NO: 2797907 - RNA, 12 nt, Leptospira interrogans serovar lai str. 56601
gauuuuauagag

SEQ ID NO: 2797908 - RNA, 17 nt, Leptospira interrogans serovar lai str. 56601
gauuuuaugaaaguuuu

SEQ ID NO: 2797909 - RNA, 16 nt, Leptospira interrogans serovar lai str. 56601
gauuuuauguaagaaa

SEQ ID NO: 2797910 - RNA, 22 nt, Leptospira interrogans serovar lai str. 56601
gauuuuauguaagaaaaacuag

SEQ ID NO: 2797911 - RNA, 19 nt, Leptospira interrogans serovar lai str. 56601
gauuuugaaaguaauuuau

SEQ ID NO: 2797912 - RNA, 15 nt, Leptospira interrogans serovar lai str. 56601
gauuuugaucuuuuu

SEQ ID NO: 2797913 - RNA, 19 nt, Leptospira interrogans serovar lai str. 56601
gauuuuggaaagaauacga

SEQ ID NO: 2797914 - RNA, 18 nt, Leptospira interrogans serovar lai str. 56601
gauuuuggauagcaaaaa

SEQ ID NO: 2797915 - RNA, 15 nt, Leptospira interrogans serovar lai str. 56601
gauuuuuauguaaua

SEQ ID NO: 2797916 - RNA, 18 nt, Leptospira interrogans serovar lai str. 56601
gauuuuucaacaacucua

SEQ ID NO: 2797917 - RNA, 19 nt, Leptospira interrogans serovar lai str. 56601
gauuuuucuguaaaaauaa

SEQ ID NO: 2797918 - RNA, 23 nt, Leptospira interrogans serovar lai str. 56601
gauuuuucuguaaaaauaaaaug

SEQ ID NO: 2797919 - RNA, 21 nt, Leptospira interrogans serovar lai str. 56601
gauuuuuuaaguagaaccuaa

SEQ ID NO: 2797920 - RNA, 21 nt, Leptospira interrogans serovar lai str. 56601
gauuuuuuacaaaaguagaaa

SEQ ID NO: 2797921 - RNA, 23 nt, Leptospira interrogans serovar lai str. 56601
gauuuuuuacaaaaguagaaaga

SEQ ID NO: 2797922 - RNA, 15 nt, Leptospira interrogans serovar lai str. 56601
gauuuuuuagcaccu

SEQ ID NO: 2797923 - RNA, 17 nt, Leptospira interrogans serovar lai str. 56601
gauuuuuucugguggaa

SEQ ID NO: 2797924 - RNA, 11 nt, Leptospira interrogans serovar lai str. 56601
gcaaaaaaaau

SEQ ID NO: 2797925 - RNA, 13 nt, Leptospira interrogans serovar lai str. 56601
gcaaaaaaaauac

SEQ ID NO: 2797926 - RNA, 14 nt, Leptospira interrogans serovar lai str. 56601
gcaaaaaaauaaaa

SEQ ID NO: 2797927 - RNA, 13 nt, Leptospira interrogans serovar lai str. 56601
gcaaaaaagaaag

SEQ ID NO: 2797928 - RNA, 23 nt, Leptospira interrogans serovar lai str. 56601
gcaaaaaagaaagcagcaaagaa

SEQ ID NO: 2797929 - RNA, 13 nt, Leptospira interrogans serovar lai str. 56601
gcaaaaauaaagu

SEQ ID NO: 2797930 - RNA, 13 nt, Leptospira interrogans serovar lai str. 56601
gcaaaaauuuaau

SEQ ID NO: 2797931 - RNA, 21 nt, Leptospira interrogans serovar lai str. 56601
gcaaaacacuuuccuuaaacc

SEQ ID NO: 2797932 - RNA, 15 nt, Leptospira interrogans serovar lai str. 56601
gccaugguaagaaga

SEQ ID NO: 2797933 - RNA, 18 nt, Leptospira interrogans serovar lai str. 56601
gccauuauccaaaacucu

SEQ ID NO: 2797934 - RNA, 22 nt, Leptospira interrogans serovar lai str. 56601
gccauuuagguuguaacucaaa

SEQ ID NO: 2797935 - RNA, 12 nt, Leptospira interrogans serovar lai str. 56601
gccauuuuucuu

SEQ ID NO: 2797936 - RNA, 14 nt, Leptospira interrogans serovar lai str. 56601
gccauuuuuuucuc

SEQ ID NO: 2797937 - RNA, 12 nt, Leptospira interrogans serovar lai str. 56601
gcccaaauuguu

SEQ ID NO: 2797938 - RNA, 22 nt, Leptospira interrogans serovar lai str. 56601
gcccacaucgaaaaaacaaaua

SEQ ID NO: 2797939 - RNA, 17 nt, Leptospira interrogans serovar lai str. 56601
gcccauucuuuccccaa

SEQ ID NO: 2797940 - RNA, 16 nt, Leptospira interrogans serovar lai str. 56601
gccccacccaaaaaua

SEQ ID NO: 2797941 - RNA, 20 nt, Leptospira interrogans serovar lai str. 56601
gccccaccuaaaaugaaaaa

SEQ ID NO: 2797942 - RNA, 17 nt, Leptospira interrogans serovar lai str. 56601
gccccauucuuuuugcc

SEQ ID NO: 2797943 - RNA, 17 nt, Leptospira interrogans serovar lai str. 56601
gcccguuucaauuuuug

SEQ ID NO: 2797944 - RNA, 16 nt, Leptospira interrogans serovar lai str. 56601
gcccucagcuauaaaa

SEQ ID NO: 2797945 - RNA, 23 nt, Leptospira interrogans serovar lai str. 56601
gcccucccguuauuuuuuuuaca

SEQ ID NO: 2797946 - RNA, 15 nt, Leptospira interrogans serovar lai str. 56601
gcccuccuauguuuc

SEQ ID NO: 2797947 - RNA, 18 nt, Leptospira interrogans serovar lai str. 56601
gcccuccuauguuucuug

SEQ ID NO: 2797948 - RNA, 21 nt, Leptospira interrogans serovar lai str. 56601
gcccucugggaucggaaccaa

SEQ ID NO: 2797949 - RNA, 14 nt, Leptospira interrogans serovar lai str. 56601
gccgcuauggaagg

SEQ ID NO: 2797950 - RNA, 20 nt, Leptospira interrogans serovar lai str. 56601
gccgcuauggaauuuuucaa

SEQ ID NO: 2797951 - RNA, 20 nt, Leptospira interrogans serovar lai str. 56601
gccguaaaaaauccaugauu

SEQ ID NO: 2797952 - RNA, 13 nt, Leptospira interrogans serovar lai str. 56601
gccguaaauauuu

SEQ ID NO: 2797953 - RNA, 23 nt, Leptospira interrogans serovar lai str. 56601
gccguuugcaaguagaagucgua

SEQ ID NO: 2797954 - RNA, 20 nt, Leptospira interrogans serovar lai str. 56601
gccuacacuguguucuuuuu

SEQ ID NO: 2797955 - RNA, 17 nt, Leptospira interrogans serovar lai str. 56601
gccuauuuuuuuaaaaa

SEQ ID NO: 2797956 - RNA, 14 nt, Leptospira interrogans serovar lai str. 56601
gccucauuucuugg

SEQ ID NO: 2797957 - RNA, 23 nt, Leptospira interrogans serovar lai str. 56601
gccugccaaaagaacuuugagau

SEQ ID NO: 2797958 - RNA, 12 nt, Leptospira interrogans serovar lai str. 56601
gccuucaauuau

SEQ ID NO: 2797959 - RNA, 14 nt, Leptospira interrogans serovar lai str. 56601
gccuucguuuaaaa

SEQ ID NO: 2797960 - RNA, 16 nt, Leptospira interrogans serovar lai str. 56601
gccuucguuuaaaaaa

SEQ ID NO: 2797961 - RNA, 16 nt, Leptospira interrogans serovar lai str. 56601
gccuucuggaaaaauu

SEQ ID NO: 2797962 - RNA, 15 nt, Leptospira interrogans serovar lai str. 56601
gccuucuuuuuucua

SEQ ID NO: 2797963 - RNA, 20 nt, Leptospira interrogans serovar lai str. 56601
gccuucuuuuuucuaaauaa

SEQ ID NO: 2797964 - RNA, 23 nt, Leptospira interrogans serovar lai str. 56601
gccuuguguucaucguuccaaac

SEQ ID NO: 2797965 - RNA, 18 nt, Leptospira interrogans serovar lai str. 56601
gccuuucaccagaauuua

SEQ ID NO: 2797966 - RNA, 14 nt, Leptospira interrogans serovar lai str. 56601
gccuuuuuauuucu

SEQ ID NO: 2797967 - RNA, 15 nt, Leptospira interrogans serovar lai str. 56601
gccuuuuuauuucua

SEQ ID NO: 2797968 - RNA, 18 nt, Leptospira interrogans serovar lai str. 56601
gcgaaagagggaauguau

SEQ ID NO: 2797969 - RNA, 20 nt, Leptospira interrogans serovar lai str. 56601
gcgaacuuuuuuauaaaugg

SEQ ID NO: 2797970 - RNA, 21 nt, Leptospira interrogans serovar lai str. 56601
gcgaaucgcucgcgaauuuca

SEQ ID NO: 2797971 - RNA, 19 nt, Leptospira interrogans serovar lai str. 56601
gcgaauuucauagucaagg

SEQ ID NO: 2797972 - RNA, 13 nt, Leptospira interrogans serovar lai str. 56601
gcgacaaaaggau

SEQ ID NO: 2797973 - RNA, 19 nt, Leptospira interrogans serovar lai str. 56601
gcgacccauaggaaagcgu

SEQ ID NO: 2797974 - RNA, 15 nt, Leptospira interrogans serovar lai str. 56601
gcgacccuagaagcc

SEQ ID NO: 2797975 - RNA, 16 nt, Leptospira interrogans serovar lai str. 56601
gcgaccgcgcuugaac

SEQ ID NO: 2797976 - RNA, 17 nt, Leptospira interrogans serovar lai str. 56601
gcgaccuuucuaaaaau

SEQ ID NO: 2797977 - RNA, 15 nt, Leptospira interrogans serovar lai str. 56601
gcgaguaacgauuuc

SEQ ID NO: 2797978 - RNA, 20 nt, Leptospira interrogans serovar lai str. 56601
gcgauaaguuuucuaguaaa

SEQ ID NO: 2797979 - RNA, 20 nt, Leptospira interrogans serovar lai str. 56601
gcgaucuaaccgacuugaga

SEQ ID NO: 2797980 - RNA, 15 nt, Leptospira interrogans serovar lai str. 56601
gcgauucuaggaucu

SEQ ID NO: 2797981 - RNA, 22 nt, Leptospira interrogans serovar lai str. 56601
gcggauucuacgacaacuauaa

SEQ ID NO: 2797982 - RNA, 13 nt, Leptospira interrogans serovar lai str. 56601
gcgggauuuugau

SEQ ID NO: 2797983 - RNA, 15 nt, Leptospira interrogans serovar lai str. 56601
gcguauaagaauguu

SEQ ID NO: 2797984 - RNA, 23 nt, Leptospira interrogans serovar lai str. 56601
gcgucucauuucuugaacucaau

SEQ ID NO: 2797985 - RNA, 12 nt, Leptospira interrogans serovar lai str. 56601
gcgucuuugaau

SEQ ID NO: 2797986 - RNA, 21 nt, Leptospira interrogans serovar lai str. 56601
gcguuuaaaccuucuuuaaga

SEQ ID NO: 2797987 - RNA, 22 nt, Leptospira interrogans serovar lai str. 56601
gcguuucguucuuuuuuccuuc

SEQ ID NO: 2797988 - RNA, 23 nt, Leptospira interrogans serovar lai str. 56601
gcguuucguucuuuuuuccuucu

SEQ ID NO: 2797989 - RNA, 18 nt, Leptospira interrogans serovar lai str. 56601
gcguuuuauaauaaauug

SEQ ID NO: 2797990 - RNA, 13 nt, Leptospira interrogans serovar lai str. 56601
gcuaaaaagaaag

SEQ ID NO: 2797991 - RNA, 23 nt, Leptospira interrogans serovar lai str. 56601
gcuaaaaagaaaguugcaaagaa

SEQ ID NO: 2797992 - RNA, 18 nt, Leptospira interrogans serovar lai str. 56601
gcuaaaauaaaguaucca

SEQ ID NO: 2797993 - RNA, 21 nt, Leptospira interrogans serovar lai str. 56601
gcuaaaauuuuuuuaagaauu

SEQ ID NO: 2797994 - RNA, 18 nt, Leptospira interrogans serovar lai str. 56601
gcuaacugauuauaaaaa

SEQ ID NO: 2797995 - RNA, 22 nt, Leptospira interrogans serovar lai str. 56601
gcuaagucuuuaaaaauaggaa

SEQ ID NO: 2797996 - RNA, 22 nt, Leptospira interrogans serovar lai str. 56601
gcuaauucaaccgcaaauuuuu

SEQ ID NO: 2797997 - RNA, 23 nt, Leptospira interrogans serovar lai str. 56601
gcuaauucuuaaaaauuuauaaa

SEQ ID NO: 2797998 - RNA, 22 nt, Leptospira interrogans serovar lai str. 56601
gcuaauuuccaaacuacaaauu

SEQ ID NO: 2797999 - RNA, 19 nt, Leptospira interrogans serovar lai str. 56601
gcuacaauucccauuaaag

SEQ ID NO: 2798000 - RNA, 20 nt, Leptospira interrogans serovar lai str. 56601
gcuacucgaaaguuuauaaa

SEQ ID NO: 2798001 - RNA, 17 nt, Leptospira interrogans serovar lai str. 56601
gcuacucgaauuuauau

SEQ ID NO: 2798002 - RNA, 19 nt, Leptospira interrogans serovar lai str. 56601
gcuacugcaagagagugac

SEQ ID NO: 2798003 - RNA, 13 nt, Leptospira interrogans serovar lai str. 56601
gcuagauuuagau

SEQ ID NO: 2798004 - RNA, 16 nt, Leptospira interrogans serovar lai str. 56601
gcuauaaaaaggaucu

SEQ ID NO: 2798005 - RNA, 19 nt, Leptospira interrogans serovar lai str. 56601
gcuaucuucauuaauuuuu

SEQ ID NO: 2798006 - RNA, 15 nt, Leptospira interrogans serovar lai str. 56601
gcuauggaauuuuuc

SEQ ID NO: 2798007 - RNA, 22 nt, Leptospira interrogans serovar lai str. 56601
gcuauugaauccuuccuccaaa

SEQ ID NO: 2798008 - RNA, 21 nt, Leptospira interrogans serovar lai str. 56601
gcucaaaauucuuaaaaaaua

SEQ ID NO: 2798009 - RNA, 15 nt, Leptospira interrogans serovar lai str. 56601
gcucaauauuuaaaa

SEQ ID NO: 2798010 - RNA, 17 nt, Leptospira interrogans serovar lai str. 56601
gcucaaucaaauuuuug

SEQ ID NO: 2798011 - RNA, 17 nt, Leptospira interrogans serovar lai str. 56601
gcucacuaccuuauaaa

SEQ ID NO: 2798012 - RNA, 15 nt, Leptospira interrogans serovar lai str. 56601
gcucagauuccaacu

SEQ ID NO: 2798013 - RNA, 17 nt, Leptospira interrogans serovar lai str. 56601
gcucagauuuccuuucu

SEQ ID NO: 2798014 - RNA, 15 nt, Leptospira interrogans serovar lai str. 56601
ggaagauaaaacgua

SEQ ID NO: 2798015 - RNA, 13 nt, Leptospira interrogans serovar lai str. 56601
ggaagauucuucu

SEQ ID NO: 2798016 - RNA, 13 nt, Leptospira interrogans serovar lai str. 56601
ggaagauuuuuca

SEQ ID NO: 2798017 - RNA, 13 nt, Leptospira interrogans serovar lai str. 56601
ggaagccaaaacc

SEQ ID NO: 2798018 - RNA, 22 nt, Leptospira interrogans serovar lai str. 56601
ggaagccaaaaccaauuuuuca

SEQ ID NO: 2798019 - RNA, 19 nt, Leptospira interrogans serovar lai str. 56601
ggaauauucguaagaaaaa

SEQ ID NO: 2798020 - RNA, 15 nt, Leptospira interrogans serovar lai str. 56601
ggaaucccaaauucu

SEQ ID NO: 2798021 - RNA, 15 nt, Leptospira interrogans serovar lai str. 56601
ggaaucguuuguaaa

SEQ ID NO: 2798022 - RNA, 17 nt, Leptospira interrogans serovar lai str. 56601
ggaaucuaaacuuugua

SEQ ID NO: 2798023 - RNA, 19 nt, Leptospira interrogans serovar lai str. 56601
ggaaucuaaacuuuguaaa

SEQ ID NO: 2798024 - RNA, 20 nt, Leptospira interrogans serovar lai str. 56601
ggaaucugcaucuuuucuaa

SEQ ID NO: 2798025 - RNA, 14 nt, Leptospira interrogans serovar lai str. 56601
ggaaugugauaguu

SEQ ID NO: 2798026 - RNA, 17 nt, Leptospira interrogans serovar lai str. 56601
ggaauuacgacaaaucu

SEQ ID NO: 2798027 - RNA, 15 nt, Leptospira interrogans serovar lai str. 56601
ggaauuacuacauuu

SEQ ID NO: 2798028 - RNA, 20 nt, Leptospira interrogans serovar lai str. 56601
ggaauuacuacauuugauua

SEQ ID NO: 2798029 - RNA, 21 nt, Leptospira interrogans serovar lai str. 56601
ggaauuccgacccagaaaaaa

SEQ ID NO: 2798030 - RNA, 13 nt, Leptospira interrogans serovar lai str. 56601
ggaauuuuuaaaa

SEQ ID NO: 2798031 - RNA, 21 nt, Leptospira interrogans serovar lai str. 56601
ggaauuuuuguaaaauccaga

SEQ ID NO: 2798032 - RNA, 14 nt, Leptospira interrogans serovar lai str. 56601
ggaauuuuuuugua

SEQ ID NO: 2798033 - RNA, 21 nt, Leptospira interrogans serovar lai str. 56601
ggacaaugcuuuccaaaagga

SEQ ID NO: 2798034 - RNA, 23 nt, Leptospira interrogans serovar lai str. 56601
ggacgaauccugcuaacugauua

SEQ ID NO: 2798035 - RNA, 16 nt, Leptospira interrogans serovar lai str. 56601
ggacggaaucggcuug

SEQ ID NO: 2798036 - RNA, 14 nt, Leptospira interrogans serovar lai str. 56601
ggacucuauuauga

SEQ ID NO: 2798037 - RNA, 17 nt, Leptospira interrogans serovar lai str. 56601
ggagaaaauuuaaacaa

SEQ ID NO: 2798038 - RNA, 15 nt, Leptospira interrogans serovar lai str. 56601
ggagaacucucucaa

SEQ ID NO: 2798039 - RNA, 15 nt, Leptospira interrogans serovar lai str. 56601
ggagaacuuuacaga

SEQ ID NO: 2798040 - RNA, 15 nt, Leptospira interrogans serovar lai str. 56601
ggagaauaaggcaaa

SEQ ID NO: 2798041 - RNA, 14 nt, Leptospira interrogans serovar lai str. 56601
ggagaguuaugagu

SEQ ID NO: 2798042 - RNA, 13 nt, Leptospira interrogans serovar lai str. 56601
ggagauaaaaaag

SEQ ID NO: 2798043 - RNA, 13 nt, Leptospira interrogans serovar lai str. 56601
ggagauuacuuuu

SEQ ID NO: 2798044 - RNA, 14 nt, Leptospira interrogans serovar lai str. 56601
ggaggauuagaaga

SEQ ID NO: 2798045 - RNA, 15 nt, Leptospira interrogans serovar lai str. 56601
ggaggauuagaagaa

SEQ ID NO: 2798046 - RNA, 16 nt, Leptospira interrogans serovar lai str. 56601
ggaguagauuccuaca

SEQ ID NO: 2798047 - RNA, 15 nt, Leptospira interrogans serovar lai str. 56601
ggaguauuuuuuccu

SEQ ID NO: 2798048 - RNA, 17 nt, Leptospira interrogans serovar lai str. 56601
ggaguucuaaauuauga

SEQ ID NO: 2798049 - RNA, 20 nt, Leptospira interrogans serovar lai str. 56601
ggaguuuuuacuaugaagac

SEQ ID NO: 2798050 - RNA, 23 nt, Leptospira interrogans serovar lai str. 56601
ggauagguuccaauuccauuucu

SEQ ID NO: 2798051 - RNA, 21 nt, Leptospira interrogans serovar lai str. 56601
ggaucaaaucgcgaagaaagg

SEQ ID NO: 2798052 - RNA, 14 nt, Leptospira interrogans serovar lai str. 56601
ggaucaacaaaauu

SEQ ID NO: 2798053 - RNA, 20 nt, Leptospira interrogans serovar lai str. 56601
ggaucgaucuguaaaaugua

SEQ ID NO: 2798054 - RNA, 21 nt, Leptospira interrogans serovar lai str. 56601
ggaucgcguuugaaacucagu

SEQ ID NO: 2798055 - RNA, 12 nt, Leptospira interrogans serovar lai str. 56601
ggaucguucucc

SEQ ID NO: 2798056 - RNA, 23 nt, Leptospira interrogans serovar lai str. 56601
ggaucucgagugagguuuuggaa

SEQ ID NO: 2798057 - RNA, 13 nt, Leptospira interrogans serovar lai str. 56601
ggaugaagcuaug

SEQ ID NO: 2798058 - RNA, 13 nt, Leptospira interrogans serovar lai str. 56601
ggaugaauugauu

SEQ ID NO: 2798059 - RNA, 17 nt, Leptospira interrogans serovar lai str. 56601
ggauggaaaaugaauuu

SEQ ID NO: 2798060 - RNA, 22 nt, Leptospira interrogans serovar lai str. 56601
ggaugguuguuaggauaaaagg

SEQ ID NO: 2798061 - RNA, 18 nt, Leptospira interrogans serovar lai str. 56601
ggauuaucccaguugaga

SEQ ID NO: 2798062 - RNA, 15 nt, Leptospira interrogans serovar lai str. 56601
ggauuaugaagaaug

SEQ ID NO: 2798063 - RNA, 20 nt, Leptospira interrogans serovar lai str. 56601
ggauucacauuaaaauagga

SEQ ID NO: 2798064 - RNA, 22 nt, Leptospira interrogans serovar lai str. 56601
ggauucacauuaaaauaggauu

SEQ ID NO: 2798065 - RNA, 15 nt, Leptospira interrogans serovar lai str. 56601
ggauuccauucuuca

SEQ ID NO: 2798066 - RNA, 20 nt, Leptospira interrogans serovar lai str. 56601
ggauucuacgacaacuauaa

SEQ ID NO: 2798067 - RNA, 17 nt, Leptospira interrogans serovar lai str. 56601
ggauucugcucuucuaa

SEQ ID NO: 2798068 - RNA, 17 nt, Leptospira interrogans serovar lai str. 56601
ggauugccuaaauuccu

SEQ ID NO: 2798069 - RNA, 20 nt, Leptospira interrogans serovar lai str. 56601
ggauugccuaaauuccuucc

SEQ ID NO: 2798070 - RNA, 20 nt, Leptospira interrogans serovar lai str. 56601
ggauuucguuucuuuuucua

SEQ ID NO: 2798071 - RNA, 19 nt, Leptospira interrogans serovar lai str. 56601
ggauuuuauguaagaaaaa

SEQ ID NO: 2798072 - RNA, 20 nt, Leptospira interrogans serovar lai str. 56601
ggcaaaauccgaaacguuuu

SEQ ID NO: 2798073 - RNA, 22 nt, Leptospira interrogans serovar lai str. 56601
ggcaaucgaaguugauuucaga

SEQ ID NO: 2798074 - RNA, 17 nt, Leptospira interrogans serovar lai str. 56601
ggcagccaauuccaaac

SEQ ID NO: 2798075 - RNA, 16 nt, Leptospira interrogans serovar lai str. 56601
ggcauaagcaaaaaua

SEQ ID NO: 2798076 - RNA, 17 nt, Leptospira interrogans serovar lai str. 56601
ggcauaagcaaaaauaa

SEQ ID NO: 2798077 - RNA, 15 nt, Leptospira interrogans serovar lai str. 56601
ggcauaugaaaauaa

SEQ ID NO: 2798078 - RNA, 20 nt, Leptospira interrogans serovar lai str. 56601
ggcauuaauauaaaaaauaa

SEQ ID NO: 2798079 - RNA, 21 nt, Leptospira interrogans serovar lai str. 56601
ggccaaauuugcgaaaaaaau

SEQ ID NO: 2798080 - RNA, 17 nt, Leptospira interrogans serovar lai str. 56601
ggccccaccuaaaauga

SEQ ID NO: 2798081 - RNA, 15 nt, Leptospira interrogans serovar lai str. 56601
ggcgagacauaaaaa

SEQ ID NO: 2798082 - RNA, 18 nt, Leptospira interrogans serovar lai str. 56601
ggcgagacauaaaaaaau

SEQ ID NO: 2798083 - RNA, 23 nt, Leptospira interrogans serovar lai str. 56601
ggcggaaugcaacagagaaagug

SEQ ID NO: 2798084 - RNA, 20 nt, Leptospira interrogans serovar lai str. 56601
ggcggcgugagcggaaggaa

SEQ ID NO: 2798085 - RNA, 17 nt, Leptospira interrogans serovar lai str. 56601
ggcgugagcggaaggaa

SEQ ID NO: 2798086 - RNA, 17 nt, Leptospira interrogans serovar lai str. 56601
ggcuaaagaauacauuu

SEQ ID NO: 2798087 - RNA, 13 nt, Leptospira interrogans serovar lai str. 56601
ggcuccauauucc

SEQ ID NO: 2798088 - RNA, 19 nt, Leptospira interrogans serovar lai str. 56601
ggcugauucccaguaaauc

SEQ ID NO: 2798089 - RNA, 21 nt, Leptospira interrogans serovar lai str. 56601
ggcuuguauuuuauuuuugga

SEQ ID NO: 2798090 - RNA, 19 nt, Leptospira interrogans serovar lai str. 56601
ggcuuguuucaaaagguuu

SEQ ID NO: 2798091 - RNA, 17 nt, Leptospira interrogans serovar lai str. 56601
ggcuuuacauuuuuaaa

SEQ ID NO: 2798092 - RNA, 18 nt, Leptospira interrogans serovar lai str. 56601
ggcuuuaguuugaaagaa

SEQ ID NO: 2798093 - RNA, 13 nt, Leptospira interrogans serovar lai str. 56601
ggcuuuuguaaau

SEQ ID NO: 2798094 - RNA, 14 nt, Leptospira interrogans serovar lai str. 56601
gggaacuacuacau

SEQ ID NO: 2798095 - RNA, 19 nt, Leptospira interrogans serovar lai str. 56601
gggaacuaucacaaaucua

SEQ ID NO: 2798096 - RNA, 16 nt, Leptospira interrogans serovar lai str. 56601
gggaagguuuuguaaa

SEQ ID NO: 2798097 - RNA, 14 nt, Leptospira interrogans serovar lai str. 56601
guaaagauuagaaa

SEQ ID NO: 2798098 - RNA, 17 nt, Leptospira interrogans serovar lai str. 56601
guaaagauuagaaaaac

SEQ ID NO: 2798099 - RNA, 18 nt, Leptospira interrogans serovar lai str. 56601
guaaaggaauccaugauu

SEQ ID NO: 2798100 - RNA, 21 nt, Leptospira interrogans serovar lai str. 56601
guaaaguucuuuucuuaaaaa

SEQ ID NO: 2798101 - RNA, 12 nt, Leptospira interrogans serovar lai str. 56601
guaaaguuuaga

SEQ ID NO: 2798102 - RNA, 15 nt, Leptospira interrogans serovar lai str. 56601
guaaauaccuguucg

SEQ ID NO: 2798103 - RNA, 22 nt, Leptospira interrogans serovar lai str. 56601
guaaauaucaaaugugagaguu

SEQ ID NO: 2798104 - RNA, 20 nt, Leptospira interrogans serovar lai str. 56601
guaaauauuuuuuuuaauca

SEQ ID NO: 2798105 - RNA, 15 nt, Leptospira interrogans serovar lai str. 56601
guaaauccguauacu

SEQ ID NO: 2798106 - RNA, 18 nt, Leptospira interrogans serovar lai str. 56601
guaaauccguauacuuua

SEQ ID NO: 2798107 - RNA, 22 nt, Leptospira interrogans serovar lai str. 56601
guaaauccguauacuuuaaaaa

SEQ ID NO: 2798108 - RNA, 18 nt, Leptospira interrogans serovar lai str. 56601
guaaaucgcugauaaauu

SEQ ID NO: 2798109 - RNA, 20 nt, Leptospira interrogans serovar lai str. 56601
guaaaucgcugauaaauuuc

SEQ ID NO: 2798110 - RNA, 22 nt, Leptospira interrogans serovar lai str. 56601
guaaaugaauuggaaagaagga

SEQ ID NO: 2798111 - RNA, 18 nt, Leptospira interrogans serovar lai str. 56601
guaaaugaauuuagaaaa

SEQ ID NO: 2798112 - RNA, 19 nt, Leptospira interrogans serovar lai str. 56601
guaaaugaauuuagaaaau

SEQ ID NO: 2798113 - RNA, 13 nt, Leptospira interrogans serovar lai str. 56601
guaaauucaaagc

SEQ ID NO: 2798114 - RNA, 14 nt, Leptospira interrogans serovar lai str. 56601
guaaauuuuuauca

SEQ ID NO: 2798115 - RNA, 19 nt, Leptospira interrogans serovar lai str. 56601
guaaauuuuuaucauaaaa

SEQ ID NO: 2798116 - RNA, 22 nt, Leptospira interrogans serovar lai str. 56601
guaacagaaaaauguuaaaaaa

SEQ ID NO: 2798117 - RNA, 13 nt, Leptospira interrogans serovar lai str. 56601
guaacaguaagaa

SEQ ID NO: 2798118 - RNA, 19 nt, Leptospira interrogans serovar lai str. 56601
guaaccuuuguuuccucuu

SEQ ID NO: 2798119 - RNA, 23 nt, Leptospira interrogans serovar lai str. 56601
guaaccuuuguuuccucuugaag

SEQ ID NO: 2798120 - RNA, 20 nt, Leptospira interrogans serovar lai str. 56601
guaacgagcaucuuuagaau

SEQ ID NO: 2798121 - RNA, 15 nt, Leptospira interrogans serovar lai str. 56601
guaacgaguagaauu

SEQ ID NO: 2798122 - RNA, 15 nt, Leptospira interrogans serovar lai str. 56601
guaacgauuucuauu

SEQ ID NO: 2798123 - RNA, 18 nt, Leptospira interrogans serovar lai str. 56601
guaacucaaaauuucgga

SEQ ID NO: 2798124 - RNA, 13 nt, Leptospira interrogans serovar lai str. 56601
guaacuccuagau

SEQ ID NO: 2798125 - RNA, 21 nt, Leptospira interrogans serovar lai str. 56601
guaacugacauuccagcuucu

SEQ ID NO: 2798126 - RNA, 14 nt, Leptospira interrogans serovar lai str. 56601
guaacuuucuuuua

SEQ ID NO: 2798127 - RNA, 14 nt, Leptospira interrogans serovar lai str. 56601
guaagaaaaacuag

SEQ ID NO: 2798128 - RNA, 15 nt, Leptospira interrogans serovar lai str. 56601
guaagaaaauuugga

SEQ ID NO: 2798129 - RNA, 22 nt, Leptospira interrogans serovar lai str. 56601
guaagaaccgggcaauaauguc

SEQ ID NO: 2798130 - RNA, 15 nt, Leptospira interrogans serovar lai str. 56601
guaagaguuccuaca

SEQ ID NO: 2798131 - RNA, 16 nt, Leptospira interrogans serovar lai str. 56601
guaagauaugaauuaa

SEQ ID NO: 2798132 - RNA, 16 nt, Leptospira interrogans serovar lai str. 56601
guaagcguaaauuaca

SEQ ID NO: 2798133 - RNA, 16 nt, Leptospira interrogans serovar lai str. 56601
guaagcuugauuuucg

SEQ ID NO: 2798134 - RNA, 18 nt, Leptospira interrogans serovar lai str. 56601
guaagggaaaguuauuuc

SEQ ID NO: 2798135 - RNA, 17 nt, Leptospira interrogans serovar lai str. 56601
guaaguaucuaaaaguu

SEQ ID NO: 2798136 - RNA, 16 nt, Leptospira interrogans serovar lai str. 56601
guaaguccaaugaaaa

SEQ ID NO: 2798137 - RNA, 20 nt, Leptospira interrogans serovar lai str. 56601
guaaguugagaauauaagaa

SEQ ID NO: 2798138 - RNA, 23 nt, Leptospira interrogans serovar lai str. 56601
guaaguuuuucgauaaaguaaaa

SEQ ID NO: 2798139 - RNA, 22 nt, Leptospira interrogans serovar lai str. 56601
guaauacgauauuuuguuuuua

SEQ ID NO: 2798140 - RNA, 13 nt, Leptospira interrogans serovar lai str. 56601
guaauauaucagu

SEQ ID NO: 2798141 - RNA, 17 nt, Leptospira interrogans serovar lai str. 56601
guaaucaguuaaacccg

SEQ ID NO: 2798142 - RNA, 18 nt, Leptospira interrogans serovar lai str. 56601
guaaucugugggaacuac

SEQ ID NO: 2798143 - RNA, 15 nt, Leptospira interrogans serovar lai str. 56601
guaaugaaaucuagu

SEQ ID NO: 2798144 - RNA, 17 nt, Leptospira interrogans serovar lai str. 56601
guaaugaaaucuaguuc

SEQ ID NO: 2798145 - RNA, 15 nt, Leptospira interrogans serovar lai str. 56601
guaauuaaaauuuac

SEQ ID NO: 2798146 - RNA, 12 nt, Leptospira interrogans serovar lai str. 56601
guaauuaaauuu

SEQ ID NO: 2798147 - RNA, 22 nt, Leptospira interrogans serovar lai str. 56601
guaauuccagaggcaguacaau

SEQ ID NO: 2798148 - RNA, 21 nt, Leptospira interrogans serovar lai str. 56601
guaauucguuccaaauacaau

SEQ ID NO: 2798149 - RNA, 13 nt, Leptospira interrogans serovar lai str. 56601
guaauucuuugga

SEQ ID NO: 2798150 - RNA, 20 nt, Leptospira interrogans serovar lai str. 56601
guaauucuuuggaaauuuuu

SEQ ID NO: 2798151 - RNA, 19 nt, Leptospira interrogans serovar lai str. 56601
guaauuguagauucuuuua

SEQ ID NO: 2798152 - RNA, 13 nt, Leptospira interrogans serovar lai str. 56601
guaauuuauauua

SEQ ID NO: 2798153 - RNA, 17 nt, Leptospira interrogans serovar lai str. 56601
guaauuuaucuguaauu

SEQ ID NO: 2798154 - RNA, 17 nt, Leptospira interrogans serovar lai str. 56601
guaauuucguuuuuuua

SEQ ID NO: 2798155 - RNA, 19 nt, Leptospira interrogans serovar lai str. 56601
guacaaaaaugugggaacu

SEQ ID NO: 2798156 - RNA, 20 nt, Leptospira interrogans serovar lai str. 56601
guacaaauugguuuuuauua

SEQ ID NO: 2798157 - RNA, 23 nt, Leptospira interrogans serovar lai str. 56601
guacaacauccuucaaacuuuuc

SEQ ID NO: 2798158 - RNA, 23 nt, Leptospira interrogans serovar lai str. 56601
guacaaucccggcggaaaauccu

SEQ ID NO: 2798159 - RNA, 20 nt, Leptospira interrogans serovar lai str. 56601
guaccauaaauuuuuauuac

SEQ ID NO: 2798160 - RNA, 22 nt, Leptospira interrogans serovar lai str. 56601
guaccauaggcgcggaaaaauu

SEQ ID NO: 2798161 - RNA, 15 nt, Leptospira interrogans serovar lai str. 56601
guaccauuuugauac

SEQ ID NO: 2798162 - RNA, 15 nt, Leptospira interrogans serovar lai str. 56601
guaccguaaagaaga

SEQ ID NO: 2798163 - RNA, 16 nt, Leptospira interrogans serovar lai str. 56601
guaccguuuauuuuua

SEQ ID NO: 2798164 - RNA, 18 nt, Leptospira interrogans serovar lai str. 56601
guacuaaaauuuuauaaa

SEQ ID NO: 2798165 - RNA, 19 nt, Leptospira interrogans serovar lai str. 56601
guacuaaaauuuuauaaaa

SEQ ID NO: 2798166 - RNA, 17 nt, Leptospira interrogans serovar lai str. 56601
guacucugcaaaauuua

SEQ ID NO: 2798167 - RNA, 15 nt, Leptospira interrogans serovar lai str. 56601
guacuuacuaaacga

SEQ ID NO: 2798168 - RNA, 19 nt, Leptospira interrogans serovar lai str. 56601
guacuuuacguagaaacaa

SEQ ID NO: 2798169 - RNA, 17 nt, Leptospira interrogans serovar lai str. 56601
guagaaauucuauuuua

SEQ ID NO: 2798170 - RNA, 15 nt, Leptospira interrogans serovar lai str. 56601
guagauaauuaaaca

SEQ ID NO: 2798171 - RNA, 18 nt, Leptospira interrogans serovar lai str. 56601
guagauacaauuaaacga

SEQ ID NO: 2798172 - RNA, 12 nt, Leptospira interrogans serovar lai str. 56601
guagaucaaauc

SEQ ID NO: 2798173 - RNA, 18 nt, Leptospira interrogans serovar lai str. 56601
guagauugcuuuuuaaaa

SEQ ID NO: 2798174 - RNA, 13 nt, Leptospira interrogans serovar lai str. 56601
guagcaagaacug

SEQ ID NO: 2798175 - RNA, 21 nt, Leptospira interrogans serovar lai str. 56601
guaggauguugcucuaagaga

SEQ ID NO: 2798176 - RNA, 18 nt, Leptospira interrogans serovar lai str. 56601
guaguagucccacauuuu

SEQ ID NO: 2798177 - RNA, 18 nt, Leptospira interrogans serovar lai str. 56601
guaguaugcgaaauuccu

SEQ ID NO: 2798178 - RNA, 17 nt, Leptospira interrogans serovar lai str. 56601
guaguuaauaaauuuuu

SEQ ID NO: 2798179 - RNA, 17 nt, Leptospira interrogans serovar lai str. 56601
guaguuauauuaauauu

SEQ ID NO: 2798180 - RNA, 18 nt, Leptospira interrogans serovar lai str. 56601
gucuaugaugcauuucug

SEQ ID NO: 2798181 - RNA, 14 nt, Leptospira interrogans serovar lai str. 56601
gucuauuacaaaac

SEQ ID NO: 2798182 - RNA, 17 nt, Leptospira interrogans serovar lai str. 56601
gucuauuacaaaacuua

SEQ ID NO: 2798183 - RNA, 21 nt, Leptospira interrogans serovar lai str. 56601
gucuauuucccaaaauuucag

SEQ ID NO: 2798184 - RNA, 23 nt, Leptospira interrogans serovar lai str. 56601
gucucaaaaccuguaaaugaauu

SEQ ID NO: 2798185 - RNA, 20 nt, Leptospira interrogans serovar lai str. 56601
gucucaaaauuaagaaucaa

SEQ ID NO: 2798186 - RNA, 15 nt, Leptospira interrogans serovar lai str. 56601
gucucauuucaaauu

SEQ ID NO: 2798187 - RNA, 16 nt, Leptospira interrogans serovar lai str. 56601
gucuccaaagugacca

SEQ ID NO: 2798188 - RNA, 18 nt, Leptospira interrogans serovar lai str. 56601
gucucgaauuguuuuuaa

SEQ ID NO: 2798189 - RNA, 13 nt, Leptospira interrogans serovar lai str. 56601
gucugaaauaaau

SEQ ID NO: 2798190 - RNA, 17 nt, Leptospira interrogans serovar lai str. 56601
gucugaauccuuuaaac

SEQ ID NO: 2798191 - RNA, 18 nt, Leptospira interrogans serovar lai str. 56601
gucugguuuauuuuugaa

SEQ ID NO: 2798192 - RNA, 21 nt, Leptospira interrogans serovar lai str. 56601
gucugguuuauuuuugaauuu

SEQ ID NO: 2798193 - RNA, 17 nt, Leptospira interrogans serovar lai str. 56601
gucuguaaaagaaaaau

SEQ ID NO: 2798194 - RNA, 19 nt, Leptospira interrogans serovar lai str. 56601
gucuguaaaagaaaaauua

SEQ ID NO: 2798195 - RNA, 13 nt, Leptospira interrogans serovar lai str. 56601
gucugucuuaaaa

SEQ ID NO: 2798196 - RNA, 22 nt, Leptospira interrogans serovar lai str. 56601
gucugucuuaaaauuugaaaag

SEQ ID NO: 2798197 - RNA, 12 nt, Leptospira interrogans serovar lai str. 56601
gucuucuaaauu

SEQ ID NO: 2798198 - RNA, 15 nt, Leptospira interrogans serovar lai str. 56601
gucuugaacuuucuu

SEQ ID NO: 2798199 - RNA, 18 nt, Leptospira interrogans serovar lai str. 56601
gucuugaacuuucuuauc

SEQ ID NO: 2798200 - RNA, 17 nt, Leptospira interrogans serovar lai str. 56601
gucuugauuauuuucug

SEQ ID NO: 2798201 - RNA, 21 nt, Leptospira interrogans serovar lai str. 56601
gucuuuauccauccauacaac

SEQ ID NO: 2798202 - RNA, 19 nt, Leptospira interrogans serovar lai str. 56601
gucuuuaugcgguuuuacu

SEQ ID NO: 2798203 - RNA, 12 nt, Leptospira interrogans serovar lai str. 56601
gucuuucuucug

SEQ ID NO: 2798204 - RNA, 16 nt, Leptospira interrogans serovar lai str. 56601
gugaaacuuaaucuca

SEQ ID NO: 2798205 - RNA, 20 nt, Leptospira interrogans serovar lai str. 56601
gugaaagauuaaagauuugc

SEQ ID NO: 2798206 - RNA, 17 nt, Leptospira interrogans serovar lai str. 56601
gugaaaguaaucuuuuu

SEQ ID NO: 2798207 - RNA, 21 nt, Leptospira interrogans serovar lai str. 56601
gugaaaguaaucuuuuuaaaa

SEQ ID NO: 2798208 - RNA, 14 nt, Leptospira interrogans serovar lai str. 56601
gugaacuauuuaua

SEQ ID NO: 2798209 - RNA, 16 nt, Leptospira interrogans serovar lai str. 56601
gugaaucgaaaguuua

SEQ ID NO: 2798210 - RNA, 15 nt, Leptospira interrogans serovar lai str. 56601
gugaauucagaaaaa

SEQ ID NO: 2798211 - RNA, 20 nt, Leptospira interrogans serovar lai str. 56601
gugaauucucuagaaauuua

SEQ ID NO: 2798212 - RNA, 15 nt, Leptospira interrogans serovar lai str. 56601
gugagacgcuuucgu

SEQ ID NO: 2798213 - RNA, 14 nt, Leptospira interrogans serovar lai str. 56601
gugagaguucccac

SEQ ID NO: 2798214 - RNA, 21 nt, Leptospira interrogans serovar lai str. 56601
gugagcucuauguaagaaaau

SEQ ID NO: 2798215 - RNA, 17 nt, Leptospira interrogans serovar lai str. 56601
gugaguuuuaaaacuca

SEQ ID NO: 2798216 - RNA, 16 nt, Leptospira interrogans serovar lai str. 56601
gugauaauucuuuaga

SEQ ID NO: 2798217 - RNA, 18 nt, Leptospira interrogans serovar lai str. 56601
gugaucagaauuaaaaau

SEQ ID NO: 2798218 - RNA, 13 nt, Leptospira interrogans serovar lai str. 56601
gugaucuaugaua

SEQ ID NO: 2798219 - RNA, 16 nt, Leptospira interrogans serovar lai str. 56601
gugaucuccuaaaaua

SEQ ID NO: 2798220 - RNA, 19 nt, Leptospira interrogans serovar lai str. 56601
gugaucuccuaaaauaaaa

SEQ ID NO: 2798221 - RNA, 16 nt, Leptospira interrogans serovar lai str. 56601
gugaugaagagaaagu

SEQ ID NO: 2798222 - RNA, 20 nt, Leptospira interrogans serovar lai str. 56601
gugauuguuuguuuuuucca

SEQ ID NO: 2798223 - RNA, 14 nt, Leptospira interrogans serovar lai str. 56601
gugauuuaaaaaua

SEQ ID NO: 2798224 - RNA, 21 nt, Leptospira interrogans serovar lai str. 56601
gugauuucaugcaaaaauuua

SEQ ID NO: 2798225 - RNA, 15 nt, Leptospira interrogans serovar lai str. 56601
gugcauuuaaaaaau

SEQ ID NO: 2798226 - RNA, 14 nt, Leptospira interrogans serovar lai str. 56601
gugcgguauuuuuu

SEQ ID NO: 2798227 - RNA, 16 nt, Leptospira interrogans serovar lai str. 56601
gugcuauauucaaaaa

SEQ ID NO: 2798228 - RNA, 22 nt, Leptospira interrogans serovar lai str. 56601
gugcuauauucaaaaaaguuua

SEQ ID NO: 2798229 - RNA, 18 nt, Leptospira interrogans serovar lai str. 56601
gugcuuuguucaaagaaa

SEQ ID NO: 2798230 - RNA, 22 nt, Leptospira interrogans serovar lai str. 56601
guggaaacgucauaguucccac

SEQ ID NO: 2798231 - RNA, 23 nt, Leptospira interrogans serovar lai str. 56601
guggaacucuauauaaagaaaaa

SEQ ID NO: 2798232 - RNA, 22 nt, Leptospira interrogans serovar lai str. 56601
guggagauuuugcacguaaaca

SEQ ID NO: 2798233 - RNA, 19 nt, Leptospira interrogans serovar lai str. 56601
gugggaauuacuacaaauu

SEQ ID NO: 2798234 - RNA, 23 nt, Leptospira interrogans serovar lai str. 56601
gugguaacuacuacgaaaauuua

SEQ ID NO: 2798235 - RNA, 23 nt, Leptospira interrogans serovar lai str. 56601
guggucaacaucucaaucaaaau

SEQ ID NO: 2798236 - RNA, 15 nt, Leptospira interrogans serovar lai str. 56601
guguaaaaaaauuuu

SEQ ID NO: 2798237 - RNA, 14 nt, Leptospira interrogans serovar lai str. 56601
guguaaaacccauc

SEQ ID NO: 2798238 - RNA, 12 nt, Leptospira interrogans serovar lai str. 56601
guguaaaauuuu

SEQ ID NO: 2798239 - RNA, 13 nt, Leptospira interrogans serovar lai str. 56601
guguaaacuauua

SEQ ID NO: 2798240 - RNA, 13 nt, Leptospira interrogans serovar lai str. 56601
guguaauaugaau

SEQ ID NO: 2798241 - RNA, 16 nt, Leptospira interrogans serovar lai str. 56601
guguaaucuuauuuuu

SEQ ID NO: 2798242 - RNA, 11 nt, Leptospira interrogans serovar lai str. 56601
gugucaagccc

SEQ ID NO: 2798243 - RNA, 13 nt, Leptospira interrogans serovar lai str. 56601
gugucaagcccuc

SEQ ID NO: 2798244 - RNA, 13 nt, Leptospira interrogans serovar lai str. 56601
gugucauguuuua

SEQ ID NO: 2798245 - RNA, 16 nt, Leptospira interrogans serovar lai str. 56601
guguuugcugaguuau

SEQ ID NO: 2798246 - RNA, 19 nt, Leptospira interrogans serovar lai str. 56601
guguuuuuuaacauuuguu

SEQ ID NO: 2798247 - RNA, 16 nt, Leptospira interrogans serovar lai str. 56601
guuaaaaaacuauaaa

SEQ ID NO: 2798248 - RNA, 14 nt, Leptospira interrogans serovar lai str. 56601
guuaaaagauuugu

SEQ ID NO: 2798249 - RNA, 22 nt, Leptospira interrogans serovar lai str. 56601
guuaaaagauuuguuuuauaaa

SEQ ID NO: 2798250 - RNA, 23 nt, Leptospira interrogans serovar lai str. 56601
guuaaaagccauuucaaaaauau

SEQ ID NO: 2798251 - RNA, 21 nt, Leptospira interrogans serovar lai str. 56601
guuaaauuuuuugcaaaaaaa

SEQ ID NO: 2798252 - RNA, 16 nt, Leptospira interrogans serovar lai str. 56601
guuaaccaaaaauuca

SEQ ID NO: 2798253 - RNA, 19 nt, Leptospira interrogans serovar lai str. 56601
guuaacgcguugauuucua

SEQ ID NO: 2798254 - RNA, 15 nt, Leptospira interrogans serovar lai str. 56601
guuaagaauaaauaa

SEQ ID NO: 2798255 - RNA, 22 nt, Leptospira interrogans serovar lai str. 56601
guuaagaguuuguuccaaaaac

SEQ ID NO: 2798256 - RNA, 21 nt, Leptospira interrogans serovar lai str. 56601
guuaauaaauugcauaaaaga

SEQ ID NO: 2798257 - RNA, 22 nt, Leptospira interrogans serovar lai str. 56601
guuaauaaauugcauaaaagaa

SEQ ID NO: 2798258 - RNA, 16 nt, Leptospira interrogans serovar lai str. 56601
guuaauacaaaacuua

SEQ ID NO: 2798259 - RNA, 23 nt, Leptospira interrogans serovar lai str. 56601
guuaauacaaaacuuaaauucgg

SEQ ID NO: 2798260 - RNA, 15 nt, Leptospira interrogans serovar lai str. 56601
guuaauagaguuguu

SEQ ID NO: 2798261 - RNA, 17 nt, Leptospira interrogans serovar lai str. 56601
guuaaucagagcaucau

SEQ ID NO: 2798262 - RNA, 19 nt, Leptospira interrogans serovar lai str. 56601
guuaauuuagaauaaaaac

SEQ ID NO: 2798263 - RNA, 14 nt, Leptospira interrogans serovar lai str. 56601
guucuaguauuauu

SEQ ID NO: 2798264 - RNA, 16 nt, Leptospira interrogans serovar lai str. 56601
guucuauaaacucaaa

SEQ ID NO: 2798265 - RNA, 23 nt, Leptospira interrogans serovar lai str. 56601
guucucccaaaccucguacuaau

SEQ ID NO: 2798266 - RNA, 20 nt, Leptospira interrogans serovar lai str. 56601
guucugaggaggauuagaag

SEQ ID NO: 2798267 - RNA, 21 nt, Leptospira interrogans serovar lai str. 56601
guucugagucguucgacaauu

SEQ ID NO: 2798268 - RNA, 15 nt, Leptospira interrogans serovar lai str. 56601
guucugggcucaaaa

SEQ ID NO: 2798269 - RNA, 22 nt, Leptospira interrogans serovar lai str. 56601
guucuggguaaaaaaaaaugag

SEQ ID NO: 2798270 - RNA, 17 nt, Leptospira interrogans serovar lai str. 56601
guucuguugaguucauu

SEQ ID NO: 2798271 - RNA, 19 nt, Leptospira interrogans serovar lai str. 56601
guucuguugaguucauucu

SEQ ID NO: 2798272 - RNA, 13 nt, Leptospira interrogans serovar lai str. 56601
guucuuaaauaaa

SEQ ID NO: 2798273 - RNA, 14 nt, Leptospira interrogans serovar lai str. 56601
guucuuaaauaaaa

SEQ ID NO: 2798274 - RNA, 21 nt, Leptospira interrogans serovar lai str. 56601
guucuuaaauaaaauuuuccg

SEQ ID NO: 2798275 - RNA, 17 nt, Leptospira interrogans serovar lai str. 56601
guucuuacaauaaaaac

SEQ ID NO: 2798276 - RNA, 14 nt, Leptospira interrogans serovar lai str. 56601
guucuucauuaaac

SEQ ID NO: 2798277 - RNA, 22 nt, Leptospira interrogans serovar lai str. 56601
guucuucauuaaacaauuuuuc

SEQ ID NO: 2798278 - RNA, 19 nt, Leptospira interrogans serovar lai str. 56601
guucuucgucuaacacgga

SEQ ID NO: 2798279 - RNA, 19 nt, Leptospira interrogans serovar lai str. 56601
guucuugcaaaaauagaau

SEQ ID NO: 2798280 - RNA, 13 nt, Leptospira interrogans serovar lai str. 56601
guucuugugggaa

SEQ ID NO: 2798281 - RNA, 17 nt, Leptospira interrogans serovar lai str. 56601
guucuuuuuuccuucuu

SEQ ID NO: 2798282 - RNA, 14 nt, Leptospira interrogans serovar lai str. 56601
guugaaagaaucua

SEQ ID NO: 2798283 - RNA, 22 nt, Leptospira interrogans serovar lai str. 56601
guugaagcggaguuccuacauu

SEQ ID NO: 2798284 - RNA, 21 nt, Leptospira interrogans serovar lai str. 56601
guugaaguuacgcguuuaaau

SEQ ID NO: 2798285 - RNA, 20 nt, Leptospira interrogans serovar lai str. 56601
guugaauaagauuuuagaau

SEQ ID NO: 2798286 - RNA, 18 nt, Leptospira interrogans serovar lai str. 56601
guugagaguuuuucuaua

SEQ ID NO: 2798287 - RNA, 21 nt, Leptospira interrogans serovar lai str. 56601
guugagcaaaaauuuucuaaa

SEQ ID NO: 2798288 - RNA, 22 nt, Leptospira interrogans serovar lai str. 56601
guugagcacagcaaaaaauuug

SEQ ID NO: 2798289 - RNA, 15 nt, Leptospira interrogans serovar lai str. 56601
guugagcaguaaaau

SEQ ID NO: 2798290 - RNA, 12 nt, Leptospira interrogans serovar lai str. 56601
guugaguucuuu

SEQ ID NO: 2798291 - RNA, 21 nt, Leptospira interrogans serovar lai str. 56601
guugaguuuucccuauuuuug

SEQ ID NO: 2798292 - RNA, 16 nt, Leptospira interrogans serovar lai str. 56601
guugaguuuuuguauc

SEQ ID NO: 2798293 - RNA, 12 nt, Leptospira interrogans serovar lai str. 56601
guugauuucuac

SEQ ID NO: 2798294 - RNA, 14 nt, Leptospira interrogans serovar lai str. 56601
guugcaaaaaagaa

SEQ ID NO: 2798295 - RNA, 16 nt, Leptospira interrogans serovar lai str. 56601
guugcaauccaaaguu

SEQ ID NO: 2798296 - RNA, 18 nt, Leptospira interrogans serovar lai str. 56601
guugcaguuccuugaacu

SEQ ID NO: 2798297 - RNA, 21 nt, Leptospira interrogans serovar lai str. 56601
guugcaguuccuugaacuuac

SEQ ID NO: 2798298 - RNA, 16 nt, Leptospira interrogans serovar lai str. 56601
guugcguuuggucugu

SEQ ID NO: 2798299 - RNA, 14 nt, Leptospira interrogans serovar lai str. 56601
guugcuauaaaaag

SEQ ID NO: 2798300 - RNA, 20 nt, Leptospira interrogans serovar lai str. 56601
guugcuauggaauuuuucaa

SEQ ID NO: 2798301 - RNA, 15 nt, Leptospira interrogans serovar lai str. 56601
guuggaaucuaaacu

SEQ ID NO: 2798302 - RNA, 19 nt, Leptospira interrogans serovar lai str. 56601
guuguaaguaucuaaaagu

SEQ ID NO: 2798303 - RNA, 21 nt, Leptospira interrogans serovar lai str. 56601
guuguaucagauguuuuaaaa

SEQ ID NO: 2798304 - RNA, 20 nt, Leptospira interrogans serovar lai str. 56601
guuguauccccauaaacaaa

SEQ ID NO: 2798305 - RNA, 16 nt, Leptospira interrogans serovar lai str. 56601
guuguauuuuaaacaa

SEQ ID NO: 2798306 - RNA, 15 nt, Leptospira interrogans serovar lai str. 56601
guuguuaaauuuuuc

SEQ ID NO: 2798307 - RNA, 19 nt, Leptospira interrogans serovar lai str. 56601
guuguuauagaugaaauua

SEQ ID NO: 2798308 - RNA, 15 nt, Leptospira interrogans serovar lai str. 56601
guuguuucaguaagu

SEQ ID NO: 2798309 - RNA, 13 nt, Leptospira interrogans serovar lai str. 56601
guuuaaaaacuuu

SEQ ID NO: 2798310 - RNA, 20 nt, Leptospira interrogans serovar lai str. 56601
guuuaaaccuucuuuaagau

SEQ ID NO: 2798311 - RNA, 21 nt, Leptospira interrogans serovar lai str. 56601
guuuaaaccuucuuuaagaua

SEQ ID NO: 2798312 - RNA, 14 nt, Leptospira interrogans serovar lai str. 56601
guuuaaaugaaaug

SEQ ID NO: 2798313 - RNA, 21 nt, Leptospira interrogans serovar lai str. 56601
guuuaagaaacucaguaaaac

SEQ ID NO: 2798314 - RNA, 15 nt, Leptospira interrogans serovar lai str. 56601
guuuaauauacuaaa

SEQ ID NO: 2798315 - RNA, 16 nt, Leptospira interrogans serovar lai str. 56601
guuuaauauacuaaaa

SEQ ID NO: 2798316 - RNA, 19 nt, Leptospira interrogans serovar lai str. 56601
guuuaauugugaaaaucua

SEQ ID NO: 2798317 - RNA, 12 nt, Leptospira interrogans serovar lai str. 56601
guuuaauuucuu

SEQ ID NO: 2798318 - RNA, 14 nt, Leptospira interrogans serovar lai str. 56601
guuuacaaacuuac

SEQ ID NO: 2798319 - RNA, 19 nt, Leptospira interrogans serovar lai str. 56601
guuuacacaacauuaugaa

SEQ ID NO: 2798320 - RNA, 17 nt, Leptospira interrogans serovar lai str. 56601
guuuacauaucaauccu

SEQ ID NO: 2798321 - RNA, 17 nt, Leptospira interrogans serovar lai str. 56601
guuuagaguauuauaaa

SEQ ID NO: 2798322 - RNA, 18 nt, Leptospira interrogans serovar lai str. 56601
guuuauaugaguucccac

SEQ ID NO: 2798323 - RNA, 17 nt, Leptospira interrogans serovar lai str. 56601
guuuaucuucucuagaa

SEQ ID NO: 2798324 - RNA, 22 nt, Leptospira interrogans serovar lai str. 56601
guuuaugugaguucccauagau

SEQ ID NO: 2798325 - RNA, 22 nt, Leptospira interrogans serovar lai str. 56601
guuuauucacuuguuauuaaaa

SEQ ID NO: 2798326 - RNA, 15 nt, Leptospira interrogans serovar lai str. 56601
guuuauuuuaaaaaa

SEQ ID NO: 2798327 - RNA, 17 nt, Leptospira interrogans serovar lai str. 56601
guuuauuuuaaaaaaau

SEQ ID NO: 2798328 - RNA, 20 nt, Leptospira interrogans serovar lai str. 56601
guuuauuuuaaaaaaauuuu

SEQ ID NO: 2798329 - RNA, 15 nt, Leptospira interrogans serovar lai str. 56601
guuuauuuuucuaaa

SEQ ID NO: 2798330 - RNA, 17 nt, Leptospira interrogans serovar lai str. 56601
guuuauuuuucuuuuaa

SEQ ID NO: 2798331 - RNA, 19 nt, Leptospira interrogans serovar lai str. 56601
guuuauuuuucuuuuaaaa

SEQ ID NO: 2798332 - RNA, 17 nt, Leptospira interrogans serovar lai str. 56601
guuucaauuuaaaauau

SEQ ID NO: 2798333 - RNA, 20 nt, Leptospira interrogans serovar lai str. 56601
guuucaauuuaucauagaac

SEQ ID NO: 2798334 - RNA, 18 nt, Leptospira interrogans serovar lai str. 56601
guuucaauuuauuauaga

SEQ ID NO: 2798335 - RNA, 13 nt, Leptospira interrogans serovar lai str. 56601
guuucaauuuuug

SEQ ID NO: 2798336 - RNA, 15 nt, Leptospira interrogans serovar lai str. 56601
guuucacaaaaauau

SEQ ID NO: 2798337 - RNA, 15 nt, Leptospira interrogans serovar lai str. 56601
guuucacaaaaugcu

SEQ ID NO: 2798338 - RNA, 17 nt, Leptospira interrogans serovar lai str. 56601
guuucauagaaggaucc

SEQ ID NO: 2798339 - RNA, 21 nt, Leptospira interrogans serovar lai str. 56601
guuucauucccuucuccugca

SEQ ID NO: 2798340 - RNA, 14 nt, Leptospira interrogans serovar lai str. 56601
guuucauugaguuu

SEQ ID NO: 2798341 - RNA, 13 nt, Leptospira interrogans serovar lai str. 56601
guuuccauaaaau

SEQ ID NO: 2798342 - RNA, 14 nt, Leptospira interrogans serovar lai str. 56601
guuuccauaaaaua

SEQ ID NO: 2798343 - RNA, 24 nt, Leptospira interrogans serovar lai str. 56601
guuucgaacucacguuaaaaguaa

SEQ ID NO: 2798344 - RNA, 19 nt, Leptospira interrogans serovar lai str. 56601
guuucguucccguuuagaa

SEQ ID NO: 2798345 - RNA, 14 nt, Leptospira interrogans serovar lai str. 56601
guuucguucuuuuu

SEQ ID NO: 2798346 - RNA, 13 nt, Leptospira interrogans serovar lai str. 56601
guuuuuuaaaaaa

SEQ ID NO: 2798347 - RNA, 15 nt, Leptospira interrogans serovar lai str. 56601
guuuuuuaaaaugua

SEQ ID NO: 2798348 - RNA, 11 nt, Leptospira interrogans serovar lai str. 56601
guuuuuuaaau

SEQ ID NO: 2798349 - RNA, 17 nt, Leptospira interrogans serovar lai str. 56601
guuuuuuagaaaauuca

SEQ ID NO: 2798350 - RNA, 15 nt, Leptospira interrogans serovar lai str. 56601
guuuuuuauaauuua

SEQ ID NO: 2798351 - RNA, 16 nt, Leptospira interrogans serovar lai str. 56601
guuuuuucguaaaaaa

SEQ ID NO: 2798352 - RNA, 17 nt, Leptospira interrogans serovar lai str. 56601
guuuuuucuuuaaaauc

SEQ ID NO: 2798353 - RNA, 12 nt, Leptospira interrogans serovar lai str. 56601
guuuuuuuucaa

SEQ ID NO: 2798354 - RNA, 21 nt, Leptospira interrogans serovar lai str. 56601
guuuuuuuucaacaacucuaa

SEQ ID NO: 2798355 - RNA, 12 nt, Leptospira interrogans serovar lai str. 56601
uaaaaaaaaaug

SEQ ID NO: 2798356 - RNA, 16 nt, Leptospira interrogans serovar lai str. 56601
uaaaaaaaaauguaaa

SEQ ID NO: 2798357 - RNA, 22 nt, Leptospira interrogans serovar lai str. 56601
uaaaaaaacaauuaaucaaauu

SEQ ID NO: 2798358 - RNA, 18 nt, Leptospira interrogans serovar lai str. 56601
uaaaaaaacaugaagaag

SEQ ID NO: 2798359 - RNA, 12 nt, Leptospira interrogans serovar lai str. 56601
uaaaaaaauaau

SEQ ID NO: 2798360 - RNA, 14 nt, Leptospira interrogans serovar lai str. 56601
uaaaaaaauaauaa

SEQ ID NO: 2798361 - RNA, 17 nt, Leptospira interrogans serovar lai str. 56601
uaaaaaaauauuaaaac

SEQ ID NO: 2798362 - RNA, 13 nt, Leptospira interrogans serovar lai str. 56601
uaaaaaaaugaau

SEQ ID NO: 2798363 - RNA, 13 nt, Leptospira interrogans serovar lai str. 56601
uaaaaaaauuaaa

SEQ ID NO: 2798364 - RNA, 14 nt, Leptospira interrogans serovar lai str. 56601
uaaaaaaauuaaaa

SEQ ID NO: 2798365 - RNA, 15 nt, Leptospira interrogans serovar lai str. 56601
uaaaaaaauuaaaaa

SEQ ID NO: 2798366 - RNA, 19 nt, Leptospira interrogans serovar lai str. 56601
uaaaaaaauuaaaaaagag

SEQ ID NO: 2798367 - RNA, 14 nt, Leptospira interrogans serovar lai str. 56601
uaaaaaaauuaauu

SEQ ID NO: 2798368 - RNA, 19 nt, Leptospira interrogans serovar lai str. 56601
uaaaaaaauuaauucucca

SEQ ID NO: 2798369 - RNA, 17 nt, Leptospira interrogans serovar lai str. 56601
uaaaaaacauaaaaauu

SEQ ID NO: 2798370 - RNA, 22 nt, Leptospira interrogans serovar lai str. 56601
uaaaaaaccgucccaaaaucuu

SEQ ID NO: 2798371 - RNA, 16 nt, Leptospira interrogans serovar lai str. 56601
uaaaaaacgaaucaua

SEQ ID NO: 2798372 - RNA, 22 nt, Leptospira interrogans serovar lai str. 56601
uaaaaaacuauaaaucauucga

SEQ ID NO: 2798373 - RNA, 13 nt, Leptospira interrogans serovar lai str. 56601
uaaaaaacucaau

SEQ ID NO: 2798374 - RNA, 17 nt, Leptospira interrogans serovar lai str. 56601
uaaaaaacugauuaaaa

SEQ ID NO: 2798375 - RNA, 15 nt, Leptospira interrogans serovar lai str. 56601
uaaaaaagauaaaaa

SEQ ID NO: 2798376 - RNA, 12 nt, Leptospira interrogans serovar lai str. 56601
uaaaaaauacaa

SEQ ID NO: 2798377 - RNA, 13 nt, Leptospira interrogans serovar lai str. 56601
uaaaaaaugaaug

SEQ ID NO: 2798378 - RNA, 21 nt, Leptospira interrogans serovar lai str. 56601
uaaaaaaugaauguuuaaaau

SEQ ID NO: 2798379 - RNA, 12 nt, Leptospira interrogans serovar lai str. 56601
uaaaaaauucau

SEQ ID NO: 2798380 - RNA, 23 nt, Leptospira interrogans serovar lai str. 56601
uaaaaaauucauuccuauaaaua

SEQ ID NO: 2798381 - RNA, 13 nt, Leptospira interrogans serovar lai str. 56601
uaaaaaauuuaua

SEQ ID NO: 2798382 - RNA, 18 nt, Leptospira interrogans serovar lai str. 56601
uaaaaacaacucagcaca

SEQ ID NO: 2798383 - RNA, 18 nt, Leptospira interrogans serovar lai str. 56601
uaaaaacagaauugaguu

SEQ ID NO: 2798384 - RNA, 19 nt, Leptospira interrogans serovar lai str. 56601
uaaaaacagaauugaguuu

SEQ ID NO: 2798385 - RNA, 23 nt, Leptospira interrogans serovar lai str. 56601
uaaaaacagauggagaauuaauu

SEQ ID NO: 2798386 - RNA, 17 nt, Leptospira interrogans serovar lai str. 56601
uaaaaaccacaaaaaca

SEQ ID NO: 2798387 - RNA, 18 nt, Leptospira interrogans serovar lai str. 56601
uaaaaaccacaaaaacaa

SEQ ID NO: 2798388 - RNA, 17 nt, Leptospira interrogans serovar lai str. 56601
uaaaaaccccauuaaaa

SEQ ID NO: 2798389 - RNA, 21 nt, Leptospira interrogans serovar lai str. 56601
uaaaaaccguuuucaauuauu

SEQ ID NO: 2798390 - RNA, 20 nt, Leptospira interrogans serovar lai str. 56601
uaaaaaccuaguguuuaauu

SEQ ID NO: 2798391 - RNA, 21 nt, Leptospira interrogans serovar lai str. 56601
uaaaaacgagacgcugaauua

SEQ ID NO: 2798392 - RNA, 23 nt, Leptospira interrogans serovar lai str. 56601
uaaaaacgguauuuaaaauuaau

SEQ ID NO: 2798393 - RNA, 15 nt, Leptospira interrogans serovar lai str. 56601
uaaaaacgucuaguc

SEQ ID NO: 2798394 - RNA, 15 nt, Leptospira interrogans serovar lai str. 56601
uaaaaacuaauaauu

SEQ ID NO: 2798395 - RNA, 18 nt, Leptospira interrogans serovar lai str. 56601
uaaaaacucuaccuuuau

SEQ ID NO: 2798396 - RNA, 23 nt, Leptospira interrogans serovar lai str. 56601
uaaaaacuugauauuucuguaaa

SEQ ID NO: 2798397 - RNA, 10 nt, Leptospira interrogans serovar lai str. 56601
uaaaaagaag

SEQ ID NO: 2798398 - RNA, 11 nt, Leptospira interrogans serovar lai str. 56601
uaaaaagaauc

SEQ ID NO: 2798399 - RNA, 18 nt, Leptospira interrogans serovar lai str. 56601
uaaaaagagacguaaucu

SEQ ID NO: 2798400 - RNA, 22 nt, Leptospira interrogans serovar lai str. 56601
uaaaaagauuaucuucuaauua

SEQ ID NO: 2798401 - RNA, 16 nt, Leptospira interrogans serovar lai str. 56601
uaaaaagcguuucauu

SEQ ID NO: 2798402 - RNA, 21 nt, Leptospira interrogans serovar lai str. 56601
uaaaaagcguuucauugaguu

SEQ ID NO: 2798403 - RNA, 12 nt, Leptospira interrogans serovar lai str. 56601
uaaaaaguaaaa

SEQ ID NO: 2798404 - RNA, 20 nt, Leptospira interrogans serovar lai str. 56601
uaaaaaguuuuucuaaauuu

SEQ ID NO: 2798405 - RNA, 21 nt, Leptospira interrogans serovar lai str. 56601
uaaaaaguuuuucuaaauuuu

SEQ ID NO: 2798406 - RNA, 16 nt, Leptospira interrogans serovar lai str. 56601
uaaaaauaaaauguag

SEQ ID NO: 2798407 - RNA, 20 nt, Leptospira interrogans serovar lai str. 56601
uaaaaauaauacaauucuga

SEQ ID NO: 2798408 - RNA, 15 nt, Leptospira interrogans serovar lai str. 56601
uaaaaauacuaaaag

SEQ ID NO: 2798409 - RNA, 22 nt, Leptospira interrogans serovar lai str. 56601
uaaaaauacuaaaagaguaauu

SEQ ID NO: 2798410 - RNA, 20 nt, Leptospira interrogans serovar lai str. 56601
uaaaaauaguauccaaaauu

SEQ ID NO: 2798411 - RNA, 12 nt, Leptospira interrogans serovar lai str. 56601
uaaaaauaucag

SEQ ID NO: 2798412 - RNA, 15 nt, Leptospira interrogans serovar lai str. 56601
uaaaaauauggaagc

SEQ ID NO: 2798413 - RNA, 22 nt, Leptospira interrogans serovar lai str. 56601
uaaaaaucgacuucucauucuu

SEQ ID NO: 2798414 - RNA, 20 nt, Leptospira interrogans serovar lai str. 56601
uaaaaaucggcauucaauuu

SEQ ID NO: 2798415 - RNA, 11 nt, Leptospira interrogans serovar lai str. 56601
uaaaaaugagu

SEQ ID NO: 2798416 - RNA, 19 nt, Leptospira interrogans serovar lai str. 56601
uaaaaaugaguaaacuauu

SEQ ID NO: 2798417 - RNA, 16 nt, Leptospira interrogans serovar lai str. 56601
uaaaaaugauacuauu

SEQ ID NO: 2798418 - RNA, 16 nt, Leptospira interrogans serovar lai str. 56601
uaaaaaugaugcaaau

SEQ ID NO: 2798419 - RNA, 12 nt, Leptospira interrogans serovar lai str. 56601
uaaaaauuaauu

SEQ ID NO: 2798420 - RNA, 13 nt, Leptospira interrogans serovar lai str. 56601
uaaaaauugaucu

SEQ ID NO: 2798421 - RNA, 12 nt, Leptospira interrogans serovar lai str. 56601
uaaaaauuuaaa

SEQ ID NO: 2798422 - RNA, 12 nt, Leptospira interrogans serovar lai str. 56601
uaaaaauuuaau

SEQ ID NO: 2798423 - RNA, 13 nt, Leptospira interrogans serovar lai str. 56601
uaaaaauuuaauu

SEQ ID NO: 2798424 - RNA, 15 nt, Leptospira interrogans serovar lai str. 56601
uaaaaauuuccggaa

SEQ ID NO: 2798425 - RNA, 16 nt, Leptospira interrogans serovar lai str. 56601
uaaaaauuuccggaaa

SEQ ID NO: 2798426 - RNA, 13 nt, Leptospira interrogans serovar lai str. 56601
uaaaaauuuccuu

SEQ ID NO: 2798427 - RNA, 23 nt, Leptospira interrogans serovar lai str. 56601
uaaaaauuugcgauauucuauua

SEQ ID NO: 2798428 - RNA, 16 nt, Leptospira interrogans serovar lai str. 56601
uaaaaauuuuuaauau

SEQ ID NO: 2798429 - RNA, 11 nt, Leptospira interrogans serovar lai str. 56601
uaaaacaaaaa

SEQ ID NO: 2798430 - RNA, 21 nt, Leptospira interrogans serovar lai str. 56601
uaaaauacuuuugaaauagau

SEQ ID NO: 2798431 - RNA, 22 nt, Leptospira interrogans serovar lai str. 56601
uaaaauacuuuugaaauagauu

SEQ ID NO: 2798432 - RNA, 18 nt, Leptospira interrogans serovar lai str. 56601
uaaaauagaaacaaaugg

SEQ ID NO: 2798433 - RNA, 19 nt, Leptospira interrogans serovar lai str. 56601
uaaaauagaaacagaugga

SEQ ID NO: 2798434 - RNA, 13 nt, Leptospira interrogans serovar lai str. 56601
uaaaauauaggaa

SEQ ID NO: 2798435 - RNA, 21 nt, Leptospira interrogans serovar lai str. 56601
uaaaauauagugguuuguaau

SEQ ID NO: 2798436 - RNA, 18 nt, Leptospira interrogans serovar lai str. 56601
uaaaauauaguuaaauuu

SEQ ID NO: 2798437 - RNA, 18 nt, Leptospira interrogans serovar lai str. 56601
uaaaauauuugcauaaac

SEQ ID NO: 2798438 - RNA, 18 nt, Leptospira interrogans serovar lai str. 56601
uaaaaucaaguaccauaa

SEQ ID NO: 2798439 - RNA, 14 nt, Leptospira interrogans serovar lai str. 56601
uaaaaucacaaaaa

SEQ ID NO: 2798440 - RNA, 20 nt, Leptospira interrogans serovar lai str. 56601
uaaaaucacguucuuagccu

SEQ ID NO: 2798441 - RNA, 21 nt, Leptospira interrogans serovar lai str. 56601
uaaaaucagggccggagaaaa

SEQ ID NO: 2798442 - RNA, 22 nt, Leptospira interrogans serovar lai str. 56601
uaaaaucagggccggagaaaau

SEQ ID NO: 2798443 - RNA, 15 nt, Leptospira interrogans serovar lai str. 56601
uaaaaucauauuuuc

SEQ ID NO: 2798444 - RNA, 18 nt, Leptospira interrogans serovar lai str. 56601
uaaaauccguagccgcuu

SEQ ID NO: 2798445 - RNA, 21 nt, Leptospira interrogans serovar lai str. 56601
uaaaaucgaguuucacaaaaa

SEQ ID NO: 2798446 - RNA, 14 nt, Leptospira interrogans serovar lai str. 56601
uaaaaucuaaaaaa

SEQ ID NO: 2798447 - RNA, 17 nt, Leptospira interrogans serovar lai str. 56601
uaaaaucuaaaaaaaau

SEQ ID NO: 2798448 - RNA, 17 nt, Leptospira interrogans serovar lai str. 56601
uaaaaucuaaaaagaau

SEQ ID NO: 2798449 - RNA, 18 nt, Leptospira interrogans serovar lai str. 56601
uaaaaucuaaaaagaauc

SEQ ID NO: 2798450 - RNA, 15 nt, Leptospira interrogans serovar lai str. 56601
uaaaaucuuuaaguu

SEQ ID NO: 2798451 - RNA, 14 nt, Leptospira interrogans serovar lai str. 56601
uaaaaugaaaaaaa

SEQ ID NO: 2798452 - RNA, 17 nt, Leptospira interrogans serovar lai str. 56601
uaaaaugaaaaaaaaca

SEQ ID NO: 2798453 - RNA, 19 nt, Leptospira interrogans serovar lai str. 56601
uaaaaugaaaaaaaacaaa

SEQ ID NO: 2798454 - RNA, 20 nt, Leptospira interrogans serovar lai str. 56601
uaaaaugaaaaaaaacaaag

SEQ ID NO: 2798455 - RNA, 21 nt, Leptospira interrogans serovar lai str. 56601
uaaaaugaaaaaaaacaaaga

SEQ ID NO: 2798456 - RNA, 15 nt, Leptospira interrogans serovar lai str. 56601
uaaaaugaaaauuau

SEQ ID NO: 2798457 - RNA, 18 nt, Leptospira interrogans serovar lai str. 56601
uaaaaugaaaauuauaag

SEQ ID NO: 2798458 - RNA, 15 nt, Leptospira interrogans serovar lai str. 56601
uaaaaugaaucucuu

SEQ ID NO: 2798459 - RNA, 19 nt, Leptospira interrogans serovar lai str. 56601
uaaaaugaaucucuuaauc

SEQ ID NO: 2798460 - RNA, 23 nt, Leptospira interrogans serovar lai str. 56601
uaaaaugagaguucgugaagaaa

SEQ ID NO: 2798461 - RNA, 19 nt, Leptospira interrogans serovar lai str. 56601
uaaaaugagcgauacacca

SEQ ID NO: 2798462 - RNA, 23 nt, Leptospira interrogans serovar lai str. 56601
uaaaaugagcgauacaccaaaca

SEQ ID NO: 2798463 - RNA, 14 nt, Leptospira interrogans serovar lai str. 56601
uaaaaugauguggg

SEQ ID NO: 2798464 - RNA, 12 nt, Leptospira interrogans serovar lai str. 56601
uaaaaugcaaua

SEQ ID NO: 2798465 - RNA, 21 nt, Leptospira interrogans serovar lai str. 56601
uaaaaugcaguaguuccuaua

SEQ ID NO: 2798466 - RNA, 10 nt, Leptospira interrogans serovar lai str. 56601
uaaaaugcug

SEQ ID NO: 2798467 - RNA, 15 nt, Leptospira interrogans serovar lai str. 56601
uaaaauggaaaaaag

SEQ ID NO: 2798468 - RNA, 23 nt, Leptospira interrogans serovar lai str. 56601
uaaaauggaaaaaagaucuuaua

SEQ ID NO: 2798469 - RNA, 23 nt, Leptospira interrogans serovar lai str. 56601
uaaaaugggaaguuuaccccgaa

SEQ ID NO: 2798470 - RNA, 16 nt, Leptospira interrogans serovar lai str. 56601
uaaaauggguuuucau

SEQ ID NO: 2798471 - RNA, 18 nt, Leptospira interrogans serovar lai str. 56601
uaaaauggguuuucauuu

SEQ ID NO: 2798472 - RNA, 16 nt, Leptospira interrogans serovar lai str. 56601
uaaaauguaaaaacua

SEQ ID NO: 2798473 - RNA, 16 nt, Leptospira interrogans serovar lai str. 56601
uaaaauguaggaaccc

SEQ ID NO: 2798474 - RNA, 17 nt, Leptospira interrogans serovar lai str. 56601
uaaaauguaggaacuac

SEQ ID NO: 2798475 - RNA, 18 nt, Leptospira interrogans serovar lai str. 56601
uaaaauguauuaaaguug

SEQ ID NO: 2798476 - RNA, 17 nt, Leptospira interrogans serovar lai str. 56601
uaaaauguggaaacuau

SEQ ID NO: 2798477 - RNA, 20 nt, Leptospira interrogans serovar lai str. 56601
uaaaauguggaaacuaucac

SEQ ID NO: 2798478 - RNA, 16 nt, Leptospira interrogans serovar lai str. 56601
uaaaaugugggaacuc

SEQ ID NO: 2798479 - RNA, 15 nt, Leptospira interrogans serovar lai str. 56601
uaaaauguuuuauuu

SEQ ID NO: 2798480 - RNA, 12 nt, Leptospira interrogans serovar lai str. 56601
uaaaauuaaaag

SEQ ID NO: 2798481 - RNA, 22 nt, Leptospira interrogans serovar lai str. 56601
uaaaauuaaauaccuaaauauu

SEQ ID NO: 2798482 - RNA, 14 nt, Leptospira interrogans serovar lai str. 56601
uaaaauuaaaucuu

SEQ ID NO: 2798483 - RNA, 22 nt, Leptospira interrogans serovar lai str. 56601
uaaaauuaacaguauucaauuu

SEQ ID NO: 2798484 - RNA, 18 nt, Leptospira interrogans serovar lai str. 56601
uaaaauuagauuuauuga

SEQ ID NO: 2798485 - RNA, 23 nt, Leptospira interrogans serovar lai str. 56601
uaaaauuagauuuguguuauuca

SEQ ID NO: 2798486 - RNA, 16 nt, Leptospira interrogans serovar lai str. 56601
uaaaauuauuaacuaa

SEQ ID NO: 2798487 - RNA, 16 nt, Leptospira interrogans serovar lai str. 56601
uaaaauucagauuuca

SEQ ID NO: 2798488 - RNA, 21 nt, Leptospira interrogans serovar lai str. 56601
uaaaauucaguuucaaacuga

SEQ ID NO: 2798489 - RNA, 17 nt, Leptospira interrogans serovar lai str. 56601
uaaaauuccgaauucua

SEQ ID NO: 2798490 - RNA, 19 nt, Leptospira interrogans serovar lai str. 56601
uaaaauucuagaaagaauu

SEQ ID NO: 2798491 - RNA, 20 nt, Leptospira interrogans serovar lai str. 56601
uaaaauucuuagaguaaaac

SEQ ID NO: 2798492 - RNA, 19 nt, Leptospira interrogans serovar lai str. 56601
uaaaauugaauacguuauu

SEQ ID NO: 2798493 - RNA, 17 nt, Leptospira interrogans serovar lai str. 56601
uaaaauugaauaucaua

SEQ ID NO: 2798494 - RNA, 19 nt, Leptospira interrogans serovar lai str. 56601
uaaaauugaauauugagcu

SEQ ID NO: 2798495 - RNA, 22 nt, Leptospira interrogans serovar lai str. 56601
uaaaauugaguaccauaaauuu

SEQ ID NO: 2798496 - RNA, 17 nt, Leptospira interrogans serovar lai str. 56601
uaaaauuuagaaauaga

SEQ ID NO: 2798497 - RNA, 22 nt, Leptospira interrogans serovar lai str. 56601
uaaaauuuagaaauagauauaa

SEQ ID NO: 2798498 - RNA, 12 nt, Leptospira interrogans serovar lai str. 56601
uaaaauuuauua

SEQ ID NO: 2798499 - RNA, 13 nt, Leptospira interrogans serovar lai str. 56601
uaaaauuucauuu

SEQ ID NO: 2798500 - RNA, 15 nt, Leptospira interrogans serovar lai str. 56601
uaaaauuucauuucu

SEQ ID NO: 2798501 - RNA, 15 nt, Leptospira interrogans serovar lai str. 56601
uaaaauuugaaaaga

SEQ ID NO: 2798502 - RNA, 18 nt, Leptospira interrogans serovar lai str. 56601
uaaaauuugaaaguaaaa

SEQ ID NO: 2798503 - RNA, 14 nt, Leptospira interrogans serovar lai str. 56601
uaaaauuuguagga

SEQ ID NO: 2798504 - RNA, 22 nt, Leptospira interrogans serovar lai str. 56601
uaaaauuuucaucuuuuccauu

SEQ ID NO: 2798505 - RNA, 23 nt, Leptospira interrogans serovar lai str. 56601
uaaaauuuucaucuuuuccauug

SEQ ID NO: 2798506 - RNA, 16 nt, Leptospira interrogans serovar lai str. 56601
uaaaauuuuuaaaaaa

SEQ ID NO: 2798507 - RNA, 11 nt, Leptospira interrogans serovar lai str. 56601
uaaaauuuuuu

SEQ ID NO: 2798508 - RNA, 19 nt, Leptospira interrogans serovar lai str. 56601
uaaaauuuuuugagguuuu

SEQ ID NO: 2798509 - RNA, 18 nt, Leptospira interrogans serovar lai str. 56601
uaaaauuuuuuuaagaau

SEQ ID NO: 2798510 - RNA, 19 nt, Leptospira interrogans serovar lai str. 56601
uaaaauuuuuuuaagaauu

SEQ ID NO: 2798511 - RNA, 20 nt, Leptospira interrogans serovar lai str. 56601
uaaacaaaauucaaaugucu

SEQ ID NO: 2798512 - RNA, 17 nt, Leptospira interrogans serovar lai str. 56601
uaaaguuguugaaaaau

SEQ ID NO: 2798513 - RNA, 22 nt, Leptospira interrogans serovar lai str. 56601
uaaaguuuacaucaaaaacaaa

SEQ ID NO: 2798514 - RNA, 13 nt, Leptospira interrogans serovar lai str. 56601
uaaauaaaaagaa

SEQ ID NO: 2798515 - RNA, 21 nt, Leptospira interrogans serovar lai str. 56601
uaaauaagcuaagcauaaaau

SEQ ID NO: 2798516 - RNA, 22 nt, Leptospira interrogans serovar lai str. 56601
uaaauaagcuaagcauaaaauu

SEQ ID NO: 2798517 - RNA, 12 nt, Leptospira interrogans serovar lai str. 56601
uaaauaauaaua

SEQ ID NO: 2798518 - RNA, 15 nt, Leptospira interrogans serovar lai str. 56601
uaaauaauaauauac

SEQ ID NO: 2798519 - RNA, 13 nt, Leptospira interrogans serovar lai str. 56601
uaaauaaugaaaa

SEQ ID NO: 2798520 - RNA, 20 nt, Leptospira interrogans serovar lai str. 56601
uaaauacaaaaauucuaaua

SEQ ID NO: 2798521 - RNA, 19 nt, Leptospira interrogans serovar lai str. 56601
uaaauacauacaaugaaaa

SEQ ID NO: 2798522 - RNA, 19 nt, Leptospira interrogans serovar lai str. 56601
uaaauaccuaaauauuuau

SEQ ID NO: 2798523 - RNA, 13 nt, Leptospira interrogans serovar lai str. 56601
uaaauaccuguuc

SEQ ID NO: 2798524 - RNA, 20 nt, Leptospira interrogans serovar lai str. 56601
uaaauagggaauauuccauu

SEQ ID NO: 2798525 - RNA, 18 nt, Leptospira interrogans serovar lai str. 56601
uaaauauggauuuuucca

SEQ ID NO: 2798526 - RNA, 19 nt, Leptospira interrogans serovar lai str. 56601
uaaauauguuuuuuuucaa

SEQ ID NO: 2798527 - RNA, 15 nt, Leptospira interrogans serovar lai str. 56601
uaaauauuaauuaua

SEQ ID NO: 2798528 - RNA, 22 nt, Leptospira interrogans serovar lai str. 56601
uaaauauuaauuuaaaaacaag

SEQ ID NO: 2798529 - RNA, 13 nt, Leptospira interrogans serovar lai str. 56601
uaaauauugaucu

SEQ ID NO: 2798530 - RNA, 19 nt, Leptospira interrogans serovar lai str. 56601
uaaauauuuauuacaaagu

SEQ ID NO: 2798531 - RNA, 13 nt, Leptospira interrogans serovar lai str. 56601
uaaauauuuccaa

SEQ ID NO: 2798532 - RNA, 14 nt, Leptospira interrogans serovar lai str. 56601
uaaaucaaaaggaa

SEQ ID NO: 2798533 - RNA, 18 nt, Leptospira interrogans serovar lai str. 56601
uaaaucaauccucuuuga

SEQ ID NO: 2798534 - RNA, 13 nt, Leptospira interrogans serovar lai str. 56601
uaaaucaaucuac

SEQ ID NO: 2798535 - RNA, 18 nt, Leptospira interrogans serovar lai str. 56601
uaaaucaaucuacuugaa

SEQ ID NO: 2798536 - RNA, 21 nt, Leptospira interrogans serovar lai str. 56601
uaaaucaaucuacuugaauua

SEQ ID NO: 2798537 - RNA, 19 nt, Leptospira interrogans serovar lai str. 56601
uaaaucaauuuucuuucua

SEQ ID NO: 2798538 - RNA, 16 nt, Leptospira interrogans serovar lai str. 56601
uaaaucaccuuuuacu

SEQ ID NO: 2798539 - RNA, 23 nt, Leptospira interrogans serovar lai str. 56601
uaaaucaccuuuuacuucauaua

SEQ ID NO: 2798540 - RNA, 15 nt, Leptospira interrogans serovar lai str. 56601
uaaaucaugaucaaa

SEQ ID NO: 2798541 - RNA, 16 nt, Leptospira interrogans serovar lai str. 56601
uaaaucaugaucaaau

SEQ ID NO: 2798542 - RNA, 18 nt, Leptospira interrogans serovar lai str. 56601
uaaaucaugaucaaauuc

SEQ ID NO: 2798543 - RNA, 19 nt, Leptospira interrogans serovar lai str. 56601
uaaaucaugaucaaauuca

SEQ ID NO: 2798544 - RNA, 15 nt, Leptospira interrogans serovar lai str. 56601
uaaaucccauuuuaa

SEQ ID NO: 2798545 - RNA, 16 nt, Leptospira interrogans serovar lai str. 56601
uaaaucccauuuuaac

SEQ ID NO: 2798546 - RNA, 20 nt, Leptospira interrogans serovar lai str. 56601
uaaauccguauacuuuaaaa

SEQ ID NO: 2798547 - RNA, 18 nt, Leptospira interrogans serovar lai str. 56601
uaaaucgacaaaaugagu

SEQ ID NO: 2798548 - RNA, 20 nt, Leptospira interrogans serovar lai str. 56601
uaaaucgaugguuucaauuu

SEQ ID NO: 2798549 - RNA, 19 nt, Leptospira interrogans serovar lai str. 56601
uaaaucgcugauaaauuuc

SEQ ID NO: 2798550 - RNA, 15 nt, Leptospira interrogans serovar lai str. 56601
uaaaucgguucuaua

SEQ ID NO: 2798551 - RNA, 15 nt, Leptospira interrogans serovar lai str. 56601
uaaaucuaauucuuc

SEQ ID NO: 2798552 - RNA, 20 nt, Leptospira interrogans serovar lai str. 56601
uaaaucuagcaacacauuuu

SEQ ID NO: 2798553 - RNA, 14 nt, Leptospira interrogans serovar lai str. 56601
uaaaucuauucuua

SEQ ID NO: 2798554 - RNA, 16 nt, Leptospira interrogans serovar lai str. 56601
uaaaucuauucuuaaa

SEQ ID NO: 2798555 - RNA, 21 nt, Leptospira interrogans serovar lai str. 56601
uaaaucuauucuuaaaaugua

SEQ ID NO: 2798556 - RNA, 17 nt, Leptospira interrogans serovar lai str. 56601
uaaaucugucggaauua

SEQ ID NO: 2798557 - RNA, 20 nt, Leptospira interrogans serovar lai str. 56601
uaaaugacuugcauuuaaua

SEQ ID NO: 2798558 - RNA, 19 nt, Leptospira interrogans serovar lai str. 56601
uaaaugaguuuuagaauau

SEQ ID NO: 2798559 - RNA, 22 nt, Leptospira interrogans serovar lai str. 56601
uaaaugauaauaauuagaaaaa

SEQ ID NO: 2798560 - RNA, 17 nt, Leptospira interrogans serovar lai str. 56601
uaaauggagauuucauu

SEQ ID NO: 2798561 - RNA, 15 nt, Leptospira interrogans serovar lai str. 56601
uaaauggauaaauuu

SEQ ID NO: 2798562 - RNA, 16 nt, Leptospira interrogans serovar lai str. 56601
uaaaugggauuuugua

SEQ ID NO: 2798563 - RNA, 16 nt, Leptospira interrogans serovar lai str. 56601
uaaauguaggaacuac

SEQ ID NO: 2798564 - RNA, 22 nt, Leptospira interrogans serovar lai str. 56601
uaaauguauauucguuguuucu

SEQ ID NO: 2798565 - RNA, 16 nt, Leptospira interrogans serovar lai str. 56601
uaaaugugggaacuac

SEQ ID NO: 2798566 - RNA, 21 nt, Leptospira interrogans serovar lai str. 56601
uaaaugugggaacuaccacaa

SEQ ID NO: 2798567 - RNA, 14 nt, Leptospira interrogans serovar lai str. 56601
uaaauguuauugau

SEQ ID NO: 2798568 - RNA, 16 nt, Leptospira interrogans serovar lai str. 56601
uaaauguuauuuugua

SEQ ID NO: 2798569 - RNA, 21 nt, Leptospira interrogans serovar lai str. 56601
uaaauuaaaaaaaaauguaaa

SEQ ID NO: 2798570 - RNA, 14 nt, Leptospira interrogans serovar lai str. 56601
uaaauuaacagcua

SEQ ID NO: 2798571 - RNA, 18 nt, Leptospira interrogans serovar lai str. 56601
uaaauuaaguuuauucaa

SEQ ID NO: 2798572 - RNA, 12 nt, Leptospira interrogans serovar lai str. 56601
uaaauuaauauu

SEQ ID NO: 2798573 - RNA, 15 nt, Leptospira interrogans serovar lai str. 56601
uaaauuaauauuuau

SEQ ID NO: 2798574 - RNA, 14 nt, Leptospira interrogans serovar lai str. 56601
uaaauuaaucugua

SEQ ID NO: 2798575 - RNA, 15 nt, Leptospira interrogans serovar lai str. 56601
uaaauuagauuauuu

SEQ ID NO: 2798576 - RNA, 17 nt, Leptospira interrogans serovar lai str. 56601
uaaauuagcuuaagaau

SEQ ID NO: 2798577 - RNA, 19 nt, Leptospira interrogans serovar lai str. 56601
uaaauuaguaauuuaauau

SEQ ID NO: 2798578 - RNA, 14 nt, Leptospira interrogans serovar lai str. 56601
uaaauuauacaauu

SEQ ID NO: 2798579 - RNA, 21 nt, Leptospira interrogans serovar lai str. 56601
uaaauuauuuucaaguaaauc

SEQ ID NO: 2798580 - RNA, 15 nt, Leptospira interrogans serovar lai str. 56601
uaaauucaaaauaag

SEQ ID NO: 2798581 - RNA, 21 nt, Leptospira interrogans serovar lai str. 56601
uaaauucagaaaaaaaaagaa

SEQ ID NO: 2798582 - RNA, 18 nt, Leptospira interrogans serovar lai str. 56601
uaaauucaucaaugaaua

SEQ ID NO: 2798583 - RNA, 16 nt, Leptospira interrogans serovar lai str. 56601
uaaauuccccaaaaug

SEQ ID NO: 2798584 - RNA, 17 nt, Leptospira interrogans serovar lai str. 56601
uaaauuccguaaaauuc

SEQ ID NO: 2798585 - RNA, 16 nt, Leptospira interrogans serovar lai str. 56601
uaaauuccuuccaagu

SEQ ID NO: 2798586 - RNA, 18 nt, Leptospira interrogans serovar lai str. 56601
uaaauucgccguaaaaaa

SEQ ID NO: 2798587 - RNA, 23 nt, Leptospira interrogans serovar lai str. 56601
uaaauucggaaauuuuaaucuuc

SEQ ID NO: 2798588 - RNA, 15 nt, Leptospira interrogans serovar lai str. 56601
uaaauucuaaaaaaa

SEQ ID NO: 2798589 - RNA, 23 nt, Leptospira interrogans serovar lai str. 56601
uaaauucuaauugugggaacuca

SEQ ID NO: 2798590 - RNA, 18 nt, Leptospira interrogans serovar lai str. 56601
uaaauucuacaaauucuu

SEQ ID NO: 2798591 - RNA, 23 nt, Leptospira interrogans serovar lai str. 56601
uaaauucuagcgucuaaaaaauu

SEQ ID NO: 2798592 - RNA, 22 nt, Leptospira interrogans serovar lai str. 56601
uaaauugagaauuuguuuuaaa

SEQ ID NO: 2798593 - RNA, 16 nt, Leptospira interrogans serovar lai str. 56601
uaaauugcauaaaaga

SEQ ID NO: 2798594 - RNA, 18 nt, Leptospira interrogans serovar lai str. 56601
uaaauugcauaaaagaaa

SEQ ID NO: 2798595 - RNA, 22 nt, Leptospira interrogans serovar lai str. 56601
uaacuuagucuuuguuuauugu

SEQ ID NO: 2798596 - RNA, 16 nt, Leptospira interrogans serovar lai str. 56601
uaacuuauaagacauu

SEQ ID NO: 2798597 - RNA, 12 nt, Leptospira interrogans serovar lai str. 56601
uaacuucauuuc

SEQ ID NO: 2798598 - RNA, 15 nt, Leptospira interrogans serovar lai str. 56601
uaacuucgguauaau

SEQ ID NO: 2798599 - RNA, 14 nt, Leptospira interrogans serovar lai str. 56601
uaacuuuacaaaaa

SEQ ID NO: 2798600 - RNA, 12 nt, Leptospira interrogans serovar lai str. 56601
uaacuuucauug

SEQ ID NO: 2798601 - RNA, 23 nt, Leptospira interrogans serovar lai str. 56601
uaacuuucuuuuagaaaauuaua

SEQ ID NO: 2798602 - RNA, 16 nt, Leptospira interrogans serovar lai str. 56601
uaacuuuuauucucuu

SEQ ID NO: 2798603 - RNA, 15 nt, Leptospira interrogans serovar lai str. 56601
uaacuuuuuuuaaaa

SEQ ID NO: 2798604 - RNA, 19 nt, Leptospira interrogans serovar lai str. 56601
uaacuuuuuuuaaaaaauu

SEQ ID NO: 2798605 - RNA, 21 nt, Leptospira interrogans serovar lai str. 56601
uaacuuuuuuuaaaaaauuca

SEQ ID NO: 2798606 - RNA, 17 nt, Leptospira interrogans serovar lai str. 56601
uaagaaaaaacuuucua

SEQ ID NO: 2798607 - RNA, 15 nt, Leptospira interrogans serovar lai str. 56601
uaagaaaaaauuucu

SEQ ID NO: 2798608 - RNA, 17 nt, Leptospira interrogans serovar lai str. 56601
uaagaaaaaauuucucc

SEQ ID NO: 2798609 - RNA, 14 nt, Leptospira interrogans serovar lai str. 56601
uaagaaaaacuagg

SEQ ID NO: 2798610 - RNA, 13 nt, Leptospira interrogans serovar lai str. 56601
uaagaaaaauuga

SEQ ID NO: 2798611 - RNA, 12 nt, Leptospira interrogans serovar lai str. 56601
uaagaaaaccau

SEQ ID NO: 2798612 - RNA, 11 nt, Leptospira interrogans serovar lai str. 56601
uaagaaaauau

SEQ ID NO: 2798613 - RNA, 15 nt, Leptospira interrogans serovar lai str. 56601
uaagaaaauuuaaaa

SEQ ID NO: 2798614 - RNA, 12 nt, Leptospira interrogans serovar lai str. 56601
uaagaaacucag

SEQ ID NO: 2798615 - RNA, 14 nt, Leptospira interrogans serovar lai str. 56601
uaagaaacucagua

SEQ ID NO: 2798616 - RNA, 17 nt, Leptospira interrogans serovar lai str. 56601
uaagaaacucaguaaaa

SEQ ID NO: 2798617 - RNA, 17 nt, Leptospira interrogans serovar lai str. 56601
uaagaaagacuuuuccu

SEQ ID NO: 2798618 - RNA, 16 nt, Leptospira interrogans serovar lai str. 56601
uaagaacaauuuaaaa

SEQ ID NO: 2798619 - RNA, 17 nt, Leptospira interrogans serovar lai str. 56601
uaagaacuuucucgaaa

SEQ ID NO: 2798620 - RNA, 19 nt, Leptospira interrogans serovar lai str. 56601
uaagaauaauuuaaacuua

SEQ ID NO: 2798621 - RNA, 15 nt, Leptospira interrogans serovar lai str. 56601
uaagaauauuauaaa

SEQ ID NO: 2798622 - RNA, 15 nt, Leptospira interrogans serovar lai str. 56601
uaagaaucaaaucuu

SEQ ID NO: 2798623 - RNA, 15 nt, Leptospira interrogans serovar lai str. 56601
uaagaaucgaaaaaa

SEQ ID NO: 2798624 - RNA, 17 nt, Leptospira interrogans serovar lai str. 56601
uaagaaucgaaaaaaua

SEQ ID NO: 2798625 - RNA, 17 nt, Leptospira interrogans serovar lai str. 56601
uaagaauuuuaaaaaau

SEQ ID NO: 2798626 - RNA, 21 nt, Leptospira interrogans serovar lai str. 56601
uaagacauuggcaaauguuau

SEQ ID NO: 2798627 - RNA, 15 nt, Leptospira interrogans serovar lai str. 56601
uaagacccuaaaaaa

SEQ ID NO: 2798628 - RNA, 19 nt, Leptospira interrogans serovar lai str. 56601
uaagacccuaaaaaauuuu

SEQ ID NO: 2798629 - RNA, 16 nt, Leptospira interrogans serovar lai str. 56601
uaagaccuaaacccug

SEQ ID NO: 2798630 - RNA, 19 nt, Leptospira interrogans serovar lai str. 56601
uaagagaauuucuauaaaa

SEQ ID NO: 2798631 - RNA, 14 nt, Leptospira interrogans serovar lai str. 56601
uaagagccuacaaa

SEQ ID NO: 2798632 - RNA, 18 nt, Leptospira interrogans serovar lai str. 56601
uaagagcgucuuugaauu

SEQ ID NO: 2798633 - RNA, 18 nt, Leptospira interrogans serovar lai str. 56601
uaagaguagaguaagaaa

SEQ ID NO: 2798634 - RNA, 17 nt, Leptospira interrogans serovar lai str. 56601
uaagagucauuuuuaaa

SEQ ID NO: 2798635 - RNA, 14 nt, Leptospira interrogans serovar lai str. 56601
uaagauaaauuaua

SEQ ID NO: 2798636 - RNA, 14 nt, Leptospira interrogans serovar lai str. 56601
uaagauaaauuuag

SEQ ID NO: 2798637 - RNA, 20 nt, Leptospira interrogans serovar lai str. 56601
uaagauauuaacaaauuuaa

SEQ ID NO: 2798638 - RNA, 14 nt, Leptospira interrogans serovar lai str. 56601
uaagaucaaagaga

SEQ ID NO: 2798639 - RNA, 22 nt, Leptospira interrogans serovar lai str. 56601
uaagaucuaucucaaaaccuau

SEQ ID NO: 2798640 - RNA, 15 nt, Leptospira interrogans serovar lai str. 56601
uaagaucugauauuc

SEQ ID NO: 2798641 - RNA, 20 nt, Leptospira interrogans serovar lai str. 56601
uaagaucuuuauaaaucugu

SEQ ID NO: 2798642 - RNA, 19 nt, Leptospira interrogans serovar lai str. 56601
uaagauuucguucggaaaa

SEQ ID NO: 2798643 - RNA, 15 nt, Leptospira interrogans serovar lai str. 56601
uaagauuuuagaauc

SEQ ID NO: 2798644 - RNA, 14 nt, Leptospira interrogans serovar lai str. 56601
uaagauuuugagac

SEQ ID NO: 2798645 - RNA, 12 nt, Leptospira interrogans serovar lai str. 56601
uaagcaaaaaua

SEQ ID NO: 2798646 - RNA, 14 nt, Leptospira interrogans serovar lai str. 56601
uaagcaaagauuaa

SEQ ID NO: 2798647 - RNA, 17 nt, Leptospira interrogans serovar lai str. 56601
uaagcauuauaaguuuu

SEQ ID NO: 2798648 - RNA, 17 nt, Leptospira interrogans serovar lai str. 56601
uaagcccccgaagaauu

SEQ ID NO: 2798649 - RNA, 21 nt, Leptospira interrogans serovar lai str. 56601
uaagcuaagcauaaaauucua

SEQ ID NO: 2798650 - RNA, 16 nt, Leptospira interrogans serovar lai str. 56601
uaagcugaaaauuuuc

SEQ ID NO: 2798651 - RNA, 13 nt, Leptospira interrogans serovar lai str. 56601
uaagcuuuagaaa

SEQ ID NO: 2798652 - RNA, 16 nt, Leptospira interrogans serovar lai str. 56601
uaagcuuuagaaaaua

SEQ ID NO: 2798653 - RNA, 21 nt, Leptospira interrogans serovar lai str. 56601
uaaggaaguguuugcugaguu

SEQ ID NO: 2798654 - RNA, 15 nt, Leptospira interrogans serovar lai str. 56601
uaaggagcaccuaac

SEQ ID NO: 2798655 - RNA, 20 nt, Leptospira interrogans serovar lai str. 56601
uaaggauccaauacaaaaca

SEQ ID NO: 2798656 - RNA, 15 nt, Leptospira interrogans serovar lai str. 56601
uaaggauucuuuucc

SEQ ID NO: 2798657 - RNA, 16 nt, Leptospira interrogans serovar lai str. 56601
uaaggauucuuuuccc

SEQ ID NO: 2798658 - RNA, 22 nt, Leptospira interrogans serovar lai str. 56601
uaaggcccacaucgaaaaaaca

SEQ ID NO: 2798659 - RNA, 14 nt, Leptospira interrogans serovar lai str. 56601
uaagggaaaguuau

SEQ ID NO: 2798660 - RNA, 15 nt, Leptospira interrogans serovar lai str. 56601
uaagguugagguucu

SEQ ID NO: 2798661 - RNA, 19 nt, Leptospira interrogans serovar lai str. 56601
uaaguaaaaaugcaaauug

SEQ ID NO: 2798662 - RNA, 15 nt, Leptospira interrogans serovar lai str. 56601
uaaguaauuuaaaaa

SEQ ID NO: 2798663 - RNA, 18 nt, Leptospira interrogans serovar lai str. 56601
uaaguaauuuguggaaac

SEQ ID NO: 2798664 - RNA, 15 nt, Leptospira interrogans serovar lai str. 56601
uaaguagaaauuuaa

SEQ ID NO: 2798665 - RNA, 20 nt, Leptospira interrogans serovar lai str. 56601
uaaguagaaauuuaauuuga

SEQ ID NO: 2798666 - RNA, 14 nt, Leptospira interrogans serovar lai str. 56601
uaaguaggaacuac

SEQ ID NO: 2798667 - RNA, 16 nt, Leptospira interrogans serovar lai str. 56601
uaaguauucaauuuca

SEQ ID NO: 2798668 - RNA, 14 nt, Leptospira interrogans serovar lai str. 56601
uaaguccuuuucuu

SEQ ID NO: 2798669 - RNA, 19 nt, Leptospira interrogans serovar lai str. 56601
uaagucguuguauuuuaaa

SEQ ID NO: 2798670 - RNA, 13 nt, Leptospira interrogans serovar lai str. 56601
uaaguuaaauaua

SEQ ID NO: 2798671 - RNA, 14 nt, Leptospira interrogans serovar lai str. 56601
uaaguuaaauauaa

SEQ ID NO: 2798672 - RNA, 17 nt, Leptospira interrogans serovar lai str. 56601
uaaguuaaauauaaaag

SEQ ID NO: 2798673 - RNA, 13 nt, Leptospira interrogans serovar lai str. 56601
uaaguuacucauu

SEQ ID NO: 2798674 - RNA, 18 nt, Leptospira interrogans serovar lai str. 56601
uaaguuaggugauauuuu

SEQ ID NO: 2798675 - RNA, 20 nt, Leptospira interrogans serovar lai str. 56601
uaaguucaucuacguuucaa

SEQ ID NO: 2798676 - RNA, 23 nt, Leptospira interrogans serovar lai str. 56601
uaaguucaucuacguuucaauua

SEQ ID NO: 2798677 - RNA, 16 nt, Leptospira interrogans serovar lai str. 56601
uaaguuuaaaaacagu

SEQ ID NO: 2798678 - RNA, 17 nt, Leptospira interrogans serovar lai str. 56601
uaaguuuauucaauuuu

SEQ ID NO: 2798679 - RNA, 14 nt, Leptospira interrogans serovar lai str. 56601
uaauaugauuaugu

SEQ ID NO: 2798680 - RNA, 17 nt, Leptospira interrogans serovar lai str. 56601
uaauauggguauugguu

SEQ ID NO: 2798681 - RNA, 15 nt, Leptospira interrogans serovar lai str. 56601
uaauauuacauucaa

SEQ ID NO: 2798682 - RNA, 17 nt, Leptospira interrogans serovar lai str. 56601
uaauauuacauucaaua

SEQ ID NO: 2798683 - RNA, 13 nt, Leptospira interrogans serovar lai str. 56601
uaauauuagaauu

SEQ ID NO: 2798684 - RNA, 23 nt, Leptospira interrogans serovar lai str. 56601
uaauauuagaauuguugaaaaau

SEQ ID NO: 2798685 - RNA, 13 nt, Leptospira interrogans serovar lai str. 56601
uaauauuauuaaa

SEQ ID NO: 2798686 - RNA, 16 nt, Leptospira interrogans serovar lai str. 56601
uaauauucuuuuauau

SEQ ID NO: 2798687 - RNA, 18 nt, Leptospira interrogans serovar lai str. 56601
uaauauuucguuuuuagu

SEQ ID NO: 2798688 - RNA, 13 nt, Leptospira interrogans serovar lai str. 56601
uaauauuucucuc

SEQ ID NO: 2798689 - RNA, 12 nt, Leptospira interrogans serovar lai str. 56601
uaauauuucuuu

SEQ ID NO: 2798690 - RNA, 22 nt, Leptospira interrogans serovar lai str. 56601
uaauauuuuuauguauuuuaaa

SEQ ID NO: 2798691 - RNA, 17 nt, Leptospira interrogans serovar lai str. 56601
uaaucaaacuaaauuag

SEQ ID NO: 2798692 - RNA, 22 nt, Leptospira interrogans serovar lai str. 56601
uaaucaaacuaaauuaguucuu

SEQ ID NO: 2798693 - RNA, 15 nt, Leptospira interrogans serovar lai str. 56601
uaaucaaauacaaaa

SEQ ID NO: 2798694 - RNA, 21 nt, Leptospira interrogans serovar lai str. 56601
uaaucaaaugcaguaguuccu

SEQ ID NO: 2798695 - RNA, 22 nt, Leptospira interrogans serovar lai str. 56601
uaaucaaauuucugcaugaaau

SEQ ID NO: 2798696 - RNA, 18 nt, Leptospira interrogans serovar lai str. 56601
uaaucacgaaaaaugaau

SEQ ID NO: 2798697 - RNA, 17 nt, Leptospira interrogans serovar lai str. 56601
uaaucagauuuugcaca

SEQ ID NO: 2798698 - RNA, 16 nt, Leptospira interrogans serovar lai str. 56601
uaaucaguuaaacccg

SEQ ID NO: 2798699 - RNA, 12 nt, Leptospira interrogans serovar lai str. 56601
uaaucaucaaaa

SEQ ID NO: 2798700 - RNA, 15 nt, Leptospira interrogans serovar lai str. 56601
uaaucaucaaaauca

SEQ ID NO: 2798701 - RNA, 22 nt, Leptospira interrogans serovar lai str. 56601
uaaucauggccuucuggaaaaa

SEQ ID NO: 2798702 - RNA, 21 nt, Leptospira interrogans serovar lai str. 56601
uaaucaugugaauucagaaaa

SEQ ID NO: 2798703 - RNA, 23 nt, Leptospira interrogans serovar lai str. 56601
uaauccaauaaaauuuuauacuu

SEQ ID NO: 2798704 - RNA, 17 nt, Leptospira interrogans serovar lai str. 56601
uaauccuaugaaaauuu

SEQ ID NO: 2798705 - RNA, 14 nt, Leptospira interrogans serovar lai str. 56601
uaauccuuuuacuu

SEQ ID NO: 2798706 - RNA, 18 nt, Leptospira interrogans serovar lai str. 56601
uaaucgagcuuuucuguu

SEQ ID NO: 2798707 - RNA, 21 nt, Leptospira interrogans serovar lai str. 56601
uaaucgcagguugcaauccaa

SEQ ID NO: 2798708 - RNA, 16 nt, Leptospira interrogans serovar lai str. 56601
uaaucgcuuucgcauu

SEQ ID NO: 2798709 - RNA, 12 nt, Leptospira interrogans serovar lai str. 56601
uaaucggaaaua

SEQ ID NO: 2798710 - RNA, 16 nt, Leptospira interrogans serovar lai str. 56601
uaaucguguuugagau

SEQ ID NO: 2798711 - RNA, 23 nt, Leptospira interrogans serovar lai str. 56601
uaaucguguuugagauuaaaaag

SEQ ID NO: 2798712 - RNA, 22 nt, Leptospira interrogans serovar lai str. 56601
uaaucuaagacgaaaagaagaa

SEQ ID NO: 2798713 - RNA, 16 nt, Leptospira interrogans serovar lai str. 56601
uaaucucgauuucuaa

SEQ ID NO: 2798714 - RNA, 17 nt, Leptospira interrogans serovar lai str. 56601
uaaucucguuaaauuuu

SEQ ID NO: 2798715 - RNA, 11 nt, Leptospira interrogans serovar lai str. 56601
uaaucuggaaa

SEQ ID NO: 2798716 - RNA, 23 nt, Leptospira interrogans serovar lai str. 56601
uaaucuggucggaauuacgacaa

SEQ ID NO: 2798717 - RNA, 22 nt, Leptospira interrogans serovar lai str. 56601
uaaucugugggaacuaccacaa

SEQ ID NO: 2798718 - RNA, 21 nt, Leptospira interrogans serovar lai str. 56601
uaaucuuauuuuuuaauauuc

SEQ ID NO: 2798719 - RNA, 12 nt, Leptospira interrogans serovar lai str. 56601
uaaucuuccgca

SEQ ID NO: 2798720 - RNA, 18 nt, Leptospira interrogans serovar lai str. 56601
uaaucuuuauagguuucu

SEQ ID NO: 2798721 - RNA, 22 nt, Leptospira interrogans serovar lai str. 56601
uaaucuuuuuaaaaguuugauu

SEQ ID NO: 2798722 - RNA, 13 nt, Leptospira interrogans serovar lai str. 56601
uaaugaaaaagaa

SEQ ID NO: 2798723 - RNA, 21 nt, Leptospira interrogans serovar lai str. 56601
uaaugaaaacuuguuuuagaa

SEQ ID NO: 2798724 - RNA, 16 nt, Leptospira interrogans serovar lai str. 56601
uaaugaaggaauugga

SEQ ID NO: 2798725 - RNA, 15 nt, Leptospira interrogans serovar lai str. 56601
uaaugagauuaaaac

SEQ ID NO: 2798726 - RNA, 20 nt, Leptospira interrogans serovar lai str. 56601
uaaugagccagguuaauuaa

SEQ ID NO: 2798727 - RNA, 21 nt, Leptospira interrogans serovar lai str. 56601
uaaugaggagaaaaaauaaca

SEQ ID NO: 2798728 - RNA, 17 nt, Leptospira interrogans serovar lai str. 56601
uaaugccuacaaaucaa

SEQ ID NO: 2798729 - RNA, 13 nt, Leptospira interrogans serovar lai str. 56601
uaaugcugauuuu

SEQ ID NO: 2798730 - RNA, 20 nt, Leptospira interrogans serovar lai str. 56601
uaauguaaaguucuuuucuu

SEQ ID NO: 2798731 - RNA, 20 nt, Leptospira interrogans serovar lai str. 56601
uaauguugaaugaaaccuga

SEQ ID NO: 2798732 - RNA, 13 nt, Leptospira interrogans serovar lai str. 56601
uaauguuugaauu

SEQ ID NO: 2798733 - RNA, 17 nt, Leptospira interrogans serovar lai str. 56601
uaauguuuuuuauuuaa

SEQ ID NO: 2798734 - RNA, 14 nt, Leptospira interrogans serovar lai str. 56601
uaauuaaaauuuac

SEQ ID NO: 2798735 - RNA, 18 nt, Leptospira interrogans serovar lai str. 56601
uaauuaaacaaagaauaa

SEQ ID NO: 2798736 - RNA, 19 nt, Leptospira interrogans serovar lai str. 56601
uaauuaaacaaagaauaaa

SEQ ID NO: 2798737 - RNA, 22 nt, Leptospira interrogans serovar lai str. 56601
uaauuaaacaaagaauaaaucc

SEQ ID NO: 2798738 - RNA, 22 nt, Leptospira interrogans serovar lai str. 56601
uaauuaaacuuuuauaaaaucu

SEQ ID NO: 2798739 - RNA, 13 nt, Leptospira interrogans serovar lai str. 56601
uaauuaaaugaag

SEQ ID NO: 2798740 - RNA, 15 nt, Leptospira interrogans serovar lai str. 56601
uaauuaaaugaagug

SEQ ID NO: 2798741 - RNA, 14 nt, Leptospira interrogans serovar lai str. 56601
uaauuaauucagca

SEQ ID NO: 2798742 - RNA, 13 nt, Leptospira interrogans serovar lai str. 56601
uaauuacaguuaa

SEQ ID NO: 2798743 - RNA, 20 nt, Leptospira interrogans serovar lai str. 56601
uaauuagaggauaaacugua

SEQ ID NO: 2798744 - RNA, 16 nt, Leptospira interrogans serovar lai str. 56601
uaauuauauucuuaua

SEQ ID NO: 2798745 - RNA, 21 nt, Leptospira interrogans serovar lai str. 56601
uaauuauucucagcugaacuc

SEQ ID NO: 2798746 - RNA, 21 nt, Leptospira interrogans serovar lai str. 56601
uaauuauugauaaaaaaaugu

SEQ ID NO: 2798747 - RNA, 13 nt, Leptospira interrogans serovar lai str. 56601
uaauuauuuauuu

SEQ ID NO: 2798748 - RNA, 19 nt, Leptospira interrogans serovar lai str. 56601
uaauucagcaucgaauauc

SEQ ID NO: 2798749 - RNA, 16 nt, Leptospira interrogans serovar lai str. 56601
uaauucccguuauaaa

SEQ ID NO: 2798750 - RNA, 18 nt, Leptospira interrogans serovar lai str. 56601
uaauuccgggguuucuuu

SEQ ID NO: 2798751 - RNA, 14 nt, Leptospira interrogans serovar lai str. 56601
uaauuccuccauga

SEQ ID NO: 2798752 - RNA, 18 nt, Leptospira interrogans serovar lai str. 56601
uaauucgugaacuuuaga

SEQ ID NO: 2798753 - RNA, 22 nt, Leptospira interrogans serovar lai str. 56601
uaauucguuuuuuaaaauguag

SEQ ID NO: 2798754 - RNA, 21 nt, Leptospira interrogans serovar lai str. 56601
uaauucuacgaaacuuuuaga

SEQ ID NO: 2798755 - RNA, 21 nt, Leptospira interrogans serovar lai str. 56601
uaauucuccaucuguuuucuu

SEQ ID NO: 2798756 - RNA, 16 nt, Leptospira interrogans serovar lai str. 56601
uaauucuccauuuguu

SEQ ID NO: 2798757 - RNA, 16 nt, Leptospira interrogans serovar lai str. 56601
uaauucugaaaaaguu

SEQ ID NO: 2798758 - RNA, 21 nt, Leptospira interrogans serovar lai str. 56601
uaauucugaaaaaguuagaau

SEQ ID NO: 2798759 - RNA, 22 nt, Leptospira interrogans serovar lai str. 56601
uaauucuguaaaauaaauuuau

SEQ ID NO: 2798760 - RNA, 12 nt, Leptospira interrogans serovar lai str. 56601
uaauucuuaauu

SEQ ID NO: 2798761 - RNA, 17 nt, Leptospira interrogans serovar lai str. 56601
uaauucuucaauaucuu

SEQ ID NO: 2798762 - RNA, 15 nt, Leptospira interrogans serovar lai str. 56601
uacaacccaacuuuc

SEQ ID NO: 2798763 - RNA, 14 nt, Leptospira interrogans serovar lai str. 56601
uacaacgaaaacag

SEQ ID NO: 2798764 - RNA, 14 nt, Leptospira interrogans serovar lai str. 56601
uacaacgauucagu

SEQ ID NO: 2798765 - RNA, 16 nt, Leptospira interrogans serovar lai str. 56601
uacaacgcgauccaua

SEQ ID NO: 2798766 - RNA, 23 nt, Leptospira interrogans serovar lai str. 56601
uacaacuuucagauuaaaaccgu

SEQ ID NO: 2798767 - RNA, 20 nt, Leptospira interrogans serovar lai str. 56601
uacaacuuuuuuaaguucuu

SEQ ID NO: 2798768 - RNA, 23 nt, Leptospira interrogans serovar lai str. 56601
uacaacuuuuuuaaguucuuuag

SEQ ID NO: 2798769 - RNA, 17 nt, Leptospira interrogans serovar lai str. 56601
uacaacuuuuuuaauuu

SEQ ID NO: 2798770 - RNA, 20 nt, Leptospira interrogans serovar lai str. 56601
uacaacuuuuuuaauuuuaa

SEQ ID NO: 2798771 - RNA, 23 nt, Leptospira interrogans serovar lai str. 56601
uacaacuuuuuuaauuuuaauua

SEQ ID NO: 2798772 - RNA, 22 nt, Leptospira interrogans serovar lai str. 56601
uacaagauuucguucggaaaaa

SEQ ID NO: 2798773 - RNA, 15 nt, Leptospira interrogans serovar lai str. 56601
uacaauaaaaacaga

SEQ ID NO: 2798774 - RNA, 13 nt, Leptospira interrogans serovar lai str. 56601
uacaauaaaaauu

SEQ ID NO: 2798775 - RNA, 16 nt, Leptospira interrogans serovar lai str. 56601
uacaauaaaaauuaga

SEQ ID NO: 2798776 - RNA, 15 nt, Leptospira interrogans serovar lai str. 56601
uacaauaaaucaaaa

SEQ ID NO: 2798777 - RNA, 18 nt, Leptospira interrogans serovar lai str. 56601
uacaauaaaucaaaagga

SEQ ID NO: 2798778 - RNA, 19 nt, Leptospira interrogans serovar lai str. 56601
uacaauaaaucaaaaggaa

SEQ ID NO: 2798779 - RNA, 21 nt, Leptospira interrogans serovar lai str. 56601
uacaauaaaucaaaaggaaua

SEQ ID NO: 2798780 - RNA, 21 nt, Leptospira interrogans serovar lai str. 56601
uacaauccucgcuuuuaauaa

SEQ ID NO: 2798781 - RNA, 15 nt, Leptospira interrogans serovar lai str. 56601
uacaaucgcuuucgc

SEQ ID NO: 2798782 - RNA, 16 nt, Leptospira interrogans serovar lai str. 56601
uacaaucggguaaaaa

SEQ ID NO: 2798783 - RNA, 17 nt, Leptospira interrogans serovar lai str. 56601
uacaaucggguaaaaaa

SEQ ID NO: 2798784 - RNA, 20 nt, Leptospira interrogans serovar lai str. 56601
uacaaucggguaaaaaauac

SEQ ID NO: 2798785 - RNA, 13 nt, Leptospira interrogans serovar lai str. 56601
uacaaugaaaaag

SEQ ID NO: 2798786 - RNA, 15 nt, Leptospira interrogans serovar lai str. 56601
uacaaugaaaaagca

SEQ ID NO: 2798787 - RNA, 16 nt, Leptospira interrogans serovar lai str. 56601
uacaaugucuaucaaa

SEQ ID NO: 2798788 - RNA, 23 nt, Leptospira interrogans serovar lai str. 56601
uacaauuaaacuucaaaaaauau

SEQ ID NO: 2798789 - RNA, 18 nt, Leptospira interrogans serovar lai str. 56601
uacaauucugaaauuguu

SEQ ID NO: 2798790 - RNA, 18 nt, Leptospira interrogans serovar lai str. 56601
uacaauucuuucuuaaau

SEQ ID NO: 2798791 - RNA, 14 nt, Leptospira interrogans serovar lai str. 56601
uacaauuguaggaa

SEQ ID NO: 2798792 - RNA, 15 nt, Leptospira interrogans serovar lai str. 56601
uacaauuguaggaau

SEQ ID NO: 2798793 - RNA, 15 nt, Leptospira interrogans serovar lai str. 56601
uacaauuuauuauaa

SEQ ID NO: 2798794 - RNA, 16 nt, Leptospira interrogans serovar lai str. 56601
uacaauuuauuauaaa

SEQ ID NO: 2798795 - RNA, 20 nt, Leptospira interrogans serovar lai str. 56601
uacaauuuauugaccagagc

SEQ ID NO: 2798796 - RNA, 17 nt, Leptospira interrogans serovar lai str. 56601
uacaauuucaggaaucg

SEQ ID NO: 2798797 - RNA, 16 nt, Leptospira interrogans serovar lai str. 56601
uacaauuugcuaaaau

SEQ ID NO: 2798798 - RNA, 18 nt, Leptospira interrogans serovar lai str. 56601
uacaauuugcuaaaauaa

SEQ ID NO: 2798799 - RNA, 19 nt, Leptospira interrogans serovar lai str. 56601
uacaauuugcuaaaauaag

SEQ ID NO: 2798800 - RNA, 22 nt, Leptospira interrogans serovar lai str. 56601
uacaauuugcuaaaauaagaau

SEQ ID NO: 2798801 - RNA, 14 nt, Leptospira interrogans serovar lai str. 56601
uacaauuuuagaau

SEQ ID NO: 2798802 - RNA, 14 nt, Leptospira interrogans serovar lai str. 56601
uacaauuuuaucuu

SEQ ID NO: 2798803 - RNA, 13 nt, Leptospira interrogans serovar lai str. 56601
uacaccuucuaaa

SEQ ID NO: 2798804 - RNA, 16 nt, Leptospira interrogans serovar lai str. 56601
uacacgauaauuuuua

SEQ ID NO: 2798805 - RNA, 16 nt, Leptospira interrogans serovar lai str. 56601
uacacggagauaaaaa

SEQ ID NO: 2798806 - RNA, 17 nt, Leptospira interrogans serovar lai str. 56601
uacacggagauaaaaaa

SEQ ID NO: 2798807 - RNA, 20 nt, Leptospira interrogans serovar lai str. 56601
uacacggagauaaaaaagga

SEQ ID NO: 2798808 - RNA, 21 nt, Leptospira interrogans serovar lai str. 56601
uacacggagauaaaaaaggau

SEQ ID NO: 2798809 - RNA, 14 nt, Leptospira interrogans serovar lai str. 56601
uacacguaauucuu

SEQ ID NO: 2798810 - RNA, 15 nt, Leptospira interrogans serovar lai str. 56601
uacacgucaauaaug

SEQ ID NO: 2798811 - RNA, 16 nt, Leptospira interrogans serovar lai str. 56601
uacacguuuuccuaau

SEQ ID NO: 2798812 - RNA, 17 nt, Leptospira interrogans serovar lai str. 56601
uacacguuuuccuaaua

SEQ ID NO: 2798813 - RNA, 16 nt, Leptospira interrogans serovar lai str. 56601
uacacucuaaguuuuu

SEQ ID NO: 2798814 - RNA, 15 nt, Leptospira interrogans serovar lai str. 56601
uacacucuuucaaug

SEQ ID NO: 2798815 - RNA, 10 nt, Leptospira interrogans serovar lai str. 56601
uacagaaaaa

SEQ ID NO: 2798816 - RNA, 16 nt, Leptospira interrogans serovar lai str. 56601
uacagaaaaaauccau

SEQ ID NO: 2798817 - RNA, 11 nt, Leptospira interrogans serovar lai str. 56601
uacagaaaaau

SEQ ID NO: 2798818 - RNA, 13 nt, Leptospira interrogans serovar lai str. 56601
uacagaaaaauca

SEQ ID NO: 2798819 - RNA, 19 nt, Leptospira interrogans serovar lai str. 56601
uacagaaaaccaaauaaua

SEQ ID NO: 2798820 - RNA, 13 nt, Leptospira interrogans serovar lai str. 56601
uacagaaacaaaa

SEQ ID NO: 2798821 - RNA, 22 nt, Leptospira interrogans serovar lai str. 56601
uacagaacccaauaaaaacuaa

SEQ ID NO: 2798822 - RNA, 19 nt, Leptospira interrogans serovar lai str. 56601
uacagaauaaauacauaca

SEQ ID NO: 2798823 - RNA, 22 nt, Leptospira interrogans serovar lai str. 56601
uacagaauaaauacauacaaug

SEQ ID NO: 2798824 - RNA, 17 nt, Leptospira interrogans serovar lai str. 56601
uacagaauuuuuuaaca

SEQ ID NO: 2798825 - RNA, 16 nt, Leptospira interrogans serovar lai str. 56601
uacagacguauuuuua

SEQ ID NO: 2798826 - RNA, 18 nt, Leptospira interrogans serovar lai str. 56601
uacagacguauuuuuaaa

SEQ ID NO: 2798827 - RNA, 12 nt, Leptospira interrogans serovar lai str. 56601
uacagauaaacg

SEQ ID NO: 2798828 - RNA, 21 nt, Leptospira interrogans serovar lai str. 56601
uacagauacucaauuugauau

SEQ ID NO: 2798829 - RNA, 21 nt, Leptospira interrogans serovar lai str. 56601
uacagaucgauuccuacuuau

SEQ ID NO: 2798830 - RNA, 19 nt, Leptospira interrogans serovar lai str. 56601
uacagauuuauuuuagaau

SEQ ID NO: 2798831 - RNA, 15 nt, Leptospira interrogans serovar lai str. 56601
uacagccaucccacu

SEQ ID NO: 2798832 - RNA, 22 nt, Leptospira interrogans serovar lai str. 56601
uacagcugaggaguuuuuauaa

SEQ ID NO: 2798833 - RNA, 19 nt, Leptospira interrogans serovar lai str. 56601
uacaguaaaaccacacuac

SEQ ID NO: 2798834 - RNA, 23 nt, Leptospira interrogans serovar lai str. 56601
uacaguaaaaucuaaauuuguaa

SEQ ID NO: 2798835 - RNA, 18 nt, Leptospira interrogans serovar lai str. 56601
uacaguaccacuuacauc

SEQ ID NO: 2798836 - RNA, 14 nt, Leptospira interrogans serovar lai str. 56601
uacaguuaaacuuu

SEQ ID NO: 2798837 - RNA, 13 nt, Leptospira interrogans serovar lai str. 56601
uacaguuucgauu

SEQ ID NO: 2798838 - RNA, 13 nt, Leptospira interrogans serovar lai str. 56601
uacaguuuuagaa

SEQ ID NO: 2798839 - RNA, 14 nt, Leptospira interrogans serovar lai str. 56601
uacaguuuuagaau

SEQ ID NO: 2798840 - RNA, 17 nt, Leptospira interrogans serovar lai str. 56601
uacauaaaaaaauaaua

SEQ ID NO: 2798841 - RNA, 17 nt, Leptospira interrogans serovar lai str. 56601
uacauaaacgauuauuu

SEQ ID NO: 2798842 - RNA, 18 nt, Leptospira interrogans serovar lai str. 56601
uacauaacuaauaaaaac

SEQ ID NO: 2798843 - RNA, 22 nt, Leptospira interrogans serovar lai str. 56601
uacauaaguucgguguaaaaaa

SEQ ID NO: 2798844 - RNA, 12 nt, Leptospira interrogans serovar lai str. 56601
uacauaauaaua

SEQ ID NO: 2798845 - RNA, 22 nt, Leptospira interrogans serovar lai str. 56601
uacgcuucaaucucuuucucau

SEQ ID NO: 2798846 - RNA, 16 nt, Leptospira interrogans serovar lai str. 56601
uacggaugugaauucu

SEQ ID NO: 2798847 - RNA, 18 nt, Leptospira interrogans serovar lai str. 56601
uacggaugugaauucucu

SEQ ID NO: 2798848 - RNA, 21 nt, Leptospira interrogans serovar lai str. 56601
uacggauucucgcauuuuccu

SEQ ID NO: 2798849 - RNA, 20 nt, Leptospira interrogans serovar lai str. 56601
uacggauugccuaaauuccu

SEQ ID NO: 2798850 - RNA, 15 nt, Leptospira interrogans serovar lai str. 56601
uacggggaauuuuua

SEQ ID NO: 2798851 - RNA, 13 nt, Leptospira interrogans serovar lai str. 56601
uacguaaaaauga

SEQ ID NO: 2798852 - RNA, 22 nt, Leptospira interrogans serovar lai str. 56601
uacgucaaacucacguuggauu

SEQ ID NO: 2798853 - RNA, 20 nt, Leptospira interrogans serovar lai str. 56601
uacgugaccaggaauacuug

SEQ ID NO: 2798854 - RNA, 21 nt, Leptospira interrogans serovar lai str. 56601
uacguuauaauucuuuaaaau

SEQ ID NO: 2798855 - RNA, 21 nt, Leptospira interrogans serovar lai str. 56601
uacguuuuauuauauaauuuu

SEQ ID NO: 2798856 - RNA, 13 nt, Leptospira interrogans serovar lai str. 56601
uacuaaaaaacau

SEQ ID NO: 2798857 - RNA, 14 nt, Leptospira interrogans serovar lai str. 56601
uacuaaaaaacaua

SEQ ID NO: 2798858 - RNA, 22 nt, Leptospira interrogans serovar lai str. 56601
uacuaaaaaacauaaaaauuuu

SEQ ID NO: 2798859 - RNA, 15 nt, Leptospira interrogans serovar lai str. 56601
uacuaaaaauucaua

SEQ ID NO: 2798860 - RNA, 16 nt, Leptospira interrogans serovar lai str. 56601
uacuaaaaauucauau

SEQ ID NO: 2798861 - RNA, 18 nt, Leptospira interrogans serovar lai str. 56601
uacuaaaaauucauauug

SEQ ID NO: 2798862 - RNA, 13 nt, Leptospira interrogans serovar lai str. 56601
uacuaaaauuaaa

SEQ ID NO: 2798863 - RNA, 16 nt, Leptospira interrogans serovar lai str. 56601
uacuaaaauuaaaaau

SEQ ID NO: 2798864 - RNA, 15 nt, Leptospira interrogans serovar lai str. 56601
uacuaaaauuauucu

SEQ ID NO: 2798865 - RNA, 17 nt, Leptospira interrogans serovar lai str. 56601
uacuaaaauuuuauaaa

SEQ ID NO: 2798866 - RNA, 14 nt, Leptospira interrogans serovar lai str. 56601
uacuaaauuaaguu

SEQ ID NO: 2798867 - RNA, 19 nt, Leptospira interrogans serovar lai str. 56601
uacuaaauuauuuucaagu

SEQ ID NO: 2798868 - RNA, 23 nt, Leptospira interrogans serovar lai str. 56601
uacuaacacaguuugaauuuuac

SEQ ID NO: 2798869 - RNA, 14 nt, Leptospira interrogans serovar lai str. 56601
uacuaauaguuuua

SEQ ID NO: 2798870 - RNA, 21 nt, Leptospira interrogans serovar lai str. 56601
uacuaaucgagcuuuucuguu

SEQ ID NO: 2798871 - RNA, 23 nt, Leptospira interrogans serovar lai str. 56601
uacuaaucgagcuuuucuguuca

SEQ ID NO: 2798872 - RNA, 17 nt, Leptospira interrogans serovar lai str. 56601
uacuaaucucuauaaaa

SEQ ID NO: 2798873 - RNA, 19 nt, Leptospira interrogans serovar lai str. 56601
uacuaaucucuauaaaagu

SEQ ID NO: 2798874 - RNA, 12 nt, Leptospira interrogans serovar lai str. 56601
uacuacaaaaau

SEQ ID NO: 2798875 - RNA, 13 nt, Leptospira interrogans serovar lai str. 56601
uacuacaaaaauu

SEQ ID NO: 2798876 - RNA, 16 nt, Leptospira interrogans serovar lai str. 56601
uacuacaaaaauuuaa

SEQ ID NO: 2798877 - RNA, 13 nt, Leptospira interrogans serovar lai str. 56601
uacuacaaaucac

SEQ ID NO: 2798878 - RNA, 15 nt, Leptospira interrogans serovar lai str. 56601
uacuacaauuaaaaa

SEQ ID NO: 2798879 - RNA, 14 nt, Leptospira interrogans serovar lai str. 56601
uacuacauuuuauu

SEQ ID NO: 2798880 - RNA, 18 nt, Leptospira interrogans serovar lai str. 56601
uacuacgaaaacuuaaug

SEQ ID NO: 2798881 - RNA, 16 nt, Leptospira interrogans serovar lai str. 56601
uacuacgaaaauuuaa

SEQ ID NO: 2798882 - RNA, 23 nt, Leptospira interrogans serovar lai str. 56601
uacuacucgaacgcaugaaaaua

SEQ ID NO: 2798883 - RNA, 23 nt, Leptospira interrogans serovar lai str. 56601
uacuacuuuaacgugaguuugau

SEQ ID NO: 2798884 - RNA, 19 nt, Leptospira interrogans serovar lai str. 56601
uacuacuuuuagaaaaaau

SEQ ID NO: 2798885 - RNA, 19 nt, Leptospira interrogans serovar lai str. 56601
uacuacuuuucugaaaaac

SEQ ID NO: 2798886 - RNA, 13 nt, Leptospira interrogans serovar lai str. 56601
uacuauaaacaua

SEQ ID NO: 2798887 - RNA, 17 nt, Leptospira interrogans serovar lai str. 56601
uacuauaaacauauuau

SEQ ID NO: 2798888 - RNA, 21 nt, Leptospira interrogans serovar lai str. 56601
uacuauaaacauauuauuuuc

SEQ ID NO: 2798889 - RNA, 14 nt, Leptospira interrogans serovar lai str. 56601
uacuauaaacuucu

SEQ ID NO: 2798890 - RNA, 14 nt, Leptospira interrogans serovar lai str. 56601
uacuauaaauuacu

SEQ ID NO: 2798891 - RNA, 17 nt, Leptospira interrogans serovar lai str. 56601
uacuauaacuuuaaaaa

SEQ ID NO: 2798892 - RNA, 18 nt, Leptospira interrogans serovar lai str. 56601
uacuauaacuuuaaaaaa

SEQ ID NO: 2798893 - RNA, 13 nt, Leptospira interrogans serovar lai str. 56601
uacuaugaaauac

SEQ ID NO: 2798894 - RNA, 12 nt, Leptospira interrogans serovar lai str. 56601
uacuauuauaau

SEQ ID NO: 2798895 - RNA, 21 nt, Leptospira interrogans serovar lai str. 56601
uacuauuauaauagauugaua

SEQ ID NO: 2798896 - RNA, 21 nt, Leptospira interrogans serovar lai str. 56601
uacuauuuugaugaaugaaua

SEQ ID NO: 2798897 - RNA, 11 nt, Leptospira interrogans serovar lai str. 56601
uacucaaagaa

SEQ ID NO: 2798898 - RNA, 23 nt, Leptospira interrogans serovar lai str. 56601
uacucaauuugauaugaaucagc

SEQ ID NO: 2798899 - RNA, 15 nt, Leptospira interrogans serovar lai str. 56601
uacucacaaauuguc

SEQ ID NO: 2798900 - RNA, 14 nt, Leptospira interrogans serovar lai str. 56601
uacucauaaaauuu

SEQ ID NO: 2798901 - RNA, 13 nt, Leptospira interrogans serovar lai str. 56601
uacucauuuccau

SEQ ID NO: 2798902 - RNA, 14 nt, Leptospira interrogans serovar lai str. 56601
uacuccggcuaaaa

SEQ ID NO: 2798903 - RNA, 21 nt, Leptospira interrogans serovar lai str. 56601
uacuccggcuaaaaaacugau

SEQ ID NO: 2798904 - RNA, 21 nt, Leptospira interrogans serovar lai str. 56601
uacuccuaggcauaugaaaau

SEQ ID NO: 2798905 - RNA, 18 nt, Leptospira interrogans serovar lai str. 56601
uacucgaauuuauauagu

SEQ ID NO: 2798906 - RNA, 14 nt, Leptospira interrogans serovar lai str. 56601
uacucgauaauucu

SEQ ID NO: 2798907 - RNA, 15 nt, Leptospira interrogans serovar lai str. 56601
uacucgauaauucuu

SEQ ID NO: 2798908 - RNA, 16 nt, Leptospira interrogans serovar lai str. 56601
uacucggaaauuuauu

SEQ ID NO: 2798909 - RNA, 20 nt, Leptospira interrogans serovar lai str. 56601
uacucguuuuuaguuucuuu

SEQ ID NO: 2798910 - RNA, 22 nt, Leptospira interrogans serovar lai str. 56601
uacucguuuuuaguuucuuuuu

SEQ ID NO: 2798911 - RNA, 17 nt, Leptospira interrogans serovar lai str. 56601
uacucuacuauaaacuu

SEQ ID NO: 2798912 - RNA, 18 nt, Leptospira interrogans serovar lai str. 56601
uacucuacuauaaacuuc

SEQ ID NO: 2798913 - RNA, 22 nt, Leptospira interrogans serovar lai str. 56601
uacucuauuauauaguuaucag

SEQ ID NO: 2798914 - RNA, 23 nt, Leptospira interrogans serovar lai str. 56601
uacucugcaaaauuuaaaaagug

SEQ ID NO: 2798915 - RNA, 13 nt, Leptospira interrogans serovar lai str. 56601
uacucuuauaaaa

SEQ ID NO: 2798916 - RNA, 15 nt, Leptospira interrogans serovar lai str. 56601
uacucuuauaaaauu

SEQ ID NO: 2798917 - RNA, 16 nt, Leptospira interrogans serovar lai str. 56601
uacugaguuucaaacg

SEQ ID NO: 2798918 - RNA, 14 nt, Leptospira interrogans serovar lai str. 56601
uacugaucuuaugg

SEQ ID NO: 2798919 - RNA, 16 nt, Leptospira interrogans serovar lai str. 56601
uacugauuucaaaaau

SEQ ID NO: 2798920 - RNA, 20 nt, Leptospira interrogans serovar lai str. 56601
uacugauuucaaaaauaaau

SEQ ID NO: 2798921 - RNA, 14 nt, Leptospira interrogans serovar lai str. 56601
uacugauuucuaua

SEQ ID NO: 2798922 - RNA, 19 nt, Leptospira interrogans serovar lai str. 56601
uacugauuucuauaaaauu

SEQ ID NO: 2798923 - RNA, 18 nt, Leptospira interrogans serovar lai str. 56601
uacugcaucaaccaagaa

SEQ ID NO: 2798924 - RNA, 21 nt, Leptospira interrogans serovar lai str. 56601
uacugcauuuuauuaaaaaua

SEQ ID NO: 2798925 - RNA, 17 nt, Leptospira interrogans serovar lai str. 56601
uacuguaaaauuuaaau

SEQ ID NO: 2798926 - RNA, 17 nt, Leptospira interrogans serovar lai str. 56601
uacuguuuuugaaacau

SEQ ID NO: 2798927 - RNA, 17 nt, Leptospira interrogans serovar lai str. 56601
uacuuaaacguauaaaa

SEQ ID NO: 2798928 - RNA, 17 nt, Leptospira interrogans serovar lai str. 56601
uagaauaaauuauacaa

SEQ ID NO: 2798929 - RNA, 14 nt, Leptospira interrogans serovar lai str. 56601
uagaauaaucggaa

SEQ ID NO: 2798930 - RNA, 20 nt, Leptospira interrogans serovar lai str. 56601
uagaauagagucuuuaaaaa

SEQ ID NO: 2798931 - RNA, 20 nt, Leptospira interrogans serovar lai str. 56601
uagaauaggaucguuucauu

SEQ ID NO: 2798932 - RNA, 22 nt, Leptospira interrogans serovar lai str. 56601
uagaauauacaacuuuuuuaau

SEQ ID NO: 2798933 - RNA, 17 nt, Leptospira interrogans serovar lai str. 56601
uagaauauuaugaaaua

SEQ ID NO: 2798934 - RNA, 17 nt, Leptospira interrogans serovar lai str. 56601
uagaaucaacuuuucca

SEQ ID NO: 2798935 - RNA, 17 nt, Leptospira interrogans serovar lai str. 56601
uagaaucaucucaaaaa

SEQ ID NO: 2798936 - RNA, 16 nt, Leptospira interrogans serovar lai str. 56601
uagaaucgaaaaguuu

SEQ ID NO: 2798937 - RNA, 15 nt, Leptospira interrogans serovar lai str. 56601
uagaaucuaaacuuu

SEQ ID NO: 2798938 - RNA, 16 nt, Leptospira interrogans serovar lai str. 56601
uagaaucuaaacuuua

SEQ ID NO: 2798939 - RNA, 17 nt, Leptospira interrogans serovar lai str. 56601
uagaaucuaaacuuuac

SEQ ID NO: 2798940 - RNA, 21 nt, Leptospira interrogans serovar lai str. 56601
uagaaucuaaacuuuacagau

SEQ ID NO: 2798941 - RNA, 19 nt, Leptospira interrogans serovar lai str. 56601
uagaaucuagacguaauuu

SEQ ID NO: 2798942 - RNA, 14 nt, Leptospira interrogans serovar lai str. 56601
uagaaucugaacuu

SEQ ID NO: 2798943 - RNA, 21 nt, Leptospira interrogans serovar lai str. 56601
uagaaucuucgggcuuauuuu

SEQ ID NO: 2798944 - RNA, 14 nt, Leptospira interrogans serovar lai str. 56601
uagaauguaaaagc

SEQ ID NO: 2798945 - RNA, 22 nt, Leptospira interrogans serovar lai str. 56601
uagaauguaaaugaauuggaaa

SEQ ID NO: 2798946 - RNA, 19 nt, Leptospira interrogans serovar lai str. 56601
uagaauucuccacaaaacc

SEQ ID NO: 2798947 - RNA, 22 nt, Leptospira interrogans serovar lai str. 56601
uagaauuguguuaguucccaca

SEQ ID NO: 2798948 - RNA, 21 nt, Leptospira interrogans serovar lai str. 56601
uagaauuguugaaaaauuaau

SEQ ID NO: 2798949 - RNA, 21 nt, Leptospira interrogans serovar lai str. 56601
uagaauuguugaaaaauuuau

SEQ ID NO: 2798950 - RNA, 18 nt, Leptospira interrogans serovar lai str. 56601
uagaauuuauuuguaaaa

SEQ ID NO: 2798951 - RNA, 14 nt, Leptospira interrogans serovar lai str. 56601
uagaauuuggcuuu

SEQ ID NO: 2798952 - RNA, 16 nt, Leptospira interrogans serovar lai str. 56601
uagaauuuguucuuaa

SEQ ID NO: 2798953 - RNA, 18 nt, Leptospira interrogans serovar lai str. 56601
uagaauuuguuuguaaaa

SEQ ID NO: 2798954 - RNA, 18 nt, Leptospira interrogans serovar lai str. 56601
uagaauuuguuuuuaaaa

SEQ ID NO: 2798955 - RNA, 16 nt, Leptospira interrogans serovar lai str. 56601
uagaauuuuaugauuu

SEQ ID NO: 2798956 - RNA, 20 nt, Leptospira interrogans serovar lai str. 56601
uagaauuuuaugauuuucuu

SEQ ID NO: 2798957 - RNA, 24 nt, Leptospira interrogans serovar lai str. 56601
uagaauuuucuaaagauucuugau

SEQ ID NO: 2798958 - RNA, 19 nt, Leptospira interrogans serovar lai str. 56601
uagaauuuuguuucuaaaa

SEQ ID NO: 2798959 - RNA, 23 nt, Leptospira interrogans serovar lai str. 56601
uagaauuuuuguagaauugaaag

SEQ ID NO: 2798960 - RNA, 13 nt, Leptospira interrogans serovar lai str. 56601
uagacaaaaaauu

SEQ ID NO: 2798961 - RNA, 12 nt, Leptospira interrogans serovar lai str. 56601
uagacaacuaaa

SEQ ID NO: 2798962 - RNA, 13 nt, Leptospira interrogans serovar lai str. 56601
uagacauuguuuu

SEQ ID NO: 2798963 - RNA, 14 nt, Leptospira interrogans serovar lai str. 56601
uagacauuguuuua

SEQ ID NO: 2798964 - RNA, 21 nt, Leptospira interrogans serovar lai str. 56601
uagaccaauuuuuuuguaaaa

SEQ ID NO: 2798965 - RNA, 21 nt, Leptospira interrogans serovar lai str. 56601
uagaccaggccaccgcaagaa

SEQ ID NO: 2798966 - RNA, 18 nt, Leptospira interrogans serovar lai str. 56601
uagacuaacgauuguaaa

SEQ ID NO: 2798967 - RNA, 19 nt, Leptospira interrogans serovar lai str. 56601
uagacuaacgauuguaaaa

SEQ ID NO: 2798968 - RNA, 19 nt, Leptospira interrogans serovar lai str. 56601
uagacuucucuuuucgaaa

SEQ ID NO: 2798969 - RNA, 14 nt, Leptospira interrogans serovar lai str. 56601
uagacuuucuuuga

SEQ ID NO: 2798970 - RNA, 14 nt, Leptospira interrogans serovar lai str. 56601
uagagaaaagcauu

SEQ ID NO: 2798971 - RNA, 15 nt, Leptospira interrogans serovar lai str. 56601
uagagaaguuaaaaa

SEQ ID NO: 2798972 - RNA, 21 nt, Leptospira interrogans serovar lai str. 56601
uagagaaugaucaauagaauu

SEQ ID NO: 2798973 - RNA, 19 nt, Leptospira interrogans serovar lai str. 56601
uagagaauuaauuuuucaa

SEQ ID NO: 2798974 - RNA, 13 nt, Leptospira interrogans serovar lai str. 56601
uagagaauuugug

SEQ ID NO: 2798975 - RNA, 20 nt, Leptospira interrogans serovar lai str. 56601
uagagaauuuucuuauugaa

SEQ ID NO: 2798976 - RNA, 20 nt, Leptospira interrogans serovar lai str. 56601
uagagacgaauuuuuuagaa

SEQ ID NO: 2798977 - RNA, 14 nt, Leptospira interrogans serovar lai str. 56601
uagagagugaaaaa

SEQ ID NO: 2798978 - RNA, 18 nt, Leptospira interrogans serovar lai str. 56601
uagagauugauauucaaa

SEQ ID NO: 2798979 - RNA, 14 nt, Leptospira interrogans serovar lai str. 56601
uagagccaaauuuu

SEQ ID NO: 2798980 - RNA, 21 nt, Leptospira interrogans serovar lai str. 56601
uagaggagccaugccaaacac

SEQ ID NO: 2798981 - RNA, 18 nt, Leptospira interrogans serovar lai str. 56601
uagaguaaauuuugaaaa

SEQ ID NO: 2798982 - RNA, 21 nt, Leptospira interrogans serovar lai str. 56601
uagagucguugaaaauucuau

SEQ ID NO: 2798983 - RNA, 16 nt, Leptospira interrogans serovar lai str. 56601
uagagugaauuuguaa

SEQ ID NO: 2798984 - RNA, 17 nt, Leptospira interrogans serovar lai str. 56601
uagagugccaaaauuuu

SEQ ID NO: 2798985 - RNA, 13 nt, Leptospira interrogans serovar lai str. 56601
uagaguguugacu

SEQ ID NO: 2798986 - RNA, 23 nt, Leptospira interrogans serovar lai str. 56601
uagaguguugacucuuuugagaa

SEQ ID NO: 2798987 - RNA, 21 nt, Leptospira interrogans serovar lai str. 56601
uagaguguuguuuagaacaga

SEQ ID NO: 2798988 - RNA, 22 nt, Leptospira interrogans serovar lai str. 56601
uagaguuauugaaaaauuucau

SEQ ID NO: 2798989 - RNA, 21 nt, Leptospira interrogans serovar lai str. 56601
uagaguucugaaaucuuagga

SEQ ID NO: 2798990 - RNA, 17 nt, Leptospira interrogans serovar lai str. 56601
uagaguuucuaaaaaaa

SEQ ID NO: 2798991 - RNA, 12 nt, Leptospira interrogans serovar lai str. 56601
uagaguuucuuu

SEQ ID NO: 2798992 - RNA, 18 nt, Leptospira interrogans serovar lai str. 56601
uagaguuugaguuucuuu

SEQ ID NO: 2798993 - RNA, 15 nt, Leptospira interrogans serovar lai str. 56601
uagaguuuguuccaa

SEQ ID NO: 2798994 - RNA, 17 nt, Leptospira interrogans serovar lai str. 56601
uagaguuuuugaaaaau

SEQ ID NO: 2798995 - RNA, 12 nt, Leptospira interrogans serovar lai str. 56601
uagauaaauaca

SEQ ID NO: 2798996 - RNA, 15 nt, Leptospira interrogans serovar lai str. 56601
uagauaaauacaucu

SEQ ID NO: 2798997 - RNA, 18 nt, Leptospira interrogans serovar lai str. 56601
uagauaagagacaaauau

SEQ ID NO: 2798998 - RNA, 20 nt, Leptospira interrogans serovar lai str. 56601
uagauaaggcuaaagaauac

SEQ ID NO: 2798999 - RNA, 21 nt, Leptospira interrogans serovar lai str. 56601
uagauaauuaaacaaagaaua

SEQ ID NO: 2799000 - RNA, 22 nt, Leptospira interrogans serovar lai str. 56601
uagauaauuuuuacucaaagaa

SEQ ID NO: 2799001 - RNA, 16 nt, Leptospira interrogans serovar lai str. 56601
uagauagagaauuaau

SEQ ID NO: 2799002 - RNA, 17 nt, Leptospira interrogans serovar lai str. 56601
uagauagguucuuagaa

SEQ ID NO: 2799003 - RNA, 20 nt, Leptospira interrogans serovar lai str. 56601
uagauagguucuuagaacuu

SEQ ID NO: 2799004 - RNA, 14 nt, Leptospira interrogans serovar lai str. 56601
uagauauuucaaga

SEQ ID NO: 2799005 - RNA, 17 nt, Leptospira interrogans serovar lai str. 56601
uagauccuagcuauuuu

SEQ ID NO: 2799006 - RNA, 17 nt, Leptospira interrogans serovar lai str. 56601
uagaucuaaauuuucuu

SEQ ID NO: 2799007 - RNA, 22 nt, Leptospira interrogans serovar lai str. 56601
uagaucuaagggaugguuguua

SEQ ID NO: 2799008 - RNA, 19 nt, Leptospira interrogans serovar lai str. 56601
uagaucugauauuuuaaau

SEQ ID NO: 2799009 - RNA, 21 nt, Leptospira interrogans serovar lai str. 56601
uagaucuuuuauaauguuuga

SEQ ID NO: 2799010 - RNA, 14 nt, Leptospira interrogans serovar lai str. 56601
uagucauauaaaag

SEQ ID NO: 2799011 - RNA, 15 nt, Leptospira interrogans serovar lai str. 56601
uagucauauaaaagu

SEQ ID NO: 2799012 - RNA, 14 nt, Leptospira interrogans serovar lai str. 56601
uagucauuuccucc

SEQ ID NO: 2799013 - RNA, 19 nt, Leptospira interrogans serovar lai str. 56601
uagucauuuccuccaaaca

SEQ ID NO: 2799014 - RNA, 14 nt, Leptospira interrogans serovar lai str. 56601
uagucucauacuua

SEQ ID NO: 2799015 - RNA, 18 nt, Leptospira interrogans serovar lai str. 56601
uagugaagauuuguaaaa

SEQ ID NO: 2799016 - RNA, 21 nt, Leptospira interrogans serovar lai str. 56601
uagugaagauuuguaaaauug

SEQ ID NO: 2799017 - RNA, 13 nt, Leptospira interrogans serovar lai str. 56601
uaguuacaauuua

SEQ ID NO: 2799018 - RNA, 15 nt, Leptospira interrogans serovar lai str. 56601
uaguuacuuauuuuu

SEQ ID NO: 2799019 - RNA, 19 nt, Leptospira interrogans serovar lai str. 56601
uaguuagcugaaauuaauu

SEQ ID NO: 2799020 - RNA, 13 nt, Leptospira interrogans serovar lai str. 56601
uaguuauaacguu

SEQ ID NO: 2799021 - RNA, 19 nt, Leptospira interrogans serovar lai str. 56601
uaguuauaacguuauaaaa

SEQ ID NO: 2799022 - RNA, 21 nt, Leptospira interrogans serovar lai str. 56601
uaguuaugaauaaaaaauuuc

SEQ ID NO: 2799023 - RNA, 16 nt, Leptospira interrogans serovar lai str. 56601
uaguuauguuuuaaaa

SEQ ID NO: 2799024 - RNA, 18 nt, Leptospira interrogans serovar lai str. 56601
uaguuauguuuuaaaaca

SEQ ID NO: 2799025 - RNA, 13 nt, Leptospira interrogans serovar lai str. 56601
uaguucaaaaaca

SEQ ID NO: 2799026 - RNA, 12 nt, Leptospira interrogans serovar lai str. 56601
uaguucaauuaa

SEQ ID NO: 2799027 - RNA, 11 nt, Leptospira interrogans serovar lai str. 56601
uaguucccaca

SEQ ID NO: 2799028 - RNA, 12 nt, Leptospira interrogans serovar lai str. 56601
uaguucccacaa

SEQ ID NO: 2799029 - RNA, 14 nt, Leptospira interrogans serovar lai str. 56601
uaguucccacaagu

SEQ ID NO: 2799030 - RNA, 21 nt, Leptospira interrogans serovar lai str. 56601
uaguucccacauuucaaaguu

SEQ ID NO: 2799031 - RNA, 15 nt, Leptospira interrogans serovar lai str. 56601
uaguucccacauuuu

SEQ ID NO: 2799032 - RNA, 21 nt, Leptospira interrogans serovar lai str. 56601
uaguucccacauuuugugaaa

SEQ ID NO: 2799033 - RNA, 21 nt, Leptospira interrogans serovar lai str. 56601
uaguucccaccuuuuuuuaug

SEQ ID NO: 2799034 - RNA, 18 nt, Leptospira interrogans serovar lai str. 56601
uaguuccuacaaauuaag

SEQ ID NO: 2799035 - RNA, 23 nt, Leptospira interrogans serovar lai str. 56601
uaguuccuacaaauuaaguccca

SEQ ID NO: 2799036 - RNA, 16 nt, Leptospira interrogans serovar lai str. 56601
uaguuccuacauuuuu

SEQ ID NO: 2799037 - RNA, 15 nt, Leptospira interrogans serovar lai str. 56601
uaguuccuauauuuu

SEQ ID NO: 2799038 - RNA, 14 nt, Leptospira interrogans serovar lai str. 56601
uaguucuauuuuau

SEQ ID NO: 2799039 - RNA, 14 nt, Leptospira interrogans serovar lai str. 56601
uaguucuucgucua

SEQ ID NO: 2799040 - RNA, 14 nt, Leptospira interrogans serovar lai str. 56601
uaguuguacaaaaa

SEQ ID NO: 2799041 - RNA, 16 nt, Leptospira interrogans serovar lai str. 56601
uaguuuacguuuuaau

SEQ ID NO: 2799042 - RNA, 18 nt, Leptospira interrogans serovar lai str. 56601
uaguuuauuuuucuuuua

SEQ ID NO: 2799043 - RNA, 16 nt, Leptospira interrogans serovar lai str. 56601
uaguuucaauuuaaaa

SEQ ID NO: 2799044 - RNA, 16 nt, Leptospira interrogans serovar lai str. 56601
uaguuuccaaaaaaga

SEQ ID NO: 2799045 - RNA, 20 nt, Leptospira interrogans serovar lai str. 56601
uaguuucuaaguguaaaauu

SEQ ID NO: 2799046 - RNA, 14 nt, Leptospira interrogans serovar lai str. 56601
uaguuuuauguggg

SEQ ID NO: 2799047 - RNA, 22 nt, Leptospira interrogans serovar lai str. 56601
uaguuuucauuacaaaacacug

SEQ ID NO: 2799048 - RNA, 17 nt, Leptospira interrogans serovar lai str. 56601
uaguuuuccuucuagau

SEQ ID NO: 2799049 - RNA, 21 nt, Leptospira interrogans serovar lai str. 56601
uaguuuucucgaacuacccaa

SEQ ID NO: 2799050 - RNA, 20 nt, Leptospira interrogans serovar lai str. 56601
uaguuuugagauuacaaaaa

SEQ ID NO: 2799051 - RNA, 19 nt, Leptospira interrogans serovar lai str. 56601
uaguuuugagcauaaaaaa

SEQ ID NO: 2799052 - RNA, 16 nt, Leptospira interrogans serovar lai str. 56601
uaguuuugauguuuuu

SEQ ID NO: 2799053 - RNA, 22 nt, Leptospira interrogans serovar lai str. 56601
uaguuuuguaccguaaagaaga

SEQ ID NO: 2799054 - RNA, 15 nt, Leptospira interrogans serovar lai str. 56601
uaguuuuuauuugau

SEQ ID NO: 2799055 - RNA, 12 nt, Leptospira interrogans serovar lai str. 56601
uaguuuuuccug

SEQ ID NO: 2799056 - RNA, 16 nt, Leptospira interrogans serovar lai str. 56601
uaguuuuuucaaaaau

SEQ ID NO: 2799057 - RNA, 20 nt, Leptospira interrogans serovar lai str. 56601
uaguuuuuucaaaaauucca

SEQ ID NO: 2799058 - RNA, 21 nt, Leptospira interrogans serovar lai str. 56601
uauaaaaaauaauauuauaaa

SEQ ID NO: 2799059 - RNA, 23 nt, Leptospira interrogans serovar lai str. 56601
uauaaaaaauaauauuauaaaua

SEQ ID NO: 2799060 - RNA, 22 nt, Leptospira interrogans serovar lai str. 56601
uauaaaaaccacaaaaacaaau

SEQ ID NO: 2799061 - RNA, 23 nt, Leptospira interrogans serovar lai str. 56601
uauaaaaacgguauuuaaaauua

SEQ ID NO: 2799062 - RNA, 16 nt, Leptospira interrogans serovar lai str. 56601
uauaaaaacuugauau

SEQ ID NO: 2799063 - RNA, 20 nt, Leptospira interrogans serovar lai str. 56601
uauaaaaagcuguuguuaua

SEQ ID NO: 2799064 - RNA, 23 nt, Leptospira interrogans serovar lai str. 56601
uauaaaaauaauacaauucugaa

SEQ ID NO: 2799065 - RNA, 21 nt, Leptospira interrogans serovar lai str. 56601
uauaaaacaaucuucaaauuc

SEQ ID NO: 2799066 - RNA, 21 nt, Leptospira interrogans serovar lai str. 56601
uauaaaaccuuuauuuaauaa

SEQ ID NO: 2799067 - RNA, 23 nt, Leptospira interrogans serovar lai str. 56601
uauaaaagaaucauuaaucagau

SEQ ID NO: 2799068 - RNA, 13 nt, Leptospira interrogans serovar lai str. 56601
uauaaaaguauaa

SEQ ID NO: 2799069 - RNA, 20 nt, Leptospira interrogans serovar lai str. 56601
uauaaaauaccaauaacuua

SEQ ID NO: 2799070 - RNA, 20 nt, Leptospira interrogans serovar lai str. 56601
uauaaaauaucuuuaauuga

SEQ ID NO: 2799071 - RNA, 19 nt, Leptospira interrogans serovar lai str. 56601
uauaaaaucuaaaaaaaca

SEQ ID NO: 2799072 - RNA, 16 nt, Leptospira interrogans serovar lai str. 56601
uauaaaaucuaaaaau

SEQ ID NO: 2799073 - RNA, 17 nt, Leptospira interrogans serovar lai str. 56601
uauaaaaucuuaaauua

SEQ ID NO: 2799074 - RNA, 17 nt, Leptospira interrogans serovar lai str. 56601
uauaaaauguauuaaag

SEQ ID NO: 2799075 - RNA, 21 nt, Leptospira interrogans serovar lai str. 56601
uauaaaauuaagcauuauaag

SEQ ID NO: 2799076 - RNA, 15 nt, Leptospira interrogans serovar lai str. 56601
uauaaaauuagauuu

SEQ ID NO: 2799077 - RNA, 22 nt, Leptospira interrogans serovar lai str. 56601
uauaaaauuugaaaguaaaaaa

SEQ ID NO: 2799078 - RNA, 16 nt, Leptospira interrogans serovar lai str. 56601
uauaaaauuuuucucc

SEQ ID NO: 2799079 - RNA, 20 nt, Leptospira interrogans serovar lai str. 56601
uauaaacagucgcuaaacuc

SEQ ID NO: 2799080 - RNA, 14 nt, Leptospira interrogans serovar lai str. 56601
uauaaacauauuau

SEQ ID NO: 2799081 - RNA, 16 nt, Leptospira interrogans serovar lai str. 56601
uauaaacauauuauuu

SEQ ID NO: 2799082 - RNA, 15 nt, Leptospira interrogans serovar lai str. 56601
uauaaaccaucucaa

SEQ ID NO: 2799083 - RNA, 18 nt, Leptospira interrogans serovar lai str. 56601
uauaaaccaucucaaaaa

SEQ ID NO: 2799084 - RNA, 20 nt, Leptospira interrogans serovar lai str. 56601
uauaaaccaucucaaaaaca

SEQ ID NO: 2799085 - RNA, 19 nt, Leptospira interrogans serovar lai str. 56601
uauaaacugucggaauuac

SEQ ID NO: 2799086 - RNA, 19 nt, Leptospira interrogans serovar lai str. 56601
uauaaacuuuuuugaauau

SEQ ID NO: 2799087 - RNA, 13 nt, Leptospira interrogans serovar lai str. 56601
uauaaagauuucc

SEQ ID NO: 2799088 - RNA, 23 nt, Leptospira interrogans serovar lai str. 56601
uauaaagauuuccuaauaacuug

SEQ ID NO: 2799089 - RNA, 15 nt, Leptospira interrogans serovar lai str. 56601
uauaaaguugaaugu

SEQ ID NO: 2799090 - RNA, 17 nt, Leptospira interrogans serovar lai str. 56601
uauaaauaaauuuaaau

SEQ ID NO: 2799091 - RNA, 22 nt, Leptospira interrogans serovar lai str. 56601
uauaaauauggauuuuuccaac

SEQ ID NO: 2799092 - RNA, 15 nt, Leptospira interrogans serovar lai str. 56601
uauaaauauuaauuu

SEQ ID NO: 2799093 - RNA, 21 nt, Leptospira interrogans serovar lai str. 56601
uauacuuuaaaaaauaucuua

SEQ ID NO: 2799094 - RNA, 19 nt, Leptospira interrogans serovar lai str. 56601
uauacuuucaaaaaauaua

SEQ ID NO: 2799095 - RNA, 14 nt, Leptospira interrogans serovar lai str. 56601
uauacuuuuuugau

SEQ ID NO: 2799096 - RNA, 20 nt, Leptospira interrogans serovar lai str. 56601
uauagaaauacuuaaaauga

SEQ ID NO: 2799097 - RNA, 16 nt, Leptospira interrogans serovar lai str. 56601
uauagaaccaucucaa

SEQ ID NO: 2799098 - RNA, 21 nt, Leptospira interrogans serovar lai str. 56601
uauagaaccaucucaaaaaua

SEQ ID NO: 2799099 - RNA, 21 nt, Leptospira interrogans serovar lai str. 56601
uauagaaguucggaagauuuu

SEQ ID NO: 2799100 - RNA, 20 nt, Leptospira interrogans serovar lai str. 56601
uauagacaacguuacuuuua

SEQ ID NO: 2799101 - RNA, 13 nt, Leptospira interrogans serovar lai str. 56601
uauagagaaaucc

SEQ ID NO: 2799102 - RNA, 18 nt, Leptospira interrogans serovar lai str. 56601
uauagagagcguuuuguu

SEQ ID NO: 2799103 - RNA, 22 nt, Leptospira interrogans serovar lai str. 56601
uauagaggucgucucaaaaaua

SEQ ID NO: 2799104 - RNA, 18 nt, Leptospira interrogans serovar lai str. 56601
uauagauaauuuuuacuc

SEQ ID NO: 2799105 - RNA, 17 nt, Leptospira interrogans serovar lai str. 56601
uauagaucgauucuuua

SEQ ID NO: 2799106 - RNA, 20 nt, Leptospira interrogans serovar lai str. 56601
uauagccaaguauaaaagug

SEQ ID NO: 2799107 - RNA, 13 nt, Leptospira interrogans serovar lai str. 56601
uauagcuguuuua

SEQ ID NO: 2799108 - RNA, 22 nt, Leptospira interrogans serovar lai str. 56601
uauagguuucuucgccuauuuu

SEQ ID NO: 2799109 - RNA, 16 nt, Leptospira interrogans serovar lai str. 56601
uauaguaaaagaaaau

SEQ ID NO: 2799110 - RNA, 20 nt, Leptospira interrogans serovar lai str. 56601
uauaguaaugaguaacgaaa

SEQ ID NO: 2799111 - RNA, 16 nt, Leptospira interrogans serovar lai str. 56601
uauaguagauauuagu

SEQ ID NO: 2799112 - RNA, 20 nt, Leptospira interrogans serovar lai str. 56601
uauaguagauauuaguaaaa

SEQ ID NO: 2799113 - RNA, 15 nt, Leptospira interrogans serovar lai str. 56601
uauauaaaaaaugua

SEQ ID NO: 2799114 - RNA, 13 nt, Leptospira interrogans serovar lai str. 56601
uauauaaaauuug

SEQ ID NO: 2799115 - RNA, 16 nt, Leptospira interrogans serovar lai str. 56601
uauauaaagaaaaaca

SEQ ID NO: 2799116 - RNA, 22 nt, Leptospira interrogans serovar lai str. 56601
uauauaaauucgccguaaaaaa

SEQ ID NO: 2799117 - RNA, 22 nt, Leptospira interrogans serovar lai str. 56601
uauauaaccaugaauaaacaau

SEQ ID NO: 2799118 - RNA, 14 nt, Leptospira interrogans serovar lai str. 56601
uauauaaguauuau

SEQ ID NO: 2799119 - RNA, 18 nt, Leptospira interrogans serovar lai str. 56601
uauauagcucuugaauaa

SEQ ID NO: 2799120 - RNA, 20 nt, Leptospira interrogans serovar lai str. 56601
uauauagcucuugaauaaag

SEQ ID NO: 2799121 - RNA, 20 nt, Leptospira interrogans serovar lai str. 56601
uauauaguuaugaauaaaaa

SEQ ID NO: 2799122 - RNA, 21 nt, Leptospira interrogans serovar lai str. 56601
uauauaguuaugaauaaaaaa

SEQ ID NO: 2799123 - RNA, 22 nt, Leptospira interrogans serovar lai str. 56601
uauauaguuuugagcauaaaaa

SEQ ID NO: 2799124 - RNA, 17 nt, Leptospira interrogans serovar lai str. 56601
uauauauccuuaugaaa

SEQ ID NO: 2799125 - RNA, 19 nt, Leptospira interrogans serovar lai str. 56601
uauauauucacaaaaaaau

SEQ ID NO: 2799126 - RNA, 13 nt, Leptospira interrogans serovar lai str. 56601
uauauauugaaau

SEQ ID NO: 2799127 - RNA, 18 nt, Leptospira interrogans serovar lai str. 56601
uauauauugaaauauuau

SEQ ID NO: 2799128 - RNA, 13 nt, Leptospira interrogans serovar lai str. 56601
uauauauuuuuaa

SEQ ID NO: 2799129 - RNA, 16 nt, Leptospira interrogans serovar lai str. 56601
uauaucgaauacauuu

SEQ ID NO: 2799130 - RNA, 17 nt, Leptospira interrogans serovar lai str. 56601
uauaucucguauugaau

SEQ ID NO: 2799131 - RNA, 18 nt, Leptospira interrogans serovar lai str. 56601
uauaucucguauugaauu

SEQ ID NO: 2799132 - RNA, 18 nt, Leptospira interrogans serovar lai str. 56601
uauaucuuaauuaaaaaa

SEQ ID NO: 2799133 - RNA, 14 nt, Leptospira interrogans serovar lai str. 56601
uauaucuucuuugg

SEQ ID NO: 2799134 - RNA, 14 nt, Leptospira interrogans serovar lai str. 56601
uauaucuuuggauu

SEQ ID NO: 2799135 - RNA, 14 nt, Leptospira interrogans serovar lai str. 56601
uauauguaaaugau

SEQ ID NO: 2799136 - RNA, 15 nt, Leptospira interrogans serovar lai str. 56601
uauauuaauauucua

SEQ ID NO: 2799137 - RNA, 21 nt, Leptospira interrogans serovar lai str. 56601
uauauuaaucuuuuuuaauaa

SEQ ID NO: 2799138 - RNA, 13 nt, Leptospira interrogans serovar lai str. 56601
uauauuagaauau

SEQ ID NO: 2799139 - RNA, 22 nt, Leptospira interrogans serovar lai str. 56601
uauauuagaauuguugaaaaac

SEQ ID NO: 2799140 - RNA, 20 nt, Leptospira interrogans serovar lai str. 56601
uauauuagaguuucuaaaaa

SEQ ID NO: 2799141 - RNA, 21 nt, Leptospira interrogans serovar lai str. 56601
uauauuagaguuucuaaaaaa

SEQ ID NO: 2799142 - RNA, 18 nt, Leptospira interrogans serovar lai str. 56601
uauauuagaguuuuugaa

SEQ ID NO: 2799143 - RNA, 22 nt, Leptospira interrogans serovar lai str. 56601
uauauuagaguuuuugaaaaau

SEQ ID NO: 2799144 - RNA, 12 nt, Leptospira interrogans serovar lai str. 56601
uauauuauaaaa

SEQ ID NO: 2799145 - RNA, 11 nt, Leptospira interrogans serovar lai str. 56601
uauauuauaau

SEQ ID NO: 2799146 - RNA, 18 nt, Leptospira interrogans serovar lai str. 56601
uauauuauaauuuuaaau

SEQ ID NO: 2799147 - RNA, 16 nt, Leptospira interrogans serovar lai str. 56601
uauauucaauuucuuu

SEQ ID NO: 2799148 - RNA, 17 nt, Leptospira interrogans serovar lai str. 56601
uauauucaauuucuuua

SEQ ID NO: 2799149 - RNA, 20 nt, Leptospira interrogans serovar lai str. 56601
uauauucacaaaaaaauuca

SEQ ID NO: 2799150 - RNA, 20 nt, Leptospira interrogans serovar lai str. 56601
uauauucgcuccguuuugaa

SEQ ID NO: 2799151 - RNA, 12 nt, Leptospira interrogans serovar lai str. 56601
uauauucuuaua

SEQ ID NO: 2799152 - RNA, 17 nt, Leptospira interrogans serovar lai str. 56601
uauauucuuauauaucu

SEQ ID NO: 2799153 - RNA, 21 nt, Leptospira interrogans serovar lai str. 56601
uauauucuuuucugaauaaaa

SEQ ID NO: 2799154 - RNA, 23 nt, Leptospira interrogans serovar lai str. 56601
uauauucuuuucugaauaaaaau

SEQ ID NO: 2799155 - RNA, 15 nt, Leptospira interrogans serovar lai str. 56601
uauauugaaauauua

SEQ ID NO: 2799156 - RNA, 19 nt, Leptospira interrogans serovar lai str. 56601
uauauugagaucaaauacu

SEQ ID NO: 2799157 - RNA, 17 nt, Leptospira interrogans serovar lai str. 56601
uauauugguuauaccaa

SEQ ID NO: 2799158 - RNA, 22 nt, Leptospira interrogans serovar lai str. 56601
uauauugucuugaauuacaauu

SEQ ID NO: 2799159 - RNA, 15 nt, Leptospira interrogans serovar lai str. 56601
uauauuuaaauguua

SEQ ID NO: 2799160 - RNA, 14 nt, Leptospira interrogans serovar lai str. 56601
uauauuucauugaa

SEQ ID NO: 2799161 - RNA, 16 nt, Leptospira interrogans serovar lai str. 56601
uauauuucauugaaau

SEQ ID NO: 2799162 - RNA, 11 nt, Leptospira interrogans serovar lai str. 56601
uauauuuuaau

SEQ ID NO: 2799163 - RNA, 15 nt, Leptospira interrogans serovar lai str. 56601
uauauuuuuaaaaag

SEQ ID NO: 2799164 - RNA, 17 nt, Leptospira interrogans serovar lai str. 56601
uauauuuuuaaaaagua

SEQ ID NO: 2799165 - RNA, 14 nt, Leptospira interrogans serovar lai str. 56601
uauauuuuuaaagc

SEQ ID NO: 2799166 - RNA, 12 nt, Leptospira interrogans serovar lai str. 56601
uauauuuuuaau

SEQ ID NO: 2799167 - RNA, 15 nt, Leptospira interrogans serovar lai str. 56601
uaucaaaauuuaaau

SEQ ID NO: 2799168 - RNA, 16 nt, Leptospira interrogans serovar lai str. 56601
uaucaaaccuuucuuu

SEQ ID NO: 2799169 - RNA, 19 nt, Leptospira interrogans serovar lai str. 56601
uaucaaaccuuucuuucug

SEQ ID NO: 2799170 - RNA, 22 nt, Leptospira interrogans serovar lai str. 56601
uaucaaacgaaguuuauuucua

SEQ ID NO: 2799171 - RNA, 15 nt, Leptospira interrogans serovar lai str. 56601
uaucaaaugugagag

SEQ ID NO: 2799172 - RNA, 22 nt, Leptospira interrogans serovar lai str. 56601
uaucaacaagaaugaaaaaacu

SEQ ID NO: 2799173 - RNA, 24 nt, Leptospira interrogans serovar lai str. 56601
uaucaacaaucggagucauaacuu

SEQ ID NO: 2799174 - RNA, 14 nt, Leptospira interrogans serovar lai str. 56601
uaucaacuuuugga

SEQ ID NO: 2799175 - RNA, 12 nt, Leptospira interrogans serovar lai str. 56601
uaucaauagaaa

SEQ ID NO: 2799176 - RNA, 20 nt, Leptospira interrogans serovar lai str. 56601
uaugaagacgcuuaaaaaug

SEQ ID NO: 2799177 - RNA, 11 nt, Leptospira interrogans serovar lai str. 56601
uaugaauaaaa

SEQ ID NO: 2799178 - RNA, 15 nt, Leptospira interrogans serovar lai str. 56601
uaugaauaaaaaauu

SEQ ID NO: 2799179 - RNA, 20 nt, Leptospira interrogans serovar lai str. 56601
uaugaaucagccauuaaauu

SEQ ID NO: 2799180 - RNA, 21 nt, Leptospira interrogans serovar lai str. 56601
uaugaauuuuuaauagacuaa

SEQ ID NO: 2799181 - RNA, 15 nt, Leptospira interrogans serovar lai str. 56601
uaugacccaagauuc

SEQ ID NO: 2799182 - RNA, 17 nt, Leptospira interrogans serovar lai str. 56601
uaugacuuaaucugugg

SEQ ID NO: 2799183 - RNA, 12 nt, Leptospira interrogans serovar lai str. 56601
uaugaguucauu

SEQ ID NO: 2799184 - RNA, 14 nt, Leptospira interrogans serovar lai str. 56601
uaugaguucccaca

SEQ ID NO: 2799185 - RNA, 17 nt, Leptospira interrogans serovar lai str. 56601
uaugaguucccacaaau

SEQ ID NO: 2799186 - RNA, 21 nt, Leptospira interrogans serovar lai str. 56601
uaugaguucccacauuuuuaa

SEQ ID NO: 2799187 - RNA, 21 nt, Leptospira interrogans serovar lai str. 56601
uaugaguuccuaacuuugaaa

SEQ ID NO: 2799188 - RNA, 22 nt, Leptospira interrogans serovar lai str. 56601
uaugaguuucuccacuuaaaaa

SEQ ID NO: 2799189 - RNA, 18 nt, Leptospira interrogans serovar lai str. 56601
uaugauaaguaauuugug

SEQ ID NO: 2799190 - RNA, 14 nt, Leptospira interrogans serovar lai str. 56601
uaugauucugaaaa

SEQ ID NO: 2799191 - RNA, 19 nt, Leptospira interrogans serovar lai str. 56601
uaugauuuucuuuuccguu

SEQ ID NO: 2799192 - RNA, 15 nt, Leptospira interrogans serovar lai str. 56601
uaugauuuuuuugaa

SEQ ID NO: 2799193 - RNA, 19 nt, Leptospira interrogans serovar lai str. 56601
uaugcaaauacaacuuuuu

SEQ ID NO: 2799194 - RNA, 14 nt, Leptospira interrogans serovar lai str. 56601
uauggaauauaaaa

SEQ ID NO: 2799195 - RNA, 18 nt, Leptospira interrogans serovar lai str. 56601
uauggcaggaucaaaauc

SEQ ID NO: 2799196 - RNA, 18 nt, Leptospira interrogans serovar lai str. 56601
uauggcucugaguagaaa

SEQ ID NO: 2799197 - RNA, 23 nt, Leptospira interrogans serovar lai str. 56601
uaugggaauuuuuguaaaaucca

SEQ ID NO: 2799198 - RNA, 13 nt, Leptospira interrogans serovar lai str. 56601
uaugguaaaaaua

SEQ ID NO: 2799199 - RNA, 14 nt, Leptospira interrogans serovar lai str. 56601
uaugguaaggagcu

SEQ ID NO: 2799200 - RNA, 16 nt, Leptospira interrogans serovar lai str. 56601
uaugguccaaucagau

SEQ ID NO: 2799201 - RNA, 23 nt, Leptospira interrogans serovar lai str. 56601
uauguaacaaucuuauuuaguuu

SEQ ID NO: 2799202 - RNA, 15 nt, Leptospira interrogans serovar lai str. 56601
uauguaauauuucuu

SEQ ID NO: 2799203 - RNA, 22 nt, Leptospira interrogans serovar lai str. 56601
uauguagaaauuugauuucgag

SEQ ID NO: 2799204 - RNA, 20 nt, Leptospira interrogans serovar lai str. 56601
uaugucucuaaucacggcgu

SEQ ID NO: 2799205 - RNA, 19 nt, Leptospira interrogans serovar lai str. 56601
uaugugacuuaaucugugg

SEQ ID NO: 2799206 - RNA, 17 nt, Leptospira interrogans serovar lai str. 56601
uauguggaugauaaaaa

SEQ ID NO: 2799207 - RNA, 18 nt, Leptospira interrogans serovar lai str. 56601
uauguggaugauaaaaaa

SEQ ID NO: 2799208 - RNA, 18 nt, Leptospira interrogans serovar lai str. 56601
uaugugguaguucccaca

SEQ ID NO: 2799209 - RNA, 20 nt, Leptospira interrogans serovar lai str. 56601
uauguuuacuugaaaauaaa

SEQ ID NO: 2799210 - RNA, 23 nt, Leptospira interrogans serovar lai str. 56601
uauguuuacuugaaaauaaaaau

SEQ ID NO: 2799211 - RNA, 21 nt, Leptospira interrogans serovar lai str. 56601
uauguuucuugugucaagccc

SEQ ID NO: 2799212 - RNA, 15 nt, Leptospira interrogans serovar lai str. 56601
uauguuuuuuuucaa

SEQ ID NO: 2799213 - RNA, 18 nt, Leptospira interrogans serovar lai str. 56601
uauuaaaaaguuuucuca

SEQ ID NO: 2799214 - RNA, 19 nt, Leptospira interrogans serovar lai str. 56601
uauuaaaacacuuuacauu

SEQ ID NO: 2799215 - RNA, 20 nt, Leptospira interrogans serovar lai str. 56601
uauuaaaaccaucuuugaua

SEQ ID NO: 2799216 - RNA, 14 nt, Leptospira interrogans serovar lai str. 56601
uauuaaaauguaca

SEQ ID NO: 2799217 - RNA, 18 nt, Leptospira interrogans serovar lai str. 56601
uauuaaaauguuuuauuu

SEQ ID NO: 2799218 - RNA, 16 nt, Leptospira interrogans serovar lai str. 56601
uauuaaaauuucccga

SEQ ID NO: 2799219 - RNA, 23 nt, Leptospira interrogans serovar lai str. 56601
uauuaaagaauaauauuuuaaug

SEQ ID NO: 2799220 - RNA, 14 nt, Leptospira interrogans serovar lai str. 56601
uauuaaagaauuau

SEQ ID NO: 2799221 - RNA, 17 nt, Leptospira interrogans serovar lai str. 56601
uauuaaagucucaaguu

SEQ ID NO: 2799222 - RNA, 18 nt, Leptospira interrogans serovar lai str. 56601
uauuaaagucucaaguug

SEQ ID NO: 2799223 - RNA, 16 nt, Leptospira interrogans serovar lai str. 56601
uauuaaauuaacguga

SEQ ID NO: 2799224 - RNA, 14 nt, Leptospira interrogans serovar lai str. 56601
uauuaaauuauauu

SEQ ID NO: 2799225 - RNA, 20 nt, Leptospira interrogans serovar lai str. 56601
uauuaaauugaguuuuccaa

SEQ ID NO: 2799226 - RNA, 22 nt, Leptospira interrogans serovar lai str. 56601
uauuaaauugaguuuuccaaua

SEQ ID NO: 2799227 - RNA, 15 nt, Leptospira interrogans serovar lai str. 56601
uauuaaauuuuauuu

SEQ ID NO: 2799228 - RNA, 16 nt, Leptospira interrogans serovar lai str. 56601
uauuaaguuuuuuaaa

SEQ ID NO: 2799229 - RNA, 18 nt, Leptospira interrogans serovar lai str. 56601
uauuaauauucuaauuca

SEQ ID NO: 2799230 - RNA, 15 nt, Leptospira interrogans serovar lai str. 56601
uauuacaaaacuuag

SEQ ID NO: 2799231 - RNA, 14 nt, Leptospira interrogans serovar lai str. 56601
uauuacaauuuuau

SEQ ID NO: 2799232 - RNA, 21 nt, Leptospira interrogans serovar lai str. 56601
uauuacucggauguauaaaaa

SEQ ID NO: 2799233 - RNA, 15 nt, Leptospira interrogans serovar lai str. 56601
uauuacuuuuuaaac

SEQ ID NO: 2799234 - RNA, 18 nt, Leptospira interrogans serovar lai str. 56601
uauuacuuuuuaaacgau

SEQ ID NO: 2799235 - RNA, 22 nt, Leptospira interrogans serovar lai str. 56601
uauuagaaaaauugaauuucuu

SEQ ID NO: 2799236 - RNA, 21 nt, Leptospira interrogans serovar lai str. 56601
uauuagaguuucuaaaaaaau

SEQ ID NO: 2799237 - RNA, 14 nt, Leptospira interrogans serovar lai str. 56601
uauuaggaaauaca

SEQ ID NO: 2799238 - RNA, 15 nt, Leptospira interrogans serovar lai str. 56601
uauuaggaaauacaa

SEQ ID NO: 2799239 - RNA, 17 nt, Leptospira interrogans serovar lai str. 56601
uauuaguuuaauauaca

SEQ ID NO: 2799240 - RNA, 21 nt, Leptospira interrogans serovar lai str. 56601
uauuauaaacuucuauuuuau

SEQ ID NO: 2799241 - RNA, 23 nt, Leptospira interrogans serovar lai str. 56601
uauuauaaauacaaaaauucuaa

SEQ ID NO: 2799242 - RNA, 16 nt, Leptospira interrogans serovar lai str. 56601
uauuauaaauauuaau

SEQ ID NO: 2799243 - RNA, 16 nt, Leptospira interrogans serovar lai str. 56601
uauuauaaauuuaaaa

SEQ ID NO: 2799244 - RNA, 18 nt, Leptospira interrogans serovar lai str. 56601
uauuauaaauuuaaaaaa

SEQ ID NO: 2799245 - RNA, 14 nt, Leptospira interrogans serovar lai str. 56601
uauuauaaauuuau

SEQ ID NO: 2799246 - RNA, 16 nt, Leptospira interrogans serovar lai str. 56601
uauuauaaauuuugag

SEQ ID NO: 2799247 - RNA, 21 nt, Leptospira interrogans serovar lai str. 56601
uauuauaauaaucuuaacuuu

SEQ ID NO: 2799248 - RNA, 16 nt, Leptospira interrogans serovar lai str. 56601
uauuauaauuuuaaau

SEQ ID NO: 2799249 - RNA, 22 nt, Leptospira interrogans serovar lai str. 56601
uauuauaauuuuaaauaauaau

SEQ ID NO: 2799250 - RNA, 21 nt, Leptospira interrogans serovar lai str. 56601
uauuauauagcucuugaauaa

SEQ ID NO: 2799251 - RNA, 22 nt, Leptospira interrogans serovar lai str. 56601
uauuauccauuucuauaaauug

SEQ ID NO: 2799252 - RNA, 23 nt, Leptospira interrogans serovar lai str. 56601
uauuauccauuucuauaaauuga

SEQ ID NO: 2799253 - RNA, 15 nt, Leptospira interrogans serovar lai str. 56601
uauuaugauucuaua

SEQ ID NO: 2799254 - RNA, 18 nt, Leptospira interrogans serovar lai str. 56601
uauuauuaaauuuuuaua

SEQ ID NO: 2799255 - RNA, 14 nt, Leptospira interrogans serovar lai str. 56601
uauuauuauuuuaa

SEQ ID NO: 2799256 - RNA, 16 nt, Leptospira interrogans serovar lai str. 56601
uauuauuuucagauug

SEQ ID NO: 2799257 - RNA, 17 nt, Leptospira interrogans serovar lai str. 56601
uauuauuuucagauugu

SEQ ID NO: 2799258 - RNA, 22 nt, Leptospira interrogans serovar lai str. 56601
uauuauuuugauuuguuucuuu

SEQ ID NO: 2799259 - RNA, 13 nt, Leptospira interrogans serovar lai str. 56601
uauuucuaaaauu

SEQ ID NO: 2799260 - RNA, 23 nt, Leptospira interrogans serovar lai str. 56601
uauuucuaaaauugaauauugag

SEQ ID NO: 2799261 - RNA, 12 nt, Leptospira interrogans serovar lai str. 56601
uauuucuaaguc

SEQ ID NO: 2799262 - RNA, 23 nt, Leptospira interrogans serovar lai str. 56601
uauuucuaaguccuuuucuuaua

SEQ ID NO: 2799263 - RNA, 21 nt, Leptospira interrogans serovar lai str. 56601
uauuucuaauaguugaaauuc

SEQ ID NO: 2799264 - RNA, 17 nt, Leptospira interrogans serovar lai str. 56601
uauuucuaauauucaaa

SEQ ID NO: 2799265 - RNA, 14 nt, Leptospira interrogans serovar lai str. 56601
uauuucucucaaau

SEQ ID NO: 2799266 - RNA, 21 nt, Leptospira interrogans serovar lai str. 56601
uauuucuuaaauucuaaaaaa

SEQ ID NO: 2799267 - RNA, 23 nt, Leptospira interrogans serovar lai str. 56601
uauuucuuucaaaaauuuaaguc

SEQ ID NO: 2799268 - RNA, 19 nt, Leptospira interrogans serovar lai str. 56601
uauuucuuuugauacaauu

SEQ ID NO: 2799269 - RNA, 13 nt, Leptospira interrogans serovar lai str. 56601
uauuugauauaau

SEQ ID NO: 2799270 - RNA, 21 nt, Leptospira interrogans serovar lai str. 56601
uauuugcggaaucaauuuuag

SEQ ID NO: 2799271 - RNA, 16 nt, Leptospira interrogans serovar lai str. 56601
uauuuggaucggcucc

SEQ ID NO: 2799272 - RNA, 19 nt, Leptospira interrogans serovar lai str. 56601
uauuuggauuuuauaaagu

SEQ ID NO: 2799273 - RNA, 15 nt, Leptospira interrogans serovar lai str. 56601
uauuuggcuuuauag

SEQ ID NO: 2799274 - RNA, 15 nt, Leptospira interrogans serovar lai str. 56601
uauuugguuuucauu

SEQ ID NO: 2799275 - RNA, 18 nt, Leptospira interrogans serovar lai str. 56601
uauuugguuuucauuuua

SEQ ID NO: 2799276 - RNA, 19 nt, Leptospira interrogans serovar lai str. 56601
uauuuguauucaagagcaa

SEQ ID NO: 2799277 - RNA, 14 nt, Leptospira interrogans serovar lai str. 56601
uauuuuaaaauuca

SEQ ID NO: 2799278 - RNA, 12 nt, Leptospira interrogans serovar lai str. 56601
uauuuuaaauug

SEQ ID NO: 2799279 - RNA, 14 nt, Leptospira interrogans serovar lai str. 56601
uauuuuaauauauu

SEQ ID NO: 2799280 - RNA, 13 nt, Leptospira interrogans serovar lai str. 56601
uauuuuacaguaa

SEQ ID NO: 2799281 - RNA, 17 nt, Leptospira interrogans serovar lai str. 56601
uauuuuacgcuuaaaua

SEQ ID NO: 2799282 - RNA, 13 nt, Leptospira interrogans serovar lai str. 56601
uauuuuaggauuu

SEQ ID NO: 2799283 - RNA, 16 nt, Leptospira interrogans serovar lai str. 56601
uauuuuagguauuucu

SEQ ID NO: 2799284 - RNA, 17 nt, Leptospira interrogans serovar lai str. 56601
uauuuuauaaauugugg

SEQ ID NO: 2799285 - RNA, 15 nt, Leptospira interrogans serovar lai str. 56601
uauuuuauacuucua

SEQ ID NO: 2799286 - RNA, 15 nt, Leptospira interrogans serovar lai str. 56601
uauuuuauuauauaa

SEQ ID NO: 2799287 - RNA, 12 nt, Leptospira interrogans serovar lai str. 56601
uauuuuauuuuu

SEQ ID NO: 2799288 - RNA, 14 nt, Leptospira interrogans serovar lai str. 56601
uauuuuauuuuugg

SEQ ID NO: 2799289 - RNA, 18 nt, Leptospira interrogans serovar lai str. 56601
uauuuucaaaaaauaaaa

SEQ ID NO: 2799290 - RNA, 20 nt, Leptospira interrogans serovar lai str. 56601
uauuuucaaaaaauaaaauu

SEQ ID NO: 2799291 - RNA, 16 nt, Leptospira interrogans serovar lai str. 56601
uauuuucaaguaaauc

SEQ ID NO: 2799292 - RNA, 11 nt, Leptospira interrogans serovar lai str. 56601
uauuuucauag

SEQ ID NO: 2799293 - RNA, 19 nt, Leptospira interrogans serovar lai str. 56601
uauuuucauaggaaauucu

SEQ ID NO: 2799294 - RNA, 17 nt, Leptospira interrogans serovar lai str. 56601
uauuuucggcauuuuau

SEQ ID NO: 2799295 - RNA, 20 nt, Leptospira interrogans serovar lai str. 56601
uauuuucuaggauuuuauau

SEQ ID NO: 2799296 - RNA, 16 nt, Leptospira interrogans serovar lai str. 56601
uauuuugaauaaguuu

SEQ ID NO: 2799297 - RNA, 17 nt, Leptospira interrogans serovar lai str. 56601
uauuuugagaaaaucca

SEQ ID NO: 2799298 - RNA, 21 nt, Leptospira interrogans serovar lai str. 56601
uauuuugagaaaauccaguca

SEQ ID NO: 2799299 - RNA, 22 nt, Leptospira interrogans serovar lai str. 56601
uauuuugagaaaauccagucaa

SEQ ID NO: 2799300 - RNA, 21 nt, Leptospira interrogans serovar lai str. 56601
uauuuugauccguuuuaaaau

SEQ ID NO: 2799301 - RNA, 12 nt, Leptospira interrogans serovar lai str. 56601
uauuuugaugaa

SEQ ID NO: 2799302 - RNA, 21 nt, Leptospira interrogans serovar lai str. 56601
uauuuugauuccaaagauaaa

SEQ ID NO: 2799303 - RNA, 14 nt, Leptospira interrogans serovar lai str. 56601
uauuuugauuuguu

SEQ ID NO: 2799304 - RNA, 18 nt, Leptospira interrogans serovar lai str. 56601
uauuuugauuuguuucuu

SEQ ID NO: 2799305 - RNA, 21 nt, Leptospira interrogans serovar lai str. 56601
uauuuugcacugaaauagaau

SEQ ID NO: 2799306 - RNA, 22 nt, Leptospira interrogans serovar lai str. 56601
uauuuuggcccuccucuaaaau

SEQ ID NO: 2799307 - RNA, 23 nt, Leptospira interrogans serovar lai str. 56601
uauuuugugacuaauuuugugaa

SEQ ID NO: 2799308 - RNA, 14 nt, Leptospira interrogans serovar lai str. 56601
uauuuuguuuugaa

SEQ ID NO: 2799309 - RNA, 22 nt, Leptospira interrogans serovar lai str. 56601
uauuuuguuuuuaguuacaauu

SEQ ID NO: 2799310 - RNA, 14 nt, Leptospira interrogans serovar lai str. 56601
uauuuuuaaaaagu

SEQ ID NO: 2799311 - RNA, 10 nt, Leptospira interrogans serovar lai str. 56601
uauuuuuaag

SEQ ID NO: 2799312 - RNA, 18 nt, Leptospira interrogans serovar lai str. 56601
uauuuuuacagaaaaauc

SEQ ID NO: 2799313 - RNA, 16 nt, Leptospira interrogans serovar lai str. 56601
uauuuuuagaaaauuu

SEQ ID NO: 2799314 - RNA, 21 nt, Leptospira interrogans serovar lai str. 56601
uauuuuuauaaagauaaaucg

SEQ ID NO: 2799315 - RNA, 20 nt, Leptospira interrogans serovar lai str. 56601
uauuuuucaacaacucuauu

SEQ ID NO: 2799316 - RNA, 14 nt, Leptospira interrogans serovar lai str. 56601
uauuuuucuaaaaa

SEQ ID NO: 2799317 - RNA, 16 nt, Leptospira interrogans serovar lai str. 56601
uauuuuucuaaaaaaa

SEQ ID NO: 2799318 - RNA, 16 nt, Leptospira interrogans serovar lai str. 56601
uauuuuugaaaagauc

SEQ ID NO: 2799319 - RNA, 17 nt, Leptospira interrogans serovar lai str. 56601
uauuuuuuacgaaaaaa

SEQ ID NO: 2799320 - RNA, 20 nt, Leptospira interrogans serovar lai str. 56601
uauuuuuuacgaaaaaauug

SEQ ID NO: 2799321 - RNA, 15 nt, Leptospira interrogans serovar lai str. 56601
uauuuuuuuaaaaaa

SEQ ID NO: 2799322 - RNA, 18 nt, Leptospira interrogans serovar lai str. 56601
uauuuuuuuaaaaaauuu

SEQ ID NO: 2799323 - RNA, 18 nt, Leptospira interrogans serovar lai str. 56601
ucaaaaaaaguaauuacu

SEQ ID NO: 2799324 - RNA, 18 nt, Leptospira interrogans serovar lai str. 56601
ucaaaaaagaaaaaucuu

SEQ ID NO: 2799325 - RNA, 18 nt, Leptospira interrogans serovar lai str. 56601
ucaaaaaauaucauuuaa

SEQ ID NO: 2799326 - RNA, 12 nt, Leptospira interrogans serovar lai str. 56601
ucaaaaaauuuu

SEQ ID NO: 2799327 - RNA, 20 nt, Leptospira interrogans serovar lai str. 56601
ucaaaaaauuuuacgcaauc

SEQ ID NO: 2799328 - RNA, 23 nt, Leptospira interrogans serovar lai str. 56601
ucaaaaaauuuuuacgcguaauu

SEQ ID NO: 2799329 - RNA, 21 nt, Leptospira interrogans serovar lai str. 56601
ucaaaaacaaauuaaguuuaa

SEQ ID NO: 2799330 - RNA, 21 nt, Leptospira interrogans serovar lai str. 56601
ucaaaaaccgaaauagaaaua

SEQ ID NO: 2799331 - RNA, 14 nt, Leptospira interrogans serovar lai str. 56601
ucaaaaagaaucgu

SEQ ID NO: 2799332 - RNA, 12 nt, Leptospira interrogans serovar lai str. 56601
ucaaaaagacua

SEQ ID NO: 2799333 - RNA, 12 nt, Leptospira interrogans serovar lai str. 56601
ucaaaaagagaa

SEQ ID NO: 2799334 - RNA, 21 nt, Leptospira interrogans serovar lai str. 56601
ucaaaaaggcacauuuuucaa

SEQ ID NO: 2799335 - RNA, 23 nt, Leptospira interrogans serovar lai str. 56601
ucaaaaaggcacauuuuucaagu

SEQ ID NO: 2799336 - RNA, 18 nt, Leptospira interrogans serovar lai str. 56601
ucaaaaaguuuuauaaac

SEQ ID NO: 2799337 - RNA, 19 nt, Leptospira interrogans serovar lai str. 56601
ucaaaaauacuuugaacuu

SEQ ID NO: 2799338 - RNA, 18 nt, Leptospira interrogans serovar lai str. 56601
ucaaaaauuauaaaucau

SEQ ID NO: 2799339 - RNA, 12 nt, Leptospira interrogans serovar lai str. 56601
ucaaaaauuuaa

SEQ ID NO: 2799340 - RNA, 19 nt, Leptospira interrogans serovar lai str. 56601
ucaaaaauuuucuguuuau

SEQ ID NO: 2799341 - RNA, 13 nt, Leptospira interrogans serovar lai str. 56601
ucaaaaccaaaac

SEQ ID NO: 2799342 - RNA, 15 nt, Leptospira interrogans serovar lai str. 56601
ucaacaauucuauug

SEQ ID NO: 2799343 - RNA, 16 nt, Leptospira interrogans serovar lai str. 56601
ucaacacaaauauuaa

SEQ ID NO: 2799344 - RNA, 17 nt, Leptospira interrogans serovar lai str. 56601
ucaacacaaauauuaag

SEQ ID NO: 2799345 - RNA, 20 nt, Leptospira interrogans serovar lai str. 56601
ucaacacaaauauuaagaau

SEQ ID NO: 2799346 - RNA, 20 nt, Leptospira interrogans serovar lai str. 56601
ucaacacaacgcucuuuaug

SEQ ID NO: 2799347 - RNA, 17 nt, Leptospira interrogans serovar lai str. 56601
ucaacagaacgggcuuu

SEQ ID NO: 2799348 - RNA, 11 nt, Leptospira interrogans serovar lai str. 56601
ucaacagauac

SEQ ID NO: 2799349 - RNA, 23 nt, Leptospira interrogans serovar lai str. 56601
ucaacagaucgcguuuuauaaua

SEQ ID NO: 2799350 - RNA, 19 nt, Leptospira interrogans serovar lai str. 56601
ucaacaggggcuuugauug

SEQ ID NO: 2799351 - RNA, 15 nt, Leptospira interrogans serovar lai str. 56601
ucaacaucacgcaca

SEQ ID NO: 2799352 - RNA, 13 nt, Leptospira interrogans serovar lai str. 56601
ucaacaucauucu

SEQ ID NO: 2799353 - RNA, 16 nt, Leptospira interrogans serovar lai str. 56601
ucaacaucauucucau

SEQ ID NO: 2799354 - RNA, 16 nt, Leptospira interrogans serovar lai str. 56601
ucaacaucucaaucaa

SEQ ID NO: 2799355 - RNA, 20 nt, Leptospira interrogans serovar lai str. 56601
ucaacaucucaaucaaaauu

SEQ ID NO: 2799356 - RNA, 19 nt, Leptospira interrogans serovar lai str. 56601
ucaacgacucguaauuaaa

SEQ ID NO: 2799357 - RNA, 18 nt, Leptospira interrogans serovar lai str. 56601
ucaacguucaaacaacaa

SEQ ID NO: 2799358 - RNA, 17 nt, Leptospira interrogans serovar lai str. 56601
ucaacuacuaaucucua

SEQ ID NO: 2799359 - RNA, 22 nt, Leptospira interrogans serovar lai str. 56601
ucaacucuauucauaaaugaua

SEQ ID NO: 2799360 - RNA, 19 nt, Leptospira interrogans serovar lai str. 56601
ucaacucuguaaauucaaa

SEQ ID NO: 2799361 - RNA, 16 nt, Leptospira interrogans serovar lai str. 56601
ucaacugaaacucuau

SEQ ID NO: 2799362 - RNA, 23 nt, Leptospira interrogans serovar lai str. 56601
ucaacugaaacucuaucacgaaa

SEQ ID NO: 2799363 - RNA, 14 nt, Leptospira interrogans serovar lai str. 56601
ucaacuuuagaaaa

SEQ ID NO: 2799364 - RNA, 15 nt, Leptospira interrogans serovar lai str. 56601
ucaacuuuagaaaaa

SEQ ID NO: 2799365 - RNA, 13 nt, Leptospira interrogans serovar lai str. 56601
ucaacuuuuccag

SEQ ID NO: 2799366 - RNA, 23 nt, Leptospira interrogans serovar lai str. 56601
ucaacuuuuugaagaaacaauuc

SEQ ID NO: 2799367 - RNA, 15 nt, Leptospira interrogans serovar lai str. 56601
ucaagaagagucaaa

SEQ ID NO: 2799368 - RNA, 22 nt, Leptospira interrogans serovar lai str. 56601
ucaagaauuuauuuacaaucga

SEQ ID NO: 2799369 - RNA, 18 nt, Leptospira interrogans serovar lai str. 56601
ucaagacaacagaacaaa

SEQ ID NO: 2799370 - RNA, 21 nt, Leptospira interrogans serovar lai str. 56601
ucaagacuuuauagucaaauu

SEQ ID NO: 2799371 - RNA, 22 nt, Leptospira interrogans serovar lai str. 56601
ucaagacuuuauagucaaauuu

SEQ ID NO: 2799372 - RNA, 20 nt, Leptospira interrogans serovar lai str. 56601
ucaagagccaaguugaaucu

SEQ ID NO: 2799373 - RNA, 23 nt, Leptospira interrogans serovar lai str. 56601
ucaagagugguuuucaaauauuu

SEQ ID NO: 2799374 - RNA, 12 nt, Leptospira interrogans serovar lai str. 56601
ucaagauugucu

SEQ ID NO: 2799375 - RNA, 22 nt, Leptospira interrogans serovar lai str. 56601
ucaagauugucuuuauucgcau

SEQ ID NO: 2799376 - RNA, 17 nt, Leptospira interrogans serovar lai str. 56601
ucaagauuuaauuuaga

SEQ ID NO: 2799377 - RNA, 17 nt, Leptospira interrogans serovar lai str. 56601
ucaaggaagugaaauug

SEQ ID NO: 2799378 - RNA, 22 nt, Leptospira interrogans serovar lai str. 56601
ucaagguuucacuuuuuuaaag

SEQ ID NO: 2799379 - RNA, 23 nt, Leptospira interrogans serovar lai str. 56601
ucaagguuucacuuuuuuaaagu

SEQ ID NO: 2799380 - RNA, 21 nt, Leptospira interrogans serovar lai str. 56601
ucaaguaccauaaauuuugau

SEQ ID NO: 2799381 - RNA, 20 nt, Leptospira interrogans serovar lai str. 56601
ucaagugauucauucuaaga

SEQ ID NO: 2799382 - RNA, 21 nt, Leptospira interrogans serovar lai str. 56601
ucaagugcaguaguuccuaca

SEQ ID NO: 2799383 - RNA, 22 nt, Leptospira interrogans serovar lai str. 56601
ucaaguggguuacuuugaacuu

SEQ ID NO: 2799384 - RNA, 23 nt, Leptospira interrogans serovar lai str. 56601
ucaaguguuccgacaagaaugag

SEQ ID NO: 2799385 - RNA, 21 nt, Leptospira interrogans serovar lai str. 56601
ucaaguuauuguaaaacucca

SEQ ID NO: 2799386 - RNA, 18 nt, Leptospira interrogans serovar lai str. 56601
ucaaguuuaggcuugauu

SEQ ID NO: 2799387 - RNA, 14 nt, Leptospira interrogans serovar lai str. 56601
ucaaguuugugaga

SEQ ID NO: 2799388 - RNA, 22 nt, Leptospira interrogans serovar lai str. 56601
ucaaguuugugagaguucccac

SEQ ID NO: 2799389 - RNA, 23 nt, Leptospira interrogans serovar lai str. 56601
ucaaguuugugagaguucccacg

SEQ ID NO: 2799390 - RNA, 12 nt, Leptospira interrogans serovar lai str. 56601
ucaaguuuucuu

SEQ ID NO: 2799391 - RNA, 21 nt, Leptospira interrogans serovar lai str. 56601
ucaauaaaauaccauaaauuu

SEQ ID NO: 2799392 - RNA, 22 nt, Leptospira interrogans serovar lai str. 56601
ucaauaaauuaguaauuuaaua

SEQ ID NO: 2799393 - RNA, 17 nt, Leptospira interrogans serovar lai str. 56601
ucaauaaauugaaagua

SEQ ID NO: 2799394 - RNA, 12 nt, Leptospira interrogans serovar lai str. 56601
ucaauaacuuga

SEQ ID NO: 2799395 - RNA, 18 nt, Leptospira interrogans serovar lai str. 56601
ucaauaaguuuacaucaa

SEQ ID NO: 2799396 - RNA, 14 nt, Leptospira interrogans serovar lai str. 56601
ucaauaauccagcu

SEQ ID NO: 2799397 - RNA, 20 nt, Leptospira interrogans serovar lai str. 56601
ucaauaauccagcugaaacu

SEQ ID NO: 2799398 - RNA, 23 nt, Leptospira interrogans serovar lai str. 56601
ucaauaauccagcugaaacuaau

SEQ ID NO: 2799399 - RNA, 15 nt, Leptospira interrogans serovar lai str. 56601
ucaauaauucuaucg

SEQ ID NO: 2799400 - RNA, 18 nt, Leptospira interrogans serovar lai str. 56601
ucaauaauuuuaauauuu

SEQ ID NO: 2799401 - RNA, 16 nt, Leptospira interrogans serovar lai str. 56601
ucaauacaacgaaaau

SEQ ID NO: 2799402 - RNA, 20 nt, Leptospira interrogans serovar lai str. 56601
ucaauaccgauuucuauuuu

SEQ ID NO: 2799403 - RNA, 21 nt, Leptospira interrogans serovar lai str. 56601
ucaauagaauuguugaaaaau

SEQ ID NO: 2799404 - RNA, 19 nt, Leptospira interrogans serovar lai str. 56601
ucaauagagucguugaaaa

SEQ ID NO: 2799405 - RNA, 15 nt, Leptospira interrogans serovar lai str. 56601
ucaauauaaaucugu

SEQ ID NO: 2799406 - RNA, 13 nt, Leptospira interrogans serovar lai str. 56601
ucaauauuuaaaa

SEQ ID NO: 2799407 - RNA, 14 nt, Leptospira interrogans serovar lai str. 56601
ucaauauuuaaaaa

SEQ ID NO: 2799408 - RNA, 16 nt, Leptospira interrogans serovar lai str. 56601
ucaauauuuaaaaauu

SEQ ID NO: 2799409 - RNA, 13 nt, Leptospira interrogans serovar lai str. 56601
ucaaucaaauuuu

SEQ ID NO: 2799410 - RNA, 14 nt, Leptospira interrogans serovar lai str. 56601
ucaaucaauugacu

SEQ ID NO: 2799411 - RNA, 17 nt, Leptospira interrogans serovar lai str. 56601
ucaauccuguaaauuca

SEQ ID NO: 2799412 - RNA, 19 nt, Leptospira interrogans serovar lai str. 56601
ucaauccuguaaauucaaa

SEQ ID NO: 2799413 - RNA, 23 nt, Leptospira interrogans serovar lai str. 56601
ucaaucuaacccauucaacauca

SEQ ID NO: 2799414 - RNA, 18 nt, Leptospira interrogans serovar lai str. 56601
ucaaucuccccaaaaucu

SEQ ID NO: 2799415 - RNA, 17 nt, Leptospira interrogans serovar lai str. 56601
ucaauggaaaauuaauu

SEQ ID NO: 2799416 - RNA, 18 nt, Leptospira interrogans serovar lai str. 56601
ucaauggaaaauuaauuu

SEQ ID NO: 2799417 - RNA, 23 nt, Leptospira interrogans serovar lai str. 56601
ucaauggaaaauuaauuuuucaa

SEQ ID NO: 2799418 - RNA, 20 nt, Leptospira interrogans serovar lai str. 56601
ucaaugguugcaaaaaagaa

SEQ ID NO: 2799419 - RNA, 20 nt, Leptospira interrogans serovar lai str. 56601
ucaaugugcgaucaacaagu

SEQ ID NO: 2799420 - RNA, 17 nt, Leptospira interrogans serovar lai str. 56601
ucaauguguugucuacg

SEQ ID NO: 2799421 - RNA, 20 nt, Leptospira interrogans serovar lai str. 56601
ucaauguugcuccuugcugu

SEQ ID NO: 2799422 - RNA, 13 nt, Leptospira interrogans serovar lai str. 56601
ucaauuaaauugu

SEQ ID NO: 2799423 - RNA, 19 nt, Leptospira interrogans serovar lai str. 56601
ucaauuaaauuguaugaaa

SEQ ID NO: 2799424 - RNA, 15 nt, Leptospira interrogans serovar lai str. 56601
ucaggcuuuauaaaa

SEQ ID NO: 2799425 - RNA, 16 nt, Leptospira interrogans serovar lai str. 56601
ucagggccggagaaaa

SEQ ID NO: 2799426 - RNA, 15 nt, Leptospira interrogans serovar lai str. 56601
ucagggcucaaaguc

SEQ ID NO: 2799427 - RNA, 22 nt, Leptospira interrogans serovar lai str. 56601
ucagguuuuaucaaauaaaguu

SEQ ID NO: 2799428 - RNA, 19 nt, Leptospira interrogans serovar lai str. 56601
ucaguaaaacgcucucuac

SEQ ID NO: 2799429 - RNA, 14 nt, Leptospira interrogans serovar lai str. 56601
ucaguaaacucaau

SEQ ID NO: 2799430 - RNA, 18 nt, Leptospira interrogans serovar lai str. 56601
ucaguagguuuuuaauuu

SEQ ID NO: 2799431 - RNA, 15 nt, Leptospira interrogans serovar lai str. 56601
ucaguagugaaaaac

SEQ ID NO: 2799432 - RNA, 18 nt, Leptospira interrogans serovar lai str. 56601
ucaguaguuauauuaaua

SEQ ID NO: 2799433 - RNA, 15 nt, Leptospira interrogans serovar lai str. 56601
ucaguauguuguucu

SEQ ID NO: 2799434 - RNA, 18 nt, Leptospira interrogans serovar lai str. 56601
ucagucaccucuauaaaa

SEQ ID NO: 2799435 - RNA, 16 nt, Leptospira interrogans serovar lai str. 56601
ucagucucauuucaaa

SEQ ID NO: 2799436 - RNA, 15 nt, Leptospira interrogans serovar lai str. 56601
ucagugaauaaaaua

SEQ ID NO: 2799437 - RNA, 16 nt, Leptospira interrogans serovar lai str. 56601
ucagugauaagaaaaa

SEQ ID NO: 2799438 - RNA, 13 nt, Leptospira interrogans serovar lai str. 56601
ucagugauucgaa

SEQ ID NO: 2799439 - RNA, 18 nt, Leptospira interrogans serovar lai str. 56601
ucagugauucgaaauuuu

SEQ ID NO: 2799440 - RNA, 19 nt, Leptospira interrogans serovar lai str. 56601
ucagugauucgaaauuuuc

SEQ ID NO: 2799441 - RNA, 21 nt, Leptospira interrogans serovar lai str. 56601
ucaguguuuugugauaaaauu

SEQ ID NO: 2799442 - RNA, 16 nt, Leptospira interrogans serovar lai str. 56601
ucaguucuuauagaaa

SEQ ID NO: 2799443 - RNA, 20 nt, Leptospira interrogans serovar lai str. 56601
ucaguuuuacuguaaaauuu

SEQ ID NO: 2799444 - RNA, 15 nt, Leptospira interrogans serovar lai str. 56601
ucauaaaaaaaucaa

SEQ ID NO: 2799445 - RNA, 19 nt, Leptospira interrogans serovar lai str. 56601
ucauaaaaauaaagaaacu

SEQ ID NO: 2799446 - RNA, 12 nt, Leptospira interrogans serovar lai str. 56601
ucauaaaauucu

SEQ ID NO: 2799447 - RNA, 19 nt, Leptospira interrogans serovar lai str. 56601
ucauaaaccgauuuuccca

SEQ ID NO: 2799448 - RNA, 21 nt, Leptospira interrogans serovar lai str. 56601
ucauaaaggugcaugaaaaua

SEQ ID NO: 2799449 - RNA, 23 nt, Leptospira interrogans serovar lai str. 56601
ucauaaaggugcaugaaaauaau

SEQ ID NO: 2799450 - RNA, 16 nt, Leptospira interrogans serovar lai str. 56601
ucauaaguguaugaaa

SEQ ID NO: 2799451 - RNA, 17 nt, Leptospira interrogans serovar lai str. 56601
ucauaaguguaugaaaa

SEQ ID NO: 2799452 - RNA, 14 nt, Leptospira interrogans serovar lai str. 56601
ucauaauaaaacua

SEQ ID NO: 2799453 - RNA, 16 nt, Leptospira interrogans serovar lai str. 56601
ucauaaucaauuaacc

SEQ ID NO: 2799454 - RNA, 17 nt, Leptospira interrogans serovar lai str. 56601
ucauaauccuaugaaaa

SEQ ID NO: 2799455 - RNA, 14 nt, Leptospira interrogans serovar lai str. 56601
ucauacaguaaaac

SEQ ID NO: 2799456 - RNA, 16 nt, Leptospira interrogans serovar lai str. 56601
ucauacuucuaaaaaa

SEQ ID NO: 2799457 - RNA, 17 nt, Leptospira interrogans serovar lai str. 56601
ucauacuucuaaaaaau

SEQ ID NO: 2799458 - RNA, 16 nt, Leptospira interrogans serovar lai str. 56601
ucauacuuuagaaauu

SEQ ID NO: 2799459 - RNA, 22 nt, Leptospira interrogans serovar lai str. 56601
ucauacuuuagaaauuucuaau

SEQ ID NO: 2799460 - RNA, 15 nt, Leptospira interrogans serovar lai str. 56601
ucauacuuuuaaaaa

SEQ ID NO: 2799461 - RNA, 17 nt, Leptospira interrogans serovar lai str. 56601
ucauacuuuuaaaaaau

SEQ ID NO: 2799462 - RNA, 21 nt, Leptospira interrogans serovar lai str. 56601
ucauagaauaaucggaaauac

SEQ ID NO: 2799463 - RNA, 16 nt, Leptospira interrogans serovar lai str. 56601
ucauagaccaauuuuu

SEQ ID NO: 2799464 - RNA, 14 nt, Leptospira interrogans serovar lai str. 56601
ucauaguucaauua

SEQ ID NO: 2799465 - RNA, 12 nt, Leptospira interrogans serovar lai str. 56601
ucauaguuccca

SEQ ID NO: 2799466 - RNA, 11 nt, Leptospira interrogans serovar lai str. 56601
ucauauaaaag

SEQ ID NO: 2799467 - RNA, 17 nt, Leptospira interrogans serovar lai str. 56601
ucauauaaaagugaaca

SEQ ID NO: 2799468 - RNA, 13 nt, Leptospira interrogans serovar lai str. 56601
ucauaucaaauuc

SEQ ID NO: 2799469 - RNA, 13 nt, Leptospira interrogans serovar lai str. 56601
ucauauccaaaac

SEQ ID NO: 2799470 - RNA, 16 nt, Leptospira interrogans serovar lai str. 56601
ucauauccaauuucaa

SEQ ID NO: 2799471 - RNA, 16 nt, Leptospira interrogans serovar lai str. 56601
ucauaucccaauaagg

SEQ ID NO: 2799472 - RNA, 23 nt, Leptospira interrogans serovar lai str. 56601
ucauaucuaaaauggacugcaaa

SEQ ID NO: 2799473 - RNA, 22 nt, Leptospira interrogans serovar lai str. 56601
ucauauugaaaucugaacauaa

SEQ ID NO: 2799474 - RNA, 17 nt, Leptospira interrogans serovar lai str. 56601
ucauauuuaacuguaau

SEQ ID NO: 2799475 - RNA, 16 nt, Leptospira interrogans serovar lai str. 56601
ucauauuuucaaaaaa

SEQ ID NO: 2799476 - RNA, 18 nt, Leptospira interrogans serovar lai str. 56601
ucaucaaugguuuuucuu

SEQ ID NO: 2799477 - RNA, 21 nt, Leptospira interrogans serovar lai str. 56601
ucaucaccaaccccacaaguu

SEQ ID NO: 2799478 - RNA, 19 nt, Leptospira interrogans serovar lai str. 56601
ucaucaggaccaaaucuuu

SEQ ID NO: 2799479 - RNA, 13 nt, Leptospira interrogans serovar lai str. 56601
ucaucauucugaa

SEQ ID NO: 2799480 - RNA, 18 nt, Leptospira interrogans serovar lai str. 56601
ucaucauucugaaaaaag

SEQ ID NO: 2799481 - RNA, 19 nt, Leptospira interrogans serovar lai str. 56601
ucaucauucugaaaaaagu

SEQ ID NO: 2799482 - RNA, 14 nt, Leptospira interrogans serovar lai str. 56601
ucaucgucuaauca

SEQ ID NO: 2799483 - RNA, 16 nt, Leptospira interrogans serovar lai str. 56601
ucaucguuccaaaccc

SEQ ID NO: 2799484 - RNA, 12 nt, Leptospira interrogans serovar lai str. 56601
ucaucuaaaaaa

SEQ ID NO: 2799485 - RNA, 20 nt, Leptospira interrogans serovar lai str. 56601
ucaucuaaucgaaacuauaa

SEQ ID NO: 2799486 - RNA, 20 nt, Leptospira interrogans serovar lai str. 56601
ucaucuacauaaaaaaggaa

SEQ ID NO: 2799487 - RNA, 22 nt, Leptospira interrogans serovar lai str. 56601
ucaucucccgaaugaauuuuca

SEQ ID NO: 2799488 - RNA, 18 nt, Leptospira interrogans serovar lai str. 56601
ucaucugaacuaugaaau

SEQ ID NO: 2799489 - RNA, 17 nt, Leptospira interrogans serovar lai str. 56601
ucaucuguggagaaaau

SEQ ID NO: 2799490 - RNA, 14 nt, Leptospira interrogans serovar lai str. 56601
ucaucuuacacacu

SEQ ID NO: 2799491 - RNA, 20 nt, Leptospira interrogans serovar lai str. 56601
ucaucuuugcgauuuuuccg

SEQ ID NO: 2799492 - RNA, 18 nt, Leptospira interrogans serovar lai str. 56601
ucaugacuacagaauaaa

SEQ ID NO: 2799493 - RNA, 12 nt, Leptospira interrogans serovar lai str. 56601
ucaugagaaaca

SEQ ID NO: 2799494 - RNA, 18 nt, Leptospira interrogans serovar lai str. 56601
ucaugagaaacaaaguag

SEQ ID NO: 2799495 - RNA, 15 nt, Leptospira interrogans serovar lai str. 56601
ucaugaucaaauuca

SEQ ID NO: 2799496 - RNA, 21 nt, Leptospira interrogans serovar lai str. 56601
ucaugaucaaauucacauaaa

SEQ ID NO: 2799497 - RNA, 21 nt, Leptospira interrogans serovar lai str. 56601
ucaugauucauuuuucugaaa

SEQ ID NO: 2799498 - RNA, 14 nt, Leptospira interrogans serovar lai str. 56601
ucaugauucugaaa

SEQ ID NO: 2799499 - RNA, 17 nt, Leptospira interrogans serovar lai str. 56601
ucauggccuucuggaaa

SEQ ID NO: 2799500 - RNA, 15 nt, Leptospira interrogans serovar lai str. 56601
ucauguaaaauuuuu

SEQ ID NO: 2799501 - RNA, 22 nt, Leptospira interrogans serovar lai str. 56601
ucauguaaaauuuuuugaaguu

SEQ ID NO: 2799502 - RNA, 21 nt, Leptospira interrogans serovar lai str. 56601
ucauguccggguuagaaucaa

SEQ ID NO: 2799503 - RNA, 18 nt, Leptospira interrogans serovar lai str. 56601
ucaugucguacuaaaauu

SEQ ID NO: 2799504 - RNA, 20 nt, Leptospira interrogans serovar lai str. 56601
ucaugucucaguucaaaaua

SEQ ID NO: 2799505 - RNA, 17 nt, Leptospira interrogans serovar lai str. 56601
ucaugugaauucagaaa

SEQ ID NO: 2799506 - RNA, 23 nt, Leptospira interrogans serovar lai str. 56601
ucauuaaaacgaauugauaaaac

SEQ ID NO: 2799507 - RNA, 16 nt, Leptospira interrogans serovar lai str. 56601
uccacauuuuagggau

SEQ ID NO: 2799508 - RNA, 13 nt, Leptospira interrogans serovar lai str. 56601
uccacccaaaccg

SEQ ID NO: 2799509 - RNA, 19 nt, Leptospira interrogans serovar lai str. 56601
uccacccgcaaucggagaa

SEQ ID NO: 2799510 - RNA, 19 nt, Leptospira interrogans serovar lai str. 56601
uccaccggaguaaggcaaa

SEQ ID NO: 2799511 - RNA, 22 nt, Leptospira interrogans serovar lai str. 56601
uccacgaauugccgauucuaac

SEQ ID NO: 2799512 - RNA, 13 nt, Leptospira interrogans serovar lai str. 56601
uccacuauggaau

SEQ ID NO: 2799513 - RNA, 15 nt, Leptospira interrogans serovar lai str. 56601
uccacuauggaauuu

SEQ ID NO: 2799514 - RNA, 18 nt, Leptospira interrogans serovar lai str. 56601
uccacuuaaaaaguuuuu

SEQ ID NO: 2799515 - RNA, 10 nt, Leptospira interrogans serovar lai str. 56601
uccacuucaa

SEQ ID NO: 2799516 - RNA, 16 nt, Leptospira interrogans serovar lai str. 56601
uccacuucucacaaau

SEQ ID NO: 2799517 - RNA, 14 nt, Leptospira interrogans serovar lai str. 56601
uccacuuuaaaaau

SEQ ID NO: 2799518 - RNA, 16 nt, Leptospira interrogans serovar lai str. 56601
uccacuuuaaaaauga

SEQ ID NO: 2799519 - RNA, 19 nt, Leptospira interrogans serovar lai str. 56601
uccacuuuaaaaaugaucu

SEQ ID NO: 2799520 - RNA, 15 nt, Leptospira interrogans serovar lai str. 56601
uccagaaccucaaag

SEQ ID NO: 2799521 - RNA, 20 nt, Leptospira interrogans serovar lai str. 56601
uccagaaccucaaagaaauu

SEQ ID NO: 2799522 - RNA, 15 nt, Leptospira interrogans serovar lai str. 56601
uccagaagauugaaa

SEQ ID NO: 2799523 - RNA, 15 nt, Leptospira interrogans serovar lai str. 56601
uccagaauaauaauc

SEQ ID NO: 2799524 - RNA, 20 nt, Leptospira interrogans serovar lai str. 56601
uccagaauuagauuaaauuu

SEQ ID NO: 2799525 - RNA, 18 nt, Leptospira interrogans serovar lai str. 56601
uccagacgguauaaaaag

SEQ ID NO: 2799526 - RNA, 21 nt, Leptospira interrogans serovar lai str. 56601
uccagaggcaguacaauucaa

SEQ ID NO: 2799527 - RNA, 22 nt, Leptospira interrogans serovar lai str. 56601
uccagaggcaguacaauucaaa

SEQ ID NO: 2799528 - RNA, 17 nt, Leptospira interrogans serovar lai str. 56601
uccagcaccuucugaaa

SEQ ID NO: 2799529 - RNA, 21 nt, Leptospira interrogans serovar lai str. 56601
uccagcaccuucugaaaguag

SEQ ID NO: 2799530 - RNA, 14 nt, Leptospira interrogans serovar lai str. 56601
uccagcacugaucg

SEQ ID NO: 2799531 - RNA, 17 nt, Leptospira interrogans serovar lai str. 56601
uccagcauuuagaaagc

SEQ ID NO: 2799532 - RNA, 21 nt, Leptospira interrogans serovar lai str. 56601
uccagcuuuuuuaaauuuuua

SEQ ID NO: 2799533 - RNA, 22 nt, Leptospira interrogans serovar lai str. 56601
uccaguuggggggaauauacgu

SEQ ID NO: 2799534 - RNA, 16 nt, Leptospira interrogans serovar lai str. 56601
uccauaaaaaaugaau

SEQ ID NO: 2799535 - RNA, 14 nt, Leptospira interrogans serovar lai str. 56601
uccauaaaauagaa

SEQ ID NO: 2799536 - RNA, 23 nt, Leptospira interrogans serovar lai str. 56601
uccauaaaauagaaacaaaugga

SEQ ID NO: 2799537 - RNA, 16 nt, Leptospira interrogans serovar lai str. 56601
uccauaaauucuacaa

SEQ ID NO: 2799538 - RNA, 14 nt, Leptospira interrogans serovar lai str. 56601
uccauaaugaagau

SEQ ID NO: 2799539 - RNA, 19 nt, Leptospira interrogans serovar lai str. 56601
uccauagcaacaauuaaca

SEQ ID NO: 2799540 - RNA, 22 nt, Leptospira interrogans serovar lai str. 56601
uccauauacguaaaaauaauau

SEQ ID NO: 2799541 - RNA, 19 nt, Leptospira interrogans serovar lai str. 56601
uccauauagagaauuugug

SEQ ID NO: 2799542 - RNA, 17 nt, Leptospira interrogans serovar lai str. 56601
uccauaucuacaaaaga

SEQ ID NO: 2799543 - RNA, 16 nt, Leptospira interrogans serovar lai str. 56601
uccauaugaguuccca

SEQ ID NO: 2799544 - RNA, 16 nt, Leptospira interrogans serovar lai str. 56601
uccaucguuuauuuuu

SEQ ID NO: 2799545 - RNA, 21 nt, Leptospira interrogans serovar lai str. 56601
uccaucguuuauuuuucuaaa

SEQ ID NO: 2799546 - RNA, 16 nt, Leptospira interrogans serovar lai str. 56601
uccaucuuuauaucuu

SEQ ID NO: 2799547 - RNA, 20 nt, Leptospira interrogans serovar lai str. 56601
uccaucuuuuuuuucuaaaa

SEQ ID NO: 2799548 - RNA, 22 nt, Leptospira interrogans serovar lai str. 56601
uccaucuuuuuuuucuaaaaua

SEQ ID NO: 2799549 - RNA, 13 nt, Leptospira interrogans serovar lai str. 56601
uccaugaaauaga

SEQ ID NO: 2799550 - RNA, 21 nt, Leptospira interrogans serovar lai str. 56601
uccaugauucauuuuucuaaa

SEQ ID NO: 2799551 - RNA, 14 nt, Leptospira interrogans serovar lai str. 56601
uccaugauucugaa

SEQ ID NO: 2799552 - RNA, 16 nt, Leptospira interrogans serovar lai str. 56601
uccaugauucugaaaa

SEQ ID NO: 2799553 - RNA, 20 nt, Leptospira interrogans serovar lai str. 56601
uccaugauucugaaaaaagu

SEQ ID NO: 2799554 - RNA, 13 nt, Leptospira interrogans serovar lai str. 56601
uccauugauuuuc

SEQ ID NO: 2799555 - RNA, 16 nt, Leptospira interrogans serovar lai str. 56601
uccauugauuuucauu

SEQ ID NO: 2799556 - RNA, 18 nt, Leptospira interrogans serovar lai str. 56601
uccauuucuauaaauuga

SEQ ID NO: 2799557 - RNA, 16 nt, Leptospira interrogans serovar lai str. 56601
uccauuuguuucuauu

SEQ ID NO: 2799558 - RNA, 14 nt, Leptospira interrogans serovar lai str. 56601
uccauuuucauaau

SEQ ID NO: 2799559 - RNA, 12 nt, Leptospira interrogans serovar lai str. 56601
uccauuuuuccg

SEQ ID NO: 2799560 - RNA, 15 nt, Leptospira interrogans serovar lai str. 56601
uccauuuuucugaaa

SEQ ID NO: 2799561 - RNA, 14 nt, Leptospira interrogans serovar lai str. 56601
ucccaaaaacucaa

SEQ ID NO: 2799562 - RNA, 14 nt, Leptospira interrogans serovar lai str. 56601
ucccaaaaccgaau

SEQ ID NO: 2799563 - RNA, 17 nt, Leptospira interrogans serovar lai str. 56601
ucccaaaaccucaaaaa

SEQ ID NO: 2799564 - RNA, 22 nt, Leptospira interrogans serovar lai str. 56601
ucccaaaccucguacuaauucu

SEQ ID NO: 2799565 - RNA, 14 nt, Leptospira interrogans serovar lai str. 56601
ucccaaacuuucuu

SEQ ID NO: 2799566 - RNA, 14 nt, Leptospira interrogans serovar lai str. 56601
ucccaacugcugga

SEQ ID NO: 2799567 - RNA, 15 nt, Leptospira interrogans serovar lai str. 56601
ucccaauaaggagca

SEQ ID NO: 2799568 - RNA, 14 nt, Leptospira interrogans serovar lai str. 56601
ucccacaaauuaag

SEQ ID NO: 2799569 - RNA, 15 nt, Leptospira interrogans serovar lai str. 56601
ucccacaauuuugaa

SEQ ID NO: 2799570 - RNA, 19 nt, Leptospira interrogans serovar lai str. 56601
ucccacaguuugaaagucu

SEQ ID NO: 2799571 - RNA, 16 nt, Leptospira interrogans serovar lai str. 56601
ucccacauuucaaagu

SEQ ID NO: 2799572 - RNA, 22 nt, Leptospira interrogans serovar lai str. 56601
ucccacauuugugggaacucau

SEQ ID NO: 2799573 - RNA, 14 nt, Leptospira interrogans serovar lai str. 56601
ucccacauuuucaa

SEQ ID NO: 2799574 - RNA, 16 nt, Leptospira interrogans serovar lai str. 56601
ucccacauuuucaaaa

SEQ ID NO: 2799575 - RNA, 15 nt, Leptospira interrogans serovar lai str. 56601
ucccacauuuuuaaa

SEQ ID NO: 2799576 - RNA, 23 nt, Leptospira interrogans serovar lai str. 56601
ucccacauuuuuaaaaguuauua

SEQ ID NO: 2799577 - RNA, 16 nt, Leptospira interrogans serovar lai str. 56601
ucccaccuuuuuuuau

SEQ ID NO: 2799578 - RNA, 23 nt, Leptospira interrogans serovar lai str. 56601
ucccaccuuuuuuuaugaaaaaa

SEQ ID NO: 2799579 - RNA, 16 nt, Leptospira interrogans serovar lai str. 56601
ucccacuuuuaaagaa

SEQ ID NO: 2799580 - RNA, 18 nt, Leptospira interrogans serovar lai str. 56601
ucccagaaaggaacuaag

SEQ ID NO: 2799581 - RNA, 15 nt, Leptospira interrogans serovar lai str. 56601
ucccagauucccuuu

SEQ ID NO: 2799582 - RNA, 12 nt, Leptospira interrogans serovar lai str. 56601
ucccaguaaauc

SEQ ID NO: 2799583 - RNA, 14 nt, Leptospira interrogans serovar lai str. 56601
ucccaguaaaucca

SEQ ID NO: 2799584 - RNA, 15 nt, Leptospira interrogans serovar lai str. 56601
ucccaguaaauccac

SEQ ID NO: 2799585 - RNA, 21 nt, Leptospira interrogans serovar lai str. 56601
ucccaguucuuaaauaaaauu

SEQ ID NO: 2799586 - RNA, 14 nt, Leptospira interrogans serovar lai str. 56601
ucccauaaaagaac

SEQ ID NO: 2799587 - RNA, 17 nt, Leptospira interrogans serovar lai str. 56601
ucccauccgaaauccca

SEQ ID NO: 2799588 - RNA, 18 nt, Leptospira interrogans serovar lai str. 56601
ucccauccgaaaucccaa

SEQ ID NO: 2799589 - RNA, 21 nt, Leptospira interrogans serovar lai str. 56601
ucccaugauagaguucugaaa

SEQ ID NO: 2799590 - RNA, 20 nt, Leptospira interrogans serovar lai str. 56601
uccucuuucguuuuuuucau

SEQ ID NO: 2799591 - RNA, 16 nt, Leptospira interrogans serovar lai str. 56601
uccugaaaauuuuccu

SEQ ID NO: 2799592 - RNA, 17 nt, Leptospira interrogans serovar lai str. 56601
uccugaaaauuuuccuu

SEQ ID NO: 2799593 - RNA, 19 nt, Leptospira interrogans serovar lai str. 56601
uccugccuucucucgacaa

SEQ ID NO: 2799594 - RNA, 14 nt, Leptospira interrogans serovar lai str. 56601
uccugcuaacugau

SEQ ID NO: 2799595 - RNA, 20 nt, Leptospira interrogans serovar lai str. 56601
uccuuaaauauaucuucuuu

SEQ ID NO: 2799596 - RNA, 15 nt, Leptospira interrogans serovar lai str. 56601
uccuuacgaucuaaa

SEQ ID NO: 2799597 - RNA, 17 nt, Leptospira interrogans serovar lai str. 56601
uccuuacgaucuaaaag

SEQ ID NO: 2799598 - RNA, 20 nt, Leptospira interrogans serovar lai str. 56601
uccuuacgaugucuuuucaa

SEQ ID NO: 2799599 - RNA, 18 nt, Leptospira interrogans serovar lai str. 56601
uccuuacucguuuuuagu

SEQ ID NO: 2799600 - RNA, 22 nt, Leptospira interrogans serovar lai str. 56601
uccuuacucguuuuuaguuucu

SEQ ID NO: 2799601 - RNA, 17 nt, Leptospira interrogans serovar lai str. 56601
uccuuacuuaccucuau

SEQ ID NO: 2799602 - RNA, 19 nt, Leptospira interrogans serovar lai str. 56601
uccuucaaaacuaggaucu

SEQ ID NO: 2799603 - RNA, 15 nt, Leptospira interrogans serovar lai str. 56601
uccuuccgaucccaa

SEQ ID NO: 2799604 - RNA, 23 nt, Leptospira interrogans serovar lai str. 56601
uccuucggugauacugucaccgu

SEQ ID NO: 2799605 - RNA, 21 nt, Leptospira interrogans serovar lai str. 56601
uccuucuuuacaguuuuuaau

SEQ ID NO: 2799606 - RNA, 12 nt, Leptospira interrogans serovar lai str. 56601
uccuucuuuucu

SEQ ID NO: 2799607 - RNA, 14 nt, Leptospira interrogans serovar lai str. 56601
uccuugaaaaaaaa

SEQ ID NO: 2799608 - RNA, 17 nt, Leptospira interrogans serovar lai str. 56601
uccuugaaaaaaaacag

SEQ ID NO: 2799609 - RNA, 16 nt, Leptospira interrogans serovar lai str. 56601
uccuugggauaaauau

SEQ ID NO: 2799610 - RNA, 19 nt, Leptospira interrogans serovar lai str. 56601
uccuugggauaaauauucu

SEQ ID NO: 2799611 - RNA, 23 nt, Leptospira interrogans serovar lai str. 56601
uccuugggauaaauauucucuau

SEQ ID NO: 2799612 - RNA, 17 nt, Leptospira interrogans serovar lai str. 56601
uccuuuaaacuuagauu

SEQ ID NO: 2799613 - RNA, 13 nt, Leptospira interrogans serovar lai str. 56601
uccuuucaagaau

SEQ ID NO: 2799614 - RNA, 20 nt, Leptospira interrogans serovar lai str. 56601
uccuuucaucucuauaaauu

SEQ ID NO: 2799615 - RNA, 17 nt, Leptospira interrogans serovar lai str. 56601
uccuuuccgauuucuuu

SEQ ID NO: 2799616 - RNA, 15 nt, Leptospira interrogans serovar lai str. 56601
uccuuuccuugaaaa

SEQ ID NO: 2799617 - RNA, 20 nt, Leptospira interrogans serovar lai str. 56601
uccuuucgacuuuaguucuc

SEQ ID NO: 2799618 - RNA, 13 nt, Leptospira interrogans serovar lai str. 56601
uccuuuuaagaau

SEQ ID NO: 2799619 - RNA, 22 nt, Leptospira interrogans serovar lai str. 56601
uccuuuuacuucguuauaauuu

SEQ ID NO: 2799620 - RNA, 21 nt, Leptospira interrogans serovar lai str. 56601
uccuuuucgaauuuccuuuug

SEQ ID NO: 2799621 - RNA, 14 nt, Leptospira interrogans serovar lai str. 56601
uccuuuucuuauaa

SEQ ID NO: 2799622 - RNA, 16 nt, Leptospira interrogans serovar lai str. 56601
uccuuuucuugguuca

SEQ ID NO: 2799623 - RNA, 17 nt, Leptospira interrogans serovar lai str. 56601
uccuuuucuuuuuuaaa

SEQ ID NO: 2799624 - RNA, 20 nt, Leptospira interrogans serovar lai str. 56601
uccuuuugagcacaauauau

SEQ ID NO: 2799625 - RNA, 15 nt, Leptospira interrogans serovar lai str. 56601
uccuuuuguuuuucu

SEQ ID NO: 2799626 - RNA, 12 nt, Leptospira interrogans serovar lai str. 56601
uccuuuuucauu

SEQ ID NO: 2799627 - RNA, 19 nt, Leptospira interrogans serovar lai str. 56601
uccuuuuuguaaggauucc

SEQ ID NO: 2799628 - RNA, 15 nt, Leptospira interrogans serovar lai str. 56601
uccuuuuuuacugau

SEQ ID NO: 2799629 - RNA, 12 nt, Leptospira interrogans serovar lai str. 56601
ucgaaaaaacaa

SEQ ID NO: 2799630 - RNA, 14 nt, Leptospira interrogans serovar lai str. 56601
ucgaaaaaacaaau

SEQ ID NO: 2799631 - RNA, 17 nt, Leptospira interrogans serovar lai str. 56601
ucgaaaacgauuuuuca

SEQ ID NO: 2799632 - RNA, 18 nt, Leptospira interrogans serovar lai str. 56601
ucgaaaacgauuuuucaa

SEQ ID NO: 2799633 - RNA, 13 nt, Leptospira interrogans serovar lai str. 56601
ucgaaaagaaaua

SEQ ID NO: 2799634 - RNA, 21 nt, Leptospira interrogans serovar lai str. 56601
ucgaaaagaaauauuaaaaaa

SEQ ID NO: 2799635 - RNA, 23 nt, Leptospira interrogans serovar lai str. 56601
ucgaaaagaaauauuaaaaaaau

SEQ ID NO: 2799636 - RNA, 17 nt, Leptospira interrogans serovar lai str. 56601
ucgaaaaucucagaaaa

SEQ ID NO: 2799637 - RNA, 21 nt, Leptospira interrogans serovar lai str. 56601
ucgaaacccaaaaauguagua

SEQ ID NO: 2799638 - RNA, 15 nt, Leptospira interrogans serovar lai str. 56601
ucgaaacuauaacgg

SEQ ID NO: 2799639 - RNA, 16 nt, Leptospira interrogans serovar lai str. 56601
ucgaaagaauuuuugg

SEQ ID NO: 2799640 - RNA, 15 nt, Leptospira interrogans serovar lai str. 56601
ucgaaagauuuuuca

SEQ ID NO: 2799641 - RNA, 16 nt, Leptospira interrogans serovar lai str. 56601
ucgaaagauuuuucau

SEQ ID NO: 2799642 - RNA, 17 nt, Leptospira interrogans serovar lai str. 56601
ucgaaagauuuuucauu

SEQ ID NO: 2799643 - RNA, 21 nt, Leptospira interrogans serovar lai str. 56601
ucgaaaguuuacaaauuggca

SEQ ID NO: 2799644 - RNA, 17 nt, Leptospira interrogans serovar lai str. 56601
ucgaaaguuuaccacga

SEQ ID NO: 2799645 - RNA, 15 nt, Leptospira interrogans serovar lai str. 56601
ucgaaauaucguucu

SEQ ID NO: 2799646 - RNA, 14 nt, Leptospira interrogans serovar lai str. 56601
ucgaaaucugaccu

SEQ ID NO: 2799647 - RNA, 19 nt, Leptospira interrogans serovar lai str. 56601
ucgaaauuaaaauaaaggc

SEQ ID NO: 2799648 - RNA, 19 nt, Leptospira interrogans serovar lai str. 56601
ucgaacgcaugaaaauaau

SEQ ID NO: 2799649 - RNA, 15 nt, Leptospira interrogans serovar lai str. 56601
ucgaacguauaaaaa

SEQ ID NO: 2799650 - RNA, 19 nt, Leptospira interrogans serovar lai str. 56601
ucgaacguauaaaaacggu

SEQ ID NO: 2799651 - RNA, 12 nt, Leptospira interrogans serovar lai str. 56601
ucgaacuaccca

SEQ ID NO: 2799652 - RNA, 15 nt, Leptospira interrogans serovar lai str. 56601
ucgaacuacccaaaa

SEQ ID NO: 2799653 - RNA, 22 nt, Leptospira interrogans serovar lai str. 56601
ucgaacuucguuggaaaguuuu

SEQ ID NO: 2799654 - RNA, 17 nt, Leptospira interrogans serovar lai str. 56601
ucgaacuuuuuuuagaa

SEQ ID NO: 2799655 - RNA, 18 nt, Leptospira interrogans serovar lai str. 56601
ucgaacuuuuuuuagaau

SEQ ID NO: 2799656 - RNA, 20 nt, Leptospira interrogans serovar lai str. 56601
ucgaagucacguauuccaag

SEQ ID NO: 2799657 - RNA, 12 nt, Leptospira interrogans serovar lai str. 56601
ucgaauaagaaa

SEQ ID NO: 2799658 - RNA, 14 nt, Leptospira interrogans serovar lai str. 56601
ucgaauaagaaauu

SEQ ID NO: 2799659 - RNA, 16 nt, Leptospira interrogans serovar lai str. 56601
ucgaauaagaaauuca

SEQ ID NO: 2799660 - RNA, 16 nt, Leptospira interrogans serovar lai str. 56601
ucgaauacauuuaaac

SEQ ID NO: 2799661 - RNA, 20 nt, Leptospira interrogans serovar lai str. 56601
ucgaauacauuuaaacuuuu

SEQ ID NO: 2799662 - RNA, 19 nt, Leptospira interrogans serovar lai str. 56601
ucgaauacgacagauucaa

SEQ ID NO: 2799663 - RNA, 15 nt, Leptospira interrogans serovar lai str. 56601
ucgaaucauuuugua

SEQ ID NO: 2799664 - RNA, 21 nt, Leptospira interrogans serovar lai str. 56601
ucgaaucgcuaaacuaucuau

SEQ ID NO: 2799665 - RNA, 22 nt, Leptospira interrogans serovar lai str. 56601
ucgaaucgcuaaacuaucuauu

SEQ ID NO: 2799666 - RNA, 22 nt, Leptospira interrogans serovar lai str. 56601
ucgaaucggguuugucuucgau

SEQ ID NO: 2799667 - RNA, 16 nt, Leptospira interrogans serovar lai str. 56601
ucgaauggaaaucuuu

SEQ ID NO: 2799668 - RNA, 18 nt, Leptospira interrogans serovar lai str. 56601
ucgaauggaaaucuuuua

SEQ ID NO: 2799669 - RNA, 19 nt, Leptospira interrogans serovar lai str. 56601
ucgaauuguauccgaaaaa

SEQ ID NO: 2799670 - RNA, 15 nt, Leptospira interrogans serovar lai str. 56601
ucgaauuuuaguucu

SEQ ID NO: 2799671 - RNA, 17 nt, Leptospira interrogans serovar lai str. 56601
ucgaauuuuuucacaaa

SEQ ID NO: 2799672 - RNA, 18 nt, Leptospira interrogans serovar lai str. 56601
ucgacagguuuuggaaca

SEQ ID NO: 2799673 - RNA, 20 nt, Leptospira interrogans serovar lai str. 56601
ucguauaacgaaacuuuaau

SEQ ID NO: 2799674 - RNA, 17 nt, Leptospira interrogans serovar lai str. 56601
ucguaucuaaagacuaa

SEQ ID NO: 2799675 - RNA, 18 nt, Leptospira interrogans serovar lai str. 56601
ucguauucggaaauuuga

SEQ ID NO: 2799676 - RNA, 16 nt, Leptospira interrogans serovar lai str. 56601
ucguauugaauuuuuu

SEQ ID NO: 2799677 - RNA, 19 nt, Leptospira interrogans serovar lai str. 56601
ucguauuuuagaaauauug

SEQ ID NO: 2799678 - RNA, 16 nt, Leptospira interrogans serovar lai str. 56601
ucgucuauaaauucau

SEQ ID NO: 2799679 - RNA, 20 nt, Leptospira interrogans serovar lai str. 56601
ucgucuaucuuuuuuaaaac

SEQ ID NO: 2799680 - RNA, 14 nt, Leptospira interrogans serovar lai str. 56601
ucgucucaaaaaua

SEQ ID NO: 2799681 - RNA, 14 nt, Leptospira interrogans serovar lai str. 56601
ucgucuucuuuuuu

SEQ ID NO: 2799682 - RNA, 13 nt, Leptospira interrogans serovar lai str. 56601
ucgucuuuauaaa

SEQ ID NO: 2799683 - RNA, 14 nt, Leptospira interrogans serovar lai str. 56601
ucgucuuuauaaag

SEQ ID NO: 2799684 - RNA, 23 nt, Leptospira interrogans serovar lai str. 56601
ucgugauuugugggaguuuucac

SEQ ID NO: 2799685 - RNA, 13 nt, Leptospira interrogans serovar lai str. 56601
ucguguucuaaau

SEQ ID NO: 2799686 - RNA, 16 nt, Leptospira interrogans serovar lai str. 56601
ucguguuguauggaaa

SEQ ID NO: 2799687 - RNA, 12 nt, Leptospira interrogans serovar lai str. 56601
ucguuaaauuuu

SEQ ID NO: 2799688 - RNA, 21 nt, Leptospira interrogans serovar lai str. 56601
ucguuagaagacaaugcgauu

SEQ ID NO: 2799689 - RNA, 17 nt, Leptospira interrogans serovar lai str. 56601
ucguucaacuuuccuuu

SEQ ID NO: 2799690 - RNA, 17 nt, Leptospira interrogans serovar lai str. 56601
ucguucgacaauuguaa

SEQ ID NO: 2799691 - RNA, 15 nt, Leptospira interrogans serovar lai str. 56601
ucguucggaaaaaau

SEQ ID NO: 2799692 - RNA, 19 nt, Leptospira interrogans serovar lai str. 56601
ucguucuuuuuuccuucuu

SEQ ID NO: 2799693 - RNA, 19 nt, Leptospira interrogans serovar lai str. 56601
ucguuggccucgaaaguuu

SEQ ID NO: 2799694 - RNA, 12 nt, Leptospira interrogans serovar lai str. 56601
ucguuuaaaaaa

SEQ ID NO: 2799695 - RNA, 14 nt, Leptospira interrogans serovar lai str. 56601
ucguuuaagaauuu

SEQ ID NO: 2799696 - RNA, 21 nt, Leptospira interrogans serovar lai str. 56601
ucguuuaagaauuuuaaaaaa

SEQ ID NO: 2799697 - RNA, 17 nt, Leptospira interrogans serovar lai str. 56601
ucguuucguacauaaau

SEQ ID NO: 2799698 - RNA, 21 nt, Leptospira interrogans serovar lai str. 56601
ucguuugcuuuucuaucaaaa

SEQ ID NO: 2799699 - RNA, 13 nt, Leptospira interrogans serovar lai str. 56601
ucguuuguaaaau

SEQ ID NO: 2799700 - RNA, 12 nt, Leptospira interrogans serovar lai str. 56601
ucguuuuaaaaa

SEQ ID NO: 2799701 - RNA, 13 nt, Leptospira interrogans serovar lai str. 56601
ucguuuuaaaaac

SEQ ID NO: 2799702 - RNA, 11 nt, Leptospira interrogans serovar lai str. 56601
ucguuuuacuu

SEQ ID NO: 2799703 - RNA, 15 nt, Leptospira interrogans serovar lai str. 56601
ucguuuuaucuuaga

SEQ ID NO: 2799704 - RNA, 16 nt, Leptospira interrogans serovar lai str. 56601
ucguuuuuaguuucaa

SEQ ID NO: 2799705 - RNA, 12 nt, Leptospira interrogans serovar lai str. 56601
ucguuuuuuaaa

SEQ ID NO: 2799706 - RNA, 14 nt, Leptospira interrogans serovar lai str. 56601
ucguuuuuuaaaau

SEQ ID NO: 2799707 - RNA, 22 nt, Leptospira interrogans serovar lai str. 56601
ucguuuuuuagaaacuaaaaaa

SEQ ID NO: 2799708 - RNA, 13 nt, Leptospira interrogans serovar lai str. 56601
ucguuuuuuucau

SEQ ID NO: 2799709 - RNA, 18 nt, Leptospira interrogans serovar lai str. 56601
ucguuuuuuucaugaaaa

SEQ ID NO: 2799710 - RNA, 17 nt, Leptospira interrogans serovar lai str. 56601
ucuaaaaacaacucagc

SEQ ID NO: 2799711 - RNA, 18 nt, Leptospira interrogans serovar lai str. 56601
ucuaaaaacaacucagca

SEQ ID NO: 2799712 - RNA, 22 nt, Leptospira interrogans serovar lai str. 56601
ucuaaaaaugaaaucuacaaaa

SEQ ID NO: 2799713 - RNA, 10 nt, Leptospira interrogans serovar lai str. 56601
ucuaaaaauu

SEQ ID NO: 2799714 - RNA, 22 nt, Leptospira interrogans serovar lai str. 56601
ucuaaaaauuuccggaaaacga

SEQ ID NO: 2799715 - RNA, 20 nt, Leptospira interrogans serovar lai str. 56601
ucuaaaacacaucuuaaaaa

SEQ ID NO: 2799716 - RNA, 21 nt, Leptospira interrogans serovar lai str. 56601
ucuaaaaccuggauuugucuc

SEQ ID NO: 2799717 - RNA, 17 nt, Leptospira interrogans serovar lai str. 56601
ucuaaaagaagaugcuu

SEQ ID NO: 2799718 - RNA, 13 nt, Leptospira interrogans serovar lai str. 56601
ucuaaaaguaaaa

SEQ ID NO: 2799719 - RNA, 20 nt, Leptospira interrogans serovar lai str. 56601
ucuaaaaguaugaacucuua

SEQ ID NO: 2799720 - RNA, 12 nt, Leptospira interrogans serovar lai str. 56601
ucuaaaauugua

SEQ ID NO: 2799721 - RNA, 23 nt, Leptospira interrogans serovar lai str. 56601
ucuaaaauuguagaaacuuauac

SEQ ID NO: 2799722 - RNA, 20 nt, Leptospira interrogans serovar lai str. 56601
ucuaaaauuguaggaacuac

SEQ ID NO: 2799723 - RNA, 20 nt, Leptospira interrogans serovar lai str. 56601
ucuaaacauuuaacuuuuau

SEQ ID NO: 2799724 - RNA, 14 nt, Leptospira interrogans serovar lai str. 56601
ucuaaacuaaaaaa

SEQ ID NO: 2799725 - RNA, 12 nt, Leptospira interrogans serovar lai str. 56601
ucuaaacucuau

SEQ ID NO: 2799726 - RNA, 19 nt, Leptospira interrogans serovar lai str. 56601
ucuaaacuuugcaaaucga

SEQ ID NO: 2799727 - RNA, 16 nt, Leptospira interrogans serovar lai str. 56601
ucuaaagaauuaucau

SEQ ID NO: 2799728 - RNA, 15 nt, Leptospira interrogans serovar lai str. 56601
ucuaaaucugaauuu

SEQ ID NO: 2799729 - RNA, 16 nt, Leptospira interrogans serovar lai str. 56601
ucuaaaucuuaggaac

SEQ ID NO: 2799730 - RNA, 18 nt, Leptospira interrogans serovar lai str. 56601
ucuaaaugacuugcauuu

SEQ ID NO: 2799731 - RNA, 22 nt, Leptospira interrogans serovar lai str. 56601
ucuaaaugacuugcauuuaaua

SEQ ID NO: 2799732 - RNA, 21 nt, Leptospira interrogans serovar lai str. 56601
ucuaaauuaauauuuauaaaa

SEQ ID NO: 2799733 - RNA, 19 nt, Leptospira interrogans serovar lai str. 56601
ucuaaauucagaaaaaaaa

SEQ ID NO: 2799734 - RNA, 12 nt, Leptospira interrogans serovar lai str. 56601
ucuaaauuuguu

SEQ ID NO: 2799735 - RNA, 16 nt, Leptospira interrogans serovar lai str. 56601
ucuaaauuuuacaauu

SEQ ID NO: 2799736 - RNA, 17 nt, Leptospira interrogans serovar lai str. 56601
ucuaaauuuuauaaaau

SEQ ID NO: 2799737 - RNA, 14 nt, Leptospira interrogans serovar lai str. 56601
ucuaaauuuucuuu

SEQ ID NO: 2799738 - RNA, 22 nt, Leptospira interrogans serovar lai str. 56601
ucuaacaaaaaguguuuauaau

SEQ ID NO: 2799739 - RNA, 13 nt, Leptospira interrogans serovar lai str. 56601
ucuaacauuuuau

SEQ ID NO: 2799740 - RNA, 20 nt, Leptospira interrogans serovar lai str. 56601
ucuaacauuuuauuauaaau

SEQ ID NO: 2799741 - RNA, 20 nt, Leptospira interrogans serovar lai str. 56601
ucuaacugguuuuucuuuaa

SEQ ID NO: 2799742 - RNA, 21 nt, Leptospira interrogans serovar lai str. 56601
ucuaacugguuuuucuuuaau

SEQ ID NO: 2799743 - RNA, 23 nt, Leptospira interrogans serovar lai str. 56601
ucuaagaguagaguaagaaacau

SEQ ID NO: 2799744 - RNA, 16 nt, Leptospira interrogans serovar lai str. 56601
ucuaagaucaacacaa

SEQ ID NO: 2799745 - RNA, 17 nt, Leptospira interrogans serovar lai str. 56601
ucuaagauccaaauuuu

SEQ ID NO: 2799746 - RNA, 19 nt, Leptospira interrogans serovar lai str. 56601
ucuaagcuuuagaaaauaa

SEQ ID NO: 2799747 - RNA, 16 nt, Leptospira interrogans serovar lai str. 56601
ucuaaguaauuuaaaa

SEQ ID NO: 2799748 - RNA, 19 nt, Leptospira interrogans serovar lai str. 56601
ucuaaguaauuuaaaaaaa

SEQ ID NO: 2799749 - RNA, 16 nt, Leptospira interrogans serovar lai str. 56601
ucuaaguccacccaaa

SEQ ID NO: 2799750 - RNA, 22 nt, Leptospira interrogans serovar lai str. 56601
ucuaaguccacccaaaccggag

SEQ ID NO: 2799751 - RNA, 13 nt, Leptospira interrogans serovar lai str. 56601
ucuaaguccuuuu

SEQ ID NO: 2799752 - RNA, 15 nt, Leptospira interrogans serovar lai str. 56601
ucuaaguccuuuucu

SEQ ID NO: 2799753 - RNA, 17 nt, Leptospira interrogans serovar lai str. 56601
ucuaaguguaaaauuaa

SEQ ID NO: 2799754 - RNA, 17 nt, Leptospira interrogans serovar lai str. 56601
ucuaaguuuuuaaauaa

SEQ ID NO: 2799755 - RNA, 22 nt, Leptospira interrogans serovar lai str. 56601
ucuaaguuuuuaaauaagcuaa

SEQ ID NO: 2799756 - RNA, 16 nt, Leptospira interrogans serovar lai str. 56601
ucuaucagaaaaacau

SEQ ID NO: 2799757 - RNA, 14 nt, Leptospira interrogans serovar lai str. 56601
ucuauccacuaaaa

SEQ ID NO: 2799758 - RNA, 16 nt, Leptospira interrogans serovar lai str. 56601
ucuauccauucuagaa

SEQ ID NO: 2799759 - RNA, 21 nt, Leptospira interrogans serovar lai str. 56601
ucuaucguuagguuauaauuu

SEQ ID NO: 2799760 - RNA, 15 nt, Leptospira interrogans serovar lai str. 56601
ucuaugauuaaagcc

SEQ ID NO: 2799761 - RNA, 13 nt, Leptospira interrogans serovar lai str. 56601
ucuauggaauuuu

SEQ ID NO: 2799762 - RNA, 19 nt, Leptospira interrogans serovar lai str. 56601
ucuauguaagaaaaucugg

SEQ ID NO: 2799763 - RNA, 20 nt, Leptospira interrogans serovar lai str. 56601
ucuaugugcgguuacguguu

SEQ ID NO: 2799764 - RNA, 17 nt, Leptospira interrogans serovar lai str. 56601
ucuauguuauagacaac

SEQ ID NO: 2799765 - RNA, 16 nt, Leptospira interrogans serovar lai str. 56601
ucuauuacaaaacuua

SEQ ID NO: 2799766 - RNA, 13 nt, Leptospira interrogans serovar lai str. 56601
ucuauuagaacau

SEQ ID NO: 2799767 - RNA, 13 nt, Leptospira interrogans serovar lai str. 56601
ucuauuaugauuc

SEQ ID NO: 2799768 - RNA, 17 nt, Leptospira interrogans serovar lai str. 56601
ucuauuaugauucuaua

SEQ ID NO: 2799769 - RNA, 12 nt, Leptospira interrogans serovar lai str. 56601
ucuauucauaac

SEQ ID NO: 2799770 - RNA, 14 nt, Leptospira interrogans serovar lai str. 56601
ucuauuccaaugua

SEQ ID NO: 2799771 - RNA, 20 nt, Leptospira interrogans serovar lai str. 56601
ucuauuccuaaaauguggga

SEQ ID NO: 2799772 - RNA, 22 nt, Leptospira interrogans serovar lai str. 56601
ucuauugaguuauaaacauuaa

SEQ ID NO: 2799773 - RNA, 22 nt, Leptospira interrogans serovar lai str. 56601
ucuauugguucuauauauuaga

SEQ ID NO: 2799774 - RNA, 14 nt, Leptospira interrogans serovar lai str. 56601
ucuauuguaauaaa

SEQ ID NO: 2799775 - RNA, 15 nt, Leptospira interrogans serovar lai str. 56601
ucuauuguaauaaau

SEQ ID NO: 2799776 - RNA, 17 nt, Leptospira interrogans serovar lai str. 56601
ucuauuguaauaaaucg

SEQ ID NO: 2799777 - RNA, 19 nt, Leptospira interrogans serovar lai str. 56601
ucuauugucucaaaauuaa

SEQ ID NO: 2799778 - RNA, 18 nt, Leptospira interrogans serovar lai str. 56601
ucuauuuaaguacuuaau

SEQ ID NO: 2799779 - RNA, 14 nt, Leptospira interrogans serovar lai str. 56601
ucuauuucccaaaa

SEQ ID NO: 2799780 - RNA, 20 nt, Leptospira interrogans serovar lai str. 56601
ucuauuuccguuauauuaaa

SEQ ID NO: 2799781 - RNA, 13 nt, Leptospira interrogans serovar lai str. 56601
ucuauuucuaaac

SEQ ID NO: 2799782 - RNA, 16 nt, Leptospira interrogans serovar lai str. 56601
ucuauuuuaauauauu

SEQ ID NO: 2799783 - RNA, 18 nt, Leptospira interrogans serovar lai str. 56601
ucuauuuuauguaaaucg

SEQ ID NO: 2799784 - RNA, 18 nt, Leptospira interrogans serovar lai str. 56601
ucuauuuuauugauucua

SEQ ID NO: 2799785 - RNA, 19 nt, Leptospira interrogans serovar lai str. 56601
ucuauuuucuuugaaaaaa

SEQ ID NO: 2799786 - RNA, 21 nt, Leptospira interrogans serovar lai str. 56601
ucuauuuugagaaaauccagu

SEQ ID NO: 2799787 - RNA, 21 nt, Leptospira interrogans serovar lai str. 56601
ucuauuuuguuuuauagaaac

SEQ ID NO: 2799788 - RNA, 18 nt, Leptospira interrogans serovar lai str. 56601
ucucaaaaaaugcauuca

SEQ ID NO: 2799789 - RNA, 21 nt, Leptospira interrogans serovar lai str. 56601
ucucaaaaacacuuuaucuuu

SEQ ID NO: 2799790 - RNA, 11 nt, Leptospira interrogans serovar lai str. 56601
ucucaaaaaua

SEQ ID NO: 2799791 - RNA, 14 nt, Leptospira interrogans serovar lai str. 56601
ucucaaaaauacuu

SEQ ID NO: 2799792 - RNA, 12 nt, Leptospira interrogans serovar lai str. 56601
ucucaaaaauau

SEQ ID NO: 2799793 - RNA, 21 nt, Leptospira interrogans serovar lai str. 56601
ucucaaaaccuguaaaugaau

SEQ ID NO: 2799794 - RNA, 16 nt, Leptospira interrogans serovar lai str. 56601
ucucaaaacuuaaaaa

SEQ ID NO: 2799795 - RNA, 18 nt, Leptospira interrogans serovar lai str. 56601
ucucaaaacuuaaaaaug

SEQ ID NO: 2799796 - RNA, 20 nt, Leptospira interrogans serovar lai str. 56601
ucucaaaaucuuaauaaaau

SEQ ID NO: 2799797 - RNA, 14 nt, Leptospira interrogans serovar lai str. 56601
ucucaaaauuuaag

SEQ ID NO: 2799798 - RNA, 14 nt, Leptospira interrogans serovar lai str. 56601
ucucaaauucuuca

SEQ ID NO: 2799799 - RNA, 20 nt, Leptospira interrogans serovar lai str. 56601
ucucaagauuuaauuuagaa

SEQ ID NO: 2799800 - RNA, 14 nt, Leptospira interrogans serovar lai str. 56601
ucucacaaaucaug

SEQ ID NO: 2799801 - RNA, 14 nt, Leptospira interrogans serovar lai str. 56601
ucucacuucuugaa

SEQ ID NO: 2799802 - RNA, 15 nt, Leptospira interrogans serovar lai str. 56601
ucucagccaaaaguu

SEQ ID NO: 2799803 - RNA, 22 nt, Leptospira interrogans serovar lai str. 56601
ucucagcucuggucaaguuauu

SEQ ID NO: 2799804 - RNA, 15 nt, Leptospira interrogans serovar lai str. 56601
ucucaucaaaaaaau

SEQ ID NO: 2799805 - RNA, 21 nt, Leptospira interrogans serovar lai str. 56601
ucucauuaccaauugauaauu

SEQ ID NO: 2799806 - RNA, 19 nt, Leptospira interrogans serovar lai str. 56601
ucucauuagaguuauugaa

SEQ ID NO: 2799807 - RNA, 16 nt, Leptospira interrogans serovar lai str. 56601
ucucauuggauucuau

SEQ ID NO: 2799808 - RNA, 12 nt, Leptospira interrogans serovar lai str. 56601
ucucauuuagag

SEQ ID NO: 2799809 - RNA, 12 nt, Leptospira interrogans serovar lai str. 56601
ucucauuucaaa

SEQ ID NO: 2799810 - RNA, 23 nt, Leptospira interrogans serovar lai str. 56601
ucucauuucaaauuuauaguuuu

SEQ ID NO: 2799811 - RNA, 14 nt, Leptospira interrogans serovar lai str. 56601
ucuccacuuaaaaa

SEQ ID NO: 2799812 - RNA, 16 nt, Leptospira interrogans serovar lai str. 56601
ucuccagcauuuagaa

SEQ ID NO: 2799813 - RNA, 17 nt, Leptospira interrogans serovar lai str. 56601
ucuccaucuguuucuau

SEQ ID NO: 2799814 - RNA, 18 nt, Leptospira interrogans serovar lai str. 56601
ucuccaucuguuucuauu

SEQ ID NO: 2799815 - RNA, 21 nt, Leptospira interrogans serovar lai str. 56601
ucuccaucuuuuuuuucuaaa

SEQ ID NO: 2799816 - RNA, 22 nt, Leptospira interrogans serovar lai str. 56601
ucuccaucuuuuuuuucuaaaa

SEQ ID NO: 2799817 - RNA, 22 nt, Leptospira interrogans serovar lai str. 56601
ucuccauuauaguuuuuucaaa

SEQ ID NO: 2799818 - RNA, 17 nt, Leptospira interrogans serovar lai str. 56601
ucuccauuuguuucuau

SEQ ID NO: 2799819 - RNA, 19 nt, Leptospira interrogans serovar lai str. 56601
ucucccuuaccuccuuuuu

SEQ ID NO: 2799820 - RNA, 20 nt, Leptospira interrogans serovar lai str. 56601
ucuccgauuugguuuucauu

SEQ ID NO: 2799821 - RNA, 20 nt, Leptospira interrogans serovar lai str. 56601
ucuccggcgaccuuucuaaa

SEQ ID NO: 2799822 - RNA, 16 nt, Leptospira interrogans serovar lai str. 56601
ucuccuaaaauaaaau

SEQ ID NO: 2799823 - RNA, 17 nt, Leptospira interrogans serovar lai str. 56601
ucuccuauguuucuugu

SEQ ID NO: 2799824 - RNA, 15 nt, Leptospira interrogans serovar lai str. 56601
ucuccuccugaaaau

SEQ ID NO: 2799825 - RNA, 22 nt, Leptospira interrogans serovar lai str. 56601
ucuccuccugaaaauuuuccuu

SEQ ID NO: 2799826 - RNA, 17 nt, Leptospira interrogans serovar lai str. 56601
ucuccugcauccacaaa

SEQ ID NO: 2799827 - RNA, 23 nt, Leptospira interrogans serovar lai str. 56601
ucuccuuagaaagcgugacuaaa

SEQ ID NO: 2799828 - RNA, 18 nt, Leptospira interrogans serovar lai str. 56601
ucucgaaaaucucagaaa

SEQ ID NO: 2799829 - RNA, 23 nt, Leptospira interrogans serovar lai str. 56601
ucucgaaaaucucagaaaauuuu

SEQ ID NO: 2799830 - RNA, 21 nt, Leptospira interrogans serovar lai str. 56601
ucucgaaauaucguucuagaa

SEQ ID NO: 2799831 - RNA, 18 nt, Leptospira interrogans serovar lai str. 56601
ucucgaacuacccaaaac

SEQ ID NO: 2799832 - RNA, 17 nt, Leptospira interrogans serovar lai str. 56601
ucucgauuucuaaaaug

SEQ ID NO: 2799833 - RNA, 22 nt, Leptospira interrogans serovar lai str. 56601
ucucgcaacggauuccuccagu

SEQ ID NO: 2799834 - RNA, 15 nt, Leptospira interrogans serovar lai str. 56601
ucucgcauuuuccuu

SEQ ID NO: 2799835 - RNA, 22 nt, Leptospira interrogans serovar lai str. 56601
ucucggaauauuuuuuccaaaa

SEQ ID NO: 2799836 - RNA, 17 nt, Leptospira interrogans serovar lai str. 56601
ucucguaauaucuaaaa

SEQ ID NO: 2799837 - RNA, 16 nt, Leptospira interrogans serovar lai str. 56601
ucucguuuuuuuacga

SEQ ID NO: 2799838 - RNA, 21 nt, Leptospira interrogans serovar lai str. 56601
ucucuaaaucuuuaagagccu

SEQ ID NO: 2799839 - RNA, 14 nt, Leptospira interrogans serovar lai str. 56601
ucuuaaaaacucua

SEQ ID NO: 2799840 - RNA, 15 nt, Leptospira interrogans serovar lai str. 56601
ucuuaaaaacuugaa

SEQ ID NO: 2799841 - RNA, 16 nt, Leptospira interrogans serovar lai str. 56601
ucuuaaaaacuugaau

SEQ ID NO: 2799842 - RNA, 14 nt, Leptospira interrogans serovar lai str. 56601
ucuuaaaaagagua

SEQ ID NO: 2799843 - RNA, 13 nt, Leptospira interrogans serovar lai str. 56601
ucuuaaaaauuua

SEQ ID NO: 2799844 - RNA, 12 nt, Leptospira interrogans serovar lai str. 56601
ucuuaaaagauu

SEQ ID NO: 2799845 - RNA, 15 nt, Leptospira interrogans serovar lai str. 56601
ucuuaaaaugauuuu

SEQ ID NO: 2799846 - RNA, 21 nt, Leptospira interrogans serovar lai str. 56601
ucuuaaaaugauuuugccguu

SEQ ID NO: 2799847 - RNA, 21 nt, Leptospira interrogans serovar lai str. 56601
ucuuaaaauuccgaauucuaa

SEQ ID NO: 2799848 - RNA, 22 nt, Leptospira interrogans serovar lai str. 56601
ucuuaaaauuccgaauucuaaa

SEQ ID NO: 2799849 - RNA, 13 nt, Leptospira interrogans serovar lai str. 56601
ucuuaaaauuuag

SEQ ID NO: 2799850 - RNA, 15 nt, Leptospira interrogans serovar lai str. 56601
ucuuaaaauuuagaa

SEQ ID NO: 2799851 - RNA, 20 nt, Leptospira interrogans serovar lai str. 56601
ucuuaaauaucgaauuucuu

SEQ ID NO: 2799852 - RNA, 22 nt, Leptospira interrogans serovar lai str. 56601
ucuuaaaucuuagauucacuuu

SEQ ID NO: 2799853 - RNA, 12 nt, Leptospira interrogans serovar lai str. 56601
ucuuaaauuaac

SEQ ID NO: 2799854 - RNA, 14 nt, Leptospira interrogans serovar lai str. 56601
ucuuaaauucuaau

SEQ ID NO: 2799855 - RNA, 15 nt, Leptospira interrogans serovar lai str. 56601
ucuuaacuuuaagca

SEQ ID NO: 2799856 - RNA, 15 nt, Leptospira interrogans serovar lai str. 56601
ucuuaauaaaauuuu

SEQ ID NO: 2799857 - RNA, 16 nt, Leptospira interrogans serovar lai str. 56601
ucuuaauauaauaauu

SEQ ID NO: 2799858 - RNA, 23 nt, Leptospira interrogans serovar lai str. 56601
ucuuaauggaucaaaagaguuuu

SEQ ID NO: 2799859 - RNA, 22 nt, Leptospira interrogans serovar lai str. 56601
ucuuaauguaaaguucuuuucu

SEQ ID NO: 2799860 - RNA, 14 nt, Leptospira interrogans serovar lai str. 56601
ucuuaauuaaaaaa

SEQ ID NO: 2799861 - RNA, 21 nt, Leptospira interrogans serovar lai str. 56601
ucuuaauuuguaagaguucca

SEQ ID NO: 2799862 - RNA, 15 nt, Leptospira interrogans serovar lai str. 56601
ucuuacaacuuuuga

SEQ ID NO: 2799863 - RNA, 15 nt, Leptospira interrogans serovar lai str. 56601
ucuuacaauuuuaga

SEQ ID NO: 2799864 - RNA, 13 nt, Leptospira interrogans serovar lai str. 56601
ucuuacuccaucu

SEQ ID NO: 2799865 - RNA, 22 nt, Leptospira interrogans serovar lai str. 56601
ucuuacuuugagaaaauuuuuu

SEQ ID NO: 2799866 - RNA, 12 nt, Leptospira interrogans serovar lai str. 56601
ucuuacuuuuug

SEQ ID NO: 2799867 - RNA, 19 nt, Leptospira interrogans serovar lai str. 56601
ucuuagaaaaccauuuugu

SEQ ID NO: 2799868 - RNA, 19 nt, Leptospira interrogans serovar lai str. 56601
ucuuagaguuguccuaaaa

SEQ ID NO: 2799869 - RNA, 21 nt, Leptospira interrogans serovar lai str. 56601
ucuuagccccaguaaauaaac

SEQ ID NO: 2799870 - RNA, 14 nt, Leptospira interrogans serovar lai str. 56601
ucuuagucuaaaaa

SEQ ID NO: 2799871 - RNA, 18 nt, Leptospira interrogans serovar lai str. 56601
ucuuauaagaaucgauuc

SEQ ID NO: 2799872 - RNA, 15 nt, Leptospira interrogans serovar lai str. 56601
ucuuauacucuuaaa

SEQ ID NO: 2799873 - RNA, 19 nt, Leptospira interrogans serovar lai str. 56601
ucuuauacucuuaaaauua

SEQ ID NO: 2799874 - RNA, 13 nt, Leptospira interrogans serovar lai str. 56601
ucuuauaucaaac

SEQ ID NO: 2799875 - RNA, 17 nt, Leptospira interrogans serovar lai str. 56601
ucuuaugguuuuuuaau

SEQ ID NO: 2799876 - RNA, 18 nt, Leptospira interrogans serovar lai str. 56601
ucuuauuauucucggccu

SEQ ID NO: 2799877 - RNA, 18 nt, Leptospira interrogans serovar lai str. 56601
ucuuauucaauaaaauac

SEQ ID NO: 2799878 - RNA, 21 nt, Leptospira interrogans serovar lai str. 56601
ucuuauucuaggcauuucauu

SEQ ID NO: 2799879 - RNA, 20 nt, Leptospira interrogans serovar lai str. 56601
ucuuauugaacguaaguuaa

SEQ ID NO: 2799880 - RNA, 15 nt, Leptospira interrogans serovar lai str. 56601
ucuuauuuauuaaag

SEQ ID NO: 2799881 - RNA, 14 nt, Leptospira interrogans serovar lai str. 56601
ucuuauuuuuuaau

SEQ ID NO: 2799882 - RNA, 20 nt, Leptospira interrogans serovar lai str. 56601
ucuucaaaaucguuuuaaaa

SEQ ID NO: 2799883 - RNA, 11 nt, Leptospira interrogans serovar lai str. 56601
ucuucaaauuc

SEQ ID NO: 2799884 - RNA, 17 nt, Leptospira interrogans serovar lai str. 56601
ucuucaccaagcuccuc

SEQ ID NO: 2799885 - RNA, 22 nt, Leptospira interrogans serovar lai str. 56601
ucuucauuaaacaauuuuucaa

SEQ ID NO: 2799886 - RNA, 22 nt, Leptospira interrogans serovar lai str. 56601
ucuucauuuugggauuuuauug

SEQ ID NO: 2799887 - RNA, 13 nt, Leptospira interrogans serovar lai str. 56601
ucuuccaauuguu

SEQ ID NO: 2799888 - RNA, 21 nt, Leptospira interrogans serovar lai str. 56601
ucuuccacaucuuuuuucguu

SEQ ID NO: 2799889 - RNA, 20 nt, Leptospira interrogans serovar lai str. 56601
ucuuccggauuaaaaagguu

SEQ ID NO: 2799890 - RNA, 22 nt, Leptospira interrogans serovar lai str. 56601
ucuuccgggaggaauuuuuaaa

SEQ ID NO: 2799891 - RNA, 22 nt, Leptospira interrogans serovar lai str. 56601
ucuuccgguggauuuuuuuauc

SEQ ID NO: 2799892 - RNA, 13 nt, Leptospira interrogans serovar lai str. 56601
ucuuccuucuuga

SEQ ID NO: 2799893 - RNA, 14 nt, Leptospira interrogans serovar lai str. 56601
ucuuccuucuugaa

SEQ ID NO: 2799894 - RNA, 15 nt, Leptospira interrogans serovar lai str. 56601
ucuuccuucuugaaa

SEQ ID NO: 2799895 - RNA, 21 nt, Leptospira interrogans serovar lai str. 56601
ucuuccuuuuuaaaaccaaaa

SEQ ID NO: 2799896 - RNA, 14 nt, Leptospira interrogans serovar lai str. 56601
ucuuccuuuuucau

SEQ ID NO: 2799897 - RNA, 17 nt, Leptospira interrogans serovar lai str. 56601
ucuucgccuauuuuuuu

SEQ ID NO: 2799898 - RNA, 16 nt, Leptospira interrogans serovar lai str. 56601
ucuucggcguugaguu

SEQ ID NO: 2799899 - RNA, 20 nt, Leptospira interrogans serovar lai str. 56601
ucuucggcguugaguuuuug

SEQ ID NO: 2799900 - RNA, 21 nt, Leptospira interrogans serovar lai str. 56601
ucuucgguaauuguagauucu

SEQ ID NO: 2799901 - RNA, 15 nt, Leptospira interrogans serovar lai str. 56601
ucuucgucucaccaa

SEQ ID NO: 2799902 - RNA, 23 nt, Leptospira interrogans serovar lai str. 56601
ucuucuaaaucuaauucuucuaa

SEQ ID NO: 2799903 - RNA, 12 nt, Leptospira interrogans serovar lai str. 56601
ucuucuaaauuu

SEQ ID NO: 2799904 - RNA, 16 nt, Leptospira interrogans serovar lai str. 56601
ucuucuaaauuuguaa

SEQ ID NO: 2799905 - RNA, 19 nt, Leptospira interrogans serovar lai str. 56601
ucuucuaauucaguuuuuc

SEQ ID NO: 2799906 - RNA, 20 nt, Leptospira interrogans serovar lai str. 56601
ucuucuauuucuuauuuauu

SEQ ID NO: 2799907 - RNA, 19 nt, Leptospira interrogans serovar lai str. 56601
ucuucuccucuuccggaag

SEQ ID NO: 2799908 - RNA, 20 nt, Leptospira interrogans serovar lai str. 56601
ucuucucguucggaaugcug

SEQ ID NO: 2799909 - RNA, 15 nt, Leptospira interrogans serovar lai str. 56601
ucuucuguaaaacuu

SEQ ID NO: 2799910 - RNA, 16 nt, Leptospira interrogans serovar lai str. 56601
ucuucuuccuuuuuaa

SEQ ID NO: 2799911 - RNA, 13 nt, Leptospira interrogans serovar lai str. 56601
ucuucuucuagau

SEQ ID NO: 2799912 - RNA, 17 nt, Leptospira interrogans serovar lai str. 56601
ucuucuuguaauuuguu

SEQ ID NO: 2799913 - RNA, 23 nt, Leptospira interrogans serovar lai str. 56601
ucuucuuuuguuuuuauaaauaa

SEQ ID NO: 2799914 - RNA, 13 nt, Leptospira interrogans serovar lai str. 56601
ucuucuuuuucca

SEQ ID NO: 2799915 - RNA, 18 nt, Leptospira interrogans serovar lai str. 56601
ucuugaaucgaaucuuuu

SEQ ID NO: 2799916 - RNA, 20 nt, Leptospira interrogans serovar lai str. 56601
ucuugagaaaggagaacuca

SEQ ID NO: 2799917 - RNA, 18 nt, Leptospira interrogans serovar lai str. 56601
ucuugagggguuuuuccu

SEQ ID NO: 2799918 - RNA, 19 nt, Leptospira interrogans serovar lai str. 56601
ucuugagggguuuuuccuu

SEQ ID NO: 2799919 - RNA, 19 nt, Leptospira interrogans serovar lai str. 56601
ucuugaucgacuguaauua

SEQ ID NO: 2799920 - RNA, 21 nt, Leptospira interrogans serovar lai str. 56601
ucuugcaaaaauagaauuuuu

SEQ ID NO: 2799921 - RNA, 13 nt, Leptospira interrogans serovar lai str. 56601
ucuugcuaaaauu

SEQ ID NO: 2799922 - RNA, 15 nt, Leptospira interrogans serovar lai str. 56601
ucuuguuuaaaucga

SEQ ID NO: 2799923 - RNA, 15 nt, Leptospira interrogans serovar lai str. 56601
ucuuuaaaaaauuag

SEQ ID NO: 2799924 - RNA, 22 nt, Leptospira interrogans serovar lai str. 56601
ucuuuaaaagagcgaaaugcag

SEQ ID NO: 2799925 - RNA, 12 nt, Leptospira interrogans serovar lai str. 56601
ucuuuaaaauac

SEQ ID NO: 2799926 - RNA, 15 nt, Leptospira interrogans serovar lai str. 56601
ucuuuaaaauacuuu

SEQ ID NO: 2799927 - RNA, 12 nt, Leptospira interrogans serovar lai str. 56601
ucuuuaaaauuu

SEQ ID NO: 2799928 - RNA, 13 nt, Leptospira interrogans serovar lai str. 56601
ucuuuaaaauuuu

SEQ ID NO: 2799929 - RNA, 17 nt, Leptospira interrogans serovar lai str. 56601
ucuuuaaaauuuuuaau

SEQ ID NO: 2799930 - RNA, 22 nt, Leptospira interrogans serovar lai str. 56601
ucuuuaaaauuuuuaauaaaau

SEQ ID NO: 2799931 - RNA, 16 nt, Leptospira interrogans serovar lai str. 56601
ucuuuaaaugugggaa

SEQ ID NO: 2799932 - RNA, 21 nt, Leptospira interrogans serovar lai str. 56601
ucuuuaagagucauuuuuaaa

SEQ ID NO: 2799933 - RNA, 21 nt, Leptospira interrogans serovar lai str. 56601
ucuuuaagauauugagcaaga

SEQ ID NO: 2799934 - RNA, 20 nt, Leptospira interrogans serovar lai str. 56601
ucuuuaaguuugugagaguu

SEQ ID NO: 2799935 - RNA, 20 nt, Leptospira interrogans serovar lai str. 56601
ucuuuaaugagucuguccca

SEQ ID NO: 2799936 - RNA, 23 nt, Leptospira interrogans serovar lai str. 56601
ucuuuaaugagucugucccaaaa

SEQ ID NO: 2799937 - RNA, 15 nt, Leptospira interrogans serovar lai str. 56601
ucuuuaaugguaucu

SEQ ID NO: 2799938 - RNA, 23 nt, Leptospira interrogans serovar lai str. 56601
ucuuuaauuucaauaacuugacu

SEQ ID NO: 2799939 - RNA, 19 nt, Leptospira interrogans serovar lai str. 56601
ucuuuacaauuugcuaaaa

SEQ ID NO: 2799940 - RNA, 22 nt, Leptospira interrogans serovar lai str. 56601
ucuuuacaauuugcuaaaauaa

SEQ ID NO: 2799941 - RNA, 15 nt, Leptospira interrogans serovar lai str. 56601
ucuuuacucuaucca

SEQ ID NO: 2799942 - RNA, 13 nt, Leptospira interrogans serovar lai str. 56601
ucuuuagaaauuu

SEQ ID NO: 2799943 - RNA, 14 nt, Leptospira interrogans serovar lai str. 56601
ucuuuagaaauuuu

SEQ ID NO: 2799944 - RNA, 19 nt, Leptospira interrogans serovar lai str. 56601
ucuuuagaaauuuuuaaua

SEQ ID NO: 2799945 - RNA, 15 nt, Leptospira interrogans serovar lai str. 56601
ucuuuauaaaaauga

SEQ ID NO: 2799946 - RNA, 15 nt, Leptospira interrogans serovar lai str. 56601
ucuuuauaaaucugu

SEQ ID NO: 2799947 - RNA, 15 nt, Leptospira interrogans serovar lai str. 56601
ucuuuauaucuugaa

SEQ ID NO: 2799948 - RNA, 17 nt, Leptospira interrogans serovar lai str. 56601
ucuuuauauuauauaag

SEQ ID NO: 2799949 - RNA, 15 nt, Leptospira interrogans serovar lai str. 56601
ucuuuaucagaaaaa

SEQ ID NO: 2799950 - RNA, 19 nt, Leptospira interrogans serovar lai str. 56601
ucuuuaugcgguuuuacuu

SEQ ID NO: 2799951 - RNA, 14 nt, Leptospira interrogans serovar lai str. 56601
ucuuuauuuuuaac

SEQ ID NO: 2799952 - RNA, 23 nt, Leptospira interrogans serovar lai str. 56601
ucuuucaaaaccgcuuuuaguuu

SEQ ID NO: 2799953 - RNA, 13 nt, Leptospira interrogans serovar lai str. 56601
ucuuucaaagcua

SEQ ID NO: 2799954 - RNA, 19 nt, Leptospira interrogans serovar lai str. 56601
ucuuuccaaccauuuaaua

SEQ ID NO: 2799955 - RNA, 19 nt, Leptospira interrogans serovar lai str. 56601
ucuuucgacuucuuuuuug

SEQ ID NO: 2799956 - RNA, 15 nt, Leptospira interrogans serovar lai str. 56601
ucuuucgagauuaaa

SEQ ID NO: 2799957 - RNA, 18 nt, Leptospira interrogans serovar lai str. 56601
ucuuucgauuuuaaauaa

SEQ ID NO: 2799958 - RNA, 22 nt, Leptospira interrogans serovar lai str. 56601
ucuuucggcccggauauuuucu

SEQ ID NO: 2799959 - RNA, 22 nt, Leptospira interrogans serovar lai str. 56601
ucuuucuacaccaguauucaau

SEQ ID NO: 2799960 - RNA, 13 nt, Leptospira interrogans serovar lai str. 56601
ucuuucucucgaa

SEQ ID NO: 2799961 - RNA, 15 nt, Leptospira interrogans serovar lai str. 56601
ucuuucuuaaauuuu

SEQ ID NO: 2799962 - RNA, 21 nt, Leptospira interrogans serovar lai str. 56601
ucuuucuuaaauuuuuuuuca

SEQ ID NO: 2799963 - RNA, 22 nt, Leptospira interrogans serovar lai str. 56601
ucuuucuuccggauuaaaaagg

SEQ ID NO: 2799964 - RNA, 18 nt, Leptospira interrogans serovar lai str. 56601
ucuuucuucuguaacgau

SEQ ID NO: 2799965 - RNA, 19 nt, Leptospira interrogans serovar lai str. 56601
ucuuugaaaaaauuuuuuc

SEQ ID NO: 2799966 - RNA, 12 nt, Leptospira interrogans serovar lai str. 56601
ucuuugaaauuc

SEQ ID NO: 2799967 - RNA, 13 nt, Leptospira interrogans serovar lai str. 56601
ucuuugaacuuuu

SEQ ID NO: 2799968 - RNA, 17 nt, Leptospira interrogans serovar lai str. 56601
ucuuugaacuuuuucaa

SEQ ID NO: 2799969 - RNA, 19 nt, Leptospira interrogans serovar lai str. 56601
ucuuugaacuuuuucaagu

SEQ ID NO: 2799970 - RNA, 19 nt, Leptospira interrogans serovar lai str. 56601
ucuuugaaggaucuuagag

SEQ ID NO: 2799971 - RNA, 19 nt, Leptospira interrogans serovar lai str. 56601
ucuuugaauucgcuuuggu

SEQ ID NO: 2799972 - RNA, 20 nt, Leptospira interrogans serovar lai str. 56601
ucuuugacccauaaaaauac

SEQ ID NO: 2799973 - RNA, 23 nt, Leptospira interrogans serovar lai str. 56601
ucuuugacccauaaaaauacuuu

SEQ ID NO: 2799974 - RNA, 22 nt, Leptospira interrogans serovar lai str. 56601
ucuuuggaaaccucgucuaucu

SEQ ID NO: 2799975 - RNA, 18 nt, Leptospira interrogans serovar lai str. 56601
ucuuuguaugaguuccca

SEQ ID NO: 2799976 - RNA, 11 nt, Leptospira interrogans serovar lai str. 56601
ucuuuuaaaau

SEQ ID NO: 2799977 - RNA, 14 nt, Leptospira interrogans serovar lai str. 56601
ucuuuuaauuucag

SEQ ID NO: 2799978 - RNA, 17 nt, Leptospira interrogans serovar lai str. 56601
ucuuuuaccuuaccacc

SEQ ID NO: 2799979 - RNA, 12 nt, Leptospira interrogans serovar lai str. 56601
ucuuuuagaguu

SEQ ID NO: 2799980 - RNA, 13 nt, Leptospira interrogans serovar lai str. 56601
ucuuuuauauaau

SEQ ID NO: 2799981 - RNA, 14 nt, Leptospira interrogans serovar lai str. 56601
ucuuuuauauaauu

SEQ ID NO: 2799982 - RNA, 19 nt, Leptospira interrogans serovar lai str. 56601
ucuuuuccccuuuuuuaau

SEQ ID NO: 2799983 - RNA, 20 nt, Leptospira interrogans serovar lai str. 56601
ucuuuuccccuuuuuuaaua

SEQ ID NO: 2799984 - RNA, 19 nt, Leptospira interrogans serovar lai str. 56601
ucuuuucccgcuaaaagua

SEQ ID NO: 2799985 - RNA, 13 nt, Leptospira interrogans serovar lai str. 56601
ucuuuucuauaau

SEQ ID NO: 2799986 - RNA, 15 nt, Leptospira interrogans serovar lai str. 56601
ucuuuucuuaaaaaa

SEQ ID NO: 2799987 - RNA, 21 nt, Leptospira interrogans serovar lai str. 56601
ucuuuucuuaaaaaaaugauu

SEQ ID NO: 2799988 - RNA, 12 nt, Leptospira interrogans serovar lai str. 56601
ucuuuucuucuu

SEQ ID NO: 2799989 - RNA, 20 nt, Leptospira interrogans serovar lai str. 56601
ucuuuugaacacgucuuaaa

SEQ ID NO: 2799990 - RNA, 21 nt, Leptospira interrogans serovar lai str. 56601
ucuuuugaacacgucuuaaau

SEQ ID NO: 2799991 - RNA, 16 nt, Leptospira interrogans serovar lai str. 56601
ucuuuugcauaguuuu

SEQ ID NO: 2799992 - RNA, 16 nt, Leptospira interrogans serovar lai str. 56601
ucuuuuggcauuccca

SEQ ID NO: 2799993 - RNA, 18 nt, Leptospira interrogans serovar lai str. 56601
ucuuuugggacagguucu

SEQ ID NO: 2799994 - RNA, 19 nt, Leptospira interrogans serovar lai str. 56601
ucuuuuguaaguuuuccau

SEQ ID NO: 2799995 - RNA, 16 nt, Leptospira interrogans serovar lai str. 56601
ucuuuuuaaaaguuug

SEQ ID NO: 2799996 - RNA, 13 nt, Leptospira interrogans serovar lai str. 56601
ucuuuuuaaauac

SEQ ID NO: 2799997 - RNA, 15 nt, Leptospira interrogans serovar lai str. 56601
ucuuuuuaaauacac

SEQ ID NO: 2799998 - RNA, 18 nt, Leptospira interrogans serovar lai str. 56601
ucuuuuuaaauacacucu

SEQ ID NO: 2799999 - RNA, 14 nt, Leptospira interrogans serovar lai str. 56601
ucuuuuuaaguaau

SEQ ID NO: 2800000 - RNA, 23 nt, Leptospira interrogans serovar lai str. 56601
ucuuuuuaaguaauauuucucuc

SEQ ID NO: 2800001 - RNA, 11 nt, Leptospira interrogans serovar lai str. 56601
ucuuuuuacuu

SEQ ID NO: 2800002 - RNA, 18 nt, Leptospira interrogans serovar lai str. 56601
ucuuuuuagacaaaaaua

SEQ ID NO: 2800003 - RNA, 23 nt, Leptospira interrogans serovar lai str. 56601
ucuuuuuagacaaaaauacuaaa

SEQ ID NO: 2800004 - RNA, 21 nt, Leptospira interrogans serovar lai str. 56601
ucuuuuuuaaaccgauuucaa

SEQ ID NO: 2800005 - RNA, 20 nt, Leptospira interrogans serovar lai str. 56601
ugaaaucagagucuauuuaa

SEQ ID NO: 2800006 - RNA, 14 nt, Leptospira interrogans serovar lai str. 56601
ugaaaucuaaauuu

SEQ ID NO: 2800007 - RNA, 16 nt, Leptospira interrogans serovar lai str. 56601
ugaaaucuaaauuugu

SEQ ID NO: 2800008 - RNA, 23 nt, Leptospira interrogans serovar lai str. 56601
ugaaaucugaacauaaaaucgau

SEQ ID NO: 2800009 - RNA, 18 nt, Leptospira interrogans serovar lai str. 56601
ugaaaucugaacuuugca

SEQ ID NO: 2800010 - RNA, 16 nt, Leptospira interrogans serovar lai str. 56601
ugaaaucugaauuuaa

SEQ ID NO: 2800011 - RNA, 23 nt, Leptospira interrogans serovar lai str. 56601
ugaaauucucuuuugaccaaaag

SEQ ID NO: 2800012 - RNA, 16 nt, Leptospira interrogans serovar lai str. 56601
ugaaauugauguuuug

SEQ ID NO: 2800013 - RNA, 14 nt, Leptospira interrogans serovar lai str. 56601
ugaaauuguuuuaa

SEQ ID NO: 2800014 - RNA, 17 nt, Leptospira interrogans serovar lai str. 56601
ugaaauuuccacuucaa

SEQ ID NO: 2800015 - RNA, 14 nt, Leptospira interrogans serovar lai str. 56601
ugaaauuuuaaaac

SEQ ID NO: 2800016 - RNA, 15 nt, Leptospira interrogans serovar lai str. 56601
ugaaauuuucuuaga

SEQ ID NO: 2800017 - RNA, 14 nt, Leptospira interrogans serovar lai str. 56601
ugaaauuuuucaau

SEQ ID NO: 2800018 - RNA, 18 nt, Leptospira interrogans serovar lai str. 56601
ugaaauuuuuguacaaaa

SEQ ID NO: 2800019 - RNA, 15 nt, Leptospira interrogans serovar lai str. 56601
ugaacaaacucuuga

SEQ ID NO: 2800020 - RNA, 20 nt, Leptospira interrogans serovar lai str. 56601
ugaacauuccauaaugaaga

SEQ ID NO: 2800021 - RNA, 12 nt, Leptospira interrogans serovar lai str. 56601
ugaacauuuuca

SEQ ID NO: 2800022 - RNA, 18 nt, Leptospira interrogans serovar lai str. 56601
ugaacauuuuuaaaaauu

SEQ ID NO: 2800023 - RNA, 22 nt, Leptospira interrogans serovar lai str. 56601
ugaacccgaacgcuaaacuucu

SEQ ID NO: 2800024 - RNA, 15 nt, Leptospira interrogans serovar lai str. 56601
ugaacgaauuuuuca

SEQ ID NO: 2800025 - RNA, 13 nt, Leptospira interrogans serovar lai str. 56601
ugaacuacagaau

SEQ ID NO: 2800026 - RNA, 17 nt, Leptospira interrogans serovar lai str. 56601
ugaacuuacaaagcacu

SEQ ID NO: 2800027 - RNA, 18 nt, Leptospira interrogans serovar lai str. 56601
ugaacuuacaaagcacuu

SEQ ID NO: 2800028 - RNA, 12 nt, Leptospira interrogans serovar lai str. 56601
ugaacuucuuuc

SEQ ID NO: 2800029 - RNA, 16 nt, Leptospira interrogans serovar lai str. 56601
ugaacuugucccaaaa

SEQ ID NO: 2800030 - RNA, 17 nt, Leptospira interrogans serovar lai str. 56601
ugaacuugucccaaaac

SEQ ID NO: 2800031 - RNA, 18 nt, Leptospira interrogans serovar lai str. 56601
ugaacuuguccuaaaauu

SEQ ID NO: 2800032 - RNA, 19 nt, Leptospira interrogans serovar lai str. 56601
ugaacuuguuccaaaacua

SEQ ID NO: 2800033 - RNA, 21 nt, Leptospira interrogans serovar lai str. 56601
ugaacuuguuccaaaacuaaa

SEQ ID NO: 2800034 - RNA, 12 nt, Leptospira interrogans serovar lai str. 56601
ugaacuuucgag

SEQ ID NO: 2800035 - RNA, 19 nt, Leptospira interrogans serovar lai str. 56601
ugaacuuuuuuauauagaa

SEQ ID NO: 2800036 - RNA, 12 nt, Leptospira interrogans serovar lai str. 56601
ugaagaaaaaaa

SEQ ID NO: 2800037 - RNA, 14 nt, Leptospira interrogans serovar lai str. 56601
ugaagaaaguuuau

SEQ ID NO: 2800038 - RNA, 16 nt, Leptospira interrogans serovar lai str. 56601
ugaagaagcuaaaauu

SEQ ID NO: 2800039 - RNA, 18 nt, Leptospira interrogans serovar lai str. 56601
ugaagaagcuaaaauuga

SEQ ID NO: 2800040 - RNA, 18 nt, Leptospira interrogans serovar lai str. 56601
ugaagaaugauaaaucuu

SEQ ID NO: 2800041 - RNA, 14 nt, Leptospira interrogans serovar lai str. 56601
ugaagagaaaguaa

SEQ ID NO: 2800042 - RNA, 16 nt, Leptospira interrogans serovar lai str. 56601
ugaagagguacagaaa

SEQ ID NO: 2800043 - RNA, 16 nt, Leptospira interrogans serovar lai str. 56601
ugaagauauuuuccuu

SEQ ID NO: 2800044 - RNA, 23 nt, Leptospira interrogans serovar lai str. 56601
ugaagauuagacacuacauguug

SEQ ID NO: 2800045 - RNA, 13 nt, Leptospira interrogans serovar lai str. 56601
ugaagauuuaggu

SEQ ID NO: 2800046 - RNA, 19 nt, Leptospira interrogans serovar lai str. 56601
ugaagccuuccaucaaaua

SEQ ID NO: 2800047 - RNA, 20 nt, Leptospira interrogans serovar lai str. 56601
ugaagcgcuugaguugcuuu

SEQ ID NO: 2800048 - RNA, 17 nt, Leptospira interrogans serovar lai str. 56601
ugaagcuaugaagaggu

SEQ ID NO: 2800049 - RNA, 15 nt, Leptospira interrogans serovar lai str. 56601
ugaaggguaacucag

SEQ ID NO: 2800050 - RNA, 22 nt, Leptospira interrogans serovar lai str. 56601
ugaaguaggugguugggaacaa

SEQ ID NO: 2800051 - RNA, 22 nt, Leptospira interrogans serovar lai str. 56601
ugaaguauaaacuuuuuugaau

SEQ ID NO: 2800052 - RNA, 19 nt, Leptospira interrogans serovar lai str. 56601
ugaagucuuaucucaaagc

SEQ ID NO: 2800053 - RNA, 15 nt, Leptospira interrogans serovar lai str. 56601
ugaaguuaagaagau

SEQ ID NO: 2800054 - RNA, 21 nt, Leptospira interrogans serovar lai str. 56601
ugaaguuacgcguuuaaauac

SEQ ID NO: 2800055 - RNA, 18 nt, Leptospira interrogans serovar lai str. 56601
ugaaguuuuacuaaaagu

SEQ ID NO: 2800056 - RNA, 20 nt, Leptospira interrogans serovar lai str. 56601
ugaaguuuuacuaaaaguaa

SEQ ID NO: 2800057 - RNA, 19 nt, Leptospira interrogans serovar lai str. 56601
ugaauaaacaauaaaauaa

SEQ ID NO: 2800058 - RNA, 20 nt, Leptospira interrogans serovar lai str. 56601
ugaauacgauagauucaauu

SEQ ID NO: 2800059 - RNA, 17 nt, Leptospira interrogans serovar lai str. 56601
ugaauaggauuuuagaa

SEQ ID NO: 2800060 - RNA, 20 nt, Leptospira interrogans serovar lai str. 56601
ugaauaggauuuuagaauca

SEQ ID NO: 2800061 - RNA, 18 nt, Leptospira interrogans serovar lai str. 56601
ugaauaggcgauuuuaca

SEQ ID NO: 2800062 - RNA, 18 nt, Leptospira interrogans serovar lai str. 56601
ugaauauaauaaaauuau

SEQ ID NO: 2800063 - RNA, 19 nt, Leptospira interrogans serovar lai str. 56601
ugaauaucuaauauuuuuc

SEQ ID NO: 2800064 - RNA, 14 nt, Leptospira interrogans serovar lai str. 56601
ugaauauuauucuu

SEQ ID NO: 2800065 - RNA, 16 nt, Leptospira interrogans serovar lai str. 56601
ugaauauuucuucguu

SEQ ID NO: 2800066 - RNA, 13 nt, Leptospira interrogans serovar lai str. 56601
ugaauauuuucca

SEQ ID NO: 2800067 - RNA, 17 nt, Leptospira interrogans serovar lai str. 56601
ugaauauuuuccaaaaa

SEQ ID NO: 2800068 - RNA, 18 nt, Leptospira interrogans serovar lai str. 56601
ugaauauuuuuaaacuca

SEQ ID NO: 2800069 - RNA, 21 nt, Leptospira interrogans serovar lai str. 56601
ugaauauuuuuaaacucauuc

SEQ ID NO: 2800070 - RNA, 23 nt, Leptospira interrogans serovar lai str. 56601
ugaaucaaauaaaaggcugcuuu

SEQ ID NO: 2800071 - RNA, 16 nt, Leptospira interrogans serovar lai str. 56601
ugaaucagccauuaaa

SEQ ID NO: 2800072 - RNA, 12 nt, Leptospira interrogans serovar lai str. 56601
ugaauccaaaag

SEQ ID NO: 2800073 - RNA, 16 nt, Leptospira interrogans serovar lai str. 56601
ugaauccgaauacaaa

SEQ ID NO: 2800074 - RNA, 14 nt, Leptospira interrogans serovar lai str. 56601
ugaauccuuccucc

SEQ ID NO: 2800075 - RNA, 16 nt, Leptospira interrogans serovar lai str. 56601
ugaaucgaauaaaaaa

SEQ ID NO: 2800076 - RNA, 16 nt, Leptospira interrogans serovar lai str. 56601
ugaaucgaaucuuuug

SEQ ID NO: 2800077 - RNA, 22 nt, Leptospira interrogans serovar lai str. 56601
ugaaucgagcgaaagccgccuu

SEQ ID NO: 2800078 - RNA, 19 nt, Leptospira interrogans serovar lai str. 56601
ugaaucuaggauauuugau

SEQ ID NO: 2800079 - RNA, 24 nt, Leptospira interrogans serovar lai str. 56601
ugaaucuaggauauuugauauaau

SEQ ID NO: 2800080 - RNA, 21 nt, Leptospira interrogans serovar lai str. 56601
ugaaucuauuguaauaaaucg

SEQ ID NO: 2800081 - RNA, 20 nt, Leptospira interrogans serovar lai str. 56601
ugaaucuauuuuugauuuua

SEQ ID NO: 2800082 - RNA, 14 nt, Leptospira interrogans serovar lai str. 56601
ugaaucucuuacga

SEQ ID NO: 2800083 - RNA, 12 nt, Leptospira interrogans serovar lai str. 56601
ugaaucuuaaau

SEQ ID NO: 2800084 - RNA, 13 nt, Leptospira interrogans serovar lai str. 56601
ugaauguauauuu

SEQ ID NO: 2800085 - RNA, 14 nt, Leptospira interrogans serovar lai str. 56601
ugaauguuuaaaau

SEQ ID NO: 2800086 - RNA, 15 nt, Leptospira interrogans serovar lai str. 56601
ugaauguuuaaaauu

SEQ ID NO: 2800087 - RNA, 15 nt, Leptospira interrogans serovar lai str. 56601
ugaauuaaaaaacuu

SEQ ID NO: 2800088 - RNA, 17 nt, Leptospira interrogans serovar lai str. 56601
ugagcauuuuuuuaaua

SEQ ID NO: 2800089 - RNA, 19 nt, Leptospira interrogans serovar lai str. 56601
ugagcuaauucuuaaaaau

SEQ ID NO: 2800090 - RNA, 23 nt, Leptospira interrogans serovar lai str. 56601
ugagcuaauucuuaaaaauuuau

SEQ ID NO: 2800091 - RNA, 23 nt, Leptospira interrogans serovar lai str. 56601
ugagcuagauuuagauucuaaaa

SEQ ID NO: 2800092 - RNA, 23 nt, Leptospira interrogans serovar lai str. 56601
ugagcucuauguaagaaaaucug

SEQ ID NO: 2800093 - RNA, 14 nt, Leptospira interrogans serovar lai str. 56601
ugagcugagugauu

SEQ ID NO: 2800094 - RNA, 15 nt, Leptospira interrogans serovar lai str. 56601
ugagcuugucccaaa

SEQ ID NO: 2800095 - RNA, 19 nt, Leptospira interrogans serovar lai str. 56601
ugagcuuuuuuagaaaaag

SEQ ID NO: 2800096 - RNA, 20 nt, Leptospira interrogans serovar lai str. 56601
ugaggaguuuuuauaaaauc

SEQ ID NO: 2800097 - RNA, 13 nt, Leptospira interrogans serovar lai str. 56601
ugaguaguaaaau

SEQ ID NO: 2800098 - RNA, 17 nt, Leptospira interrogans serovar lai str. 56601
ugagucaacaaauauuc

SEQ ID NO: 2800099 - RNA, 14 nt, Leptospira interrogans serovar lai str. 56601
ugagucaagauuau

SEQ ID NO: 2800100 - RNA, 20 nt, Leptospira interrogans serovar lai str. 56601
ugagucugucccaaaaucug

SEQ ID NO: 2800101 - RNA, 16 nt, Leptospira interrogans serovar lai str. 56601
ugagugccuaaauuuu

SEQ ID NO: 2800102 - RNA, 18 nt, Leptospira interrogans serovar lai str. 56601
ugaguggugaauuuugcu

SEQ ID NO: 2800103 - RNA, 20 nt, Leptospira interrogans serovar lai str. 56601
ugaguguuuuuaguuuucau

SEQ ID NO: 2800104 - RNA, 20 nt, Leptospira interrogans serovar lai str. 56601
ugaguuaaccuacagaacac

SEQ ID NO: 2800105 - RNA, 18 nt, Leptospira interrogans serovar lai str. 56601
ugaguuagacguuugaaa

SEQ ID NO: 2800106 - RNA, 15 nt, Leptospira interrogans serovar lai str. 56601
ugaguuauaaacauu

SEQ ID NO: 2800107 - RNA, 17 nt, Leptospira interrogans serovar lai str. 56601
ugaguuauaaacauuaa

SEQ ID NO: 2800108 - RNA, 20 nt, Leptospira interrogans serovar lai str. 56601
ugaguucaauguaagaaacu

SEQ ID NO: 2800109 - RNA, 21 nt, Leptospira interrogans serovar lai str. 56601
ugaguucauucugauucuaaa

SEQ ID NO: 2800110 - RNA, 17 nt, Leptospira interrogans serovar lai str. 56601
ugaguuccaaaacucau

SEQ ID NO: 2800111 - RNA, 12 nt, Leptospira interrogans serovar lai str. 56601
ugaguucccaca

SEQ ID NO: 2800112 - RNA, 18 nt, Leptospira interrogans serovar lai str. 56601
ugaguucccacaaauucc

SEQ ID NO: 2800113 - RNA, 19 nt, Leptospira interrogans serovar lai str. 56601
ugaguuccuacauuuucag

SEQ ID NO: 2800114 - RNA, 20 nt, Leptospira interrogans serovar lai str. 56601
ugaguucgacauaagaaaga

SEQ ID NO: 2800115 - RNA, 22 nt, Leptospira interrogans serovar lai str. 56601
ugaguucggcguaagaaaacca

SEQ ID NO: 2800116 - RNA, 20 nt, Leptospira interrogans serovar lai str. 56601
ugaguucgguguaaggaauu

SEQ ID NO: 2800117 - RNA, 19 nt, Leptospira interrogans serovar lai str. 56601
ugaguucguggagaaauuc

SEQ ID NO: 2800118 - RNA, 12 nt, Leptospira interrogans serovar lai str. 56601
ugaguucuuuua

SEQ ID NO: 2800119 - RNA, 17 nt, Leptospira interrogans serovar lai str. 56601
ugaguugcuuugaauga

SEQ ID NO: 2800120 - RNA, 19 nt, Leptospira interrogans serovar lai str. 56601
ugaguuucacaaaaugcug

SEQ ID NO: 2800121 - RNA, 19 nt, Leptospira interrogans serovar lai str. 56601
ugaguuucuccacuuaaaa

SEQ ID NO: 2800122 - RNA, 11 nt, Leptospira interrogans serovar lai str. 56601
ugaguuugaga

SEQ ID NO: 2800123 - RNA, 17 nt, Leptospira interrogans serovar lai str. 56601
ugaguuugagaaaucau

SEQ ID NO: 2800124 - RNA, 16 nt, Leptospira interrogans serovar lai str. 56601
ugaguuuuaaaacuca

SEQ ID NO: 2800125 - RNA, 17 nt, Leptospira interrogans serovar lai str. 56601
ugaguuuuaaaacucac

SEQ ID NO: 2800126 - RNA, 18 nt, Leptospira interrogans serovar lai str. 56601
ugaguuuuaaaacucaca

SEQ ID NO: 2800127 - RNA, 17 nt, Leptospira interrogans serovar lai str. 56601
ugaguuuucccuauuuu

SEQ ID NO: 2800128 - RNA, 13 nt, Leptospira interrogans serovar lai str. 56601
ugaguuuuuccua

SEQ ID NO: 2800129 - RNA, 15 nt, Leptospira interrogans serovar lai str. 56601
ugaguuuuuccuauu

SEQ ID NO: 2800130 - RNA, 17 nt, Leptospira interrogans serovar lai str. 56601
ugaguuuuuccuauuuu

SEQ ID NO: 2800131 - RNA, 21 nt, Leptospira interrogans serovar lai str. 56601
ugauaaaauauaguuaaauuu

SEQ ID NO: 2800132 - RNA, 13 nt, Leptospira interrogans serovar lai str. 56601
ugauaaagaaaac

SEQ ID NO: 2800133 - RNA, 15 nt, Leptospira interrogans serovar lai str. 56601
ugauaauaauuagaa

SEQ ID NO: 2800134 - RNA, 21 nt, Leptospira interrogans serovar lai str. 56601
ugauaauuauccuuaaaauga

SEQ ID NO: 2800135 - RNA, 21 nt, Leptospira interrogans serovar lai str. 56601
ugauaauucgugaacuuuaga

SEQ ID NO: 2800136 - RNA, 20 nt, Leptospira interrogans serovar lai str. 56601
ugauaauuucauuauuagag

SEQ ID NO: 2800137 - RNA, 20 nt, Leptospira interrogans serovar lai str. 56601
ugauaauuugugaacuuuug

SEQ ID NO: 2800138 - RNA, 21 nt, Leptospira interrogans serovar lai str. 56601
ugauaauuugugaacuuuuga

SEQ ID NO: 2800139 - RNA, 19 nt, Leptospira interrogans serovar lai str. 56601
ugauaauuuguuuguuaua

SEQ ID NO: 2800140 - RNA, 22 nt, Leptospira interrogans serovar lai str. 56601
ugauaccgggauuuuaaaaauu

SEQ ID NO: 2800141 - RNA, 15 nt, Leptospira interrogans serovar lai str. 56601
ugauagaaauauuua

SEQ ID NO: 2800142 - RNA, 16 nt, Leptospira interrogans serovar lai str. 56601
ugauagaacucuuuua

SEQ ID NO: 2800143 - RNA, 17 nt, Leptospira interrogans serovar lai str. 56601
ugauagagaaaaauuuu

SEQ ID NO: 2800144 - RNA, 19 nt, Leptospira interrogans serovar lai str. 56601
ugauagauuaauuuuuaua

SEQ ID NO: 2800145 - RNA, 19 nt, Leptospira interrogans serovar lai str. 56601
ugauaguuaauuuuaucuu

SEQ ID NO: 2800146 - RNA, 16 nt, Leptospira interrogans serovar lai str. 56601
ugauauaaucuuaaua

SEQ ID NO: 2800147 - RNA, 20 nt, Leptospira interrogans serovar lai str. 56601
ugauauaccaguuaaauuca

SEQ ID NO: 2800148 - RNA, 16 nt, Leptospira interrogans serovar lai str. 56601
ugauauauuuuuaaag

SEQ ID NO: 2800149 - RNA, 19 nt, Leptospira interrogans serovar lai str. 56601
ugauauguuauauaaaguu

SEQ ID NO: 2800150 - RNA, 23 nt, Leptospira interrogans serovar lai str. 56601
ugauauucaaauuuacucuuaua

SEQ ID NO: 2800151 - RNA, 15 nt, Leptospira interrogans serovar lai str. 56601
ugauauuucauucuu

SEQ ID NO: 2800152 - RNA, 15 nt, Leptospira interrogans serovar lai str. 56601
ugauauuucuggaaa

SEQ ID NO: 2800153 - RNA, 13 nt, Leptospira interrogans serovar lai str. 56601
ugauauuuggauc

SEQ ID NO: 2800154 - RNA, 13 nt, Leptospira interrogans serovar lai str. 56601
ugauauuuuaaau

SEQ ID NO: 2800155 - RNA, 16 nt, Leptospira interrogans serovar lai str. 56601
ugauauuuuaaauuga

SEQ ID NO: 2800156 - RNA, 21 nt, Leptospira interrogans serovar lai str. 56601
ugaucaaauucacauaaaguu

SEQ ID NO: 2800157 - RNA, 20 nt, Leptospira interrogans serovar lai str. 56601
ugaucauauccgaaagauaa

SEQ ID NO: 2800158 - RNA, 14 nt, Leptospira interrogans serovar lai str. 56601
ugauccaacaaauu

SEQ ID NO: 2800159 - RNA, 17 nt, Leptospira interrogans serovar lai str. 56601
ugauccaacaaauugaa

SEQ ID NO: 2800160 - RNA, 17 nt, Leptospira interrogans serovar lai str. 56601
ugauccguuuuaaaauu

SEQ ID NO: 2800161 - RNA, 21 nt, Leptospira interrogans serovar lai str. 56601
ugaucgaauaccguucuuaca

SEQ ID NO: 2800162 - RNA, 15 nt, Leptospira interrogans serovar lai str. 56601
ugaucgguuuaaaac

SEQ ID NO: 2800163 - RNA, 16 nt, Leptospira interrogans serovar lai str. 56601
ugaucgguuuaaaacu

SEQ ID NO: 2800164 - RNA, 19 nt, Leptospira interrogans serovar lai str. 56601
ugaucgguuuaaaacuagc

SEQ ID NO: 2800165 - RNA, 13 nt, Leptospira interrogans serovar lai str. 56601
ugaucguaacuuu

SEQ ID NO: 2800166 - RNA, 19 nt, Leptospira interrogans serovar lai str. 56601
ugaucguaacuuucuuuua

SEQ ID NO: 2800167 - RNA, 22 nt, Leptospira interrogans serovar lai str. 56601
ugaucguaacuuucuuuuagaa

SEQ ID NO: 2800168 - RNA, 18 nt, Leptospira interrogans serovar lai str. 56601
ugaucgucaaucaauuga

SEQ ID NO: 2800169 - RNA, 20 nt, Leptospira interrogans serovar lai str. 56601
ugaucguuggccucgaaagu

SEQ ID NO: 2800170 - RNA, 17 nt, Leptospira interrogans serovar lai str. 56601
ugaucuaucuuuccagu

SEQ ID NO: 2800171 - RNA, 19 nt, Leptospira interrogans serovar lai str. 56601
ugcaauacauucuuauaaa

SEQ ID NO: 2800172 - RNA, 17 nt, Leptospira interrogans serovar lai str. 56601
ugcaaucguccaaucuc

SEQ ID NO: 2800173 - RNA, 19 nt, Leptospira interrogans serovar lai str. 56601
ugcaaucguccaaucucuu

SEQ ID NO: 2800174 - RNA, 20 nt, Leptospira interrogans serovar lai str. 56601
ugcaaucguccaaucucuuu

SEQ ID NO: 2800175 - RNA, 18 nt, Leptospira interrogans serovar lai str. 56601
ugcaauucgcauuaaaau

SEQ ID NO: 2800176 - RNA, 19 nt, Leptospira interrogans serovar lai str. 56601
ugcaauucgcauuaaaauu

SEQ ID NO: 2800177 - RNA, 20 nt, Leptospira interrogans serovar lai str. 56601
ugcaauuguuggcuuuuuua

SEQ ID NO: 2800178 - RNA, 17 nt, Leptospira interrogans serovar lai str. 56601
ugcaauuuuacuuauac

SEQ ID NO: 2800179 - RNA, 19 nt, Leptospira interrogans serovar lai str. 56601
ugcaauuuuacuuauacaa

SEQ ID NO: 2800180 - RNA, 19 nt, Leptospira interrogans serovar lai str. 56601
ugcaauuuuugccauuauc

SEQ ID NO: 2800181 - RNA, 20 nt, Leptospira interrogans serovar lai str. 56601
ugcacaaaaccucuguuuug

SEQ ID NO: 2800182 - RNA, 13 nt, Leptospira interrogans serovar lai str. 56601
ugcacaaguuuuu

SEQ ID NO: 2800183 - RNA, 22 nt, Leptospira interrogans serovar lai str. 56601
ugcacugaaauagaauuuugca

SEQ ID NO: 2800184 - RNA, 13 nt, Leptospira interrogans serovar lai str. 56601
ugcacuguagagc

SEQ ID NO: 2800185 - RNA, 22 nt, Leptospira interrogans serovar lai str. 56601
ugcacuguagagcauuacuaca

SEQ ID NO: 2800186 - RNA, 18 nt, Leptospira interrogans serovar lai str. 56601
ugcagaaguauuccauau

SEQ ID NO: 2800187 - RNA, 22 nt, Leptospira interrogans serovar lai str. 56601
ugcagaauguuuucuacaaaua

SEQ ID NO: 2800188 - RNA, 15 nt, Leptospira interrogans serovar lai str. 56601
ugcagauaaguaagu

SEQ ID NO: 2800189 - RNA, 19 nt, Leptospira interrogans serovar lai str. 56601
ugcaguaaggauucuuuuc

SEQ ID NO: 2800190 - RNA, 19 nt, Leptospira interrogans serovar lai str. 56601
ugcaguaguucccacaaau

SEQ ID NO: 2800191 - RNA, 18 nt, Leptospira interrogans serovar lai str. 56601
ugcaguaguuccuacaaa

SEQ ID NO: 2800192 - RNA, 23 nt, Leptospira interrogans serovar lai str. 56601
ugcaguaguuccuauaaauucau

SEQ ID NO: 2800193 - RNA, 15 nt, Leptospira interrogans serovar lai str. 56601
ugcaguuccuugaac

SEQ ID NO: 2800194 - RNA, 15 nt, Leptospira interrogans serovar lai str. 56601
ugcaguugugaucag

SEQ ID NO: 2800195 - RNA, 18 nt, Leptospira interrogans serovar lai str. 56601
ugcauaaaagaaacauua

SEQ ID NO: 2800196 - RNA, 19 nt, Leptospira interrogans serovar lai str. 56601
ugcauaauagauuucugcu

SEQ ID NO: 2800197 - RNA, 16 nt, Leptospira interrogans serovar lai str. 56601
ugcauaggugauuaaa

SEQ ID NO: 2800198 - RNA, 16 nt, Leptospira interrogans serovar lai str. 56601
ugcauauacggauuuc

SEQ ID NO: 2800199 - RNA, 13 nt, Leptospira interrogans serovar lai str. 56601
ugcaucaaagaaa

SEQ ID NO: 2800200 - RNA, 12 nt, Leptospira interrogans serovar lai str. 56601
ugcaucaaaucg

SEQ ID NO: 2800201 - RNA, 20 nt, Leptospira interrogans serovar lai str. 56601
ugcaugaauuuguuuuucuu

SEQ ID NO: 2800202 - RNA, 20 nt, Leptospira interrogans serovar lai str. 56601
ugcauucaaaaaguuuuaua

SEQ ID NO: 2800203 - RNA, 21 nt, Leptospira interrogans serovar lai str. 56601
ugcauucaaaaaguuuuauaa

SEQ ID NO: 2800204 - RNA, 12 nt, Leptospira interrogans serovar lai str. 56601
ugcauuuaaaaa

SEQ ID NO: 2800205 - RNA, 13 nt, Leptospira interrogans serovar lai str. 56601
ugcauuuaaaaaa

SEQ ID NO: 2800206 - RNA, 19 nt, Leptospira interrogans serovar lai str. 56601
ugcauuuuauuaaaaauau

SEQ ID NO: 2800207 - RNA, 22 nt, Leptospira interrogans serovar lai str. 56601
ugcauuuuauuaaaaauuuuua

SEQ ID NO: 2800208 - RNA, 22 nt, Leptospira interrogans serovar lai str. 56601
ugccaaaacuaccucaauuuuc

SEQ ID NO: 2800209 - RNA, 19 nt, Leptospira interrogans serovar lai str. 56601
ugccauuauccaaaacucu

SEQ ID NO: 2800210 - RNA, 19 nt, Leptospira interrogans serovar lai str. 56601
ugccauuuccaauuuugcu

SEQ ID NO: 2800211 - RNA, 15 nt, Leptospira interrogans serovar lai str. 56601
ugccauuuuucuucu

SEQ ID NO: 2800212 - RNA, 21 nt, Leptospira interrogans serovar lai str. 56601
ugccauuuuucuucuuuguaa

SEQ ID NO: 2800213 - RNA, 15 nt, Leptospira interrogans serovar lai str. 56601
ugccccaaaauuuag

SEQ ID NO: 2800214 - RNA, 15 nt, Leptospira interrogans serovar lai str. 56601
ugccccauucuuuuu

SEQ ID NO: 2800215 - RNA, 17 nt, Leptospira interrogans serovar lai str. 56601
ugccccuccguuuacaa

SEQ ID NO: 2800216 - RNA, 18 nt, Leptospira interrogans serovar lai str. 56601
ugccccuccguuuacaaa

SEQ ID NO: 2800217 - RNA, 16 nt, Leptospira interrogans serovar lai str. 56601
ugccuaaauuccuucc

SEQ ID NO: 2800218 - RNA, 18 nt, Leptospira interrogans serovar lai str. 56601
ugccuaaauuuuuaucac

SEQ ID NO: 2800219 - RNA, 11 nt, Leptospira interrogans serovar lai str. 56601
ugccuacaaau

SEQ ID NO: 2800220 - RNA, 16 nt, Leptospira interrogans serovar lai str. 56601
ugccuacaaaucaaau

SEQ ID NO: 2800221 - RNA, 19 nt, Leptospira interrogans serovar lai str. 56601
ugccuaugccccauucuuu

SEQ ID NO: 2800222 - RNA, 23 nt, Leptospira interrogans serovar lai str. 56601
ugccucuacaaguucauaagauu

SEQ ID NO: 2800223 - RNA, 21 nt, Leptospira interrogans serovar lai str. 56601
ugccuuauaaugaagacgcuu

SEQ ID NO: 2800224 - RNA, 21 nt, Leptospira interrogans serovar lai str. 56601
ugccuucacauaaccaacccc

SEQ ID NO: 2800225 - RNA, 22 nt, Leptospira interrogans serovar lai str. 56601
ugccuuguucauaaaaacgucu

SEQ ID NO: 2800226 - RNA, 21 nt, Leptospira interrogans serovar lai str. 56601
ugcgacagcaaggagcaacau

SEQ ID NO: 2800227 - RNA, 18 nt, Leptospira interrogans serovar lai str. 56601
ugcgacuacgauuucauc

SEQ ID NO: 2800228 - RNA, 18 nt, Leptospira interrogans serovar lai str. 56601
ugcgauuauuaucaaaau

SEQ ID NO: 2800229 - RNA, 17 nt, Leptospira interrogans serovar lai str. 56601
ugcggaaacuuuuucgu

SEQ ID NO: 2800230 - RNA, 18 nt, Leptospira interrogans serovar lai str. 56601
ugcggaucguuuuuauuc

SEQ ID NO: 2800231 - RNA, 20 nt, Leptospira interrogans serovar lai str. 56601
ugcggauuccauucuucaaa

SEQ ID NO: 2800232 - RNA, 16 nt, Leptospira interrogans serovar lai str. 56601
ugcgguaguucccaca

SEQ ID NO: 2800233 - RNA, 18 nt, Leptospira interrogans serovar lai str. 56601
ugcgguuaucgucaaaau

SEQ ID NO: 2800234 - RNA, 12 nt, Leptospira interrogans serovar lai str. 56601
ugcguuuaaaaa

SEQ ID NO: 2800235 - RNA, 22 nt, Leptospira interrogans serovar lai str. 56601
ugcguuuggucugucguuugca

SEQ ID NO: 2800236 - RNA, 12 nt, Leptospira interrogans serovar lai str. 56601
ugcuaaaauuuu

SEQ ID NO: 2800237 - RNA, 18 nt, Leptospira interrogans serovar lai str. 56601
ugcuaacugauuauaaaa

SEQ ID NO: 2800238 - RNA, 18 nt, Leptospira interrogans serovar lai str. 56601
ugcuaagaaaaaagcagc

SEQ ID NO: 2800239 - RNA, 19 nt, Leptospira interrogans serovar lai str. 56601
ugcuaagaaaaaagcagcu

SEQ ID NO: 2800240 - RNA, 17 nt, Leptospira interrogans serovar lai str. 56601
ugcuacgggcuuucagc

SEQ ID NO: 2800241 - RNA, 12 nt, Leptospira interrogans serovar lai str. 56601
ugcuauaaaaag

SEQ ID NO: 2800242 - RNA, 17 nt, Leptospira interrogans serovar lai str. 56601
ugcucaaaaauuauaaa

SEQ ID NO: 2800243 - RNA, 13 nt, Leptospira interrogans serovar lai str. 56601
ugcucacuaccuu

SEQ ID NO: 2800244 - RNA, 20 nt, Leptospira interrogans serovar lai str. 56601
ugcucacuaccuuauaaaaa

SEQ ID NO: 2800245 - RNA, 13 nt, Leptospira interrogans serovar lai str. 56601
ugcucauuuuuuc

SEQ ID NO: 2800246 - RNA, 13 nt, Leptospira interrogans serovar lai str. 56601
ugcuccauaaaag

SEQ ID NO: 2800247 - RNA, 15 nt, Leptospira interrogans serovar lai str. 56601
ugcucggcuucuuca

SEQ ID NO: 2800248 - RNA, 12 nt, Leptospira interrogans serovar lai str. 56601
ugcucuaaaaua

SEQ ID NO: 2800249 - RNA, 17 nt, Leptospira interrogans serovar lai str. 56601
ugcucuaagagacucua

SEQ ID NO: 2800250 - RNA, 20 nt, Leptospira interrogans serovar lai str. 56601
ugcucucgcaaugaaaauuc

SEQ ID NO: 2800251 - RNA, 18 nt, Leptospira interrogans serovar lai str. 56601
ugcugaauugcucaaaga

SEQ ID NO: 2800252 - RNA, 20 nt, Leptospira interrogans serovar lai str. 56601
ugcuguaacucauauagaaa

SEQ ID NO: 2800253 - RNA, 23 nt, Leptospira interrogans serovar lai str. 56601
ugcuguaguuuauuuuucuuuua

SEQ ID NO: 2800254 - RNA, 21 nt, Leptospira interrogans serovar lai str. 56601
uggauuuauguucguucccac

SEQ ID NO: 2800255 - RNA, 14 nt, Leptospira interrogans serovar lai str. 56601
uggauuugauuuuu

SEQ ID NO: 2800256 - RNA, 12 nt, Leptospira interrogans serovar lai str. 56601
uggauuuuaugu

SEQ ID NO: 2800257 - RNA, 21 nt, Leptospira interrogans serovar lai str. 56601
uggauuuuauuuuuacaaaga

SEQ ID NO: 2800258 - RNA, 15 nt, Leptospira interrogans serovar lai str. 56601
uggauuuuuauguaa

SEQ ID NO: 2800259 - RNA, 19 nt, Leptospira interrogans serovar lai str. 56601
uggauuuuuauguaauauu

SEQ ID NO: 2800260 - RNA, 17 nt, Leptospira interrogans serovar lai str. 56601
uggcacuuauucuuaua

SEQ ID NO: 2800261 - RNA, 16 nt, Leptospira interrogans serovar lai str. 56601
uggcauacaucucuaa

SEQ ID NO: 2800262 - RNA, 17 nt, Leptospira interrogans serovar lai str. 56601
uggcauccaggauuuuc

SEQ ID NO: 2800263 - RNA, 21 nt, Leptospira interrogans serovar lai str. 56601
uggcauccaggauuuucacag

SEQ ID NO: 2800264 - RNA, 23 nt, Leptospira interrogans serovar lai str. 56601
uggcccuccucuaaaaugcugca

SEQ ID NO: 2800265 - RNA, 21 nt, Leptospira interrogans serovar lai str. 56601
uggccucgaaaguuuacacaa

SEQ ID NO: 2800266 - RNA, 22 nt, Leptospira interrogans serovar lai str. 56601
uggccuucuggaaaaauuccua

SEQ ID NO: 2800267 - RNA, 18 nt, Leptospira interrogans serovar lai str. 56601
uggcucaacuuuuccaga

SEQ ID NO: 2800268 - RNA, 16 nt, Leptospira interrogans serovar lai str. 56601
uggcucagauuuccuu

SEQ ID NO: 2800269 - RNA, 21 nt, Leptospira interrogans serovar lai str. 56601
uggcucauuuuucuuaaaaaa

SEQ ID NO: 2800270 - RNA, 17 nt, Leptospira interrogans serovar lai str. 56601
uggcucuugcuaaaauu

SEQ ID NO: 2800271 - RNA, 20 nt, Leptospira interrogans serovar lai str. 56601
uggcuguaguuaugacccaa

SEQ ID NO: 2800272 - RNA, 17 nt, Leptospira interrogans serovar lai str. 56601
ugggaacuaccaccaaa

SEQ ID NO: 2800273 - RNA, 12 nt, Leptospira interrogans serovar lai str. 56601
ugggaacuacua

SEQ ID NO: 2800274 - RNA, 18 nt, Leptospira interrogans serovar lai str. 56601
ugggaacuauuacaaaau

SEQ ID NO: 2800275 - RNA, 12 nt, Leptospira interrogans serovar lai str. 56601
ugggaauucuua

SEQ ID NO: 2800276 - RNA, 15 nt, Leptospira interrogans serovar lai str. 56601
ugggacaaacucuuu

SEQ ID NO: 2800277 - RNA, 17 nt, Leptospira interrogans serovar lai str. 56601
ugggacuuuuuucguug

SEQ ID NO: 2800278 - RNA, 23 nt, Leptospira interrogans serovar lai str. 56601
ugggaguucguaugaguucccac

SEQ ID NO: 2800279 - RNA, 21 nt, Leptospira interrogans serovar lai str. 56601
ugggaguuuucacauuuuagg

SEQ ID NO: 2800280 - RNA, 18 nt, Leptospira interrogans serovar lai str. 56601
ugggaucugaauuuuaua

SEQ ID NO: 2800281 - RNA, 22 nt, Leptospira interrogans serovar lai str. 56601
ugggauuuuguaaugaaaucua

SEQ ID NO: 2800282 - RNA, 15 nt, Leptospira interrogans serovar lai str. 56601
ugggcauaggaaaua

SEQ ID NO: 2800283 - RNA, 23 nt, Leptospira interrogans serovar lai str. 56601
ugggcauaggaaauaauuccucc

SEQ ID NO: 2800284 - RNA, 22 nt, Leptospira interrogans serovar lai str. 56601
ugggcucaaaaaggcacauuuu

SEQ ID NO: 2800285 - RNA, 18 nt, Leptospira interrogans serovar lai str. 56601
uggggacuuuauuuuaua

SEQ ID NO: 2800286 - RNA, 13 nt, Leptospira interrogans serovar lai str. 56601
uggguaucuaaau

SEQ ID NO: 2800287 - RNA, 16 nt, Leptospira interrogans serovar lai str. 56601
uggguuguuaugcaaa

SEQ ID NO: 2800288 - RNA, 17 nt, Leptospira interrogans serovar lai str. 56601
uggguuguuaugcaaau

SEQ ID NO: 2800289 - RNA, 16 nt, Leptospira interrogans serovar lai str. 56601
uggguuucuuaaaucu

SEQ ID NO: 2800290 - RNA, 17 nt, Leptospira interrogans serovar lai str. 56601
uggguuuuacuaaaaaa

SEQ ID NO: 2800291 - RNA, 12 nt, Leptospira interrogans serovar lai str. 56601
ugguaauuugug

SEQ ID NO: 2800292 - RNA, 16 nt, Leptospira interrogans serovar lai str. 56601
ugguacgaccaaaaca

SEQ ID NO: 2800293 - RNA, 22 nt, Leptospira interrogans serovar lai str. 56601
ugguagauugcuuuuuaaaaga

SEQ ID NO: 2800294 - RNA, 12 nt, Leptospira interrogans serovar lai str. 56601
ugguaguuccca

SEQ ID NO: 2800295 - RNA, 20 nt, Leptospira interrogans serovar lai str. 56601
ugguaguucccacaaauuaa

SEQ ID NO: 2800296 - RNA, 13 nt, Leptospira interrogans serovar lai str. 56601
ugguauuuaaaau

SEQ ID NO: 2800297 - RNA, 14 nt, Leptospira interrogans serovar lai str. 56601
ugguauuuaaaauu

SEQ ID NO: 2800298 - RNA, 21 nt, Leptospira interrogans serovar lai str. 56601
uggucaacaucucaaucaaaa

SEQ ID NO: 2800299 - RNA, 20 nt, Leptospira interrogans serovar lai str. 56601
uggucaauaaauuguaugca

SEQ ID NO: 2800300 - RNA, 18 nt, Leptospira interrogans serovar lai str. 56601
uggucgaagauaccaaau

SEQ ID NO: 2800301 - RNA, 23 nt, Leptospira interrogans serovar lai str. 56601
uggucgaucguuuuuugaucgua

SEQ ID NO: 2800302 - RNA, 15 nt, Leptospira interrogans serovar lai str. 56601
uggucuauuacaaaa

SEQ ID NO: 2800303 - RNA, 21 nt, Leptospira interrogans serovar lai str. 56601
uggugaacuauuuauaaaaua

SEQ ID NO: 2800304 - RNA, 23 nt, Leptospira interrogans serovar lai str. 56601
ugguugaaagaaucuaauuucag

SEQ ID NO: 2800305 - RNA, 14 nt, Leptospira interrogans serovar lai str. 56601
ugguugggaacaau

SEQ ID NO: 2800306 - RNA, 16 nt, Leptospira interrogans serovar lai str. 56601
ugguuuagaaaacgga

SEQ ID NO: 2800307 - RNA, 20 nt, Leptospira interrogans serovar lai str. 56601
ugguuuagacguaggaaaug

SEQ ID NO: 2800308 - RNA, 12 nt, Leptospira interrogans serovar lai str. 56601
ugguuucaauuu

SEQ ID NO: 2800309 - RNA, 16 nt, Leptospira interrogans serovar lai str. 56601
ugguuucaauuuaaaa

SEQ ID NO: 2800310 - RNA, 20 nt, Leptospira interrogans serovar lai str. 56601
ugguuucaauuuaaaauauc

SEQ ID NO: 2800311 - RNA, 15 nt, Leptospira interrogans serovar lai str. 56601
ugguuuguaauaguu

SEQ ID NO: 2800312 - RNA, 20 nt, Leptospira interrogans serovar lai str. 56601
ugguuuuaaacgauuuaaaa

SEQ ID NO: 2800313 - RNA, 14 nt, Leptospira interrogans serovar lai str. 56601
ugguuuuauuucug

SEQ ID NO: 2800314 - RNA, 18 nt, Leptospira interrogans serovar lai str. 56601
uguaaaaaaacaugaaga

SEQ ID NO: 2800315 - RNA, 12 nt, Leptospira interrogans serovar lai str. 56601
uguaaaaacuac

SEQ ID NO: 2800316 - RNA, 14 nt, Leptospira interrogans serovar lai str. 56601
uguaaaaacuacca

SEQ ID NO: 2800317 - RNA, 13 nt, Leptospira interrogans serovar lai str. 56601
uguaaaaaugagu

SEQ ID NO: 2800318 - RNA, 16 nt, Leptospira interrogans serovar lai str. 56601
uguaaaagaaaaauua

SEQ ID NO: 2800319 - RNA, 12 nt, Leptospira interrogans serovar lai str. 56601
uguaaaaugaug

SEQ ID NO: 2800320 - RNA, 20 nt, Leptospira interrogans serovar lai str. 56601
uguaaaaugauguaggaacu

SEQ ID NO: 2800321 - RNA, 13 nt, Leptospira interrogans serovar lai str. 56601
uguaaaauucaga

SEQ ID NO: 2800322 - RNA, 15 nt, Leptospira interrogans serovar lai str. 56601
uguaaaauuuagauu

SEQ ID NO: 2800323 - RNA, 18 nt, Leptospira interrogans serovar lai str. 56601
uguaaaguucuuuucuua

SEQ ID NO: 2800324 - RNA, 19 nt, Leptospira interrogans serovar lai str. 56601
uguaaaguucuuuucuuaa

SEQ ID NO: 2800325 - RNA, 19 nt, Leptospira interrogans serovar lai str. 56601
uguaaaguuuagauuuuaa

SEQ ID NO: 2800326 - RNA, 17 nt, Leptospira interrogans serovar lai str. 56601
uguaaauauguuuuuuu

SEQ ID NO: 2800327 - RNA, 17 nt, Leptospira interrogans serovar lai str. 56601
uguaaauccguauacuu

SEQ ID NO: 2800328 - RNA, 22 nt, Leptospira interrogans serovar lai str. 56601
uguaaauccguauacuuuaaaa

SEQ ID NO: 2800329 - RNA, 20 nt, Leptospira interrogans serovar lai str. 56601
uguaaaucgguucuauaaaa

SEQ ID NO: 2800330 - RNA, 11 nt, Leptospira interrogans serovar lai str. 56601
uguaaaugaau

SEQ ID NO: 2800331 - RNA, 20 nt, Leptospira interrogans serovar lai str. 56601
uguaaaugaauuggaaagaa

SEQ ID NO: 2800332 - RNA, 14 nt, Leptospira interrogans serovar lai str. 56601
uguaaaugaauuua

SEQ ID NO: 2800333 - RNA, 17 nt, Leptospira interrogans serovar lai str. 56601
uguaaauguuccaaagc

SEQ ID NO: 2800334 - RNA, 23 nt, Leptospira interrogans serovar lai str. 56601
uguaaauuagauuauuuacauau

SEQ ID NO: 2800335 - RNA, 13 nt, Leptospira interrogans serovar lai str. 56601
uguaaauucaaaa

SEQ ID NO: 2800336 - RNA, 13 nt, Leptospira interrogans serovar lai str. 56601
uguaaauucaaag

SEQ ID NO: 2800337 - RNA, 20 nt, Leptospira interrogans serovar lai str. 56601
uguccuaaaaccucaaaaaa

SEQ ID NO: 2800338 - RNA, 23 nt, Leptospira interrogans serovar lai str. 56601
uguccuaaaaccucaaaaaauuu

SEQ ID NO: 2800339 - RNA, 20 nt, Leptospira interrogans serovar lai str. 56601
uguccuaaaauuuuaaaaaa

SEQ ID NO: 2800340 - RNA, 22 nt, Leptospira interrogans serovar lai str. 56601
uguccuaaaauuuuaaaaaauu

SEQ ID NO: 2800341 - RNA, 14 nt, Leptospira interrogans serovar lai str. 56601
uguccuagaucucc

SEQ ID NO: 2800342 - RNA, 23 nt, Leptospira interrogans serovar lai str. 56601
ugucgcaacauaauguuucaauu

SEQ ID NO: 2800343 - RNA, 15 nt, Leptospira interrogans serovar lai str. 56601
ugucguaaaaaguuu

SEQ ID NO: 2800344 - RNA, 15 nt, Leptospira interrogans serovar lai str. 56601
ugucuaaacuaaaaa

SEQ ID NO: 2800345 - RNA, 19 nt, Leptospira interrogans serovar lai str. 56601
ugucuacuugucuuuagaa

SEQ ID NO: 2800346 - RNA, 23 nt, Leptospira interrogans serovar lai str. 56601
ugucuauagaugcugaaaauggu

SEQ ID NO: 2800347 - RNA, 13 nt, Leptospira interrogans serovar lai str. 56601
ugucuauuuuaau

SEQ ID NO: 2800348 - RNA, 15 nt, Leptospira interrogans serovar lai str. 56601
ugucucaaaauuaag

SEQ ID NO: 2800349 - RNA, 15 nt, Leptospira interrogans serovar lai str. 56601
ugucucaaaauuuaa

SEQ ID NO: 2800350 - RNA, 19 nt, Leptospira interrogans serovar lai str. 56601
ugucucuuuauauaaaauu

SEQ ID NO: 2800351 - RNA, 17 nt, Leptospira interrogans serovar lai str. 56601
ugucuggaacggaaaug

SEQ ID NO: 2800352 - RNA, 21 nt, Leptospira interrogans serovar lai str. 56601
ugucuucgauccgagucgaau

SEQ ID NO: 2800353 - RNA, 23 nt, Leptospira interrogans serovar lai str. 56601
ugucuucuaaaucuaauucuucu

SEQ ID NO: 2800354 - RNA, 13 nt, Leptospira interrogans serovar lai str. 56601
ugucuuuaaaauu

SEQ ID NO: 2800355 - RNA, 13 nt, Leptospira interrogans serovar lai str. 56601
ugucuuuuuagag

SEQ ID NO: 2800356 - RNA, 12 nt, Leptospira interrogans serovar lai str. 56601
ugucuuuuucua

SEQ ID NO: 2800357 - RNA, 12 nt, Leptospira interrogans serovar lai str. 56601
ugugaaacucaa

SEQ ID NO: 2800358 - RNA, 14 nt, Leptospira interrogans serovar lai str. 56601
ugugaauauuucuu

SEQ ID NO: 2800359 - RNA, 20 nt, Leptospira interrogans serovar lai str. 56601
ugugaaucaaaagguauaaa

SEQ ID NO: 2800360 - RNA, 23 nt, Leptospira interrogans serovar lai str. 56601
ugugaaucaaaagguauaaaaua

SEQ ID NO: 2800361 - RNA, 20 nt, Leptospira interrogans serovar lai str. 56601
ugugaauguauauuuuuuua

SEQ ID NO: 2800362 - RNA, 16 nt, Leptospira interrogans serovar lai str. 56601
ugugacuuuaauuuua

SEQ ID NO: 2800363 - RNA, 20 nt, Leptospira interrogans serovar lai str. 56601
ugugagaguucccacauuuu

SEQ ID NO: 2800364 - RNA, 22 nt, Leptospira interrogans serovar lai str. 56601
ugugaguucccacauuuuaaag

SEQ ID NO: 2800365 - RNA, 21 nt, Leptospira interrogans serovar lai str. 56601
ugugaguucgacguaaagaau

SEQ ID NO: 2800366 - RNA, 14 nt, Leptospira interrogans serovar lai str. 56601
ugugaguuuuaaaa

SEQ ID NO: 2800367 - RNA, 13 nt, Leptospira interrogans serovar lai str. 56601
ugugauaguuuuu

SEQ ID NO: 2800368 - RNA, 21 nt, Leptospira interrogans serovar lai str. 56601
ugugccuucguuuaaaaaacg

SEQ ID NO: 2800369 - RNA, 16 nt, Leptospira interrogans serovar lai str. 56601
ugugcuauauucaaaa

SEQ ID NO: 2800370 - RNA, 22 nt, Leptospira interrogans serovar lai str. 56601
uguggaaaacuuucuuuuacau

SEQ ID NO: 2800371 - RNA, 18 nt, Leptospira interrogans serovar lai str. 56601
uguggaacucuauauaaa

SEQ ID NO: 2800372 - RNA, 19 nt, Leptospira interrogans serovar lai str. 56601
uguggagcucgauuuuaua

SEQ ID NO: 2800373 - RNA, 22 nt, Leptospira interrogans serovar lai str. 56601
uguggauaccuuuaguuuuuua

SEQ ID NO: 2800374 - RNA, 23 nt, Leptospira interrogans serovar lai str. 56601
uguggcaagaggaacaauuugua

SEQ ID NO: 2800375 - RNA, 18 nt, Leptospira interrogans serovar lai str. 56601
ugugggaacuaccacaaa

SEQ ID NO: 2800376 - RNA, 22 nt, Leptospira interrogans serovar lai str. 56601
ugugggaacuaucacaaaucua

SEQ ID NO: 2800377 - RNA, 15 nt, Leptospira interrogans serovar lai str. 56601
ugugggaacuauuac

SEQ ID NO: 2800378 - RNA, 17 nt, Leptospira interrogans serovar lai str. 56601
ugugggaacucucacaa

SEQ ID NO: 2800379 - RNA, 20 nt, Leptospira interrogans serovar lai str. 56601
ugugggaacucucacaaauc

SEQ ID NO: 2800380 - RNA, 23 nt, Leptospira interrogans serovar lai str. 56601
ugugggaacucucacaaaucgug

SEQ ID NO: 2800381 - RNA, 23 nt, Leptospira interrogans serovar lai str. 56601
uguggggcgggaacuaaguuuua

SEQ ID NO: 2800382 - RNA, 22 nt, Leptospira interrogans serovar lai str. 56601
uguggguggggacuaaguuuua

SEQ ID NO: 2800383 - RNA, 15 nt, Leptospira interrogans serovar lai str. 56601
ugugguagguuucca

SEQ ID NO: 2800384 - RNA, 16 nt, Leptospira interrogans serovar lai str. 56601
ugugguaguucccaca

SEQ ID NO: 2800385 - RNA, 16 nt, Leptospira interrogans serovar lai str. 56601
ugugguaguuccuacg

SEQ ID NO: 2800386 - RNA, 17 nt, Leptospira interrogans serovar lai str. 56601
uguguaaugauuucaga

SEQ ID NO: 2800387 - RNA, 20 nt, Leptospira interrogans serovar lai str. 56601
uguguuaguucccacauuuu

SEQ ID NO: 2800388 - RNA, 17 nt, Leptospira interrogans serovar lai str. 56601
uguguugaguuuuuccu

SEQ ID NO: 2800389 - RNA, 23 nt, Leptospira interrogans serovar lai str. 56601
uguguuucagacugacugaaaaa

SEQ ID NO: 2800390 - RNA, 18 nt, Leptospira interrogans serovar lai str. 56601
uguguuugauaauuugug

SEQ ID NO: 2800391 - RNA, 15 nt, Leptospira interrogans serovar lai str. 56601
uguguuuuuuaacau

SEQ ID NO: 2800392 - RNA, 13 nt, Leptospira interrogans serovar lai str. 56601
uguguuuuuucuu

SEQ ID NO: 2800393 - RNA, 21 nt, Leptospira interrogans serovar lai str. 56601
uguuaaaagauuuguuuuaua

SEQ ID NO: 2800394 - RNA, 20 nt, Leptospira interrogans serovar lai str. 56601
uguuaaaagccauuucaaaa

SEQ ID NO: 2800395 - RNA, 20 nt, Leptospira interrogans serovar lai str. 56601
uguuaaaauaaaaaaauuga

SEQ ID NO: 2800396 - RNA, 15 nt, Leptospira interrogans serovar lai str. 56601
uguuaaccaaaaauu

SEQ ID NO: 2800397 - RNA, 17 nt, Leptospira interrogans serovar lai str. 56601
uguuaaccaaaaauuca

SEQ ID NO: 2800398 - RNA, 23 nt, Leptospira interrogans serovar lai str. 56601
uguuaaccaccucuauggaauuu

SEQ ID NO: 2800399 - RNA, 15 nt, Leptospira interrogans serovar lai str. 56601
uguuaagauaaauuu

SEQ ID NO: 2800400 - RNA, 19 nt, Leptospira interrogans serovar lai str. 56601
uguuacggaguaaagucga

SEQ ID NO: 2800401 - RNA, 21 nt, Leptospira interrogans serovar lai str. 56601
uguuacgguaauauauucaau

SEQ ID NO: 2800402 - RNA, 22 nt, Leptospira interrogans serovar lai str. 56601
uguuacucgucuuuauaaaguu

SEQ ID NO: 2800403 - RNA, 23 nt, Leptospira interrogans serovar lai str. 56601
uguuaggcaauauuauuuuaacu

SEQ ID NO: 2800404 - RNA, 18 nt, Leptospira interrogans serovar lai str. 56601
uguuaguucccacauuuc

SEQ ID NO: 2800405 - RNA, 13 nt, Leptospira interrogans serovar lai str. 56601
uguuauaaaaugu

SEQ ID NO: 2800406 - RNA, 17 nt, Leptospira interrogans serovar lai str. 56601
uguuauaaaauguauua

SEQ ID NO: 2800407 - RNA, 14 nt, Leptospira interrogans serovar lai str. 56601
uguuauagaugaaa

SEQ ID NO: 2800408 - RNA, 16 nt, Leptospira interrogans serovar lai str. 56601
uguuauagaugaaauu

SEQ ID NO: 2800409 - RNA, 17 nt, Leptospira interrogans serovar lai str. 56601
uguuauauauuuuuaau

SEQ ID NO: 2800410 - RNA, 15 nt, Leptospira interrogans serovar lai str. 56601
uguuauaucgaauuc

SEQ ID NO: 2800411 - RNA, 17 nt, Leptospira interrogans serovar lai str. 56601
uguuaucaacuuuugga

SEQ ID NO: 2800412 - RNA, 19 nt, Leptospira interrogans serovar lai str. 56601
uguuaucgcuaauacaaaa

SEQ ID NO: 2800413 - RNA, 14 nt, Leptospira interrogans serovar lai str. 56601
uguuauuuuuauua

SEQ ID NO: 2800414 - RNA, 16 nt, Leptospira interrogans serovar lai str. 56601
uguucaaagaaaugug

SEQ ID NO: 2800415 - RNA, 16 nt, Leptospira interrogans serovar lai str. 56601
uguucauaaaaacguc

SEQ ID NO: 2800416 - RNA, 17 nt, Leptospira interrogans serovar lai str. 56601
uguucauucuuuaaaau

SEQ ID NO: 2800417 - RNA, 21 nt, Leptospira interrogans serovar lai str. 56601
uguuccaaaaccucaaaaaau

SEQ ID NO: 2800418 - RNA, 20 nt, Leptospira interrogans serovar lai str. 56601
uguuccgaaaggaaaagaaa

SEQ ID NO: 2800419 - RNA, 21 nt, Leptospira interrogans serovar lai str. 56601
uuaaaaguagaaucaucucaa

SEQ ID NO: 2800420 - RNA, 16 nt, Leptospira interrogans serovar lai str. 56601
uuaaaaucacaaaaaa

SEQ ID NO: 2800421 - RNA, 22 nt, Leptospira interrogans serovar lai str. 56601
uuaaaaucagggccggagaaaa

SEQ ID NO: 2800422 - RNA, 12 nt, Leptospira interrogans serovar lai str. 56601
uuaaaaucggaa

SEQ ID NO: 2800423 - RNA, 19 nt, Leptospira interrogans serovar lai str. 56601
uuaaaaucguaaaaaagau

SEQ ID NO: 2800424 - RNA, 20 nt, Leptospira interrogans serovar lai str. 56601
uuaaaaucuaucucaaaaau

SEQ ID NO: 2800425 - RNA, 18 nt, Leptospira interrogans serovar lai str. 56601
uuaaaaugaaaauuauaa

SEQ ID NO: 2800426 - RNA, 21 nt, Leptospira interrogans serovar lai str. 56601
uuaaaauguacaauuaaagua

SEQ ID NO: 2800427 - RNA, 21 nt, Leptospira interrogans serovar lai str. 56601
uuaaaauuaaugaggagaaaa

SEQ ID NO: 2800428 - RNA, 23 nt, Leptospira interrogans serovar lai str. 56601
uuaaaauuaaugaggagaaaaaa

SEQ ID NO: 2800429 - RNA, 12 nt, Leptospira interrogans serovar lai str. 56601
uuaaaauuuaug

SEQ ID NO: 2800430 - RNA, 14 nt, Leptospira interrogans serovar lai str. 56601
uuaaaauuugaaaa

SEQ ID NO: 2800431 - RNA, 21 nt, Leptospira interrogans serovar lai str. 56601
uuaaaauuugugauaucucau

SEQ ID NO: 2800432 - RNA, 16 nt, Leptospira interrogans serovar lai str. 56601
uuaaaauuuuuaauaa

SEQ ID NO: 2800433 - RNA, 17 nt, Leptospira interrogans serovar lai str. 56601
uuaaaauuuuuaauaaa

SEQ ID NO: 2800434 - RNA, 16 nt, Leptospira interrogans serovar lai str. 56601
uuaaacaaagaauaaa

SEQ ID NO: 2800435 - RNA, 16 nt, Leptospira interrogans serovar lai str. 56601
uuaaacaauugauugc

SEQ ID NO: 2800436 - RNA, 14 nt, Leptospira interrogans serovar lai str. 56601
uuaaacaauuuuuc

SEQ ID NO: 2800437 - RNA, 15 nt, Leptospira interrogans serovar lai str. 56601
uuaaacaauuuuuca

SEQ ID NO: 2800438 - RNA, 22 nt, Leptospira interrogans serovar lai str. 56601
uuaaacauuuauuuuucguaau

SEQ ID NO: 2800439 - RNA, 14 nt, Leptospira interrogans serovar lai str. 56601
uuaaaccaguuugu

SEQ ID NO: 2800440 - RNA, 18 nt, Leptospira interrogans serovar lai str. 56601
uuaaaccgguaaaaagua

SEQ ID NO: 2800441 - RNA, 22 nt, Leptospira interrogans serovar lai str. 56601
uuaaaccgguaaaaaguaaaac

SEQ ID NO: 2800442 - RNA, 15 nt, Leptospira interrogans serovar lai str. 56601
uuaaaccuuccuuug

SEQ ID NO: 2800443 - RNA, 15 nt, Leptospira interrogans serovar lai str. 56601
uuaaacgauuuaaaa

SEQ ID NO: 2800444 - RNA, 18 nt, Leptospira interrogans serovar lai str. 56601
uuaaacguuuauuucaaa

SEQ ID NO: 2800445 - RNA, 19 nt, Leptospira interrogans serovar lai str. 56601
uuaaacguuuauuucaaaa

SEQ ID NO: 2800446 - RNA, 14 nt, Leptospira interrogans serovar lai str. 56601
uuaaacuauagaga

SEQ ID NO: 2800447 - RNA, 20 nt, Leptospira interrogans serovar lai str. 56601
uuaaacucauucuaguuugu

SEQ ID NO: 2800448 - RNA, 22 nt, Leptospira interrogans serovar lai str. 56601
uuaaacuuagauucgaguccuu

SEQ ID NO: 2800449 - RNA, 16 nt, Leptospira interrogans serovar lai str. 56601
uuaaacuuauauugau

SEQ ID NO: 2800450 - RNA, 15 nt, Leptospira interrogans serovar lai str. 56601
uuaaacuucaaaaaa

SEQ ID NO: 2800451 - RNA, 16 nt, Leptospira interrogans serovar lai str. 56601
uuaaacuuuuauaaaa

SEQ ID NO: 2800452 - RNA, 16 nt, Leptospira interrogans serovar lai str. 56601
uuaaagaaacucauaa

SEQ ID NO: 2800453 - RNA, 22 nt, Leptospira interrogans serovar lai str. 56601
uuaaagaaugaucaacuacuaa

SEQ ID NO: 2800454 - RNA, 20 nt, Leptospira interrogans serovar lai str. 56601
uuaaagaauuuuuacagaaa

SEQ ID NO: 2800455 - RNA, 18 nt, Leptospira interrogans serovar lai str. 56601
uuaaagacgauugauucu

SEQ ID NO: 2800456 - RNA, 16 nt, Leptospira interrogans serovar lai str. 56601
uuaaagccucaugaaa

SEQ ID NO: 2800457 - RNA, 15 nt, Leptospira interrogans serovar lai str. 56601
uuaaaguaaaauuaa

SEQ ID NO: 2800458 - RNA, 21 nt, Leptospira interrogans serovar lai str. 56601
uuaaaguuguugaaaaauuaa

SEQ ID NO: 2800459 - RNA, 21 nt, Leptospira interrogans serovar lai str. 56601
uuaaaguuuacaucaaaaaca

SEQ ID NO: 2800460 - RNA, 14 nt, Leptospira interrogans serovar lai str. 56601
uuaaauaaaaagaa

SEQ ID NO: 2800461 - RNA, 16 nt, Leptospira interrogans serovar lai str. 56601
uuaaauaaaauuuucc

SEQ ID NO: 2800462 - RNA, 13 nt, Leptospira interrogans serovar lai str. 56601
uuaaauacauuaa

SEQ ID NO: 2800463 - RNA, 23 nt, Leptospira interrogans serovar lai str. 56601
uuaaauacauuaagauuauauua

SEQ ID NO: 2800464 - RNA, 22 nt, Leptospira interrogans serovar lai str. 56601
uuaaauaccuaaauauuuauua

SEQ ID NO: 2800465 - RNA, 15 nt, Leptospira interrogans serovar lai str. 56601
uuaaauacuuaaaaa

SEQ ID NO: 2800466 - RNA, 15 nt, Listeria monocytogenes EGD-e
aaaauaaaucugcuu

SEQ ID NO: 2800467 - RNA, 14 nt, Listeria monocytogenes EGD-e
aaaauaaguccaaa

SEQ ID NO: 2800468 - RNA, 17 nt, Listeria monocytogenes EGD-e
aaaauaauaucuucuau

SEQ ID NO: 2800469 - RNA, 21 nt, Listeria monocytogenes EGD-e
aaaauagacgaccauauaauc

SEQ ID NO: 2800470 - RNA, 19 nt, Listeria monocytogenes EGD-e
aaaauauugaauagaacua

SEQ ID NO: 2800471 - RNA, 16 nt, Listeria monocytogenes EGD-e
aaaaucaugccuucaa

SEQ ID NO: 2800472 - RNA, 15 nt, Listeria monocytogenes EGD-e
aaaaucauuaaauuu

SEQ ID NO: 2800473 - RNA, 15 nt, Listeria monocytogenes EGD-e
aaaaucuacaacuag

SEQ ID NO: 2800474 - RNA, 18 nt, Listeria monocytogenes EGD-e
aaaaucuggauuuacuac

SEQ ID NO: 2800475 - RNA, 15 nt, Listeria monocytogenes EGD-e
aaaaucuuuaaacaa

SEQ ID NO: 2800476 - RNA, 13 nt, Listeria monocytogenes EGD-e
aaaaugaaaagaa

SEQ ID NO: 2800477 - RNA, 17 nt, Listeria monocytogenes EGD-e
aaaaugagcccaaaaau

SEQ ID NO: 2800478 - RNA, 21 nt, Listeria monocytogenes EGD-e
aaaaugagcccaaaaauaagu

SEQ ID NO: 2800479 - RNA, 22 nt, Listeria monocytogenes EGD-e
aaaaugauucuaguuuguccca

SEQ ID NO: 2800480 - RNA, 21 nt, Listeria monocytogenes EGD-e
aaaaugcuaauuuauuuagaa

SEQ ID NO: 2800481 - RNA, 22 nt, Listeria monocytogenes EGD-e
aaaaugcuaauuuauuuagaaa

SEQ ID NO: 2800482 - RNA, 19 nt, Listeria monocytogenes EGD-e
aaaaugcucaucaagaaau

SEQ ID NO: 2800483 - RNA, 20 nt, Listeria monocytogenes EGD-e
aaaaugcucaucaagaaauu

SEQ ID NO: 2800484 - RNA, 22 nt, Listeria monocytogenes EGD-e
aaaauggccaaccggaucauca

SEQ ID NO: 2800485 - RNA, 18 nt, Listeria monocytogenes EGD-e
aaaaugggcaguuacuuu

SEQ ID NO: 2800486 - RNA, 23 nt, Listeria monocytogenes EGD-e
aaaaugguacguugguuguucuu

SEQ ID NO: 2800487 - RNA, 19 nt, Listeria monocytogenes EGD-e
aaaaugguuucuuaaauac

SEQ ID NO: 2800488 - RNA, 13 nt, Listeria monocytogenes EGD-e
aaaauuucaucgu

SEQ ID NO: 2800489 - RNA, 22 nt, Listeria monocytogenes EGD-e
aaaauuuugguuuggucaacau

SEQ ID NO: 2800490 - RNA, 14 nt, Listeria monocytogenes EGD-e
aaacaaaguaccaa

SEQ ID NO: 2800491 - RNA, 17 nt, Listeria monocytogenes EGD-e
aaacaacccauuugcau

SEQ ID NO: 2800492 - RNA, 12 nt, Listeria monocytogenes EGD-e
aaacaauaacau

SEQ ID NO: 2800493 - RNA, 18 nt, Listeria monocytogenes EGD-e
aaacaggcguaauaaaug

SEQ ID NO: 2800494 - RNA, 14 nt, Listeria monocytogenes EGD-e
aaacaucacaccuu

SEQ ID NO: 2800495 - RNA, 20 nt, Listeria monocytogenes EGD-e
aaacaucuuccgcucuuuuu

SEQ ID NO: 2800496 - RNA, 21 nt, Listeria monocytogenes EGD-e
aaacaucuugacuuuguuaac

SEQ ID NO: 2800497 - RNA, 20 nt, Listeria monocytogenes EGD-e
aaacauuauuuugcuaaaga

SEQ ID NO: 2800498 - RNA, 20 nt, Listeria monocytogenes EGD-e
aaacauucgguccuuguacu

SEQ ID NO: 2800499 - RNA, 23 nt, Listeria monocytogenes EGD-e
aaacauuugauacauauuugaac

SEQ ID NO: 2800500 - RNA, 18 nt, Listeria monocytogenes EGD-e
aaacauuuucauucuuuc

SEQ ID NO: 2800501 - RNA, 24 nt, Listeria monocytogenes EGD-e
aaaccaaauaugcuauacaacaca

SEQ ID NO: 2800502 - RNA, 18 nt, Listeria monocytogenes EGD-e
aaaccauuauacaauuaa

SEQ ID NO: 2800503 - RNA, 20 nt, Listeria monocytogenes EGD-e
aaaccauuauacaauuaaua

SEQ ID NO: 2800504 - RNA, 19 nt, Listeria monocytogenes EGD-e
aaaccauucaucuaauuua

SEQ ID NO: 2800505 - RNA, 22 nt, Listeria monocytogenes EGD-e
aaaccgauaauuuucauuuguu

SEQ ID NO: 2800506 - RNA, 18 nt, Listeria monocytogenes EGD-e
aaaccguaacuguugaaa

SEQ ID NO: 2800507 - RNA, 18 nt, Listeria monocytogenes EGD-e
aaacgacagauaaauaug

SEQ ID NO: 2800508 - RNA, 20 nt, Listeria monocytogenes EGD-e
aaacguuccaguuaaacaaa

SEQ ID NO: 2800509 - RNA, 21 nt, Listeria monocytogenes EGD-e
aaacguuccaguuaaacaaac

SEQ ID NO: 2800510 - RNA, 20 nt, Listeria monocytogenes EGD-e
aaacguuccgauacaacaaa

SEQ ID NO: 2800511 - RNA, 16 nt, Listeria monocytogenes EGD-e
aaacuacugguucuuc

SEQ ID NO: 2800512 - RNA, 15 nt, Listeria monocytogenes EGD-e
aaacuaucaauaaau

SEQ ID NO: 2800513 - RNA, 18 nt, Listeria monocytogenes EGD-e
aaacuaucaauaaaucca

SEQ ID NO: 2800514 - RNA, 12 nt, Listeria monocytogenes EGD-e
aaacuuucacaa

SEQ ID NO: 2800515 - RNA, 15 nt, Listeria monocytogenes EGD-e
aaacuuucuuuucuu

SEQ ID NO: 2800516 - RNA, 17 nt, Listeria monocytogenes EGD-e
aaacuuuuucucaaaaa

SEQ ID NO: 2800517 - RNA, 18 nt, Listeria monocytogenes EGD-e
aaagaacuagauuuaaua

SEQ ID NO: 2800518 - RNA, 21 nt, Listeria monocytogenes EGD-e
aaagaacuuacagaagcauuu

SEQ ID NO: 2800519 - RNA, 12 nt, Listeria monocytogenes EGD-e
aaagaagaaaaa

SEQ ID NO: 2800520 - RNA, 13 nt, Listeria monocytogenes EGD-e
aaagaagaaaaag

SEQ ID NO: 2800521 - RNA, 12 nt, Listeria monocytogenes EGD-e
aaagaauaaaac

SEQ ID NO: 2800522 - RNA, 21 nt, Listeria monocytogenes EGD-e
aaagaauauccguuucauuuu

SEQ ID NO: 2800523 - RNA, 18 nt, Listeria monocytogenes EGD-e
aaagagccauaaaauuag

SEQ ID NO: 2800524 - RNA, 15 nt, Listeria monocytogenes EGD-e
aaagaggauuuucca

SEQ ID NO: 2800525 - RNA, 16 nt, Listeria monocytogenes EGD-e
aaagaggauuuuccaa

SEQ ID NO: 2800526 - RNA, 16 nt, Listeria monocytogenes EGD-e
aaagauacuuugaauu

SEQ ID NO: 2800527 - RNA, 17 nt, Listeria monocytogenes EGD-e
aaagcaaaugcauuucu

SEQ ID NO: 2800528 - RNA, 13 nt, Listeria monocytogenes EGD-e
aaagcaucgaaua

SEQ ID NO: 2800529 - RNA, 15 nt, Listeria monocytogenes EGD-e
aaagcaugaauuuuu

SEQ ID NO: 2800530 - RNA, 18 nt, Listeria monocytogenes EGD-e
aaagccaguuuucauuuc

SEQ ID NO: 2800531 - RNA, 19 nt, Listeria monocytogenes EGD-e
aaagcgaacuuaacgaauu

SEQ ID NO: 2800532 - RNA, 17 nt, Listeria monocytogenes EGD-e
aaagcuaagcauuauaa

SEQ ID NO: 2800533 - RNA, 17 nt, Listeria monocytogenes EGD-e
aaagcuguuuucaacaa

SEQ ID NO: 2800534 - RNA, 21 nt, Listeria monocytogenes EGD-e
aaagcuguuuucaacaaaaca

SEQ ID NO: 2800535 - RNA, 18 nt, Listeria monocytogenes EGD-e
aaagggaugaaaaucuac

SEQ ID NO: 2800536 - RNA, 23 nt, Listeria monocytogenes EGD-e
aaaguaaaaucuuuuaauaacug

SEQ ID NO: 2800537 - RNA, 17 nt, Listeria monocytogenes EGD-e
aaaguaacuaaaaauca

SEQ ID NO: 2800538 - RNA, 20 nt, Listeria monocytogenes EGD-e
aaaguaacuaaaaaucauuu

SEQ ID NO: 2800539 - RNA, 18 nt, Listeria monocytogenes EGD-e
aaaguaaguuucgcuccg

SEQ ID NO: 2800540 - RNA, 23 nt, Listeria monocytogenes EGD-e
aaaguagauuccgcuaaaacuaa

SEQ ID NO: 2800541 - RNA, 21 nt, Listeria monocytogenes EGD-e
aaaguauugugcuaaguagac

SEQ ID NO: 2800542 - RNA, 16 nt, Listeria monocytogenes EGD-e
aaagugaccuuugaaa

SEQ ID NO: 2800543 - RNA, 17 nt, Listeria monocytogenes EGD-e
aaagugaccuuugaaaa

SEQ ID NO: 2800544 - RNA, 23 nt, Listeria monocytogenes EGD-e
aaagugcgcuuauuuuuugagcg

SEQ ID NO: 2800545 - RNA, 20 nt, Listeria monocytogenes EGD-e
aaagugcguaagauuuuugc

SEQ ID NO: 2800546 - RNA, 15 nt, Listeria monocytogenes EGD-e
aaaguguauuuacaa

SEQ ID NO: 2800547 - RNA, 12 nt, Listeria monocytogenes EGD-e
aaaguuagauua

SEQ ID NO: 2800548 - RNA, 13 nt, Listeria monocytogenes EGD-e
aaaguuucuuuuu

SEQ ID NO: 2800549 - RNA, 17 nt, Listeria monocytogenes EGD-e
aaaguuuuaugacaauu

SEQ ID NO: 2800550 - RNA, 21 nt, Listeria monocytogenes EGD-e
aaaguuuuaugacaauuaaaa

SEQ ID NO: 2800551 - RNA, 12 nt, Listeria monocytogenes EGD-e
aaauaaccauuc

SEQ ID NO: 2800552 - RNA, 14 nt, Listeria monocytogenes EGD-e
aaauaaccauucca

SEQ ID NO: 2800553 - RNA, 20 nt, Listeria monocytogenes EGD-e
aaauaacggaaacuaucaau

SEQ ID NO: 2800554 - RNA, 20 nt, Listeria monocytogenes EGD-e
aaauaacguugcauuaaaaa

SEQ ID NO: 2800555 - RNA, 18 nt, Listeria monocytogenes EGD-e
aaauaacuacuauuuaaa

SEQ ID NO: 2800556 - RNA, 20 nt, Listeria monocytogenes EGD-e
aaauaacuacuauuuaaaua

SEQ ID NO: 2800557 - RNA, 22 nt, Listeria monocytogenes EGD-e
aaauaaguccaaagagccauaa

SEQ ID NO: 2800558 - RNA, 12 nt, Listeria monocytogenes EGD-e
aaauaauaccag

SEQ ID NO: 2800559 - RNA, 12 nt, Listeria monocytogenes EGD-e
aaauaauccuuc

SEQ ID NO: 2800560 - RNA, 13 nt, Listeria monocytogenes EGD-e
aaauaauccuucc

SEQ ID NO: 2800561 - RNA, 19 nt, Listeria monocytogenes EGD-e
aaauaauuccauuuaauuu

SEQ ID NO: 2800562 - RNA, 22 nt, Listeria monocytogenes EGD-e
aaauacaugaccgccaauuuua

SEQ ID NO: 2800563 - RNA, 14 nt, Listeria monocytogenes EGD-e
aaauacauuuuagc

SEQ ID NO: 2800564 - RNA, 16 nt, Listeria monocytogenes EGD-e
aaauaccgaaugcaau

SEQ ID NO: 2800565 - RNA, 16 nt, Listeria monocytogenes EGD-e
aaauagcacagcuacc

SEQ ID NO: 2800566 - RNA, 15 nt, Listeria monocytogenes EGD-e
aaauagcuuucccuu

SEQ ID NO: 2800567 - RNA, 20 nt, Listeria monocytogenes EGD-e
aacauagcuacaauuaaaau

SEQ ID NO: 2800568 - RNA, 21 nt, Listeria monocytogenes EGD-e
aacauagcuacaauuaaaaua

SEQ ID NO: 2800569 - RNA, 23 nt, Listeria monocytogenes EGD-e
aacauagcuacaauuaaaauagu

SEQ ID NO: 2800570 - RNA, 16 nt, Listeria monocytogenes EGD-e
aacaucagauuaaaua

SEQ ID NO: 2800571 - RNA, 11 nt, Listeria monocytogenes EGD-e
aacaucauuag

SEQ ID NO: 2800572 - RNA, 15 nt, Listeria monocytogenes EGD-e
aacaucuuuguauac

SEQ ID NO: 2800573 - RNA, 12 nt, Listeria monocytogenes EGD-e
aacaugauauau

SEQ ID NO: 2800574 - RNA, 17 nt, Listeria monocytogenes EGD-e
aacauuaaaccucuuuu

SEQ ID NO: 2800575 - RNA, 13 nt, Listeria monocytogenes EGD-e
aacauuucucccu

SEQ ID NO: 2800576 - RNA, 14 nt, Listeria monocytogenes EGD-e
aacauuucucccuc

SEQ ID NO: 2800577 - RNA, 13 nt, Listeria monocytogenes EGD-e
aaccauuauuugg

SEQ ID NO: 2800578 - RNA, 19 nt, Listeria monocytogenes EGD-e
aaccauucaucuaauuuag

SEQ ID NO: 2800579 - RNA, 18 nt, Listeria monocytogenes EGD-e
aaccauuccguugaaaga

SEQ ID NO: 2800580 - RNA, 21 nt, Listeria monocytogenes EGD-e
aaccgagaaaucucaugaaac

SEQ ID NO: 2800581 - RNA, 21 nt, Listeria monocytogenes EGD-e
aaccgaguuaccugucgcugu

SEQ ID NO: 2800582 - RNA, 16 nt, Listeria monocytogenes EGD-e
aaccguaacuguugaa

SEQ ID NO: 2800583 - RNA, 13 nt, Listeria monocytogenes EGD-e
aaccuaguuuuau

SEQ ID NO: 2800584 - RNA, 15 nt, Listeria monocytogenes EGD-e
aacgaauccuuggaa

SEQ ID NO: 2800585 - RNA, 18 nt, Listeria monocytogenes EGD-e
aacgaauccuuggaaaaa

SEQ ID NO: 2800586 - RNA, 21 nt, Listeria monocytogenes EGD-e
aacgaauccuuggaaaaauga

SEQ ID NO: 2800587 - RNA, 13 nt, Listeria monocytogenes EGD-e
aacgacaaauggu

SEQ ID NO: 2800588 - RNA, 21 nt, Listeria monocytogenes EGD-e
aacgacauccuucagccaauu

SEQ ID NO: 2800589 - RNA, 15 nt, Listeria monocytogenes EGD-e
aacgauagauuuuaa

SEQ ID NO: 2800590 - RNA, 16 nt, Listeria monocytogenes EGD-e
aacgauagauuuuaau

SEQ ID NO: 2800591 - RNA, 20 nt, Listeria monocytogenes EGD-e
aacgauguucauuacuucag

SEQ ID NO: 2800592 - RNA, 23 nt, Listeria monocytogenes EGD-e
aacgauguucauuacuucagcca

SEQ ID NO: 2800593 - RNA, 14 nt, Listeria monocytogenes EGD-e
aacgcaucugcuaa

SEQ ID NO: 2800594 - RNA, 22 nt, Listeria monocytogenes EGD-e
aacgcaucugcuaauacuauug

SEQ ID NO: 2800595 - RNA, 18 nt, Listeria monocytogenes EGD-e
aacgcgcguauccacaua

SEQ ID NO: 2800596 - RNA, 13 nt, Listeria monocytogenes EGD-e
aacgcuaucaauc

SEQ ID NO: 2800597 - RNA, 22 nt, Listeria monocytogenes EGD-e
aacggagagcuagaaagccuuu

SEQ ID NO: 2800598 - RNA, 18 nt, Listeria monocytogenes EGD-e
aacguaacgggucgcugu

SEQ ID NO: 2800599 - RNA, 18 nt, Listeria monocytogenes EGD-e
aacguauuggguuugaua

SEQ ID NO: 2800600 - RNA, 22 nt, Listeria monocytogenes EGD-e
aacguuccgauacaacaaaaua

SEQ ID NO: 2800601 - RNA, 13 nt, Listeria monocytogenes EGD-e
aacuaaauuaauu

SEQ ID NO: 2800602 - RNA, 19 nt, Listeria monocytogenes EGD-e
aacuaacacuuauaugaaa

SEQ ID NO: 2800603 - RNA, 17 nt, Listeria monocytogenes EGD-e
aacuauaaccaaauuuc

SEQ ID NO: 2800604 - RNA, 14 nt, Listeria monocytogenes EGD-e
aacucccagccaua

SEQ ID NO: 2800605 - RNA, 20 nt, Listeria monocytogenes EGD-e
aacuccugcauuguuaaauu

SEQ ID NO: 2800606 - RNA, 23 nt, Listeria monocytogenes EGD-e
aacuccugcauuguuaaauuauc

SEQ ID NO: 2800607 - RNA, 23 nt, Listeria monocytogenes EGD-e
aacucucccauuugucccacaaa

SEQ ID NO: 2800608 - RNA, 13 nt, Listeria monocytogenes EGD-e
aacugaacaaaga

SEQ ID NO: 2800609 - RNA, 14 nt, Listeria monocytogenes EGD-e
aacugaacaaagaa

SEQ ID NO: 2800610 - RNA, 15 nt, Listeria monocytogenes EGD-e
aacugaacaaagaag

SEQ ID NO: 2800611 - RNA, 19 nt, Listeria monocytogenes EGD-e
aacugaacaaagaagaaga

SEQ ID NO: 2800612 - RNA, 15 nt, Listeria monocytogenes EGD-e
aacugacuagaaauu

SEQ ID NO: 2800613 - RNA, 23 nt, Listeria monocytogenes EGD-e
aacugacuagaaauuaaugccag

SEQ ID NO: 2800614 - RNA, 21 nt, Listeria monocytogenes EGD-e
aacugguuccauuaaaucaua

SEQ ID NO: 2800615 - RNA, 21 nt, Listeria monocytogenes EGD-e
aacuuacagaagcauuuucau

SEQ ID NO: 2800616 - RNA, 22 nt, Listeria monocytogenes EGD-e
aacuuauaaugcagauuaaccc

SEQ ID NO: 2800617 - RNA, 18 nt, Listeria monocytogenes EGD-e
aacuuaucucuucauuuu

SEQ ID NO: 2800618 - RNA, 12 nt, Listeria monocytogenes EGD-e
aacuucaaaauu

SEQ ID NO: 2800619 - RNA, 19 nt, Listeria monocytogenes EGD-e
aacuucaaaauuacuauuu

SEQ ID NO: 2800620 - RNA, 19 nt, Listeria monocytogenes EGD-e
aacuucaccacuucuucca

SEQ ID NO: 2800621 - RNA, 18 nt, Listeria monocytogenes EGD-e
aacuucacuaacaaaaua

SEQ ID NO: 2800622 - RNA, 18 nt, Listeria monocytogenes EGD-e
aacuucauuagacaaaaa

SEQ ID NO: 2800623 - RNA, 21 nt, Listeria monocytogenes EGD-e
aacuucauuagacaaaaagaa

SEQ ID NO: 2800624 - RNA, 22 nt, Listeria monocytogenes EGD-e
aacuucucuccaaucagcaaga

SEQ ID NO: 2800625 - RNA, 14 nt, Listeria monocytogenes EGD-e
aacuucuuccgcuu

SEQ ID NO: 2800626 - RNA, 22 nt, Listeria monocytogenes EGD-e
aacuuggaaaguggaccccgau

SEQ ID NO: 2800627 - RNA, 14 nt, Listeria monocytogenes EGD-e
aacuuguuuuugua

SEQ ID NO: 2800628 - RNA, 15 nt, Listeria monocytogenes EGD-e
aacuuguuuuuguag

SEQ ID NO: 2800629 - RNA, 16 nt, Listeria monocytogenes EGD-e
aacuuuaucaagaaca

SEQ ID NO: 2800630 - RNA, 23 nt, Listeria monocytogenes EGD-e
aacuuucucuugcuuuaauuugg

SEQ ID NO: 2800631 - RNA, 16 nt, Listeria monocytogenes EGD-e
aacuuucuuguuucau

SEQ ID NO: 2800632 - RNA, 22 nt, Listeria monocytogenes EGD-e
aacuuuuucucaaaaauaugcu

SEQ ID NO: 2800633 - RNA, 23 nt, Listeria monocytogenes EGD-e
aacuuuuuuucuuagaagaugca

SEQ ID NO: 2800634 - RNA, 11 nt, Listeria monocytogenes EGD-e
aagaaaaaaag

SEQ ID NO: 2800635 - RNA, 21 nt, Listeria monocytogenes EGD-e
aagaaaaaccgagaaaucuca

SEQ ID NO: 2800636 - RNA, 19 nt, Listeria monocytogenes EGD-e
aagaaaaucccaauagaaa

SEQ ID NO: 2800637 - RNA, 21 nt, Listeria monocytogenes EGD-e
aagaaaucgccuugaugugga

SEQ ID NO: 2800638 - RNA, 12 nt, Listeria monocytogenes EGD-e
aagaaauuaaau

SEQ ID NO: 2800639 - RNA, 16 nt, Listeria monocytogenes EGD-e
aagaacuagauuuaau

SEQ ID NO: 2800640 - RNA, 19 nt, Listeria monocytogenes EGD-e
aagaagagcugcaacagau

SEQ ID NO: 2800641 - RNA, 11 nt, Listeria monocytogenes EGD-e
aagaagcuuuu

SEQ ID NO: 2800642 - RNA, 19 nt, Listeria monocytogenes EGD-e
aagaagggcuuuuuuccuu

SEQ ID NO: 2800643 - RNA, 15 nt, Listeria monocytogenes EGD-e
aagaaguacaauaaa

SEQ ID NO: 2800644 - RNA, 14 nt, Listeria monocytogenes EGD-e
aagaauaguacaua

SEQ ID NO: 2800645 - RNA, 18 nt, Listeria monocytogenes EGD-e
aagaauugauucgucuua

SEQ ID NO: 2800646 - RNA, 18 nt, Listeria monocytogenes EGD-e
aagacauaacaaguacaa

SEQ ID NO: 2800647 - RNA, 16 nt, Listeria monocytogenes EGD-e
aagaccuaaacgaagc

SEQ ID NO: 2800648 - RNA, 18 nt, Listeria monocytogenes EGD-e
aagagaaaaaguuucaau

SEQ ID NO: 2800649 - RNA, 19 nt, Listeria monocytogenes EGD-e
aagagaaacuuuuucucaa

SEQ ID NO: 2800650 - RNA, 20 nt, Listeria monocytogenes EGD-e
aagagaaacuuuuucucaaa

SEQ ID NO: 2800651 - RNA, 21 nt, Listeria monocytogenes EGD-e
aagagaaacuuuuucucaaaa

SEQ ID NO: 2800652 - RNA, 13 nt, Listeria monocytogenes EGD-e
aagagccauaaaa

SEQ ID NO: 2800653 - RNA, 14 nt, Listeria monocytogenes EGD-e
aagagccauaaaau

SEQ ID NO: 2800654 - RNA, 22 nt, Listeria monocytogenes EGD-e
aagagcgagagcaccaaaaaca

SEQ ID NO: 2800655 - RNA, 17 nt, Listeria monocytogenes EGD-e
aagauaaacuaauuacu

SEQ ID NO: 2800656 - RNA, 22 nt, Listeria monocytogenes EGD-e
aagaucuuccgguaucaugaau

SEQ ID NO: 2800657 - RNA, 17 nt, Listeria monocytogenes EGD-e
aagaugcacuagaaaaa

SEQ ID NO: 2800658 - RNA, 20 nt, Listeria monocytogenes EGD-e
aagauuuuguacauaaaagc

SEQ ID NO: 2800659 - RNA, 13 nt, Listeria monocytogenes EGD-e
aagcaaaaaagua

SEQ ID NO: 2800660 - RNA, 15 nt, Listeria monocytogenes EGD-e
aagcaaaaaaguagg

SEQ ID NO: 2800661 - RNA, 16 nt, Listeria monocytogenes EGD-e
aagcaaaugcauuucu

SEQ ID NO: 2800662 - RNA, 18 nt, Listeria monocytogenes EGD-e
aagcacaaauuauuagaa

SEQ ID NO: 2800663 - RNA, 20 nt, Listeria monocytogenes EGD-e
aagcacaaauuauuagaauu

SEQ ID NO: 2800664 - RNA, 13 nt, Listeria monocytogenes EGD-e
aagcacuuacugc

SEQ ID NO: 2800665 - RNA, 17 nt, Listeria monocytogenes EGD-e
aagcaggauggcuacua

SEQ ID NO: 2800666 - RNA, 17 nt, Listeria monocytogenes EGD-e
aagcauauuaauuugau

SEQ ID NO: 2800667 - RNA, 23 nt, Listeria monocytogenes EGD-e
aagcaucuaguagcaauuuuaaa

SEQ ID NO: 2800668 - RNA, 21 nt, Listeria monocytogenes EGD-e
aauauccacccuagcuauaca

SEQ ID NO: 2800669 - RNA, 21 nt, Listeria monocytogenes EGD-e
aauauccuuguuguucuaaua

SEQ ID NO: 2800670 - RNA, 14 nt, Listeria monocytogenes EGD-e
aauaucuauucauu

SEQ ID NO: 2800671 - RNA, 16 nt, Listeria monocytogenes EGD-e
aauaucuauucauucc

SEQ ID NO: 2800672 - RNA, 18 nt, Listeria monocytogenes EGD-e
aauaugcgcagaaaguug

SEQ ID NO: 2800673 - RNA, 15 nt, Listeria monocytogenes EGD-e
aauaugcuauacaac

SEQ ID NO: 2800674 - RNA, 21 nt, Listeria monocytogenes EGD-e
aauaugggggcagcugauuuu

SEQ ID NO: 2800675 - RNA, 16 nt, Listeria monocytogenes EGD-e
aauauuagaaaaucau

SEQ ID NO: 2800676 - RNA, 15 nt, Listeria monocytogenes EGD-e
aauauuuaauuuuau

SEQ ID NO: 2800677 - RNA, 16 nt, Listeria monocytogenes EGD-e
aaucaaaugcacagca

SEQ ID NO: 2800678 - RNA, 18 nt, Listeria monocytogenes EGD-e
aaucaagugcagcgacaa

SEQ ID NO: 2800679 - RNA, 16 nt, Listeria monocytogenes EGD-e
aaucaauaaagaagca

SEQ ID NO: 2800680 - RNA, 19 nt, Listeria monocytogenes EGD-e
aaucaauaaagaagcauga

SEQ ID NO: 2800681 - RNA, 16 nt, Listeria monocytogenes EGD-e
aaucaauugguuuuac

SEQ ID NO: 2800682 - RNA, 15 nt, Listeria monocytogenes EGD-e
aaucaauuucuucgu

SEQ ID NO: 2800683 - RNA, 18 nt, Listeria monocytogenes EGD-e
aaucacuauugaauguca

SEQ ID NO: 2800684 - RNA, 21 nt, Listeria monocytogenes EGD-e
aaucacuauugaaugucacuu

SEQ ID NO: 2800685 - RNA, 17 nt, Listeria monocytogenes EGD-e
aaucagcaucuggauca

SEQ ID NO: 2800686 - RNA, 21 nt, Listeria monocytogenes EGD-e
aaucaguaccugcaagcgaau

SEQ ID NO: 2800687 - RNA, 16 nt, Listeria monocytogenes EGD-e
aaucauaauaggagac

SEQ ID NO: 2800688 - RNA, 18 nt, Listeria monocytogenes EGD-e
aaucaucuuaucaaguaa

SEQ ID NO: 2800689 - RNA, 19 nt, Listeria monocytogenes EGD-e
aaucaucuuaucaaguaau

SEQ ID NO: 2800690 - RNA, 18 nt, Listeria monocytogenes EGD-e
aaucaugccuucaaacac

SEQ ID NO: 2800691 - RNA, 15 nt, Listeria monocytogenes EGD-e
aaucauggaaacaaa

SEQ ID NO: 2800692 - RNA, 20 nt, Listeria monocytogenes EGD-e
aaucauggaaacgacauccu

SEQ ID NO: 2800693 - RNA, 14 nt, Listeria monocytogenes EGD-e
aaucauuaaagcua

SEQ ID NO: 2800694 - RNA, 17 nt, Listeria monocytogenes EGD-e
aaucauuaaccuacuuu

SEQ ID NO: 2800695 - RNA, 15 nt, Listeria monocytogenes EGD-e
aaucauuccacuuuu

SEQ ID NO: 2800696 - RNA, 19 nt, Listeria monocytogenes EGD-e
aaucauuggaccagaaugg

SEQ ID NO: 2800697 - RNA, 16 nt, Listeria monocytogenes EGD-e
aaucauuuauuuuccc

SEQ ID NO: 2800698 - RNA, 18 nt, Listeria monocytogenes EGD-e
aaucauuuauuuucccuc

SEQ ID NO: 2800699 - RNA, 17 nt, Listeria monocytogenes EGD-e
aaucauuucuacaacug

SEQ ID NO: 2800700 - RNA, 13 nt, Listeria monocytogenes EGD-e
aauccaaccauuc

SEQ ID NO: 2800701 - RNA, 19 nt, Listeria monocytogenes EGD-e
aauccagagcugauuauau

SEQ ID NO: 2800702 - RNA, 17 nt, Listeria monocytogenes EGD-e
aauccagcuugauuaaa

SEQ ID NO: 2800703 - RNA, 22 nt, Listeria monocytogenes EGD-e
aauccagcuugauuaaaaccaa

SEQ ID NO: 2800704 - RNA, 19 nt, Listeria monocytogenes EGD-e
aauccauuucauucuuuuu

SEQ ID NO: 2800705 - RNA, 12 nt, Listeria monocytogenes EGD-e
aauccauuuuuc

SEQ ID NO: 2800706 - RNA, 15 nt, Listeria monocytogenes EGD-e
aauccauuuuucuuc

SEQ ID NO: 2800707 - RNA, 17 nt, Listeria monocytogenes EGD-e
aaucccuauaaaaacau

SEQ ID NO: 2800708 - RNA, 19 nt, Listeria monocytogenes EGD-e
aaucccuauaaaaacauga

SEQ ID NO: 2800709 - RNA, 22 nt, Listeria monocytogenes EGD-e
aaucccuauaaaaacaugauau

SEQ ID NO: 2800710 - RNA, 16 nt, Listeria monocytogenes EGD-e
aauccuuggaaaaaug

SEQ ID NO: 2800711 - RNA, 13 nt, Listeria monocytogenes EGD-e
aaucgcagcagau

SEQ ID NO: 2800712 - RNA, 17 nt, Listeria monocytogenes EGD-e
aaucgcagggcagaaaa

SEQ ID NO: 2800713 - RNA, 23 nt, Listeria monocytogenes EGD-e
aaucgcagggcagaaaacagaaa

SEQ ID NO: 2800714 - RNA, 15 nt, Listeria monocytogenes EGD-e
aaucgccaguugcug

SEQ ID NO: 2800715 - RNA, 21 nt, Listeria monocytogenes EGD-e
aaucgccaguugcugaauauc

SEQ ID NO: 2800716 - RNA, 21 nt, Listeria monocytogenes EGD-e
aaucgccuugauguggauaga

SEQ ID NO: 2800717 - RNA, 14 nt, Listeria monocytogenes EGD-e
aaucggggaaauag

SEQ ID NO: 2800718 - RNA, 15 nt, Listeria monocytogenes EGD-e
aaucggggaaauagu

SEQ ID NO: 2800719 - RNA, 22 nt, Listeria monocytogenes EGD-e
aaucuacaacaggaagcccaua

SEQ ID NO: 2800720 - RNA, 17 nt, Listeria monocytogenes EGD-e
aaucuacaacuagauuu

SEQ ID NO: 2800721 - RNA, 21 nt, Listeria monocytogenes EGD-e
aaucuaguacgaaaucaaacu

SEQ ID NO: 2800722 - RNA, 17 nt, Listeria monocytogenes EGD-e
aaucuagucguuucaac

SEQ ID NO: 2800723 - RNA, 14 nt, Listeria monocytogenes EGD-e
aaucucaucaccag

SEQ ID NO: 2800724 - RNA, 14 nt, Listeria monocytogenes EGD-e
aaucugaacugacu

SEQ ID NO: 2800725 - RNA, 20 nt, Listeria monocytogenes EGD-e
aaucugaacugacuagaaau

SEQ ID NO: 2800726 - RNA, 14 nt, Listeria monocytogenes EGD-e
aaucugauuaaaag

SEQ ID NO: 2800727 - RNA, 15 nt, Listeria monocytogenes EGD-e
aaucugauuaaaagu

SEQ ID NO: 2800728 - RNA, 19 nt, Listeria monocytogenes EGD-e
aaucugcuucguccagcug

SEQ ID NO: 2800729 - RNA, 15 nt, Listeria monocytogenes EGD-e
aaucuggauaaaaau

SEQ ID NO: 2800730 - RNA, 13 nt, Listeria monocytogenes EGD-e
aaucuguaaaaau

SEQ ID NO: 2800731 - RNA, 14 nt, Listeria monocytogenes EGD-e
aaucuguaaaaaua

SEQ ID NO: 2800732 - RNA, 15 nt, Listeria monocytogenes EGD-e
aaucuguaaaaauaa

SEQ ID NO: 2800733 - RNA, 17 nt, Listeria monocytogenes EGD-e
aaucuguaaaaauaaau

SEQ ID NO: 2800734 - RNA, 16 nt, Listeria monocytogenes EGD-e
aaucuguacuccuugu

SEQ ID NO: 2800735 - RNA, 18 nt, Listeria monocytogenes EGD-e
aaucuucugccuguucac

SEQ ID NO: 2800736 - RNA, 13 nt, Listeria monocytogenes EGD-e
aaucuucuugcuu

SEQ ID NO: 2800737 - RNA, 23 nt, Listeria monocytogenes EGD-e
aaucuuucacacgauaccaaagu

SEQ ID NO: 2800738 - RNA, 16 nt, Listeria monocytogenes EGD-e
aaucuuucggcacacu

SEQ ID NO: 2800739 - RNA, 19 nt, Listeria monocytogenes EGD-e
aaucuuuuaauaacugaau

SEQ ID NO: 2800740 - RNA, 15 nt, Listeria monocytogenes EGD-e
aaugaacuucaccac

SEQ ID NO: 2800741 - RNA, 19 nt, Listeria monocytogenes EGD-e
aaugaauaagcaauuggaa

SEQ ID NO: 2800742 - RNA, 16 nt, Listeria monocytogenes EGD-e
aaugagcccaaaaaua

SEQ ID NO: 2800743 - RNA, 18 nt, Listeria monocytogenes EGD-e
aaugagcccaaaaauaag

SEQ ID NO: 2800744 - RNA, 19 nt, Listeria monocytogenes EGD-e
aaugagcccaaaaauaagu

SEQ ID NO: 2800745 - RNA, 13 nt, Listeria monocytogenes EGD-e
aaugagcuccuuc

SEQ ID NO: 2800746 - RNA, 12 nt, Listeria monocytogenes EGD-e
aaugauagaaga

SEQ ID NO: 2800747 - RNA, 14 nt, Listeria monocytogenes EGD-e
aaugauaucaucaa

SEQ ID NO: 2800748 - RNA, 18 nt, Listeria monocytogenes EGD-e
aaugauucaaagcuacuu

SEQ ID NO: 2800749 - RNA, 15 nt, Listeria monocytogenes EGD-e
aaugcacagcagaaa

SEQ ID NO: 2800750 - RNA, 13 nt, Listeria monocytogenes EGD-e
aaugcacaugaua

SEQ ID NO: 2800751 - RNA, 14 nt, Listeria monocytogenes EGD-e
aaugcccaguaaaa

SEQ ID NO: 2800752 - RNA, 20 nt, Listeria monocytogenes EGD-e
aaugcuaggccuacuuuuuu

SEQ ID NO: 2800753 - RNA, 19 nt, Listeria monocytogenes EGD-e
aaugcucaucaagaaauua

SEQ ID NO: 2800754 - RNA, 15 nt, Listeria monocytogenes EGD-e
aaugcucauuuuucu

SEQ ID NO: 2800755 - RNA, 17 nt, Listeria monocytogenes EGD-e
aaugcugaauguuuucu

SEQ ID NO: 2800756 - RNA, 16 nt, Listeria monocytogenes EGD-e
aauggagcuauuguaa

SEQ ID NO: 2800757 - RNA, 17 nt, Listeria monocytogenes EGD-e
aauggaugcacuuuuaa

SEQ ID NO: 2800758 - RNA, 17 nt, Listeria monocytogenes EGD-e
aauggauugcagguaau

SEQ ID NO: 2800759 - RNA, 22 nt, Listeria monocytogenes EGD-e
aauggauugcagguaauuuaau

SEQ ID NO: 2800760 - RNA, 23 nt, Listeria monocytogenes EGD-e
aauggcgcgggaugguauacuau

SEQ ID NO: 2800761 - RNA, 24 nt, Listeria monocytogenes EGD-e
aauggcgcgggaugguauacuaua

SEQ ID NO: 2800762 - RNA, 19 nt, Listeria monocytogenes EGD-e
aauggcguuuuaaauccuu

SEQ ID NO: 2800763 - RNA, 16 nt, Listeria monocytogenes EGD-e
aauggcugaugacuaa

SEQ ID NO: 2800764 - RNA, 19 nt, Listeria monocytogenes EGD-e
aaugugaccuuaaauuaua

SEQ ID NO: 2800765 - RNA, 22 nt, Listeria monocytogenes EGD-e
aaugugaccuuaaauuauacua

SEQ ID NO: 2800766 - RNA, 24 nt, Listeria monocytogenes EGD-e
aaugugaccuuaaauuauacuaua

SEQ ID NO: 2800767 - RNA, 15 nt, Listeria monocytogenes EGD-e
aauguucuaaaauau

SEQ ID NO: 2800768 - RNA, 18 nt, Listeria monocytogenes EGD-e
aauguugguguaggaagu

SEQ ID NO: 2800769 - RNA, 19 nt, Listeria monocytogenes EGD-e
acaaucgcgucuacuuuuc

SEQ ID NO: 2800770 - RNA, 16 nt, Listeria monocytogenes EGD-e
acaauggaaugacaaa

SEQ ID NO: 2800771 - RNA, 18 nt, Listeria monocytogenes EGD-e
acaauggaaugacaaaau

SEQ ID NO: 2800772 - RNA, 21 nt, Listeria monocytogenes EGD-e
acaauggaaugacaaaauuau

SEQ ID NO: 2800773 - RNA, 14 nt, Listeria monocytogenes EGD-e
acaauuaaaauagu

SEQ ID NO: 2800774 - RNA, 13 nt, Listeria monocytogenes EGD-e
acaauuacuucca

SEQ ID NO: 2800775 - RNA, 23 nt, Listeria monocytogenes EGD-e
acaauuuucauuuaacaucagau

SEQ ID NO: 2800776 - RNA, 23 nt, Listeria monocytogenes EGD-e
acacaaaaugcucaucaagaaau

SEQ ID NO: 2800777 - RNA, 12 nt, Listeria monocytogenes EGD-e
acaccaaauucg

SEQ ID NO: 2800778 - RNA, 13 nt, Listeria monocytogenes EGD-e
acaccaaauucgc

SEQ ID NO: 2800779 - RNA, 23 nt, Listeria monocytogenes EGD-e
acaccaauuucuguuuuguuuuc

SEQ ID NO: 2800780 - RNA, 15 nt, Listeria monocytogenes EGD-e
acaccaauuuuaaau

SEQ ID NO: 2800781 - RNA, 14 nt, Listeria monocytogenes EGD-e
acacccauaauauu

SEQ ID NO: 2800782 - RNA, 18 nt, Listeria monocytogenes EGD-e
acacccgguccuucaauc

SEQ ID NO: 2800783 - RNA, 17 nt, Listeria monocytogenes EGD-e
acacuaaauugauacca

SEQ ID NO: 2800784 - RNA, 19 nt, Listeria monocytogenes EGD-e
acagaaacgcuuuguuuag

SEQ ID NO: 2800785 - RNA, 14 nt, Listeria monocytogenes EGD-e
acaggcuauuccag

SEQ ID NO: 2800786 - RNA, 18 nt, Listeria monocytogenes EGD-e
acaguauuccucaaugag

SEQ ID NO: 2800787 - RNA, 22 nt, Listeria monocytogenes EGD-e
acaguuagaaccguauuuaaua

SEQ ID NO: 2800788 - RNA, 15 nt, Listeria monocytogenes EGD-e
acauaaucccacaaa

SEQ ID NO: 2800789 - RNA, 17 nt, Listeria monocytogenes EGD-e
acauagcuacaauuaaa

SEQ ID NO: 2800790 - RNA, 22 nt, Listeria monocytogenes EGD-e
acauagucagggaauaagaaau

SEQ ID NO: 2800791 - RNA, 16 nt, Listeria monocytogenes EGD-e
acauauaaucuacugu

SEQ ID NO: 2800792 - RNA, 17 nt, Listeria monocytogenes EGD-e
acauauaaucuacugua

SEQ ID NO: 2800793 - RNA, 23 nt, Listeria monocytogenes EGD-e
acauauccggcguacuuaaauca

SEQ ID NO: 2800794 - RNA, 22 nt, Listeria monocytogenes EGD-e
acauauuccaaaaucgcauccu

SEQ ID NO: 2800795 - RNA, 16 nt, Listeria monocytogenes EGD-e
acauauuugaacccuu

SEQ ID NO: 2800796 - RNA, 18 nt, Listeria monocytogenes EGD-e
acaucacuaauuagcaua

SEQ ID NO: 2800797 - RNA, 17 nt, Listeria monocytogenes EGD-e
acaucagauuaaauaua

SEQ ID NO: 2800798 - RNA, 22 nt, Listeria monocytogenes EGD-e
acauccgcaugaauuuuugcau

SEQ ID NO: 2800799 - RNA, 23 nt, Listeria monocytogenes EGD-e
acauccgcaugaauuuuugcauc

SEQ ID NO: 2800800 - RNA, 19 nt, Listeria monocytogenes EGD-e
acauccuucagccaauucu

SEQ ID NO: 2800801 - RNA, 23 nt, Listeria monocytogenes EGD-e
acauccuucagccaauucuucca

SEQ ID NO: 2800802 - RNA, 14 nt, Listeria monocytogenes EGD-e
acaucgcuucugau

SEQ ID NO: 2800803 - RNA, 20 nt, Listeria monocytogenes EGD-e
acaucuucaauugcuucuuu

SEQ ID NO: 2800804 - RNA, 14 nt, Listeria monocytogenes EGD-e
acaucuuugccauc

SEQ ID NO: 2800805 - RNA, 18 nt, Listeria monocytogenes EGD-e
acaugauaaccagaaacg

SEQ ID NO: 2800806 - RNA, 16 nt, Listeria monocytogenes EGD-e
acaugauauauuuaua

SEQ ID NO: 2800807 - RNA, 14 nt, Listeria monocytogenes EGD-e
acaugaugauuguu

SEQ ID NO: 2800808 - RNA, 15 nt, Listeria monocytogenes EGD-e
acauuaauucauuua

SEQ ID NO: 2800809 - RNA, 16 nt, Listeria monocytogenes EGD-e
acauuauuuugcuaaa

SEQ ID NO: 2800810 - RNA, 20 nt, Listeria monocytogenes EGD-e
acauucgggaauaaaucaag

SEQ ID NO: 2800811 - RNA, 18 nt, Listeria monocytogenes EGD-e
acauuuccaaguguuuua

SEQ ID NO: 2800812 - RNA, 13 nt, Listeria monocytogenes EGD-e
acauuuugaugua

SEQ ID NO: 2800813 - RNA, 16 nt, Listeria monocytogenes EGD-e
acauuuugauguaguu

SEQ ID NO: 2800814 - RNA, 12 nt, Listeria monocytogenes EGD-e
accaaaaauacg

SEQ ID NO: 2800815 - RNA, 13 nt, Listeria monocytogenes EGD-e
accaaauaugcua

SEQ ID NO: 2800816 - RNA, 18 nt, Listeria monocytogenes EGD-e
accaaauaugcuauacaa

SEQ ID NO: 2800817 - RNA, 20 nt, Listeria monocytogenes EGD-e
accaaaucugcgaauaacag

SEQ ID NO: 2800818 - RNA, 13 nt, Listeria monocytogenes EGD-e
accaacaauuacu

SEQ ID NO: 2800819 - RNA, 16 nt, Listeria monocytogenes EGD-e
accaacuucgagcagc

SEQ ID NO: 2800820 - RNA, 13 nt, Listeria monocytogenes EGD-e
accaagaagagcu

SEQ ID NO: 2800821 - RNA, 14 nt, Listeria monocytogenes EGD-e
accaagaauaagca

SEQ ID NO: 2800822 - RNA, 13 nt, Listeria monocytogenes EGD-e
accaagggugauc

SEQ ID NO: 2800823 - RNA, 19 nt, Listeria monocytogenes EGD-e
accaagggugaucaaucag

SEQ ID NO: 2800824 - RNA, 17 nt, Listeria monocytogenes EGD-e
accaauaaaaccugcuu

SEQ ID NO: 2800825 - RNA, 23 nt, Listeria monocytogenes EGD-e
accacaagaagggcuuuuuuccu

SEQ ID NO: 2800826 - RNA, 15 nt, Listeria monocytogenes EGD-e
accagcuucuaaguc

SEQ ID NO: 2800827 - RNA, 16 nt, Listeria monocytogenes EGD-e
accaguuugugcacca

SEQ ID NO: 2800828 - RNA, 21 nt, Listeria monocytogenes EGD-e
accaucgcaaaagcaaacaaa

SEQ ID NO: 2800829 - RNA, 19 nt, Listeria monocytogenes EGD-e
accauucaucuaauuuagg

SEQ ID NO: 2800830 - RNA, 18 nt, Listeria monocytogenes EGD-e
accauuccguugaaagag

SEQ ID NO: 2800831 - RNA, 15 nt, Listeria monocytogenes EGD-e
accauucgaaagcaa

SEQ ID NO: 2800832 - RNA, 16 nt, Listeria monocytogenes EGD-e
accauucgaaagcaaa

SEQ ID NO: 2800833 - RNA, 14 nt, Listeria monocytogenes EGD-e
accauugauaucca

SEQ ID NO: 2800834 - RNA, 15 nt, Listeria monocytogenes EGD-e
accauuguagcucau

SEQ ID NO: 2800835 - RNA, 21 nt, Listeria monocytogenes EGD-e
acccauaauauuauaguuuuc

SEQ ID NO: 2800836 - RNA, 19 nt, Listeria monocytogenes EGD-e
acccauuugcauuggauug

SEQ ID NO: 2800837 - RNA, 15 nt, Listeria monocytogenes EGD-e
acccgcuaagaagag

SEQ ID NO: 2800838 - RNA, 18 nt, Listeria monocytogenes EGD-e
acccuuugaauugauuuu

SEQ ID NO: 2800839 - RNA, 15 nt, Listeria monocytogenes EGD-e
acccuuuuuuuacau

SEQ ID NO: 2800840 - RNA, 23 nt, Listeria monocytogenes EGD-e
accgauaauagguccgauaauac

SEQ ID NO: 2800841 - RNA, 23 nt, Listeria monocytogenes EGD-e
accgccgccgucuccaccaaguu

SEQ ID NO: 2800842 - RNA, 13 nt, Listeria monocytogenes EGD-e
accguaacuguug

SEQ ID NO: 2800843 - RNA, 16 nt, Listeria monocytogenes EGD-e
accguuaccauaaaga

SEQ ID NO: 2800844 - RNA, 21 nt, Listeria monocytogenes EGD-e
accuaaauacguauuaccucg

SEQ ID NO: 2800845 - RNA, 14 nt, Listeria monocytogenes EGD-e
accuaaaucuuuca

SEQ ID NO: 2800846 - RNA, 17 nt, Listeria monocytogenes EGD-e
accuacuuuaauuucca

SEQ ID NO: 2800847 - RNA, 13 nt, Listeria monocytogenes EGD-e
accuagccagaca

SEQ ID NO: 2800848 - RNA, 19 nt, Listeria monocytogenes EGD-e
accuagccagacaucuuug

SEQ ID NO: 2800849 - RNA, 19 nt, Listeria monocytogenes EGD-e
accuauuugguacuuguga

SEQ ID NO: 2800850 - RNA, 18 nt, Listeria monocytogenes EGD-e
accucgcaaaaaauaaua

SEQ ID NO: 2800851 - RNA, 22 nt, Listeria monocytogenes EGD-e
accugaaacauagucagggaau

SEQ ID NO: 2800852 - RNA, 14 nt, Listeria monocytogenes EGD-e
accugaaagaacug

SEQ ID NO: 2800853 - RNA, 16 nt, Listeria monocytogenes EGD-e
accuuaaauuauacua

SEQ ID NO: 2800854 - RNA, 21 nt, Listeria monocytogenes EGD-e
accuuauuaacuaauaacccu

SEQ ID NO: 2800855 - RNA, 17 nt, Listeria monocytogenes EGD-e
accuucaauuucuuuug

SEQ ID NO: 2800856 - RNA, 22 nt, Listeria monocytogenes EGD-e
accuucaauuucuuuugacaaa

SEQ ID NO: 2800857 - RNA, 19 nt, Listeria monocytogenes EGD-e
accuuugaaaacugaacaa

SEQ ID NO: 2800858 - RNA, 23 nt, Listeria monocytogenes EGD-e
accuuugaaaacugaacaaagaa

SEQ ID NO: 2800859 - RNA, 17 nt, Listeria monocytogenes EGD-e
accuuuugcuucuucca

SEQ ID NO: 2800860 - RNA, 19 nt, Listeria monocytogenes EGD-e
accuuuugcuucuuccaua

SEQ ID NO: 2800861 - RNA, 20 nt, Listeria monocytogenes EGD-e
acgaaaaacauuauuuugcu

SEQ ID NO: 2800862 - RNA, 17 nt, Listeria monocytogenes EGD-e
acgaaaagcaaugagac

SEQ ID NO: 2800863 - RNA, 12 nt, Listeria monocytogenes EGD-e
acgaaagcaaca

SEQ ID NO: 2800864 - RNA, 21 nt, Listeria monocytogenes EGD-e
acgaacggggcaucauuuuuu

SEQ ID NO: 2800865 - RNA, 14 nt, Listeria monocytogenes EGD-e
acgaaucaagauuu

SEQ ID NO: 2800866 - RNA, 18 nt, Listeria monocytogenes EGD-e
acgaaucaagauuuugcu

SEQ ID NO: 2800867 - RNA, 22 nt, Listeria monocytogenes EGD-e
acgacaaaugguucacuuucuu

SEQ ID NO: 2800868 - RNA, 17 nt, Listeria monocytogenes EGD-e
acgaccauauaaucaau

SEQ ID NO: 2800869 - RNA, 18 nt, Listeria monocytogenes EGD-e
acgaccauauaaucaaua

SEQ ID NO: 2800870 - RNA, 21 nt, Listeria monocytogenes EGD-e
acuuuuaaaauucuauuaaua

SEQ ID NO: 2800871 - RNA, 18 nt, Listeria monocytogenes EGD-e
acuuuuaaaggaaaacuc

SEQ ID NO: 2800872 - RNA, 17 nt, Listeria monocytogenes EGD-e
acuuuuaauuaaaaguu

SEQ ID NO: 2800873 - RNA, 13 nt, Listeria monocytogenes EGD-e
acuuuugcagcug

SEQ ID NO: 2800874 - RNA, 14 nt, Listeria monocytogenes EGD-e
acuuuuucucaaaa

SEQ ID NO: 2800875 - RNA, 22 nt, Listeria monocytogenes EGD-e
acuuuuucucaaaaauaugcuu

SEQ ID NO: 2800876 - RNA, 21 nt, Listeria monocytogenes EGD-e
acuuuuuuuauuuaccuugcu

SEQ ID NO: 2800877 - RNA, 12 nt, Listeria monocytogenes EGD-e
agaaaaaaacaa

SEQ ID NO: 2800878 - RNA, 15 nt, Listeria monocytogenes EGD-e
agaaaaagugcguaa

SEQ ID NO: 2800879 - RNA, 12 nt, Listeria monocytogenes EGD-e
agaaaacagaaa

SEQ ID NO: 2800880 - RNA, 20 nt, Listeria monocytogenes EGD-e
agaaaacgacucaaugaaaa

SEQ ID NO: 2800881 - RNA, 19 nt, Listeria monocytogenes EGD-e
agaaaccaucgcaaaagca

SEQ ID NO: 2800882 - RNA, 15 nt, Listeria monocytogenes EGD-e
agaaacuuucuuuuc

SEQ ID NO: 2800883 - RNA, 16 nt, Listeria monocytogenes EGD-e
agaaacuuucuuuucu

SEQ ID NO: 2800884 - RNA, 22 nt, Listeria monocytogenes EGD-e
agaaacuuuuucucaaaaauau

SEQ ID NO: 2800885 - RNA, 15 nt, Listeria monocytogenes EGD-e
agaaagccaucaaua

SEQ ID NO: 2800886 - RNA, 14 nt, Listeria monocytogenes EGD-e
agaaauaacuacua

SEQ ID NO: 2800887 - RNA, 14 nt, Listeria monocytogenes EGD-e
agaaaucgccuuga

SEQ ID NO: 2800888 - RNA, 20 nt, Listeria monocytogenes EGD-e
agaaaucgccuugaugugga

SEQ ID NO: 2800889 - RNA, 22 nt, Listeria monocytogenes EGD-e
agaaauggauugcagguaauuu

SEQ ID NO: 2800890 - RNA, 19 nt, Listeria monocytogenes EGD-e
agaaauggcgguaauugga

SEQ ID NO: 2800891 - RNA, 21 nt, Listeria monocytogenes EGD-e
agaaauguugcgaaacaacug

SEQ ID NO: 2800892 - RNA, 15 nt, Listeria monocytogenes EGD-e
agaaauuaaugccag

SEQ ID NO: 2800893 - RNA, 20 nt, Listeria monocytogenes EGD-e
agaaauuaccuaaugaauaa

SEQ ID NO: 2800894 - RNA, 19 nt, Listeria monocytogenes EGD-e
agaaauuacguuucacuuu

SEQ ID NO: 2800895 - RNA, 17 nt, Listeria monocytogenes EGD-e
agaacgacaaaugguuc

SEQ ID NO: 2800896 - RNA, 15 nt, Listeria monocytogenes EGD-e
agaacgauuuuggua

SEQ ID NO: 2800897 - RNA, 23 nt, Listeria monocytogenes EGD-e
agaagauauuuugcucaagugaa

SEQ ID NO: 2800898 - RNA, 13 nt, Listeria monocytogenes EGD-e
agaagaugcacua

SEQ ID NO: 2800899 - RNA, 16 nt, Listeria monocytogenes EGD-e
agaagcaugagaguga

SEQ ID NO: 2800900 - RNA, 15 nt, Listeria monocytogenes EGD-e
agaagcgauguggga

SEQ ID NO: 2800901 - RNA, 18 nt, Listeria monocytogenes EGD-e
agaaggggcugugaagga

SEQ ID NO: 2800902 - RNA, 22 nt, Listeria monocytogenes EGD-e
agaagguaccgucguaaauagc

SEQ ID NO: 2800903 - RNA, 15 nt, Listeria monocytogenes EGD-e
agaagguucaucacu

SEQ ID NO: 2800904 - RNA, 21 nt, Listeria monocytogenes EGD-e
agaagguucaucacuuguuga

SEQ ID NO: 2800905 - RNA, 13 nt, Listeria monocytogenes EGD-e
agaaguacaauaa

SEQ ID NO: 2800906 - RNA, 13 nt, Listeria monocytogenes EGD-e
agaauaaugacgc

SEQ ID NO: 2800907 - RNA, 13 nt, Listeria monocytogenes EGD-e
agaauaguacaua

SEQ ID NO: 2800908 - RNA, 23 nt, Listeria monocytogenes EGD-e
agaauaguacauaguuauaaaua

SEQ ID NO: 2800909 - RNA, 19 nt, Listeria monocytogenes EGD-e
agaauaucuauucauuccc

SEQ ID NO: 2800910 - RNA, 19 nt, Listeria monocytogenes EGD-e
agaauauggacauacuuca

SEQ ID NO: 2800911 - RNA, 20 nt, Listeria monocytogenes EGD-e
agaauauggacauacuucau

SEQ ID NO: 2800912 - RNA, 20 nt, Listeria monocytogenes EGD-e
agaauuccugcuaaaaccau

SEQ ID NO: 2800913 - RNA, 21 nt, Listeria monocytogenes EGD-e
agacaaguccggcgauaauug

SEQ ID NO: 2800914 - RNA, 14 nt, Listeria monocytogenes EGD-e
agacaccaauuucu

SEQ ID NO: 2800915 - RNA, 15 nt, Listeria monocytogenes EGD-e
agacaguuuguauaa

SEQ ID NO: 2800916 - RNA, 16 nt, Listeria monocytogenes EGD-e
agaccaccaagaauaa

SEQ ID NO: 2800917 - RNA, 15 nt, Listeria monocytogenes EGD-e
agagagccuggauuu

SEQ ID NO: 2800918 - RNA, 15 nt, Listeria monocytogenes EGD-e
agagcaccaaaaaca

SEQ ID NO: 2800919 - RNA, 19 nt, Listeria monocytogenes EGD-e
agagcagggcuauuuuucc

SEQ ID NO: 2800920 - RNA, 22 nt, Listeria monocytogenes EGD-e
agaggauuuucacccauacuaa

SEQ ID NO: 2800921 - RNA, 17 nt, Listeria monocytogenes EGD-e
agaggcguacuaaaaau

SEQ ID NO: 2800922 - RNA, 15 nt, Listeria monocytogenes EGD-e
agagguuuugcacaa

SEQ ID NO: 2800923 - RNA, 16 nt, Listeria monocytogenes EGD-e
agauaaguuaaucauu

SEQ ID NO: 2800924 - RNA, 17 nt, Listeria monocytogenes EGD-e
agauaaguuuucauaua

SEQ ID NO: 2800925 - RNA, 15 nt, Listeria monocytogenes EGD-e
agauaaucaagauuu

SEQ ID NO: 2800926 - RNA, 20 nt, Listeria monocytogenes EGD-e
agauaaucaagauuuuguac

SEQ ID NO: 2800927 - RNA, 15 nt, Listeria monocytogenes EGD-e
agauacucuuuaaau

SEQ ID NO: 2800928 - RNA, 15 nt, Listeria monocytogenes EGD-e
agauacuguucugau

SEQ ID NO: 2800929 - RNA, 16 nt, Listeria monocytogenes EGD-e
agauacuguucugauu

SEQ ID NO: 2800930 - RNA, 14 nt, Listeria monocytogenes EGD-e
agauaguuguucca

SEQ ID NO: 2800931 - RNA, 15 nt, Listeria monocytogenes EGD-e
agaucaaaagcaaaa

SEQ ID NO: 2800932 - RNA, 18 nt, Listeria monocytogenes EGD-e
agaucaaaagcaaaaaag

SEQ ID NO: 2800933 - RNA, 19 nt, Listeria monocytogenes EGD-e
agaucaaaagcaaaaaagu

SEQ ID NO: 2800934 - RNA, 21 nt, Listeria monocytogenes EGD-e
agauccauugcaagguaucga

SEQ ID NO: 2800935 - RNA, 18 nt, Listeria monocytogenes EGD-e
agaucccaaacucccuuu

SEQ ID NO: 2800936 - RNA, 14 nt, Listeria monocytogenes EGD-e
agauccuucaauaa

SEQ ID NO: 2800937 - RNA, 17 nt, Listeria monocytogenes EGD-e
agaucuccgaauacuuu

SEQ ID NO: 2800938 - RNA, 15 nt, Listeria monocytogenes EGD-e
agauggaagaagugg

SEQ ID NO: 2800939 - RNA, 23 nt, Listeria monocytogenes EGD-e
agauggagauucauaaacaaaag

SEQ ID NO: 2800940 - RNA, 19 nt, Listeria monocytogenes EGD-e
agauuaaaaaucuagauuu

SEQ ID NO: 2800941 - RNA, 16 nt, Listeria monocytogenes EGD-e
agauucauaaacaaaa

SEQ ID NO: 2800942 - RNA, 17 nt, Listeria monocytogenes EGD-e
agauuuaauaaauuaga

SEQ ID NO: 2800943 - RNA, 20 nt, Listeria monocytogenes EGD-e
agauuuagaggcguacuaaa

SEQ ID NO: 2800944 - RNA, 18 nt, Listeria monocytogenes EGD-e
agcaaaugcauuucucga

SEQ ID NO: 2800945 - RNA, 21 nt, Listeria monocytogenes EGD-e
agcaagauaacucaaaguaac

SEQ ID NO: 2800946 - RNA, 18 nt, Listeria monocytogenes EGD-e
agcaauuggaacaucuuu

SEQ ID NO: 2800947 - RNA, 21 nt, Listeria monocytogenes EGD-e
agcaauuggaacaucuuugua

SEQ ID NO: 2800948 - RNA, 21 nt, Listeria monocytogenes EGD-e
agcaauuuguuuauccguuaa

SEQ ID NO: 2800949 - RNA, 13 nt, Listeria monocytogenes EGD-e
agcacagcuacca

SEQ ID NO: 2800950 - RNA, 17 nt, Listeria monocytogenes EGD-e
agcacauguccauugau

SEQ ID NO: 2800951 - RNA, 19 nt, Listeria monocytogenes EGD-e
agcacgcgcguucauucgg

SEQ ID NO: 2800952 - RNA, 20 nt, Listeria monocytogenes EGD-e
agcacuuacugcaaucauuu

SEQ ID NO: 2800953 - RNA, 15 nt, Listeria monocytogenes EGD-e
agcagaaacuuucuu

SEQ ID NO: 2800954 - RNA, 18 nt, Listeria monocytogenes EGD-e
agcagaagccccuuggac

SEQ ID NO: 2800955 - RNA, 13 nt, Listeria monocytogenes EGD-e
agcagauuuugcg

SEQ ID NO: 2800956 - RNA, 16 nt, Listeria monocytogenes EGD-e
agcagcuccauuaaau

SEQ ID NO: 2800957 - RNA, 17 nt, Listeria monocytogenes EGD-e
agcagggcuauuuuucc

SEQ ID NO: 2800958 - RNA, 15 nt, Listeria monocytogenes EGD-e
agcaguagacuaaau

SEQ ID NO: 2800959 - RNA, 13 nt, Listeria monocytogenes EGD-e
agcaguuuucauu

SEQ ID NO: 2800960 - RNA, 21 nt, Listeria monocytogenes EGD-e
agcauccucuuuuguaguaaa

SEQ ID NO: 2800961 - RNA, 13 nt, Listeria monocytogenes EGD-e
agcaucuggauca

SEQ ID NO: 2800962 - RNA, 22 nt, Listeria monocytogenes EGD-e
agcaucuuuuucuugcuuucca

SEQ ID NO: 2800963 - RNA, 14 nt, Listeria monocytogenes EGD-e
agcaugaauuuuua

SEQ ID NO: 2800964 - RNA, 14 nt, Listeria monocytogenes EGD-e
agcauuauaaaaag

SEQ ID NO: 2800965 - RNA, 16 nt, Listeria monocytogenes EGD-e
agcauuauaaaaagua

SEQ ID NO: 2800966 - RNA, 21 nt, Listeria monocytogenes EGD-e
agccaaugaccuaguuaaucu

SEQ ID NO: 2800967 - RNA, 16 nt, Listeria monocytogenes EGD-e
agccauuucucgcugc

SEQ ID NO: 2800968 - RNA, 18 nt, Listeria monocytogenes EGD-e
agccgcaaauaguuguuc

SEQ ID NO: 2800969 - RNA, 16 nt, Listeria monocytogenes EGD-e
agccuaaguuaaacca

SEQ ID NO: 2800970 - RNA, 23 nt, Listeria monocytogenes EGD-e
agccuaaguuaaaccauaaaaau

SEQ ID NO: 2800971 - RNA, 23 nt, Listeria monocytogenes EGD-e
aguuacuuuaccuugaucaaaau

SEQ ID NO: 2800972 - RNA, 14 nt, Listeria monocytogenes EGD-e
aguuagauuaaaaa

SEQ ID NO: 2800973 - RNA, 22 nt, Listeria monocytogenes EGD-e
aguuagauuaaaaaucuagauu

SEQ ID NO: 2800974 - RNA, 22 nt, Listeria monocytogenes EGD-e
aguuaggcuuccuuguuuuuug

SEQ ID NO: 2800975 - RNA, 20 nt, Listeria monocytogenes EGD-e
aguuauagcggucaaucauu

SEQ ID NO: 2800976 - RNA, 12 nt, Listeria monocytogenes EGD-e
aguuauauuuaa

SEQ ID NO: 2800977 - RNA, 17 nt, Listeria monocytogenes EGD-e
aguucaacuacuucaac

SEQ ID NO: 2800978 - RNA, 21 nt, Listeria monocytogenes EGD-e
aguucaacuacuucaacuaaa

SEQ ID NO: 2800979 - RNA, 19 nt, Listeria monocytogenes EGD-e
aguucacugugaacugauu

SEQ ID NO: 2800980 - RNA, 14 nt, Listeria monocytogenes EGD-e
aguuccaucuucua

SEQ ID NO: 2800981 - RNA, 20 nt, Listeria monocytogenes EGD-e
aguucuguuggcgcagaaau

SEQ ID NO: 2800982 - RNA, 12 nt, Listeria monocytogenes EGD-e
aguucuuaaggg

SEQ ID NO: 2800983 - RNA, 14 nt, Listeria monocytogenes EGD-e
aguugauauauuca

SEQ ID NO: 2800984 - RNA, 20 nt, Listeria monocytogenes EGD-e
aguugcuaguugcauaccua

SEQ ID NO: 2800985 - RNA, 18 nt, Listeria monocytogenes EGD-e
aguugcugcuaaaggcaa

SEQ ID NO: 2800986 - RNA, 19 nt, Listeria monocytogenes EGD-e
aguugcuuuuguuuuccuu

SEQ ID NO: 2800987 - RNA, 20 nt, Listeria monocytogenes EGD-e
aguuguaaaccguaacuguu

SEQ ID NO: 2800988 - RNA, 22 nt, Listeria monocytogenes EGD-e
aguuguugcagcccaaccuauu

SEQ ID NO: 2800989 - RNA, 12 nt, Listeria monocytogenes EGD-e
aguuuauaaaua

SEQ ID NO: 2800990 - RNA, 14 nt, Listeria monocytogenes EGD-e
aguuucauugaguc

SEQ ID NO: 2800991 - RNA, 21 nt, Listeria monocytogenes EGD-e
aguuucgaagugagaaucauu

SEQ ID NO: 2800992 - RNA, 21 nt, Listeria monocytogenes EGD-e
aguuucuuuaccauacacaua

SEQ ID NO: 2800993 - RNA, 14 nt, Listeria monocytogenes EGD-e
aguuucuuuuugau

SEQ ID NO: 2800994 - RNA, 21 nt, Listeria monocytogenes EGD-e
aguuuguuuaggauauuuuuu

SEQ ID NO: 2800995 - RNA, 13 nt, Listeria monocytogenes EGD-e
auaaaaaaauaca

SEQ ID NO: 2800996 - RNA, 12 nt, Listeria monocytogenes EGD-e
auaaaaacauga

SEQ ID NO: 2800997 - RNA, 21 nt, Listeria monocytogenes EGD-e
auaaaaagcugccaccacuua

SEQ ID NO: 2800998 - RNA, 21 nt, Listeria monocytogenes EGD-e
auaaaaaguaacauagcuaca

SEQ ID NO: 2800999 - RNA, 21 nt, Listeria monocytogenes EGD-e
auaaaaauaacggaaacuauc

SEQ ID NO: 2801000 - RNA, 11 nt, Listeria monocytogenes EGD-e
auaaaaauaca

SEQ ID NO: 2801001 - RNA, 14 nt, Listeria monocytogenes EGD-e
auaaaaauacauuu

SEQ ID NO: 2801002 - RNA, 17 nt, Listeria monocytogenes EGD-e
auaaaaauugcaacagu

SEQ ID NO: 2801003 - RNA, 21 nt, Listeria monocytogenes EGD-e
auaaaaccauucaucuaauuu

SEQ ID NO: 2801004 - RNA, 16 nt, Listeria monocytogenes EGD-e
auaaaagcaugaauuu

SEQ ID NO: 2801005 - RNA, 14 nt, Listeria monocytogenes EGD-e
auaaaaucauaaua

SEQ ID NO: 2801006 - RNA, 16 nt, Listeria monocytogenes EGD-e
auaaaaugcacaugau

SEQ ID NO: 2801007 - RNA, 15 nt, Listeria monocytogenes EGD-e
auaaagaaauaacua

SEQ ID NO: 2801008 - RNA, 21 nt, Listeria monocytogenes EGD-e
auaaagaacuagauuuaauaa

SEQ ID NO: 2801009 - RNA, 18 nt, Listeria monocytogenes EGD-e
auaaagaacuuacagaag

SEQ ID NO: 2801010 - RNA, 14 nt, Listeria monocytogenes EGD-e
auaaagaccuaaac

SEQ ID NO: 2801011 - RNA, 17 nt, Listeria monocytogenes EGD-e
auaaagcuaagcauuau

SEQ ID NO: 2801012 - RNA, 16 nt, Listeria monocytogenes EGD-e
auaaauauagcuucaa

SEQ ID NO: 2801013 - RNA, 19 nt, Listeria monocytogenes EGD-e
auaaauaugcgcagaaagu

SEQ ID NO: 2801014 - RNA, 22 nt, Listeria monocytogenes EGD-e
auaaauccagcgucuaaaaaug

SEQ ID NO: 2801015 - RNA, 14 nt, Listeria monocytogenes EGD-e
auaaaucgccacau

SEQ ID NO: 2801016 - RNA, 16 nt, Listeria monocytogenes EGD-e
auaaaucgccacauca

SEQ ID NO: 2801017 - RNA, 13 nt, Listeria monocytogenes EGD-e
auaacaagaauaa

SEQ ID NO: 2801018 - RNA, 13 nt, Listeria monocytogenes EGD-e
auaacaaguacaa

SEQ ID NO: 2801019 - RNA, 23 nt, Listeria monocytogenes EGD-e
auaacagauuuggucauuuuuua

SEQ ID NO: 2801020 - RNA, 20 nt, Listeria monocytogenes EGD-e
auaacauaaccuucaucguu

SEQ ID NO: 2801021 - RNA, 15 nt, Listeria monocytogenes EGD-e
auaacaucuuuaaaa

SEQ ID NO: 2801022 - RNA, 14 nt, Listeria monocytogenes EGD-e
auaacauuaaaccu

SEQ ID NO: 2801023 - RNA, 19 nt, Listeria monocytogenes EGD-e
auaacauuuucucuuguaa

SEQ ID NO: 2801024 - RNA, 19 nt, Listeria monocytogenes EGD-e
auaacccucgauuggaauc

SEQ ID NO: 2801025 - RNA, 20 nt, Listeria monocytogenes EGD-e
auaaccucgcaaaaaauaau

SEQ ID NO: 2801026 - RNA, 16 nt, Listeria monocytogenes EGD-e
auaacgaguaauggag

SEQ ID NO: 2801027 - RNA, 14 nt, Listeria monocytogenes EGD-e
auaacguaugaaca

SEQ ID NO: 2801028 - RNA, 13 nt, Listeria monocytogenes EGD-e
auaacuacuauuu

SEQ ID NO: 2801029 - RNA, 20 nt, Listeria monocytogenes EGD-e
auaacuacuauuuaaauaua

SEQ ID NO: 2801030 - RNA, 22 nt, Listeria monocytogenes EGD-e
auaacuugacgcguggaaagaa

SEQ ID NO: 2801031 - RNA, 19 nt, Listeria monocytogenes EGD-e
auaacuuucaccaguuugu

SEQ ID NO: 2801032 - RNA, 14 nt, Listeria monocytogenes EGD-e
auaagaagauauuu

SEQ ID NO: 2801033 - RNA, 15 nt, Listeria monocytogenes EGD-e
auaagagaauaucua

SEQ ID NO: 2801034 - RNA, 17 nt, Listeria monocytogenes EGD-e
auaagcaucggucaaau

SEQ ID NO: 2801035 - RNA, 16 nt, Listeria monocytogenes EGD-e
auaaguacuugaaaaa

SEQ ID NO: 2801036 - RNA, 15 nt, Listeria monocytogenes EGD-e
auaaguguaaaaguu

SEQ ID NO: 2801037 - RNA, 19 nt, Listeria monocytogenes EGD-e
auaauaguugauauauuca

SEQ ID NO: 2801038 - RNA, 18 nt, Listeria monocytogenes EGD-e
auaauauccauaaagcua

SEQ ID NO: 2801039 - RNA, 20 nt, Listeria monocytogenes EGD-e
auaauauuauaguuuucuac

SEQ ID NO: 2801040 - RNA, 14 nt, Listeria monocytogenes EGD-e
auaaucaaauacau

SEQ ID NO: 2801041 - RNA, 21 nt, Listeria monocytogenes EGD-e
auaaucaauccgccaaccagu

SEQ ID NO: 2801042 - RNA, 18 nt, Listeria monocytogenes EGD-e
auaaucacguuuuugcuc

SEQ ID NO: 2801043 - RNA, 19 nt, Listeria monocytogenes EGD-e
auaaucacguuuuugcucu

SEQ ID NO: 2801044 - RNA, 17 nt, Listeria monocytogenes EGD-e
auaaucccacaaaaaau

SEQ ID NO: 2801045 - RNA, 18 nt, Listeria monocytogenes EGD-e
auaaucccacaaaaaaua

SEQ ID NO: 2801046 - RNA, 20 nt, Listeria monocytogenes EGD-e
auaaucccacaaaaaauacg

SEQ ID NO: 2801047 - RNA, 19 nt, Listeria monocytogenes EGD-e
auaauccuuccaucaacuu

SEQ ID NO: 2801048 - RNA, 18 nt, Listeria monocytogenes EGD-e
auaaucuccgcaaucauu

SEQ ID NO: 2801049 - RNA, 22 nt, Listeria monocytogenes EGD-e
auaaucuccgcaaucauuccaa

SEQ ID NO: 2801050 - RNA, 19 nt, Listeria monocytogenes EGD-e
auaaucucgugcuaauucu

SEQ ID NO: 2801051 - RNA, 20 nt, Listeria monocytogenes EGD-e
auaaugauucaaagcuacuu

SEQ ID NO: 2801052 - RNA, 21 nt, Listeria monocytogenes EGD-e
auaaugauuucuauaaaaaug

SEQ ID NO: 2801053 - RNA, 16 nt, Listeria monocytogenes EGD-e
auaaugcagauuaacc

SEQ ID NO: 2801054 - RNA, 18 nt, Listeria monocytogenes EGD-e
auaaugcucauuuuucuu

SEQ ID NO: 2801055 - RNA, 19 nt, Listeria monocytogenes EGD-e
auaaugugaccuuaaauua

SEQ ID NO: 2801056 - RNA, 20 nt, Listeria monocytogenes EGD-e
auaaugugaccuuaaauuau

SEQ ID NO: 2801057 - RNA, 21 nt, Listeria monocytogenes EGD-e
auaaugugaccuuaaauuaua

SEQ ID NO: 2801058 - RNA, 11 nt, Listeria monocytogenes EGD-e
auaauuaacaa

SEQ ID NO: 2801059 - RNA, 21 nt, Listeria monocytogenes EGD-e
auaauuaagaccuucuuuuaa

SEQ ID NO: 2801060 - RNA, 12 nt, Listeria monocytogenes EGD-e
auaauuccauuu

SEQ ID NO: 2801061 - RNA, 13 nt, Listeria monocytogenes EGD-e
auaauuccauuua

SEQ ID NO: 2801062 - RNA, 16 nt, Listeria monocytogenes EGD-e
auaauucugcuaacag

SEQ ID NO: 2801063 - RNA, 15 nt, Listeria monocytogenes EGD-e
auaauuuuuucauuu

SEQ ID NO: 2801064 - RNA, 17 nt, Listeria monocytogenes EGD-e
auaauuuuuucauuuuc

SEQ ID NO: 2801065 - RNA, 14 nt, Listeria monocytogenes EGD-e
auacaaacuuuucc

SEQ ID NO: 2801066 - RNA, 20 nt, Listeria monocytogenes EGD-e
auacaacaaaauaaucaauc

SEQ ID NO: 2801067 - RNA, 15 nt, Listeria monocytogenes EGD-e
auacaauuaauaaua

SEQ ID NO: 2801068 - RNA, 16 nt, Listeria monocytogenes EGD-e
auacaauuaauaauaa

SEQ ID NO: 2801069 - RNA, 16 nt, Listeria monocytogenes EGD-e
auacaggaacuacaua

SEQ ID NO: 2801070 - RNA, 13 nt, Listeria monocytogenes EGD-e
auaccauuuuuuc

SEQ ID NO: 2801071 - RNA, 23 nt, Listeria monocytogenes EGD-e
auacgauugggcggaaauaaaaa

SEQ ID NO: 2801072 - RNA, 16 nt, Listeria monocytogenes EGD-e
aucauuuauuuucccu

SEQ ID NO: 2801073 - RNA, 18 nt, Listeria monocytogenes EGD-e
auccaaacacgaacauac

SEQ ID NO: 2801074 - RNA, 19 nt, Listeria monocytogenes EGD-e
auccaagcggguuuucuca

SEQ ID NO: 2801075 - RNA, 21 nt, Listeria monocytogenes EGD-e
auccaaguuuuuuaauuuuuc

SEQ ID NO: 2801076 - RNA, 20 nt, Listeria monocytogenes EGD-e
auccacuaacuuaucuuuca

SEQ ID NO: 2801077 - RNA, 14 nt, Listeria monocytogenes EGD-e
auccagcgucuaaa

SEQ ID NO: 2801078 - RNA, 22 nt, Listeria monocytogenes EGD-e
auccaguguaaucuugaugcca

SEQ ID NO: 2801079 - RNA, 19 nt, Listeria monocytogenes EGD-e
auccauuucauucuuuuuu

SEQ ID NO: 2801080 - RNA, 13 nt, Listeria monocytogenes EGD-e
aucccacaaaaaa

SEQ ID NO: 2801081 - RNA, 15 nt, Listeria monocytogenes EGD-e
aucccacaaaaaaua

SEQ ID NO: 2801082 - RNA, 17 nt, Listeria monocytogenes EGD-e
aucccuauaaaaacaug

SEQ ID NO: 2801083 - RNA, 17 nt, Listeria monocytogenes EGD-e
aucccucauguucaauc

SEQ ID NO: 2801084 - RNA, 15 nt, Listeria monocytogenes EGD-e
auccgaaccaagcac

SEQ ID NO: 2801085 - RNA, 14 nt, Listeria monocytogenes EGD-e
auccgcgaauagca

SEQ ID NO: 2801086 - RNA, 14 nt, Listeria monocytogenes EGD-e
auccguugucuucu

SEQ ID NO: 2801087 - RNA, 17 nt, Listeria monocytogenes EGD-e
auccucaaacgucauuc

SEQ ID NO: 2801088 - RNA, 14 nt, Listeria monocytogenes EGD-e
auccuguaauucga

SEQ ID NO: 2801089 - RNA, 20 nt, Listeria monocytogenes EGD-e
auccuucagccaauucuucc

SEQ ID NO: 2801090 - RNA, 16 nt, Listeria monocytogenes EGD-e
auccuuucuugauuug

SEQ ID NO: 2801091 - RNA, 14 nt, Listeria monocytogenes EGD-e
aucgaauacuaacg

SEQ ID NO: 2801092 - RNA, 22 nt, Listeria monocytogenes EGD-e
aucgagucaccgaauccaaaca

SEQ ID NO: 2801093 - RNA, 17 nt, Listeria monocytogenes EGD-e
aucgcaagcgacauuaa

SEQ ID NO: 2801094 - RNA, 12 nt, Listeria monocytogenes EGD-e
aucgcagcagaa

SEQ ID NO: 2801095 - RNA, 19 nt, Listeria monocytogenes EGD-e
aucggcauuugaauaagca

SEQ ID NO: 2801096 - RNA, 23 nt, Listeria monocytogenes EGD-e
aucggcuuuuuuuauuuaaucau

SEQ ID NO: 2801097 - RNA, 21 nt, Listeria monocytogenes EGD-e
aucggucaauugcaugagcaa

SEQ ID NO: 2801098 - RNA, 18 nt, Listeria monocytogenes EGD-e
aucguauguuuuugaguu

SEQ ID NO: 2801099 - RNA, 12 nt, Listeria monocytogenes EGD-e
aucguugugcuu

SEQ ID NO: 2801100 - RNA, 16 nt, Listeria monocytogenes EGD-e
aucguuuaacauauaa

SEQ ID NO: 2801101 - RNA, 15 nt, Listeria monocytogenes EGD-e
aucguuuuaaagcuu

SEQ ID NO: 2801102 - RNA, 21 nt, Listeria monocytogenes EGD-e
aucguuuuaaagcuugauuua

SEQ ID NO: 2801103 - RNA, 16 nt, Listeria monocytogenes EGD-e
aucuaagucaucggcu

SEQ ID NO: 2801104 - RNA, 21 nt, Listeria monocytogenes EGD-e
aucuaagucaucggcuuuuuu

SEQ ID NO: 2801105 - RNA, 20 nt, Listeria monocytogenes EGD-e
aucuacagguguauucgucu

SEQ ID NO: 2801106 - RNA, 13 nt, Listeria monocytogenes EGD-e
aucucaucaccag

SEQ ID NO: 2801107 - RNA, 16 nt, Listeria monocytogenes EGD-e
aucucuucauuuuucu

SEQ ID NO: 2801108 - RNA, 21 nt, Listeria monocytogenes EGD-e
aucugaacugacuagaaauua

SEQ ID NO: 2801109 - RNA, 14 nt, Listeria monocytogenes EGD-e
aucugcuauuuuug

SEQ ID NO: 2801110 - RNA, 19 nt, Listeria monocytogenes EGD-e
aucuggcaguuuuucaaug

SEQ ID NO: 2801111 - RNA, 23 nt, Listeria monocytogenes EGD-e
aucugguacguuuuuuauuuuuu

SEQ ID NO: 2801112 - RNA, 13 nt, Listeria monocytogenes EGD-e
aucuguaaaaaua

SEQ ID NO: 2801113 - RNA, 16 nt, Listeria monocytogenes EGD-e
aucuguaaaaauaaau

SEQ ID NO: 2801114 - RNA, 14 nt, Listeria monocytogenes EGD-e
aucuguuccuuugc

SEQ ID NO: 2801115 - RNA, 22 nt, Listeria monocytogenes EGD-e
aucuguucuaaacguucuuccu

SEQ ID NO: 2801116 - RNA, 21 nt, Listeria monocytogenes EGD-e
aucuuaggaauuucgaaauua

SEQ ID NO: 2801117 - RNA, 22 nt, Listeria monocytogenes EGD-e
aucuuaggaauuucgaaauuaa

SEQ ID NO: 2801118 - RNA, 13 nt, Listeria monocytogenes EGD-e
aucuuaucaagua

SEQ ID NO: 2801119 - RNA, 19 nt, Listeria monocytogenes EGD-e
aucuuaucaaguaauaaga

SEQ ID NO: 2801120 - RNA, 20 nt, Listeria monocytogenes EGD-e
aucuuaucaaguaauaagaa

SEQ ID NO: 2801121 - RNA, 19 nt, Listeria monocytogenes EGD-e
aucuuauccgguuuuugcu

SEQ ID NO: 2801122 - RNA, 15 nt, Listeria monocytogenes EGD-e
aucuucaauugcuuc

SEQ ID NO: 2801123 - RNA, 16 nt, Listeria monocytogenes EGD-e
aucuucaauugcuucu

SEQ ID NO: 2801124 - RNA, 19 nt, Listeria monocytogenes EGD-e
aucuuccaucauaauccca

SEQ ID NO: 2801125 - RNA, 21 nt, Listeria monocytogenes EGD-e
aucuuccgcucuuuuuuauga

SEQ ID NO: 2801126 - RNA, 17 nt, Listeria monocytogenes EGD-e
aucuucguauauuuuau

SEQ ID NO: 2801127 - RNA, 16 nt, Listeria monocytogenes EGD-e
aucuucuaagaaaaaa

SEQ ID NO: 2801128 - RNA, 21 nt, Listeria monocytogenes EGD-e
aucuucuguuaacauuuccaa

SEQ ID NO: 2801129 - RNA, 13 nt, Listeria monocytogenes EGD-e
aucuucuugcuuc

SEQ ID NO: 2801130 - RNA, 22 nt, Listeria monocytogenes EGD-e
aucuugauccaaguuuuuuaau

SEQ ID NO: 2801131 - RNA, 18 nt, Listeria monocytogenes EGD-e
aucuuggcaugaugaaaa

SEQ ID NO: 2801132 - RNA, 16 nt, Listeria monocytogenes EGD-e
aucuuuaaacaagcuu

SEQ ID NO: 2801133 - RNA, 16 nt, Listeria monocytogenes EGD-e
aucuuuuccaaaaugg

SEQ ID NO: 2801134 - RNA, 22 nt, Listeria monocytogenes EGD-e
aucuuuuucuugcuuuccagca

SEQ ID NO: 2801135 - RNA, 16 nt, Listeria monocytogenes EGD-e
augaaaagaaaaaccg

SEQ ID NO: 2801136 - RNA, 16 nt, Listeria monocytogenes EGD-e
augaaaaucuacaacu

SEQ ID NO: 2801137 - RNA, 17 nt, Listeria monocytogenes EGD-e
augaaaccaaauaugcu

SEQ ID NO: 2801138 - RNA, 15 nt, Listeria monocytogenes EGD-e
augaacggauguaaa

SEQ ID NO: 2801139 - RNA, 17 nt, Listeria monocytogenes EGD-e
augaagccauucccguc

SEQ ID NO: 2801140 - RNA, 11 nt, Listeria monocytogenes EGD-e
augaauuacuu

SEQ ID NO: 2801141 - RNA, 13 nt, Listeria monocytogenes EGD-e
augaauucugggu

SEQ ID NO: 2801142 - RNA, 20 nt, Listeria monocytogenes EGD-e
augaauuuuuauacacgaua

SEQ ID NO: 2801143 - RNA, 16 nt, Listeria monocytogenes EGD-e
augacaaagcuauuuu

SEQ ID NO: 2801144 - RNA, 15 nt, Listeria monocytogenes EGD-e
augacaagagcgaga

SEQ ID NO: 2801145 - RNA, 15 nt, Listeria monocytogenes EGD-e
augacuguuguuuca

SEQ ID NO: 2801146 - RNA, 12 nt, Listeria monocytogenes EGD-e
augacuuaaaug

SEQ ID NO: 2801147 - RNA, 16 nt, Listeria monocytogenes EGD-e
augagcccaaaaauaa

SEQ ID NO: 2801148 - RNA, 17 nt, Listeria monocytogenes EGD-e
augagcccaaaaauaag

SEQ ID NO: 2801149 - RNA, 15 nt, Listeria monocytogenes EGD-e
augagcuaauuuuuu

SEQ ID NO: 2801150 - RNA, 23 nt, Listeria monocytogenes EGD-e
augagcuaauuuuuuuauaccua

SEQ ID NO: 2801151 - RNA, 13 nt, Listeria monocytogenes EGD-e
augagcuccuuca

SEQ ID NO: 2801152 - RNA, 12 nt, Listeria monocytogenes EGD-e
augaucuuuucg

SEQ ID NO: 2801153 - RNA, 23 nt, Listeria monocytogenes EGD-e
augauucaaagcuacuuuucgaa

SEQ ID NO: 2801154 - RNA, 23 nt, Listeria monocytogenes EGD-e
augauuucuauaaaaaugauaau

SEQ ID NO: 2801155 - RNA, 16 nt, Listeria monocytogenes EGD-e
augauuuguuucuggu

SEQ ID NO: 2801156 - RNA, 20 nt, Listeria monocytogenes EGD-e
augauuuuuaucuaaaucuu

SEQ ID NO: 2801157 - RNA, 23 nt, Listeria monocytogenes EGD-e
augcaaaagcaguagacuaaauu

SEQ ID NO: 2801158 - RNA, 17 nt, Listeria monocytogenes EGD-e
augcaauccauguuguu

SEQ ID NO: 2801159 - RNA, 18 nt, Listeria monocytogenes EGD-e
augcaauccauguuguuu

SEQ ID NO: 2801160 - RNA, 17 nt, Listeria monocytogenes EGD-e
augcacuagaaaaauga

SEQ ID NO: 2801161 - RNA, 20 nt, Listeria monocytogenes EGD-e
augcacuagaaaaaugaaga

SEQ ID NO: 2801162 - RNA, 22 nt, Listeria monocytogenes EGD-e
augcacuagaaaaaugaagaga

SEQ ID NO: 2801163 - RNA, 15 nt, Listeria monocytogenes EGD-e
augcagguaaaacag

SEQ ID NO: 2801164 - RNA, 23 nt, Listeria monocytogenes EGD-e
augcauuucuuacuauuuucuaa

SEQ ID NO: 2801165 - RNA, 13 nt, Listeria monocytogenes EGD-e
augccaguauuuu

SEQ ID NO: 2801166 - RNA, 13 nt, Listeria monocytogenes EGD-e
augccaucaggag

SEQ ID NO: 2801167 - RNA, 21 nt, Listeria monocytogenes EGD-e
augccuucaaacacuucuaaa

SEQ ID NO: 2801168 - RNA, 15 nt, Listeria monocytogenes EGD-e
augcgacauacuuuu

SEQ ID NO: 2801169 - RNA, 14 nt, Listeria monocytogenes EGD-e
augcugaauguuuu

SEQ ID NO: 2801170 - RNA, 18 nt, Listeria monocytogenes EGD-e
augcuucgacguuuaauu

SEQ ID NO: 2801171 - RNA, 14 nt, Listeria monocytogenes EGD-e
auggaaaaauccac

SEQ ID NO: 2801172 - RNA, 12 nt, Listeria monocytogenes EGD-e
auggaaccauuc

SEQ ID NO: 2801173 - RNA, 17 nt, Listeria monocytogenes EGD-e
auugcuucuccguuuuc

SEQ ID NO: 2801174 - RNA, 19 nt, Listeria monocytogenes EGD-e
auugcuucuccguuuucca

SEQ ID NO: 2801175 - RNA, 16 nt, Listeria monocytogenes EGD-e
auugcuucuuuuuucu

SEQ ID NO: 2801176 - RNA, 17 nt, Listeria monocytogenes EGD-e
auugcuucuuuuuucuu

SEQ ID NO: 2801177 - RNA, 20 nt, Listeria monocytogenes EGD-e
auuggcgauucuucaauacg

SEQ ID NO: 2801178 - RNA, 17 nt, Listeria monocytogenes EGD-e
auugggcggaaauaaaa

SEQ ID NO: 2801179 - RNA, 19 nt, Listeria monocytogenes EGD-e
auuggucauauguuucgcc

SEQ ID NO: 2801180 - RNA, 22 nt, Listeria monocytogenes EGD-e
auugguuuuacaccauuuuguu

SEQ ID NO: 2801181 - RNA, 21 nt, Listeria monocytogenes EGD-e
auuguaccgcuugauguuuuu

SEQ ID NO: 2801182 - RNA, 21 nt, Listeria monocytogenes EGD-e
auuguagcucauuacaaaauu

SEQ ID NO: 2801183 - RNA, 19 nt, Listeria monocytogenes EGD-e
auugugcuaaguagacaag

SEQ ID NO: 2801184 - RNA, 15 nt, Listeria monocytogenes EGD-e
auuguuaauagaagc

SEQ ID NO: 2801185 - RNA, 22 nt, Listeria monocytogenes EGD-e
auuguuccagcuguaucaauga

SEQ ID NO: 2801186 - RNA, 16 nt, Listeria monocytogenes EGD-e
auuguuuuuugauuuu

SEQ ID NO: 2801187 - RNA, 17 nt, Listeria monocytogenes EGD-e
auuguuuuuugauuuuu

SEQ ID NO: 2801188 - RNA, 20 nt, Listeria monocytogenes EGD-e
auuuaacaucagauuaaaua

SEQ ID NO: 2801189 - RNA, 23 nt, Listeria monocytogenes EGD-e
auuuaacaucagauuaaauauag

SEQ ID NO: 2801190 - RNA, 14 nt, Listeria monocytogenes EGD-e
auuuaauaaauuag

SEQ ID NO: 2801191 - RNA, 13 nt, Listeria monocytogenes EGD-e
auuuaauuuaauu

SEQ ID NO: 2801192 - RNA, 16 nt, Listeria monocytogenes EGD-e
auuuaauuuaauuuuc

SEQ ID NO: 2801193 - RNA, 21 nt, Listeria monocytogenes EGD-e
auuuaauuugggagcuuucuu

SEQ ID NO: 2801194 - RNA, 23 nt, Listeria monocytogenes EGD-e
auuuacuggcaacuucaaaauua

SEQ ID NO: 2801195 - RNA, 20 nt, Listeria monocytogenes EGD-e
auuuagaggcguacuaaaaa

SEQ ID NO: 2801196 - RNA, 21 nt, Listeria monocytogenes EGD-e
auuuagaggcguacuaaaaau

SEQ ID NO: 2801197 - RNA, 22 nt, Listeria monocytogenes EGD-e
auuuagaggcguacuaaaaauu

SEQ ID NO: 2801198 - RNA, 22 nt, Listeria monocytogenes EGD-e
auuuaggggcauaucuuuugag

SEQ ID NO: 2801199 - RNA, 19 nt, Listeria monocytogenes EGD-e
auuuauauagaaggaauuu

SEQ ID NO: 2801200 - RNA, 14 nt, Listeria monocytogenes EGD-e
auuuaucaaacaaa

SEQ ID NO: 2801201 - RNA, 15 nt, Listeria monocytogenes EGD-e
auuuaucaaacaaaa

SEQ ID NO: 2801202 - RNA, 13 nt, Listeria monocytogenes EGD-e
auuuauuauaagc

SEQ ID NO: 2801203 - RNA, 14 nt, Listeria monocytogenes EGD-e
auuuauuuucccuc

SEQ ID NO: 2801204 - RNA, 15 nt, Listeria monocytogenes EGD-e
auuuauuuucccucc

SEQ ID NO: 2801205 - RNA, 15 nt, Listeria monocytogenes EGD-e
auuucaaccaauucu

SEQ ID NO: 2801206 - RNA, 15 nt, Listeria monocytogenes EGD-e
auuucaauaaugugg

SEQ ID NO: 2801207 - RNA, 21 nt, Listeria monocytogenes EGD-e
auuucaaucgcagcagauuuu

SEQ ID NO: 2801208 - RNA, 18 nt, Listeria monocytogenes EGD-e
auuucauaaucaaauaca

SEQ ID NO: 2801209 - RNA, 17 nt, Listeria monocytogenes EGD-e
auuucaucuuuuuuuau

SEQ ID NO: 2801210 - RNA, 18 nt, Listeria monocytogenes EGD-e
auuucauucuuuuuuaua

SEQ ID NO: 2801211 - RNA, 23 nt, Listeria monocytogenes EGD-e
auuuccaagucuauuucagcuaa

SEQ ID NO: 2801212 - RNA, 13 nt, Listeria monocytogenes EGD-e
auuucuauaaaaa

SEQ ID NO: 2801213 - RNA, 19 nt, Listeria monocytogenes EGD-e
auuucucaaggguuuuugu

SEQ ID NO: 2801214 - RNA, 18 nt, Listeria monocytogenes EGD-e
auuucucccucauccuuu

SEQ ID NO: 2801215 - RNA, 15 nt, Listeria monocytogenes EGD-e
auuucuuuaucuuuc

SEQ ID NO: 2801216 - RNA, 16 nt, Listeria monocytogenes EGD-e
auuucuuuaucuuucc

SEQ ID NO: 2801217 - RNA, 17 nt, Listeria monocytogenes EGD-e
auuucuuuaucuuuccc

SEQ ID NO: 2801218 - RNA, 18 nt, Listeria monocytogenes EGD-e
auuucuuugucgccaccu

SEQ ID NO: 2801219 - RNA, 15 nt, Listeria monocytogenes EGD-e
auuucuuuugacaaa

SEQ ID NO: 2801220 - RNA, 14 nt, Listeria monocytogenes EGD-e
auuugauacauauu

SEQ ID NO: 2801221 - RNA, 17 nt, Listeria monocytogenes EGD-e
auuugccaucgcagcag

SEQ ID NO: 2801222 - RNA, 16 nt, Listeria monocytogenes EGD-e
auuugguacuugugaa

SEQ ID NO: 2801223 - RNA, 17 nt, Listeria monocytogenes EGD-e
auuugguccaucaaauu

SEQ ID NO: 2801224 - RNA, 19 nt, Listeria monocytogenes EGD-e
auuugucccacaaacucau

SEQ ID NO: 2801225 - RNA, 20 nt, Listeria monocytogenes EGD-e
auuugucccacaaacucauu

SEQ ID NO: 2801226 - RNA, 18 nt, Listeria monocytogenes EGD-e
auuugucuucggauuuuu

SEQ ID NO: 2801227 - RNA, 20 nt, Listeria monocytogenes EGD-e
auuugucuucggauuuuuca

SEQ ID NO: 2801228 - RNA, 15 nt, Listeria monocytogenes EGD-e
auuuguuuuauuaca

SEQ ID NO: 2801229 - RNA, 17 nt, Listeria monocytogenes EGD-e
auuuguuuuauuacauu

SEQ ID NO: 2801230 - RNA, 14 nt, Listeria monocytogenes EGD-e
auuuuaaagagagu

SEQ ID NO: 2801231 - RNA, 12 nt, Listeria monocytogenes EGD-e
auuuuaaaucuu

SEQ ID NO: 2801232 - RNA, 13 nt, Listeria monocytogenes EGD-e
auuuuaacggcuu

SEQ ID NO: 2801233 - RNA, 18 nt, Listeria monocytogenes EGD-e
auuuuaacggcuucaaaa

SEQ ID NO: 2801234 - RNA, 15 nt, Listeria monocytogenes EGD-e
auuuuagcuuauuaa

SEQ ID NO: 2801235 - RNA, 20 nt, Listeria monocytogenes EGD-e
auuuuauagguaacaucuuc

SEQ ID NO: 2801236 - RNA, 22 nt, Listeria monocytogenes EGD-e
auuuuaucugguacguuuuuua

SEQ ID NO: 2801237 - RNA, 12 nt, Listeria monocytogenes EGD-e
auuuuauuuuua

SEQ ID NO: 2801238 - RNA, 21 nt, Listeria monocytogenes EGD-e
auuuuauuuuuauuauaaaaa

SEQ ID NO: 2801239 - RNA, 16 nt, Listeria monocytogenes EGD-e
auuuucacccauacua

SEQ ID NO: 2801240 - RNA, 14 nt, Listeria monocytogenes EGD-e
auuuucacugcaua

SEQ ID NO: 2801241 - RNA, 19 nt, Listeria monocytogenes EGD-e
auuuucagaaaaugcugcu

SEQ ID NO: 2801242 - RNA, 20 nt, Listeria monocytogenes EGD-e
auuuucaucccuuuuuucau

SEQ ID NO: 2801243 - RNA, 13 nt, Listeria monocytogenes EGD-e
auuuucauucuuu

SEQ ID NO: 2801244 - RNA, 23 nt, Listeria monocytogenes EGD-e
auuuucccuccuuuauuuuuuau

SEQ ID NO: 2801245 - RNA, 18 nt, Listeria monocytogenes EGD-e
auuuuccgcagcuucaau

SEQ ID NO: 2801246 - RNA, 19 nt, Listeria monocytogenes EGD-e
auuuuccgcagcuucaauc

SEQ ID NO: 2801247 - RNA, 16 nt, Listeria monocytogenes EGD-e
auuuucuaaucaaaug

SEQ ID NO: 2801248 - RNA, 16 nt, Listeria monocytogenes EGD-e
auuuucuauuccuccu

SEQ ID NO: 2801249 - RNA, 14 nt, Listeria monocytogenes EGD-e
auuuugcucaagug

SEQ ID NO: 2801250 - RNA, 16 nt, Listeria monocytogenes EGD-e
auuuugcuugucuuau

SEQ ID NO: 2801251 - RNA, 16 nt, Listeria monocytogenes EGD-e
auuuuggaguuaagua

SEQ ID NO: 2801252 - RNA, 22 nt, Listeria monocytogenes EGD-e
auuuugguuuggucaacaucau

SEQ ID NO: 2801253 - RNA, 21 nt, Listeria monocytogenes EGD-e
auuuugucaauccauuuuucu

SEQ ID NO: 2801254 - RNA, 12 nt, Listeria monocytogenes EGD-e
auuuuuaucuaa

SEQ ID NO: 2801255 - RNA, 14 nt, Listeria monocytogenes EGD-e
auuuuuauuauaaa

SEQ ID NO: 2801256 - RNA, 15 nt, Listeria monocytogenes EGD-e
auuuuuauuauaaaa

SEQ ID NO: 2801257 - RNA, 15 nt, Listeria monocytogenes EGD-e
auuuuucaaaucaau

SEQ ID NO: 2801258 - RNA, 22 nt, Listeria monocytogenes EGD-e
auuuuucuagugcaucuucuaa

SEQ ID NO: 2801259 - RNA, 12 nt, Listeria monocytogenes EGD-e
auuuuucuucug

SEQ ID NO: 2801260 - RNA, 13 nt, Listeria monocytogenes EGD-e
auuuuucuuucuu

SEQ ID NO: 2801261 - RNA, 16 nt, Listeria monocytogenes EGD-e
auuuuucuuucuuuug

SEQ ID NO: 2801262 - RNA, 19 nt, Listeria monocytogenes EGD-e
auuuuugaauuaguauuuu

SEQ ID NO: 2801263 - RNA, 15 nt, Listeria monocytogenes EGD-e
auuuuugcauccacu

SEQ ID NO: 2801264 - RNA, 21 nt, Listeria monocytogenes EGD-e
auuuuuucuuugccuuaaaau

SEQ ID NO: 2801265 - RNA, 19 nt, Listeria monocytogenes EGD-e
auuuuuuggugacgaauca

SEQ ID NO: 2801266 - RNA, 16 nt, Listeria monocytogenes EGD-e
auuuuuuugaaaaaac

SEQ ID NO: 2801267 - RNA, 23 nt, Listeria monocytogenes EGD-e
caaaaagauuauggaaaaaucca

SEQ ID NO: 2801268 - RNA, 13 nt, Listeria monocytogenes EGD-e
caaaaauaugcuu

SEQ ID NO: 2801269 - RNA, 14 nt, Listeria monocytogenes EGD-e
caaaacaaacuagu

SEQ ID NO: 2801270 - RNA, 14 nt, Listeria monocytogenes EGD-e
caaaacauuuucau

SEQ ID NO: 2801271 - RNA, 20 nt, Listeria monocytogenes EGD-e
caaaaccucuuuuuuuauac

SEQ ID NO: 2801272 - RNA, 17 nt, Listeria monocytogenes EGD-e
caaaacucucuuucugc

SEQ ID NO: 2801273 - RNA, 16 nt, Listeria monocytogenes EGD-e
caaaagauagacacac

SEQ ID NO: 2801274 - RNA, 14 nt, Listeria monocytogenes EGD-e
cacaagaagggcuu

SEQ ID NO: 2801275 - RNA, 22 nt, Listeria monocytogenes EGD-e
cacaagaagggcuuuuuuccuu

SEQ ID NO: 2801276 - RNA, 14 nt, Listeria monocytogenes EGD-e
cacaaguaacucuu

SEQ ID NO: 2801277 - RNA, 16 nt, Listeria monocytogenes EGD-e
cacagcagaaacuuuc

SEQ ID NO: 2801278 - RNA, 17 nt, Listeria monocytogenes EGD-e
cacagcgcuuaaaaauu

SEQ ID NO: 2801279 - RNA, 18 nt, Listeria monocytogenes EGD-e
cacaucacgagaaagcca

SEQ ID NO: 2801280 - RNA, 14 nt, Listeria monocytogenes EGD-e
cacauccgcaugaa

SEQ ID NO: 2801281 - RNA, 21 nt, Listeria monocytogenes EGD-e
cacauccgcaugaauuuuugc

SEQ ID NO: 2801282 - RNA, 15 nt, Listeria monocytogenes EGD-e
cacaucgcuucugau

SEQ ID NO: 2801283 - RNA, 19 nt, Listeria monocytogenes EGD-e
cacauuguagcgauucccu

SEQ ID NO: 2801284 - RNA, 18 nt, Listeria monocytogenes EGD-e
caccaacaauuacuucca

SEQ ID NO: 2801285 - RNA, 13 nt, Listeria monocytogenes EGD-e
caccaauuuuaaa

SEQ ID NO: 2801286 - RNA, 23 nt, Listeria monocytogenes EGD-e
caccaauuuuaaauccguugucu

SEQ ID NO: 2801287 - RNA, 17 nt, Listeria monocytogenes EGD-e
caccaccuuugguaaaa

SEQ ID NO: 2801288 - RNA, 16 nt, Listeria monocytogenes EGD-e
caccacuucuuccacc

SEQ ID NO: 2801289 - RNA, 15 nt, Listeria monocytogenes EGD-e
caccaggcaaaacaa

SEQ ID NO: 2801290 - RNA, 14 nt, Listeria monocytogenes EGD-e
cacccauaauagca

SEQ ID NO: 2801291 - RNA, 15 nt, Listeria monocytogenes EGD-e
cacccgguccuucaa

SEQ ID NO: 2801292 - RNA, 17 nt, Listeria monocytogenes EGD-e
caccucuuguacacauu

SEQ ID NO: 2801293 - RNA, 21 nt, Listeria monocytogenes EGD-e
caccucuuguacacauuauac

SEQ ID NO: 2801294 - RNA, 21 nt, Listeria monocytogenes EGD-e
caccugcauuucauuuuaauc

SEQ ID NO: 2801295 - RNA, 15 nt, Listeria monocytogenes EGD-e
cacgacgaauggccu

SEQ ID NO: 2801296 - RNA, 20 nt, Listeria monocytogenes EGD-e
cacgaguugcuuuagaauau

SEQ ID NO: 2801297 - RNA, 22 nt, Listeria monocytogenes EGD-e
cacgucccauugcgaauaacaa

SEQ ID NO: 2801298 - RNA, 20 nt, Listeria monocytogenes EGD-e
cacguuccccaccaagguaa

SEQ ID NO: 2801299 - RNA, 15 nt, Listeria monocytogenes EGD-e
cacuaacauaaauug

SEQ ID NO: 2801300 - RNA, 21 nt, Listeria monocytogenes EGD-e
cacuaaugcucaccuucuuuu

SEQ ID NO: 2801301 - RNA, 22 nt, Listeria monocytogenes EGD-e
cacuaauuagcauaauauccau

SEQ ID NO: 2801302 - RNA, 19 nt, Listeria monocytogenes EGD-e
cacuagaaaaaugaagaga

SEQ ID NO: 2801303 - RNA, 21 nt, Listeria monocytogenes EGD-e
cacuaguauuccuaucacaaa

SEQ ID NO: 2801304 - RNA, 17 nt, Listeria monocytogenes EGD-e
cacucuuuuauaaaaau

SEQ ID NO: 2801305 - RNA, 17 nt, Listeria monocytogenes EGD-e
cacuggagcugauuuua

SEQ ID NO: 2801306 - RNA, 16 nt, Listeria monocytogenes EGD-e
cacugugaacugauuu

SEQ ID NO: 2801307 - RNA, 21 nt, Listeria monocytogenes EGD-e
cacuuagguuagcagcuuuug

SEQ ID NO: 2801308 - RNA, 19 nt, Listeria monocytogenes EGD-e
cacuucuaccguuccuuca

SEQ ID NO: 2801309 - RNA, 20 nt, Listeria monocytogenes EGD-e
cacuucuaccguuccuucaa

SEQ ID NO: 2801310 - RNA, 23 nt, Listeria monocytogenes EGD-e
cacuucuaccguuccuucaagca

SEQ ID NO: 2801311 - RNA, 19 nt, Listeria monocytogenes EGD-e
cacuuggaacggcuuuauc

SEQ ID NO: 2801312 - RNA, 14 nt, Listeria monocytogenes EGD-e
cagaaaaaaacaaa

SEQ ID NO: 2801313 - RNA, 12 nt, Listeria monocytogenes EGD-e
cagaaaaacugc

SEQ ID NO: 2801314 - RNA, 17 nt, Listeria monocytogenes EGD-e
cagaaaacagaaagcug

SEQ ID NO: 2801315 - RNA, 12 nt, Listeria monocytogenes EGD-e
cagaaacaauca

SEQ ID NO: 2801316 - RNA, 13 nt, Listeria monocytogenes EGD-e
cagaagcauuuuc

SEQ ID NO: 2801317 - RNA, 15 nt, Listeria monocytogenes EGD-e
cagaagccccuugga

SEQ ID NO: 2801318 - RNA, 19 nt, Listeria monocytogenes EGD-e
cagaaugggccguccaauu

SEQ ID NO: 2801319 - RNA, 15 nt, Listeria monocytogenes EGD-e
cagacgcaauuucaa

SEQ ID NO: 2801320 - RNA, 17 nt, Listeria monocytogenes EGD-e
cagacuuuuuuuuauaa

SEQ ID NO: 2801321 - RNA, 14 nt, Listeria monocytogenes EGD-e
cagauaguuguucc

SEQ ID NO: 2801322 - RNA, 21 nt, Listeria monocytogenes EGD-e
cagaucaaaagcaaaaaagua

SEQ ID NO: 2801323 - RNA, 21 nt, Listeria monocytogenes EGD-e
cagauccuucaauaauauaau

SEQ ID NO: 2801324 - RNA, 22 nt, Listeria monocytogenes EGD-e
cagauguaucuaaaaucauuaa

SEQ ID NO: 2801325 - RNA, 17 nt, Listeria monocytogenes EGD-e
cagauuaacccaauuuu

SEQ ID NO: 2801326 - RNA, 19 nt, Listeria monocytogenes EGD-e
cagcaagagcaccaauaaa

SEQ ID NO: 2801327 - RNA, 20 nt, Listeria monocytogenes EGD-e
cagcaagagcaccaauaaaa

SEQ ID NO: 2801328 - RNA, 21 nt, Listeria monocytogenes EGD-e
cagcagauuuugcgaaagcug

SEQ ID NO: 2801329 - RNA, 22 nt, Listeria monocytogenes EGD-e
cagcagauuuugcgaaagcugu

SEQ ID NO: 2801330 - RNA, 15 nt, Listeria monocytogenes EGD-e
cagccaauucuucca

SEQ ID NO: 2801331 - RNA, 19 nt, Listeria monocytogenes EGD-e
cagcccaaccuauuuggua

SEQ ID NO: 2801332 - RNA, 14 nt, Listeria monocytogenes EGD-e
cagcgguuguugua

SEQ ID NO: 2801333 - RNA, 17 nt, Listeria monocytogenes EGD-e
cagcguauccaccaaaa

SEQ ID NO: 2801334 - RNA, 17 nt, Listeria monocytogenes EGD-e
cagcgucuaaaaaugca

SEQ ID NO: 2801335 - RNA, 14 nt, Listeria monocytogenes EGD-e
cagcuaaguuuucu

SEQ ID NO: 2801336 - RNA, 21 nt, Listeria monocytogenes EGD-e
cagcuagacaagcacuuacug

SEQ ID NO: 2801337 - RNA, 12 nt, Listeria monocytogenes EGD-e
cagcugauuuuu

SEQ ID NO: 2801338 - RNA, 14 nt, Listeria monocytogenes EGD-e
cagcugauuuuugg

SEQ ID NO: 2801339 - RNA, 19 nt, Listeria monocytogenes EGD-e
cagcugauuuuugggguuu

SEQ ID NO: 2801340 - RNA, 18 nt, Listeria monocytogenes EGD-e
cagcuucaaucuguucca

SEQ ID NO: 2801341 - RNA, 20 nt, Listeria monocytogenes EGD-e
cagcuucuuccauuuguucu

SEQ ID NO: 2801342 - RNA, 16 nt, Listeria monocytogenes EGD-e
caggaguuaauucugu

SEQ ID NO: 2801343 - RNA, 22 nt, Listeria monocytogenes EGD-e
caggaucaaaaugggcaguuac

SEQ ID NO: 2801344 - RNA, 17 nt, Listeria monocytogenes EGD-e
caggauggcuacuagaa

SEQ ID NO: 2801345 - RNA, 16 nt, Listeria monocytogenes EGD-e
caggcugcuuggacug

SEQ ID NO: 2801346 - RNA, 20 nt, Listeria monocytogenes EGD-e
caggguggccgugauaaaua

SEQ ID NO: 2801347 - RNA, 17 nt, Listeria monocytogenes EGD-e
caggguuuguuccaccg

SEQ ID NO: 2801348 - RNA, 16 nt, Listeria monocytogenes EGD-e
caguaacgccucgaga

SEQ ID NO: 2801349 - RNA, 19 nt, Listeria monocytogenes EGD-e
caguaccugcaagcgaauu

SEQ ID NO: 2801350 - RNA, 14 nt, Listeria monocytogenes EGD-e
caguaguuuacuuc

SEQ ID NO: 2801351 - RNA, 18 nt, Listeria monocytogenes EGD-e
caguccaccagcuacuuc

SEQ ID NO: 2801352 - RNA, 18 nt, Listeria monocytogenes EGD-e
cagugaugguauuguuuu

SEQ ID NO: 2801353 - RNA, 21 nt, Listeria monocytogenes EGD-e
cagugaugguauuguuuuuug

SEQ ID NO: 2801354 - RNA, 18 nt, Listeria monocytogenes EGD-e
cagugaugguggaaucug

SEQ ID NO: 2801355 - RNA, 15 nt, Listeria monocytogenes EGD-e
caguuaaacaaacac

SEQ ID NO: 2801356 - RNA, 19 nt, Listeria monocytogenes EGD-e
caguuagaaccguauuuaa

SEQ ID NO: 2801357 - RNA, 19 nt, Listeria monocytogenes EGD-e
caguuagaagaacugcggc

SEQ ID NO: 2801358 - RNA, 12 nt, Listeria monocytogenes EGD-e
caguuauuaaaa

SEQ ID NO: 2801359 - RNA, 21 nt, Listeria monocytogenes EGD-e
caguuauuaaaaggacaccca

SEQ ID NO: 2801360 - RNA, 16 nt, Listeria monocytogenes EGD-e
caguucaacuacuuca

SEQ ID NO: 2801361 - RNA, 17 nt, Listeria monocytogenes EGD-e
caguucaacuacuucaa

SEQ ID NO: 2801362 - RNA, 15 nt, Listeria monocytogenes EGD-e
caguuuauaaauacc

SEQ ID NO: 2801363 - RNA, 23 nt, Listeria monocytogenes EGD-e
caguuuauaaauaccuguuucug

SEQ ID NO: 2801364 - RNA, 16 nt, Listeria monocytogenes EGD-e
caguuucuuuuugcug

SEQ ID NO: 2801365 - RNA, 20 nt, Listeria monocytogenes EGD-e
cauaaaaagcugccaccacu

SEQ ID NO: 2801366 - RNA, 12 nt, Listeria monocytogenes EGD-e
cauaaacaaaag

SEQ ID NO: 2801367 - RNA, 23 nt, Listeria monocytogenes EGD-e
cauaaagcuaagcauuauaaaaa

SEQ ID NO: 2801368 - RNA, 21 nt, Listeria monocytogenes EGD-e
cauaaccucgcaaaaaauaau

SEQ ID NO: 2801369 - RNA, 14 nt, Listeria monocytogenes EGD-e
cauaaccuucaucg

SEQ ID NO: 2801370 - RNA, 12 nt, Listeria monocytogenes EGD-e
cauaauaaugcu

SEQ ID NO: 2801371 - RNA, 17 nt, Listeria monocytogenes EGD-e
cauaauagaaagccauc

SEQ ID NO: 2801372 - RNA, 19 nt, Listeria monocytogenes EGD-e
cauaauaggagacauuaaa

SEQ ID NO: 2801373 - RNA, 12 nt, Listeria monocytogenes EGD-e
cauaaucaaaua

SEQ ID NO: 2801374 - RNA, 19 nt, Listeria monocytogenes EGD-e
cauaaucccacaaaaaaua

SEQ ID NO: 2801375 - RNA, 23 nt, Listeria monocytogenes EGD-e
ccaaucauggaaacaaaguauug

SEQ ID NO: 2801376 - RNA, 15 nt, Listeria monocytogenes EGD-e
ccaauucacuuacuu

SEQ ID NO: 2801377 - RNA, 12 nt, Listeria monocytogenes EGD-e
ccaauuguuuua

SEQ ID NO: 2801378 - RNA, 15 nt, Listeria monocytogenes EGD-e
ccaauuguuuuacca

SEQ ID NO: 2801379 - RNA, 23 nt, Listeria monocytogenes EGD-e
ccaauuucuguuuuguuuucagg

SEQ ID NO: 2801380 - RNA, 10 nt, Listeria monocytogenes EGD-e
ccaauuuuac

SEQ ID NO: 2801381 - RNA, 22 nt, Listeria monocytogenes EGD-e
ccaauuuuacgcauaucaucaa

SEQ ID NO: 2801382 - RNA, 12 nt, Listeria monocytogenes EGD-e
ccacaaaaaaua

SEQ ID NO: 2801383 - RNA, 19 nt, Listeria monocytogenes EGD-e
ccacaaacucauuacuuga

SEQ ID NO: 2801384 - RNA, 18 nt, Listeria monocytogenes EGD-e
ccacaaaggacaacaggu

SEQ ID NO: 2801385 - RNA, 17 nt, Listeria monocytogenes EGD-e
ccacacugguuuuuuga

SEQ ID NO: 2801386 - RNA, 18 nt, Listeria monocytogenes EGD-e
ccacaucgauguuaccac

SEQ ID NO: 2801387 - RNA, 17 nt, Listeria monocytogenes EGD-e
ccaccaggcaaaacaag

SEQ ID NO: 2801388 - RNA, 18 nt, Listeria monocytogenes EGD-e
ccaccauuuguuuuauuu

SEQ ID NO: 2801389 - RNA, 12 nt, Listeria monocytogenes EGD-e
ccacgugcaccu

SEQ ID NO: 2801390 - RNA, 19 nt, Listeria monocytogenes EGD-e
ccacgugcaccugcauuuc

SEQ ID NO: 2801391 - RNA, 21 nt, Listeria monocytogenes EGD-e
ccacuucuaccguuccuucaa

SEQ ID NO: 2801392 - RNA, 17 nt, Listeria monocytogenes EGD-e
ccagaaaaaaacaaauu

SEQ ID NO: 2801393 - RNA, 21 nt, Listeria monocytogenes EGD-e
ccagaaacgccaauaccgcua

SEQ ID NO: 2801394 - RNA, 16 nt, Listeria monocytogenes EGD-e
ccagacuuuuuuuuau

SEQ ID NO: 2801395 - RNA, 22 nt, Listeria monocytogenes EGD-e
ccagcaggguggccgugauaaa

SEQ ID NO: 2801396 - RNA, 18 nt, Listeria monocytogenes EGD-e
ccagcaguuuucauuaaa

SEQ ID NO: 2801397 - RNA, 21 nt, Listeria monocytogenes EGD-e
ccagcggucgcguucuugucu

SEQ ID NO: 2801398 - RNA, 19 nt, Listeria monocytogenes EGD-e
ccagcuuaauccaauuucu

SEQ ID NO: 2801399 - RNA, 11 nt, Listeria monocytogenes EGD-e
ccagcuucacg

SEQ ID NO: 2801400 - RNA, 14 nt, Listeria monocytogenes EGD-e
ccagcuugauuaaa

SEQ ID NO: 2801401 - RNA, 14 nt, Listeria monocytogenes EGD-e
ccaggcaaaacaag

SEQ ID NO: 2801402 - RNA, 18 nt, Listeria monocytogenes EGD-e
ccaguaaaacaagaggcu

SEQ ID NO: 2801403 - RNA, 21 nt, Listeria monocytogenes EGD-e
ccaguggcugaaacaaucgcg

SEQ ID NO: 2801404 - RNA, 13 nt, Listeria monocytogenes EGD-e
ccaguuaaacaaa

SEQ ID NO: 2801405 - RNA, 21 nt, Listeria monocytogenes EGD-e
ccaguuaaacaaacacaaaau

SEQ ID NO: 2801406 - RNA, 18 nt, Listeria monocytogenes EGD-e
ccauaagacauaacaagu

SEQ ID NO: 2801407 - RNA, 10 nt, Listeria monocytogenes EGD-e
ccauaauagc

SEQ ID NO: 2801408 - RNA, 14 nt, Listeria monocytogenes EGD-e
ccauauuuucucua

SEQ ID NO: 2801409 - RNA, 17 nt, Listeria monocytogenes EGD-e
ccaucaaauuaucuagc

SEQ ID NO: 2801410 - RNA, 19 nt, Listeria monocytogenes EGD-e
ccaucaguaguaaagcacu

SEQ ID NO: 2801411 - RNA, 16 nt, Listeria monocytogenes EGD-e
ccaucauaaucccagu

SEQ ID NO: 2801412 - RNA, 19 nt, Listeria monocytogenes EGD-e
ccauggucaggugaaacca

SEQ ID NO: 2801413 - RNA, 17 nt, Listeria monocytogenes EGD-e
ccauuacuuuaauuucu

SEQ ID NO: 2801414 - RNA, 17 nt, Listeria monocytogenes EGD-e
ccauuauuuggaaucuc

SEQ ID NO: 2801415 - RNA, 18 nt, Listeria monocytogenes EGD-e
ccauugcccagcuuaauc

SEQ ID NO: 2801416 - RNA, 19 nt, Listeria monocytogenes EGD-e
ccauugcgaauaacaagcg

SEQ ID NO: 2801417 - RNA, 22 nt, Listeria monocytogenes EGD-e
ccauuuuucuucuggaagagcg

SEQ ID NO: 2801418 - RNA, 11 nt, Listeria monocytogenes EGD-e
cccaaaaauaa

SEQ ID NO: 2801419 - RNA, 15 nt, Listeria monocytogenes EGD-e
cccaagauucuucua

SEQ ID NO: 2801420 - RNA, 23 nt, Listeria monocytogenes EGD-e
cccaaguagcaggacaugcuaaa

SEQ ID NO: 2801421 - RNA, 11 nt, Listeria monocytogenes EGD-e
cccagaaaaaa

SEQ ID NO: 2801422 - RNA, 13 nt, Listeria monocytogenes EGD-e
cccauacuaauca

SEQ ID NO: 2801423 - RNA, 14 nt, Listeria monocytogenes EGD-e
cccaucuuuuuucu

SEQ ID NO: 2801424 - RNA, 14 nt, Listeria monocytogenes EGD-e
ccccauaguaaaaa

SEQ ID NO: 2801425 - RNA, 20 nt, Listeria monocytogenes EGD-e
cccgcgcuaaucuucuugcu

SEQ ID NO: 2801426 - RNA, 19 nt, Listeria monocytogenes EGD-e
cccgcuaagaagaguccgc

SEQ ID NO: 2801427 - RNA, 19 nt, Listeria monocytogenes EGD-e
cccggucauuuucacugca

SEQ ID NO: 2801428 - RNA, 21 nt, Listeria monocytogenes EGD-e
cccuagcuauacauugaaaaa

SEQ ID NO: 2801429 - RNA, 18 nt, Listeria monocytogenes EGD-e
cccucauguucaaucuca

SEQ ID NO: 2801430 - RNA, 21 nt, Listeria monocytogenes EGD-e
cccuuuacuugcaaaugcuuu

SEQ ID NO: 2801431 - RNA, 22 nt, Listeria monocytogenes EGD-e
cccuuuuuuuacauuuuugcuu

SEQ ID NO: 2801432 - RNA, 13 nt, Listeria monocytogenes EGD-e
ccgaaaaucgagu

SEQ ID NO: 2801433 - RNA, 15 nt, Listeria monocytogenes EGD-e
ccgaaccaagcacau

SEQ ID NO: 2801434 - RNA, 19 nt, Listeria monocytogenes EGD-e
ccgauuauccuguaauucg

SEQ ID NO: 2801435 - RNA, 15 nt, Listeria monocytogenes EGD-e
ccgcaaauucaugca

SEQ ID NO: 2801436 - RNA, 15 nt, Listeria monocytogenes EGD-e
ccgccuauuauuucu

SEQ ID NO: 2801437 - RNA, 21 nt, Listeria monocytogenes EGD-e
ccgcggaaaguuucgaaguga

SEQ ID NO: 2801438 - RNA, 21 nt, Listeria monocytogenes EGD-e
ccgcucuuuuuuaugaucuuu

SEQ ID NO: 2801439 - RNA, 17 nt, Listeria monocytogenes EGD-e
ccgcugccuuaagcaag

SEQ ID NO: 2801440 - RNA, 23 nt, Listeria monocytogenes EGD-e
ccggacuuaguauuucagcaaga

SEQ ID NO: 2801441 - RNA, 22 nt, Listeria monocytogenes EGD-e
ccggcguacuuaaaucacuucu

SEQ ID NO: 2801442 - RNA, 15 nt, Listeria monocytogenes EGD-e
ccgguaccaucuuuu

SEQ ID NO: 2801443 - RNA, 20 nt, Listeria monocytogenes EGD-e
ccgguccuucaaucggaaca

SEQ ID NO: 2801444 - RNA, 18 nt, Listeria monocytogenes EGD-e
ccggucugugauuacucc

SEQ ID NO: 2801445 - RNA, 17 nt, Listeria monocytogenes EGD-e
ccguaauauauucaaaa

SEQ ID NO: 2801446 - RNA, 15 nt, Listeria monocytogenes EGD-e
ccguauuuauauucu

SEQ ID NO: 2801447 - RNA, 16 nt, Listeria monocytogenes EGD-e
ccgucaagcccagcua

SEQ ID NO: 2801448 - RNA, 14 nt, Listeria monocytogenes EGD-e
ccguccaauucuuu

SEQ ID NO: 2801449 - RNA, 22 nt, Listeria monocytogenes EGD-e
ccgucuccaccaaguucuguug

SEQ ID NO: 2801450 - RNA, 14 nt, Listeria monocytogenes EGD-e
ccgugauaaauaac

SEQ ID NO: 2801451 - RNA, 12 nt, Listeria monocytogenes EGD-e
ccuaaagcaucg

SEQ ID NO: 2801452 - RNA, 13 nt, Listeria monocytogenes EGD-e
ccuaaaucuuuca

SEQ ID NO: 2801453 - RNA, 15 nt, Listeria monocytogenes EGD-e
ccuaauuuacuacua

SEQ ID NO: 2801454 - RNA, 11 nt, Listeria monocytogenes EGD-e
ccuaauuuuac

SEQ ID NO: 2801455 - RNA, 19 nt, Listeria monocytogenes EGD-e
ccuacuucuaaauuaacuu

SEQ ID NO: 2801456 - RNA, 13 nt, Listeria monocytogenes EGD-e
ccuagcuaaugcu

SEQ ID NO: 2801457 - RNA, 14 nt, Listeria monocytogenes EGD-e
ccuagcuaaugcua

SEQ ID NO: 2801458 - RNA, 22 nt, Listeria monocytogenes EGD-e
ccuaggcgcucuuuaauaauua

SEQ ID NO: 2801459 - RNA, 13 nt, Listeria monocytogenes EGD-e
ccuaguuaaucua

SEQ ID NO: 2801460 - RNA, 21 nt, Listeria monocytogenes EGD-e
ccucauauuuggccaauuaaa

SEQ ID NO: 2801461 - RNA, 18 nt, Listeria monocytogenes EGD-e
ccucaucugagaagccag

SEQ ID NO: 2801462 - RNA, 19 nt, Listeria monocytogenes EGD-e
ccucauuacucgguucaau

SEQ ID NO: 2801463 - RNA, 21 nt, Listeria monocytogenes EGD-e
ccucauuacucgguucaauua

SEQ ID NO: 2801464 - RNA, 15 nt, Listeria monocytogenes EGD-e
ccuccuguugcacca

SEQ ID NO: 2801465 - RNA, 19 nt, Listeria monocytogenes EGD-e
ccucuaaaguuagauuaaa

SEQ ID NO: 2801466 - RNA, 21 nt, Listeria monocytogenes EGD-e
ccucuaaaguuagauuaaaaa

SEQ ID NO: 2801467 - RNA, 14 nt, Listeria monocytogenes EGD-e
ccucuuuuuuuagu

SEQ ID NO: 2801468 - RNA, 18 nt, Listeria monocytogenes EGD-e
ccugaugaugccgcaaga

SEQ ID NO: 2801469 - RNA, 14 nt, Listeria monocytogenes EGD-e
ccugcauuucauuu

SEQ ID NO: 2801470 - RNA, 13 nt, Listeria monocytogenes EGD-e
ccugcuaaaacca

SEQ ID NO: 2801471 - RNA, 20 nt, Listeria monocytogenes EGD-e
ccuggauuuucuagguucuu

SEQ ID NO: 2801472 - RNA, 16 nt, Listeria monocytogenes EGD-e
ccugguaaauagccaa

SEQ ID NO: 2801473 - RNA, 19 nt, Listeria monocytogenes EGD-e
ccuguaauucgaauaagaa

SEQ ID NO: 2801474 - RNA, 12 nt, Listeria monocytogenes EGD-e
ccuuaugacaag

SEQ ID NO: 2801475 - RNA, 22 nt, Listeria monocytogenes EGD-e
ccuucaauuucuuuugacaaaa

SEQ ID NO: 2801476 - RNA, 19 nt, Listeria monocytogenes EGD-e
ccuucauaauuauuuuugu

SEQ ID NO: 2801477 - RNA, 14 nt, Listeria monocytogenes EGD-e
cguuuuaaauccuu

SEQ ID NO: 2801478 - RNA, 19 nt, Listeria monocytogenes EGD-e
cuaaaaaauauugaauaga

SEQ ID NO: 2801479 - RNA, 21 nt, Listeria monocytogenes EGD-e
cuaaaaaauauugaauagaac

SEQ ID NO: 2801480 - RNA, 20 nt, Listeria monocytogenes EGD-e
cuaaaacaggcguaauaaau

SEQ ID NO: 2801481 - RNA, 13 nt, Listeria monocytogenes EGD-e
cuaaaauaacauc

SEQ ID NO: 2801482 - RNA, 15 nt, Listeria monocytogenes EGD-e
cuaaaauaucaucaa

SEQ ID NO: 2801483 - RNA, 20 nt, Listeria monocytogenes EGD-e
cuaaacguucuuccuuuuuc

SEQ ID NO: 2801484 - RNA, 21 nt, Listeria monocytogenes EGD-e
cuaaacguucuuccuuuuuca

SEQ ID NO: 2801485 - RNA, 20 nt, Listeria monocytogenes EGD-e
cuaaauaaaaccauucaucu

SEQ ID NO: 2801486 - RNA, 14 nt, Listeria monocytogenes EGD-e
cuaaauagucccca

SEQ ID NO: 2801487 - RNA, 15 nt, Listeria monocytogenes EGD-e
cuaaauauuuaauuu

SEQ ID NO: 2801488 - RNA, 24 nt, Listeria monocytogenes EGD-e
cuaaaucuuuucgaaucguacuuu

SEQ ID NO: 2801489 - RNA, 20 nt, Listeria monocytogenes EGD-e
cuaaauugauaccaaauugu

SEQ ID NO: 2801490 - RNA, 15 nt, Listeria monocytogenes EGD-e
cuaacaacaagcaaa

SEQ ID NO: 2801491 - RNA, 19 nt, Listeria monocytogenes EGD-e
cuaacaacaagcaaaacau

SEQ ID NO: 2801492 - RNA, 18 nt, Listeria monocytogenes EGD-e
cuaacacagcuaccucau

SEQ ID NO: 2801493 - RNA, 12 nt, Listeria monocytogenes EGD-e
cuaacauuaauu

SEQ ID NO: 2801494 - RNA, 18 nt, Listeria monocytogenes EGD-e
cuaacauuaauucauuua

SEQ ID NO: 2801495 - RNA, 15 nt, Listeria monocytogenes EGD-e
cuaacgcuuuuucag

SEQ ID NO: 2801496 - RNA, 19 nt, Listeria monocytogenes EGD-e
cuaagaaugaacgaagagc

SEQ ID NO: 2801497 - RNA, 16 nt, Listeria monocytogenes EGD-e
cuaagcauuauaaaaa

SEQ ID NO: 2801498 - RNA, 16 nt, Listeria monocytogenes EGD-e
cuaaguagacaagucc

SEQ ID NO: 2801499 - RNA, 14 nt, Listeria monocytogenes EGD-e
cuaaguuaaaccau

SEQ ID NO: 2801500 - RNA, 13 nt, Listeria monocytogenes EGD-e
cuaauaacauuaa

SEQ ID NO: 2801501 - RNA, 14 nt, Listeria monocytogenes EGD-e
cuaauaacauuaaa

SEQ ID NO: 2801502 - RNA, 23 nt, Listeria monocytogenes EGD-e
cuaauagcagagcuccaauaaua

SEQ ID NO: 2801503 - RNA, 13 nt, Listeria monocytogenes EGD-e
cuaaugaauaagc

SEQ ID NO: 2801504 - RNA, 20 nt, Listeria monocytogenes EGD-e
cuaaugauagaagaacgaau

SEQ ID NO: 2801505 - RNA, 22 nt, Listeria monocytogenes EGD-e
cuaaugcuaggccuacuuuuuu

SEQ ID NO: 2801506 - RNA, 13 nt, Listeria monocytogenes EGD-e
cuaauuacuaaaa

SEQ ID NO: 2801507 - RNA, 19 nt, Listeria monocytogenes EGD-e
cuaauucugcgauuuuuuc

SEQ ID NO: 2801508 - RNA, 21 nt, Listeria monocytogenes EGD-e
cuaauuguuaccgcauuuuuc

SEQ ID NO: 2801509 - RNA, 13 nt, Listeria monocytogenes EGD-e
cuaauuuuacuuc

SEQ ID NO: 2801510 - RNA, 18 nt, Listeria monocytogenes EGD-e
cuaauuuuacuucuacuu

SEQ ID NO: 2801511 - RNA, 23 nt, Listeria monocytogenes EGD-e
cuaauuuuuuuauaccuaaagca

SEQ ID NO: 2801512 - RNA, 14 nt, Listeria monocytogenes EGD-e
cuacaacuagauuu

SEQ ID NO: 2801513 - RNA, 18 nt, Listeria monocytogenes EGD-e
cuacaacuagauuuucau

SEQ ID NO: 2801514 - RNA, 14 nt, Listeria monocytogenes EGD-e
cuacaauuaaaaua

SEQ ID NO: 2801515 - RNA, 23 nt, Listeria monocytogenes EGD-e
cuacagguguauucgucuuuuca

SEQ ID NO: 2801516 - RNA, 23 nt, Listeria monocytogenes EGD-e
cuacuaauuguuaccgcauuuuu

SEQ ID NO: 2801517 - RNA, 21 nt, Listeria monocytogenes EGD-e
cuacuaucaugacuaaaaagc

SEQ ID NO: 2801518 - RNA, 18 nt, Listeria monocytogenes EGD-e
cuacuaucgguuguuccu

SEQ ID NO: 2801519 - RNA, 17 nt, Listeria monocytogenes EGD-e
cuacuuacggucuuuuu

SEQ ID NO: 2801520 - RNA, 20 nt, Listeria monocytogenes EGD-e
cuacuuuuaaaauucuauua

SEQ ID NO: 2801521 - RNA, 16 nt, Listeria monocytogenes EGD-e
cuacuuuuuuuauuua

SEQ ID NO: 2801522 - RNA, 20 nt, Listeria monocytogenes EGD-e
cuagacuguaugaaacuugu

SEQ ID NO: 2801523 - RNA, 15 nt, Listeria monocytogenes EGD-e
cuagauuuaauaaau

SEQ ID NO: 2801524 - RNA, 17 nt, Listeria monocytogenes EGD-e
cuagauuuaauaaauua

SEQ ID NO: 2801525 - RNA, 17 nt, Listeria monocytogenes EGD-e
cuagcaucagcuuuuuu

SEQ ID NO: 2801526 - RNA, 20 nt, Listeria monocytogenes EGD-e
cuagcaugucguaugcuuua

SEQ ID NO: 2801527 - RNA, 20 nt, Listeria monocytogenes EGD-e
cuagccgcucgucuaaauug

SEQ ID NO: 2801528 - RNA, 17 nt, Listeria monocytogenes EGD-e
cuaggccuacuuuuuug

SEQ ID NO: 2801529 - RNA, 22 nt, Listeria monocytogenes EGD-e
cuagguucuuuuuuaugaaaaa

SEQ ID NO: 2801530 - RNA, 23 nt, Listeria monocytogenes EGD-e
cuagguucuuuuuuaugaaaaaa

SEQ ID NO: 2801531 - RNA, 18 nt, Listeria monocytogenes EGD-e
cuagguuuucuuuuuucg

SEQ ID NO: 2801532 - RNA, 17 nt, Listeria monocytogenes EGD-e
cuaguauuccuaucaca

SEQ ID NO: 2801533 - RNA, 20 nt, Listeria monocytogenes EGD-e
cuauaacaaagcguuuuuua

SEQ ID NO: 2801534 - RNA, 19 nt, Listeria monocytogenes EGD-e
cuauauucauuauuaaacu

SEQ ID NO: 2801535 - RNA, 13 nt, Listeria monocytogenes EGD-e
cuaugucuuuuug

SEQ ID NO: 2801536 - RNA, 15 nt, Listeria monocytogenes EGD-e
cuaugucuuuuugug

SEQ ID NO: 2801537 - RNA, 12 nt, Listeria monocytogenes EGD-e
cuauuaauaaug

SEQ ID NO: 2801538 - RNA, 22 nt, Listeria monocytogenes EGD-e
cuauuaaugguugcauuuggag

SEQ ID NO: 2801539 - RNA, 12 nt, Listeria monocytogenes EGD-e
cuauuauuucug

SEQ ID NO: 2801540 - RNA, 21 nt, Listeria monocytogenes EGD-e
cuauuccuccuaauuguuuug

SEQ ID NO: 2801541 - RNA, 13 nt, Listeria monocytogenes EGD-e
cuauuuaaauaua

SEQ ID NO: 2801542 - RNA, 18 nt, Listeria monocytogenes EGD-e
cuauuuaucaaacaaaaa

SEQ ID NO: 2801543 - RNA, 15 nt, Listeria monocytogenes EGD-e
cucaccuucuuuuug

SEQ ID NO: 2801544 - RNA, 19 nt, Listeria monocytogenes EGD-e
cucagauccuucaauaaua

SEQ ID NO: 2801545 - RNA, 18 nt, Listeria monocytogenes EGD-e
cucagcuucgauuuuuuc

SEQ ID NO: 2801546 - RNA, 16 nt, Listeria monocytogenes EGD-e
cucaggaguuaauucu

SEQ ID NO: 2801547 - RNA, 24 nt, Listeria monocytogenes EGD-e
cucauaacgaugacgaugacgcuc

SEQ ID NO: 2801548 - RNA, 14 nt, Listeria monocytogenes EGD-e
cucauaagcuucau

SEQ ID NO: 2801549 - RNA, 16 nt, Listeria monocytogenes EGD-e
cucauaagcuucauaa

SEQ ID NO: 2801550 - RNA, 19 nt, Listeria monocytogenes EGD-e
cucaucaagaaauuaaauu

SEQ ID NO: 2801551 - RNA, 21 nt, Listeria monocytogenes EGD-e
cucaugaaacuuuaacaaaag

SEQ ID NO: 2801552 - RNA, 14 nt, Listeria monocytogenes EGD-e
cucauguucaaucu

SEQ ID NO: 2801553 - RNA, 14 nt, Listeria monocytogenes EGD-e
cucauuacaaaauu

SEQ ID NO: 2801554 - RNA, 13 nt, Listeria monocytogenes EGD-e
cucauuacucggu

SEQ ID NO: 2801555 - RNA, 21 nt, Listeria monocytogenes EGD-e
cucauuacucgguucaauuaa

SEQ ID NO: 2801556 - RNA, 22 nt, Listeria monocytogenes EGD-e
cuccaaucagcaagauaacuca

SEQ ID NO: 2801557 - RNA, 23 nt, Listeria monocytogenes EGD-e
cuccaauuuuacugguuuuucuu

SEQ ID NO: 2801558 - RNA, 14 nt, Listeria monocytogenes EGD-e
cuccauugcccagc

SEQ ID NO: 2801559 - RNA, 22 nt, Listeria monocytogenes EGD-e
cucccaaaucgcgcaaacaguu

SEQ ID NO: 2801560 - RNA, 22 nt, Listeria monocytogenes EGD-e
cucccucauccuuucuugauuu

SEQ ID NO: 2801561 - RNA, 13 nt, Listeria monocytogenes EGD-e
cuccuuuauuuuu

SEQ ID NO: 2801562 - RNA, 20 nt, Listeria monocytogenes EGD-e
cucgaauaccagcaguuuuc

SEQ ID NO: 2801563 - RNA, 22 nt, Listeria monocytogenes EGD-e
cucgagauaaauuacugaauaa

SEQ ID NO: 2801564 - RNA, 14 nt, Listeria monocytogenes EGD-e
cucgaguauaugcu

SEQ ID NO: 2801565 - RNA, 12 nt, Listeria monocytogenes EGD-e
cucgauuuuuuu

SEQ ID NO: 2801566 - RNA, 15 nt, Listeria monocytogenes EGD-e
cucgcaaaaaauaau

SEQ ID NO: 2801567 - RNA, 17 nt, Listeria monocytogenes EGD-e
cucguauuaucaauuac

SEQ ID NO: 2801568 - RNA, 13 nt, Listeria monocytogenes EGD-e
cucgucuaaaaaa

SEQ ID NO: 2801569 - RNA, 17 nt, Listeria monocytogenes EGD-e
cucguucuuaguuaauu

SEQ ID NO: 2801570 - RNA, 19 nt, Listeria monocytogenes EGD-e
cucuauaauuuauaaaagc

SEQ ID NO: 2801571 - RNA, 20 nt, Listeria monocytogenes EGD-e
cucucuuucugccuaccaaa

SEQ ID NO: 2801572 - RNA, 21 nt, Listeria monocytogenes EGD-e
cucuuaugagaguuauaaaga

SEQ ID NO: 2801573 - RNA, 20 nt, Listeria monocytogenes EGD-e
cucuucauuuuucuagugca

SEQ ID NO: 2801574 - RNA, 15 nt, Listeria monocytogenes EGD-e
cucuuccaaaaucau

SEQ ID NO: 2801575 - RNA, 15 nt, Listeria monocytogenes EGD-e
cucuuguaaaagcga

SEQ ID NO: 2801576 - RNA, 20 nt, Listeria monocytogenes EGD-e
cucuuugcuucaaucccagc

SEQ ID NO: 2801577 - RNA, 20 nt, Listeria monocytogenes EGD-e
cucuuuggagugaggauuuu

SEQ ID NO: 2801578 - RNA, 14 nt, Listeria monocytogenes EGD-e
cuucuaagaaaaaa

SEQ ID NO: 2801579 - RNA, 18 nt, Listeria monocytogenes EGD-e
cuucuaagaaaaaaaguu

SEQ ID NO: 2801580 - RNA, 22 nt, Listeria monocytogenes EGD-e
cuucuaagaaaaaaaguuauau

SEQ ID NO: 2801581 - RNA, 20 nt, Listeria monocytogenes EGD-e
cuucuaccguuccuucaagc

SEQ ID NO: 2801582 - RNA, 13 nt, Listeria monocytogenes EGD-e
cuucuacuuuuac

SEQ ID NO: 2801583 - RNA, 16 nt, Listeria monocytogenes EGD-e
cuucuagcgucacaau

SEQ ID NO: 2801584 - RNA, 22 nt, Listeria monocytogenes EGD-e
cuucuauauuaaugucaauuau

SEQ ID NO: 2801585 - RNA, 21 nt, Listeria monocytogenes EGD-e
cuucucagcuucgauuuuuuc

SEQ ID NO: 2801586 - RNA, 21 nt, Listeria monocytogenes EGD-e
cuucugccgauuauccuguaa

SEQ ID NO: 2801587 - RNA, 15 nt, Listeria monocytogenes EGD-e
cuucuguuuuuucuu

SEQ ID NO: 2801588 - RNA, 19 nt, Listeria monocytogenes EGD-e
cuucuguuuuuucuuuguc

SEQ ID NO: 2801589 - RNA, 21 nt, Listeria monocytogenes EGD-e
cuucuucagacgcaauuucaa

SEQ ID NO: 2801590 - RNA, 22 nt, Listeria monocytogenes EGD-e
cuucuucagacgcaauuucaau

SEQ ID NO: 2801591 - RNA, 17 nt, Listeria monocytogenes EGD-e
cuucuuccauuuguucu

SEQ ID NO: 2801592 - RNA, 18 nt, Listeria monocytogenes EGD-e
cuucuugcuucacgugcu

SEQ ID NO: 2801593 - RNA, 19 nt, Listeria monocytogenes EGD-e
cuucuuuuugcuuuaaaaa

SEQ ID NO: 2801594 - RNA, 14 nt, Listeria monocytogenes EGD-e
cuucuuuuuucuuc

SEQ ID NO: 2801595 - RNA, 15 nt, Listeria monocytogenes EGD-e
cuugaauguuuucaa

SEQ ID NO: 2801596 - RNA, 19 nt, Listeria monocytogenes EGD-e
cuugacgcguggaaagaau

SEQ ID NO: 2801597 - RNA, 15 nt, Listeria monocytogenes EGD-e
cuugauuuaaauaaa

SEQ ID NO: 2801598 - RNA, 20 nt, Listeria monocytogenes EGD-e
cuugauuuaauuguaauucc

SEQ ID NO: 2801599 - RNA, 22 nt, Listeria monocytogenes EGD-e
cuugcaucaagggaagcuuuug

SEQ ID NO: 2801600 - RNA, 22 nt, Listeria monocytogenes EGD-e
cuugcccuugauuuaaauaaac

SEQ ID NO: 2801601 - RNA, 20 nt, Listeria monocytogenes EGD-e
cuugcugcucgcucaucauc

SEQ ID NO: 2801602 - RNA, 18 nt, Listeria monocytogenes EGD-e
cuugcuucacgugcugcu

SEQ ID NO: 2801603 - RNA, 19 nt, Listeria monocytogenes EGD-e
cuuggaacggcuuuauccc

SEQ ID NO: 2801604 - RNA, 13 nt, Listeria monocytogenes EGD-e
cuuggaauaaaca

SEQ ID NO: 2801605 - RNA, 23 nt, Listeria monocytogenes EGD-e
cuuggacggcgcaauuuggcucu

SEQ ID NO: 2801606 - RNA, 16 nt, Listeria monocytogenes EGD-e
cuuggauggacauaau

SEQ ID NO: 2801607 - RNA, 23 nt, Listeria monocytogenes EGD-e
cuuguaacugugcggaaaucuug

SEQ ID NO: 2801608 - RNA, 17 nt, Listeria monocytogenes EGD-e
cuuguaagaagcuuuua

SEQ ID NO: 2801609 - RNA, 15 nt, Listeria monocytogenes EGD-e
cuugucuugcaagag

SEQ ID NO: 2801610 - RNA, 17 nt, Listeria monocytogenes EGD-e
cuuguuccauuacuuua

SEQ ID NO: 2801611 - RNA, 20 nt, Listeria monocytogenes EGD-e
cuuguuuugucgauaguuca

SEQ ID NO: 2801612 - RNA, 21 nt, Listeria monocytogenes EGD-e
cuuuaaaaacaguacuucuau

SEQ ID NO: 2801613 - RNA, 15 nt, Listeria monocytogenes EGD-e
cuuuaauuuggaaau

SEQ ID NO: 2801614 - RNA, 15 nt, Listeria monocytogenes EGD-e
cuuuacauaauucau

SEQ ID NO: 2801615 - RNA, 19 nt, Listeria monocytogenes EGD-e
cuuuaccuugaucaaaauu

SEQ ID NO: 2801616 - RNA, 15 nt, Listeria monocytogenes EGD-e
cuuuagaauauggac

SEQ ID NO: 2801617 - RNA, 18 nt, Listeria monocytogenes EGD-e
cuuuaucccagaaagaau

SEQ ID NO: 2801618 - RNA, 11 nt, Listeria monocytogenes EGD-e
cuuuaucuuuc

SEQ ID NO: 2801619 - RNA, 16 nt, Listeria monocytogenes EGD-e
cuuuaucuuucccauc

SEQ ID NO: 2801620 - RNA, 21 nt, Listeria monocytogenes EGD-e
cuuucacacgauaccaaaguu

SEQ ID NO: 2801621 - RNA, 14 nt, Listeria monocytogenes EGD-e
cuuucacaucuuca

SEQ ID NO: 2801622 - RNA, 12 nt, Listeria monocytogenes EGD-e
cuuuccagcagg

SEQ ID NO: 2801623 - RNA, 16 nt, Listeria monocytogenes EGD-e
cuuucguuucagcucu

SEQ ID NO: 2801624 - RNA, 19 nt, Listeria monocytogenes EGD-e
cuuucuucggauucucuuc

SEQ ID NO: 2801625 - RNA, 13 nt, Listeria monocytogenes EGD-e
cuuucuucuacua

SEQ ID NO: 2801626 - RNA, 15 nt, Listeria monocytogenes EGD-e
cuuucuuuuguucuu

SEQ ID NO: 2801627 - RNA, 14 nt, Listeria monocytogenes EGD-e
cuuucuuuuuuaau

SEQ ID NO: 2801628 - RNA, 21 nt, Listeria monocytogenes EGD-e
cuuugaaaacugaacaaagaa

SEQ ID NO: 2801629 - RNA, 23 nt, Listeria monocytogenes EGD-e
cuuugaauuaagaaguacaauaa

SEQ ID NO: 2801630 - RNA, 14 nt, Listeria monocytogenes EGD-e
cuuugauuuuuucu

SEQ ID NO: 2801631 - RNA, 19 nt, Listeria monocytogenes EGD-e
cuuugcuaucaaccacuuu

SEQ ID NO: 2801632 - RNA, 14 nt, Listeria monocytogenes EGD-e
cuuugguaaaaaac

SEQ ID NO: 2801633 - RNA, 15 nt, Listeria monocytogenes EGD-e
cuuugucuuaaauga

SEQ ID NO: 2801634 - RNA, 16 nt, Listeria monocytogenes EGD-e
cuuuguguuaauaaaa

SEQ ID NO: 2801635 - RNA, 23 nt, Listeria monocytogenes EGD-e
cuuuuaaauuaucauucauaaug

SEQ ID NO: 2801636 - RNA, 19 nt, Listeria monocytogenes EGD-e
cuuuuacgaucuacuucua

SEQ ID NO: 2801637 - RNA, 16 nt, Listeria monocytogenes EGD-e
cuuuuacggcuucaau

SEQ ID NO: 2801638 - RNA, 16 nt, Listeria monocytogenes EGD-e
cuuuuagaaugaagau

SEQ ID NO: 2801639 - RNA, 19 nt, Listeria monocytogenes EGD-e
cuuuuauaaaaauacauuu

SEQ ID NO: 2801640 - RNA, 20 nt, Listeria monocytogenes EGD-e
cuuuuauugcacuauuuggu

SEQ ID NO: 2801641 - RNA, 14 nt, Listeria monocytogenes EGD-e
cuuuuauuuuuaaa

SEQ ID NO: 2801642 - RNA, 14 nt, Listeria monocytogenes EGD-e
cuuuuauuuuucuu

SEQ ID NO: 2801643 - RNA, 14 nt, Listeria monocytogenes EGD-e
cuuuuccaaaaugg

SEQ ID NO: 2801644 - RNA, 22 nt, Listeria monocytogenes EGD-e
cuuuugaucugugggaaucaga

SEQ ID NO: 2801645 - RNA, 13 nt, Listeria monocytogenes EGD-e
cuuuugcuucuuc

SEQ ID NO: 2801646 - RNA, 18 nt, Listeria monocytogenes EGD-e
cuuuugguuuaauuuccu

SEQ ID NO: 2801647 - RNA, 19 nt, Listeria monocytogenes EGD-e
cuuuuucaaguaaaaacaa

SEQ ID NO: 2801648 - RNA, 22 nt, Listeria monocytogenes EGD-e
cuuuuucgauuaauauacuuua

SEQ ID NO: 2801649 - RNA, 17 nt, Listeria monocytogenes EGD-e
cuuuuugauuaaugauu

SEQ ID NO: 2801650 - RNA, 23 nt, Listeria monocytogenes EGD-e
cuuuuugauuaggcauuucuuug

SEQ ID NO: 2801651 - RNA, 13 nt, Listeria monocytogenes EGD-e
cuuuuugcuggcu

SEQ ID NO: 2801652 - RNA, 14 nt, Listeria monocytogenes EGD-e
cuuuuugcuuuaaa

SEQ ID NO: 2801653 - RNA, 11 nt, Listeria monocytogenes EGD-e
cuuuuuuccuu

SEQ ID NO: 2801654 - RNA, 12 nt, Listeria monocytogenes EGD-e
cuuuuuuuaaac

SEQ ID NO: 2801655 - RNA, 23 nt, Listeria monocytogenes EGD-e
cuuuuuuuacauuuuugcuugcc

SEQ ID NO: 2801656 - RNA, 18 nt, Listeria monocytogenes EGD-e
cuuuuuuuaguaaacauu

SEQ ID NO: 2801657 - RNA, 16 nt, Listeria monocytogenes EGD-e
cuuuuuuuauuuugcg

SEQ ID NO: 2801658 - RNA, 23 nt, Listeria monocytogenes EGD-e
gaaaaaccgagaaaucucaugaa

SEQ ID NO: 2801659 - RNA, 20 nt, Listeria monocytogenes EGD-e
gaaaaagugaccuuugaaaa

SEQ ID NO: 2801660 - RNA, 22 nt, Listeria monocytogenes EGD-e
gaaaaaguuguuucuaauccag

SEQ ID NO: 2801661 - RNA, 17 nt, Listeria monocytogenes EGD-e
gaaaaaguuucaauuuc

SEQ ID NO: 2801662 - RNA, 21 nt, Listeria monocytogenes EGD-e
gaaaaauaaucacguuuuugc

SEQ ID NO: 2801663 - RNA, 24 nt, Listeria monocytogenes EGD-e
gaaaaaugauucuaguuuguccca

SEQ ID NO: 2801664 - RNA, 15 nt, Listeria monocytogenes EGD-e
gaaaaauguuugcau

SEQ ID NO: 2801665 - RNA, 16 nt, Listeria monocytogenes EGD-e
gaaaaauuucaucguu

SEQ ID NO: 2801666 - RNA, 14 nt, Listeria monocytogenes EGD-e
gaaaacugaacaaa

SEQ ID NO: 2801667 - RNA, 18 nt, Listeria monocytogenes EGD-e
gaaaacugaacaaagaag

SEQ ID NO: 2801668 - RNA, 17 nt, Listeria monocytogenes EGD-e
gaaaaguaguguauaac

SEQ ID NO: 2801669 - RNA, 19 nt, Listeria monocytogenes EGD-e
gaaaaucgaggaaguugca

SEQ ID NO: 2801670 - RNA, 13 nt, Listeria monocytogenes EGD-e
gaaaaugagccca

SEQ ID NO: 2801671 - RNA, 20 nt, Listeria monocytogenes EGD-e
gaaaauuggauuauucaauu

SEQ ID NO: 2801672 - RNA, 18 nt, Listeria monocytogenes EGD-e
gaaacauagucagggaau

SEQ ID NO: 2801673 - RNA, 16 nt, Listeria monocytogenes EGD-e
gaaaccaucgcaaaag

SEQ ID NO: 2801674 - RNA, 19 nt, Listeria monocytogenes EGD-e
gaaaccauuccguugaaag

SEQ ID NO: 2801675 - RNA, 18 nt, Listeria monocytogenes EGD-e
gaaacgacauccuucagc

SEQ ID NO: 2801676 - RNA, 15 nt, Listeria monocytogenes EGD-e
gaaacuuguuuuugu

SEQ ID NO: 2801677 - RNA, 17 nt, Listeria monocytogenes EGD-e
gaaacuuucuuuucuug

SEQ ID NO: 2801678 - RNA, 16 nt, Listeria monocytogenes EGD-e
gaaagaauaaaacaaa

SEQ ID NO: 2801679 - RNA, 11 nt, Listeria monocytogenes EGD-e
gauucaaagcu

SEQ ID NO: 2801680 - RNA, 14 nt, Listeria monocytogenes EGD-e
gauucauaaacaaa

SEQ ID NO: 2801681 - RNA, 19 nt, Listeria monocytogenes EGD-e
gauucccacagaucaaaag

SEQ ID NO: 2801682 - RNA, 22 nt, Listeria monocytogenes EGD-e
gauucgucuuagaaaaauguuu

SEQ ID NO: 2801683 - RNA, 23 nt, Listeria monocytogenes EGD-e
gauucgucuuagaaaaauguuug

SEQ ID NO: 2801684 - RNA, 21 nt, Listeria monocytogenes EGD-e
gauucuaguuugucccaagau

SEQ ID NO: 2801685 - RNA, 20 nt, Listeria monocytogenes EGD-e
gauucucuucuaacaauuua

SEQ ID NO: 2801686 - RNA, 14 nt, Listeria monocytogenes EGD-e
gauugcgucacaau

SEQ ID NO: 2801687 - RNA, 21 nt, Listeria monocytogenes EGD-e
gauugcuucaccaagaagagc

SEQ ID NO: 2801688 - RNA, 21 nt, Listeria monocytogenes EGD-e
gauuggaucuuccaucauaau

SEQ ID NO: 2801689 - RNA, 15 nt, Listeria monocytogenes EGD-e
gauuguucuuuaaaa

SEQ ID NO: 2801690 - RNA, 9 nt, Listeria monocytogenes EGD-e
gauuuaaau

SEQ ID NO: 2801691 - RNA, 17 nt, Listeria monocytogenes EGD-e
gauuuaaauaaacaaau

SEQ ID NO: 2801692 - RNA, 14 nt, Listeria monocytogenes EGD-e
gauuucugcagaau

SEQ ID NO: 2801693 - RNA, 20 nt, Listeria monocytogenes EGD-e
gauuuuauuuuuauuauaaa

SEQ ID NO: 2801694 - RNA, 14 nt, Listeria monocytogenes EGD-e
gauuuuguacauaa

SEQ ID NO: 2801695 - RNA, 21 nt, Listeria monocytogenes EGD-e
gauuuuuauuccguucauuug

SEQ ID NO: 2801696 - RNA, 16 nt, Listeria monocytogenes EGD-e
gcaaaaaauaauaucu

SEQ ID NO: 2801697 - RNA, 17 nt, Listeria monocytogenes EGD-e
gcaaauaacguugcauu

SEQ ID NO: 2801698 - RNA, 21 nt, Listeria monocytogenes EGD-e
gcaaaucuuucggcacacuuu

SEQ ID NO: 2801699 - RNA, 15 nt, Listeria monocytogenes EGD-e
gcaacaguuauuaaa

SEQ ID NO: 2801700 - RNA, 22 nt, Listeria monocytogenes EGD-e
gcaacauucaaaucaccacaaa

SEQ ID NO: 2801701 - RNA, 22 nt, Listeria monocytogenes EGD-e
gcaaguagcuuaggcuacuugc

SEQ ID NO: 2801702 - RNA, 22 nt, Listeria monocytogenes EGD-e
gcaaucaauuuacguuguucua

SEQ ID NO: 2801703 - RNA, 19 nt, Listeria monocytogenes EGD-e
gcaauuucggaagauccgc

SEQ ID NO: 2801704 - RNA, 15 nt, Listeria monocytogenes EGD-e
gcaauuuuaaaucuu

SEQ ID NO: 2801705 - RNA, 14 nt, Listeria monocytogenes EGD-e
gcacaaaaugcaaa

SEQ ID NO: 2801706 - RNA, 16 nt, Listeria monocytogenes EGD-e
gcacaaauuauuagaa

SEQ ID NO: 2801707 - RNA, 17 nt, Listeria monocytogenes EGD-e
gcacaaauuauuagaau

SEQ ID NO: 2801708 - RNA, 21 nt, Listeria monocytogenes EGD-e
gcacaaguaauauuauaucca

SEQ ID NO: 2801709 - RNA, 16 nt, Listeria monocytogenes EGD-e
gcacagcaauggccgg

SEQ ID NO: 2801710 - RNA, 21 nt, Listeria monocytogenes EGD-e
gcacagcuaccacaagaaggg

SEQ ID NO: 2801711 - RNA, 19 nt, Listeria monocytogenes EGD-e
gcacaugauaaccagaaac

SEQ ID NO: 2801712 - RNA, 20 nt, Listeria monocytogenes EGD-e
gcaccaaagacgcuuuuuuc

SEQ ID NO: 2801713 - RNA, 18 nt, Listeria monocytogenes EGD-e
gcacuagaaaaaugaaga

SEQ ID NO: 2801714 - RNA, 19 nt, Listeria monocytogenes EGD-e
gcacuagaaaaaugaagag

SEQ ID NO: 2801715 - RNA, 15 nt, Listeria monocytogenes EGD-e
gcacuggcaaauaac

SEQ ID NO: 2801716 - RNA, 20 nt, Listeria monocytogenes EGD-e
gcacuuuuauugcacuauuu

SEQ ID NO: 2801717 - RNA, 13 nt, Listeria monocytogenes EGD-e
gcagaaacaauca

SEQ ID NO: 2801718 - RNA, 19 nt, Listeria monocytogenes EGD-e
gcagauuuugcgaaagcug

SEQ ID NO: 2801719 - RNA, 15 nt, Listeria monocytogenes EGD-e
gcagcgacaauuaug

SEQ ID NO: 2801720 - RNA, 18 nt, Listeria monocytogenes EGD-e
gcagcuuuuguccaaccu

SEQ ID NO: 2801721 - RNA, 15 nt, Listeria monocytogenes EGD-e
gcaguccaccagcua

SEQ ID NO: 2801722 - RNA, 12 nt, Listeria monocytogenes EGD-e
gcauagaaagua

SEQ ID NO: 2801723 - RNA, 20 nt, Listeria monocytogenes EGD-e
gcauccaagcggguuuucuc

SEQ ID NO: 2801724 - RNA, 19 nt, Listeria monocytogenes EGD-e
gcaucccaacucucuucag

SEQ ID NO: 2801725 - RNA, 17 nt, Listeria monocytogenes EGD-e
gcaucccauaaaaccgc

SEQ ID NO: 2801726 - RNA, 13 nt, Listeria monocytogenes EGD-e
gcaucuaguagca

SEQ ID NO: 2801727 - RNA, 18 nt, Listeria monocytogenes EGD-e
gcaucuucguauauuuua

SEQ ID NO: 2801728 - RNA, 21 nt, Listeria monocytogenes EGD-e
gcaucuucuaagaaaaaaagu

SEQ ID NO: 2801729 - RNA, 13 nt, Listeria monocytogenes EGD-e
gcaugaauuuuug

SEQ ID NO: 2801730 - RNA, 21 nt, Listeria monocytogenes EGD-e
gcaugccuggcguaucaauaa

SEQ ID NO: 2801731 - RNA, 21 nt, Listeria monocytogenes EGD-e
gcauuaaaaaggaauuuuucc

SEQ ID NO: 2801732 - RNA, 17 nt, Listeria monocytogenes EGD-e
gcauucugugauggaag

SEQ ID NO: 2801733 - RNA, 14 nt, Listeria monocytogenes EGD-e
gcauugauuuuuga

SEQ ID NO: 2801734 - RNA, 22 nt, Listeria monocytogenes EGD-e
gcauuucacaccacucuuuuau

SEQ ID NO: 2801735 - RNA, 20 nt, Listeria monocytogenes EGD-e
gcauuucauaaucaaauaca

SEQ ID NO: 2801736 - RNA, 14 nt, Listeria monocytogenes EGD-e
gcauuuuuucuuug

SEQ ID NO: 2801737 - RNA, 22 nt, Listeria monocytogenes EGD-e
gccaacugaagcgaugauuuuc

SEQ ID NO: 2801738 - RNA, 16 nt, Listeria monocytogenes EGD-e
gccaagauuaaaaaua

SEQ ID NO: 2801739 - RNA, 13 nt, Listeria monocytogenes EGD-e
gccaauuaaaaua

SEQ ID NO: 2801740 - RNA, 15 nt, Listeria monocytogenes EGD-e
gccaauucuuccaca

SEQ ID NO: 2801741 - RNA, 14 nt, Listeria monocytogenes EGD-e
gccaccuucaauuu

SEQ ID NO: 2801742 - RNA, 14 nt, Listeria monocytogenes EGD-e
gccaucgcagcaga

SEQ ID NO: 2801743 - RNA, 16 nt, Listeria monocytogenes EGD-e
gcccauuaaaaagcuu

SEQ ID NO: 2801744 - RNA, 19 nt, Listeria monocytogenes EGD-e
gcccuugauuuaaauaaac

SEQ ID NO: 2801745 - RNA, 15 nt, Listeria monocytogenes EGD-e
gccgacuaguucugc

SEQ ID NO: 2801746 - RNA, 13 nt, Listeria monocytogenes EGD-e
gccgccgucucca

SEQ ID NO: 2801747 - RNA, 17 nt, Listeria monocytogenes EGD-e
gccgccuauuauuucug

SEQ ID NO: 2801748 - RNA, 15 nt, Listeria monocytogenes EGD-e
gccggaccugaaaga

SEQ ID NO: 2801749 - RNA, 17 nt, Listeria monocytogenes EGD-e
gccguccaauucuuucg

SEQ ID NO: 2801750 - RNA, 15 nt, Listeria monocytogenes EGD-e
gccgugauaaauaac

SEQ ID NO: 2801751 - RNA, 21 nt, Listeria monocytogenes EGD-e
gccuucaaacacuucuaaaac

SEQ ID NO: 2801752 - RNA, 17 nt, Listeria monocytogenes EGD-e
gccuuucuuuuuuaaua

SEQ ID NO: 2801753 - RNA, 19 nt, Listeria monocytogenes EGD-e
gcgacuuuugcagcuggaa

SEQ ID NO: 2801754 - RNA, 16 nt, Listeria monocytogenes EGD-e
gcgauuuuuucuucca

SEQ ID NO: 2801755 - RNA, 13 nt, Listeria monocytogenes EGD-e
gcgcaaacaguua

SEQ ID NO: 2801756 - RNA, 12 nt, Listeria monocytogenes EGD-e
gcgcagaaaguu

SEQ ID NO: 2801757 - RNA, 16 nt, Listeria monocytogenes EGD-e
gcgcauacgaguucua

SEQ ID NO: 2801758 - RNA, 20 nt, Listeria monocytogenes EGD-e
gcgcaucguugugcuuuccc

SEQ ID NO: 2801759 - RNA, 13 nt, Listeria monocytogenes EGD-e
gcgccagcuucac

SEQ ID NO: 2801760 - RNA, 19 nt, Listeria monocytogenes EGD-e
gcgccauuugccaucgcag

SEQ ID NO: 2801761 - RNA, 21 nt, Listeria monocytogenes EGD-e
gcgccauuugccaucgcagca

SEQ ID NO: 2801762 - RNA, 18 nt, Listeria monocytogenes EGD-e
gcgcuuucacaucuucaa

SEQ ID NO: 2801763 - RNA, 16 nt, Listeria monocytogenes EGD-e
gcggaaauaucaccau

SEQ ID NO: 2801764 - RNA, 14 nt, Listeria monocytogenes EGD-e
gcggauaauaauca

SEQ ID NO: 2801765 - RNA, 18 nt, Listeria monocytogenes EGD-e
gcggcauuucaaucgcag

SEQ ID NO: 2801766 - RNA, 20 nt, Listeria monocytogenes EGD-e
gcggcauuucaaucgcagca

SEQ ID NO: 2801767 - RNA, 16 nt, Listeria monocytogenes EGD-e
gcgguagccugcucgc

SEQ ID NO: 2801768 - RNA, 21 nt, Listeria monocytogenes EGD-e
gcgguuucuuuuauuuuucuu

SEQ ID NO: 2801769 - RNA, 20 nt, Listeria monocytogenes EGD-e
gcguaagauuuuugcucagu

SEQ ID NO: 2801770 - RNA, 12 nt, Listeria monocytogenes EGD-e
gcguaucuuuuc

SEQ ID NO: 2801771 - RNA, 19 nt, Listeria monocytogenes EGD-e
gcguuccacccauguuuuc

SEQ ID NO: 2801772 - RNA, 18 nt, Listeria monocytogenes EGD-e
gcuaaaacuaaaacgaca

SEQ ID NO: 2801773 - RNA, 15 nt, Listeria monocytogenes EGD-e
gcuaaaggcaacaaa

SEQ ID NO: 2801774 - RNA, 17 nt, Listeria monocytogenes EGD-e
gcuaaaggcaacaaaga

SEQ ID NO: 2801775 - RNA, 14 nt, Listeria monocytogenes EGD-e
gcuaaauauuuaau

SEQ ID NO: 2801776 - RNA, 18 nt, Listeria monocytogenes EGD-e
gcuaacaacaagcaaaac

SEQ ID NO: 2801777 - RNA, 15 nt, Listeria monocytogenes EGD-e
gcuaaucguuuuaaa

SEQ ID NO: 2801778 - RNA, 16 nt, Listeria monocytogenes EGD-e
gcuacaauuaaaauag

SEQ ID NO: 2801779 - RNA, 23 nt, Listeria monocytogenes EGD-e
gcuacacccauaauauuauaguu

SEQ ID NO: 2801780 - RNA, 22 nt, Listeria monocytogenes EGD-e
ggucauuuucacugcauaaaaa

SEQ ID NO: 2801781 - RNA, 17 nt, Listeria monocytogenes EGD-e
gguccugcugaaauagc

SEQ ID NO: 2801782 - RNA, 18 nt, Listeria monocytogenes EGD-e
ggucugugauuacuccaa

SEQ ID NO: 2801783 - RNA, 19 nt, Listeria monocytogenes EGD-e
ggugaaugccagccauuuu

SEQ ID NO: 2801784 - RNA, 12 nt, Listeria monocytogenes EGD-e
ggugagcuucuu

SEQ ID NO: 2801785 - RNA, 17 nt, Listeria monocytogenes EGD-e
ggugcugggaaaucagg

SEQ ID NO: 2801786 - RNA, 18 nt, Listeria monocytogenes EGD-e
gguguuuauucauauaaa

SEQ ID NO: 2801787 - RNA, 11 nt, Listeria monocytogenes EGD-e
gguuauuucuu

SEQ ID NO: 2801788 - RNA, 23 nt, Listeria monocytogenes EGD-e
gguucuuuacauauuccaaaauc

SEQ ID NO: 2801789 - RNA, 22 nt, Listeria monocytogenes EGD-e
gguuuaauaggaaggagcagaa

SEQ ID NO: 2801790 - RNA, 17 nt, Listeria monocytogenes EGD-e
gguuuggaaaacauaga

SEQ ID NO: 2801791 - RNA, 15 nt, Listeria monocytogenes EGD-e
gguuuuguccaaacc

SEQ ID NO: 2801792 - RNA, 12 nt, Listeria monocytogenes EGD-e
guaaaaaacugu

SEQ ID NO: 2801793 - RNA, 12 nt, Listeria monocytogenes EGD-e
guaaaauacguu

SEQ ID NO: 2801794 - RNA, 14 nt, Listeria monocytogenes EGD-e
guaaaaucuuuuaa

SEQ ID NO: 2801795 - RNA, 16 nt, Listeria monocytogenes EGD-e
guaaaaucuuuuaaua

SEQ ID NO: 2801796 - RNA, 20 nt, Listeria monocytogenes EGD-e
guaaacuugcaucuucuguu

SEQ ID NO: 2801797 - RNA, 17 nt, Listeria monocytogenes EGD-e
guaaauaggauuaaaau

SEQ ID NO: 2801798 - RNA, 23 nt, Listeria monocytogenes EGD-e
guaacauagcuacaauuaaaaua

SEQ ID NO: 2801799 - RNA, 19 nt, Listeria monocytogenes EGD-e
guaacaucuuccacuccag

SEQ ID NO: 2801800 - RNA, 12 nt, Listeria monocytogenes EGD-e
guaacucuucca

SEQ ID NO: 2801801 - RNA, 12 nt, Listeria monocytogenes EGD-e
guaagaagaaaa

SEQ ID NO: 2801802 - RNA, 23 nt, Listeria monocytogenes EGD-e
guaagaagcuuuuacgaucuacu

SEQ ID NO: 2801803 - RNA, 16 nt, Listeria monocytogenes EGD-e
guaaggcauguaucuu

SEQ ID NO: 2801804 - RNA, 15 nt, Listeria monocytogenes EGD-e
guaaguagcauuuuc

SEQ ID NO: 2801805 - RNA, 14 nt, Listeria monocytogenes EGD-e
guaauaaaugguug

SEQ ID NO: 2801806 - RNA, 11 nt, Listeria monocytogenes EGD-e
guaauaagaag

SEQ ID NO: 2801807 - RNA, 17 nt, Listeria monocytogenes EGD-e
guaauaagucaaugaua

SEQ ID NO: 2801808 - RNA, 16 nt, Listeria monocytogenes EGD-e
guaauauaaauuugcc

SEQ ID NO: 2801809 - RNA, 17 nt, Listeria monocytogenes EGD-e
guaaucuguaaaaauaa

SEQ ID NO: 2801810 - RNA, 15 nt, Listeria monocytogenes EGD-e
guaauucgaauaaga

SEQ ID NO: 2801811 - RNA, 17 nt, Listeria monocytogenes EGD-e
guaauucgaauaagaac

SEQ ID NO: 2801812 - RNA, 16 nt, Listeria monocytogenes EGD-e
guacaguagaagcaau

SEQ ID NO: 2801813 - RNA, 14 nt, Listeria monocytogenes EGD-e
guacauaaaagcau

SEQ ID NO: 2801814 - RNA, 16 nt, Listeria monocytogenes EGD-e
guacauaguuauaaau

SEQ ID NO: 2801815 - RNA, 15 nt, Listeria monocytogenes EGD-e
guaccaucuuuuauc

SEQ ID NO: 2801816 - RNA, 15 nt, Listeria monocytogenes EGD-e
guacccguaauauau

SEQ ID NO: 2801817 - RNA, 19 nt, Listeria monocytogenes EGD-e
guacccguaauauauucaa

SEQ ID NO: 2801818 - RNA, 19 nt, Listeria monocytogenes EGD-e
guaccgcuugauguuuuug

SEQ ID NO: 2801819 - RNA, 16 nt, Listeria monocytogenes EGD-e
guaccugcaagcgaau

SEQ ID NO: 2801820 - RNA, 23 nt, Listeria monocytogenes EGD-e
guaccugcaagcgaauuaauaaa

SEQ ID NO: 2801821 - RNA, 18 nt, Listeria monocytogenes EGD-e
guacguuuuuuauuuuuu

SEQ ID NO: 2801822 - RNA, 15 nt, Listeria monocytogenes EGD-e
guacuaauucugcga

SEQ ID NO: 2801823 - RNA, 20 nt, Listeria monocytogenes EGD-e
guacuuaaaucacuucuuaa

SEQ ID NO: 2801824 - RNA, 19 nt, Listeria monocytogenes EGD-e
guacuugaaaaauuucauc

SEQ ID NO: 2801825 - RNA, 21 nt, Listeria monocytogenes EGD-e
guacuuucgucgccuaauugu

SEQ ID NO: 2801826 - RNA, 12 nt, Listeria monocytogenes EGD-e
guagagcuucug

SEQ ID NO: 2801827 - RNA, 14 nt, Listeria monocytogenes EGD-e
guagcuucaaucaa

SEQ ID NO: 2801828 - RNA, 21 nt, Listeria monocytogenes EGD-e
guaguaagggugaagcuuccu

SEQ ID NO: 2801829 - RNA, 19 nt, Listeria monocytogenes EGD-e
guauacccuuuuuuuacau

SEQ ID NO: 2801830 - RNA, 19 nt, Listeria monocytogenes EGD-e
guauacuuuuaauuaaaag

SEQ ID NO: 2801831 - RNA, 18 nt, Listeria monocytogenes EGD-e
guauccacauaacggaaa

SEQ ID NO: 2801832 - RNA, 17 nt, Listeria monocytogenes EGD-e
guaucccucauguucaa

SEQ ID NO: 2801833 - RNA, 11 nt, Listeria monocytogenes EGD-e
guaucuuaucc

SEQ ID NO: 2801834 - RNA, 11 nt, Listeria monocytogenes EGD-e
guauuccucaa

SEQ ID NO: 2801835 - RNA, 15 nt, Listeria monocytogenes EGD-e
guauuggguuugaua

SEQ ID NO: 2801836 - RNA, 19 nt, Listeria monocytogenes EGD-e
guauuguuuuuugauuuuu

SEQ ID NO: 2801837 - RNA, 16 nt, Listeria monocytogenes EGD-e
guauuuauauucuucu

SEQ ID NO: 2801838 - RNA, 12 nt, Listeria monocytogenes EGD-e
guauuucagcaa

SEQ ID NO: 2801839 - RNA, 22 nt, Listeria monocytogenes EGD-e
gucaacaucauuagauuugcaa

SEQ ID NO: 2801840 - RNA, 13 nt, Listeria monocytogenes EGD-e
gucaagcccagcu

SEQ ID NO: 2801841 - RNA, 18 nt, Listeria monocytogenes EGD-e
gucaaugcccaguaaaac

SEQ ID NO: 2801842 - RNA, 13 nt, Listeria monocytogenes EGD-e
gucaauguauaca

SEQ ID NO: 2801843 - RNA, 19 nt, Listeria monocytogenes EGD-e
gucacaaacgcuuuuucaa

SEQ ID NO: 2801844 - RNA, 15 nt, Listeria monocytogenes EGD-e
gucacgucccauugc

SEQ ID NO: 2801845 - RNA, 17 nt, Listeria monocytogenes EGD-e
gucauaaaacuuucaca

SEQ ID NO: 2801846 - RNA, 20 nt, Listeria monocytogenes EGD-e
gucaucggcuuuuuuuauuu

SEQ ID NO: 2801847 - RNA, 14 nt, Listeria monocytogenes EGD-e
guccaaccuaaauc

SEQ ID NO: 2801848 - RNA, 16 nt, Listeria monocytogenes EGD-e
gucccaagauucuucu

SEQ ID NO: 2801849 - RNA, 13 nt, Listeria monocytogenes EGD-e
guccgucaagccc

SEQ ID NO: 2801850 - RNA, 15 nt, Listeria monocytogenes EGD-e
guccgucaagcccag

SEQ ID NO: 2801851 - RNA, 12 nt, Listeria monocytogenes EGD-e
gucuaagaaauc

SEQ ID NO: 2801852 - RNA, 23 nt, Listeria monocytogenes EGD-e
gucuacuuuugacgaagcguguu

SEQ ID NO: 2801853 - RNA, 14 nt, Listeria monocytogenes EGD-e
gucuagguuuucuu

SEQ ID NO: 2801854 - RNA, 13 nt, Listeria monocytogenes EGD-e
gucugcuuuuuca

SEQ ID NO: 2801855 - RNA, 19 nt, Listeria monocytogenes EGD-e
gucuggcauauuugccaga

SEQ ID NO: 2801856 - RNA, 19 nt, Listeria monocytogenes EGD-e
gucuuuuuguaaaggauaa

SEQ ID NO: 2801857 - RNA, 22 nt, Listeria monocytogenes EGD-e
gucuuuuuguguaaguguuucu

SEQ ID NO: 2801858 - RNA, 21 nt, Listeria monocytogenes EGD-e
gugaaaauuggauuauucaau

SEQ ID NO: 2801859 - RNA, 18 nt, Listeria monocytogenes EGD-e
gugaaugccagccauuuu

SEQ ID NO: 2801860 - RNA, 22 nt, Listeria monocytogenes EGD-e
gugaaugccagccauuuuggaa

SEQ ID NO: 2801861 - RNA, 21 nt, Listeria monocytogenes EGD-e
gugacgaaucaagauuuugcu

SEQ ID NO: 2801862 - RNA, 18 nt, Listeria monocytogenes EGD-e
gugagaacgacaaauggu

SEQ ID NO: 2801863 - RNA, 18 nt, Listeria monocytogenes EGD-e
gugaugaaaccaaauaug

SEQ ID NO: 2801864 - RNA, 17 nt, Listeria monocytogenes EGD-e
gugcaccugcauuucau

SEQ ID NO: 2801865 - RNA, 22 nt, Listeria monocytogenes EGD-e
gugcaccugcauuucauuuuaa

SEQ ID NO: 2801866 - RNA, 15 nt, Listeria monocytogenes EGD-e
gugcaucuucuaaga

SEQ ID NO: 2801867 - RNA, 21 nt, Listeria monocytogenes EGD-e
gugccccgcugauauccauug

SEQ ID NO: 2801868 - RNA, 13 nt, Listeria monocytogenes EGD-e
gugcucuuugcuu

SEQ ID NO: 2801869 - RNA, 15 nt, Listeria monocytogenes EGD-e
gugcugcuuuccuug

SEQ ID NO: 2801870 - RNA, 22 nt, Listeria monocytogenes EGD-e
gugcuuuccccaccaggcaaaa

SEQ ID NO: 2801871 - RNA, 18 nt, Listeria monocytogenes EGD-e
gugguaagccauuucucg

SEQ ID NO: 2801872 - RNA, 14 nt, Listeria monocytogenes EGD-e
guguccaaaaacca

SEQ ID NO: 2801873 - RNA, 18 nt, Listeria monocytogenes EGD-e
gugucccuugauaugcag

SEQ ID NO: 2801874 - RNA, 20 nt, Listeria monocytogenes EGD-e
guuaaacaaacacaaaaugc

SEQ ID NO: 2801875 - RNA, 17 nt, Listeria monocytogenes EGD-e
guuaaacuaauaaaaac

SEQ ID NO: 2801876 - RNA, 14 nt, Listeria monocytogenes EGD-e
guuaauaaaaucau

SEQ ID NO: 2801877 - RNA, 16 nt, Listeria monocytogenes EGD-e
guuaauagaagccaau

SEQ ID NO: 2801878 - RNA, 16 nt, Listeria monocytogenes EGD-e
guuaaucugauuaaaa

SEQ ID NO: 2801879 - RNA, 12 nt, Listeria monocytogenes EGD-e
guuaauucuguu

SEQ ID NO: 2801880 - RNA, 18 nt, Listeria monocytogenes EGD-e
guuaauuuccauuucgau

SEQ ID NO: 2801881 - RNA, 21 nt, Listeria monocytogenes EGD-e
guuacuccuccaaauuauaau

SEQ ID NO: 2801882 - RNA, 16 nt, Listeria monocytogenes EGD-e
guuauaaagaaauaac

SEQ ID NO: 2801883 - RNA, 21 nt, Listeria monocytogenes EGD-e
guuauaaagaaauaacuacua

SEQ ID NO: 2801884 - RNA, 20 nt, Listeria monocytogenes EGD-e
guuauguaauucuaaauaaa

SEQ ID NO: 2801885 - RNA, 14 nt, Listeria monocytogenes EGD-e
guuauuaaaaggac

SEQ ID NO: 2801886 - RNA, 15 nt, Listeria monocytogenes EGD-e
guuauuucuuuaucu

SEQ ID NO: 2801887 - RNA, 14 nt, Listeria monocytogenes EGD-e
guucaagugauaca

SEQ ID NO: 2801888 - RNA, 13 nt, Listeria monocytogenes EGD-e
guucacuaaguuu

SEQ ID NO: 2801889 - RNA, 15 nt, Listeria monocytogenes EGD-e
guucauuugaaaaag

SEQ ID NO: 2801890 - RNA, 17 nt, Listeria monocytogenes EGD-e
guucauuugaaaaaggg

SEQ ID NO: 2801891 - RNA, 18 nt, Listeria monocytogenes EGD-e
guucauuugaaaaagggc

SEQ ID NO: 2801892 - RNA, 22 nt, Listeria monocytogenes EGD-e
guuccaaucggggaaauaguuu

SEQ ID NO: 2801893 - RNA, 19 nt, Listeria monocytogenes EGD-e
guuccagcuguaucaauga

SEQ ID NO: 2801894 - RNA, 18 nt, Listeria monocytogenes EGD-e
guuccaguuaaacaaaca

SEQ ID NO: 2801895 - RNA, 15 nt, Listeria monocytogenes EGD-e
guuccauuaaaucau

SEQ ID NO: 2801896 - RNA, 16 nt, Listeria monocytogenes EGD-e
guuccauuacuuuaau

SEQ ID NO: 2801897 - RNA, 17 nt, Listeria monocytogenes EGD-e
guuccuucaagcauuuc

SEQ ID NO: 2801898 - RNA, 22 nt, Listeria monocytogenes EGD-e
guucgcauugauuuuugaauaa

SEQ ID NO: 2801899 - RNA, 12 nt, Listeria monocytogenes EGD-e
guucuaaaauau

SEQ ID NO: 2801900 - RNA, 19 nt, Listeria monocytogenes EGD-e
guucuaaugauagaagaac

SEQ ID NO: 2801901 - RNA, 22 nt, Listeria monocytogenes EGD-e
guucugguaauaagucaaugau

SEQ ID NO: 2801902 - RNA, 17 nt, Listeria monocytogenes EGD-e
guucuuuaucgccaaag

SEQ ID NO: 2801903 - RNA, 19 nt, Listeria monocytogenes EGD-e
guugaaaggaaauaauucc

SEQ ID NO: 2801904 - RNA, 15 nt, Listeria monocytogenes EGD-e
guugaacuucucucc

SEQ ID NO: 2801905 - RNA, 23 nt, Listeria monocytogenes EGD-e
guugcauuaaaaaggaauuuuuc

SEQ ID NO: 2801906 - RNA, 14 nt, Listeria monocytogenes EGD-e
guugcauuuggaga

SEQ ID NO: 2801907 - RNA, 21 nt, Listeria monocytogenes EGD-e
guugcccaucuuuuuucucaa

SEQ ID NO: 2801908 - RNA, 22 nt, Listeria monocytogenes EGD-e
guugcgguuucuuuuauuuuuc

SEQ ID NO: 2801909 - RNA, 21 nt, Listeria monocytogenes EGD-e
guugcuaguugcauaccuaaa

SEQ ID NO: 2801910 - RNA, 19 nt, Listeria monocytogenes EGD-e
guugcugggaauauccuug

SEQ ID NO: 2801911 - RNA, 17 nt, Listeria monocytogenes EGD-e
guugcuuuuauuuuuaa

SEQ ID NO: 2801912 - RNA, 12 nt, Listeria monocytogenes EGD-e
guugcuuuuguu

SEQ ID NO: 2801913 - RNA, 20 nt, Listeria monocytogenes EGD-e
guuggaauaccauuguagcu

SEQ ID NO: 2801914 - RNA, 20 nt, Listeria monocytogenes EGD-e
guuguaaaugcgacauacuu

SEQ ID NO: 2801915 - RNA, 16 nt, Listeria monocytogenes EGD-e
guuguuccauuuuguc

SEQ ID NO: 2801916 - RNA, 18 nt, Listeria monocytogenes EGD-e
guuguuccauuuugucaa

SEQ ID NO: 2801917 - RNA, 18 nt, Listeria monocytogenes EGD-e
guuguuuucccagaaaaa

SEQ ID NO: 2801918 - RNA, 14 nt, Listeria monocytogenes EGD-e
guuuaauaugcauu

SEQ ID NO: 2801919 - RNA, 23 nt, Listeria monocytogenes EGD-e
guuucaaagcaucagcuuuugcu

SEQ ID NO: 2801920 - RNA, 18 nt, Listeria monocytogenes EGD-e
guuucauauauguaguuu

SEQ ID NO: 2801921 - RNA, 18 nt, Listeria monocytogenes EGD-e
guuucauuucaucuuuuu

SEQ ID NO: 2801922 - RNA, 16 nt, Listeria monocytogenes EGD-e
guuucauuuuuccaag

SEQ ID NO: 2801923 - RNA, 15 nt, Listeria monocytogenes EGD-e
guuucuaauccagcu

SEQ ID NO: 2801924 - RNA, 22 nt, Listeria monocytogenes EGD-e
guuucuuuuauuuuucuuucuu

SEQ ID NO: 2801925 - RNA, 12 nt, Listeria monocytogenes EGD-e
guuucuuuuguu

SEQ ID NO: 2801926 - RNA, 13 nt, Listeria monocytogenes EGD-e
guuucuuuuugcu

SEQ ID NO: 2801927 - RNA, 22 nt, Listeria monocytogenes EGD-e
guuugacccgcuaagaagaguc

SEQ ID NO: 2801928 - RNA, 17 nt, Listeria monocytogenes EGD-e
guuuguuaacuaacaaa

SEQ ID NO: 2801929 - RNA, 23 nt, Listeria monocytogenes EGD-e
guuuuagauaaguuaaucauuaa

SEQ ID NO: 2801930 - RNA, 16 nt, Listeria monocytogenes EGD-e
guuuucaacaaaacaa

SEQ ID NO: 2801931 - RNA, 13 nt, Listeria monocytogenes EGD-e
guuuucaacgugu

SEQ ID NO: 2801932 - RNA, 16 nt, Listeria monocytogenes EGD-e
guuuucauauaagugu

SEQ ID NO: 2801933 - RNA, 16 nt, Listeria monocytogenes EGD-e
guuuucccagaaaaaa

SEQ ID NO: 2801934 - RNA, 13 nt, Listeria monocytogenes EGD-e
guuuuccuuuguc

SEQ ID NO: 2801935 - RNA, 20 nt, Listeria monocytogenes EGD-e
guuuucgauauuuuuuuguu

SEQ ID NO: 2801936 - RNA, 12 nt, Listeria monocytogenes EGD-e
guuuucuacugu

SEQ ID NO: 2801937 - RNA, 14 nt, Listeria monocytogenes EGD-e
guuuuucugcaucc

SEQ ID NO: 2801938 - RNA, 16 nt, Listeria monocytogenes EGD-e
guuuuuuguuuguaaa

SEQ ID NO: 2801939 - RNA, 23 nt, Listeria monocytogenes EGD-e
guuuuuuuaugcuaaaugaauuc

SEQ ID NO: 2801940 - RNA, 12 nt, Listeria monocytogenes EGD-e
uaaaaaaauacc

SEQ ID NO: 2801941 - RNA, 16 nt, Listeria monocytogenes EGD-e
uaaaaacaauaacauu

SEQ ID NO: 2801942 - RNA, 14 nt, Listeria monocytogenes EGD-e
uaaaaacaguacuu

SEQ ID NO: 2801943 - RNA, 15 nt, Listeria monocytogenes EGD-e
uaaaaaccuaguagu

SEQ ID NO: 2801944 - RNA, 19 nt, Listeria monocytogenes EGD-e
uaaaaagcuuauuaaacau

SEQ ID NO: 2801945 - RNA, 20 nt, Listeria monocytogenes EGD-e
uaaaaaggaauuuuuccauu

SEQ ID NO: 2801946 - RNA, 14 nt, Listeria monocytogenes EGD-e
uaaaaauaaauagg

SEQ ID NO: 2801947 - RNA, 13 nt, Listeria monocytogenes EGD-e
uaaaaauacauuu

SEQ ID NO: 2801948 - RNA, 15 nt, Listeria monocytogenes EGD-e
uaaaaaucaucacuu

SEQ ID NO: 2801949 - RNA, 23 nt, Listeria monocytogenes EGD-e
uaaaaaucaucacuuaauucuug

SEQ ID NO: 2801950 - RNA, 15 nt, Listeria monocytogenes EGD-e
uaaaaccauucaucu

SEQ ID NO: 2801951 - RNA, 16 nt, Listeria monocytogenes EGD-e
uaaaacuaaauuaauu

SEQ ID NO: 2801952 - RNA, 13 nt, Listeria monocytogenes EGD-e
uaaaacuuucaca

SEQ ID NO: 2801953 - RNA, 16 nt, Listeria monocytogenes EGD-e
uaaaaggacacccaua

SEQ ID NO: 2801954 - RNA, 20 nt, Listeria monocytogenes EGD-e
uaaaaggacacccauaauag

SEQ ID NO: 2801955 - RNA, 23 nt, Listeria monocytogenes EGD-e
uaaaaguuugggcauuacgaaag

SEQ ID NO: 2801956 - RNA, 12 nt, Listeria monocytogenes EGD-e
uaaaauaaaaaa

SEQ ID NO: 2801957 - RNA, 16 nt, Listeria monocytogenes EGD-e
uaaaauggauaaaaaa

SEQ ID NO: 2801958 - RNA, 17 nt, Listeria monocytogenes EGD-e
uaaaauggauaaaaaaa

SEQ ID NO: 2801959 - RNA, 15 nt, Listeria monocytogenes EGD-e
uaaaauucuauuaau

SEQ ID NO: 2801960 - RNA, 16 nt, Listeria monocytogenes EGD-e
uaaaauucuauuaaua

SEQ ID NO: 2801961 - RNA, 22 nt, Listeria monocytogenes EGD-e
uaaacaaauucuccuuaaauaa

SEQ ID NO: 2801962 - RNA, 13 nt, Listeria monocytogenes EGD-e
uaaacaacccauu

SEQ ID NO: 2801963 - RNA, 23 nt, Listeria monocytogenes EGD-e
uaaaccguaacuguugaaaagua

SEQ ID NO: 2801964 - RNA, 16 nt, Listeria monocytogenes EGD-e
uaaaccguuaccauaa

SEQ ID NO: 2801965 - RNA, 14 nt, Listeria monocytogenes EGD-e
uaaaccucuuuuuu

SEQ ID NO: 2801966 - RNA, 19 nt, Listeria monocytogenes EGD-e
uaaacgaccaucugggcuc

SEQ ID NO: 2801967 - RNA, 19 nt, Listeria monocytogenes EGD-e
uaaacuaccaucauauaau

SEQ ID NO: 2801968 - RNA, 23 nt, Listeria monocytogenes EGD-e
uaaagaaauaacuacuauuuaaa

SEQ ID NO: 2801969 - RNA, 12 nt, Listeria monocytogenes EGD-e
uaaagcacuggc

SEQ ID NO: 2801970 - RNA, 18 nt, Listeria monocytogenes EGD-e
uaaagcacuggcaaauaa

SEQ ID NO: 2801971 - RNA, 16 nt, Listeria monocytogenes EGD-e
uaaagcuaacgcaauu

SEQ ID NO: 2801972 - RNA, 21 nt, Listeria monocytogenes EGD-e
uaaagcuugauuuaauuguaa

SEQ ID NO: 2801973 - RNA, 14 nt, Listeria monocytogenes EGD-e
uaaaggaaaacucu

SEQ ID NO: 2801974 - RNA, 16 nt, Listeria monocytogenes EGD-e
uaaaggauaaaaauug

SEQ ID NO: 2801975 - RNA, 15 nt, Listeria monocytogenes EGD-e
uaaaggcaacaaaga

SEQ ID NO: 2801976 - RNA, 19 nt, Listeria monocytogenes EGD-e
uaaaggcaacaaagaagaa

SEQ ID NO: 2801977 - RNA, 12 nt, Listeria monocytogenes EGD-e
uaaauaaaacca

SEQ ID NO: 2801978 - RNA, 17 nt, Listeria monocytogenes EGD-e
uaaauacgaaaaacauu

SEQ ID NO: 2801979 - RNA, 20 nt, Listeria monocytogenes EGD-e
uaaauacgaaaaacauuauu

SEQ ID NO: 2801980 - RNA, 22 nt, Listeria monocytogenes EGD-e
uaaauacucgucauagauacuc

SEQ ID NO: 2801981 - RNA, 13 nt, Listeria monocytogenes EGD-e
uaaauagcacagc

SEQ ID NO: 2801982 - RNA, 21 nt, Listeria monocytogenes EGD-e
uaaauagcacagcuaccacaa

SEQ ID NO: 2801983 - RNA, 15 nt, Listeria monocytogenes EGD-e
uaaucaagauuuugu

SEQ ID NO: 2801984 - RNA, 20 nt, Listeria monocytogenes EGD-e
uaaucaagauuuuguacaua

SEQ ID NO: 2801985 - RNA, 21 nt, Listeria monocytogenes EGD-e
uaaucaauccgccaaccagua

SEQ ID NO: 2801986 - RNA, 19 nt, Listeria monocytogenes EGD-e
uaaucacguuuuugcucua

SEQ ID NO: 2801987 - RNA, 13 nt, Listeria monocytogenes EGD-e
uaaucccacaaaa

SEQ ID NO: 2801988 - RNA, 16 nt, Listeria monocytogenes EGD-e
uaaucccacaaaaaau

SEQ ID NO: 2801989 - RNA, 17 nt, Listeria monocytogenes EGD-e
uaaucccacaaaaaaua

SEQ ID NO: 2801990 - RNA, 20 nt, Listeria monocytogenes EGD-e
uaaucgcagggcagaaaaca

SEQ ID NO: 2801991 - RNA, 22 nt, Listeria monocytogenes EGD-e
uaaucgcagggcagaaaacaga

SEQ ID NO: 2801992 - RNA, 18 nt, Listeria monocytogenes EGD-e
uaaucuccgcaaucauuc

SEQ ID NO: 2801993 - RNA, 21 nt, Listeria monocytogenes EGD-e
uaaucucgugcuaauucuguu

SEQ ID NO: 2801994 - RNA, 16 nt, Listeria monocytogenes EGD-e
uaaucugauuaaaagu

SEQ ID NO: 2801995 - RNA, 15 nt, Listeria monocytogenes EGD-e
uaaucuguaaaaaua

SEQ ID NO: 2801996 - RNA, 22 nt, Listeria monocytogenes EGD-e
uaaucuugaugccaucaggagu

SEQ ID NO: 2801997 - RNA, 16 nt, Listeria monocytogenes EGD-e
uaaugaauaagcaauu

SEQ ID NO: 2801998 - RNA, 22 nt, Listeria monocytogenes EGD-e
uaaugauucaaagcuacuuuuc

SEQ ID NO: 2801999 - RNA, 15 nt, Listeria monocytogenes EGD-e
uaaugauuucaauaa

SEQ ID NO: 2802000 - RNA, 23 nt, Listeria monocytogenes EGD-e
uaaugauuucuauaaaaaugaua

SEQ ID NO: 2802001 - RNA, 20 nt, Listeria monocytogenes EGD-e
uaauuaacaaccauuuuguu

SEQ ID NO: 2802002 - RNA, 17 nt, Listeria monocytogenes EGD-e
uaauuacuaaaaaggua

SEQ ID NO: 2802003 - RNA, 14 nt, Listeria monocytogenes EGD-e
uaauuagaggauuu

SEQ ID NO: 2802004 - RNA, 14 nt, Listeria monocytogenes EGD-e
uaauuccauuuaau

SEQ ID NO: 2802005 - RNA, 15 nt, Listeria monocytogenes EGD-e
uaauucgaauaagaa

SEQ ID NO: 2802006 - RNA, 23 nt, Listeria monocytogenes EGD-e
uaauucggcaaacagcuuuucua

SEQ ID NO: 2802007 - RNA, 19 nt, Listeria monocytogenes EGD-e
uaauucuaaauaaauauuu

SEQ ID NO: 2802008 - RNA, 23 nt, Listeria monocytogenes EGD-e
uaauucugcgauuuuuucuucca

SEQ ID NO: 2802009 - RNA, 12 nt, Listeria monocytogenes EGD-e
uaauucuuuuuc

SEQ ID NO: 2802010 - RNA, 17 nt, Listeria monocytogenes EGD-e
uaauugcaacuuuucuu

SEQ ID NO: 2802011 - RNA, 22 nt, Listeria monocytogenes EGD-e
uaauuggaauagagcuuuuaaa

SEQ ID NO: 2802012 - RNA, 12 nt, Listeria monocytogenes EGD-e
uaauuguauaag

SEQ ID NO: 2802013 - RNA, 13 nt, Listeria monocytogenes EGD-e
uaauuguauaagu

SEQ ID NO: 2802014 - RNA, 21 nt, Listeria monocytogenes EGD-e
uaauuguuaccgcauuuuucu

SEQ ID NO: 2802015 - RNA, 15 nt, Listeria monocytogenes EGD-e
uaauuuacuacuaau

SEQ ID NO: 2802016 - RNA, 20 nt, Listeria monocytogenes EGD-e
uaauuuauaaaagcuucuau

SEQ ID NO: 2802017 - RNA, 17 nt, Listeria monocytogenes EGD-e
uaauuucaaauggagcu

SEQ ID NO: 2802018 - RNA, 13 nt, Listeria monocytogenes EGD-e
uaauuucuuuguc

SEQ ID NO: 2802019 - RNA, 15 nt, Listeria monocytogenes EGD-e
uaauuucuuuugaga

SEQ ID NO: 2802020 - RNA, 14 nt, Listeria monocytogenes EGD-e
uaauuuggaaauaa

SEQ ID NO: 2802021 - RNA, 22 nt, Listeria monocytogenes EGD-e
uaauuuggaaauaauucugcua

SEQ ID NO: 2802022 - RNA, 19 nt, Listeria monocytogenes EGD-e
uaauuugggagcuuucuuu

SEQ ID NO: 2802023 - RNA, 14 nt, Listeria monocytogenes EGD-e
uaauuuuacuucua

SEQ ID NO: 2802024 - RNA, 20 nt, Listeria monocytogenes EGD-e
uaauuuuuucauuuucuauu

SEQ ID NO: 2802025 - RNA, 13 nt, Listeria monocytogenes EGD-e
uaauuuuuuucga

SEQ ID NO: 2802026 - RNA, 12 nt, Listeria monocytogenes EGD-e
uacaaacuuuuc

SEQ ID NO: 2802027 - RNA, 16 nt, Listeria monocytogenes EGD-e
uacaacaaaauaauca

SEQ ID NO: 2802028 - RNA, 19 nt, Listeria monocytogenes EGD-e
uacaauuuucauuuaacau

SEQ ID NO: 2802029 - RNA, 21 nt, Listeria monocytogenes EGD-e
uacacaaaguaaaaaggaaag

SEQ ID NO: 2802030 - RNA, 14 nt, Listeria monocytogenes EGD-e
uacacaucuuucga

SEQ ID NO: 2802031 - RNA, 14 nt, Listeria monocytogenes EGD-e
uacacauuauacga

SEQ ID NO: 2802032 - RNA, 13 nt, Listeria monocytogenes EGD-e
uacacccauaaua

SEQ ID NO: 2802033 - RNA, 19 nt, Listeria monocytogenes EGD-e
uacaccgaacuagcaucag

SEQ ID NO: 2802034 - RNA, 24 nt, Listeria monocytogenes EGD-e
uacacuaguauuccuaucacaaac

SEQ ID NO: 2802035 - RNA, 22 nt, Listeria monocytogenes EGD-e
uacaggaacuacauacuuauag

SEQ ID NO: 2802036 - RNA, 14 nt, Listeria monocytogenes EGD-e
uacagguguauucg

SEQ ID NO: 2802037 - RNA, 12 nt, Listeria monocytogenes EGD-e
uacauaauucau

SEQ ID NO: 2802038 - RNA, 14 nt, Listeria monocytogenes EGD-e
uacauauuccaaaa

SEQ ID NO: 2802039 - RNA, 15 nt, Listeria monocytogenes EGD-e
uacauauuccaaaau

SEQ ID NO: 2802040 - RNA, 22 nt, Listeria monocytogenes EGD-e
uacaucaagugcuucaucuuua

SEQ ID NO: 2802041 - RNA, 16 nt, Listeria monocytogenes EGD-e
uaccaccgacacuaaa

SEQ ID NO: 2802042 - RNA, 13 nt, Listeria monocytogenes EGD-e
uaccauacacaua

SEQ ID NO: 2802043 - RNA, 17 nt, Listeria monocytogenes EGD-e
uaccaucauauaauucu

SEQ ID NO: 2802044 - RNA, 20 nt, Listeria monocytogenes EGD-e
uaccaucauauaauucuaau

SEQ ID NO: 2802045 - RNA, 16 nt, Listeria monocytogenes EGD-e
uaccauguuuauuuaa

SEQ ID NO: 2802046 - RNA, 23 nt, Listeria monocytogenes EGD-e
uacccuuuuuuuacauuuuugcu

SEQ ID NO: 2802047 - RNA, 13 nt, Listeria monocytogenes EGD-e
uaccgaaugcaau

SEQ ID NO: 2802048 - RNA, 13 nt, Listeria monocytogenes EGD-e
uaccgcuaauaua

SEQ ID NO: 2802049 - RNA, 14 nt, Listeria monocytogenes EGD-e
uaccgcuaauauaa

SEQ ID NO: 2802050 - RNA, 17 nt, Listeria monocytogenes EGD-e
uaccguuccuucaagca

SEQ ID NO: 2802051 - RNA, 19 nt, Listeria monocytogenes EGD-e
uaccuaaugaauaagcaau

SEQ ID NO: 2802052 - RNA, 15 nt, Listeria monocytogenes EGD-e
uaccugcaagcgaau

SEQ ID NO: 2802053 - RNA, 14 nt, Listeria monocytogenes EGD-e
uaccuguuucugcc

SEQ ID NO: 2802054 - RNA, 15 nt, Listeria monocytogenes EGD-e
uaccuugaucaaaau

SEQ ID NO: 2802055 - RNA, 11 nt, Listeria monocytogenes EGD-e
uaccuuuaaaa

SEQ ID NO: 2802056 - RNA, 12 nt, Listeria monocytogenes EGD-e
uacgauuugcuc

SEQ ID NO: 2802057 - RNA, 22 nt, Listeria monocytogenes EGD-e
uacgccuuugcaaggcuuuuaa

SEQ ID NO: 2802058 - RNA, 19 nt, Listeria monocytogenes EGD-e
uacgggugagcuucuuuuu

SEQ ID NO: 2802059 - RNA, 17 nt, Listeria monocytogenes EGD-e
uacgguuaauuuccauu

SEQ ID NO: 2802060 - RNA, 23 nt, Listeria monocytogenes EGD-e
uacguagcagauguaucuaaaau

SEQ ID NO: 2802061 - RNA, 15 nt, Listeria monocytogenes EGD-e
uacguaucuuauccg

SEQ ID NO: 2802062 - RNA, 13 nt, Listeria monocytogenes EGD-e
uacguauuaccuc

SEQ ID NO: 2802063 - RNA, 16 nt, Listeria monocytogenes EGD-e
uacguuguucuaacau

SEQ ID NO: 2802064 - RNA, 16 nt, Listeria monocytogenes EGD-e
uacuaacgcuuuuuca

SEQ ID NO: 2802065 - RNA, 19 nt, Listeria monocytogenes EGD-e
uacuaagugcuucgcuguc

SEQ ID NO: 2802066 - RNA, 16 nt, Listeria monocytogenes EGD-e
uacuacacguucccca

SEQ ID NO: 2802067 - RNA, 14 nt, Listeria monocytogenes EGD-e
uacuagcuuugucu

SEQ ID NO: 2802068 - RNA, 23 nt, Listeria monocytogenes EGD-e
uacuauacaagcguaugguucaa

SEQ ID NO: 2802069 - RNA, 17 nt, Listeria monocytogenes EGD-e
uacuccaaaauaaaaug

SEQ ID NO: 2802070 - RNA, 21 nt, Listeria monocytogenes EGD-e
uacucgucauagauacucuuu

SEQ ID NO: 2802071 - RNA, 15 nt, Listeria monocytogenes EGD-e
uacugcaucccaacu

SEQ ID NO: 2802072 - RNA, 14 nt, Listeria monocytogenes EGD-e
uacugguucuucuu

SEQ ID NO: 2802073 - RNA, 21 nt, Listeria monocytogenes EGD-e
uacugguucuucuuuuugauu

SEQ ID NO: 2802074 - RNA, 20 nt, Listeria monocytogenes EGD-e
uacugguuuuucuuuuccua

SEQ ID NO: 2802075 - RNA, 12 nt, Listeria monocytogenes EGD-e
uacuguauaugu

SEQ ID NO: 2802076 - RNA, 17 nt, Listeria monocytogenes EGD-e
uacugucgcaaaaauca

SEQ ID NO: 2802077 - RNA, 19 nt, Listeria monocytogenes EGD-e
uacuguuuuauauuuuauu

SEQ ID NO: 2802078 - RNA, 19 nt, Listeria monocytogenes EGD-e
uacuguuuuugauuuaauu

SEQ ID NO: 2802079 - RNA, 19 nt, Listeria monocytogenes EGD-e
uacuucagccacguuugga

SEQ ID NO: 2802080 - RNA, 17 nt, Listeria monocytogenes EGD-e
uacuucaugugcuuuuu

SEQ ID NO: 2802081 - RNA, 19 nt, Listeria monocytogenes EGD-e
uacuucggggcaaaaagga

SEQ ID NO: 2802082 - RNA, 14 nt, Listeria monocytogenes EGD-e
uacuuggaauaaac

SEQ ID NO: 2802083 - RNA, 15 nt, Listeria monocytogenes EGD-e
uacuuggaauaaaca

SEQ ID NO: 2802084 - RNA, 18 nt, Listeria monocytogenes EGD-e
uacuugugaaaguuuuau

SEQ ID NO: 2802085 - RNA, 15 nt, Listeria monocytogenes EGD-e
uauagguaacaucuu

SEQ ID NO: 2802086 - RNA, 16 nt, Listeria monocytogenes EGD-e
uauagucauaagcuaa

SEQ ID NO: 2802087 - RNA, 23 nt, Listeria monocytogenes EGD-e
uauauagucauaagcuaacaaca

SEQ ID NO: 2802088 - RNA, 11 nt, Listeria monocytogenes EGD-e
uauaugaaaac

SEQ ID NO: 2802089 - RNA, 20 nt, Listeria monocytogenes EGD-e
uauaugaaaacuuaucucuu

SEQ ID NO: 2802090 - RNA, 14 nt, Listeria monocytogenes EGD-e
uauauguaguuuca

SEQ ID NO: 2802091 - RNA, 18 nt, Listeria monocytogenes EGD-e
uauauucauccucauauu

SEQ ID NO: 2802092 - RNA, 20 nt, Listeria monocytogenes EGD-e
uauauuccggaaugcgcgca

SEQ ID NO: 2802093 - RNA, 13 nt, Listeria monocytogenes EGD-e
uauauuuauaaac

SEQ ID NO: 2802094 - RNA, 15 nt, Listeria monocytogenes EGD-e
uaucaauaaauccag

SEQ ID NO: 2802095 - RNA, 12 nt, Listeria monocytogenes EGD-e
uaucaauaauag

SEQ ID NO: 2802096 - RNA, 18 nt, Listeria monocytogenes EGD-e
uaucaccauuacuauuaa

SEQ ID NO: 2802097 - RNA, 15 nt, Listeria monocytogenes EGD-e
uaucaucaauaaaau

SEQ ID NO: 2802098 - RNA, 20 nt, Listeria monocytogenes EGD-e
uaucaucaauaaaaugcaca

SEQ ID NO: 2802099 - RNA, 17 nt, Listeria monocytogenes EGD-e
uaucaucaauuaaauua

SEQ ID NO: 2802100 - RNA, 18 nt, Listeria monocytogenes EGD-e
uaucaugaauaaguuauu

SEQ ID NO: 2802101 - RNA, 21 nt, Listeria monocytogenes EGD-e
uauccacauaacggaaauucc

SEQ ID NO: 2802102 - RNA, 14 nt, Listeria monocytogenes EGD-e
uauccaccaaaaac

SEQ ID NO: 2802103 - RNA, 15 nt, Listeria monocytogenes EGD-e
uauccaguauuuccc

SEQ ID NO: 2802104 - RNA, 14 nt, Listeria monocytogenes EGD-e
uauccccuagcucg

SEQ ID NO: 2802105 - RNA, 22 nt, Listeria monocytogenes EGD-e
uauccguuaaucugauuaaaag

SEQ ID NO: 2802106 - RNA, 15 nt, Listeria monocytogenes EGD-e
uaucgccaacuucuu

SEQ ID NO: 2802107 - RNA, 11 nt, Listeria monocytogenes EGD-e
uaucuaaaauc

SEQ ID NO: 2802108 - RNA, 19 nt, Listeria monocytogenes EGD-e
uaucuacaaguucuuucau

SEQ ID NO: 2802109 - RNA, 12 nt, Listeria monocytogenes EGD-e
uaucucuucauu

SEQ ID NO: 2802110 - RNA, 19 nt, Listeria monocytogenes EGD-e
uaucuggcaguuuuucaau

SEQ ID NO: 2802111 - RNA, 13 nt, Listeria monocytogenes EGD-e
uaucuuuauuuuu

SEQ ID NO: 2802112 - RNA, 15 nt, Listeria monocytogenes EGD-e
uaucuuuauuuuuug

SEQ ID NO: 2802113 - RNA, 18 nt, Listeria monocytogenes EGD-e
uaucuuucccaucauauc

SEQ ID NO: 2802114 - RNA, 16 nt, Listeria monocytogenes EGD-e
uaucuuuuccaaaaug

SEQ ID NO: 2802115 - RNA, 19 nt, Listeria monocytogenes EGD-e
uaugagaguuauaaagaaa

SEQ ID NO: 2802116 - RNA, 20 nt, Listeria monocytogenes EGD-e
uaugauaaccgcuaucuaca

SEQ ID NO: 2802117 - RNA, 16 nt, Listeria monocytogenes EGD-e
uaugaucuuuucgcaa

SEQ ID NO: 2802118 - RNA, 14 nt, Listeria monocytogenes EGD-e
uaugcacuuucaaa

SEQ ID NO: 2802119 - RNA, 18 nt, Listeria monocytogenes EGD-e
uaugcacuuucaaaucag

SEQ ID NO: 2802120 - RNA, 20 nt, Listeria monocytogenes EGD-e
uaugcagguaaaacagcaag

SEQ ID NO: 2802121 - RNA, 19 nt, Listeria monocytogenes EGD-e
uaugcauaaaaaagcacuc

SEQ ID NO: 2802122 - RNA, 15 nt, Listeria monocytogenes EGD-e
uaugcgguagccugc

SEQ ID NO: 2802123 - RNA, 22 nt, Listeria monocytogenes EGD-e
uauggugcgcggauaaauauag

SEQ ID NO: 2802124 - RNA, 18 nt, Listeria monocytogenes EGD-e
uauguaauucuaaauaaa

SEQ ID NO: 2802125 - RNA, 19 nt, Listeria monocytogenes EGD-e
uauguaauucuaaauaaau

SEQ ID NO: 2802126 - RNA, 15 nt, Listeria monocytogenes EGD-e
uaugugcgaugccac

SEQ ID NO: 2802127 - RNA, 22 nt, Listeria monocytogenes EGD-e
uauguuucggguuuguuaauaa

SEQ ID NO: 2802128 - RNA, 15 nt, Listeria monocytogenes EGD-e
uauguuuuauuuaua

SEQ ID NO: 2802129 - RNA, 15 nt, Listeria monocytogenes EGD-e
uauuaacuaauaacc

SEQ ID NO: 2802130 - RNA, 18 nt, Listeria monocytogenes EGD-e
uauuaauaaugauuucua

SEQ ID NO: 2802131 - RNA, 13 nt, Listeria monocytogenes EGD-e
uauuaauccgaau

SEQ ID NO: 2802132 - RNA, 17 nt, Listeria monocytogenes EGD-e
uauuaauccgaauucca

SEQ ID NO: 2802133 - RNA, 13 nt, Listeria monocytogenes EGD-e
uauuaaugacugu

SEQ ID NO: 2802134 - RNA, 16 nt, Listeria monocytogenes EGD-e
uauuaaugacuguugu

SEQ ID NO: 2802135 - RNA, 17 nt, Listeria monocytogenes EGD-e
uauuaaugguugcauuu

SEQ ID NO: 2802136 - RNA, 21 nt, Listeria monocytogenes EGD-e
uauuaauuauggcauaaaaaa

SEQ ID NO: 2802137 - RNA, 13 nt, Listeria monocytogenes EGD-e
uauuagaaaauca

SEQ ID NO: 2802138 - RNA, 17 nt, Listeria monocytogenes EGD-e
uauuauaaccccaaaau

SEQ ID NO: 2802139 - RNA, 23 nt, Listeria monocytogenes EGD-e
uauuauaagcaguacuuccuguu

SEQ ID NO: 2802140 - RNA, 11 nt, Listeria monocytogenes EGD-e
uauuauuucug

SEQ ID NO: 2802141 - RNA, 14 nt, Listeria monocytogenes EGD-e
uauucaauucccag

SEQ ID NO: 2802142 - RNA, 15 nt, Listeria monocytogenes EGD-e
uauucagcaggcacg

SEQ ID NO: 2802143 - RNA, 15 nt, Listeria monocytogenes EGD-e
uauucauauaaaguu

SEQ ID NO: 2802144 - RNA, 19 nt, Listeria monocytogenes EGD-e
uauucauauaaaguuuuuu

SEQ ID NO: 2802145 - RNA, 21 nt, Listeria monocytogenes EGD-e
uauucauauaaaguuuuuugg

SEQ ID NO: 2802146 - RNA, 15 nt, Listeria monocytogenes EGD-e
uauuccuaucacaaa

SEQ ID NO: 2802147 - RNA, 18 nt, Listeria monocytogenes EGD-e
uauuccuccaauuuuacu

SEQ ID NO: 2802148 - RNA, 21 nt, Listeria monocytogenes EGD-e
uauuccuccuaauuguuuugu

SEQ ID NO: 2802149 - RNA, 22 nt, Listeria monocytogenes EGD-e
uauucuagccgcucgucuaaau

SEQ ID NO: 2802150 - RNA, 23 nt, Listeria monocytogenes EGD-e
uauucucuuaugagaguuauaaa

SEQ ID NO: 2802151 - RNA, 12 nt, Listeria monocytogenes EGD-e
uauucuucuaaa

SEQ ID NO: 2802152 - RNA, 14 nt, Listeria monocytogenes EGD-e
uauucuucuaaaau

SEQ ID NO: 2802153 - RNA, 15 nt, Listeria monocytogenes EGD-e
uauucuucuaaaaua

SEQ ID NO: 2802154 - RNA, 16 nt, Listeria monocytogenes EGD-e
uauucuucuaaaauaa

SEQ ID NO: 2802155 - RNA, 20 nt, Listeria monocytogenes EGD-e
uauucuucuaaaauaacauc

SEQ ID NO: 2802156 - RNA, 12 nt, Listeria monocytogenes EGD-e
uauuuaaauaua

SEQ ID NO: 2802157 - RNA, 16 nt, Listeria monocytogenes EGD-e
uauuuaucaaacaaaa

SEQ ID NO: 2802158 - RNA, 21 nt, Listeria monocytogenes EGD-e
uauuuccccgcagaaaaauaa

SEQ ID NO: 2802159 - RNA, 17 nt, Listeria monocytogenes EGD-e
uauuucuuuauaacucu

SEQ ID NO: 2802160 - RNA, 20 nt, Listeria monocytogenes EGD-e
uauuuggccaauuaaaauac

SEQ ID NO: 2802161 - RNA, 16 nt, Listeria monocytogenes EGD-e
uauuugggauuagaau

SEQ ID NO: 2802162 - RNA, 20 nt, Listeria monocytogenes EGD-e
uauuuuaacauaaaaagcug

SEQ ID NO: 2802163 - RNA, 14 nt, Listeria monocytogenes EGD-e
uauuuugauaacgu

SEQ ID NO: 2802164 - RNA, 18 nt, Listeria monocytogenes EGD-e
uauuuugcggaaauauca

SEQ ID NO: 2802165 - RNA, 19 nt, Listeria monocytogenes EGD-e
uauuuugguuauuucuuua

SEQ ID NO: 2802166 - RNA, 15 nt, Listeria monocytogenes EGD-e
uauuuuuauuauaaa

SEQ ID NO: 2802167 - RNA, 20 nt, Listeria monocytogenes EGD-e
uauuuuucagcuaaauauuu

SEQ ID NO: 2802168 - RNA, 11 nt, Listeria monocytogenes EGD-e
uauuuuucuuu

SEQ ID NO: 2802169 - RNA, 20 nt, Listeria monocytogenes EGD-e
uauuuuuuucgaaagaaaug

SEQ ID NO: 2802170 - RNA, 12 nt, Listeria monocytogenes EGD-e
ucaaaaauaugc

SEQ ID NO: 2802171 - RNA, 16 nt, Listeria monocytogenes EGD-e
ucaaaagcaaaaaagu

SEQ ID NO: 2802172 - RNA, 18 nt, Listeria monocytogenes EGD-e
ucaaaaucaagcguacca

SEQ ID NO: 2802173 - RNA, 14 nt, Listeria monocytogenes EGD-e
ucaaacacuucuaa

SEQ ID NO: 2802174 - RNA, 23 nt, Listeria monocytogenes EGD-e
ucaaacgaucagccauuuuacgg

SEQ ID NO: 2802175 - RNA, 15 nt, Listeria monocytogenes EGD-e
ucaaacgucauucgg

SEQ ID NO: 2802176 - RNA, 13 nt, Listeria monocytogenes EGD-e
ucaaacucuuucu

SEQ ID NO: 2802177 - RNA, 14 nt, Listeria monocytogenes EGD-e
ucaaagguuuaaua

SEQ ID NO: 2802178 - RNA, 22 nt, Listeria monocytogenes EGD-e
ucaaaguaaaauacguugucug

SEQ ID NO: 2802179 - RNA, 18 nt, Listeria monocytogenes EGD-e
ucaaaucaauuucuucgu

SEQ ID NO: 2802180 - RNA, 18 nt, Listeria monocytogenes EGD-e
ucaaaucaccacaaagga

SEQ ID NO: 2802181 - RNA, 21 nt, Listeria monocytogenes EGD-e
ucaaaucagcuuccauacuuu

SEQ ID NO: 2802182 - RNA, 17 nt, Listeria monocytogenes EGD-e
ucaaaucuggauaaaaa

SEQ ID NO: 2802183 - RNA, 19 nt, Listeria monocytogenes EGD-e
ucaaaucuggauaaaaaua

SEQ ID NO: 2802184 - RNA, 21 nt, Listeria monocytogenes EGD-e
ucaaaucuggauaaaaauaac

SEQ ID NO: 2802185 - RNA, 18 nt, Listeria monocytogenes EGD-e
ucaaauggcgcaggaaua

SEQ ID NO: 2802186 - RNA, 14 nt, Listeria monocytogenes EGD-e
ucaaauucuucucc

SEQ ID NO: 2802187 - RNA, 18 nt, Listeria monocytogenes EGD-e
uccagcguuaaucuuaca

SEQ ID NO: 2802188 - RNA, 14 nt, Listeria monocytogenes EGD-e
uccagcuaaguuuu

SEQ ID NO: 2802189 - RNA, 22 nt, Listeria monocytogenes EGD-e
uccagcuaaguuuucuaaacua

SEQ ID NO: 2802190 - RNA, 21 nt, Listeria monocytogenes EGD-e
uccaguauuuccccgcagaaa

SEQ ID NO: 2802191 - RNA, 15 nt, Listeria monocytogenes EGD-e
uccaguuaaacaaac

SEQ ID NO: 2802192 - RNA, 22 nt, Listeria monocytogenes EGD-e
uccaguuaaacaaacacaaaau

SEQ ID NO: 2802193 - RNA, 21 nt, Listeria monocytogenes EGD-e
uccauacuuucugccaaauug

SEQ ID NO: 2802194 - RNA, 24 nt, Listeria monocytogenes EGD-e
uccauacuuucugccaaauugguc

SEQ ID NO: 2802195 - RNA, 22 nt, Listeria monocytogenes EGD-e
uccauagaauguauacacuagu

SEQ ID NO: 2802196 - RNA, 14 nt, Listeria monocytogenes EGD-e
uccauauaaucucg

SEQ ID NO: 2802197 - RNA, 13 nt, Listeria monocytogenes EGD-e
uccauaucaccaa

SEQ ID NO: 2802198 - RNA, 15 nt, Listeria monocytogenes EGD-e
uccauauuuucucua

SEQ ID NO: 2802199 - RNA, 15 nt, Listeria monocytogenes EGD-e
uccaucauaauccca

SEQ ID NO: 2802200 - RNA, 15 nt, Listeria monocytogenes EGD-e
uccauuuuucuucug

SEQ ID NO: 2802201 - RNA, 20 nt, Listeria monocytogenes EGD-e
uccauuuuucuucuggaaga

SEQ ID NO: 2802202 - RNA, 17 nt, Listeria monocytogenes EGD-e
ucccaauagaaaccauc

SEQ ID NO: 2802203 - RNA, 18 nt, Listeria monocytogenes EGD-e
ucccacaucgcuucugau

SEQ ID NO: 2802204 - RNA, 13 nt, Listeria monocytogenes EGD-e
ucccagaaaaaaa

SEQ ID NO: 2802205 - RNA, 14 nt, Listeria monocytogenes EGD-e
ucccagaaaaaaac

SEQ ID NO: 2802206 - RNA, 14 nt, Listeria monocytogenes EGD-e
ucccagcuuuuccu

SEQ ID NO: 2802207 - RNA, 16 nt, Listeria monocytogenes EGD-e
uccccaccaggcaaaa

SEQ ID NO: 2802208 - RNA, 20 nt, Listeria monocytogenes EGD-e
uccccgcagaaaaauaaucc

SEQ ID NO: 2802209 - RNA, 20 nt, Listeria monocytogenes EGD-e
uccccuuuuagaaugaagau

SEQ ID NO: 2802210 - RNA, 19 nt, Listeria monocytogenes EGD-e
ucccgcgcuaaucuucuug

SEQ ID NO: 2802211 - RNA, 22 nt, Listeria monocytogenes EGD-e
ucccgcugaacuuggaaagugg

SEQ ID NO: 2802212 - RNA, 15 nt, Listeria monocytogenes EGD-e
ucccuauaaaaacau

SEQ ID NO: 2802213 - RNA, 15 nt, Listeria monocytogenes EGD-e
ucccucauccuuucu

SEQ ID NO: 2802214 - RNA, 17 nt, Listeria monocytogenes EGD-e
ucccucauguucaaucu

SEQ ID NO: 2802215 - RNA, 19 nt, Listeria monocytogenes EGD-e
ucccuccuuuauuuuuuau

SEQ ID NO: 2802216 - RNA, 23 nt, Listeria monocytogenes EGD-e
ucccuuuacuugcaaaugcuuua

SEQ ID NO: 2802217 - RNA, 13 nt, Listeria monocytogenes EGD-e
ucccuuuuugacc

SEQ ID NO: 2802218 - RNA, 13 nt, Listeria monocytogenes EGD-e
ucccuuuuuucau

SEQ ID NO: 2802219 - RNA, 16 nt, Listeria monocytogenes EGD-e
uccgaaccaagcacau

SEQ ID NO: 2802220 - RNA, 20 nt, Listeria monocytogenes EGD-e
uccgauacaacaaaauaauc

SEQ ID NO: 2802221 - RNA, 15 nt, Listeria monocytogenes EGD-e
uccgcucuuuuuuau

SEQ ID NO: 2802222 - RNA, 17 nt, Listeria monocytogenes EGD-e
uccgcuucguuucauuu

SEQ ID NO: 2802223 - RNA, 14 nt, Listeria monocytogenes EGD-e
uccguaagaagaaa

SEQ ID NO: 2802224 - RNA, 22 nt, Listeria monocytogenes EGD-e
uccguuuguugcgccacuucua

SEQ ID NO: 2802225 - RNA, 23 nt, Listeria monocytogenes EGD-e
uccuaggcgcucuuuaauaauua

SEQ ID NO: 2802226 - RNA, 13 nt, Listeria monocytogenes EGD-e
uccucauauuugg

SEQ ID NO: 2802227 - RNA, 18 nt, Listeria monocytogenes EGD-e
uccucauugaggaauacu

SEQ ID NO: 2802228 - RNA, 13 nt, Listeria monocytogenes EGD-e
uccuccuaauugu

SEQ ID NO: 2802229 - RNA, 21 nt, Listeria monocytogenes EGD-e
uccucuaagucugcuuuuuca

SEQ ID NO: 2802230 - RNA, 22 nt, Listeria monocytogenes EGD-e
uccucuaagucugcuuuuucaa

SEQ ID NO: 2802231 - RNA, 20 nt, Listeria monocytogenes EGD-e
uccuguaacgucucucauug

SEQ ID NO: 2802232 - RNA, 22 nt, Listeria monocytogenes EGD-e
uccuguaauucgaauaagaacc

SEQ ID NO: 2802233 - RNA, 20 nt, Listeria monocytogenes EGD-e
uccuguugcaccaaaaauac

SEQ ID NO: 2802234 - RNA, 21 nt, Listeria monocytogenes EGD-e
uccuguugcaccaaaaauacg

SEQ ID NO: 2802235 - RNA, 15 nt, Listeria monocytogenes EGD-e
uccuuauuaauagua

SEQ ID NO: 2802236 - RNA, 15 nt, Listeria monocytogenes EGD-e
uccuucaagcauuuc

SEQ ID NO: 2802237 - RNA, 23 nt, Listeria monocytogenes EGD-e
uccuucaauaauauaaugauuca

SEQ ID NO: 2802238 - RNA, 23 nt, Listeria monocytogenes EGD-e
uccuucauaauuauuuuuguaau

SEQ ID NO: 2802239 - RNA, 20 nt, Listeria monocytogenes EGD-e
uccuucuacguagcagaugu

SEQ ID NO: 2802240 - RNA, 22 nt, Listeria monocytogenes EGD-e
uccuucuacguagcagauguau

SEQ ID NO: 2802241 - RNA, 21 nt, Listeria monocytogenes EGD-e
uccuugcugcucgcucaucau

SEQ ID NO: 2802242 - RNA, 14 nt, Listeria monocytogenes EGD-e
uccuuguacuaauu

SEQ ID NO: 2802243 - RNA, 15 nt, Listeria monocytogenes EGD-e
uccuuguacuaauuc

SEQ ID NO: 2802244 - RNA, 21 nt, Listeria monocytogenes EGD-e
uccuuguuuuuuguauucaac

SEQ ID NO: 2802245 - RNA, 13 nt, Listeria monocytogenes EGD-e
uccuuuaucauuc

SEQ ID NO: 2802246 - RNA, 13 nt, Listeria monocytogenes EGD-e
uccuuuauuuuuu

SEQ ID NO: 2802247 - RNA, 16 nt, Listeria monocytogenes EGD-e
uccuuuuguuuuaaua

SEQ ID NO: 2802248 - RNA, 19 nt, Listeria monocytogenes EGD-e
uccuuuuguuuuaauaaau

SEQ ID NO: 2802249 - RNA, 23 nt, Listeria monocytogenes EGD-e
uccuuuuguuuuaauaaaucaua

SEQ ID NO: 2802250 - RNA, 17 nt, Listeria monocytogenes EGD-e
uccuuuuucauuauaag

SEQ ID NO: 2802251 - RNA, 13 nt, Listeria monocytogenes EGD-e
ucgaaagaaaugu

SEQ ID NO: 2802252 - RNA, 14 nt, Listeria monocytogenes EGD-e
ucgaaaguaaaauc

SEQ ID NO: 2802253 - RNA, 21 nt, Listeria monocytogenes EGD-e
ucgaauacuaacgcuuuuuca

SEQ ID NO: 2802254 - RNA, 22 nt, Listeria monocytogenes EGD-e
ucgaauacuaacgcuuuuucag

SEQ ID NO: 2802255 - RNA, 15 nt, Listeria monocytogenes EGD-e
ucgaauucuuuuucu

SEQ ID NO: 2802256 - RNA, 14 nt, Listeria monocytogenes EGD-e
ucgacaguuucuuu

SEQ ID NO: 2802257 - RNA, 19 nt, Listeria monocytogenes EGD-e
ucgaggaaguaauucaucc

SEQ ID NO: 2802258 - RNA, 16 nt, Listeria monocytogenes EGD-e
ucgauuuucaacuguu

SEQ ID NO: 2802259 - RNA, 19 nt, Listeria monocytogenes EGD-e
ucgauuuucaacuguugcu

SEQ ID NO: 2802260 - RNA, 19 nt, Listeria monocytogenes EGD-e
ucgcaaaaaauaauaucuu

SEQ ID NO: 2802261 - RNA, 21 nt, Listeria monocytogenes EGD-e
ucgcaagcgacauuaaauagc

SEQ ID NO: 2802262 - RNA, 17 nt, Listeria monocytogenes EGD-e
ucgcagggcagaaaaca

SEQ ID NO: 2802263 - RNA, 18 nt, Listeria monocytogenes EGD-e
ucgcagggcagaaaacag

SEQ ID NO: 2802264 - RNA, 23 nt, Listeria monocytogenes EGD-e
ucgcaucaaucgccaguugcuga

SEQ ID NO: 2802265 - RNA, 22 nt, Listeria monocytogenes EGD-e
ucgccaccugguaaauagccaa

SEQ ID NO: 2802266 - RNA, 16 nt, Listeria monocytogenes EGD-e
ucgccguuggaaguga

SEQ ID NO: 2802267 - RNA, 19 nt, Listeria monocytogenes EGD-e
ucgccguuggaagugaaaa

SEQ ID NO: 2802268 - RNA, 15 nt, Listeria monocytogenes EGD-e
ucgcggauaauaauc

SEQ ID NO: 2802269 - RNA, 16 nt, Listeria monocytogenes EGD-e
ucgcggauaauaauca

SEQ ID NO: 2802270 - RNA, 18 nt, Listeria monocytogenes EGD-e
ucgcgguagcuucaauca

SEQ ID NO: 2802271 - RNA, 13 nt, Listeria monocytogenes EGD-e
ucgcuauucuauu

SEQ ID NO: 2802272 - RNA, 14 nt, Listeria monocytogenes EGD-e
ucgcuuguuuugau

SEQ ID NO: 2802273 - RNA, 22 nt, Listeria monocytogenes EGD-e
ucgcuuuaauacguauucuagc

SEQ ID NO: 2802274 - RNA, 22 nt, Listeria monocytogenes EGD-e
ucggaccuuuugcuucuuccau

SEQ ID NO: 2802275 - RNA, 13 nt, Listeria monocytogenes EGD-e
ucggauuuuucaa

SEQ ID NO: 2802276 - RNA, 18 nt, Listeria monocytogenes EGD-e
ucggauuuuucaaaucaa

SEQ ID NO: 2802277 - RNA, 23 nt, Listeria monocytogenes EGD-e
ucggcuuuuuuuauuuaaucauu

SEQ ID NO: 2802278 - RNA, 16 nt, Listeria monocytogenes EGD-e
ucgggaauaaaucaag

SEQ ID NO: 2802279 - RNA, 18 nt, Listeria monocytogenes EGD-e
ucggguuuguuaauaauu

SEQ ID NO: 2802280 - RNA, 13 nt, Listeria monocytogenes EGD-e
ucggguuuuaaaa

SEQ ID NO: 2802281 - RNA, 13 nt, Listeria monocytogenes EGD-e
ucgguaagaccac

SEQ ID NO: 2802282 - RNA, 13 nt, Listeria monocytogenes EGD-e
ucgguaaucuagu

SEQ ID NO: 2802283 - RNA, 14 nt, Listeria monocytogenes EGD-e
ucgguacaguagaa

SEQ ID NO: 2802284 - RNA, 20 nt, Listeria monocytogenes EGD-e
ucgguacaguagaagcaauu

SEQ ID NO: 2802285 - RNA, 13 nt, Listeria monocytogenes EGD-e
ucgguauaaaaca

SEQ ID NO: 2802286 - RNA, 17 nt, Listeria monocytogenes EGD-e
ucguaaauagcacagcu

SEQ ID NO: 2802287 - RNA, 19 nt, Listeria monocytogenes EGD-e
ucgucguauguuuucccuu

SEQ ID NO: 2802288 - RNA, 13 nt, Listeria monocytogenes EGD-e
ugaacaaagaaga

SEQ ID NO: 2802289 - RNA, 15 nt, Listeria monocytogenes EGD-e
ugaacaaagaagaag

SEQ ID NO: 2802290 - RNA, 22 nt, Listeria monocytogenes EGD-e
ugaacacccgguccuucaaucg

SEQ ID NO: 2802291 - RNA, 17 nt, Listeria monocytogenes EGD-e
ugaacugacuagaaauu

SEQ ID NO: 2802292 - RNA, 22 nt, Listeria monocytogenes EGD-e
ugaacugacuagaaauuaaugc

SEQ ID NO: 2802293 - RNA, 20 nt, Listeria monocytogenes EGD-e
ugaagagauaaguuuucaua

SEQ ID NO: 2802294 - RNA, 14 nt, Listeria monocytogenes EGD-e
ugaagcuuccuuua

SEQ ID NO: 2802295 - RNA, 19 nt, Listeria monocytogenes EGD-e
ugaagcuuccuuuaucauu

SEQ ID NO: 2802296 - RNA, 13 nt, Listeria monocytogenes EGD-e
ugaaggaaacgaa

SEQ ID NO: 2802297 - RNA, 13 nt, Listeria monocytogenes EGD-e
ugaauaagcaauu

SEQ ID NO: 2802298 - RNA, 22 nt, Listeria monocytogenes EGD-e
ugaauaagcaauuggaacaucu

SEQ ID NO: 2802299 - RNA, 20 nt, Listeria monocytogenes EGD-e
ugaauagauugcgucacaau

SEQ ID NO: 2802300 - RNA, 20 nt, Listeria monocytogenes EGD-e
ugaauauuagaaaaucauuu

SEQ ID NO: 2802301 - RNA, 22 nt, Listeria monocytogenes EGD-e
ugaauccgaccuuguucacuag

SEQ ID NO: 2802302 - RNA, 16 nt, Listeria monocytogenes EGD-e
ugaauguucuaaaaua

SEQ ID NO: 2802303 - RNA, 18 nt, Listeria monocytogenes EGD-e
ugaauuaagaaguacaau

SEQ ID NO: 2802304 - RNA, 20 nt, Listeria monocytogenes EGD-e
ugaauuaagaaguacaauaa

SEQ ID NO: 2802305 - RNA, 16 nt, Listeria monocytogenes EGD-e
ugacagcaucuuuuuc

SEQ ID NO: 2802306 - RNA, 13 nt, Listeria monocytogenes EGD-e
ugaccaauuucuu

SEQ ID NO: 2802307 - RNA, 20 nt, Listeria monocytogenes EGD-e
ugaccuagccagacaucuuu

SEQ ID NO: 2802308 - RNA, 21 nt, Listeria monocytogenes EGD-e
ugaccuagccagacaucuuug

SEQ ID NO: 2802309 - RNA, 16 nt, Listeria monocytogenes EGD-e
ugacuaaaaagcaacu

SEQ ID NO: 2802310 - RNA, 17 nt, Listeria monocytogenes EGD-e
ugagacguaaagucuca

SEQ ID NO: 2802311 - RNA, 18 nt, Listeria monocytogenes EGD-e
ugagaguuauaaagaaau

SEQ ID NO: 2802312 - RNA, 19 nt, Listeria monocytogenes EGD-e
ugagcaaucguauguuuuu

SEQ ID NO: 2802313 - RNA, 13 nt, Listeria monocytogenes EGD-e
ugagcacuaaugc

SEQ ID NO: 2802314 - RNA, 20 nt, Listeria monocytogenes EGD-e
ugagcgccuucaauuuuauu

SEQ ID NO: 2802315 - RNA, 17 nt, Listeria monocytogenes EGD-e
ugagcuaugugcgaugc

SEQ ID NO: 2802316 - RNA, 12 nt, Listeria monocytogenes EGD-e
ugagcuucuuuu

SEQ ID NO: 2802317 - RNA, 18 nt, Listeria monocytogenes EGD-e
ugagcuucuuuuucgauu

SEQ ID NO: 2802318 - RNA, 18 nt, Listeria monocytogenes EGD-e
ugagugaagauaaacuaa

SEQ ID NO: 2802319 - RNA, 22 nt, Listeria monocytogenes EGD-e
ugauaaggguuuucagcucuuu

SEQ ID NO: 2802320 - RNA, 17 nt, Listeria monocytogenes EGD-e
ugauaucaucaauaaua

SEQ ID NO: 2802321 - RNA, 23 nt, Listeria monocytogenes EGD-e
ugauaugcagguaaaacagcaag

SEQ ID NO: 2802322 - RNA, 23 nt, Listeria monocytogenes EGD-e
ugaucaaucaguucaacuacuuc

SEQ ID NO: 2802323 - RNA, 22 nt, Listeria monocytogenes EGD-e
ugaugacuaacuaguuguaaac

SEQ ID NO: 2802324 - RNA, 22 nt, Listeria monocytogenes EGD-e
ugaugccgacuaguucugcuag

SEQ ID NO: 2802325 - RNA, 16 nt, Listeria monocytogenes EGD-e
ugauguuucguuuucc

SEQ ID NO: 2802326 - RNA, 17 nt, Listeria monocytogenes EGD-e
ugauuaaugauuucaau

SEQ ID NO: 2802327 - RNA, 16 nt, Listeria monocytogenes EGD-e
ugauuacuccaaaaua

SEQ ID NO: 2802328 - RNA, 17 nt, Listeria monocytogenes EGD-e
ugauuaggcauuucuuu

SEQ ID NO: 2802329 - RNA, 11 nt, Listeria monocytogenes EGD-e
ugauucccaca

SEQ ID NO: 2802330 - RNA, 20 nt, Listeria monocytogenes EGD-e
ugauucgucuuagaaaaaug

SEQ ID NO: 2802331 - RNA, 22 nt, Listeria monocytogenes EGD-e
ugauucgucuuagaaaaauguu

SEQ ID NO: 2802332 - RNA, 21 nt, Listeria monocytogenes EGD-e
ugauugguccugcugaaauag

SEQ ID NO: 2802333 - RNA, 13 nt, Listeria monocytogenes EGD-e
ugauuuaauuuaa

SEQ ID NO: 2802334 - RNA, 16 nt, Listeria monocytogenes EGD-e
ugauuucaauaaugug

SEQ ID NO: 2802335 - RNA, 14 nt, Listeria monocytogenes EGD-e
ugauuuguuuuauu

SEQ ID NO: 2802336 - RNA, 15 nt, Listeria monocytogenes EGD-e
ugauuuguuuuauua

SEQ ID NO: 2802337 - RNA, 12 nt, Listeria monocytogenes EGD-e
ugauuuucauua

SEQ ID NO: 2802338 - RNA, 16 nt, Listeria monocytogenes EGD-e
ugauuuuuauuccguu

SEQ ID NO: 2802339 - RNA, 13 nt, Listeria monocytogenes EGD-e
ugauuuuuucuuc

SEQ ID NO: 2802340 - RNA, 18 nt, Listeria monocytogenes EGD-e
ugcaacaguuauuaaaag

SEQ ID NO: 2802341 - RNA, 18 nt, Listeria monocytogenes EGD-e
ugcacagcagaaacuuuc

SEQ ID NO: 2802342 - RNA, 17 nt, Listeria monocytogenes EGD-e
ugcaccugcauuucauu

SEQ ID NO: 2802343 - RNA, 16 nt, Listeria monocytogenes EGD-e
ugcacuuucaaaucag

SEQ ID NO: 2802344 - RNA, 19 nt, Listeria monocytogenes EGD-e
ugcacuuucaaaucagcuu

SEQ ID NO: 2802345 - RNA, 21 nt, Listeria monocytogenes EGD-e
ugcacuuucaaaucagcuucc

SEQ ID NO: 2802346 - RNA, 13 nt, Listeria monocytogenes EGD-e
ugcauaaaaaaca

SEQ ID NO: 2802347 - RNA, 16 nt, Listeria monocytogenes EGD-e
ugcaucuucuaagaaa

SEQ ID NO: 2802348 - RNA, 18 nt, Listeria monocytogenes EGD-e
ugcaucuucuaagaaaaa

SEQ ID NO: 2802349 - RNA, 12 nt, Listeria monocytogenes EGD-e
ugcauuaaaaag

SEQ ID NO: 2802350 - RNA, 19 nt, Listeria monocytogenes EGD-e
ugcauucugugauggaagu

SEQ ID NO: 2802351 - RNA, 15 nt, Listeria monocytogenes EGD-e
ugcauuguuaaauua

SEQ ID NO: 2802352 - RNA, 18 nt, Listeria monocytogenes EGD-e
ugcauuguuaaauuaucc

SEQ ID NO: 2802353 - RNA, 13 nt, Listeria monocytogenes EGD-e
ugcauuuggagaa

SEQ ID NO: 2802354 - RNA, 15 nt, Listeria monocytogenes EGD-e
ugcauuuuuucuuug

SEQ ID NO: 2802355 - RNA, 20 nt, Listeria monocytogenes EGD-e
ugccaaauuggucauauguu

SEQ ID NO: 2802356 - RNA, 14 nt, Listeria monocytogenes EGD-e
ugccacuugaauau

SEQ ID NO: 2802357 - RNA, 16 nt, Listeria monocytogenes EGD-e
ugccaucgcagcagaa

SEQ ID NO: 2802358 - RNA, 20 nt, Listeria monocytogenes EGD-e
ugccaucgccgccuauuauu

SEQ ID NO: 2802359 - RNA, 20 nt, Listeria monocytogenes EGD-e
ugccaucgguacaguagaag

SEQ ID NO: 2802360 - RNA, 17 nt, Listeria monocytogenes EGD-e
ugcccuugauuuaaaua

SEQ ID NO: 2802361 - RNA, 19 nt, Listeria monocytogenes EGD-e
ugcccuugauuuaaauaaa

SEQ ID NO: 2802362 - RNA, 18 nt, Listeria monocytogenes EGD-e
ugccgcgacuauuucgcg

SEQ ID NO: 2802363 - RNA, 13 nt, Listeria monocytogenes EGD-e
ugccuaccaaaac

SEQ ID NO: 2802364 - RNA, 15 nt, Listeria monocytogenes EGD-e
ugccugaaauaauac

SEQ ID NO: 2802365 - RNA, 19 nt, Listeria monocytogenes EGD-e
ugccuucaaacacuucuaa

SEQ ID NO: 2802366 - RNA, 14 nt, Listeria monocytogenes EGD-e
ugcgaaaaaugaaa

SEQ ID NO: 2802367 - RNA, 21 nt, Listeria monocytogenes EGD-e
ugcgaaaaaugaaaagaaaaa

SEQ ID NO: 2802368 - RNA, 15 nt, Listeria monocytogenes EGD-e
ugcgaauaacaagcg

SEQ ID NO: 2802369 - RNA, 18 nt, Listeria monocytogenes EGD-e
ugcgcaacauucaaauca

SEQ ID NO: 2802370 - RNA, 19 nt, Listeria monocytogenes EGD-e
ugcgcaucguugugcuuuc

SEQ ID NO: 2802371 - RNA, 15 nt, Listeria monocytogenes EGD-e
ugcgcgcauggcuag

SEQ ID NO: 2802372 - RNA, 18 nt, Listeria monocytogenes EGD-e
ugcggcauagaaaguaga

SEQ ID NO: 2802373 - RNA, 19 nt, Listeria monocytogenes EGD-e
ugcggcuaauaacauuaaa

SEQ ID NO: 2802374 - RNA, 14 nt, Listeria monocytogenes EGD-e
ugcguaaacuuuug

SEQ ID NO: 2802375 - RNA, 16 nt, Listeria monocytogenes EGD-e
ugcguaaacuuuuguu

SEQ ID NO: 2802376 - RNA, 16 nt, Listeria monocytogenes EGD-e
ugcuaaaauaaaucug

SEQ ID NO: 2802377 - RNA, 20 nt, Listeria monocytogenes EGD-e
ugcuaaaauaaaucugcuuc

SEQ ID NO: 2802378 - RNA, 23 nt, Listeria monocytogenes EGD-e
ugcuaaaggcaacaaagaagaaa

SEQ ID NO: 2802379 - RNA, 15 nt, Listeria monocytogenes EGD-e
ugcuaaaugaauucg

SEQ ID NO: 2802380 - RNA, 17 nt, Listeria monocytogenes EGD-e
ugcuaaauugugaaauu

SEQ ID NO: 2802381 - RNA, 21 nt, Listeria monocytogenes EGD-e
ugcuaacacagcuaccucauu

SEQ ID NO: 2802382 - RNA, 21 nt, Listeria monocytogenes EGD-e
ugcuacuaucaugacuaaaaa

SEQ ID NO: 2802383 - RNA, 16 nt, Listeria monocytogenes EGD-e
ugcucaccuucuuuuu

SEQ ID NO: 2802384 - RNA, 15 nt, Listeria monocytogenes EGD-e
ugcuccauugcccag

SEQ ID NO: 2802385 - RNA, 18 nt, Listeria monocytogenes EGD-e
ugcucccgcgcuaaucuu

SEQ ID NO: 2802386 - RNA, 16 nt, Listeria monocytogenes EGD-e
ugcucgaauucuuuuu

SEQ ID NO: 2802387 - RNA, 15 nt, Listeria monocytogenes EGD-e
ugcugcgccaacaaa

SEQ ID NO: 2802388 - RNA, 11 nt, Listeria monocytogenes EGD-e
ugcuucaaucc

SEQ ID NO: 2802389 - RNA, 18 nt, Listeria monocytogenes EGD-e
uguucuaauaauuuuaau

SEQ ID NO: 2802390 - RNA, 13 nt, Listeria monocytogenes EGD-e
uguucuugccaaa

SEQ ID NO: 2802391 - RNA, 21 nt, Listeria monocytogenes EGD-e
uguugaaaaguaguguauaac

SEQ ID NO: 2802392 - RNA, 16 nt, Listeria monocytogenes EGD-e
uguugcgaaacaacug

SEQ ID NO: 2802393 - RNA, 20 nt, Listeria monocytogenes EGD-e
uguugcuuuuauuuuuaaag

SEQ ID NO: 2802394 - RNA, 18 nt, Listeria monocytogenes EGD-e
uguuguaauuucuuuguc

SEQ ID NO: 2802395 - RNA, 15 nt, Listeria monocytogenes EGD-e
uguuguucuaauaau

SEQ ID NO: 2802396 - RNA, 13 nt, Listeria monocytogenes EGD-e
uguuguucuugcc

SEQ ID NO: 2802397 - RNA, 16 nt, Listeria monocytogenes EGD-e
uguuguucuugccaaa

SEQ ID NO: 2802398 - RNA, 16 nt, Listeria monocytogenes EGD-e
uguuuaaacaucuucc

SEQ ID NO: 2802399 - RNA, 17 nt, Listeria monocytogenes EGD-e
uguuuaaucuaaaucua

SEQ ID NO: 2802400 - RNA, 20 nt, Listeria monocytogenes EGD-e
uguuuacgaacgauuuccgc

SEQ ID NO: 2802401 - RNA, 14 nt, Listeria monocytogenes EGD-e
uguuuagccuuuua

SEQ ID NO: 2802402 - RNA, 15 nt, Listeria monocytogenes EGD-e
uguuuaggauauuuu

SEQ ID NO: 2802403 - RNA, 22 nt, Listeria monocytogenes EGD-e
uguuuaguggagcuauauagaa

SEQ ID NO: 2802404 - RNA, 14 nt, Listeria monocytogenes EGD-e
uguuuauuuaauaa

SEQ ID NO: 2802405 - RNA, 19 nt, Listeria monocytogenes EGD-e
uguuucauauaauuuuuuc

SEQ ID NO: 2802406 - RNA, 14 nt, Listeria monocytogenes EGD-e
uguuucauuuuucc

SEQ ID NO: 2802407 - RNA, 18 nt, Listeria monocytogenes EGD-e
uguuuccaacguuuuaau

SEQ ID NO: 2802408 - RNA, 21 nt, Listeria monocytogenes EGD-e
uguuucgccaauuugcgacaa

SEQ ID NO: 2802409 - RNA, 13 nt, Listeria monocytogenes EGD-e
uguuucuaaucca

SEQ ID NO: 2802410 - RNA, 14 nt, Listeria monocytogenes EGD-e
uguuuguaaaaaua

SEQ ID NO: 2802411 - RNA, 22 nt, Listeria monocytogenes EGD-e
uguuuguaaaaauagcuuuguc

SEQ ID NO: 2802412 - RNA, 13 nt, Listeria monocytogenes EGD-e
uguuuuaauaaau

SEQ ID NO: 2802413 - RNA, 15 nt, Listeria monocytogenes EGD-e
uguuuuaauuucaaa

SEQ ID NO: 2802414 - RNA, 22 nt, Listeria monocytogenes EGD-e
uguuuuagauaaguuaaucauu

SEQ ID NO: 2802415 - RNA, 17 nt, Listeria monocytogenes EGD-e
uguuuucccagaaaaaa

SEQ ID NO: 2802416 - RNA, 18 nt, Listeria monocytogenes EGD-e
uguuuucccagaaaaaaa

SEQ ID NO: 2802417 - RNA, 19 nt, Listeria monocytogenes EGD-e
uguuuucccagaaaaaaac

SEQ ID NO: 2802418 - RNA, 20 nt, Listeria monocytogenes EGD-e
uguuuuuguaggguuuggaa

SEQ ID NO: 2802419 - RNA, 13 nt, Listeria monocytogenes EGD-e
uguuuuuuuuagu

SEQ ID NO: 2802420 - RNA, 17 nt, Listeria monocytogenes EGD-e
uuaaaaaggaauuuuuc

SEQ ID NO: 2802421 - RNA, 15 nt, Listeria monocytogenes EGD-e
uuaaaaauuuugguu

SEQ ID NO: 2802422 - RNA, 22 nt, Listeria monocytogenes EGD-e
uuaaaaauuuugguuuggucaa

SEQ ID NO: 2802423 - RNA, 22 nt, Listeria monocytogenes EGD-e
uuaaaauaguuuuuuucauuaa

SEQ ID NO: 2802424 - RNA, 12 nt, Listeria monocytogenes EGD-e
uuaaacaaacac

SEQ ID NO: 2802425 - RNA, 15 nt, Listeria monocytogenes EGD-e
uuaaacaagcuuugu

SEQ ID NO: 2802426 - RNA, 13 nt, Listeria monocytogenes EGD-e
uuaaaccauaaaa

SEQ ID NO: 2802427 - RNA, 21 nt, Listeria monocytogenes EGD-e
uuaaaccgauaauuuucauuu

SEQ ID NO: 2802428 - RNA, 14 nt, Listeria monocytogenes EGD-e
uuaaagcguuuuuc

SEQ ID NO: 2802429 - RNA, 19 nt, Listeria monocytogenes EGD-e
uuaaagcguuuuucugcau

SEQ ID NO: 2802430 - RNA, 17 nt, Listeria monocytogenes EGD-e
uuaaagcuugauuuaau

SEQ ID NO: 2802431 - RNA, 19 nt, Listeria monocytogenes EGD-e
uuaaagcuugauuuaauug

SEQ ID NO: 2802432 - RNA, 11 nt, Listeria monocytogenes EGD-e
uuaaagguaac

SEQ ID NO: 2802433 - RNA, 19 nt, Listeria monocytogenes EGD-e
uuaaauacgaaaaacauua

SEQ ID NO: 2802434 - RNA, 23 nt, Listeria monocytogenes EGD-e
uuaaauauagucuacuuuuaaaa

SEQ ID NO: 2802435 - RNA, 18 nt, Listeria monocytogenes EGD-e
uuaaauuucccgcuacua

SEQ ID NO: 2802436 - RNA, 16 nt, Listeria monocytogenes EGD-e
uuaacaaccauuuugu

SEQ ID NO: 2802437 - RNA, 18 nt, Listeria monocytogenes EGD-e
uuaacaaccauuuuguuc

SEQ ID NO: 2802438 - RNA, 20 nt, Listeria monocytogenes EGD-e
uuaacaaccauuuuguucuc

SEQ ID NO: 2802439 - RNA, 20 nt, Listeria monocytogenes EGD-e
uuaacauaaaaagcugccac

SEQ ID NO: 2802440 - RNA, 18 nt, Listeria monocytogenes EGD-e
uuaacaucagauuaaaua

SEQ ID NO: 2802441 - RNA, 19 nt, Listeria monocytogenes EGD-e
uuaaguacaauuuucauuu

SEQ ID NO: 2802442 - RNA, 13 nt, Listeria monocytogenes EGD-e
uuaagucugcuuc

SEQ ID NO: 2802443 - RNA, 20 nt, Listeria monocytogenes EGD-e
uuaauacggugaaugccagc

SEQ ID NO: 2802444 - RNA, 19 nt, Listeria monocytogenes EGD-e
uuaaucauuaaccuacuuu

SEQ ID NO: 2802445 - RNA, 19 nt, Listeria monocytogenes EGD-e
uuaaucauugcuuuguguu

SEQ ID NO: 2802446 - RNA, 18 nt, Listeria monocytogenes EGD-e
uuaauccgaauuccacgc

SEQ ID NO: 2802447 - RNA, 16 nt, Listeria monocytogenes EGD-e
uuaaucugauuaaaag

SEQ ID NO: 2802448 - RNA, 13 nt, Listeria monocytogenes EGD-e
uuaaucuuacauu

SEQ ID NO: 2802449 - RNA, 22 nt, Listeria monocytogenes EGD-e
uuaaugacuguuguuucauaua

SEQ ID NO: 2802450 - RNA, 19 nt, Listeria monocytogenes EGD-e
uuaaugcgaaaaaugaaaa

SEQ ID NO: 2802451 - RNA, 14 nt, Listeria monocytogenes EGD-e
uuaauugucauaaa

SEQ ID NO: 2802452 - RNA, 21 nt, Listeria monocytogenes EGD-e
uuaauuuccauuucgauaacu

SEQ ID NO: 2802453 - RNA, 22 nt, Listeria monocytogenes EGD-e
uuaauuucuggguguuuauuca

SEQ ID NO: 2802454 - RNA, 22 nt, Listeria monocytogenes EGD-e
uuaauuuuccgcagcuucaauc

SEQ ID NO: 2802455 - RNA, 22 nt, Listeria monocytogenes EGD-e
uuacaaaaguggaaauguucca

SEQ ID NO: 2802456 - RNA, 19 nt, Listeria monocytogenes EGD-e
uuacauaauucauugacaa

SEQ ID NO: 2802457 - RNA, 23 nt, Listeria monocytogenes EGD-e
uuacauauuccaaaaucgcaucc

SEQ ID NO: 2802458 - RNA, 15 nt, Listeria monocytogenes EGD-e
uuacauuuuugcuug

SEQ ID NO: 2802459 - RNA, 16 nt, Listeria monocytogenes EGD-e
uuaccuaaugaauaag

SEQ ID NO: 2802460 - RNA, 19 nt, Listeria monocytogenes EGD-e
uuaccuugaucaaaauuca

SEQ ID NO: 2802461 - RNA, 17 nt, Listeria monocytogenes EGD-e
uuacguuucacuuuauc

SEQ ID NO: 2802462 - RNA, 14 nt, Listeria monocytogenes EGD-e
uuacuaaaaaggua

SEQ ID NO: 2802463 - RNA, 14 nt, Listeria monocytogenes EGD-e
uuacucccuuuuuc

SEQ ID NO: 2802464 - RNA, 22 nt, Listeria monocytogenes EGD-e
uuacugcaaucauuuauuuucc

SEQ ID NO: 2802465 - RNA, 15 nt, Listeria monocytogenes EGD-e
uuacuucaccaguaa

SEQ ID NO: 2802466 - RNA, 12 nt, Listeria monocytogenes EGD-e
uuacuuccauga

SEQ ID NO: 2802467 - RNA, 21 nt, Listeria monocytogenes EGD-e
uuacuugauagagcugagccu

SEQ ID NO: 2802468 - RNA, 14 nt, Listeria monocytogenes EGD-e
uuagaaauauguuu

SEQ ID NO: 2802469 - RNA, 21 nt, Listeria monocytogenes EGD-e
uuagaagaugcacuagaaaaa

SEQ ID NO: 2802470 - RNA, 20 nt, Listeria monocytogenes EGD-e
uuagaggcguacuaaaaauu

SEQ ID NO: 2802471 - RNA, 18 nt, Listeria monocytogenes EGD-e
uuagguuagcagcuuuug

SEQ ID NO: 2802472 - RNA, 12 nt, Listeria monocytogenes EGD-e
uuaguaaacauu

SEQ ID NO: 2802473 - RNA, 15 nt, Listeria monocytogenes EGD-e
uuaguggagcucuuu

SEQ ID NO: 2802474 - RNA, 12 nt, Listeria monocytogenes EGD-e
uuauaaaaauac

SEQ ID NO: 2802475 - RNA, 16 nt, Listeria monocytogenes EGD-e
uuauaaaagcuucuau

SEQ ID NO: 2802476 - RNA, 23 nt, Listeria monocytogenes EGD-e
uuauaaacguuccaguuaaacaa

SEQ ID NO: 2802477 - RNA, 14 nt, Listeria monocytogenes EGD-e
uuauaaagaaauaa

SEQ ID NO: 2802478 - RNA, 18 nt, Listeria monocytogenes EGD-e
uuauaaagaaauaacuac

SEQ ID NO: 2802479 - RNA, 20 nt, Listeria monocytogenes EGD-e
uuauaacucucauaagagaa

SEQ ID NO: 2802480 - RNA, 19 nt, Listeria monocytogenes EGD-e
uuauaaguguaaaaguuaa

SEQ ID NO: 2802481 - RNA, 12 nt, Listeria monocytogenes EGD-e
uuauaauuuaau

SEQ ID NO: 2802482 - RNA, 13 nt, Listeria monocytogenes EGD-e
uuauagcguacau

SEQ ID NO: 2802483 - RNA, 16 nt, Listeria monocytogenes EGD-e
uuauaguuuucuacua

SEQ ID NO: 2802484 - RNA, 22 nt, Listeria monocytogenes EGD-e
uuauauagaaggaauuugccaa

SEQ ID NO: 2802485 - RNA, 18 nt, Listeria monocytogenes EGD-e
uuaucaggcuauaacaaa

SEQ ID NO: 2802486 - RNA, 16 nt, Listeria monocytogenes EGD-e
uuaucauccacgaguu

SEQ ID NO: 2802487 - RNA, 19 nt, Listeria monocytogenes EGD-e
uuauccaguguaaucuuga

SEQ ID NO: 2802488 - RNA, 20 nt, Listeria monocytogenes EGD-e
uuauccaguguaaucuugau

SEQ ID NO: 2802489 - RNA, 17 nt, Listeria monocytogenes EGD-e
uuauccuguaauucgaa

SEQ ID NO: 2802490 - RNA, 17 nt, Listeria monocytogenes EGD-e
uucucuccaaucagcaa

SEQ ID NO: 2802491 - RNA, 14 nt, Listeria monocytogenes EGD-e
uucucuuaugagag

SEQ ID NO: 2802492 - RNA, 20 nt, Listeria monocytogenes EGD-e
uucugcuuugccgcgacuau

SEQ ID NO: 2802493 - RNA, 14 nt, Listeria monocytogenes EGD-e
uucuggcuggcagu

SEQ ID NO: 2802494 - RNA, 15 nt, Listeria monocytogenes EGD-e
uucugucacaucugu

SEQ ID NO: 2802495 - RNA, 21 nt, Listeria monocytogenes EGD-e
uucuguuaaaugauuuuuauc

SEQ ID NO: 2802496 - RNA, 18 nt, Listeria monocytogenes EGD-e
uucuguuaacauuuccaa

SEQ ID NO: 2802497 - RNA, 17 nt, Listeria monocytogenes EGD-e
uucuuaguuaauucuuu

SEQ ID NO: 2802498 - RNA, 21 nt, Listeria monocytogenes EGD-e
uucuuaguuaauucuuuuucu

SEQ ID NO: 2802499 - RNA, 20 nt, Listeria monocytogenes EGD-e
uucuucagacgcaauuucaa

SEQ ID NO: 2802500 - RNA, 17 nt, Listeria monocytogenes EGD-e
uucuuccauuaaucucg

SEQ ID NO: 2802501 - RNA, 14 nt, Listeria monocytogenes EGD-e
uucuuccauuuguu

SEQ ID NO: 2802502 - RNA, 16 nt, Listeria monocytogenes EGD-e
uucuuccauuuguucu

SEQ ID NO: 2802503 - RNA, 13 nt, Listeria monocytogenes EGD-e
uucuucuaaaaua

SEQ ID NO: 2802504 - RNA, 14 nt, Listeria monocytogenes EGD-e
uucuucuaauacau

SEQ ID NO: 2802505 - RNA, 13 nt, Listeria monocytogenes EGD-e
uucuugauuuguu

SEQ ID NO: 2802506 - RNA, 17 nt, Listeria monocytogenes EGD-e
uucuugauuuguuuuau

SEQ ID NO: 2802507 - RNA, 11 nt, Listeria monocytogenes EGD-e
uucuugccaaa

SEQ ID NO: 2802508 - RNA, 16 nt, Listeria monocytogenes EGD-e
uucuuguugaauaaca

SEQ ID NO: 2802509 - RNA, 17 nt, Listeria monocytogenes EGD-e
uucuuuacauauuccaa

SEQ ID NO: 2802510 - RNA, 24 nt, Listeria monocytogenes EGD-e
uucuuuacauauuccaaaaucgca

SEQ ID NO: 2802511 - RNA, 19 nt, Listeria monocytogenes EGD-e
uucuuuauaacucucauaa

SEQ ID NO: 2802512 - RNA, 17 nt, Listeria monocytogenes EGD-e
uucuuugccuuaaaaua

SEQ ID NO: 2802513 - RNA, 19 nt, Listeria monocytogenes EGD-e
uucuuuuacggcuucaaug

SEQ ID NO: 2802514 - RNA, 22 nt, Listeria monocytogenes EGD-e
uucuuuuccuaauuuuacuucu

SEQ ID NO: 2802515 - RNA, 21 nt, Listeria monocytogenes EGD-e
uugaaaacugaacaaagaaga

SEQ ID NO: 2802516 - RNA, 23 nt, Listeria monocytogenes EGD-e
uugaaaacugaacaaagaagaag

SEQ ID NO: 2802517 - RNA, 21 nt, Listeria monocytogenes EGD-e
uugaauagaacuauaaccaaa

SEQ ID NO: 2802518 - RNA, 15 nt, Listeria monocytogenes EGD-e
uugaauugauuuuuu

SEQ ID NO: 2802519 - RNA, 22 nt, Listeria monocytogenes EGD-e
uugacuaccaccuugaauccga

SEQ ID NO: 2802520 - RNA, 16 nt, Listeria monocytogenes EGD-e
uugagcgguuuuguuu

SEQ ID NO: 2802521 - RNA, 22 nt, Listeria monocytogenes EGD-e
uugagucgcuauucuauuuauc

SEQ ID NO: 2802522 - RNA, 16 nt, Listeria monocytogenes EGD-e
uugauaccaaauugua

SEQ ID NO: 2802523 - RNA, 18 nt, Listeria monocytogenes EGD-e
uugauaggcucuuccuuu

SEQ ID NO: 2802524 - RNA, 19 nt, Listeria monocytogenes EGD-e
uugauauccaguauuuccc

SEQ ID NO: 2802525 - RNA, 14 nt, Listeria monocytogenes EGD-e
uugauccaaguuuu

SEQ ID NO: 2802526 - RNA, 18 nt, Listeria monocytogenes EGD-e
uugaugcgaaaaaugaaa

SEQ ID NO: 2802527 - RNA, 15 nt, Listeria monocytogenes EGD-e
uugauguuuuugcuu

SEQ ID NO: 2802528 - RNA, 18 nt, Listeria monocytogenes EGD-e
uugauguuuuugcuucuc

SEQ ID NO: 2802529 - RNA, 15 nt, Listeria monocytogenes EGD-e
uugauuaaaaccaac

SEQ ID NO: 2802530 - RNA, 19 nt, Listeria monocytogenes EGD-e
uugauucgucuuagaaaaa

SEQ ID NO: 2802531 - RNA, 11 nt, Listeria monocytogenes EGD-e
uugauuuaaau

SEQ ID NO: 2802532 - RNA, 20 nt, Listeria monocytogenes EGD-e
uugauuuaaauaaacaaauu

SEQ ID NO: 2802533 - RNA, 16 nt, Listeria monocytogenes EGD-e
uugauuuguuuuauua

SEQ ID NO: 2802534 - RNA, 23 nt, Listeria monocytogenes EGD-e
uugcaacaguuauuaaaaggaca

SEQ ID NO: 2802535 - RNA, 17 nt, Listeria monocytogenes EGD-e
uugcacugcaccuaaua

SEQ ID NO: 2802536 - RNA, 13 nt, Listeria monocytogenes EGD-e
uugcagaaacaau

SEQ ID NO: 2802537 - RNA, 23 nt, Listeria monocytogenes EGD-e
uugcugcuaaaggcaacaaagaa

SEQ ID NO: 2802538 - RNA, 22 nt, Listeria monocytogenes EGD-e
uugcugcucgcucaucaucaac

SEQ ID NO: 2802539 - RNA, 22 nt, Listeria monocytogenes EGD-e
uugcuucuccguuuuccaccau

SEQ ID NO: 2802540 - RNA, 21 nt, Listeria monocytogenes EGD-e
uugcuucuuccauaucaccaa

SEQ ID NO: 2802541 - RNA, 18 nt, Listeria monocytogenes EGD-e
uugcuuguguaacauaaa

SEQ ID NO: 2802542 - RNA, 19 nt, Listeria monocytogenes EGD-e
uugcuuuaauuuggaaaua

SEQ ID NO: 2802543 - RNA, 21 nt, Listeria monocytogenes EGD-e
uugcuuuaauuuggaaauaau

SEQ ID NO: 2802544 - RNA, 14 nt, Listeria monocytogenes EGD-e
uuggaaaagagaaa

SEQ ID NO: 2802545 - RNA, 17 nt, Listeria monocytogenes EGD-e
uuggaaaagagaaaaag

SEQ ID NO: 2802546 - RNA, 22 nt, Listeria monocytogenes EGD-e
uuggaaaaucggucaauugcau

SEQ ID NO: 2802547 - RNA, 21 nt, Listeria monocytogenes EGD-e
uuggaacggcuuuauccccua

SEQ ID NO: 2802548 - RNA, 13 nt, Listeria monocytogenes EGD-e
uuggaagugaaaa

SEQ ID NO: 2802549 - RNA, 21 nt, Listeria monocytogenes EGD-e
uuggacgauuggaucuuccau

SEQ ID NO: 2802550 - RNA, 14 nt, Listeria monocytogenes EGD-e
uuggagaaauggau

SEQ ID NO: 2802551 - RNA, 14 nt, Listeria monocytogenes EGD-e
uuggaucuuccauc

SEQ ID NO: 2802552 - RNA, 14 nt, Listeria monocytogenes EGD-e
uuggauuauucaau

SEQ ID NO: 2802553 - RNA, 19 nt, Listeria monocytogenes EGD-e
uuggccuucgauaguuccu

SEQ ID NO: 2802554 - RNA, 13 nt, Listeria monocytogenes EGD-e
uugggagcuuucu

SEQ ID NO: 2802555 - RNA, 15 nt, Listeria monocytogenes EGD-e
uugguacuugugaaa

SEQ ID NO: 2802556 - RNA, 17 nt, Listeria monocytogenes EGD-e
uugguaguuuuaaauuu

SEQ ID NO: 2802557 - RNA, 18 nt, Listeria monocytogenes EGD-e
uuggugugggcaguccac

SEQ ID NO: 2802558 - RNA, 15 nt, Listeria monocytogenes EGD-e
uugguuuaauuuccu

SEQ ID NO: 2802559 - RNA, 21 nt, Listeria monocytogenes EGD-e
uuguaaaaauagcuuugucuu

SEQ ID NO: 2802560 - RNA, 15 nt, Listeria monocytogenes EGD-e
uuguaacaacuaauu

SEQ ID NO: 2802561 - RNA, 18 nt, Listeria monocytogenes EGD-e
uuguaauuucuuugucgc

SEQ ID NO: 2802562 - RNA, 14 nt, Listeria monocytogenes EGD-e
uuguacauaaaagc

SEQ ID NO: 2802563 - RNA, 17 nt, Listeria monocytogenes EGD-e
uuguaggguuuggaaaa

SEQ ID NO: 2802564 - RNA, 19 nt, Listeria monocytogenes EGD-e
uuguauagcuuaaagguuu

SEQ ID NO: 2802565 - RNA, 15 nt, Listeria monocytogenes EGD-e
uugucauaaaacuuu

SEQ ID NO: 2802566 - RNA, 13 nt, Listeria monocytogenes EGD-e
uugucaucauaaa

SEQ ID NO: 2802567 - RNA, 16 nt, Listeria monocytogenes EGD-e
uugucaucauaaacau

SEQ ID NO: 2802568 - RNA, 17 nt, Listeria monocytogenes EGD-e
uugucccaagauucuuc

SEQ ID NO: 2802569 - RNA, 20 nt, Listeria monocytogenes EGD-e
uugucuucggauuuuucaaa

SEQ ID NO: 2802570 - RNA, 14 nt, Listeria monocytogenes EGD-e
uugugaaaguuuua

SEQ ID NO: 2802571 - RNA, 18 nt, Listeria monocytogenes EGD-e
uugugcuaaaucugccau

SEQ ID NO: 2802572 - RNA, 17 nt, Listeria monocytogenes EGD-e
uugugcuaaguagacaa

SEQ ID NO: 2802573 - RNA, 13 nt, Listeria monocytogenes EGD-e
uuguguaacauaa

SEQ ID NO: 2802574 - RNA, 21 nt, Listeria monocytogenes EGD-e
uuguguaaguguuucuagauu

SEQ ID NO: 2802575 - RNA, 14 nt, Listeria monocytogenes EGD-e
uuguuaaauuaucc

SEQ ID NO: 2802576 - RNA, 23 nt, Listeria monocytogenes EGD-e
uuguuccaacauaauauauggga

SEQ ID NO: 2802577 - RNA, 11 nt, Listeria monocytogenes EGD-e
uuguucuggua

SEQ ID NO: 2802578 - RNA, 12 nt, Listeria monocytogenes EGD-e
uuguuucuaauc

SEQ ID NO: 2802579 - RNA, 19 nt, Listeria monocytogenes EGD-e
uuguuuucaggaagauauc

SEQ ID NO: 2802580 - RNA, 12 nt, Listeria monocytogenes EGD-e
uuguuuuccuuu

SEQ ID NO: 2802581 - RNA, 11 nt, Listeria monocytogenes EGD-e
uuguuuuguua

SEQ ID NO: 2802582 - RNA, 20 nt, Listeria monocytogenes EGD-e
uuuaaauuucccgcuacuau

SEQ ID NO: 2802583 - RNA, 21 nt, Listeria monocytogenes EGD-e
uuuaacaucagauuaaauaua

SEQ ID NO: 2802584 - RNA, 22 nt, Listeria monocytogenes EGD-e
uuuaacuuucuuguuucauaua

SEQ ID NO: 2802585 - RNA, 22 nt, Listeria monocytogenes EGD-e
uuuaagucgaaagaauaaaaca

SEQ ID NO: 2802586 - RNA, 22 nt, Listeria monocytogenes EGD-e
uuuaagugcugcgccaacaaaa

SEQ ID NO: 2802587 - RNA, 18 nt, Listeria monocytogenes EGD-e
uuuaauaaaucauaauaa

SEQ ID NO: 2802588 - RNA, 15 nt, Listeria monocytogenes EGD-e
uuuaauaagcuugca

SEQ ID NO: 2802589 - RNA, 23 nt, Listeria monocytogenes EGD-e
uuuaauaauuaagaccuucuuuu

SEQ ID NO: 2802590 - RNA, 12 nt, Listeria monocytogenes EGD-e
uuuaaucuaaau

SEQ ID NO: 2802591 - RNA, 20 nt, Listeria monocytogenes EGD-e
uuuuacguaauaggauuuua

SEQ ID NO: 2802592 - RNA, 21 nt, Listeria monocytogenes EGD-e
uuuuacguaauaggauuuuac

SEQ ID NO: 2802593 - RNA, 19 nt, Listeria monocytogenes EGD-e
uuuuauaauuaacaaccau

SEQ ID NO: 2802594 - RNA, 12 nt, Listeria monocytogenes EGD-e
uuuuauaccauu

SEQ ID NO: 2802595 - RNA, 22 nt, Listeria monocytogenes EGD-e
uuuuaucuggcaguuuuucaau

SEQ ID NO: 2802596 - RNA, 21 nt, Listeria monocytogenes EGD-e
uuuuaugaaaaaaaauaaaug

SEQ ID NO: 2802597 - RNA, 23 nt, Listeria monocytogenes EGD-e
uuuuaugaaaaaaaauaaaugca

SEQ ID NO: 2802598 - RNA, 18 nt, Listeria monocytogenes EGD-e
uuuuaugacaauuaaaaa

SEQ ID NO: 2802599 - RNA, 15 nt, Listeria monocytogenes EGD-e
uuuuaugcauaaaaa

SEQ ID NO: 2802600 - RNA, 17 nt, Listeria monocytogenes EGD-e
uuuuaugcauaaaaaag

SEQ ID NO: 2802601 - RNA, 15 nt, Listeria monocytogenes EGD-e
uuuuauguuauaaau

SEQ ID NO: 2802602 - RNA, 14 nt, Listeria monocytogenes EGD-e
uuuuauuauauuuu

SEQ ID NO: 2802603 - RNA, 21 nt, Listeria monocytogenes EGD-e
uuuuauucgaauaaagaacuu

SEQ ID NO: 2802604 - RNA, 20 nt, Listeria monocytogenes EGD-e
uuuuauugcacuauuugguu

SEQ ID NO: 2802605 - RNA, 15 nt, Listeria monocytogenes EGD-e
uuuuauuuaaucauu

SEQ ID NO: 2802606 - RNA, 21 nt, Listeria monocytogenes EGD-e
uuuuauuuugcggaaauauca

SEQ ID NO: 2802607 - RNA, 14 nt, Listeria monocytogenes EGD-e
uuuuauuuuuaaag

SEQ ID NO: 2802608 - RNA, 23 nt, Listeria monocytogenes EGD-e
uuuuauuuuucagcuaaauauuu

SEQ ID NO: 2802609 - RNA, 18 nt, Listeria monocytogenes EGD-e
uuuuauuuuuuuauaauu

SEQ ID NO: 2802610 - RNA, 12 nt, Listeria monocytogenes EGD-e
uuuucaaaauca

SEQ ID NO: 2802611 - RNA, 14 nt, Listeria monocytogenes EGD-e
uuuucaacaaaaca

SEQ ID NO: 2802612 - RNA, 21 nt, Listeria monocytogenes EGD-e
uuuucaacgauagauuuuaau

SEQ ID NO: 2802613 - RNA, 16 nt, Listeria monocytogenes EGD-e
uuuucaaguaaaaaca

SEQ ID NO: 2802614 - RNA, 21 nt, Listeria monocytogenes EGD-e
uuuucagcuaaauauuuaauu

SEQ ID NO: 2802615 - RNA, 16 nt, Listeria monocytogenes EGD-e
uuuucauuuguuucuu

SEQ ID NO: 2802616 - RNA, 12 nt, Listeria monocytogenes EGD-e
uuuuccaaaaug

SEQ ID NO: 2802617 - RNA, 22 nt, Listeria monocytogenes EGD-e
uuuuccacacugguuuuuugau

SEQ ID NO: 2802618 - RNA, 14 nt, Listeria monocytogenes EGD-e
uuuuccuagaacua

SEQ ID NO: 2802619 - RNA, 21 nt, Listeria monocytogenes EGD-e
uuuucgauauuuuuuuguucu

SEQ ID NO: 2802620 - RNA, 17 nt, Listeria monocytogenes EGD-e
uuuucuaaucaaaugca

SEQ ID NO: 2802621 - RNA, 20 nt, Listeria monocytogenes EGD-e
uuuucucaggaguuaauucu

SEQ ID NO: 2802622 - RNA, 20 nt, Listeria monocytogenes EGD-e
uuuucuuccaccgcuuguuu

SEQ ID NO: 2802623 - RNA, 18 nt, Listeria monocytogenes EGD-e
uuuucuuccauauuuucu

SEQ ID NO: 2802624 - RNA, 14 nt, Listeria monocytogenes EGD-e
uuuugaaaaaacau

SEQ ID NO: 2802625 - RNA, 14 nt, Listeria monocytogenes EGD-e
uuuugagauaauca

SEQ ID NO: 2802626 - RNA, 23 nt, Listeria monocytogenes EGD-e
uuuugagauaaucaagauuuugu

SEQ ID NO: 2802627 - RNA, 18 nt, Listeria monocytogenes EGD-e
uuuugaugcgaaaaauga

SEQ ID NO: 2802628 - RNA, 20 nt, Listeria monocytogenes EGD-e
uuuugaugcgaaaaaugaaa

SEQ ID NO: 2802629 - RNA, 21 nt, Listeria monocytogenes EGD-e
uuuugaugcgaaaaaugaaaa

SEQ ID NO: 2802630 - RNA, 21 nt, Listeria monocytogenes EGD-e
uuuugauucaagucuggauuu

SEQ ID NO: 2802631 - RNA, 16 nt, Listeria monocytogenes EGD-e
uuuugcacaaaaugca

SEQ ID NO: 2802632 - RNA, 21 nt, Listeria monocytogenes EGD-e
uuuugcucaguaguucuuuua

SEQ ID NO: 2802633 - RNA, 12 nt, Listeria monocytogenes EGD-e
uuuugcugauuu

SEQ ID NO: 2802634 - RNA, 13 nt, Listeria monocytogenes EGD-e
uuuugcuucuucc

SEQ ID NO: 2802635 - RNA, 12 nt, Listeria monocytogenes EGD-e
uuuuggaaaauc

SEQ ID NO: 2802636 - RNA, 23 nt, Listeria monocytogenes EGD-e
uuuugguuauuucuuuaucuuuc

SEQ ID NO: 2802637 - RNA, 22 nt, Listeria monocytogenes EGD-e
uuuuguaauaccgagaucuugc

SEQ ID NO: 2802638 - RNA, 14 nt, Listeria monocytogenes EGD-e
uuuuguauugguuu

SEQ ID NO: 2802639 - RNA, 13 nt, Listeria monocytogenes EGD-e
uuuuguccaaccu

SEQ ID NO: 2802640 - RNA, 20 nt, Listeria monocytogenes EGD-e
uuuugucgauaguucacugu

SEQ ID NO: 2802641 - RNA, 21 nt, Listeria monocytogenes EGD-e
uuuuguucgggcgaauaacca

SEQ ID NO: 2802642 - RNA, 12 nt, Listeria monocytogenes EGD-e
uuuuguugaacu

SEQ ID NO: 2802643 - RNA, 12 nt, Listeria monocytogenes EGD-e
uuuuuaugcaua

SEQ ID NO: 2802644 - RNA, 13 nt, Listeria monocytogenes EGD-e
uuuuucaaaauca

SEQ ID NO: 2802645 - RNA, 24 nt, Listeria monocytogenes EGD-e
uuuuucauuaauuuguccuuccuc

SEQ ID NO: 2802646 - RNA, 23 nt, Listeria monocytogenes EGD-e
uuuuucgauuggcgauucuucaa

SEQ ID NO: 2802647 - RNA, 16 nt, Listeria monocytogenes EGD-e
uuuuugaaaaaacauc

SEQ ID NO: 2802648 - RNA, 15 nt, Listeria monocytogenes EGD-e
uuuuugaguuggaau

SEQ ID NO: 2802649 - RNA, 18 nt, Listeria monocytogenes EGD-e
uuuuuguuuuauuuggga

SEQ ID NO: 2802650 - RNA, 13 nt, Listeria monocytogenes EGD-e
uuuuuguuuugcu

SEQ ID NO: 2802651 - RNA, 21 nt, Listeria monocytogenes EGD-e
uuuuuuauacgccuuugcaag

SEQ ID NO: 2802652 - RNA, 21 nt, Listeria monocytogenes EGD-e
uuuuuuaugaucuuuucgcaa

SEQ ID NO: 2802653 - RNA, 13 nt, Listeria monocytogenes EGD-e
uuuuuuauuaucc

SEQ ID NO: 2802654 - RNA, 13 nt, Listeria monocytogenes EGD-e
uuuuuuauuuaau

SEQ ID NO: 2802655 - RNA, 13 nt, Listeria monocytogenes EGD-e
uuuuuuauuuuuu

SEQ ID NO: 2802656 - RNA, 17 nt, Listeria monocytogenes EGD-e
uuuuuugaaaaaacauc

SEQ ID NO: 2802657 - RNA, 20 nt, Listeria monocytogenes EGD-e
uuuuuugaugcgaaaaauga

SEQ ID NO: 2802658 - RNA, 16 nt, Listeria monocytogenes EGD-e
uuuuuuguugucaaug

SEQ ID NO: 2802659 - RNA, 13 nt, Listeria monocytogenes EGD-e
uuuuuuuaugcau

SEQ ID NO: 2802660 - RNA, 20 nt, Listeria monocytogenes EGD-e
uuuuuuucuuagaagaugca

SEQ ID NO: 2802661 - RNA, 19 nt, Listeria monocytogenes EGD-e
uuuuuuucuuuaaaaucca

SEQ ID NO: 2802662 - RNA, 12 nt, Listeria monocytogenes EGD-e
aaaaaaacaaau

SEQ ID NO: 2802663 - RNA, 11 nt, Listeria monocytogenes EGD-e
aaaaaaaguua

SEQ ID NO: 2802664 - RNA, 22 nt, Listeria monocytogenes EGD-e
aaaaaacagaaacgcuuuguuu

SEQ ID NO: 2802665 - RNA, 18 nt, Listeria monocytogenes EGD-e
aaaaaacaucuugacuuu

SEQ ID NO: 2802666 - RNA, 12 nt, Listeria monocytogenes EGD-e
aaaaaagcacuc

SEQ ID NO: 2802667 - RNA, 19 nt, Listeria monocytogenes EGD-e
aaaaacaguauuccucaau

SEQ ID NO: 2802668 - RNA, 16 nt, Listeria monocytogenes EGD-e
aaaaacaguuucuuua

SEQ ID NO: 2802669 - RNA, 17 nt, Listeria monocytogenes EGD-e
aaaaacaugauauauuu

SEQ ID NO: 2802670 - RNA, 17 nt, Listeria monocytogenes EGD-e
aaaaacccgaauaacuc

SEQ ID NO: 2802671 - RNA, 15 nt, Listeria monocytogenes EGD-e
aaaaacuguuguucu

SEQ ID NO: 2802672 - RNA, 17 nt, Listeria monocytogenes EGD-e
aaaaagauuauggaaaa

SEQ ID NO: 2802673 - RNA, 15 nt, Listeria monocytogenes EGD-e
aaaaagcaacucuuu

SEQ ID NO: 2802674 - RNA, 20 nt, Listeria monocytogenes EGD-e
aaaaagcacucgucuaaaaa

SEQ ID NO: 2802675 - RNA, 23 nt, Listeria monocytogenes EGD-e
aaaaagcacucgucuaaaaaaua

SEQ ID NO: 2802676 - RNA, 12 nt, Listeria monocytogenes EGD-e
aaaaagcuuauu

SEQ ID NO: 2802677 - RNA, 19 nt, Listeria monocytogenes EGD-e
aaaaagcuuauuaaacaua

SEQ ID NO: 2802678 - RNA, 15 nt, Listeria monocytogenes EGD-e
aaaaaggaauugcuu

SEQ ID NO: 2802679 - RNA, 23 nt, Listeria monocytogenes EGD-e
aaaaagguauccuuauuaauagu

SEQ ID NO: 2802680 - RNA, 17 nt, Listeria monocytogenes EGD-e
aaaaauaaauaggccca

SEQ ID NO: 2802681 - RNA, 12 nt, Listeria monocytogenes EGD-e
aaaaauaagucc

SEQ ID NO: 2802682 - RNA, 17 nt, Listeria monocytogenes EGD-e
aaaaauaauaucuucua

SEQ ID NO: 2802683 - RNA, 13 nt, Listeria monocytogenes EGD-e
aaaaauaaucacg

SEQ ID NO: 2802684 - RNA, 17 nt, Listeria monocytogenes EGD-e
aaaaauacguaucuuau

SEQ ID NO: 2802685 - RNA, 20 nt, Listeria monocytogenes EGD-e
aaaaauagcuuugucuuaaa

SEQ ID NO: 2802686 - RNA, 16 nt, Listeria monocytogenes EGD-e
aaaaauaugcuugcaa

SEQ ID NO: 2802687 - RNA, 14 nt, Listeria monocytogenes EGD-e
aaaaauauugaaua

SEQ ID NO: 2802688 - RNA, 13 nt, Listeria monocytogenes EGD-e
aaaaaucauuaaa

SEQ ID NO: 2802689 - RNA, 18 nt, Listeria monocytogenes EGD-e
aaaaaucauuaaauuuag

SEQ ID NO: 2802690 - RNA, 16 nt, Listeria monocytogenes EGD-e
aaaaaugaaaagaaaa

SEQ ID NO: 2802691 - RNA, 17 nt, Listeria monocytogenes EGD-e
aaaaaugauucuaguuu

SEQ ID NO: 2802692 - RNA, 23 nt, Listeria monocytogenes EGD-e
aaaaaugauucuaguuuguccca

SEQ ID NO: 2802693 - RNA, 15 nt, Listeria monocytogenes EGD-e
aaaaaugcagaaaau

SEQ ID NO: 2802694 - RNA, 19 nt, Listeria monocytogenes EGD-e
aaaacaaaagauagacaca

SEQ ID NO: 2802695 - RNA, 22 nt, Listeria monocytogenes EGD-e
aaaacaaauuugccaaagagaa

SEQ ID NO: 2802696 - RNA, 23 nt, Listeria monocytogenes EGD-e
aaaacaagaggcuuauuccucca

SEQ ID NO: 2802697 - RNA, 17 nt, Listeria monocytogenes EGD-e
aaaacaaggaagaauag

SEQ ID NO: 2802698 - RNA, 20 nt, Listeria monocytogenes EGD-e
aaaacaaggaagaauaguac

SEQ ID NO: 2802699 - RNA, 23 nt, Listeria monocytogenes EGD-e
aaaacagaaagcuguuuucaaca

SEQ ID NO: 2802700 - RNA, 15 nt, Listeria monocytogenes EGD-e
aaaacaguuucuuua

SEQ ID NO: 2802701 - RNA, 19 nt, Listeria monocytogenes EGD-e
aaaacauuauuuugcuaaa

SEQ ID NO: 2802702 - RNA, 21 nt, Listeria monocytogenes EGD-e
aaaacauuuucauucuuuccc

SEQ ID NO: 2802703 - RNA, 16 nt, Listeria monocytogenes EGD-e
aaaaccaacaaucgua

SEQ ID NO: 2802704 - RNA, 20 nt, Listeria monocytogenes EGD-e
aaaaccaguaaaacaagagg

SEQ ID NO: 2802705 - RNA, 21 nt, Listeria monocytogenes EGD-e
aaaaccauucaucuaauuuag

SEQ ID NO: 2802706 - RNA, 16 nt, Listeria monocytogenes EGD-e
aaaaccgagaaaucuc

SEQ ID NO: 2802707 - RNA, 17 nt, Listeria monocytogenes EGD-e
aaaacggaucuuucuca

SEQ ID NO: 2802708 - RNA, 13 nt, Listeria monocytogenes EGD-e
aaaacuaaaacga

SEQ ID NO: 2802709 - RNA, 15 nt, Listeria monocytogenes EGD-e
aaaacugaacaaaga

SEQ ID NO: 2802710 - RNA, 16 nt, Listeria monocytogenes EGD-e
aaaacugaacaaagaa

SEQ ID NO: 2802711 - RNA, 14 nt, Listeria monocytogenes EGD-e
aaaagaaaaaacaa

SEQ ID NO: 2802712 - RNA, 22 nt, Listeria monocytogenes EGD-e
aaaagguauccuuauuaauagu

SEQ ID NO: 2802713 - RNA, 22 nt, Listeria monocytogenes EGD-e
aaaaguaacauagcuacaauua

SEQ ID NO: 2802714 - RNA, 17 nt, Listeria monocytogenes EGD-e
aaaagucaugacagcau

SEQ ID NO: 2802715 - RNA, 19 nt, Listeria monocytogenes EGD-e
aaaagucaugacagcaucu

SEQ ID NO: 2802716 - RNA, 17 nt, Listeria monocytogenes EGD-e
aaaagugaccuuugaaa

SEQ ID NO: 2802717 - RNA, 19 nt, Listeria monocytogenes EGD-e
aaaaguuaagaagcggaag

SEQ ID NO: 2802718 - RNA, 21 nt, Listeria monocytogenes EGD-e
aaaaguugaccgcaaauagag

SEQ ID NO: 2802719 - RNA, 24 nt, Listeria monocytogenes EGD-e
aaaaguuucaauuucgccguugga

SEQ ID NO: 2802720 - RNA, 20 nt, Listeria monocytogenes EGD-e
aaaaguuugggcauuacgaa

SEQ ID NO: 2802721 - RNA, 15 nt, Listeria monocytogenes EGD-e
aaaauaaaaaaauac

SEQ ID NO: 2802722 - RNA, 21 nt, Listeria monocytogenes EGD-e
aaaauaaaauggauaaaaaaa

SEQ ID NO: 2802723 - RNA, 16 nt, Listeria monocytogenes EGD-e
aaauagcuuucccuuu

SEQ ID NO: 2802724 - RNA, 16 nt, Listeria monocytogenes EGD-e
aaauaggauuaaaaua

SEQ ID NO: 2802725 - RNA, 18 nt, Listeria monocytogenes EGD-e
aaauaggauuaaaauaaa

SEQ ID NO: 2802726 - RNA, 18 nt, Listeria monocytogenes EGD-e
aaauaggcccauuaaaaa

SEQ ID NO: 2802727 - RNA, 20 nt, Listeria monocytogenes EGD-e
aaauaguaguuauuucuuua

SEQ ID NO: 2802728 - RNA, 21 nt, Listeria monocytogenes EGD-e
aaauaguaguuauuucuuuau

SEQ ID NO: 2802729 - RNA, 11 nt, Listeria monocytogenes EGD-e
aaauauacaca

SEQ ID NO: 2802730 - RNA, 19 nt, Listeria monocytogenes EGD-e
aaauauagucuacuuuuaa

SEQ ID NO: 2802731 - RNA, 14 nt, Listeria monocytogenes EGD-e
aaauaucaucaauu

SEQ ID NO: 2802732 - RNA, 13 nt, Listeria monocytogenes EGD-e
aaauauuuaauuu

SEQ ID NO: 2802733 - RNA, 17 nt, Listeria monocytogenes EGD-e
aaauauuuaauuuuauc

SEQ ID NO: 2802734 - RNA, 19 nt, Listeria monocytogenes EGD-e
aaaucaagcguaccauuca

SEQ ID NO: 2802735 - RNA, 16 nt, Listeria monocytogenes EGD-e
aaaucaguaccugcaa

SEQ ID NO: 2802736 - RNA, 23 nt, Listeria monocytogenes EGD-e
aaaucaguaccugcaagcgaauu

SEQ ID NO: 2802737 - RNA, 17 nt, Listeria monocytogenes EGD-e
aaaucauaacguuucau

SEQ ID NO: 2802738 - RNA, 15 nt, Listeria monocytogenes EGD-e
aaaucaugccuucaa

SEQ ID NO: 2802739 - RNA, 13 nt, Listeria monocytogenes EGD-e
aaaucauuuaaac

SEQ ID NO: 2802740 - RNA, 16 nt, Listeria monocytogenes EGD-e
aaaucauuuaaacacg

SEQ ID NO: 2802741 - RNA, 23 nt, Listeria monocytogenes EGD-e
aaaucauuuaaacacgccaaaaa

SEQ ID NO: 2802742 - RNA, 20 nt, Listeria monocytogenes EGD-e
aaaucauuucgauaagcaca

SEQ ID NO: 2802743 - RNA, 17 nt, Listeria monocytogenes EGD-e
aaauccagcgucuaaaa

SEQ ID NO: 2802744 - RNA, 20 nt, Listeria monocytogenes EGD-e
aaauccagcgucuaaaaaug

SEQ ID NO: 2802745 - RNA, 16 nt, Listeria monocytogenes EGD-e
aaauccgcuucguuuc

SEQ ID NO: 2802746 - RNA, 21 nt, Listeria monocytogenes EGD-e
aaaucgagucaccgaauccaa

SEQ ID NO: 2802747 - RNA, 21 nt, Listeria monocytogenes EGD-e
aaaucgcgcaaacaguuagaa

SEQ ID NO: 2802748 - RNA, 18 nt, Listeria monocytogenes EGD-e
aaaucgcggauaauaauc

SEQ ID NO: 2802749 - RNA, 16 nt, Listeria monocytogenes EGD-e
aaaucucaugaaacuu

SEQ ID NO: 2802750 - RNA, 20 nt, Listeria monocytogenes EGD-e
aaaucugcgaauaacagauu

SEQ ID NO: 2802751 - RNA, 19 nt, Listeria monocytogenes EGD-e
aaaucuggauaaaaauaac

SEQ ID NO: 2802752 - RNA, 17 nt, Listeria monocytogenes EGD-e
aaaucuuuaaacaagcu

SEQ ID NO: 2802753 - RNA, 11 nt, Listeria monocytogenes EGD-e
aaaucuuuucg

SEQ ID NO: 2802754 - RNA, 19 nt, Listeria monocytogenes EGD-e
aaaucuuuuuguuuugcuu

SEQ ID NO: 2802755 - RNA, 20 nt, Listeria monocytogenes EGD-e
aaaucuuuuuguuuugcuuc

SEQ ID NO: 2802756 - RNA, 21 nt, Listeria monocytogenes EGD-e
aaaugaagagauaaguuuuca

SEQ ID NO: 2802757 - RNA, 18 nt, Listeria monocytogenes EGD-e
aaaugaccaaugcuuucu

SEQ ID NO: 2802758 - RNA, 14 nt, Listeria monocytogenes EGD-e
aaaugagcccaaaa

SEQ ID NO: 2802759 - RNA, 17 nt, Listeria monocytogenes EGD-e
aaaugagcccaaaaaua

SEQ ID NO: 2802760 - RNA, 12 nt, Listeria monocytogenes EGD-e
aaaugauaaugu

SEQ ID NO: 2802761 - RNA, 21 nt, Listeria monocytogenes EGD-e
aaaugauuuuuaucuaaaucu

SEQ ID NO: 2802762 - RNA, 14 nt, Listeria monocytogenes EGD-e
aaaugcacagcaga

SEQ ID NO: 2802763 - RNA, 19 nt, Listeria monocytogenes EGD-e
aaaugcacagcagaaacuu

SEQ ID NO: 2802764 - RNA, 20 nt, Listeria monocytogenes EGD-e
aaaugcacagcagaaacuuu

SEQ ID NO: 2802765 - RNA, 22 nt, Listeria monocytogenes EGD-e
aaaugcacaugauaaccagaaa

SEQ ID NO: 2802766 - RNA, 16 nt, Listeria monocytogenes EGD-e
aaaugcucaucaagaa

SEQ ID NO: 2802767 - RNA, 22 nt, Listeria monocytogenes EGD-e
aaauggaugcacuuuuaauuua

SEQ ID NO: 2802768 - RNA, 20 nt, Listeria monocytogenes EGD-e
aaauggcgcaggaauagcaa

SEQ ID NO: 2802769 - RNA, 19 nt, Listeria monocytogenes EGD-e
aaauggcguuuuaaauccu

SEQ ID NO: 2802770 - RNA, 21 nt, Listeria monocytogenes EGD-e
aaaugguacguugguuguucu

SEQ ID NO: 2802771 - RNA, 14 nt, Listeria monocytogenes EGD-e
aaaugguuucuuaa

SEQ ID NO: 2802772 - RNA, 19 nt, Listeria monocytogenes EGD-e
aaauuaaaagcuaauuauu

SEQ ID NO: 2802773 - RNA, 11 nt, Listeria monocytogenes EGD-e
aaauuaacuuc

SEQ ID NO: 2802774 - RNA, 14 nt, Listeria monocytogenes EGD-e
aaauuaauuugacc

SEQ ID NO: 2802775 - RNA, 20 nt, Listeria monocytogenes EGD-e
aaauuagugccaugaauauu

SEQ ID NO: 2802776 - RNA, 14 nt, Listeria monocytogenes EGD-e
aaauuauacuauaa

SEQ ID NO: 2802777 - RNA, 19 nt, Listeria monocytogenes EGD-e
aaauuaucccguuuguuaa

SEQ ID NO: 2802778 - RNA, 18 nt, Listeria monocytogenes EGD-e
aaauucugaaaugauuuu

SEQ ID NO: 2802779 - RNA, 15 nt, Listeria monocytogenes EGD-e
aaauugcaacaguua

SEQ ID NO: 2802780 - RNA, 20 nt, Listeria monocytogenes EGD-e
aaauugcaacaguuauuaaa

SEQ ID NO: 2802781 - RNA, 23 nt, Listeria monocytogenes EGD-e
aaauuggauuauucaauucccag

SEQ ID NO: 2802782 - RNA, 17 nt, Listeria monocytogenes EGD-e
aaauuggucauauguuu

SEQ ID NO: 2802783 - RNA, 18 nt, Listeria monocytogenes EGD-e
aaauugucuacugcuuuu

SEQ ID NO: 2802784 - RNA, 19 nt, Listeria monocytogenes EGD-e
aaauuucccgcuacuaucg

SEQ ID NO: 2802785 - RNA, 18 nt, Listeria monocytogenes EGD-e
aaauuucuguuaugaaca

SEQ ID NO: 2802786 - RNA, 20 nt, Listeria monocytogenes EGD-e
aaauuugccaaagagaaacu

SEQ ID NO: 2802787 - RNA, 20 nt, Listeria monocytogenes EGD-e
aaauuuugguuuggucaaca

SEQ ID NO: 2802788 - RNA, 15 nt, Listeria monocytogenes EGD-e
aaauuuuuuugaaaa

SEQ ID NO: 2802789 - RNA, 19 nt, Listeria monocytogenes EGD-e
aaauuuuuuugaaaaaaca

SEQ ID NO: 2802790 - RNA, 20 nt, Listeria monocytogenes EGD-e
aaauuuuuuugaaaaaacau

SEQ ID NO: 2802791 - RNA, 18 nt, Listeria monocytogenes EGD-e
aacaaaagucacagcgua

SEQ ID NO: 2802792 - RNA, 16 nt, Listeria monocytogenes EGD-e
aacaaaauaaucaauc

SEQ ID NO: 2802793 - RNA, 13 nt, Listeria monocytogenes EGD-e
aacaaacacaaaa

SEQ ID NO: 2802794 - RNA, 20 nt, Listeria monocytogenes EGD-e
aacaaacuaguaauuuaauu

SEQ ID NO: 2802795 - RNA, 17 nt, Listeria monocytogenes EGD-e
aacaaagaagaaaaagu

SEQ ID NO: 2802796 - RNA, 19 nt, Listeria monocytogenes EGD-e
aacaaagcguuuuuuauuu

SEQ ID NO: 2802797 - RNA, 22 nt, Listeria monocytogenes EGD-e
aacaaauucuccuuaaauaaaa

SEQ ID NO: 2802798 - RNA, 19 nt, Listeria monocytogenes EGD-e
aacaaauuugccaaagaga

SEQ ID NO: 2802799 - RNA, 20 nt, Listeria monocytogenes EGD-e
aacaaauuugccaaagagaa

SEQ ID NO: 2802800 - RNA, 14 nt, Listeria monocytogenes EGD-e
aacaacaagcaaaa

SEQ ID NO: 2802801 - RNA, 18 nt, Listeria monocytogenes EGD-e
aacaacaagcaaaacauu

SEQ ID NO: 2802802 - RNA, 19 nt, Listeria monocytogenes EGD-e
aacaacaugcguaaacuuu

SEQ ID NO: 2802803 - RNA, 15 nt, Listeria monocytogenes EGD-e
aacaaccaucaaacu

SEQ ID NO: 2802804 - RNA, 18 nt, Listeria monocytogenes EGD-e
aacaacuaacacuuauau

SEQ ID NO: 2802805 - RNA, 14 nt, Listeria monocytogenes EGD-e
aacaacuaauuuuu

SEQ ID NO: 2802806 - RNA, 22 nt, Listeria monocytogenes EGD-e
aacaagaggcuuauuccuccaa

SEQ ID NO: 2802807 - RNA, 15 nt, Listeria monocytogenes EGD-e
aacaagcuuugugga

SEQ ID NO: 2802808 - RNA, 13 nt, Listeria monocytogenes EGD-e
aacaaggaagaau

SEQ ID NO: 2802809 - RNA, 21 nt, Listeria monocytogenes EGD-e
aacaaggaagaauaguacaua

SEQ ID NO: 2802810 - RNA, 19 nt, Listeria monocytogenes EGD-e
aacaaguccgucaagccca

SEQ ID NO: 2802811 - RNA, 21 nt, Listeria monocytogenes EGD-e
aacaaguccgucaagcccagc

SEQ ID NO: 2802812 - RNA, 22 nt, Listeria monocytogenes EGD-e
aacaauaacauuuucucuugua

SEQ ID NO: 2802813 - RNA, 17 nt, Listeria monocytogenes EGD-e
aacaauuacuuccauga

SEQ ID NO: 2802814 - RNA, 20 nt, Listeria monocytogenes EGD-e
aacagaaagcuguuuucaac

SEQ ID NO: 2802815 - RNA, 19 nt, Listeria monocytogenes EGD-e
aacagcuugauaauuuuuu

SEQ ID NO: 2802816 - RNA, 13 nt, Listeria monocytogenes EGD-e
aacagcuuuucua

SEQ ID NO: 2802817 - RNA, 18 nt, Listeria monocytogenes EGD-e
aacaguauuccucaauga

SEQ ID NO: 2802818 - RNA, 16 nt, Listeria monocytogenes EGD-e
aacaguuauuaaaagg

SEQ ID NO: 2802819 - RNA, 19 nt, Listeria monocytogenes EGD-e
aacaguuauuaaaaggaca

SEQ ID NO: 2802820 - RNA, 20 nt, Listeria monocytogenes EGD-e
aacaguuauuaaaaggacac

SEQ ID NO: 2802821 - RNA, 21 nt, Listeria monocytogenes EGD-e
aacauaaaccgcaauaacaua

SEQ ID NO: 2802822 - RNA, 17 nt, Listeria monocytogenes EGD-e
aacauaaccuucaucgu

SEQ ID NO: 2802823 - RNA, 19 nt, Listeria monocytogenes EGD-e
aacauaaccuucaucguuu

SEQ ID NO: 2802824 - RNA, 17 nt, Listeria monocytogenes EGD-e
aagccaaugaccuaguu

SEQ ID NO: 2802825 - RNA, 17 nt, Listeria monocytogenes EGD-e
aagcgaauauccgauaa

SEQ ID NO: 2802826 - RNA, 22 nt, Listeria monocytogenes EGD-e
aagcgaugugggaaugaauaga

SEQ ID NO: 2802827 - RNA, 13 nt, Listeria monocytogenes EGD-e
aagcgcagaauga

SEQ ID NO: 2802828 - RNA, 22 nt, Listeria monocytogenes EGD-e
aagcguucuaaugauagaagaa

SEQ ID NO: 2802829 - RNA, 14 nt, Listeria monocytogenes EGD-e
aagcguuuuucugc

SEQ ID NO: 2802830 - RNA, 17 nt, Listeria monocytogenes EGD-e
aagcuaauuauuucaag

SEQ ID NO: 2802831 - RNA, 22 nt, Listeria monocytogenes EGD-e
aagcuauuuuuuauacucucuu

SEQ ID NO: 2802832 - RNA, 17 nt, Listeria monocytogenes EGD-e
aagcuguuuucaacaaa

SEQ ID NO: 2802833 - RNA, 20 nt, Listeria monocytogenes EGD-e
aagcuguuuucaacaaaaca

SEQ ID NO: 2802834 - RNA, 22 nt, Listeria monocytogenes EGD-e
aagcuguuuucaacaaaacaaa

SEQ ID NO: 2802835 - RNA, 18 nt, Listeria monocytogenes EGD-e
aaggaaaacucucccauu

SEQ ID NO: 2802836 - RNA, 16 nt, Listeria monocytogenes EGD-e
aaggaaacgaauaaaa

SEQ ID NO: 2802837 - RNA, 13 nt, Listeria monocytogenes EGD-e
aaggaaauaauuc

SEQ ID NO: 2802838 - RNA, 13 nt, Listeria monocytogenes EGD-e
aaggaagaauagu

SEQ ID NO: 2802839 - RNA, 20 nt, Listeria monocytogenes EGD-e
aaggacacccauaauagcag

SEQ ID NO: 2802840 - RNA, 14 nt, Listeria monocytogenes EGD-e
aaggagaaaaagug

SEQ ID NO: 2802841 - RNA, 14 nt, Listeria monocytogenes EGD-e
aaggagcagaaaaa

SEQ ID NO: 2802842 - RNA, 22 nt, Listeria monocytogenes EGD-e
aaggagcggcucagauccuuca

SEQ ID NO: 2802843 - RNA, 21 nt, Listeria monocytogenes EGD-e
aaggauuugucacuuggaaaa

SEQ ID NO: 2802844 - RNA, 13 nt, Listeria monocytogenes EGD-e
aaggcuuuuaacu

SEQ ID NO: 2802845 - RNA, 13 nt, Listeria monocytogenes EGD-e
aagggaagcuuuu

SEQ ID NO: 2802846 - RNA, 13 nt, Listeria monocytogenes EGD-e
aagggugaagcuu

SEQ ID NO: 2802847 - RNA, 14 nt, Listeria monocytogenes EGD-e
aaggguuuucagcu

SEQ ID NO: 2802848 - RNA, 13 nt, Listeria monocytogenes EGD-e
aagguauugagug

SEQ ID NO: 2802849 - RNA, 15 nt, Listeria monocytogenes EGD-e
aaguaaaaucuuuua

SEQ ID NO: 2802850 - RNA, 14 nt, Listeria monocytogenes EGD-e
aaguaacuaaaaau

SEQ ID NO: 2802851 - RNA, 22 nt, Listeria monocytogenes EGD-e
aaguaacuaaaaaucauuuaaa

SEQ ID NO: 2802852 - RNA, 18 nt, Listeria monocytogenes EGD-e
aaguacaauuuucauuua

SEQ ID NO: 2802853 - RNA, 21 nt, Listeria monocytogenes EGD-e
aaguacaauuuucauuuaaca

SEQ ID NO: 2802854 - RNA, 20 nt, Listeria monocytogenes EGD-e
aaguagauuccgcuaaaacu

SEQ ID NO: 2802855 - RNA, 21 nt, Listeria monocytogenes EGD-e
aaguaggccuagcauuagcua

SEQ ID NO: 2802856 - RNA, 15 nt, Listeria monocytogenes EGD-e
aaguauucaaauuca

SEQ ID NO: 2802857 - RNA, 21 nt, Listeria monocytogenes EGD-e
aagucaaagguuuaauaggaa

SEQ ID NO: 2802858 - RNA, 17 nt, Listeria monocytogenes EGD-e
aagucaaugauauuaug

SEQ ID NO: 2802859 - RNA, 12 nt, Listeria monocytogenes EGD-e
aagucacagcgu

SEQ ID NO: 2802860 - RNA, 22 nt, Listeria monocytogenes EGD-e
aaguccaaagagccauaaaauu

SEQ ID NO: 2802861 - RNA, 18 nt, Listeria monocytogenes EGD-e
aaguccgucaagcccagc

SEQ ID NO: 2802862 - RNA, 17 nt, Listeria monocytogenes EGD-e
aagucgaaagaauaaaa

SEQ ID NO: 2802863 - RNA, 14 nt, Listeria monocytogenes EGD-e
aagucuggauuucu

SEQ ID NO: 2802864 - RNA, 14 nt, Listeria monocytogenes EGD-e
aagucuuuuuguaa

SEQ ID NO: 2802865 - RNA, 22 nt, Listeria monocytogenes EGD-e
aagugagaaucauuaauauaaa

SEQ ID NO: 2802866 - RNA, 20 nt, Listeria monocytogenes EGD-e
aagugauguuucguuuuccu

SEQ ID NO: 2802867 - RNA, 16 nt, Listeria monocytogenes EGD-e
aagugcguaagauuuu

SEQ ID NO: 2802868 - RNA, 15 nt, Listeria monocytogenes EGD-e
aaguguaaaaguuaa

SEQ ID NO: 2802869 - RNA, 14 nt, Listeria monocytogenes EGD-e
aagugugaaaaucg

SEQ ID NO: 2802870 - RNA, 17 nt, Listeria monocytogenes EGD-e
aaguuaaucauuaaaua

SEQ ID NO: 2802871 - RNA, 16 nt, Listeria monocytogenes EGD-e
aaguuagauuaaaaau

SEQ ID NO: 2802872 - RNA, 23 nt, Listeria monocytogenes EGD-e
aaguucuguuggcgcagaaauau

SEQ ID NO: 2802873 - RNA, 16 nt, Listeria monocytogenes EGD-e
aaguuguaagauaaua

SEQ ID NO: 2802874 - RNA, 14 nt, Listeria monocytogenes EGD-e
aauaaaacaaaaga

SEQ ID NO: 2802875 - RNA, 16 nt, Listeria monocytogenes EGD-e
aauaaaacaaaagaua

SEQ ID NO: 2802876 - RNA, 17 nt, Listeria monocytogenes EGD-e
aauaaaaccauucaucu

SEQ ID NO: 2802877 - RNA, 14 nt, Listeria monocytogenes EGD-e
aauaaaauaggcaa

SEQ ID NO: 2802878 - RNA, 12 nt, Listeria monocytogenes EGD-e
aauaaagaacuu

SEQ ID NO: 2802879 - RNA, 22 nt, Listeria monocytogenes EGD-e
aauaaagaacuuacagaagcau

SEQ ID NO: 2802880 - RNA, 22 nt, Listeria monocytogenes EGD-e
aauaaagccaaaucgcggauaa

SEQ ID NO: 2802881 - RNA, 18 nt, Listeria monocytogenes EGD-e
aauaaaguuaacuucauu

SEQ ID NO: 2802882 - RNA, 11 nt, Listeria monocytogenes EGD-e
aauaaaucaag

SEQ ID NO: 2802883 - RNA, 15 nt, Listeria monocytogenes EGD-e
aauaacaucuuuaaa

SEQ ID NO: 2802884 - RNA, 13 nt, Listeria monocytogenes EGD-e
aauaacauuaaac

SEQ ID NO: 2802885 - RNA, 22 nt, Listeria monocytogenes EGD-e
aauaacauuaaaccucuuuuuu

SEQ ID NO: 2802886 - RNA, 12 nt, Listeria monocytogenes EGD-e
aauaaccauucc

SEQ ID NO: 2802887 - RNA, 18 nt, Listeria monocytogenes EGD-e
aauaaccgccaaaaagca

SEQ ID NO: 2802888 - RNA, 19 nt, Listeria monocytogenes EGD-e
aauaacguugcauuaaaaa

SEQ ID NO: 2802889 - RNA, 17 nt, Listeria monocytogenes EGD-e
aauaacuacuauuuaaa

SEQ ID NO: 2802890 - RNA, 22 nt, Listeria monocytogenes EGD-e
aauaacucggggugaaaaugag

SEQ ID NO: 2802891 - RNA, 20 nt, Listeria monocytogenes EGD-e
aauaagcgaauauccgauaa

SEQ ID NO: 2802892 - RNA, 11 nt, Listeria monocytogenes EGD-e
aauaagugaau

SEQ ID NO: 2802893 - RNA, 18 nt, Listeria monocytogenes EGD-e
aauaagugaauugaugga

SEQ ID NO: 2802894 - RNA, 15 nt, Listeria monocytogenes EGD-e
aauaauacaaacuuu

SEQ ID NO: 2802895 - RNA, 17 nt, Listeria monocytogenes EGD-e
aauaaucacguuuuugc

SEQ ID NO: 2802896 - RNA, 17 nt, Listeria monocytogenes EGD-e
aauaauccuuccaucaa

SEQ ID NO: 2802897 - RNA, 20 nt, Listeria monocytogenes EGD-e
aauaaugauuucuauaaaaa

SEQ ID NO: 2802898 - RNA, 21 nt, Listeria monocytogenes EGD-e
aauaaugauuucuauaaaaau

SEQ ID NO: 2802899 - RNA, 18 nt, Listeria monocytogenes EGD-e
aauaaugugguucguuag

SEQ ID NO: 2802900 - RNA, 23 nt, Listeria monocytogenes EGD-e
aauaauuaagaccuucuuuuaaa

SEQ ID NO: 2802901 - RNA, 12 nt, Listeria monocytogenes EGD-e
aauaauucugcu

SEQ ID NO: 2802902 - RNA, 17 nt, Listeria monocytogenes EGD-e
aauacaaacuuuuccuu

SEQ ID NO: 2802903 - RNA, 22 nt, Listeria monocytogenes EGD-e
aauacaaacuuuuccuucuaca

SEQ ID NO: 2802904 - RNA, 22 nt, Listeria monocytogenes EGD-e
aauaccagcaguuuucauuaaa

SEQ ID NO: 2802905 - RNA, 16 nt, Listeria monocytogenes EGD-e
aauaccaggaucaaaa

SEQ ID NO: 2802906 - RNA, 22 nt, Listeria monocytogenes EGD-e
aauaccauguuuauuuaauaag

SEQ ID NO: 2802907 - RNA, 23 nt, Listeria monocytogenes EGD-e
aauacuaacgcuuuuucagcaau

SEQ ID NO: 2802908 - RNA, 20 nt, Listeria monocytogenes EGD-e
aauacuuuuuucuauauuca

SEQ ID NO: 2802909 - RNA, 22 nt, Listeria monocytogenes EGD-e
aauagcaaucggcgcuuucaaa

SEQ ID NO: 2802910 - RNA, 22 nt, Listeria monocytogenes EGD-e
aauagcagagcuccaauaauag

SEQ ID NO: 2802911 - RNA, 23 nt, Listeria monocytogenes EGD-e
aauagcuuugucuuaaaugacaa

SEQ ID NO: 2802912 - RNA, 16 nt, Listeria monocytogenes EGD-e
aauaggaaggagcaga

SEQ ID NO: 2802913 - RNA, 20 nt, Listeria monocytogenes EGD-e
aauaggauuuuacugcggcg

SEQ ID NO: 2802914 - RNA, 18 nt, Listeria monocytogenes EGD-e
aauaguagcacuccuuga

SEQ ID NO: 2802915 - RNA, 16 nt, Listeria monocytogenes EGD-e
aauaguauaaggauac

SEQ ID NO: 2802916 - RNA, 15 nt, Listeria monocytogenes EGD-e
aauauacacaaagua

SEQ ID NO: 2802917 - RNA, 18 nt, Listeria monocytogenes EGD-e
aauauacuuuauaacuuu

SEQ ID NO: 2802918 - RNA, 13 nt, Listeria monocytogenes EGD-e
aauauagcuucaa

SEQ ID NO: 2802919 - RNA, 18 nt, Listeria monocytogenes EGD-e
aauauagcuucaaacgca

SEQ ID NO: 2802920 - RNA, 17 nt, Listeria monocytogenes EGD-e
aauauagucuacuuuua

SEQ ID NO: 2802921 - RNA, 17 nt, Listeria monocytogenes EGD-e
aauaucaaauccaagca

SEQ ID NO: 2802922 - RNA, 18 nt, Listeria monocytogenes EGD-e
aauaucaccauuacuauu

SEQ ID NO: 2802923 - RNA, 18 nt, Listeria monocytogenes EGD-e
aauaucaucaauuaaauu

SEQ ID NO: 2802924 - RNA, 22 nt, Listeria monocytogenes EGD-e
aauaucaucaauuaaauuauac

SEQ ID NO: 2802925 - RNA, 21 nt, Listeria monocytogenes EGD-e
aauguugguguaggaagugau

SEQ ID NO: 2802926 - RNA, 12 nt, Listeria monocytogenes EGD-e
aauuaaaaguug

SEQ ID NO: 2802927 - RNA, 21 nt, Listeria monocytogenes EGD-e
aauuaaagguaacgucuacuu

SEQ ID NO: 2802928 - RNA, 18 nt, Listeria monocytogenes EGD-e
aauuaaauuuuuuugaaa

SEQ ID NO: 2802929 - RNA, 15 nt, Listeria monocytogenes EGD-e
aauuaacaaccauuu

SEQ ID NO: 2802930 - RNA, 23 nt, Listeria monocytogenes EGD-e
aauuaauaaaagaggauuuucca

SEQ ID NO: 2802931 - RNA, 18 nt, Listeria monocytogenes EGD-e
aauuagacauauaucuua

SEQ ID NO: 2802932 - RNA, 22 nt, Listeria monocytogenes EGD-e
aauuagacauauaucuuaggaa

SEQ ID NO: 2802933 - RNA, 14 nt, Listeria monocytogenes EGD-e
aauuagucccauua

SEQ ID NO: 2802934 - RNA, 14 nt, Listeria monocytogenes EGD-e
aauuauaauuuaau

SEQ ID NO: 2802935 - RNA, 14 nt, Listeria monocytogenes EGD-e
aauuauacuauaaa

SEQ ID NO: 2802936 - RNA, 18 nt, Listeria monocytogenes EGD-e
aauuauacuauaaagaac

SEQ ID NO: 2802937 - RNA, 16 nt, Listeria monocytogenes EGD-e
aauuauccaguguaau

SEQ ID NO: 2802938 - RNA, 18 nt, Listeria monocytogenes EGD-e
aauuauggcauaaaaaau

SEQ ID NO: 2802939 - RNA, 20 nt, Listeria monocytogenes EGD-e
aauuaugucggugcauuuuu

SEQ ID NO: 2802940 - RNA, 13 nt, Listeria monocytogenes EGD-e
aauuauuuuugua

SEQ ID NO: 2802941 - RNA, 22 nt, Listeria monocytogenes EGD-e
aauuauuuuuguaauaccgaga

SEQ ID NO: 2802942 - RNA, 21 nt, Listeria monocytogenes EGD-e
aauucauuuaauugucgaaaa

SEQ ID NO: 2802943 - RNA, 20 nt, Listeria monocytogenes EGD-e
aauucauuuaguacauaaaa

SEQ ID NO: 2802944 - RNA, 17 nt, Listeria monocytogenes EGD-e
aauucggcaaacagcuu

SEQ ID NO: 2802945 - RNA, 21 nt, Listeria monocytogenes EGD-e
aauucuauuaauaaugauuuc

SEQ ID NO: 2802946 - RNA, 18 nt, Listeria monocytogenes EGD-e
aauucuccuuaaauaaaa

SEQ ID NO: 2802947 - RNA, 16 nt, Listeria monocytogenes EGD-e
aauucuugaauguuuu

SEQ ID NO: 2802948 - RNA, 15 nt, Listeria monocytogenes EGD-e
aauucuuuuucuucu

SEQ ID NO: 2802949 - RNA, 16 nt, Listeria monocytogenes EGD-e
aauugaaguucgaauu

SEQ ID NO: 2802950 - RNA, 12 nt, Listeria monocytogenes EGD-e
aauugauaccaa

SEQ ID NO: 2802951 - RNA, 14 nt, Listeria monocytogenes EGD-e
aauugauaccaaau

SEQ ID NO: 2802952 - RNA, 16 nt, Listeria monocytogenes EGD-e
aauugauuuguuucca

SEQ ID NO: 2802953 - RNA, 16 nt, Listeria monocytogenes EGD-e
aauugauuuuuuugaa

SEQ ID NO: 2802954 - RNA, 20 nt, Listeria monocytogenes EGD-e
aauugcuucuccguuuucca

SEQ ID NO: 2802955 - RNA, 21 nt, Listeria monocytogenes EGD-e
aauugcuucuccguuuuccac

SEQ ID NO: 2802956 - RNA, 13 nt, Listeria monocytogenes EGD-e
aauuguaauuccg

SEQ ID NO: 2802957 - RNA, 19 nt, Listeria monocytogenes EGD-e
aauuguaauuccgugaaau

SEQ ID NO: 2802958 - RNA, 15 nt, Listeria monocytogenes EGD-e
aauuguaccgcuuga

SEQ ID NO: 2802959 - RNA, 10 nt, Listeria monocytogenes EGD-e
aauuguauaa

SEQ ID NO: 2802960 - RNA, 15 nt, Listeria monocytogenes EGD-e
aauugucauaaaacu

SEQ ID NO: 2802961 - RNA, 16 nt, Listeria monocytogenes EGD-e
aauugucauaaaacuu

SEQ ID NO: 2802962 - RNA, 15 nt, Listeria monocytogenes EGD-e
aauugugcuaaaucu

SEQ ID NO: 2802963 - RNA, 15 nt, Listeria monocytogenes EGD-e
aauuuaagucguuau

SEQ ID NO: 2802964 - RNA, 12 nt, Listeria monocytogenes EGD-e
aauuuaauugcu

SEQ ID NO: 2802965 - RNA, 20 nt, Listeria monocytogenes EGD-e
aauuuaauugcuagcgaagu

SEQ ID NO: 2802966 - RNA, 16 nt, Listeria monocytogenes EGD-e
aauuuaauuuucccca

SEQ ID NO: 2802967 - RNA, 15 nt, Listeria monocytogenes EGD-e
aauuuacguuguucu

SEQ ID NO: 2802968 - RNA, 20 nt, Listeria monocytogenes EGD-e
aauuuacguuguucuaacau

SEQ ID NO: 2802969 - RNA, 17 nt, Listeria monocytogenes EGD-e
aauuuauauuuuaaaga

SEQ ID NO: 2802970 - RNA, 13 nt, Listeria monocytogenes EGD-e
aauuucaucguuu

SEQ ID NO: 2802971 - RNA, 22 nt, Listeria monocytogenes EGD-e
aauuucaucguuuucuacugua

SEQ ID NO: 2802972 - RNA, 23 nt, Listeria monocytogenes EGD-e
aauuuccacaucgauguuaccac

SEQ ID NO: 2802973 - RNA, 16 nt, Listeria monocytogenes EGD-e
aauuucgaaauuaaaa

SEQ ID NO: 2802974 - RNA, 17 nt, Listeria monocytogenes EGD-e
aauuucgaaauuaaaag

SEQ ID NO: 2802975 - RNA, 20 nt, Listeria monocytogenes EGD-e
aauuucgaaauuaaaagcua

SEQ ID NO: 2802976 - RNA, 22 nt, Listeria monocytogenes EGD-e
aauuucgccguuggaagugaaa

SEQ ID NO: 2802977 - RNA, 18 nt, Listeria monocytogenes EGD-e
aauuucuggguguuuauu

SEQ ID NO: 2802978 - RNA, 20 nt, Listeria monocytogenes EGD-e
aauuucuucgugcgcaacau

SEQ ID NO: 2802979 - RNA, 17 nt, Listeria monocytogenes EGD-e
aauuucuuuugacaaaa

SEQ ID NO: 2802980 - RNA, 20 nt, Listeria monocytogenes EGD-e
aauuugacgcaaggaaucuu

SEQ ID NO: 2802981 - RNA, 19 nt, Listeria monocytogenes EGD-e
aauuugauugccugaaaua

SEQ ID NO: 2802982 - RNA, 16 nt, Listeria monocytogenes EGD-e
aauuugccaaagagaa

SEQ ID NO: 2802983 - RNA, 20 nt, Listeria monocytogenes EGD-e
aauuugccaaagagaaacuu

SEQ ID NO: 2802984 - RNA, 17 nt, Listeria monocytogenes EGD-e
aauuugggagcuuucuu

SEQ ID NO: 2802985 - RNA, 20 nt, Listeria monocytogenes EGD-e
aauuugggagcuuucuuuuu

SEQ ID NO: 2802986 - RNA, 14 nt, Listeria monocytogenes EGD-e
aauuugucuuuacu

SEQ ID NO: 2802987 - RNA, 15 nt, Listeria monocytogenes EGD-e
aauuugucuuuacua

SEQ ID NO: 2802988 - RNA, 13 nt, Listeria monocytogenes EGD-e
aauuuuacuucua

SEQ ID NO: 2802989 - RNA, 18 nt, Listeria monocytogenes EGD-e
aauuuucauuuguuucuu

SEQ ID NO: 2802990 - RNA, 21 nt, Listeria monocytogenes EGD-e
aauuuucauuuguuucuuuug

SEQ ID NO: 2802991 - RNA, 21 nt, Listeria monocytogenes EGD-e
aauuuuggaguuaaguacaau

SEQ ID NO: 2802992 - RNA, 12 nt, Listeria monocytogenes EGD-e
acaaaaaaguuc

SEQ ID NO: 2802993 - RNA, 12 nt, Listeria monocytogenes EGD-e
acaaaaaauacg

SEQ ID NO: 2802994 - RNA, 17 nt, Listeria monocytogenes EGD-e
acaaaaagaaaaaacaa

SEQ ID NO: 2802995 - RNA, 17 nt, Listeria monocytogenes EGD-e
acaaaacggaucuuucu

SEQ ID NO: 2802996 - RNA, 17 nt, Listeria monocytogenes EGD-e
acaaaaggacaagccca

SEQ ID NO: 2802997 - RNA, 17 nt, Listeria monocytogenes EGD-e
acaaaaguggaaauguu

SEQ ID NO: 2802998 - RNA, 16 nt, Listeria monocytogenes EGD-e
acaaaauaauaauaag

SEQ ID NO: 2802999 - RNA, 20 nt, Listeria monocytogenes EGD-e
acaaaauccagcguuaaucu

SEQ ID NO: 2803000 - RNA, 19 nt, Listeria monocytogenes EGD-e
acaaaaucuuuaaacaagc

SEQ ID NO: 2803001 - RNA, 15 nt, Listeria monocytogenes EGD-e
acaaaauuugucuuu

SEQ ID NO: 2803002 - RNA, 23 nt, Listeria monocytogenes EGD-e
acaaacgcuuuuucaaaaucaag

SEQ ID NO: 2803003 - RNA, 21 nt, Listeria monocytogenes EGD-e
acaaacguucuugaaaucaag

SEQ ID NO: 2803004 - RNA, 18 nt, Listeria monocytogenes EGD-e
acaaacuaguaauuuaau

SEQ ID NO: 2803005 - RNA, 14 nt, Listeria monocytogenes EGD-e
acaaagaagaaaaa

SEQ ID NO: 2803006 - RNA, 16 nt, Listeria monocytogenes EGD-e
acaaaguaacuaaaaa

SEQ ID NO: 2803007 - RNA, 18 nt, Listeria monocytogenes EGD-e
acaaaguaacuaaaaauc

SEQ ID NO: 2803008 - RNA, 20 nt, Listeria monocytogenes EGD-e
acaaaguaacuaaaaaucau

SEQ ID NO: 2803009 - RNA, 16 nt, Listeria monocytogenes EGD-e
acaaaugguucacuuu

SEQ ID NO: 2803010 - RNA, 14 nt, Listeria monocytogenes EGD-e
acaaauuauuagaa

SEQ ID NO: 2803011 - RNA, 15 nt, Listeria monocytogenes EGD-e
acaaauuauuagaau

SEQ ID NO: 2803012 - RNA, 19 nt, Listeria monocytogenes EGD-e
acaaauucuccuuaaauaa

SEQ ID NO: 2803013 - RNA, 22 nt, Listeria monocytogenes EGD-e
acaaauucuccuuaaauaaaaa

SEQ ID NO: 2803014 - RNA, 22 nt, Listeria monocytogenes EGD-e
acaacaugcguaaacuuuuguu

SEQ ID NO: 2803015 - RNA, 20 nt, Listeria monocytogenes EGD-e
acaagcacuuacugcaauca

SEQ ID NO: 2803016 - RNA, 16 nt, Listeria monocytogenes EGD-e
acaagcgacaaaccaa

SEQ ID NO: 2803017 - RNA, 23 nt, Listeria monocytogenes EGD-e
acaagcguaugguucaaaaagau

SEQ ID NO: 2803018 - RNA, 14 nt, Listeria monocytogenes EGD-e
acaaguacuuugaa

SEQ ID NO: 2803019 - RNA, 20 nt, Listeria monocytogenes EGD-e
acaaguccgucaagcccagc

SEQ ID NO: 2803020 - RNA, 21 nt, Listeria monocytogenes EGD-e
acaaguccgucaagcccagcu

SEQ ID NO: 2803021 - RNA, 15 nt, Listeria monocytogenes EGD-e
acaaguguuguacca

SEQ ID NO: 2803022 - RNA, 23 nt, Listeria monocytogenes EGD-e
acaaguguuguaccauaagcagc

SEQ ID NO: 2803023 - RNA, 15 nt, Listeria monocytogenes EGD-e
acaauacauaacuuc

SEQ ID NO: 2803024 - RNA, 21 nt, Listeria monocytogenes EGD-e
acaauaccauguuuauuuaau

SEQ ID NO: 2803025 - RNA, 22 nt, Listeria monocytogenes EGD-e
acaaucaugccagcuucuucca

SEQ ID NO: 2803026 - RNA, 14 nt, Listeria monocytogenes EGD-e
acgagcuacagcug

SEQ ID NO: 2803027 - RNA, 22 nt, Listeria monocytogenes EGD-e
acgaguaacuccaccaugguca

SEQ ID NO: 2803028 - RNA, 16 nt, Listeria monocytogenes EGD-e
acgaucagccauuuua

SEQ ID NO: 2803029 - RNA, 15 nt, Listeria monocytogenes EGD-e
acgaucuacuucuaa

SEQ ID NO: 2803030 - RNA, 16 nt, Listeria monocytogenes EGD-e
acgauucgauuuucaa

SEQ ID NO: 2803031 - RNA, 16 nt, Listeria monocytogenes EGD-e
acgcauaucaucaaua

SEQ ID NO: 2803032 - RNA, 22 nt, Listeria monocytogenes EGD-e
acgcaucugcuaauacuauuga

SEQ ID NO: 2803033 - RNA, 20 nt, Listeria monocytogenes EGD-e
acgcauuucacaccacucuu

SEQ ID NO: 2803034 - RNA, 17 nt, Listeria monocytogenes EGD-e
acgccucgagauaaauu

SEQ ID NO: 2803035 - RNA, 20 nt, Listeria monocytogenes EGD-e
acgcgcaucuucguauauuu

SEQ ID NO: 2803036 - RNA, 23 nt, Listeria monocytogenes EGD-e
acgcggcauuucaaucgcagcag

SEQ ID NO: 2803037 - RNA, 18 nt, Listeria monocytogenes EGD-e
acgcuuuuucaaaaucaa

SEQ ID NO: 2803038 - RNA, 19 nt, Listeria monocytogenes EGD-e
acggaucgcgguagcuuca

SEQ ID NO: 2803039 - RNA, 20 nt, Listeria monocytogenes EGD-e
acggaucgcgguagcuucaa

SEQ ID NO: 2803040 - RNA, 13 nt, Listeria monocytogenes EGD-e
acggcuucaaaaa

SEQ ID NO: 2803041 - RNA, 17 nt, Listeria monocytogenes EGD-e
acggugaugaaaccaaa

SEQ ID NO: 2803042 - RNA, 17 nt, Listeria monocytogenes EGD-e
acgucucucauuguugu

SEQ ID NO: 2803043 - RNA, 16 nt, Listeria monocytogenes EGD-e
acgugaaaaucuuguu

SEQ ID NO: 2803044 - RNA, 17 nt, Listeria monocytogenes EGD-e
acgugaaaaucuuguug

SEQ ID NO: 2803045 - RNA, 23 nt, Listeria monocytogenes EGD-e
acguuccgauacaacaaaauaau

SEQ ID NO: 2803046 - RNA, 14 nt, Listeria monocytogenes EGD-e
acguucuugaaauc

SEQ ID NO: 2803047 - RNA, 18 nt, Listeria monocytogenes EGD-e
acguugguuguucuuuua

SEQ ID NO: 2803048 - RNA, 13 nt, Listeria monocytogenes EGD-e
acguuuaucaaua

SEQ ID NO: 2803049 - RNA, 13 nt, Listeria monocytogenes EGD-e
acuaaaaaucauu

SEQ ID NO: 2803050 - RNA, 15 nt, Listeria monocytogenes EGD-e
acuaaaaaucauuua

SEQ ID NO: 2803051 - RNA, 17 nt, Listeria monocytogenes EGD-e
acuaaauuaucauccac

SEQ ID NO: 2803052 - RNA, 15 nt, Listeria monocytogenes EGD-e
acuaacaaaauaaua

SEQ ID NO: 2803053 - RNA, 16 nt, Listeria monocytogenes EGD-e
acuaacauaaauugau

SEQ ID NO: 2803054 - RNA, 16 nt, Listeria monocytogenes EGD-e
acuaaucaauaaagaa

SEQ ID NO: 2803055 - RNA, 16 nt, Listeria monocytogenes EGD-e
acuaauuacuaaaaag

SEQ ID NO: 2803056 - RNA, 19 nt, Listeria monocytogenes EGD-e
acuaccggcccacaaaacg

SEQ ID NO: 2803057 - RNA, 15 nt, Listeria monocytogenes EGD-e
acuacuaauuguuac

SEQ ID NO: 2803058 - RNA, 16 nt, Listeria monocytogenes EGD-e
acuagaaaaaugaaga

SEQ ID NO: 2803059 - RNA, 20 nt, Listeria monocytogenes EGD-e
acuagaaaaaugaagagaua

SEQ ID NO: 2803060 - RNA, 24 nt, Listeria monocytogenes EGD-e
acuagaaaaaugaagagauaaguu

SEQ ID NO: 2803061 - RNA, 14 nt, Listeria monocytogenes EGD-e
acuagaaauuaaug

SEQ ID NO: 2803062 - RNA, 16 nt, Listeria monocytogenes EGD-e
acuagauuuaauaaau

SEQ ID NO: 2803063 - RNA, 17 nt, Listeria monocytogenes EGD-e
acuagcgcacaaguaau

SEQ ID NO: 2803064 - RNA, 14 nt, Listeria monocytogenes EGD-e
acuagugaaauaga

SEQ ID NO: 2803065 - RNA, 13 nt, Listeria monocytogenes EGD-e
acuaucaucuucu

SEQ ID NO: 2803066 - RNA, 14 nt, Listeria monocytogenes EGD-e
acuaucaucuucuc

SEQ ID NO: 2803067 - RNA, 12 nt, Listeria monocytogenes EGD-e
acuauuuucuaa

SEQ ID NO: 2803068 - RNA, 15 nt, Listeria monocytogenes EGD-e
acucaaaguaacuuu

SEQ ID NO: 2803069 - RNA, 20 nt, Listeria monocytogenes EGD-e
acucacuguauuaauccgaa

SEQ ID NO: 2803070 - RNA, 13 nt, Listeria monocytogenes EGD-e
acuccaaaauaaa

SEQ ID NO: 2803071 - RNA, 15 nt, Listeria monocytogenes EGD-e
acuccaaaauaaaau

SEQ ID NO: 2803072 - RNA, 18 nt, Listeria monocytogenes EGD-e
acuccaccaccuuuggua

SEQ ID NO: 2803073 - RNA, 22 nt, Listeria monocytogenes EGD-e
acuccaccaccuuugguaaaaa

SEQ ID NO: 2803074 - RNA, 18 nt, Listeria monocytogenes EGD-e
acucccuuuuuccacacu

SEQ ID NO: 2803075 - RNA, 19 nt, Listeria monocytogenes EGD-e
acucggggugaaaaugagc

SEQ ID NO: 2803076 - RNA, 16 nt, Listeria monocytogenes EGD-e
acucucauaagagaau

SEQ ID NO: 2803077 - RNA, 22 nt, Listeria monocytogenes EGD-e
acucucccauuugucccacaaa

SEQ ID NO: 2803078 - RNA, 16 nt, Listeria monocytogenes EGD-e
acucucuucagaaagu

SEQ ID NO: 2803079 - RNA, 22 nt, Listeria monocytogenes EGD-e
acucuuuggagugaggauuuuu

SEQ ID NO: 2803080 - RNA, 23 nt, Listeria monocytogenes EGD-e
acucuuuggagugaggauuuuuu

SEQ ID NO: 2803081 - RNA, 21 nt, Listeria monocytogenes EGD-e
acucuuuuauaaaaauacauu

SEQ ID NO: 2803082 - RNA, 14 nt, Listeria monocytogenes EGD-e
acugaacaaagaag

SEQ ID NO: 2803083 - RNA, 21 nt, Listeria monocytogenes EGD-e
acugacuagaaauuaaugcca

SEQ ID NO: 2803084 - RNA, 17 nt, Listeria monocytogenes EGD-e
acugcauaaaaaacauu

SEQ ID NO: 2803085 - RNA, 19 nt, Listeria monocytogenes EGD-e
acugcggcauagaaaguag

SEQ ID NO: 2803086 - RNA, 17 nt, Listeria monocytogenes EGD-e
acuggagcugauuuuau

SEQ ID NO: 2803087 - RNA, 23 nt, Listeria monocytogenes EGD-e
acugguuuuuuaaugcgaaaaau

SEQ ID NO: 2803088 - RNA, 23 nt, Listeria monocytogenes EGD-e
acugguuuuuugaugcgaaaaau

SEQ ID NO: 2803089 - RNA, 16 nt, Listeria monocytogenes EGD-e
acuguccggacuuagu

SEQ ID NO: 2803090 - RNA, 18 nt, Listeria monocytogenes EGD-e
acugugaacugauuuuuu

SEQ ID NO: 2803091 - RNA, 17 nt, Listeria monocytogenes EGD-e
acugugcucuuugcuuc

SEQ ID NO: 2803092 - RNA, 18 nt, Listeria monocytogenes EGD-e
acugugcucuuugcuuca

SEQ ID NO: 2803093 - RNA, 18 nt, Listeria monocytogenes EGD-e
acuguuguucuugccaaa

SEQ ID NO: 2803094 - RNA, 14 nt, Listeria monocytogenes EGD-e
acuguuguuuaaua

SEQ ID NO: 2803095 - RNA, 19 nt, Listeria monocytogenes EGD-e
acuguuguuuaauaugcau

SEQ ID NO: 2803096 - RNA, 22 nt, Listeria monocytogenes EGD-e
acuguuuccccgucuaagaaau

SEQ ID NO: 2803097 - RNA, 14 nt, Listeria monocytogenes EGD-e
acuguuuuugauuu

SEQ ID NO: 2803098 - RNA, 16 nt, Listeria monocytogenes EGD-e
acuuaacgaauuuuuc

SEQ ID NO: 2803099 - RNA, 17 nt, Listeria monocytogenes EGD-e
acuuaacgcgaaaugga

SEQ ID NO: 2803100 - RNA, 21 nt, Listeria monocytogenes EGD-e
acuuacagaagcauuuucaug

SEQ ID NO: 2803101 - RNA, 23 nt, Listeria monocytogenes EGD-e
acuuacggucuuuuuuucuuuaa

SEQ ID NO: 2803102 - RNA, 16 nt, Listeria monocytogenes EGD-e
acuuauaugaaaacuu

SEQ ID NO: 2803103 - RNA, 22 nt, Listeria monocytogenes EGD-e
acuuaucucuucauuuuucuag

SEQ ID NO: 2803104 - RNA, 23 nt, Listeria monocytogenes EGD-e
acuuaucucuucauuuuucuagu

SEQ ID NO: 2803105 - RNA, 18 nt, Listeria monocytogenes EGD-e
acuucaaaauuacuauuu

SEQ ID NO: 2803106 - RNA, 15 nt, Listeria monocytogenes EGD-e
acuucaugugcuuuu

SEQ ID NO: 2803107 - RNA, 21 nt, Listeria monocytogenes EGD-e
acuucaugugcuuuuuuuagu

SEQ ID NO: 2803108 - RNA, 15 nt, Listeria monocytogenes EGD-e
acuucauuagacaaa

SEQ ID NO: 2803109 - RNA, 19 nt, Listeria monocytogenes EGD-e
acuuccaugacaucuucua

SEQ ID NO: 2803110 - RNA, 16 nt, Listeria monocytogenes EGD-e
acuucgagcagcucca

SEQ ID NO: 2803111 - RNA, 18 nt, Listeria monocytogenes EGD-e
acuucggggcaaaaagga

SEQ ID NO: 2803112 - RNA, 16 nt, Listeria monocytogenes EGD-e
acuucuaccguuccuu

SEQ ID NO: 2803113 - RNA, 14 nt, Listeria monocytogenes EGD-e
acuucuuaagaauu

SEQ ID NO: 2803114 - RNA, 14 nt, Listeria monocytogenes EGD-e
acuugcaaaugcuu

SEQ ID NO: 2803115 - RNA, 16 nt, Listeria monocytogenes EGD-e
acuugcaucuucuguu

SEQ ID NO: 2803116 - RNA, 18 nt, Listeria monocytogenes EGD-e
acuugcaucuucuguuaa

SEQ ID NO: 2803117 - RNA, 13 nt, Listeria monocytogenes EGD-e
acuugugaaaguu

SEQ ID NO: 2803118 - RNA, 19 nt, Listeria monocytogenes EGD-e
acuugugaaaguuuuauga

SEQ ID NO: 2803119 - RNA, 23 nt, Listeria monocytogenes EGD-e
acuugugaaaguuuuaugacaau

SEQ ID NO: 2803120 - RNA, 22 nt, Listeria monocytogenes EGD-e
acuuucaauuaagucugcuucu

SEQ ID NO: 2803121 - RNA, 15 nt, Listeria monocytogenes EGD-e
acuuucaccaguuug

SEQ ID NO: 2803122 - RNA, 16 nt, Listeria monocytogenes EGD-e
acuuucaccaguuugu

SEQ ID NO: 2803123 - RNA, 13 nt, Listeria monocytogenes EGD-e
acuuucugccaaa

SEQ ID NO: 2803124 - RNA, 14 nt, Listeria monocytogenes EGD-e
acuuucugccaaau

SEQ ID NO: 2803125 - RNA, 21 nt, Listeria monocytogenes EGD-e
acuuugcuuguguaacauaaa

SEQ ID NO: 2803126 - RNA, 18 nt, Listeria monocytogenes EGD-e
acuuuuaaaauucuauua

SEQ ID NO: 2803127 - RNA, 13 nt, Listeria monocytogenes EGD-e
agccuugcugcgu

SEQ ID NO: 2803128 - RNA, 14 nt, Listeria monocytogenes EGD-e
agccuugcugcgug

SEQ ID NO: 2803129 - RNA, 15 nt, Listeria monocytogenes EGD-e
agcgaauuaauaaaa

SEQ ID NO: 2803130 - RNA, 17 nt, Listeria monocytogenes EGD-e
agcgacuuuugcagcug

SEQ ID NO: 2803131 - RNA, 19 nt, Listeria monocytogenes EGD-e
agcgacuuuugcagcugga

SEQ ID NO: 2803132 - RNA, 15 nt, Listeria monocytogenes EGD-e
agcgcaucucuaaca

SEQ ID NO: 2803133 - RNA, 18 nt, Listeria monocytogenes EGD-e
agcgguuuuguuuccaac

SEQ ID NO: 2803134 - RNA, 18 nt, Listeria monocytogenes EGD-e
agcguaccauucacuucg

SEQ ID NO: 2803135 - RNA, 19 nt, Listeria monocytogenes EGD-e
agcguauccaccaaaaacu

SEQ ID NO: 2803136 - RNA, 15 nt, Listeria monocytogenes EGD-e
agcguucuaaugaua

SEQ ID NO: 2803137 - RNA, 18 nt, Listeria monocytogenes EGD-e
agcuaagcauuauaaaaa

SEQ ID NO: 2803138 - RNA, 16 nt, Listeria monocytogenes EGD-e
agcuaaucguuuuaaa

SEQ ID NO: 2803139 - RNA, 20 nt, Listeria monocytogenes EGD-e
agcuaaucguuuuaaagcuu

SEQ ID NO: 2803140 - RNA, 17 nt, Listeria monocytogenes EGD-e
agcuaccacaagaaggg

SEQ ID NO: 2803141 - RNA, 19 nt, Listeria monocytogenes EGD-e
agcuagacaagcacuuacu

SEQ ID NO: 2803142 - RNA, 18 nt, Listeria monocytogenes EGD-e
agcuaugugcgaugccac

SEQ ID NO: 2803143 - RNA, 16 nt, Listeria monocytogenes EGD-e
agcuauuuuuuugcuu

SEQ ID NO: 2803144 - RNA, 19 nt, Listeria monocytogenes EGD-e
agcuauuuuuuugcuuuuu

SEQ ID NO: 2803145 - RNA, 18 nt, Listeria monocytogenes EGD-e
agcuccauuaaaugacca

SEQ ID NO: 2803146 - RNA, 19 nt, Listeria monocytogenes EGD-e
agcuccugccguaugucca

SEQ ID NO: 2803147 - RNA, 20 nt, Listeria monocytogenes EGD-e
agcucuuuuuuuauuuucau

SEQ ID NO: 2803148 - RNA, 14 nt, Listeria monocytogenes EGD-e
agcugccaccacuu

SEQ ID NO: 2803149 - RNA, 18 nt, Listeria monocytogenes EGD-e
agcugcuucaagcgaaau

SEQ ID NO: 2803150 - RNA, 13 nt, Listeria monocytogenes EGD-e
agcuguaaaugaa

SEQ ID NO: 2803151 - RNA, 13 nt, Listeria monocytogenes EGD-e
agcuguaucaaug

SEQ ID NO: 2803152 - RNA, 15 nt, Listeria monocytogenes EGD-e
agcuguaucaaugau

SEQ ID NO: 2803153 - RNA, 19 nt, Listeria monocytogenes EGD-e
agcuuccauacuuucugcc

SEQ ID NO: 2803154 - RNA, 21 nt, Listeria monocytogenes EGD-e
agcuucuaagucaaaacguuc

SEQ ID NO: 2803155 - RNA, 23 nt, Listeria monocytogenes EGD-e
agcuucuaagucaaaacguucga

SEQ ID NO: 2803156 - RNA, 22 nt, Listeria monocytogenes EGD-e
agcuucuuccauuuguucucua

SEQ ID NO: 2803157 - RNA, 17 nt, Listeria monocytogenes EGD-e
agcuugauuaaaaccaa

SEQ ID NO: 2803158 - RNA, 21 nt, Listeria monocytogenes EGD-e
agcuuuuacgaucuacuucua

SEQ ID NO: 2803159 - RNA, 20 nt, Listeria monocytogenes EGD-e
aggaaacgaauaaaaucaua

SEQ ID NO: 2803160 - RNA, 23 nt, Listeria monocytogenes EGD-e
aggaaacgaauaaaaucauaaua

SEQ ID NO: 2803161 - RNA, 17 nt, Listeria monocytogenes EGD-e
aggaauuucgaaauuaa

SEQ ID NO: 2803162 - RNA, 14 nt, Listeria monocytogenes EGD-e
aggaauuuuuccau

SEQ ID NO: 2803163 - RNA, 13 nt, Listeria monocytogenes EGD-e
aggacaagcccag

SEQ ID NO: 2803164 - RNA, 19 nt, Listeria monocytogenes EGD-e
aggagaaaucaagugcagc

SEQ ID NO: 2803165 - RNA, 20 nt, Listeria monocytogenes EGD-e
aggagaaggcuuuuuaugca

SEQ ID NO: 2803166 - RNA, 19 nt, Listeria monocytogenes EGD-e
aggagacauuaaaccgaua

SEQ ID NO: 2803167 - RNA, 22 nt, Listeria monocytogenes EGD-e
aggauauuuuuuucgaaagaaa

SEQ ID NO: 2803168 - RNA, 14 nt, Listeria monocytogenes EGD-e
aggauuaaaauaaa

SEQ ID NO: 2803169 - RNA, 19 nt, Listeria monocytogenes EGD-e
aggauuugucacuuggaaa

SEQ ID NO: 2803170 - RNA, 19 nt, Listeria monocytogenes EGD-e
aggcaaaucuuucggcaca

SEQ ID NO: 2803171 - RNA, 12 nt, Listeria monocytogenes EGD-e
aggcguaucuuu

SEQ ID NO: 2803172 - RNA, 16 nt, Listeria monocytogenes EGD-e
aggcucucuucgccac

SEQ ID NO: 2803173 - RNA, 22 nt, Listeria monocytogenes EGD-e
aggcucucuucgccaccuucaa

SEQ ID NO: 2803174 - RNA, 20 nt, Listeria monocytogenes EGD-e
aggcucuuccuuuuguuuua

SEQ ID NO: 2803175 - RNA, 22 nt, Listeria monocytogenes EGD-e
aggcucuuccuuuuguuuuaau

SEQ ID NO: 2803176 - RNA, 21 nt, Listeria monocytogenes EGD-e
aggcuuuuaacuuucuuguuu

SEQ ID NO: 2803177 - RNA, 16 nt, Listeria monocytogenes EGD-e
aggucaggauuaaaag

SEQ ID NO: 2803178 - RNA, 17 nt, Listeria monocytogenes EGD-e
agguucaccaaaugcuu

SEQ ID NO: 2803179 - RNA, 16 nt, Listeria monocytogenes EGD-e
agguugcgguuucuuu

SEQ ID NO: 2803180 - RNA, 18 nt, Listeria monocytogenes EGD-e
agguugcgguuucuuuua

SEQ ID NO: 2803181 - RNA, 22 nt, Listeria monocytogenes EGD-e
aguaaaacaagaggcuuauucc

SEQ ID NO: 2803182 - RNA, 11 nt, Listeria monocytogenes EGD-e
aguaaacauuu

SEQ ID NO: 2803183 - RNA, 12 nt, Listeria monocytogenes EGD-e
aguaaacauuuc

SEQ ID NO: 2803184 - RNA, 19 nt, Listeria monocytogenes EGD-e
aguaacuuuaucaagaaca

SEQ ID NO: 2803185 - RNA, 19 nt, Listeria monocytogenes EGD-e
aguaauaaaauaggcaaau

SEQ ID NO: 2803186 - RNA, 12 nt, Listeria monocytogenes EGD-e
aguaauacgcug

SEQ ID NO: 2803187 - RNA, 16 nt, Listeria monocytogenes EGD-e
aguaauauuauaucca

SEQ ID NO: 2803188 - RNA, 21 nt, Listeria monocytogenes EGD-e
aguaauggagcaagugugaaa

SEQ ID NO: 2803189 - RNA, 15 nt, Listeria monocytogenes EGD-e
aguacaucaagugcu

SEQ ID NO: 2803190 - RNA, 16 nt, Listeria monocytogenes EGD-e
aguaccugcaagcgaa

SEQ ID NO: 2803191 - RNA, 16 nt, Listeria monocytogenes EGD-e
aguacgaaaucaaacu

SEQ ID NO: 2803192 - RNA, 17 nt, Listeria monocytogenes EGD-e
aguagcaauuuuaaauc

SEQ ID NO: 2803193 - RNA, 20 nt, Listeria monocytogenes EGD-e
aguagcacuccuugaucugc

SEQ ID NO: 2803194 - RNA, 18 nt, Listeria monocytogenes EGD-e
aguagcaggacaugcuaa

SEQ ID NO: 2803195 - RNA, 19 nt, Listeria monocytogenes EGD-e
aguagcaggacaugcuaaa

SEQ ID NO: 2803196 - RNA, 13 nt, Listeria monocytogenes EGD-e
aguagcauuuucg

SEQ ID NO: 2803197 - RNA, 15 nt, Listeria monocytogenes EGD-e
aguaguaagggugaa

SEQ ID NO: 2803198 - RNA, 15 nt, Listeria monocytogenes EGD-e
aguaguuauuucuuu

SEQ ID NO: 2803199 - RNA, 13 nt, Listeria monocytogenes EGD-e
aguaguuuacuuc

SEQ ID NO: 2803200 - RNA, 21 nt, Listeria monocytogenes EGD-e
aguauguuucggguuuguuaa

SEQ ID NO: 2803201 - RNA, 19 nt, Listeria monocytogenes EGD-e
aguauuuccccgcagaaaa

SEQ ID NO: 2803202 - RNA, 23 nt, Listeria monocytogenes EGD-e
agucacagcguauccaccaaaaa

SEQ ID NO: 2803203 - RNA, 21 nt, Listeria monocytogenes EGD-e
agucacuagcgcacaaguaau

SEQ ID NO: 2803204 - RNA, 14 nt, Listeria monocytogenes EGD-e
agucacuuugcuug

SEQ ID NO: 2803205 - RNA, 20 nt, Listeria monocytogenes EGD-e
agucaugacagcaucuuuuu

SEQ ID NO: 2803206 - RNA, 15 nt, Listeria monocytogenes EGD-e
aguccaaagagccau

SEQ ID NO: 2803207 - RNA, 21 nt, Listeria monocytogenes EGD-e
agucccauuacugucgcaaaa

SEQ ID NO: 2803208 - RNA, 22 nt, Listeria monocytogenes EGD-e
agucccauuacugucgcaaaaa

SEQ ID NO: 2803209 - RNA, 16 nt, Listeria monocytogenes EGD-e
aguccgucaagcccag

SEQ ID NO: 2803210 - RNA, 12 nt, Listeria monocytogenes EGD-e
agucgaaagugc

SEQ ID NO: 2803211 - RNA, 13 nt, Listeria monocytogenes EGD-e
agucuauuucagc

SEQ ID NO: 2803212 - RNA, 14 nt, Listeria monocytogenes EGD-e
agucuuuuuguaaa

SEQ ID NO: 2803213 - RNA, 15 nt, Listeria monocytogenes EGD-e
agugcaucuucuaag

SEQ ID NO: 2803214 - RNA, 18 nt, Listeria monocytogenes EGD-e
agugcaucuucuaagaaa

SEQ ID NO: 2803215 - RNA, 16 nt, Listeria monocytogenes EGD-e
agugcguaagauuuuu

SEQ ID NO: 2803216 - RNA, 18 nt, Listeria monocytogenes EGD-e
agugcuaaaauaaaucug

SEQ ID NO: 2803217 - RNA, 15 nt, Listeria monocytogenes EGD-e
aguggcugaaacaau

SEQ ID NO: 2803218 - RNA, 19 nt, Listeria monocytogenes EGD-e
agugggcaaccuaguuuua

SEQ ID NO: 2803219 - RNA, 19 nt, Listeria monocytogenes EGD-e
aguggguaggcgaauccuu

SEQ ID NO: 2803220 - RNA, 15 nt, Listeria monocytogenes EGD-e
agugguaguguaauu

SEQ ID NO: 2803221 - RNA, 19 nt, Listeria monocytogenes EGD-e
aguguaaucuugaugccau

SEQ ID NO: 2803222 - RNA, 15 nt, Listeria monocytogenes EGD-e
aguguaauugauuug

SEQ ID NO: 2803223 - RNA, 19 nt, Listeria monocytogenes EGD-e
agugucaguguuuuuguau

SEQ ID NO: 2803224 - RNA, 23 nt, Listeria monocytogenes EGD-e
aguuaaacaaacacaaaaugcuc

SEQ ID NO: 2803225 - RNA, 22 nt, Listeria monocytogenes EGD-e
aguuaauucuguuaaaggagaa

SEQ ID NO: 2803226 - RNA, 17 nt, Listeria monocytogenes EGD-e
aguuacuuuaccuugau

SEQ ID NO: 2803227 - RNA, 22 nt, Listeria monocytogenes EGD-e
aguuacuuuaccuugaucaaaa

SEQ ID NO: 2803228 - RNA, 15 nt, Listeria monocytogenes EGD-e
auacuauugaauguu

SEQ ID NO: 2803229 - RNA, 18 nt, Listeria monocytogenes EGD-e
auacuauugaauguucua

SEQ ID NO: 2803230 - RNA, 13 nt, Listeria monocytogenes EGD-e
auacucuuuaaau

SEQ ID NO: 2803231 - RNA, 15 nt, Listeria monocytogenes EGD-e
auacuucaaaaccuu

SEQ ID NO: 2803232 - RNA, 13 nt, Listeria monocytogenes EGD-e
auacuucaugugc

SEQ ID NO: 2803233 - RNA, 19 nt, Listeria monocytogenes EGD-e
auacuucaugugcuuuuuu

SEQ ID NO: 2803234 - RNA, 20 nt, Listeria monocytogenes EGD-e
auacuuugaauuaagaagua

SEQ ID NO: 2803235 - RNA, 19 nt, Listeria monocytogenes EGD-e
auagaagguauugagugcu

SEQ ID NO: 2803236 - RNA, 23 nt, Listeria monocytogenes EGD-e
auagaagguauugagugcuuucg

SEQ ID NO: 2803237 - RNA, 21 nt, Listeria monocytogenes EGD-e
auagagcuuuuaaauauaccg

SEQ ID NO: 2803238 - RNA, 18 nt, Listeria monocytogenes EGD-e
auagauacucuuuaaauc

SEQ ID NO: 2803239 - RNA, 22 nt, Listeria monocytogenes EGD-e
auagauugauguuguaaauacu

SEQ ID NO: 2803240 - RNA, 14 nt, Listeria monocytogenes EGD-e
auagccaagauuaa

SEQ ID NO: 2803241 - RNA, 14 nt, Listeria monocytogenes EGD-e
auagcccgcugccu

SEQ ID NO: 2803242 - RNA, 21 nt, Listeria monocytogenes EGD-e
auagccggaccugaaagaacu

SEQ ID NO: 2803243 - RNA, 15 nt, Listeria monocytogenes EGD-e
auagcggucaaucau

SEQ ID NO: 2803244 - RNA, 19 nt, Listeria monocytogenes EGD-e
auagcggucaaucauuucu

SEQ ID NO: 2803245 - RNA, 13 nt, Listeria monocytogenes EGD-e
auagcuacaauua

SEQ ID NO: 2803246 - RNA, 18 nt, Listeria monocytogenes EGD-e
auagcuacaauuaaaaua

SEQ ID NO: 2803247 - RNA, 19 nt, Listeria monocytogenes EGD-e
auagcuuucccuuuacuug

SEQ ID NO: 2803248 - RNA, 20 nt, Listeria monocytogenes EGD-e
auaggcgcgaguacaauuau

SEQ ID NO: 2803249 - RNA, 17 nt, Listeria monocytogenes EGD-e
auagguaacaucuucca

SEQ ID NO: 2803250 - RNA, 15 nt, Listeria monocytogenes EGD-e
auaguaaaaaaacua

SEQ ID NO: 2803251 - RNA, 24 nt, Listeria monocytogenes EGD-e
auagucauaagcuaacaacaagca

SEQ ID NO: 2803252 - RNA, 19 nt, Listeria monocytogenes EGD-e
auagucuacuuuuaaaauu

SEQ ID NO: 2803253 - RNA, 14 nt, Listeria monocytogenes EGD-e
auaguuuucuacua

SEQ ID NO: 2803254 - RNA, 15 nt, Listeria monocytogenes EGD-e
auauaaagauccauc

SEQ ID NO: 2803255 - RNA, 21 nt, Listeria monocytogenes EGD-e
auauaagcggguguccaaaaa

SEQ ID NO: 2803256 - RNA, 21 nt, Listeria monocytogenes EGD-e
auauaaguguuaguuguugca

SEQ ID NO: 2803257 - RNA, 21 nt, Listeria monocytogenes EGD-e
auauaaugauucaaagcuacu

SEQ ID NO: 2803258 - RNA, 23 nt, Listeria monocytogenes EGD-e
auauaaugauucaaagcuacuuu

SEQ ID NO: 2803259 - RNA, 12 nt, Listeria monocytogenes EGD-e
auauaauuuuuu

SEQ ID NO: 2803260 - RNA, 23 nt, Listeria monocytogenes EGD-e
auauacacaaaguaaaaaggaaa

SEQ ID NO: 2803261 - RNA, 22 nt, Listeria monocytogenes EGD-e
auaucaccaacaauuacuucca

SEQ ID NO: 2803262 - RNA, 22 nt, Listeria monocytogenes EGD-e
auaucaucaauuaaauuauaca

SEQ ID NO: 2803263 - RNA, 20 nt, Listeria monocytogenes EGD-e
auauccggcguacuuaaauc

SEQ ID NO: 2803264 - RNA, 20 nt, Listeria monocytogenes EGD-e
auauccguuucauuuuugau

SEQ ID NO: 2803265 - RNA, 14 nt, Listeria monocytogenes EGD-e
auauccuuguuguu

SEQ ID NO: 2803266 - RNA, 20 nt, Listeria monocytogenes EGD-e
auaucuuaggaauuucgaaa

SEQ ID NO: 2803267 - RNA, 15 nt, Listeria monocytogenes EGD-e
auaugcgcagaaagu

SEQ ID NO: 2803268 - RNA, 19 nt, Listeria monocytogenes EGD-e
auaugcgcagaaaguuggg

SEQ ID NO: 2803269 - RNA, 19 nt, Listeria monocytogenes EGD-e
auauuaaugucaauuauuc

SEQ ID NO: 2803270 - RNA, 14 nt, Listeria monocytogenes EGD-e
auauuaauuugauu

SEQ ID NO: 2803271 - RNA, 16 nt, Listeria monocytogenes EGD-e
auauuagaaaaucauu

SEQ ID NO: 2803272 - RNA, 18 nt, Listeria monocytogenes EGD-e
auauuauacuuggaauaa

SEQ ID NO: 2803273 - RNA, 17 nt, Listeria monocytogenes EGD-e
auauucacaucacuaau

SEQ ID NO: 2803274 - RNA, 19 nt, Listeria monocytogenes EGD-e
auauucauuauuaaacuca

SEQ ID NO: 2803275 - RNA, 18 nt, Listeria monocytogenes EGD-e
auauucuucuaaaauaac

SEQ ID NO: 2803276 - RNA, 23 nt, Listeria monocytogenes EGD-e
auauucuucugucacaucuguuc

SEQ ID NO: 2803277 - RNA, 16 nt, Listeria monocytogenes EGD-e
auauuuggccaauuaa

SEQ ID NO: 2803278 - RNA, 18 nt, Listeria monocytogenes EGD-e
auauuuggccaauuaaaa

SEQ ID NO: 2803279 - RNA, 20 nt, Listeria monocytogenes EGD-e
auauuuggccaauuaaaaua

SEQ ID NO: 2803280 - RNA, 22 nt, Listeria monocytogenes EGD-e
auauuuggccaauuaaaauacg

SEQ ID NO: 2803281 - RNA, 21 nt, Listeria monocytogenes EGD-e
aucaaaaugggcaguuacuuu

SEQ ID NO: 2803282 - RNA, 22 nt, Listeria monocytogenes EGD-e
aucaaaauucaguuuauaaaua

SEQ ID NO: 2803283 - RNA, 22 nt, Listeria monocytogenes EGD-e
aucaaauaaccauuauuuggaa

SEQ ID NO: 2803284 - RNA, 22 nt, Listeria monocytogenes EGD-e
aucaaauccaagcacaugucca

SEQ ID NO: 2803285 - RNA, 15 nt, Listeria monocytogenes EGD-e
aucaaccacuuuugc

SEQ ID NO: 2803286 - RNA, 20 nt, Listeria monocytogenes EGD-e
aucaacgggcgcuuucacau

SEQ ID NO: 2803287 - RNA, 23 nt, Listeria monocytogenes EGD-e
aucaagccuaggcucucuucgcc

SEQ ID NO: 2803288 - RNA, 22 nt, Listeria monocytogenes EGD-e
aucaagggaagcuuuugcuaca

SEQ ID NO: 2803289 - RNA, 17 nt, Listeria monocytogenes EGD-e
aucaaguaauaagaaga

SEQ ID NO: 2803290 - RNA, 23 nt, Listeria monocytogenes EGD-e
aucaaguaauaagaagauauuuu

SEQ ID NO: 2803291 - RNA, 23 nt, Listeria monocytogenes EGD-e
aucaagugcagcgacaauuaugu

SEQ ID NO: 2803292 - RNA, 23 nt, Listeria monocytogenes EGD-e
aucaagugcuucaucuuuauaaa

SEQ ID NO: 2803293 - RNA, 15 nt, Listeria monocytogenes EGD-e
aucaauaaagaagca

SEQ ID NO: 2803294 - RNA, 15 nt, Listeria monocytogenes EGD-e
aucaauaacaaucca

SEQ ID NO: 2803295 - RNA, 19 nt, Listeria monocytogenes EGD-e
aucaauagcagaaucuaca

SEQ ID NO: 2803296 - RNA, 21 nt, Listeria monocytogenes EGD-e
aucaauagcagaaucuacaac

SEQ ID NO: 2803297 - RNA, 15 nt, Listeria monocytogenes EGD-e
aucaauaucuuuauu

SEQ ID NO: 2803298 - RNA, 16 nt, Listeria monocytogenes EGD-e
aucaaucgccaguugc

SEQ ID NO: 2803299 - RNA, 20 nt, Listeria monocytogenes EGD-e
aucaaugauaucaucaauaa

SEQ ID NO: 2803300 - RNA, 22 nt, Listeria monocytogenes EGD-e
aucaaugauaucaucaauaaua

SEQ ID NO: 2803301 - RNA, 15 nt, Listeria monocytogenes EGD-e
aucaauuaaauuaua

SEQ ID NO: 2803302 - RNA, 22 nt, Listeria monocytogenes EGD-e
aucaauuacgcuuuaguuugua

SEQ ID NO: 2803303 - RNA, 22 nt, Listeria monocytogenes EGD-e
aucaauuuacguuguucuaaca

SEQ ID NO: 2803304 - RNA, 20 nt, Listeria monocytogenes EGD-e
aucacaaaccaaauaccgaa

SEQ ID NO: 2803305 - RNA, 20 nt, Listeria monocytogenes EGD-e
aucaccaacaauuacuucca

SEQ ID NO: 2803306 - RNA, 16 nt, Listeria monocytogenes EGD-e
aucaccagcuucuaag

SEQ ID NO: 2803307 - RNA, 16 nt, Listeria monocytogenes EGD-e
aucacgagaaagccaa

SEQ ID NO: 2803308 - RNA, 22 nt, Listeria monocytogenes EGD-e
aucacguaaggauuugucacuu

SEQ ID NO: 2803309 - RNA, 18 nt, Listeria monocytogenes EGD-e
aucacuaauuagcauaau

SEQ ID NO: 2803310 - RNA, 20 nt, Listeria monocytogenes EGD-e
aucacuaauuagcauaauau

SEQ ID NO: 2803311 - RNA, 21 nt, Listeria monocytogenes EGD-e
aucacuaauuagcauaauauc

SEQ ID NO: 2803312 - RNA, 23 nt, Listeria monocytogenes EGD-e
aucagaagcgaugugggaaugaa

SEQ ID NO: 2803313 - RNA, 19 nt, Listeria monocytogenes EGD-e
aucagcuuuuuuuauuuug

SEQ ID NO: 2803314 - RNA, 13 nt, Listeria monocytogenes EGD-e
aucauaaacauuu

SEQ ID NO: 2803315 - RNA, 14 nt, Listeria monocytogenes EGD-e
aucauaaacauuug

SEQ ID NO: 2803316 - RNA, 16 nt, Listeria monocytogenes EGD-e
aucauauucuucuaaa

SEQ ID NO: 2803317 - RNA, 20 nt, Listeria monocytogenes EGD-e
aucauauucuucuaaaauaa

SEQ ID NO: 2803318 - RNA, 16 nt, Listeria monocytogenes EGD-e
aucaucacguaaggau

SEQ ID NO: 2803319 - RNA, 14 nt, Listeria monocytogenes EGD-e
aucaucuucucgaa

SEQ ID NO: 2803320 - RNA, 16 nt, Listeria monocytogenes EGD-e
aucaugccagcuucuu

SEQ ID NO: 2803321 - RNA, 17 nt, Listeria monocytogenes EGD-e
aucaugccagcuucuuc

SEQ ID NO: 2803322 - RNA, 19 nt, Listeria monocytogenes EGD-e
aucaugccagcuucuucca

SEQ ID NO: 2803323 - RNA, 15 nt, Listeria monocytogenes EGD-e
aucaugccuucaaac

SEQ ID NO: 2803324 - RNA, 16 nt, Listeria monocytogenes EGD-e
aucaugccuucaaaca

SEQ ID NO: 2803325 - RNA, 23 nt, Listeria monocytogenes EGD-e
aucauuaaagcuauauaaucuca

SEQ ID NO: 2803326 - RNA, 19 nt, Listeria monocytogenes EGD-e
aucauuaaauauacacaaa

SEQ ID NO: 2803327 - RNA, 18 nt, Listeria monocytogenes EGD-e
aucauuaaauuuagcuag

SEQ ID NO: 2803328 - RNA, 18 nt, Listeria monocytogenes EGD-e
auggaaguaaugguguaa

SEQ ID NO: 2803329 - RNA, 21 nt, Listeria monocytogenes EGD-e
auggaaugcgguaacuaaaau

SEQ ID NO: 2803330 - RNA, 13 nt, Listeria monocytogenes EGD-e
auggcauaaaaaa

SEQ ID NO: 2803331 - RNA, 14 nt, Listeria monocytogenes EGD-e
auggcauaaaaaau

SEQ ID NO: 2803332 - RNA, 17 nt, Listeria monocytogenes EGD-e
auggccucguaaucuug

SEQ ID NO: 2803333 - RNA, 21 nt, Listeria monocytogenes EGD-e
auggcugggaguuuuuuauua

SEQ ID NO: 2803334 - RNA, 23 nt, Listeria monocytogenes EGD-e
auguaauucuaaauaaauauuuu

SEQ ID NO: 2803335 - RNA, 23 nt, Listeria monocytogenes EGD-e
auguaguuauagcggucaaucau

SEQ ID NO: 2803336 - RNA, 14 nt, Listeria monocytogenes EGD-e
auguauacaggaac

SEQ ID NO: 2803337 - RNA, 14 nt, Listeria monocytogenes EGD-e
auguaucuaaaauc

SEQ ID NO: 2803338 - RNA, 22 nt, Listeria monocytogenes EGD-e
auguccuaggcgcucuuuaaua

SEQ ID NO: 2803339 - RNA, 19 nt, Listeria monocytogenes EGD-e
augucgguucggagacaga

SEQ ID NO: 2803340 - RNA, 15 nt, Listeria monocytogenes EGD-e
augugaccuuaaauu

SEQ ID NO: 2803341 - RNA, 21 nt, Listeria monocytogenes EGD-e
augugcuuguaagaagcuuuu

SEQ ID NO: 2803342 - RNA, 14 nt, Listeria monocytogenes EGD-e
auguguugcuuuua

SEQ ID NO: 2803343 - RNA, 23 nt, Listeria monocytogenes EGD-e
auguguugcuuuuauuuuuaaag

SEQ ID NO: 2803344 - RNA, 14 nt, Listeria monocytogenes EGD-e
auguuaaauucauu

SEQ ID NO: 2803345 - RNA, 16 nt, Listeria monocytogenes EGD-e
auguuaaauucauuua

SEQ ID NO: 2803346 - RNA, 14 nt, Listeria monocytogenes EGD-e
auguugcaauuuug

SEQ ID NO: 2803347 - RNA, 21 nt, Listeria monocytogenes EGD-e
auguugguguaggaagugaug

SEQ ID NO: 2803348 - RNA, 15 nt, Listeria monocytogenes EGD-e
auguuguuuuagaua

SEQ ID NO: 2803349 - RNA, 10 nt, Listeria monocytogenes EGD-e
auguuuuccc

SEQ ID NO: 2803350 - RNA, 17 nt, Listeria monocytogenes EGD-e
auuaaaaagcuuauuaa

SEQ ID NO: 2803351 - RNA, 20 nt, Listeria monocytogenes EGD-e
auuaaaaaggaauuuuucca

SEQ ID NO: 2803352 - RNA, 19 nt, Listeria monocytogenes EGD-e
auuaaaaguuguauagcuu

SEQ ID NO: 2803353 - RNA, 21 nt, Listeria monocytogenes EGD-e
auuaaaccgauaauuuucauu

SEQ ID NO: 2803354 - RNA, 19 nt, Listeria monocytogenes EGD-e
auuaaaccucuuuuuuuag

SEQ ID NO: 2803355 - RNA, 16 nt, Listeria monocytogenes EGD-e
auuaaagcuauauaau

SEQ ID NO: 2803356 - RNA, 22 nt, Listeria monocytogenes EGD-e
auuaaauuuuuuugaaaaaaca

SEQ ID NO: 2803357 - RNA, 23 nt, Listeria monocytogenes EGD-e
auuaaauuuuuuugaaaaaacau

SEQ ID NO: 2803358 - RNA, 14 nt, Listeria monocytogenes EGD-e
auuaacaaccauuu

SEQ ID NO: 2803359 - RNA, 16 nt, Listeria monocytogenes EGD-e
auuaaccuacuuuaau

SEQ ID NO: 2803360 - RNA, 21 nt, Listeria monocytogenes EGD-e
auuaagaaguacaauaaaguu

SEQ ID NO: 2803361 - RNA, 19 nt, Listeria monocytogenes EGD-e
auuaauaaaagaggauuuu

SEQ ID NO: 2803362 - RNA, 22 nt, Listeria monocytogenes EGD-e
auuaauaaaagaggauuuucca

SEQ ID NO: 2803363 - RNA, 11 nt, Listeria monocytogenes EGD-e
auuaaugacug

SEQ ID NO: 2803364 - RNA, 16 nt, Listeria monocytogenes EGD-e
auuaaugacuguuguu

SEQ ID NO: 2803365 - RNA, 18 nt, Listeria monocytogenes EGD-e
auuaaugauuucaauaau

SEQ ID NO: 2803366 - RNA, 19 nt, Listeria monocytogenes EGD-e
auuaauuugaccaccuaau

SEQ ID NO: 2803367 - RNA, 22 nt, Listeria monocytogenes EGD-e
auuaauuugauugccugaaaua

SEQ ID NO: 2803368 - RNA, 23 nt, Listeria monocytogenes EGD-e
auuaauuugauugccugaaauaa

SEQ ID NO: 2803369 - RNA, 12 nt, Listeria monocytogenes EGD-e
auuacaaaauuu

SEQ ID NO: 2803370 - RNA, 22 nt, Listeria monocytogenes EGD-e
auuacaaaauuugucuuuacua

SEQ ID NO: 2803371 - RNA, 19 nt, Listeria monocytogenes EGD-e
auuacauuaaguuuacaau

SEQ ID NO: 2803372 - RNA, 17 nt, Listeria monocytogenes EGD-e
auuaccucgcuuuaaua

SEQ ID NO: 2803373 - RNA, 13 nt, Listeria monocytogenes EGD-e
auuacuaaaaagg

SEQ ID NO: 2803374 - RNA, 16 nt, Listeria monocytogenes EGD-e
auuacuagcuuugucu

SEQ ID NO: 2803375 - RNA, 16 nt, Listeria monocytogenes EGD-e
auuacuccaaaauaaa

SEQ ID NO: 2803376 - RNA, 19 nt, Listeria monocytogenes EGD-e
auuacuccaaaauaaaaug

SEQ ID NO: 2803377 - RNA, 13 nt, Listeria monocytogenes EGD-e
auuacucgguuca

SEQ ID NO: 2803378 - RNA, 12 nt, Listeria monocytogenes EGD-e
auuacuuuaauu

SEQ ID NO: 2803379 - RNA, 14 nt, Listeria monocytogenes EGD-e
auuagaaaaucauu

SEQ ID NO: 2803380 - RNA, 16 nt, Listeria monocytogenes EGD-e
auuagaaaaucauuuc

SEQ ID NO: 2803381 - RNA, 16 nt, Listeria monocytogenes EGD-e
auuagaaugcuaaauu

SEQ ID NO: 2803382 - RNA, 23 nt, Listeria monocytogenes EGD-e
auuagacauauaucuuaggaauu

SEQ ID NO: 2803383 - RNA, 21 nt, Listeria monocytogenes EGD-e
auuagcuaggccuacuuuuuu

SEQ ID NO: 2803384 - RNA, 15 nt, Listeria monocytogenes EGD-e
auuaggcauuucuuu

SEQ ID NO: 2803385 - RNA, 17 nt, Listeria monocytogenes EGD-e
auuaggcauuucuuuga

SEQ ID NO: 2803386 - RNA, 18 nt, Listeria monocytogenes EGD-e
auuauaaccccaaaaugc

SEQ ID NO: 2803387 - RNA, 18 nt, Listeria monocytogenes EGD-e
auuauaaguguaaaaguu

SEQ ID NO: 2803388 - RNA, 17 nt, Listeria monocytogenes EGD-e
auuauacuuggaauaaa

SEQ ID NO: 2803389 - RNA, 17 nt, Listeria monocytogenes EGD-e
auuauggaaaaauccac

SEQ ID NO: 2803390 - RNA, 22 nt, Listeria monocytogenes EGD-e
auuaugucggugcauuuuuucu

SEQ ID NO: 2803391 - RNA, 13 nt, Listeria monocytogenes EGD-e
auuauugcuuuuu

SEQ ID NO: 2803392 - RNA, 13 nt, Listeria monocytogenes EGD-e
auucaaaauggua

SEQ ID NO: 2803393 - RNA, 11 nt, Listeria monocytogenes EGD-e
auucaaaucac

SEQ ID NO: 2803394 - RNA, 13 nt, Listeria monocytogenes EGD-e
auucaaauucaau

SEQ ID NO: 2803395 - RNA, 22 nt, Listeria monocytogenes EGD-e
auucaauacuuuuuucuauauu

SEQ ID NO: 2803396 - RNA, 21 nt, Listeria monocytogenes EGD-e
auucaauucccaggcugcuug

SEQ ID NO: 2803397 - RNA, 16 nt, Listeria monocytogenes EGD-e
auucagccguuuccuc

SEQ ID NO: 2803398 - RNA, 22 nt, Listeria monocytogenes EGD-e
auucaugcaagcgcagaaugaa

SEQ ID NO: 2803399 - RNA, 16 nt, Listeria monocytogenes EGD-e
auucauugacaaguuc

SEQ ID NO: 2803400 - RNA, 14 nt, Listeria monocytogenes EGD-e
auuccaaaaucgca

SEQ ID NO: 2803401 - RNA, 12 nt, Listeria monocytogenes EGD-e
auuccacuuuua

SEQ ID NO: 2803402 - RNA, 21 nt, Listeria monocytogenes EGD-e
auuccagcuagacaagcacuu

SEQ ID NO: 2803403 - RNA, 21 nt, Listeria monocytogenes EGD-e
auuccguucauuugaaaaagg

SEQ ID NO: 2803404 - RNA, 15 nt, Listeria monocytogenes EGD-e
auuccucaaugagga

SEQ ID NO: 2803405 - RNA, 12 nt, Listeria monocytogenes EGD-e
auuccucauuga

SEQ ID NO: 2803406 - RNA, 17 nt, Listeria monocytogenes EGD-e
auucgaauaaagaacuu

SEQ ID NO: 2803407 - RNA, 15 nt, Listeria monocytogenes EGD-e
auucgaauaagaacc

SEQ ID NO: 2803408 - RNA, 15 nt, Listeria monocytogenes EGD-e
auucgaguuucuguu

SEQ ID NO: 2803409 - RNA, 19 nt, Listeria monocytogenes EGD-e
auucgaguuucuguucuuu

SEQ ID NO: 2803410 - RNA, 12 nt, Listeria monocytogenes EGD-e
auucggcuucaa

SEQ ID NO: 2803411 - RNA, 21 nt, Listeria monocytogenes EGD-e
auucuagccgcucgucuaaau

SEQ ID NO: 2803412 - RNA, 19 nt, Listeria monocytogenes EGD-e
auucugaaaugauuuuuau

SEQ ID NO: 2803413 - RNA, 17 nt, Listeria monocytogenes EGD-e
auucugcgauuuuuucu

SEQ ID NO: 2803414 - RNA, 14 nt, Listeria monocytogenes EGD-e
auucugugauggaa

SEQ ID NO: 2803415 - RNA, 19 nt, Listeria monocytogenes EGD-e
auucugugauggaaguaau

SEQ ID NO: 2803416 - RNA, 17 nt, Listeria monocytogenes EGD-e
auucuguuaaaggagaa

SEQ ID NO: 2803417 - RNA, 17 nt, Listeria monocytogenes EGD-e
auucuucgcuuguuuug

SEQ ID NO: 2803418 - RNA, 21 nt, Listeria monocytogenes EGD-e
auucuucuaaaauaacauccg

SEQ ID NO: 2803419 - RNA, 16 nt, Listeria monocytogenes EGD-e
auucuucuaauacauu

SEQ ID NO: 2803420 - RNA, 15 nt, Listeria monocytogenes EGD-e
auucuuuuucuucuu

SEQ ID NO: 2803421 - RNA, 18 nt, Listeria monocytogenes EGD-e
auugaccaauuucuuuuu

SEQ ID NO: 2803422 - RNA, 20 nt, Listeria monocytogenes EGD-e
auugaugccgacuaguucug

SEQ ID NO: 2803423 - RNA, 11 nt, Listeria monocytogenes EGD-e
auugauggauu

SEQ ID NO: 2803424 - RNA, 16 nt, Listeria monocytogenes EGD-e
auugauggauuccuaa

SEQ ID NO: 2803425 - RNA, 20 nt, Listeria monocytogenes EGD-e
auugcccagcuuaauccaau

SEQ ID NO: 2803426 - RNA, 16 nt, Listeria monocytogenes EGD-e
auugcgaauaacaagc

SEQ ID NO: 2803427 - RNA, 21 nt, Listeria monocytogenes EGD-e
auugcucguucuuaguuaauu

SEQ ID NO: 2803428 - RNA, 13 nt, Listeria monocytogenes EGD-e
auugcuucaccaa

SEQ ID NO: 2803429 - RNA, 16 nt, Listeria monocytogenes EGD-e
caaaaggacaagccca

SEQ ID NO: 2803430 - RNA, 19 nt, Listeria monocytogenes EGD-e
caaaauaauaauaaguaua

SEQ ID NO: 2803431 - RNA, 21 nt, Listeria monocytogenes EGD-e
caaaaucgcauccucaaacgu

SEQ ID NO: 2803432 - RNA, 22 nt, Listeria monocytogenes EGD-e
caaaaucgcauccucaaacguc

SEQ ID NO: 2803433 - RNA, 15 nt, Listeria monocytogenes EGD-e
caaaaucuuuaaaca

SEQ ID NO: 2803434 - RNA, 21 nt, Listeria monocytogenes EGD-e
caaaaucuuuuuguuuugcuu

SEQ ID NO: 2803435 - RNA, 22 nt, Listeria monocytogenes EGD-e
caaaaucuuuuuguuuugcuuc

SEQ ID NO: 2803436 - RNA, 23 nt, Listeria monocytogenes EGD-e
caaaaucuuuuuguuuugcuuca

SEQ ID NO: 2803437 - RNA, 15 nt, Listeria monocytogenes EGD-e
caaaaugguuucuua

SEQ ID NO: 2803438 - RNA, 19 nt, Listeria monocytogenes EGD-e
caaaaugguuucuuaaaua

SEQ ID NO: 2803439 - RNA, 17 nt, Listeria monocytogenes EGD-e
caaaauuacuauuugga

SEQ ID NO: 2803440 - RNA, 15 nt, Listeria monocytogenes EGD-e
caaacagcuuuucua

SEQ ID NO: 2803441 - RNA, 18 nt, Listeria monocytogenes EGD-e
caaacagcuuuucuauag

SEQ ID NO: 2803442 - RNA, 15 nt, Listeria monocytogenes EGD-e
caaaccaaauaccga

SEQ ID NO: 2803443 - RNA, 17 nt, Listeria monocytogenes EGD-e
caaacuaguaauuuaau

SEQ ID NO: 2803444 - RNA, 21 nt, Listeria monocytogenes EGD-e
caaacugcucagaaggaauaa

SEQ ID NO: 2803445 - RNA, 14 nt, Listeria monocytogenes EGD-e
caaacuuuuccuuc

SEQ ID NO: 2803446 - RNA, 13 nt, Listeria monocytogenes EGD-e
caaagaagaaaaa

SEQ ID NO: 2803447 - RNA, 14 nt, Listeria monocytogenes EGD-e
caaagaagaagacg

SEQ ID NO: 2803448 - RNA, 19 nt, Listeria monocytogenes EGD-e
caaagacgcuuuuuucaaa

SEQ ID NO: 2803449 - RNA, 15 nt, Listeria monocytogenes EGD-e
caaagcguuuuuuau

SEQ ID NO: 2803450 - RNA, 13 nt, Listeria monocytogenes EGD-e
caaagcuauuuuu

SEQ ID NO: 2803451 - RNA, 13 nt, Listeria monocytogenes EGD-e
caaaguaaaaagg

SEQ ID NO: 2803452 - RNA, 17 nt, Listeria monocytogenes EGD-e
caaaguaacuaaaaauc

SEQ ID NO: 2803453 - RNA, 22 nt, Listeria monocytogenes EGD-e
caaauagguugggcugcaacaa

SEQ ID NO: 2803454 - RNA, 17 nt, Listeria monocytogenes EGD-e
caaaucuggauaaaaau

SEQ ID NO: 2803455 - RNA, 18 nt, Listeria monocytogenes EGD-e
caaaucuggauaaaaaua

SEQ ID NO: 2803456 - RNA, 19 nt, Listeria monocytogenes EGD-e
caaaucuggauaaaaauaa

SEQ ID NO: 2803457 - RNA, 17 nt, Listeria monocytogenes EGD-e
caaaugcacagcagaaa

SEQ ID NO: 2803458 - RNA, 22 nt, Listeria monocytogenes EGD-e
caaaugcacagcagaaacuuuc

SEQ ID NO: 2803459 - RNA, 22 nt, Listeria monocytogenes EGD-e
caaaugcuucgacguuuaauuc

SEQ ID NO: 2803460 - RNA, 19 nt, Listeria monocytogenes EGD-e
caaauggagcuauuguaaa

SEQ ID NO: 2803461 - RNA, 13 nt, Listeria monocytogenes EGD-e
caaauuauuagaa

SEQ ID NO: 2803462 - RNA, 18 nt, Listeria monocytogenes EGD-e
caaauucaacaguugcua

SEQ ID NO: 2803463 - RNA, 20 nt, Listeria monocytogenes EGD-e
caaauuguaccgcuugaugu

SEQ ID NO: 2803464 - RNA, 21 nt, Listeria monocytogenes EGD-e
caaauuucuguuaugaacaga

SEQ ID NO: 2803465 - RNA, 23 nt, Listeria monocytogenes EGD-e
caaauuucuguuaugaacagaag

SEQ ID NO: 2803466 - RNA, 14 nt, Listeria monocytogenes EGD-e
caacaauuacuucc

SEQ ID NO: 2803467 - RNA, 21 nt, Listeria monocytogenes EGD-e
caacacacuaucccaaagauu

SEQ ID NO: 2803468 - RNA, 18 nt, Listeria monocytogenes EGD-e
caacaugcguaaacuuuu

SEQ ID NO: 2803469 - RNA, 16 nt, Listeria monocytogenes EGD-e
caaccauuuuguucuc

SEQ ID NO: 2803470 - RNA, 22 nt, Listeria monocytogenes EGD-e
caaccuauuugguacuugugaa

SEQ ID NO: 2803471 - RNA, 13 nt, Listeria monocytogenes EGD-e
caacgauguucau

SEQ ID NO: 2803472 - RNA, 20 nt, Listeria monocytogenes EGD-e
caacgcgcguauccacauaa

SEQ ID NO: 2803473 - RNA, 16 nt, Listeria monocytogenes EGD-e
caacuaacacuuauau

SEQ ID NO: 2803474 - RNA, 18 nt, Listeria monocytogenes EGD-e
caacuaauuuuucgauug

SEQ ID NO: 2803475 - RNA, 16 nt, Listeria monocytogenes EGD-e
caacuggacaaugauc

SEQ ID NO: 2803476 - RNA, 17 nt, Listeria monocytogenes EGD-e
caacuucaaaauuacua

SEQ ID NO: 2803477 - RNA, 14 nt, Listeria monocytogenes EGD-e
caacuucuuccgcu

SEQ ID NO: 2803478 - RNA, 22 nt, Listeria monocytogenes EGD-e
caagaagagcugcaacagauag

SEQ ID NO: 2803479 - RNA, 21 nt, Listeria monocytogenes EGD-e
caagaagggcuuuuuuccuuc

SEQ ID NO: 2803480 - RNA, 14 nt, Listeria monocytogenes EGD-e
caagaggcuuauuc

SEQ ID NO: 2803481 - RNA, 20 nt, Listeria monocytogenes EGD-e
caagaggcuuauuccuccaa

SEQ ID NO: 2803482 - RNA, 13 nt, Listeria monocytogenes EGD-e
caagcacagcaau

SEQ ID NO: 2803483 - RNA, 22 nt, Listeria monocytogenes EGD-e
caagcacuuacugcaaucauuu

SEQ ID NO: 2803484 - RNA, 12 nt, Listeria monocytogenes EGD-e
caagcccagcac

SEQ ID NO: 2803485 - RNA, 16 nt, Listeria monocytogenes EGD-e
caagccguauucuguu

SEQ ID NO: 2803486 - RNA, 23 nt, Listeria monocytogenes EGD-e
caagccuaggcucucuucgccac

SEQ ID NO: 2803487 - RNA, 22 nt, Listeria monocytogenes EGD-e
caagcgacauuaaauagccuga

SEQ ID NO: 2803488 - RNA, 22 nt, Listeria monocytogenes EGD-e
caagcgcuuccucgacuucaag

SEQ ID NO: 2803489 - RNA, 17 nt, Listeria monocytogenes EGD-e
caagcuucccguuaauc

SEQ ID NO: 2803490 - RNA, 23 nt, Listeria monocytogenes EGD-e
caaggagcggcucagauccuuca

SEQ ID NO: 2803491 - RNA, 15 nt, Listeria monocytogenes EGD-e
caaguaacucuucca

SEQ ID NO: 2803492 - RNA, 12 nt, Listeria monocytogenes EGD-e
caaguaauaaga

SEQ ID NO: 2803493 - RNA, 18 nt, Listeria monocytogenes EGD-e
caaguccgucaagcccag

SEQ ID NO: 2803494 - RNA, 20 nt, Listeria monocytogenes EGD-e
caagugaacguacaacuaaa

SEQ ID NO: 2803495 - RNA, 17 nt, Listeria monocytogenes EGD-e
caagugugauuguucca

SEQ ID NO: 2803496 - RNA, 21 nt, Listeria monocytogenes EGD-e
caaguucaugacgcgcaucuu

SEQ ID NO: 2803497 - RNA, 20 nt, Listeria monocytogenes EGD-e
caaguuuuuuaauuuuucuu

SEQ ID NO: 2803498 - RNA, 21 nt, Listeria monocytogenes EGD-e
caaguuuuuuaauuuuucuuc

SEQ ID NO: 2803499 - RNA, 20 nt, Listeria monocytogenes EGD-e
caauaauaauacaaacuuuu

SEQ ID NO: 2803500 - RNA, 16 nt, Listeria monocytogenes EGD-e
caauaccauguuuauu

SEQ ID NO: 2803501 - RNA, 21 nt, Listeria monocytogenes EGD-e
caaucaauuuacguuguucua

SEQ ID NO: 2803502 - RNA, 21 nt, Listeria monocytogenes EGD-e
caaucaucuuaucaaguaaua

SEQ ID NO: 2803503 - RNA, 15 nt, Listeria monocytogenes EGD-e
caaucaugccagcuu

SEQ ID NO: 2803504 - RNA, 13 nt, Listeria monocytogenes EGD-e
caauccauuuuuc

SEQ ID NO: 2803505 - RNA, 14 nt, Listeria monocytogenes EGD-e
caauccauuuuucu

SEQ ID NO: 2803506 - RNA, 17 nt, Listeria monocytogenes EGD-e
caaucccuauaaaaaca

SEQ ID NO: 2803507 - RNA, 18 nt, Listeria monocytogenes EGD-e
caaucgccaguugcugaa

SEQ ID NO: 2803508 - RNA, 13 nt, Listeria monocytogenes EGD-e
caaucggggaaau

SEQ ID NO: 2803509 - RNA, 23 nt, Listeria monocytogenes EGD-e
caaucugaacugacuagaaauua

SEQ ID NO: 2803510 - RNA, 15 nt, Listeria monocytogenes EGD-e
caaucuguuccaaca

SEQ ID NO: 2803511 - RNA, 19 nt, Listeria monocytogenes EGD-e
caaugagucaaugcccagu

SEQ ID NO: 2803512 - RNA, 16 nt, Listeria monocytogenes EGD-e
caaugagugaagauaa

SEQ ID NO: 2803513 - RNA, 17 nt, Listeria monocytogenes EGD-e
caaugauaucaucaaua

SEQ ID NO: 2803514 - RNA, 18 nt, Listeria monocytogenes EGD-e
caauggaaugacaaaauu

SEQ ID NO: 2803515 - RNA, 11 nt, Listeria monocytogenes EGD-e
caauguauaca

SEQ ID NO: 2803516 - RNA, 13 nt, Listeria monocytogenes EGD-e
caauguauacagg

SEQ ID NO: 2803517 - RNA, 12 nt, Listeria monocytogenes EGD-e
caauuaaaauac

SEQ ID NO: 2803518 - RNA, 19 nt, Listeria monocytogenes EGD-e
caauuaaaauaguuuuuuu

SEQ ID NO: 2803519 - RNA, 15 nt, Listeria monocytogenes EGD-e
caauuagucccauua

SEQ ID NO: 2803520 - RNA, 22 nt, Listeria monocytogenes EGD-e
caauuaugucggugcauuuuuu

SEQ ID NO: 2803521 - RNA, 18 nt, Listeria monocytogenes EGD-e
caauucucguaauguugc

SEQ ID NO: 2803522 - RNA, 19 nt, Listeria monocytogenes EGD-e
caauucuuccacaucugaa

SEQ ID NO: 2803523 - RNA, 16 nt, Listeria monocytogenes EGD-e
caauugcuucuuuuuu

SEQ ID NO: 2803524 - RNA, 22 nt, Listeria monocytogenes EGD-e
caauugcuucuuuuuucuucca

SEQ ID NO: 2803525 - RNA, 22 nt, Listeria monocytogenes EGD-e
caauuuuauuugguuuugucca

SEQ ID NO: 2803526 - RNA, 15 nt, Listeria monocytogenes EGD-e
cacaaacgcuuuuuc

SEQ ID NO: 2803527 - RNA, 15 nt, Listeria monocytogenes EGD-e
cacaaacucauuacu

SEQ ID NO: 2803528 - RNA, 16 nt, Listeria monocytogenes EGD-e
cacaaacucauuacuu

SEQ ID NO: 2803529 - RNA, 17 nt, Listeria monocytogenes EGD-e
cacaaaguaaaaaggaa

SEQ ID NO: 2803530 - RNA, 20 nt, Listeria monocytogenes EGD-e
cauaaucccacaaaaaauac

SEQ ID NO: 2803531 - RNA, 15 nt, Listeria monocytogenes EGD-e
cauaccaauaacgag

SEQ ID NO: 2803532 - RNA, 17 nt, Listeria monocytogenes EGD-e
cauagaauguauacacu

SEQ ID NO: 2803533 - RNA, 23 nt, Listeria monocytogenes EGD-e
cauagccggaccugaaagaacug

SEQ ID NO: 2803534 - RNA, 21 nt, Listeria monocytogenes EGD-e
cauaggucaggauuaaaaguu

SEQ ID NO: 2803535 - RNA, 15 nt, Listeria monocytogenes EGD-e
cauaguaaaaaaacu

SEQ ID NO: 2803536 - RNA, 20 nt, Listeria monocytogenes EGD-e
cauauaaucaauaucuuuau

SEQ ID NO: 2803537 - RNA, 21 nt, Listeria monocytogenes EGD-e
cauauaauuuuuucauuuucu

SEQ ID NO: 2803538 - RNA, 16 nt, Listeria monocytogenes EGD-e
cauauauguaguuuca

SEQ ID NO: 2803539 - RNA, 10 nt, Listeria monocytogenes EGD-e
cauaucacca

SEQ ID NO: 2803540 - RNA, 15 nt, Listeria monocytogenes EGD-e
cauaucaucaauaaa

SEQ ID NO: 2803541 - RNA, 21 nt, Listeria monocytogenes EGD-e
cauaucaucaauaaaaugcac

SEQ ID NO: 2803542 - RNA, 22 nt, Listeria monocytogenes EGD-e
cauaucaucaauaaaaugcaca

SEQ ID NO: 2803543 - RNA, 21 nt, Listeria monocytogenes EGD-e
cauaucuuuugagauaaucaa

SEQ ID NO: 2803544 - RNA, 20 nt, Listeria monocytogenes EGD-e
cauauguuucgccaauuugc

SEQ ID NO: 2803545 - RNA, 18 nt, Listeria monocytogenes EGD-e
cauauucuucuaaaauaa

SEQ ID NO: 2803546 - RNA, 19 nt, Listeria monocytogenes EGD-e
cauauucuucuaaaauaac

SEQ ID NO: 2803547 - RNA, 17 nt, Listeria monocytogenes EGD-e
caucaagugcuucaucu

SEQ ID NO: 2803548 - RNA, 20 nt, Listeria monocytogenes EGD-e
caucaauuaaauuauacauu

SEQ ID NO: 2803549 - RNA, 19 nt, Listeria monocytogenes EGD-e
caucauuuuuuugauuaau

SEQ ID NO: 2803550 - RNA, 20 nt, Listeria monocytogenes EGD-e
cauccaagcggguuuucuca

SEQ ID NO: 2803551 - RNA, 22 nt, Listeria monocytogenes EGD-e
cauccaagcggguuuucucaga

SEQ ID NO: 2803552 - RNA, 21 nt, Listeria monocytogenes EGD-e
cauccggugcugggaaaucag

SEQ ID NO: 2803553 - RNA, 22 nt, Listeria monocytogenes EGD-e
caucgaauacuaacgcuuuuuc

SEQ ID NO: 2803554 - RNA, 19 nt, Listeria monocytogenes EGD-e
caucgccgccuauuauuuc

SEQ ID NO: 2803555 - RNA, 14 nt, Listeria monocytogenes EGD-e
caucguuuaacaua

SEQ ID NO: 2803556 - RNA, 16 nt, Listeria monocytogenes EGD-e
caucguuuucuacugu

SEQ ID NO: 2803557 - RNA, 17 nt, Listeria monocytogenes EGD-e
caucguuuucuacugua

SEQ ID NO: 2803558 - RNA, 12 nt, Listeria monocytogenes EGD-e
caucuaauuuag

SEQ ID NO: 2803559 - RNA, 20 nt, Listeria monocytogenes EGD-e
caucugaaaaaguuguuucu

SEQ ID NO: 2803560 - RNA, 17 nt, Listeria monocytogenes EGD-e
caucugagaagccagca

SEQ ID NO: 2803561 - RNA, 16 nt, Listeria monocytogenes EGD-e
caucugcuauuuuuga

SEQ ID NO: 2803562 - RNA, 17 nt, Listeria monocytogenes EGD-e
caucuuaucaaguaaua

SEQ ID NO: 2803563 - RNA, 21 nt, Listeria monocytogenes EGD-e
caucuuaucaaguaauaagaa

SEQ ID NO: 2803564 - RNA, 18 nt, Listeria monocytogenes EGD-e
caucuuccacuccagcug

SEQ ID NO: 2803565 - RNA, 19 nt, Listeria monocytogenes EGD-e
caucuucuagcgucacaau

SEQ ID NO: 2803566 - RNA, 16 nt, Listeria monocytogenes EGD-e
caucuuuuaucuuccc

SEQ ID NO: 2803567 - RNA, 12 nt, Listeria monocytogenes EGD-e
caucuuuuucuu

SEQ ID NO: 2803568 - RNA, 13 nt, Listeria monocytogenes EGD-e
caucuuuuuucuc

SEQ ID NO: 2803569 - RNA, 18 nt, Listeria monocytogenes EGD-e
caugaaacuuuaacaaaa

SEQ ID NO: 2803570 - RNA, 20 nt, Listeria monocytogenes EGD-e
caugaacgcguacgauugcu

SEQ ID NO: 2803571 - RNA, 19 nt, Listeria monocytogenes EGD-e
caugaauauuagaaaauca

SEQ ID NO: 2803572 - RNA, 12 nt, Listeria monocytogenes EGD-e
caugaauuacuu

SEQ ID NO: 2803573 - RNA, 13 nt, Listeria monocytogenes EGD-e
caugaauuuuugc

SEQ ID NO: 2803574 - RNA, 21 nt, Listeria monocytogenes EGD-e
caugaugauuguucuuuaaaa

SEQ ID NO: 2803575 - RNA, 22 nt, Listeria monocytogenes EGD-e
cauguccuaggcgcucuuuaau

SEQ ID NO: 2803576 - RNA, 18 nt, Listeria monocytogenes EGD-e
caugucguaugcuuuaug

SEQ ID NO: 2803577 - RNA, 12 nt, Listeria monocytogenes EGD-e
cauguucaaucu

SEQ ID NO: 2803578 - RNA, 18 nt, Listeria monocytogenes EGD-e
cauuaaaccucuuuuuuu

SEQ ID NO: 2803579 - RNA, 15 nt, Listeria monocytogenes EGD-e
cauuaaagcuauaua

SEQ ID NO: 2803580 - RNA, 15 nt, Listeria monocytogenes EGD-e
cauuaaccuacuuua

SEQ ID NO: 2803581 - RNA, 16 nt, Listeria monocytogenes EGD-e
cauuaaccuacuuuaa

SEQ ID NO: 2803582 - RNA, 14 nt, Listeria monocytogenes EGD-e
cauuaauucauuua

SEQ ID NO: 2803583 - RNA, 16 nt, Listeria monocytogenes EGD-e
cauuaauucauuuaau

SEQ ID NO: 2803584 - RNA, 14 nt, Listeria monocytogenes EGD-e
cauuaauuuguccu

SEQ ID NO: 2803585 - RNA, 22 nt, Listeria monocytogenes EGD-e
cauuacaaaauuugucuuuacu

SEQ ID NO: 2803586 - RNA, 22 nt, Listeria monocytogenes EGD-e
cauuacugucgcaaaaaucauc

SEQ ID NO: 2803587 - RNA, 15 nt, Listeria monocytogenes EGD-e
cauuagauuugcaag

SEQ ID NO: 2803588 - RNA, 22 nt, Listeria monocytogenes EGD-e
cauuagcuaggccuacuuuuuu

SEQ ID NO: 2803589 - RNA, 14 nt, Listeria monocytogenes EGD-e
cauucaaaucacca

SEQ ID NO: 2803590 - RNA, 15 nt, Listeria monocytogenes EGD-e
cauucacugauuuau

SEQ ID NO: 2803591 - RNA, 23 nt, Listeria monocytogenes EGD-e
cauucacugauuuauuauaagca

SEQ ID NO: 2803592 - RNA, 17 nt, Listeria monocytogenes EGD-e
cauucgguccuuguacu

SEQ ID NO: 2803593 - RNA, 22 nt, Listeria monocytogenes EGD-e
cauugagucgcuauucuauuua

SEQ ID NO: 2803594 - RNA, 19 nt, Listeria monocytogenes EGD-e
cauugcaaucaucuuauca

SEQ ID NO: 2803595 - RNA, 17 nt, Listeria monocytogenes EGD-e
cauugcacuuuuauugc

SEQ ID NO: 2803596 - RNA, 17 nt, Listeria monocytogenes EGD-e
cauugcuuuguguuaau

SEQ ID NO: 2803597 - RNA, 13 nt, Listeria monocytogenes EGD-e
cauuggaccagaa

SEQ ID NO: 2803598 - RNA, 18 nt, Listeria monocytogenes EGD-e
cauuuaacaucagauuaa

SEQ ID NO: 2803599 - RNA, 21 nt, Listeria monocytogenes EGD-e
cauuuaacaucagauuaaaua

SEQ ID NO: 2803600 - RNA, 21 nt, Listeria monocytogenes EGD-e
cauuuaauugucgaaaaccua

SEQ ID NO: 2803601 - RNA, 23 nt, Listeria monocytogenes EGD-e
cauuuaauuuacuggcaacuuca

SEQ ID NO: 2803602 - RNA, 18 nt, Listeria monocytogenes EGD-e
cauuucauaaucaaauac

SEQ ID NO: 2803603 - RNA, 15 nt, Listeria monocytogenes EGD-e
cauuucaucuuuuuu

SEQ ID NO: 2803604 - RNA, 16 nt, Listeria monocytogenes EGD-e
cauuucaucuuuuuuu

SEQ ID NO: 2803605 - RNA, 20 nt, Listeria monocytogenes EGD-e
cauuucauucuuuuuuauac

SEQ ID NO: 2803606 - RNA, 22 nt, Listeria monocytogenes EGD-e
cauuucauucuuuuuuauacgc

SEQ ID NO: 2803607 - RNA, 14 nt, Listeria monocytogenes EGD-e
cauuuccaagucua

SEQ ID NO: 2803608 - RNA, 18 nt, Listeria monocytogenes EGD-e
cauuuccaagucuauuuc

SEQ ID NO: 2803609 - RNA, 23 nt, Listeria monocytogenes EGD-e
cauuuccaaguguuuuagugcac

SEQ ID NO: 2803610 - RNA, 17 nt, Listeria monocytogenes EGD-e
cauuucuuacuauuuuc

SEQ ID NO: 2803611 - RNA, 16 nt, Listeria monocytogenes EGD-e
cauuugaaaaagggcu

SEQ ID NO: 2803612 - RNA, 19 nt, Listeria monocytogenes EGD-e
cauuugauacauauuugaa

SEQ ID NO: 2803613 - RNA, 15 nt, Listeria monocytogenes EGD-e
cauuuguuucuuuug

SEQ ID NO: 2803614 - RNA, 18 nt, Listeria monocytogenes EGD-e
cauuuguuuuauuuuggu

SEQ ID NO: 2803615 - RNA, 13 nt, Listeria monocytogenes EGD-e
cauuuucacaagu

SEQ ID NO: 2803616 - RNA, 20 nt, Listeria monocytogenes EGD-e
cauuuucacaaguaacucuu

SEQ ID NO: 2803617 - RNA, 22 nt, Listeria monocytogenes EGD-e
cauuuuucuagugcaucuucua

SEQ ID NO: 2803618 - RNA, 20 nt, Listeria monocytogenes EGD-e
cauuuuucuucuggaagagc

SEQ ID NO: 2803619 - RNA, 13 nt, Listeria monocytogenes EGD-e
ccaaaaauaaguc

SEQ ID NO: 2803620 - RNA, 14 nt, Listeria monocytogenes EGD-e
ccaaaauaaaaugg

SEQ ID NO: 2803621 - RNA, 21 nt, Listeria monocytogenes EGD-e
ccaaaaucgcauccucaaacg

SEQ ID NO: 2803622 - RNA, 21 nt, Listeria monocytogenes EGD-e
ccaaauuggucauauguuucg

SEQ ID NO: 2803623 - RNA, 15 nt, Listeria monocytogenes EGD-e
ccaaccggaucauca

SEQ ID NO: 2803624 - RNA, 17 nt, Listeria monocytogenes EGD-e
ccaacguuuuaauuugg

SEQ ID NO: 2803625 - RNA, 12 nt, Listeria monocytogenes EGD-e
ccaagaagagcu

SEQ ID NO: 2803626 - RNA, 13 nt, Listeria monocytogenes EGD-e
ccaagaagagcug

SEQ ID NO: 2803627 - RNA, 16 nt, Listeria monocytogenes EGD-e
ccaagcaauaacaucu

SEQ ID NO: 2803628 - RNA, 20 nt, Listeria monocytogenes EGD-e
ccaagcguacggaauuuauu

SEQ ID NO: 2803629 - RNA, 20 nt, Listeria monocytogenes EGD-e
ccaagcuucccguuaaucga

SEQ ID NO: 2803630 - RNA, 21 nt, Listeria monocytogenes EGD-e
ccaaggguaauauaaauuugc

SEQ ID NO: 2803631 - RNA, 19 nt, Listeria monocytogenes EGD-e
ccuucgauuguagcuucuc

SEQ ID NO: 2803632 - RNA, 20 nt, Listeria monocytogenes EGD-e
ccuucuaauacgacaccaau

SEQ ID NO: 2803633 - RNA, 18 nt, Listeria monocytogenes EGD-e
ccuucuucagacgcaauu

SEQ ID NO: 2803634 - RNA, 19 nt, Listeria monocytogenes EGD-e
ccuugauuuaaauaaacaa

SEQ ID NO: 2803635 - RNA, 21 nt, Listeria monocytogenes EGD-e
ccuugcucccgcgcuaaucuu

SEQ ID NO: 2803636 - RNA, 12 nt, Listeria monocytogenes EGD-e
ccuuuauuuuuu

SEQ ID NO: 2803637 - RNA, 14 nt, Listeria monocytogenes EGD-e
ccuuucuuuuuuaa

SEQ ID NO: 2803638 - RNA, 19 nt, Listeria monocytogenes EGD-e
ccuuugaauugauuuuuuu

SEQ ID NO: 2803639 - RNA, 17 nt, Listeria monocytogenes EGD-e
ccuuugguaaaaaacug

SEQ ID NO: 2803640 - RNA, 20 nt, Listeria monocytogenes EGD-e
ccuuugucaucauaaacauu

SEQ ID NO: 2803641 - RNA, 14 nt, Listeria monocytogenes EGD-e
cgaaaaaugaaaag

SEQ ID NO: 2803642 - RNA, 16 nt, Listeria monocytogenes EGD-e
cgaaaaaugaaaagaa

SEQ ID NO: 2803643 - RNA, 12 nt, Listeria monocytogenes EGD-e
cgaaacaacugc

SEQ ID NO: 2803644 - RNA, 17 nt, Listeria monocytogenes EGD-e
cgaaagcaaaugcauuu

SEQ ID NO: 2803645 - RNA, 19 nt, Listeria monocytogenes EGD-e
cgaaagugcgcuuauuuuu

SEQ ID NO: 2803646 - RNA, 16 nt, Listeria monocytogenes EGD-e
cgaaaguuucuuuuug

SEQ ID NO: 2803647 - RNA, 23 nt, Listeria monocytogenes EGD-e
cgaaauggaugcacuuuuaauuu

SEQ ID NO: 2803648 - RNA, 15 nt, Listeria monocytogenes EGD-e
cgaaauuaaaagcua

SEQ ID NO: 2803649 - RNA, 21 nt, Listeria monocytogenes EGD-e
cgaaccccaauugcgccuaga

SEQ ID NO: 2803650 - RNA, 21 nt, Listeria monocytogenes EGD-e
cgaacgcuugcaucaagggaa

SEQ ID NO: 2803651 - RNA, 13 nt, Listeria monocytogenes EGD-e
cgaacuagcauca

SEQ ID NO: 2803652 - RNA, 19 nt, Listeria monocytogenes EGD-e
cgaagucccgccguauucg

SEQ ID NO: 2803653 - RNA, 18 nt, Listeria monocytogenes EGD-e
cgaauaaaaucauaauag

SEQ ID NO: 2803654 - RNA, 14 nt, Listeria monocytogenes EGD-e
cgaauaaagaacuu

SEQ ID NO: 2803655 - RNA, 21 nt, Listeria monocytogenes EGD-e
cgaauaacucggggugaaaau

SEQ ID NO: 2803656 - RNA, 14 nt, Listeria monocytogenes EGD-e
cgaauaccagcagu

SEQ ID NO: 2803657 - RNA, 13 nt, Listeria monocytogenes EGD-e
cgaauauccgaua

SEQ ID NO: 2803658 - RNA, 12 nt, Listeria monocytogenes EGD-e
cgaauccuugga

SEQ ID NO: 2803659 - RNA, 17 nt, Listeria monocytogenes EGD-e
cgaaugaacuucaccac

SEQ ID NO: 2803660 - RNA, 21 nt, Listeria monocytogenes EGD-e
cgacaaaguaacuaaaaauca

SEQ ID NO: 2803661 - RNA, 17 nt, Listeria monocytogenes EGD-e
cgacguuuaauucggcu

SEQ ID NO: 2803662 - RNA, 19 nt, Listeria monocytogenes EGD-e
cgaguuaccugucgcuguu

SEQ ID NO: 2803663 - RNA, 17 nt, Listeria monocytogenes EGD-e
cgaguugcuuuagaaua

SEQ ID NO: 2803664 - RNA, 13 nt, Listeria monocytogenes EGD-e
cgaguuuuuauuc

SEQ ID NO: 2803665 - RNA, 21 nt, Listeria monocytogenes EGD-e
cgauaauuuucauuuguuucu

SEQ ID NO: 2803666 - RNA, 15 nt, Listeria monocytogenes EGD-e
cgauaccaaaguugu

SEQ ID NO: 2803667 - RNA, 17 nt, Listeria monocytogenes EGD-e
cgauauuuuuuuguucu

SEQ ID NO: 2803668 - RNA, 17 nt, Listeria monocytogenes EGD-e
cgaugauaauaacgaac

SEQ ID NO: 2803669 - RNA, 16 nt, Listeria monocytogenes EGD-e
cgauguucauuacuuc

SEQ ID NO: 2803670 - RNA, 13 nt, Listeria monocytogenes EGD-e
cgauuauccugua

SEQ ID NO: 2803671 - RNA, 15 nt, Listeria monocytogenes EGD-e
cgauugcuucaccaa

SEQ ID NO: 2803672 - RNA, 20 nt, Listeria monocytogenes EGD-e
cgauugcuucaccaagaaga

SEQ ID NO: 2803673 - RNA, 15 nt, Listeria monocytogenes EGD-e
cgauuucugcagaau

SEQ ID NO: 2803674 - RNA, 17 nt, Listeria monocytogenes EGD-e
cgcaacauucaaaucac

SEQ ID NO: 2803675 - RNA, 22 nt, Listeria monocytogenes EGD-e
cgcaauuuuaggcguaucuuuu

SEQ ID NO: 2803676 - RNA, 14 nt, Listeria monocytogenes EGD-e
cgcagcuucaaucu

SEQ ID NO: 2803677 - RNA, 13 nt, Listeria monocytogenes EGD-e
cgcaggaauagca

SEQ ID NO: 2803678 - RNA, 14 nt, Listeria monocytogenes EGD-e
cgcauaucaucaau

SEQ ID NO: 2803679 - RNA, 17 nt, Listeria monocytogenes EGD-e
cgcauaucaucaauaaa

SEQ ID NO: 2803680 - RNA, 12 nt, Listeria monocytogenes EGD-e
cgcauuuuucuc

SEQ ID NO: 2803681 - RNA, 20 nt, Listeria monocytogenes EGD-e
cgccaccaacuucgagcagc

SEQ ID NO: 2803682 - RNA, 20 nt, Listeria monocytogenes EGD-e
cgccaccugguaaauagcca

SEQ ID NO: 2803683 - RNA, 14 nt, Listeria monocytogenes EGD-e
cgccaccuucaauu

SEQ ID NO: 2803684 - RNA, 13 nt, Listeria monocytogenes EGD-e
cgccagcuucacg

SEQ ID NO: 2803685 - RNA, 20 nt, Listeria monocytogenes EGD-e
cgccucgagauaaauuacug

SEQ ID NO: 2803686 - RNA, 23 nt, Listeria monocytogenes EGD-e
cgcgacaaaguaacuaaaaauca

SEQ ID NO: 2803687 - RNA, 15 nt, Listeria monocytogenes EGD-e
cgcgaguacaauuau

SEQ ID NO: 2803688 - RNA, 22 nt, Listeria monocytogenes EGD-e
cgcggcauuucaaucgcagcag

SEQ ID NO: 2803689 - RNA, 23 nt, Listeria monocytogenes EGD-e
cgcggucaugagcuaauuuuuuu

SEQ ID NO: 2803690 - RNA, 16 nt, Listeria monocytogenes EGD-e
cgcuggauaaagaccu

SEQ ID NO: 2803691 - RNA, 14 nt, Listeria monocytogenes EGD-e
cgcugucaaauucu

SEQ ID NO: 2803692 - RNA, 17 nt, Listeria monocytogenes EGD-e
cgcuuccucgacuucaa

SEQ ID NO: 2803693 - RNA, 17 nt, Listeria monocytogenes EGD-e
cgcuuguuuugaugcua

SEQ ID NO: 2803694 - RNA, 16 nt, Listeria monocytogenes EGD-e
cgcuuucacaucuuca

SEQ ID NO: 2803695 - RNA, 14 nt, Listeria monocytogenes EGD-e
cggaccuuuugcuu

SEQ ID NO: 2803696 - RNA, 18 nt, Listeria monocytogenes EGD-e
cggauaaauauagcuuca

SEQ ID NO: 2803697 - RNA, 20 nt, Listeria monocytogenes EGD-e
cggauaaauauagcuucaaa

SEQ ID NO: 2803698 - RNA, 12 nt, Listeria monocytogenes EGD-e
cggauaauaauc

SEQ ID NO: 2803699 - RNA, 14 nt, Listeria monocytogenes EGD-e
cggauaauaaucag

SEQ ID NO: 2803700 - RNA, 18 nt, Listeria monocytogenes EGD-e
cggaucgcgguagcuuca

SEQ ID NO: 2803701 - RNA, 23 nt, Listeria monocytogenes EGD-e
cggaucgcgguagcuucaaucaa

SEQ ID NO: 2803702 - RNA, 14 nt, Listeria monocytogenes EGD-e
cggauucucuucua

SEQ ID NO: 2803703 - RNA, 22 nt, Listeria monocytogenes EGD-e
cggccuccuguugcaccaaaaa

SEQ ID NO: 2803704 - RNA, 20 nt, Listeria monocytogenes EGD-e
cgggcacgaguaacuccacc

SEQ ID NO: 2803705 - RNA, 15 nt, Listeria monocytogenes EGD-e
cgggcgcuuucacau

SEQ ID NO: 2803706 - RNA, 12 nt, Listeria monocytogenes EGD-e
cggguuuuaaaa

SEQ ID NO: 2803707 - RNA, 17 nt, Listeria monocytogenes EGD-e
cgguacaguagaagcaa

SEQ ID NO: 2803708 - RNA, 13 nt, Listeria monocytogenes EGD-e
cgguaccaucuuu

SEQ ID NO: 2803709 - RNA, 23 nt, Listeria monocytogenes EGD-e
cgguaccaucuuuuaucuucccc

SEQ ID NO: 2803710 - RNA, 15 nt, Listeria monocytogenes EGD-e
cgguagcuucaauca

SEQ ID NO: 2803711 - RNA, 15 nt, Listeria monocytogenes EGD-e
cgguugauaauaauc

SEQ ID NO: 2803712 - RNA, 17 nt, Listeria monocytogenes EGD-e
cgguugauaauaaucag

SEQ ID NO: 2803713 - RNA, 21 nt, Listeria monocytogenes EGD-e
cgguuuucaugaagcaaacca

SEQ ID NO: 2803714 - RNA, 17 nt, Listeria monocytogenes EGD-e
cgguuuuugcuccauug

SEQ ID NO: 2803715 - RNA, 21 nt, Listeria monocytogenes EGD-e
cguaagaugcgcauguuuuua

SEQ ID NO: 2803716 - RNA, 17 nt, Listeria monocytogenes EGD-e
cguacggaauuuauuau

SEQ ID NO: 2803717 - RNA, 19 nt, Listeria monocytogenes EGD-e
cguacggaauuuauuauug

SEQ ID NO: 2803718 - RNA, 13 nt, Listeria monocytogenes EGD-e
cguacuaaaaauu

SEQ ID NO: 2803719 - RNA, 11 nt, Listeria monocytogenes EGD-e
cguaucaauaa

SEQ ID NO: 2803720 - RNA, 18 nt, Listeria monocytogenes EGD-e
cguauccaccaaaaacuu

SEQ ID NO: 2803721 - RNA, 19 nt, Listeria monocytogenes EGD-e
cguauuaccucgcuuuaau

SEQ ID NO: 2803722 - RNA, 13 nt, Listeria monocytogenes EGD-e
cguauuuauauuc

SEQ ID NO: 2803723 - RNA, 15 nt, Listeria monocytogenes EGD-e
cgucacgucccauug

SEQ ID NO: 2803724 - RNA, 14 nt, Listeria monocytogenes EGD-e
cgucauucgguaau

SEQ ID NO: 2803725 - RNA, 13 nt, Listeria monocytogenes EGD-e
cgugagaacgaca

SEQ ID NO: 2803726 - RNA, 12 nt, Listeria monocytogenes EGD-e
cguuaccauaaa

SEQ ID NO: 2803727 - RNA, 23 nt, Listeria monocytogenes EGD-e
cguucauucgguaagaccaccaa

SEQ ID NO: 2803728 - RNA, 21 nt, Listeria monocytogenes EGD-e
cguucauuugaaaaagggcug

SEQ ID NO: 2803729 - RNA, 22 nt, Listeria monocytogenes EGD-e
cguuccaguuaaacaaacacaa

SEQ ID NO: 2803730 - RNA, 16 nt, Listeria monocytogenes EGD-e
cguuguucuaacauua

SEQ ID NO: 2803731 - RNA, 20 nt, Listeria monocytogenes EGD-e
cguuuaauucggcuucaaaa

SEQ ID NO: 2803732 - RNA, 20 nt, Listeria monocytogenes EGD-e
cguuuguugcgccacuucua

SEQ ID NO: 2803733 - RNA, 22 nt, Listeria monocytogenes EGD-e
cucuuuggagugaggauuuuuu

SEQ ID NO: 2803734 - RNA, 20 nt, Listeria monocytogenes EGD-e
cucuuuuuuuaguaaacauu

SEQ ID NO: 2803735 - RNA, 15 nt, Listeria monocytogenes EGD-e
cucuuuuuuuauacc

SEQ ID NO: 2803736 - RNA, 17 nt, Listeria monocytogenes EGD-e
cucuuuuuuuauaccuu

SEQ ID NO: 2803737 - RNA, 20 nt, Listeria monocytogenes EGD-e
cugaaacauagucagggaau

SEQ ID NO: 2803738 - RNA, 23 nt, Listeria monocytogenes EGD-e
cugaagcgaugauuuucauuaaa

SEQ ID NO: 2803739 - RNA, 20 nt, Listeria monocytogenes EGD-e
cugacuagaaauuaaugcca

SEQ ID NO: 2803740 - RNA, 14 nt, Listeria monocytogenes EGD-e
cugagaguaauaaa

SEQ ID NO: 2803741 - RNA, 18 nt, Listeria monocytogenes EGD-e
cugaguagaaaguuaguu

SEQ ID NO: 2803742 - RNA, 23 nt, Listeria monocytogenes EGD-e
cugaugacuaacuaguuguaaac

SEQ ID NO: 2803743 - RNA, 22 nt, Listeria monocytogenes EGD-e
cugaugaugccgcaagaucuuc

SEQ ID NO: 2803744 - RNA, 22 nt, Listeria monocytogenes EGD-e
cugaugcauggaacgguauaca

SEQ ID NO: 2803745 - RNA, 23 nt, Listeria monocytogenes EGD-e
cugauuuuuuggugacgaaucaa

SEQ ID NO: 2803746 - RNA, 21 nt, Listeria monocytogenes EGD-e
cugcaacagauaguuguucca

SEQ ID NO: 2803747 - RNA, 21 nt, Listeria monocytogenes EGD-e
cugcaaucauuuauuuucccu

SEQ ID NO: 2803748 - RNA, 18 nt, Listeria monocytogenes EGD-e
cugcauaaaaaacauucg

SEQ ID NO: 2803749 - RNA, 16 nt, Listeria monocytogenes EGD-e
cugccaccacuuauag

SEQ ID NO: 2803750 - RNA, 18 nt, Listeria monocytogenes EGD-e
cugccgaaugaccugaaa

SEQ ID NO: 2803751 - RNA, 19 nt, Listeria monocytogenes EGD-e
cugcguguuuuuuuaugcu

SEQ ID NO: 2803752 - RNA, 21 nt, Listeria monocytogenes EGD-e
cugcuaaaggcaacaaagaag

SEQ ID NO: 2803753 - RNA, 23 nt, Listeria monocytogenes EGD-e
cugcuacgccgguaccaucuuuu

SEQ ID NO: 2803754 - RNA, 17 nt, Listeria monocytogenes EGD-e
cugcucgcucaucauca

SEQ ID NO: 2803755 - RNA, 18 nt, Listeria monocytogenes EGD-e
cugcugaaauagcauuca

SEQ ID NO: 2803756 - RNA, 21 nt, Listeria monocytogenes EGD-e
cugcugcuacgccgguaccau

SEQ ID NO: 2803757 - RNA, 14 nt, Listeria monocytogenes EGD-e
cugcuuuccuugcu

SEQ ID NO: 2803758 - RNA, 19 nt, Listeria monocytogenes EGD-e
cugcuuuuucaaguaaaaa

SEQ ID NO: 2803759 - RNA, 15 nt, Listeria monocytogenes EGD-e
cuggauaaaaauaac

SEQ ID NO: 2803760 - RNA, 14 nt, Listeria monocytogenes EGD-e
cuggaucacuauau

SEQ ID NO: 2803761 - RNA, 23 nt, Listeria monocytogenes EGD-e
cuggaucauauucuucuaaaaua

SEQ ID NO: 2803762 - RNA, 23 nt, Listeria monocytogenes EGD-e
cuggauuuucuagguucuuuuuu

SEQ ID NO: 2803763 - RNA, 16 nt, Listeria monocytogenes EGD-e
cuggcaacuucaaaau

SEQ ID NO: 2803764 - RNA, 14 nt, Listeria monocytogenes EGD-e
cuggcgaaugaacu

SEQ ID NO: 2803765 - RNA, 17 nt, Listeria monocytogenes EGD-e
cugggaauauccuuguu

SEQ ID NO: 2803766 - RNA, 21 nt, Listeria monocytogenes EGD-e
cugggaguuuuuuauuacuuu

SEQ ID NO: 2803767 - RNA, 12 nt, Listeria monocytogenes EGD-e
cugguucgauuu

SEQ ID NO: 2803768 - RNA, 14 nt, Listeria monocytogenes EGD-e
cuguaaaaauaaau

SEQ ID NO: 2803769 - RNA, 15 nt, Listeria monocytogenes EGD-e
cuguaaaaauaaaua

SEQ ID NO: 2803770 - RNA, 16 nt, Listeria monocytogenes EGD-e
cuguaacaaaaucuuu

SEQ ID NO: 2803771 - RNA, 12 nt, Listeria monocytogenes EGD-e
cuguacuccuug

SEQ ID NO: 2803772 - RNA, 14 nt, Listeria monocytogenes EGD-e
cuguauauguuuua

SEQ ID NO: 2803773 - RNA, 21 nt, Listeria monocytogenes EGD-e
cuguauauguuuuauuuauag

SEQ ID NO: 2803774 - RNA, 22 nt, Listeria monocytogenes EGD-e
cuguauauguuuuauuuauaga

SEQ ID NO: 2803775 - RNA, 20 nt, Listeria monocytogenes EGD-e
cuguaugaaacuuguuuuug

SEQ ID NO: 2803776 - RNA, 14 nt, Listeria monocytogenes EGD-e
cuguccauuccaau

SEQ ID NO: 2803777 - RNA, 14 nt, Listeria monocytogenes EGD-e
cugugaaggaaacg

SEQ ID NO: 2803778 - RNA, 21 nt, Listeria monocytogenes EGD-e
cugugauuacuccaaaauaaa

SEQ ID NO: 2803779 - RNA, 17 nt, Listeria monocytogenes EGD-e
cuguuaaaggagaaaaa

SEQ ID NO: 2803780 - RNA, 16 nt, Listeria monocytogenes EGD-e
cuguuccaacauaucc

SEQ ID NO: 2803781 - RNA, 20 nt, Listeria monocytogenes EGD-e
cuguucugauugguccugcu

SEQ ID NO: 2803782 - RNA, 18 nt, Listeria monocytogenes EGD-e
cuguugcaccaaaaauac

SEQ ID NO: 2803783 - RNA, 21 nt, Listeria monocytogenes EGD-e
cuguugcuaacacagcuaccu

SEQ ID NO: 2803784 - RNA, 21 nt, Listeria monocytogenes EGD-e
cuguugguguggaaauaacca

SEQ ID NO: 2803785 - RNA, 18 nt, Listeria monocytogenes EGD-e
cuguuuccccgucuaaga

SEQ ID NO: 2803786 - RNA, 14 nt, Listeria monocytogenes EGD-e
cuguuuuuucuuug

SEQ ID NO: 2803787 - RNA, 19 nt, Listeria monocytogenes EGD-e
cuguuuuuucuuugucuug

SEQ ID NO: 2803788 - RNA, 15 nt, Listeria monocytogenes EGD-e
cuuaaaauaaaaaaa

SEQ ID NO: 2803789 - RNA, 14 nt, Listeria monocytogenes EGD-e
cuuaaauacgaaaa

SEQ ID NO: 2803790 - RNA, 17 nt, Listeria monocytogenes EGD-e
cuuaaauacgaaaaaca

SEQ ID NO: 2803791 - RNA, 14 nt, Listeria monocytogenes EGD-e
cuuaaauuauacua

SEQ ID NO: 2803792 - RNA, 11 nt, Listeria monocytogenes EGD-e
cuuaagcaagg

SEQ ID NO: 2803793 - RNA, 15 nt, Listeria monocytogenes EGD-e
cuuaagggcuuuuuu

SEQ ID NO: 2803794 - RNA, 16 nt, Listeria monocytogenes EGD-e
cuuaauccaauuucug

SEQ ID NO: 2803795 - RNA, 17 nt, Listeria monocytogenes EGD-e
cuuacagaagcauuuuc

SEQ ID NO: 2803796 - RNA, 23 nt, Listeria monocytogenes EGD-e
cuuacugcaaucauuuauuuucc

SEQ ID NO: 2803797 - RNA, 19 nt, Listeria monocytogenes EGD-e
cuuauaugaaaacuuaucu

SEQ ID NO: 2803798 - RNA, 18 nt, Listeria monocytogenes EGD-e
cuuaucaaguaauaagaa

SEQ ID NO: 2803799 - RNA, 20 nt, Listeria monocytogenes EGD-e
cuuauccgguuuuugcucca

SEQ ID NO: 2803800 - RNA, 14 nt, Listeria monocytogenes EGD-e
cuuaucucuucauu

SEQ ID NO: 2803801 - RNA, 19 nt, Listeria monocytogenes EGD-e
cuuaugagaguuauaaaga

SEQ ID NO: 2803802 - RNA, 14 nt, Listeria monocytogenes EGD-e
cuuauuaaacauac

SEQ ID NO: 2803803 - RNA, 17 nt, Listeria monocytogenes EGD-e
cuuauuaacuaauaacc

SEQ ID NO: 2803804 - RNA, 13 nt, Listeria monocytogenes EGD-e
cuuauuaauagua

SEQ ID NO: 2803805 - RNA, 22 nt, Listeria monocytogenes EGD-e
cuuauuaauuauggcauaaaaa

SEQ ID NO: 2803806 - RNA, 20 nt, Listeria monocytogenes EGD-e
cuuauuauaaccccaaaaug

SEQ ID NO: 2803807 - RNA, 12 nt, Listeria monocytogenes EGD-e
cuuauuuuauac

SEQ ID NO: 2803808 - RNA, 17 nt, Listeria monocytogenes EGD-e
cuuauuuuuugagcgcc

SEQ ID NO: 2803809 - RNA, 15 nt, Listeria monocytogenes EGD-e
cuucaaacacuucua

SEQ ID NO: 2803810 - RNA, 16 nt, Listeria monocytogenes EGD-e
cuucaaacacuucuaa

SEQ ID NO: 2803811 - RNA, 11 nt, Listeria monocytogenes EGD-e
cuucaagacca

SEQ ID NO: 2803812 - RNA, 14 nt, Listeria monocytogenes EGD-e
cuucaaucaagccu

SEQ ID NO: 2803813 - RNA, 16 nt, Listeria monocytogenes EGD-e
cuucaaucccagcuuu

SEQ ID NO: 2803814 - RNA, 14 nt, Listeria monocytogenes EGD-e
cuucaauugcuucu

SEQ ID NO: 2803815 - RNA, 20 nt, Listeria monocytogenes EGD-e
cuucaauugcuucuuuuuuc

SEQ ID NO: 2803816 - RNA, 21 nt, Listeria monocytogenes EGD-e
cuucacgugcugcuuuccuug

SEQ ID NO: 2803817 - RNA, 14 nt, Listeria monocytogenes EGD-e
cuucagccaauucu

SEQ ID NO: 2803818 - RNA, 15 nt, Listeria monocytogenes EGD-e
cuucauaaaucgcca

SEQ ID NO: 2803819 - RNA, 16 nt, Listeria monocytogenes EGD-e
cuucauaauuauuuuu

SEQ ID NO: 2803820 - RNA, 14 nt, Listeria monocytogenes EGD-e
cuucaugugcuuuu

SEQ ID NO: 2803821 - RNA, 17 nt, Listeria monocytogenes EGD-e
cuuccacaucugaaaaa

SEQ ID NO: 2803822 - RNA, 21 nt, Listeria monocytogenes EGD-e
cuuccaccuguauuaaugacu

SEQ ID NO: 2803823 - RNA, 14 nt, Listeria monocytogenes EGD-e
cuuccauaucacca

SEQ ID NO: 2803824 - RNA, 13 nt, Listeria monocytogenes EGD-e
cuuccauauuuuc

SEQ ID NO: 2803825 - RNA, 14 nt, Listeria monocytogenes EGD-e
cuuccauauuuucu

SEQ ID NO: 2803826 - RNA, 15 nt, Listeria monocytogenes EGD-e
cuuccauuuguucuc

SEQ ID NO: 2803827 - RNA, 19 nt, Listeria monocytogenes EGD-e
cuucgaaaguaaaaucuuu

SEQ ID NO: 2803828 - RNA, 18 nt, Listeria monocytogenes EGD-e
cuucgauugcaucucuuu

SEQ ID NO: 2803829 - RNA, 17 nt, Listeria monocytogenes EGD-e
cuucgccaccuucaauu

SEQ ID NO: 2803830 - RNA, 20 nt, Listeria monocytogenes EGD-e
cuucggauuuuucaaaucaa

SEQ ID NO: 2803831 - RNA, 16 nt, Listeria monocytogenes EGD-e
cuucggggcaaaaagg

SEQ ID NO: 2803832 - RNA, 14 nt, Listeria monocytogenes EGD-e
cuucguuucauuuc

SEQ ID NO: 2803833 - RNA, 14 nt, Listeria monocytogenes EGD-e
cuucuaaaauaaca

SEQ ID NO: 2803834 - RNA, 18 nt, Listeria monocytogenes EGD-e
gaaagcaaaugcauuucu

SEQ ID NO: 2803835 - RNA, 19 nt, Listeria monocytogenes EGD-e
gaaagugcgcuuauuuuuu

SEQ ID NO: 2803836 - RNA, 16 nt, Listeria monocytogenes EGD-e
gaaaguuucgaaguga

SEQ ID NO: 2803837 - RNA, 15 nt, Listeria monocytogenes EGD-e
gaaaguuucuuuuug

SEQ ID NO: 2803838 - RNA, 12 nt, Listeria monocytogenes EGD-e
gaaauaaccauu

SEQ ID NO: 2803839 - RNA, 18 nt, Listeria monocytogenes EGD-e
gaaauaucaccauuacua

SEQ ID NO: 2803840 - RNA, 14 nt, Listeria monocytogenes EGD-e
gaaauuaaagguaa

SEQ ID NO: 2803841 - RNA, 22 nt, Listeria monocytogenes EGD-e
gaaauuaaauuuuuuugaaaaa

SEQ ID NO: 2803842 - RNA, 11 nt, Listeria monocytogenes EGD-e
gaacaaagaag

SEQ ID NO: 2803843 - RNA, 20 nt, Listeria monocytogenes EGD-e
gaacaaucauggaaacgaca

SEQ ID NO: 2803844 - RNA, 13 nt, Listeria monocytogenes EGD-e
gaacccuuugaau

SEQ ID NO: 2803845 - RNA, 16 nt, Listeria monocytogenes EGD-e
gaaccuucaagcauau

SEQ ID NO: 2803846 - RNA, 16 nt, Listeria monocytogenes EGD-e
gaacgaagagccaagc

SEQ ID NO: 2803847 - RNA, 21 nt, Listeria monocytogenes EGD-e
gaacgaauccuuggaaaaaug

SEQ ID NO: 2803848 - RNA, 17 nt, Listeria monocytogenes EGD-e
gaacgacaaaugguuca

SEQ ID NO: 2803849 - RNA, 14 nt, Listeria monocytogenes EGD-e
gaacggggcaucau

SEQ ID NO: 2803850 - RNA, 17 nt, Listeria monocytogenes EGD-e
gaacugacuagaaauua

SEQ ID NO: 2803851 - RNA, 18 nt, Listeria monocytogenes EGD-e
gaagaugcacuagaaaaa

SEQ ID NO: 2803852 - RNA, 19 nt, Listeria monocytogenes EGD-e
gaagaugcacuagaaaaau

SEQ ID NO: 2803853 - RNA, 18 nt, Listeria monocytogenes EGD-e
gaagcguguugauaaaga

SEQ ID NO: 2803854 - RNA, 22 nt, Listeria monocytogenes EGD-e
gaagcuuccuuuaucauucaau

SEQ ID NO: 2803855 - RNA, 13 nt, Listeria monocytogenes EGD-e
gaaggaauuugcc

SEQ ID NO: 2803856 - RNA, 21 nt, Listeria monocytogenes EGD-e
gaaguucgaauuccguuuguu

SEQ ID NO: 2803857 - RNA, 21 nt, Listeria monocytogenes EGD-e
gaauaaaacaaaagauagaca

SEQ ID NO: 2803858 - RNA, 18 nt, Listeria monocytogenes EGD-e
gaauaaauugcucgauuu

SEQ ID NO: 2803859 - RNA, 21 nt, Listeria monocytogenes EGD-e
gaauaagcaucggucaaaucu

SEQ ID NO: 2803860 - RNA, 20 nt, Listeria monocytogenes EGD-e
gaauaccauuguagcucauu

SEQ ID NO: 2803861 - RNA, 15 nt, Listeria monocytogenes EGD-e
gaauagauugcguca

SEQ ID NO: 2803862 - RNA, 16 nt, Listeria monocytogenes EGD-e
gaaucagagaaaccgc

SEQ ID NO: 2803863 - RNA, 22 nt, Listeria monocytogenes EGD-e
gaauccaaacacgaacauacca

SEQ ID NO: 2803864 - RNA, 21 nt, Listeria monocytogenes EGD-e
gaaugaacuucaccacuucuu

SEQ ID NO: 2803865 - RNA, 13 nt, Listeria monocytogenes EGD-e
gaaugcgguaacu

SEQ ID NO: 2803866 - RNA, 18 nt, Listeria monocytogenes EGD-e
gaaugcgguaacuaaaau

SEQ ID NO: 2803867 - RNA, 14 nt, Listeria monocytogenes EGD-e
gaauguuaaauuca

SEQ ID NO: 2803868 - RNA, 16 nt, Listeria monocytogenes EGD-e
gaauguuuucuuccau

SEQ ID NO: 2803869 - RNA, 18 nt, Listeria monocytogenes EGD-e
gaauuaagaaguacaaua

SEQ ID NO: 2803870 - RNA, 22 nt, Listeria monocytogenes EGD-e
gaauuccacgcggcauuucaau

SEQ ID NO: 2803871 - RNA, 18 nt, Listeria monocytogenes EGD-e
gaauucguuauuuccuuc

SEQ ID NO: 2803872 - RNA, 13 nt, Listeria monocytogenes EGD-e
gaauucuuuuucu

SEQ ID NO: 2803873 - RNA, 12 nt, Listeria monocytogenes EGD-e
gaauugauuuuu

SEQ ID NO: 2803874 - RNA, 22 nt, Listeria monocytogenes EGD-e
gaauugcuucuccguuuuccac

SEQ ID NO: 2803875 - RNA, 15 nt, Listeria monocytogenes EGD-e
gacaaaaagaaaaaa

SEQ ID NO: 2803876 - RNA, 17 nt, Listeria monocytogenes EGD-e
gacaaaaagaaaaaaca

SEQ ID NO: 2803877 - RNA, 16 nt, Listeria monocytogenes EGD-e
gacaaagcuauuuuuu

SEQ ID NO: 2803878 - RNA, 12 nt, Listeria monocytogenes EGD-e
gacaagcccagc

SEQ ID NO: 2803879 - RNA, 17 nt, Listeria monocytogenes EGD-e
gacacccgcguuuucua

SEQ ID NO: 2803880 - RNA, 22 nt, Listeria monocytogenes EGD-e
gacauaaucccacaaaaaauac

SEQ ID NO: 2803881 - RNA, 20 nt, Listeria monocytogenes EGD-e
gaccaucaguaguaaagcac

SEQ ID NO: 2803882 - RNA, 17 nt, Listeria monocytogenes EGD-e
gaccgcaaauagagcca

SEQ ID NO: 2803883 - RNA, 14 nt, Listeria monocytogenes EGD-e
gaccuaaacgaagc

SEQ ID NO: 2803884 - RNA, 13 nt, Listeria monocytogenes EGD-e
gaccuuugaaaac

SEQ ID NO: 2803885 - RNA, 14 nt, Listeria monocytogenes EGD-e
gaccuuuugcuucu

SEQ ID NO: 2803886 - RNA, 18 nt, Listeria monocytogenes EGD-e
gaccuuuugcuucuucca

SEQ ID NO: 2803887 - RNA, 18 nt, Listeria monocytogenes EGD-e
gacgaaucaagauuuugc

SEQ ID NO: 2803888 - RNA, 17 nt, Listeria monocytogenes EGD-e
gacgauuggaucuucca

SEQ ID NO: 2803889 - RNA, 22 nt, Listeria monocytogenes EGD-e
gacguuuaucaauaauagcaau

SEQ ID NO: 2803890 - RNA, 13 nt, Listeria monocytogenes EGD-e
gacuaguucugcu

SEQ ID NO: 2803891 - RNA, 14 nt, Listeria monocytogenes EGD-e
gacucaaugaaaag

SEQ ID NO: 2803892 - RNA, 21 nt, Listeria monocytogenes EGD-e
gacuguuguuucauauaauuu

SEQ ID NO: 2803893 - RNA, 20 nt, Listeria monocytogenes EGD-e
gacuucuuagggagaagccu

SEQ ID NO: 2803894 - RNA, 19 nt, Listeria monocytogenes EGD-e
gagaaaaaguggcgcuucc

SEQ ID NO: 2803895 - RNA, 23 nt, Listeria monocytogenes EGD-e
gagaacgauuuugguaauaaucc

SEQ ID NO: 2803896 - RNA, 16 nt, Listeria monocytogenes EGD-e
gagaaucauuaauaua

SEQ ID NO: 2803897 - RNA, 18 nt, Listeria monocytogenes EGD-e
gagacagaaaaagaagua

SEQ ID NO: 2803898 - RNA, 22 nt, Listeria monocytogenes EGD-e
gagagugacguaaggcauguau

SEQ ID NO: 2803899 - RNA, 14 nt, Listeria monocytogenes EGD-e
gagaguuauaaaga

SEQ ID NO: 2803900 - RNA, 15 nt, Listeria monocytogenes EGD-e
gagcagcauccaucc

SEQ ID NO: 2803901 - RNA, 17 nt, Listeria monocytogenes EGD-e
gagcagggcuauuuuuc

SEQ ID NO: 2803902 - RNA, 16 nt, Listeria monocytogenes EGD-e
gagcgaauaagugaau

SEQ ID NO: 2803903 - RNA, 17 nt, Listeria monocytogenes EGD-e
gagcuauuguaaauguu

SEQ ID NO: 2803904 - RNA, 14 nt, Listeria monocytogenes EGD-e
gagcugauuuuauu

SEQ ID NO: 2803905 - RNA, 14 nt, Listeria monocytogenes EGD-e
gagcuuucuuuuuu

SEQ ID NO: 2803906 - RNA, 17 nt, Listeria monocytogenes EGD-e
gaggaaguaauucaucc

SEQ ID NO: 2803907 - RNA, 13 nt, Listeria monocytogenes EGD-e
gaggauuuuccaa

SEQ ID NO: 2803908 - RNA, 22 nt, Listeria monocytogenes EGD-e
gagguuuugcacaaaaugcaaa

SEQ ID NO: 2803909 - RNA, 22 nt, Listeria monocytogenes EGD-e
gaguagauugcauucugugaug

SEQ ID NO: 2803910 - RNA, 15 nt, Listeria monocytogenes EGD-e
gaguaucuuguuucg

SEQ ID NO: 2803911 - RNA, 18 nt, Listeria monocytogenes EGD-e
gagugucaguguuuuugu

SEQ ID NO: 2803912 - RNA, 17 nt, Listeria monocytogenes EGD-e
gaguuccaucuucuaau

SEQ ID NO: 2803913 - RNA, 19 nt, Listeria monocytogenes EGD-e
gaguugcugcuaaaggcaa

SEQ ID NO: 2803914 - RNA, 13 nt, Listeria monocytogenes EGD-e
gauaaauuacuga

SEQ ID NO: 2803915 - RNA, 18 nt, Listeria monocytogenes EGD-e
gauaaccgcuaucuacau

SEQ ID NO: 2803916 - RNA, 11 nt, Listeria monocytogenes EGD-e
gauaaguuuuc

SEQ ID NO: 2803917 - RNA, 22 nt, Listeria monocytogenes EGD-e
gauaauacgcgccaaagacuga

SEQ ID NO: 2803918 - RNA, 23 nt, Listeria monocytogenes EGD-e
gauaauacgcgccaaagacugaa

SEQ ID NO: 2803919 - RNA, 19 nt, Listeria monocytogenes EGD-e
gauaaugugaccuuaaauu

SEQ ID NO: 2803920 - RNA, 18 nt, Listeria monocytogenes EGD-e
gauaccuuuuucaucgca

SEQ ID NO: 2803921 - RNA, 21 nt, Listeria monocytogenes EGD-e
gauaggcucuuccuuuuguuu

SEQ ID NO: 2803922 - RNA, 20 nt, Listeria monocytogenes EGD-e
gauaucuacaaguucuuuca

SEQ ID NO: 2803923 - RNA, 18 nt, Listeria monocytogenes EGD-e
gauaugcagguaaaacag

SEQ ID NO: 2803924 - RNA, 15 nt, Listeria monocytogenes EGD-e
gauauucucuuauga

SEQ ID NO: 2803925 - RNA, 14 nt, Listeria monocytogenes EGD-e
gaucaauagcagaa

SEQ ID NO: 2803926 - RNA, 17 nt, Listeria monocytogenes EGD-e
gauccauugcaagguau

SEQ ID NO: 2803927 - RNA, 23 nt, Listeria monocytogenes EGD-e
gaucgccuacuucuaaauuaacu

SEQ ID NO: 2803928 - RNA, 17 nt, Listeria monocytogenes EGD-e
gaucgcgguagcuucaa

SEQ ID NO: 2803929 - RNA, 15 nt, Listeria monocytogenes EGD-e
gaucuacuucuaaau

SEQ ID NO: 2803930 - RNA, 19 nt, Listeria monocytogenes EGD-e
gaucuacuucuaaauaguc

SEQ ID NO: 2803931 - RNA, 22 nt, Listeria monocytogenes EGD-e
gaucuuccaucauaaucccagu

SEQ ID NO: 2803932 - RNA, 16 nt, Listeria monocytogenes EGD-e
gaugcacuagaaaaau

SEQ ID NO: 2803933 - RNA, 19 nt, Listeria monocytogenes EGD-e
gaugccgacuaguucugcu

SEQ ID NO: 2803934 - RNA, 18 nt, Listeria monocytogenes EGD-e
gaugcgaaaaaugaaaag

SEQ ID NO: 2803935 - RNA, 19 nt, Listeria monocytogenes EGD-e
gcuacuucggggcaaaaag

SEQ ID NO: 2803936 - RNA, 20 nt, Listeria monocytogenes EGD-e
gcuacuucggggcaaaaagg

SEQ ID NO: 2803937 - RNA, 15 nt, Listeria monocytogenes EGD-e
gcuagaaagccuuua

SEQ ID NO: 2803938 - RNA, 14 nt, Listeria monocytogenes EGD-e
gcuauuuuuuugcu

SEQ ID NO: 2803939 - RNA, 16 nt, Listeria monocytogenes EGD-e
gcuauuuuuuugcuuu

SEQ ID NO: 2803940 - RNA, 16 nt, Listeria monocytogenes EGD-e
gcucagauccuucaau

SEQ ID NO: 2803941 - RNA, 16 nt, Listeria monocytogenes EGD-e
gcucagcggguugaaa

SEQ ID NO: 2803942 - RNA, 13 nt, Listeria monocytogenes EGD-e
gcucauuuuucuu

SEQ ID NO: 2803943 - RNA, 12 nt, Listeria monocytogenes EGD-e
gcuccguaucca

SEQ ID NO: 2803944 - RNA, 23 nt, Listeria monocytogenes EGD-e
gcucuuccuuuuguuuuaauaaa

SEQ ID NO: 2803945 - RNA, 17 nt, Listeria monocytogenes EGD-e
gcugaacuuggaaagug

SEQ ID NO: 2803946 - RNA, 15 nt, Listeria monocytogenes EGD-e
gcugaauaucaaauc

SEQ ID NO: 2803947 - RNA, 19 nt, Listeria monocytogenes EGD-e
gcugaugacuaacuaguug

SEQ ID NO: 2803948 - RNA, 16 nt, Listeria monocytogenes EGD-e
gcugcauuuucacaag

SEQ ID NO: 2803949 - RNA, 20 nt, Listeria monocytogenes EGD-e
gcugcuaaaggcaacaaaga

SEQ ID NO: 2803950 - RNA, 13 nt, Listeria monocytogenes EGD-e
gcugcuuggacug

SEQ ID NO: 2803951 - RNA, 22 nt, Listeria monocytogenes EGD-e
gcugggaauauccuuguuguuc

SEQ ID NO: 2803952 - RNA, 14 nt, Listeria monocytogenes EGD-e
gcuggugcuuuuuu

SEQ ID NO: 2803953 - RNA, 19 nt, Listeria monocytogenes EGD-e
gcuggugcuuuuuuuguuu

SEQ ID NO: 2803954 - RNA, 19 nt, Listeria monocytogenes EGD-e
gcuguaacaaaaucuuuuu

SEQ ID NO: 2803955 - RNA, 23 nt, Listeria monocytogenes EGD-e
gcuguaacaaaaucuuuuuguuu

SEQ ID NO: 2803956 - RNA, 23 nt, Listeria monocytogenes EGD-e
gcuguaucaaugauaucaucaau

SEQ ID NO: 2803957 - RNA, 13 nt, Listeria monocytogenes EGD-e
gcugucaaauucu

SEQ ID NO: 2803958 - RNA, 14 nt, Listeria monocytogenes EGD-e
gcugucaaauucuu

SEQ ID NO: 2803959 - RNA, 22 nt, Listeria monocytogenes EGD-e
gcugucuuggaagaaccuucaa

SEQ ID NO: 2803960 - RNA, 17 nt, Listeria monocytogenes EGD-e
gcuuaauacgcgcugga

SEQ ID NO: 2803961 - RNA, 13 nt, Listeria monocytogenes EGD-e
gcuuauuaaacau

SEQ ID NO: 2803962 - RNA, 16 nt, Listeria monocytogenes EGD-e
gcuuauuccuccaauu

SEQ ID NO: 2803963 - RNA, 18 nt, Listeria monocytogenes EGD-e
gcuucaaaacucucuuuc

SEQ ID NO: 2803964 - RNA, 23 nt, Listeria monocytogenes EGD-e
gcuucaaucccagcuuuuccuag

SEQ ID NO: 2803965 - RNA, 17 nt, Listeria monocytogenes EGD-e
gcuucauaaaucgccac

SEQ ID NO: 2803966 - RNA, 12 nt, Listeria monocytogenes EGD-e
gcuucaucuuua

SEQ ID NO: 2803967 - RNA, 19 nt, Listeria monocytogenes EGD-e
gcuucgcuguccauuccaa

SEQ ID NO: 2803968 - RNA, 14 nt, Listeria monocytogenes EGD-e
gcuucguccagcug

SEQ ID NO: 2803969 - RNA, 16 nt, Listeria monocytogenes EGD-e
gcuucuaagucaaaac

SEQ ID NO: 2803970 - RNA, 15 nt, Listeria monocytogenes EGD-e
gcuucugauucccac

SEQ ID NO: 2803971 - RNA, 15 nt, Listeria monocytogenes EGD-e
gcuucuguuuuuucu

SEQ ID NO: 2803972 - RNA, 16 nt, Listeria monocytogenes EGD-e
gcuucuguuuuuucuu

SEQ ID NO: 2803973 - RNA, 18 nt, Listeria monocytogenes EGD-e
gcuucuguuuuuucuuug

SEQ ID NO: 2803974 - RNA, 13 nt, Listeria monocytogenes EGD-e
gcuucuuccauau

SEQ ID NO: 2803975 - RNA, 19 nt, Listeria monocytogenes EGD-e
gcuucuuccauaucaccaa

SEQ ID NO: 2803976 - RNA, 21 nt, Listeria monocytogenes EGD-e
gcuucuuccauaucaccaaca

SEQ ID NO: 2803977 - RNA, 13 nt, Listeria monocytogenes EGD-e
gcuuuagcagcaa

SEQ ID NO: 2803978 - RNA, 20 nt, Listeria monocytogenes EGD-e
gcuuuguguuaauaaaauca

SEQ ID NO: 2803979 - RNA, 14 nt, Listeria monocytogenes EGD-e
gcuuuguuuagccu

SEQ ID NO: 2803980 - RNA, 15 nt, Listeria monocytogenes EGD-e
gcuuuuaacuuucuu

SEQ ID NO: 2803981 - RNA, 16 nt, Listeria monocytogenes EGD-e
gcuuuuaacuuucuug

SEQ ID NO: 2803982 - RNA, 19 nt, Listeria monocytogenes EGD-e
gcuuuugaaaccauuccgu

SEQ ID NO: 2803983 - RNA, 20 nt, Listeria monocytogenes EGD-e
ggaaagaauauccguuucau

SEQ ID NO: 2803984 - RNA, 20 nt, Listeria monocytogenes EGD-e
ggaacgaauccuuggaaaaa

SEQ ID NO: 2803985 - RNA, 13 nt, Listeria monocytogenes EGD-e
ggaacuacauacu

SEQ ID NO: 2803986 - RNA, 11 nt, Listeria monocytogenes EGD-e
ggaagugaaaa

SEQ ID NO: 2803987 - RNA, 22 nt, Listeria monocytogenes EGD-e
ggaauacuguuuuugauuuaau

SEQ ID NO: 2803988 - RNA, 17 nt, Listeria monocytogenes EGD-e
ggacacccauaauagca

SEQ ID NO: 2803989 - RNA, 20 nt, Listeria monocytogenes EGD-e
ggacauacuucaugugcuuu

SEQ ID NO: 2803990 - RNA, 20 nt, Listeria monocytogenes EGD-e
ggaccuuuugcuucuuccau

SEQ ID NO: 2803991 - RNA, 13 nt, Listeria monocytogenes EGD-e
ggagaaaaagugg

SEQ ID NO: 2803992 - RNA, 12 nt, Listeria monocytogenes EGD-e
ggagacauuaaa

SEQ ID NO: 2803993 - RNA, 16 nt, Listeria monocytogenes EGD-e
ggagcaagugugaaaa

SEQ ID NO: 2803994 - RNA, 20 nt, Listeria monocytogenes EGD-e
ggaguuuguaacaacuaauu

SEQ ID NO: 2803995 - RNA, 14 nt, Listeria monocytogenes EGD-e
ggauaaaaauugca

SEQ ID NO: 2803996 - RNA, 11 nt, Listeria monocytogenes EGD-e
ggauuagaaug

SEQ ID NO: 2803997 - RNA, 14 nt, Listeria monocytogenes EGD-e
ggauucucuucuaa

SEQ ID NO: 2803998 - RNA, 15 nt, Listeria monocytogenes EGD-e
ggauuuuucaaauca

SEQ ID NO: 2803999 - RNA, 12 nt, Listeria monocytogenes EGD-e
ggcaaaacaagu

SEQ ID NO: 2804000 - RNA, 14 nt, Listeria monocytogenes EGD-e
ggcaaauaacguug

SEQ ID NO: 2804001 - RNA, 13 nt, Listeria monocytogenes EGD-e
ggcaacaaagaag

SEQ ID NO: 2804002 - RNA, 14 nt, Listeria monocytogenes EGD-e
ggcaacaaagaaga

SEQ ID NO: 2804003 - RNA, 15 nt, Listeria monocytogenes EGD-e
ggcaacaaagaagaa

SEQ ID NO: 2804004 - RNA, 17 nt, Listeria monocytogenes EGD-e
ggcaacaaagaagaaaa

SEQ ID NO: 2804005 - RNA, 19 nt, Listeria monocytogenes EGD-e
ggcaacaaagaagaaaaag

SEQ ID NO: 2804006 - RNA, 19 nt, Listeria monocytogenes EGD-e
ggcaacuucaaaauuacua

SEQ ID NO: 2804007 - RNA, 19 nt, Listeria monocytogenes EGD-e
ggcaguccaccagcuacuu

SEQ ID NO: 2804008 - RNA, 21 nt, Listeria monocytogenes EGD-e
ggcaguuugauaauauugaua

SEQ ID NO: 2804009 - RNA, 21 nt, Listeria monocytogenes EGD-e
ggcauuucaaucgcagcagau

SEQ ID NO: 2804010 - RNA, 13 nt, Listeria monocytogenes EGD-e
ggccaauuaaaau

SEQ ID NO: 2804011 - RNA, 17 nt, Listeria monocytogenes EGD-e
ggccgugauaaauaaca

SEQ ID NO: 2804012 - RNA, 18 nt, Listeria monocytogenes EGD-e
ggccuacuuuuuugcuuu

SEQ ID NO: 2804013 - RNA, 19 nt, Listeria monocytogenes EGD-e
ggcgcgggaugguauacua

SEQ ID NO: 2804014 - RNA, 17 nt, Listeria monocytogenes EGD-e
ggcuaauaacauuaaac

SEQ ID NO: 2804015 - RNA, 17 nt, Listeria monocytogenes EGD-e
ggcuaauuacuagcuuu

SEQ ID NO: 2804016 - RNA, 21 nt, Listeria monocytogenes EGD-e
ggcuagcgcauacgaguucua

SEQ ID NO: 2804017 - RNA, 22 nt, Listeria monocytogenes EGD-e
ggcugugaaggaaacgaauaaa

SEQ ID NO: 2804018 - RNA, 14 nt, Listeria monocytogenes EGD-e
ggcuuauuccucca

SEQ ID NO: 2804019 - RNA, 18 nt, Listeria monocytogenes EGD-e
ggcuuauuuuaacggcuu

SEQ ID NO: 2804020 - RNA, 12 nt, Listeria monocytogenes EGD-e
ggcuucaaaacu

SEQ ID NO: 2804021 - RNA, 19 nt, Listeria monocytogenes EGD-e
ggcuuccuuguuuuuugua

SEQ ID NO: 2804022 - RNA, 13 nt, Listeria monocytogenes EGD-e
ggcuuuuuaugca

SEQ ID NO: 2804023 - RNA, 12 nt, Listeria monocytogenes EGD-e
gggcaaaaagga

SEQ ID NO: 2804024 - RNA, 13 nt, Listeria monocytogenes EGD-e
gggcaaaaaggaa

SEQ ID NO: 2804025 - RNA, 21 nt, Listeria monocytogenes EGD-e
gggcauaucuuuugagauaau

SEQ ID NO: 2804026 - RNA, 22 nt, Listeria monocytogenes EGD-e
gggcucguugcagaaacaauca

SEQ ID NO: 2804027 - RNA, 13 nt, Listeria monocytogenes EGD-e
ggguuugauaauc

SEQ ID NO: 2804028 - RNA, 21 nt, Listeria monocytogenes EGD-e
gguaaacaacccauuugcauu

SEQ ID NO: 2804029 - RNA, 11 nt, Listeria monocytogenes EGD-e
gguaacaucuu

SEQ ID NO: 2804030 - RNA, 20 nt, Listeria monocytogenes EGD-e
gguaagaccaccaagaauaa

SEQ ID NO: 2804031 - RNA, 16 nt, Listeria monocytogenes EGD-e
gguaauauaaauuugc

SEQ ID NO: 2804032 - RNA, 16 nt, Listeria monocytogenes EGD-e
gguacaguagaagcaa

SEQ ID NO: 2804033 - RNA, 22 nt, Listeria monocytogenes EGD-e
gguauacaccgaacuagcauca

SEQ ID NO: 2804034 - RNA, 21 nt, Listeria monocytogenes EGD-e
gguaucccucauguucaaucu

SEQ ID NO: 2804035 - RNA, 21 nt, Listeria monocytogenes EGD-e
ggucaaaucuggauaaaaaua

SEQ ID NO: 2804036 - RNA, 13 nt, Listeria monocytogenes EGD-e
ggucaggauuaaa

SEQ ID NO: 2804037 - RNA, 23 nt, Listeria monocytogenes EGD-e
uaaauagccaagauuaaaaauag

SEQ ID NO: 2804038 - RNA, 18 nt, Listeria monocytogenes EGD-e
uaaauaggauuaaaauaa

SEQ ID NO: 2804039 - RNA, 18 nt, Listeria monocytogenes EGD-e
uaaauaggcccauuaaaa

SEQ ID NO: 2804040 - RNA, 19 nt, Listeria monocytogenes EGD-e
uaaauaguaguuauuucuu

SEQ ID NO: 2804041 - RNA, 16 nt, Listeria monocytogenes EGD-e
uaaauauacacaaagu

SEQ ID NO: 2804042 - RNA, 23 nt, Listeria monocytogenes EGD-e
uaaauauacacaaaguaaaaagg

SEQ ID NO: 2804043 - RNA, 20 nt, Listeria monocytogenes EGD-e
uaaauaugcgcagaaaguug

SEQ ID NO: 2804044 - RNA, 22 nt, Listeria monocytogenes EGD-e
uaaauccauuucauucuuuuuu

SEQ ID NO: 2804045 - RNA, 17 nt, Listeria monocytogenes EGD-e
uaaauccuuuuugauuc

SEQ ID NO: 2804046 - RNA, 22 nt, Listeria monocytogenes EGD-e
uaaaucuuucacacgauaccaa

SEQ ID NO: 2804047 - RNA, 12 nt, Listeria monocytogenes EGD-e
uaaaugcgacau

SEQ ID NO: 2804048 - RNA, 22 nt, Listeria monocytogenes EGD-e
uaaauguugguguaggaaguga

SEQ ID NO: 2804049 - RNA, 21 nt, Listeria monocytogenes EGD-e
uaaauuacugaauaaguaaua

SEQ ID NO: 2804050 - RNA, 14 nt, Listeria monocytogenes EGD-e
uaaauugauaccaa

SEQ ID NO: 2804051 - RNA, 19 nt, Listeria monocytogenes EGD-e
uaaauuugcccaccgauaa

SEQ ID NO: 2804052 - RNA, 15 nt, Listeria monocytogenes EGD-e
uaaauuuuuuugaaa

SEQ ID NO: 2804053 - RNA, 19 nt, Listeria monocytogenes EGD-e
uaaauuuuuuugaaaaaac

SEQ ID NO: 2804054 - RNA, 14 nt, Listeria monocytogenes EGD-e
uaacaaaauaauaa

SEQ ID NO: 2804055 - RNA, 15 nt, Listeria monocytogenes EGD-e
uaacaaaauaauaau

SEQ ID NO: 2804056 - RNA, 13 nt, Listeria monocytogenes EGD-e
uaacaacaagcaa

SEQ ID NO: 2804057 - RNA, 17 nt, Listeria monocytogenes EGD-e
uaacaacaagcaaaaca

SEQ ID NO: 2804058 - RNA, 19 nt, Listeria monocytogenes EGD-e
uaacaacaagcaaaacauu

SEQ ID NO: 2804059 - RNA, 22 nt, Listeria monocytogenes EGD-e
uaacaacaagcaaaacauuuuc

SEQ ID NO: 2804060 - RNA, 18 nt, Listeria monocytogenes EGD-e
uaacaacuaauuuuucga

SEQ ID NO: 2804061 - RNA, 20 nt, Listeria monocytogenes EGD-e
uaacaauuuauacacaucuu

SEQ ID NO: 2804062 - RNA, 18 nt, Listeria monocytogenes EGD-e
uaacacuuauaugaaaac

SEQ ID NO: 2804063 - RNA, 21 nt, Listeria monocytogenes EGD-e
uaacacuuauaugaaaacuua

SEQ ID NO: 2804064 - RNA, 23 nt, Listeria monocytogenes EGD-e
uaacaggugugucauuuuugcug

SEQ ID NO: 2804065 - RNA, 21 nt, Listeria monocytogenes EGD-e
uaacauaaaaagcugccacca

SEQ ID NO: 2804066 - RNA, 15 nt, Listeria monocytogenes EGD-e
uaacauaaauugauu

SEQ ID NO: 2804067 - RNA, 18 nt, Listeria monocytogenes EGD-e
uaacauaaccuucaucgu

SEQ ID NO: 2804068 - RNA, 20 nt, Listeria monocytogenes EGD-e
uaacauagcuacaauuaaaa

SEQ ID NO: 2804069 - RNA, 21 nt, Listeria monocytogenes EGD-e
uaacauagcuacaauuaaaau

SEQ ID NO: 2804070 - RNA, 16 nt, Listeria monocytogenes EGD-e
uaacauauaaucuacu

SEQ ID NO: 2804071 - RNA, 16 nt, Listeria monocytogenes EGD-e
uaacaucagauuaaau

SEQ ID NO: 2804072 - RNA, 20 nt, Listeria monocytogenes EGD-e
uaacaucagauuaaauauag

SEQ ID NO: 2804073 - RNA, 15 nt, Listeria monocytogenes EGD-e
uaacaucuuccacuc

SEQ ID NO: 2804074 - RNA, 17 nt, Listeria monocytogenes EGD-e
uaacaucuuuaaaaaca

SEQ ID NO: 2804075 - RNA, 17 nt, Listeria monocytogenes EGD-e
uaaccaaauuucuguua

SEQ ID NO: 2804076 - RNA, 16 nt, Listeria monocytogenes EGD-e
uaaccccaaaaugcua

SEQ ID NO: 2804077 - RNA, 20 nt, Listeria monocytogenes EGD-e
uaaccgcuaucuacaugaau

SEQ ID NO: 2804078 - RNA, 23 nt, Listeria monocytogenes EGD-e
uaaccucgcaaaaaauaauaucu

SEQ ID NO: 2804079 - RNA, 20 nt, Listeria monocytogenes EGD-e
uaacgaugacgaugacgcuc

SEQ ID NO: 2804080 - RNA, 19 nt, Listeria monocytogenes EGD-e
uaacgcuaucaaucaucac

SEQ ID NO: 2804081 - RNA, 14 nt, Listeria monocytogenes EGD-e
uaacgguuuucaug

SEQ ID NO: 2804082 - RNA, 17 nt, Listeria monocytogenes EGD-e
uaacguuuucccgcuga

SEQ ID NO: 2804083 - RNA, 14 nt, Listeria monocytogenes EGD-e
uaacuaaaaaucau

SEQ ID NO: 2804084 - RNA, 16 nt, Listeria monocytogenes EGD-e
uaacuaaaaaucauuu

SEQ ID NO: 2804085 - RNA, 17 nt, Listeria monocytogenes EGD-e
uaacucggggugaaaau

SEQ ID NO: 2804086 - RNA, 16 nt, Listeria monocytogenes EGD-e
uaacucucauaagaga

SEQ ID NO: 2804087 - RNA, 12 nt, Listeria monocytogenes EGD-e
uaacucuuccaa

SEQ ID NO: 2804088 - RNA, 21 nt, Listeria monocytogenes EGD-e
uaacuucauuagacaaaaaga

SEQ ID NO: 2804089 - RNA, 23 nt, Listeria monocytogenes EGD-e
uaacuucauuagacaaaaagaaa

SEQ ID NO: 2804090 - RNA, 15 nt, Listeria monocytogenes EGD-e
uaacuuucuuguuuc

SEQ ID NO: 2804091 - RNA, 22 nt, Listeria monocytogenes EGD-e
uaacuuucuuguuucauauaau

SEQ ID NO: 2804092 - RNA, 17 nt, Listeria monocytogenes EGD-e
uaacuuuuuuucuuaga

SEQ ID NO: 2804093 - RNA, 11 nt, Listeria monocytogenes EGD-e
uaagaagcuuu

SEQ ID NO: 2804094 - RNA, 20 nt, Listeria monocytogenes EGD-e
uaagaaugaacgaagagcca

SEQ ID NO: 2804095 - RNA, 16 nt, Listeria monocytogenes EGD-e
uaagacauaacaagua

SEQ ID NO: 2804096 - RNA, 21 nt, Listeria monocytogenes EGD-e
uaagaccaccaagaauaagca

SEQ ID NO: 2804097 - RNA, 20 nt, Listeria monocytogenes EGD-e
uaagcaacgguaaacaaccc

SEQ ID NO: 2804098 - RNA, 15 nt, Listeria monocytogenes EGD-e
uaagcacaaauuauu

SEQ ID NO: 2804099 - RNA, 19 nt, Listeria monocytogenes EGD-e
uaagcagccuccgcuuugg

SEQ ID NO: 2804100 - RNA, 18 nt, Listeria monocytogenes EGD-e
uaagcaucggucaaaucu

SEQ ID NO: 2804101 - RNA, 14 nt, Listeria monocytogenes EGD-e
uaagccauuucucg

SEQ ID NO: 2804102 - RNA, 18 nt, Listeria monocytogenes EGD-e
uaaggauaccuuuuucau

SEQ ID NO: 2804103 - RNA, 20 nt, Listeria monocytogenes EGD-e
uaaggauuugucacuuggaa

SEQ ID NO: 2804104 - RNA, 18 nt, Listeria monocytogenes EGD-e
uaaggucuuuguuguuuu

SEQ ID NO: 2804105 - RNA, 12 nt, Listeria monocytogenes EGD-e
uaaguagacaag

SEQ ID NO: 2804106 - RNA, 15 nt, Listeria monocytogenes EGD-e
uaagucaaaacguuc

SEQ ID NO: 2804107 - RNA, 19 nt, Listeria monocytogenes EGD-e
uaagucaaugauauuauga

SEQ ID NO: 2804108 - RNA, 23 nt, Listeria monocytogenes EGD-e
uaagucaaugauauuaugauuug

SEQ ID NO: 2804109 - RNA, 23 nt, Listeria monocytogenes EGD-e
uaagugaauugauggauuccuaa

SEQ ID NO: 2804110 - RNA, 21 nt, Listeria monocytogenes EGD-e
uaaguuagcguuaguaaacuu

SEQ ID NO: 2804111 - RNA, 17 nt, Listeria monocytogenes EGD-e
uaaguucuagcucaacu

SEQ ID NO: 2804112 - RNA, 20 nt, Listeria monocytogenes EGD-e
uaauaaaauaggcaaaucuu

SEQ ID NO: 2804113 - RNA, 13 nt, Listeria monocytogenes EGD-e
uaauaaaaucauu

SEQ ID NO: 2804114 - RNA, 15 nt, Listeria monocytogenes EGD-e
uaauaaaucauaaua

SEQ ID NO: 2804115 - RNA, 22 nt, Listeria monocytogenes EGD-e
uaauaaauuagacauauaucuu

SEQ ID NO: 2804116 - RNA, 16 nt, Listeria monocytogenes EGD-e
uaauaacugaauaaau

SEQ ID NO: 2804117 - RNA, 15 nt, Listeria monocytogenes EGD-e
uaauacaaacuuuuc

SEQ ID NO: 2804118 - RNA, 18 nt, Listeria monocytogenes EGD-e
uaauacaaacuuuuccuu

SEQ ID NO: 2804119 - RNA, 15 nt, Listeria monocytogenes EGD-e
uaauaccaggaucaa

SEQ ID NO: 2804120 - RNA, 20 nt, Listeria monocytogenes EGD-e
uaauaccaggaucaaaaugg

SEQ ID NO: 2804121 - RNA, 19 nt, Listeria monocytogenes EGD-e
uaauacgcgccaaagacug

SEQ ID NO: 2804122 - RNA, 18 nt, Listeria monocytogenes EGD-e
uaauacgcuguaucgcca

SEQ ID NO: 2804123 - RNA, 22 nt, Listeria monocytogenes EGD-e
uaauacgcuguaucgccaacuu

SEQ ID NO: 2804124 - RNA, 13 nt, Listeria monocytogenes EGD-e
uaauacguauucu

SEQ ID NO: 2804125 - RNA, 12 nt, Listeria monocytogenes EGD-e
uaauagaagcca

SEQ ID NO: 2804126 - RNA, 18 nt, Listeria monocytogenes EGD-e
uaauagaagccaauucac

SEQ ID NO: 2804127 - RNA, 23 nt, Listeria monocytogenes EGD-e
uaauagcagagcuccaauaauag

SEQ ID NO: 2804128 - RNA, 22 nt, Listeria monocytogenes EGD-e
uaauagcauaaaguauucagca

SEQ ID NO: 2804129 - RNA, 18 nt, Listeria monocytogenes EGD-e
uaauauacuuuauaacuu

SEQ ID NO: 2804130 - RNA, 16 nt, Listeria monocytogenes EGD-e
uaauauauagucauaa

SEQ ID NO: 2804131 - RNA, 20 nt, Listeria monocytogenes EGD-e
uaauauccacccuagcuaua

SEQ ID NO: 2804132 - RNA, 16 nt, Listeria monocytogenes EGD-e
uaauauccauaaagcu

SEQ ID NO: 2804133 - RNA, 15 nt, Listeria monocytogenes EGD-e
uaauaucuucuauau

SEQ ID NO: 2804134 - RNA, 21 nt, Listeria monocytogenes EGD-e
uaauaucuucuauauuaaugu

SEQ ID NO: 2804135 - RNA, 15 nt, Listeria monocytogenes EGD-e
uaauaugauaaccgc

SEQ ID NO: 2804136 - RNA, 17 nt, Listeria monocytogenes EGD-e
uaaucaaaugcacagca

SEQ ID NO: 2804137 - RNA, 15 nt, Listeria monocytogenes EGD-e
uacuuuaauuuccac

SEQ ID NO: 2804138 - RNA, 16 nt, Listeria monocytogenes EGD-e
uacuuuaauuucuggg

SEQ ID NO: 2804139 - RNA, 23 nt, Listeria monocytogenes EGD-e
uacuuuaccuugaucaaaauuca

SEQ ID NO: 2804140 - RNA, 14 nt, Listeria monocytogenes EGD-e
uacuuucugccaaa

SEQ ID NO: 2804141 - RNA, 14 nt, Listeria monocytogenes EGD-e
uacuuuuccgaccu

SEQ ID NO: 2804142 - RNA, 18 nt, Listeria monocytogenes EGD-e
uacuuuuuugcuuuugau

SEQ ID NO: 2804143 - RNA, 14 nt, Listeria monocytogenes EGD-e
uagaaaaaugaaga

SEQ ID NO: 2804144 - RNA, 15 nt, Listeria monocytogenes EGD-e
uagaaaaauguuugc

SEQ ID NO: 2804145 - RNA, 22 nt, Listeria monocytogenes EGD-e
uagaaaacgacucaaugaaaag

SEQ ID NO: 2804146 - RNA, 12 nt, Listeria monocytogenes EGD-e
uagaaaaucauu

SEQ ID NO: 2804147 - RNA, 16 nt, Listeria monocytogenes EGD-e
uagaaaccaucgcaaa

SEQ ID NO: 2804148 - RNA, 22 nt, Listeria monocytogenes EGD-e
uagaaaguuaguugcuuuuguu

SEQ ID NO: 2804149 - RNA, 15 nt, Listeria monocytogenes EGD-e
uagaaauauguuuaa

SEQ ID NO: 2804150 - RNA, 18 nt, Listeria monocytogenes EGD-e
uagaaauauguuuaaucu

SEQ ID NO: 2804151 - RNA, 21 nt, Listeria monocytogenes EGD-e
uagaagcaauuagucccauua

SEQ ID NO: 2804152 - RNA, 14 nt, Listeria monocytogenes EGD-e
uagaagccaauuca

SEQ ID NO: 2804153 - RNA, 16 nt, Listeria monocytogenes EGD-e
uagaaggaauuugcca

SEQ ID NO: 2804154 - RNA, 14 nt, Listeria monocytogenes EGD-e
uagacaaaaagaaa

SEQ ID NO: 2804155 - RNA, 17 nt, Listeria monocytogenes EGD-e
uagagcgaauaagugaa

SEQ ID NO: 2804156 - RNA, 14 nt, Listeria monocytogenes EGD-e
uagaggauuuucac

SEQ ID NO: 2804157 - RNA, 13 nt, Listeria monocytogenes EGD-e
uagauauucucuu

SEQ ID NO: 2804158 - RNA, 18 nt, Listeria monocytogenes EGD-e
uagauuccgcuaaaacua

SEQ ID NO: 2804159 - RNA, 22 nt, Listeria monocytogenes EGD-e
uagauuuagaggcguacuaaaa

SEQ ID NO: 2804160 - RNA, 19 nt, Listeria monocytogenes EGD-e
uagauuuuaauuucuuuug

SEQ ID NO: 2804161 - RNA, 19 nt, Listeria monocytogenes EGD-e
uagcaacuucacuaacaaa

SEQ ID NO: 2804162 - RNA, 22 nt, Listeria monocytogenes EGD-e
uagcaacuucacuaacaaaaua

SEQ ID NO: 2804163 - RNA, 15 nt, Listeria monocytogenes EGD-e
uagcacagcuaccac

SEQ ID NO: 2804164 - RNA, 22 nt, Listeria monocytogenes EGD-e
uagcagauguaucuaaaaucau

SEQ ID NO: 2804165 - RNA, 22 nt, Listeria monocytogenes EGD-e
uagcaggacaugcuaaauaaaa

SEQ ID NO: 2804166 - RNA, 20 nt, Listeria monocytogenes EGD-e
uagcauucacacgaacccca

SEQ ID NO: 2804167 - RNA, 22 nt, Listeria monocytogenes EGD-e
uagccauuguugcggcaguagu

SEQ ID NO: 2804168 - RNA, 21 nt, Listeria monocytogenes EGD-e
uagccugaugaugccgcaaga

SEQ ID NO: 2804169 - RNA, 19 nt, Listeria monocytogenes EGD-e
uagcguacaugaugauugu

SEQ ID NO: 2804170 - RNA, 22 nt, Listeria monocytogenes EGD-e
uagcuaugcguuacacuucgaa

SEQ ID NO: 2804171 - RNA, 14 nt, Listeria monocytogenes EGD-e
uagcuauuuuuuug

SEQ ID NO: 2804172 - RNA, 23 nt, Listeria monocytogenes EGD-e
uagcuauuuuuuugcuuuuuaag

SEQ ID NO: 2804173 - RNA, 14 nt, Listeria monocytogenes EGD-e
uagcucauuacaaa

SEQ ID NO: 2804174 - RNA, 18 nt, Listeria monocytogenes EGD-e
uagcuuaaagguuuuguu

SEQ ID NO: 2804175 - RNA, 12 nt, Listeria monocytogenes EGD-e
uagcuucaauca

SEQ ID NO: 2804176 - RNA, 18 nt, Listeria monocytogenes EGD-e
uagcuuugucuuaaauga

SEQ ID NO: 2804177 - RNA, 16 nt, Listeria monocytogenes EGD-e
uaggaauuucgaaauu

SEQ ID NO: 2804178 - RNA, 17 nt, Listeria monocytogenes EGD-e
uaggaauuucgaaauua

SEQ ID NO: 2804179 - RNA, 17 nt, Listeria monocytogenes EGD-e
uaggauauuuuuuucga

SEQ ID NO: 2804180 - RNA, 18 nt, Listeria monocytogenes EGD-e
uaggauauuuuuuucgaa

SEQ ID NO: 2804181 - RNA, 22 nt, Listeria monocytogenes EGD-e
uaggauauuuuuuucgaaagaa

SEQ ID NO: 2804182 - RNA, 15 nt, Listeria monocytogenes EGD-e
uaggcauuguauuca

SEQ ID NO: 2804183 - RNA, 19 nt, Listeria monocytogenes EGD-e
uaggccacuaacauaaauu

SEQ ID NO: 2804184 - RNA, 13 nt, Listeria monocytogenes EGD-e
uaggccuagcuaa

SEQ ID NO: 2804185 - RNA, 23 nt, Listeria monocytogenes EGD-e
uaggcucuuccuuuuguuuuaau

SEQ ID NO: 2804186 - RNA, 19 nt, Listeria monocytogenes EGD-e
uaggcuuccuuguuuuuug

SEQ ID NO: 2804187 - RNA, 14 nt, Listeria monocytogenes EGD-e
uaggguuuggaaaa

SEQ ID NO: 2804188 - RNA, 17 nt, Listeria monocytogenes EGD-e
uaggguuuggaaaacau

SEQ ID NO: 2804189 - RNA, 12 nt, Listeria monocytogenes EGD-e
uagguaacaucu

SEQ ID NO: 2804190 - RNA, 22 nt, Listeria monocytogenes EGD-e
uagguuagcagcuuuuguccaa

SEQ ID NO: 2804191 - RNA, 19 nt, Listeria monocytogenes EGD-e
uaguaaauggcugaugacu

SEQ ID NO: 2804192 - RNA, 15 nt, Listeria monocytogenes EGD-e
uaguacauaguuaua

SEQ ID NO: 2804193 - RNA, 18 nt, Listeria monocytogenes EGD-e
uaguacauaguuauaaau

SEQ ID NO: 2804194 - RNA, 22 nt, Listeria monocytogenes EGD-e
uaguacgaaaucaaacuuauaa

SEQ ID NO: 2804195 - RNA, 15 nt, Listeria monocytogenes EGD-e
uaguagcacuccuug

SEQ ID NO: 2804196 - RNA, 15 nt, Listeria monocytogenes EGD-e
uaguauacuuuuaau

SEQ ID NO: 2804197 - RNA, 16 nt, Listeria monocytogenes EGD-e
uaguauuucagcaaga

SEQ ID NO: 2804198 - RNA, 16 nt, Listeria monocytogenes EGD-e
uagucguuucaacucc

SEQ ID NO: 2804199 - RNA, 17 nt, Listeria monocytogenes EGD-e
uagucuacuuuuaaaau

SEQ ID NO: 2804200 - RNA, 19 nt, Listeria monocytogenes EGD-e
uagugcaucuucuaagaaa

SEQ ID NO: 2804201 - RNA, 20 nt, Listeria monocytogenes EGD-e
uaguggagcucuuucuucua

SEQ ID NO: 2804202 - RNA, 13 nt, Listeria monocytogenes EGD-e
uagugucaguccu

SEQ ID NO: 2804203 - RNA, 17 nt, Listeria monocytogenes EGD-e
uaguuaacgguuuucau

SEQ ID NO: 2804204 - RNA, 23 nt, Listeria monocytogenes EGD-e
uaguuaacgguuuucaugaagca

SEQ ID NO: 2804205 - RNA, 17 nt, Listeria monocytogenes EGD-e
uaguuaggcuuccuugu

SEQ ID NO: 2804206 - RNA, 20 nt, Listeria monocytogenes EGD-e
uaguuaggcuuccuuguuuu

SEQ ID NO: 2804207 - RNA, 13 nt, Listeria monocytogenes EGD-e
uaguuauuucuuu

SEQ ID NO: 2804208 - RNA, 14 nt, Listeria monocytogenes EGD-e
uaguuauuucuuua

SEQ ID NO: 2804209 - RNA, 17 nt, Listeria monocytogenes EGD-e
uaguugauauauucaca

SEQ ID NO: 2804210 - RNA, 15 nt, Listeria monocytogenes EGD-e
uaguugguaguuuua

SEQ ID NO: 2804211 - RNA, 16 nt, Listeria monocytogenes EGD-e
uaguugguaguuuuaa

SEQ ID NO: 2804212 - RNA, 19 nt, Listeria monocytogenes EGD-e
uaguuguucaggguuuguu

SEQ ID NO: 2804213 - RNA, 17 nt, Listeria monocytogenes EGD-e
uaguuucgauaucuuca

SEQ ID NO: 2804214 - RNA, 13 nt, Listeria monocytogenes EGD-e
uaguuuucuacua

SEQ ID NO: 2804215 - RNA, 12 nt, Listeria monocytogenes EGD-e
uauaaaaacaug

SEQ ID NO: 2804216 - RNA, 21 nt, Listeria monocytogenes EGD-e
uauaaagaacuagauuuaaua

SEQ ID NO: 2804217 - RNA, 17 nt, Listeria monocytogenes EGD-e
uauaaaguuuuuugguu

SEQ ID NO: 2804218 - RNA, 22 nt, Listeria monocytogenes EGD-e
uauaacaaagcguuuuuuauuu

SEQ ID NO: 2804219 - RNA, 18 nt, Listeria monocytogenes EGD-e
uauaaccccaaaaugcua

SEQ ID NO: 2804220 - RNA, 12 nt, Listeria monocytogenes EGD-e
uauaacucucau

SEQ ID NO: 2804221 - RNA, 19 nt, Listeria monocytogenes EGD-e
uauaacuuuuuuucuuaga

SEQ ID NO: 2804222 - RNA, 14 nt, Listeria monocytogenes EGD-e
uauaagaaauuacg

SEQ ID NO: 2804223 - RNA, 14 nt, Listeria monocytogenes EGD-e
uauaaguacuugaa

SEQ ID NO: 2804224 - RNA, 15 nt, Listeria monocytogenes EGD-e
uauaaucaauaucuu

SEQ ID NO: 2804225 - RNA, 20 nt, Listeria monocytogenes EGD-e
uauaaucuacuguauauguu

SEQ ID NO: 2804226 - RNA, 15 nt, Listeria monocytogenes EGD-e
uauaaugauucaaag

SEQ ID NO: 2804227 - RNA, 20 nt, Listeria monocytogenes EGD-e
uauaauucggcaaacagcuu

SEQ ID NO: 2804228 - RNA, 22 nt, Listeria monocytogenes EGD-e
uauacaagcguaugguucaaaa

SEQ ID NO: 2804229 - RNA, 14 nt, Listeria monocytogenes EGD-e
uauacacgauaacu

SEQ ID NO: 2804230 - RNA, 15 nt, Listeria monocytogenes EGD-e
uauacaggaacuaca

SEQ ID NO: 2804231 - RNA, 14 nt, Listeria monocytogenes EGD-e
uauacauugaaaaa

SEQ ID NO: 2804232 - RNA, 20 nt, Listeria monocytogenes EGD-e
uauaccgaccaucaguagua

SEQ ID NO: 2804233 - RNA, 13 nt, Listeria monocytogenes EGD-e
uauacgcaaugcu

SEQ ID NO: 2804234 - RNA, 20 nt, Listeria monocytogenes EGD-e
uauacuuggaauaaacagcc

SEQ ID NO: 2804235 - RNA, 18 nt, Listeria monocytogenes EGD-e
uauacuuuuaauuaaaag

SEQ ID NO: 2804236 - RNA, 22 nt, Listeria monocytogenes EGD-e
uauacuuuuaauuaaaaguugu

SEQ ID NO: 2804237 - RNA, 14 nt, Listeria monocytogenes EGD-e
uauagcguacauga

SEQ ID NO: 2804238 - RNA, 14 nt, Listeria monocytogenes EGD-e
ucaacaaaacaaac

SEQ ID NO: 2804239 - RNA, 20 nt, Listeria monocytogenes EGD-e
ucaacgggcgcuuucacauc

SEQ ID NO: 2804240 - RNA, 15 nt, Listeria monocytogenes EGD-e
ucaacuggacaauga

SEQ ID NO: 2804241 - RNA, 18 nt, Listeria monocytogenes EGD-e
ucaacuggacaaugaucc

SEQ ID NO: 2804242 - RNA, 13 nt, Listeria monocytogenes EGD-e
ucaagauuuugcu

SEQ ID NO: 2804243 - RNA, 17 nt, Listeria monocytogenes EGD-e
ucaagauuuugcucagc

SEQ ID NO: 2804244 - RNA, 12 nt, Listeria monocytogenes EGD-e
ucaagauuuugu

SEQ ID NO: 2804245 - RNA, 15 nt, Listeria monocytogenes EGD-e
ucaagcauauuaauu

SEQ ID NO: 2804246 - RNA, 20 nt, Listeria monocytogenes EGD-e
ucaagcauuucauaaucaaa

SEQ ID NO: 2804247 - RNA, 16 nt, Listeria monocytogenes EGD-e
ucaaguaauaagaaga

SEQ ID NO: 2804248 - RNA, 14 nt, Listeria monocytogenes EGD-e
ucaauaaauccagc

SEQ ID NO: 2804249 - RNA, 22 nt, Listeria monocytogenes EGD-e
ucaauaaauccagcgucuaaaa

SEQ ID NO: 2804250 - RNA, 23 nt, Listeria monocytogenes EGD-e
ucaauaaauccagcgucuaaaaa

SEQ ID NO: 2804251 - RNA, 16 nt, Listeria monocytogenes EGD-e
ucaauaauaauacaaa

SEQ ID NO: 2804252 - RNA, 16 nt, Listeria monocytogenes EGD-e
ucaauacguuucauag

SEQ ID NO: 2804253 - RNA, 16 nt, Listeria monocytogenes EGD-e
ucaauagcagaaucua

SEQ ID NO: 2804254 - RNA, 15 nt, Listeria monocytogenes EGD-e
ucaauccauuuuucu

SEQ ID NO: 2804255 - RNA, 17 nt, Listeria monocytogenes EGD-e
ucaaucggaacaccaag

SEQ ID NO: 2804256 - RNA, 15 nt, Listeria monocytogenes EGD-e
ucaaucucaucacca

SEQ ID NO: 2804257 - RNA, 22 nt, Listeria monocytogenes EGD-e
ucaaugauaucaucaauaauaa

SEQ ID NO: 2804258 - RNA, 17 nt, Listeria monocytogenes EGD-e
ucaauuaaauuauacau

SEQ ID NO: 2804259 - RNA, 17 nt, Listeria monocytogenes EGD-e
ucaauuuugccagugau

SEQ ID NO: 2804260 - RNA, 18 nt, Listeria monocytogenes EGD-e
ucacaaacgcuuuuucaa

SEQ ID NO: 2804261 - RNA, 22 nt, Listeria monocytogenes EGD-e
ucacaaacgcuuuuucaaaauc

SEQ ID NO: 2804262 - RNA, 19 nt, Listeria monocytogenes EGD-e
ucacaaguaacucuuccaa

SEQ ID NO: 2804263 - RNA, 21 nt, Listeria monocytogenes EGD-e
ucacaaguaacucuuccaaaa

SEQ ID NO: 2804264 - RNA, 18 nt, Listeria monocytogenes EGD-e
ucacaaguaccaaauagg

SEQ ID NO: 2804265 - RNA, 22 nt, Listeria monocytogenes EGD-e
ucacaccuugugugguguuuuu

SEQ ID NO: 2804266 - RNA, 15 nt, Listeria monocytogenes EGD-e
ucacacgaaccccaa

SEQ ID NO: 2804267 - RNA, 16 nt, Listeria monocytogenes EGD-e
ucacacgacgaauggc

SEQ ID NO: 2804268 - RNA, 18 nt, Listeria monocytogenes EGD-e
ucacacgacgaauggccu

SEQ ID NO: 2804269 - RNA, 20 nt, Listeria monocytogenes EGD-e
ucacagcguauccaccaaaa

SEQ ID NO: 2804270 - RNA, 13 nt, Listeria monocytogenes EGD-e
ucaccaaaugcuu

SEQ ID NO: 2804271 - RNA, 15 nt, Listeria monocytogenes EGD-e
ucaccacaaaggaca

SEQ ID NO: 2804272 - RNA, 15 nt, Listeria monocytogenes EGD-e
ucaccacuucuucca

SEQ ID NO: 2804273 - RNA, 19 nt, Listeria monocytogenes EGD-e
ucacccauacuaaucaaua

SEQ ID NO: 2804274 - RNA, 22 nt, Listeria monocytogenes EGD-e
ucacgucauaaccucgcaaaaa

SEQ ID NO: 2804275 - RNA, 14 nt, Listeria monocytogenes EGD-e
ucacuaacaaaaua

SEQ ID NO: 2804276 - RNA, 17 nt, Listeria monocytogenes EGD-e
ucacuaacaaaauaaua

SEQ ID NO: 2804277 - RNA, 18 nt, Listeria monocytogenes EGD-e
ucacuaacaaaauaauaa

SEQ ID NO: 2804278 - RNA, 21 nt, Listeria monocytogenes EGD-e
ucacuagcgcacaaguaauau

SEQ ID NO: 2804279 - RNA, 22 nt, Listeria monocytogenes EGD-e
ucacugauuuauuauaagcagu

SEQ ID NO: 2804280 - RNA, 18 nt, Listeria monocytogenes EGD-e
ucacuggagcugauuuua

SEQ ID NO: 2804281 - RNA, 19 nt, Listeria monocytogenes EGD-e
ucacugugaacugauuuuu

SEQ ID NO: 2804282 - RNA, 18 nt, Listeria monocytogenes EGD-e
ucacuuaauucuugaaug

SEQ ID NO: 2804283 - RNA, 18 nt, Listeria monocytogenes EGD-e
ucacuucgaaaguaaaau

SEQ ID NO: 2804284 - RNA, 15 nt, Listeria monocytogenes EGD-e
ucacuucuuaagaau

SEQ ID NO: 2804285 - RNA, 23 nt, Listeria monocytogenes EGD-e
ucacuuucuugcugcauuuucac

SEQ ID NO: 2804286 - RNA, 16 nt, Listeria monocytogenes EGD-e
ucagaucuccgaauac

SEQ ID NO: 2804287 - RNA, 18 nt, Listeria monocytogenes EGD-e
ucagcaagauaacucaaa

SEQ ID NO: 2804288 - RNA, 17 nt, Listeria monocytogenes EGD-e
ucagcaauguaggcauu

SEQ ID NO: 2804289 - RNA, 17 nt, Listeria monocytogenes EGD-e
ucagccaauucuuccac

SEQ ID NO: 2804290 - RNA, 18 nt, Listeria monocytogenes EGD-e
ucagcggguugaaaggaa

SEQ ID NO: 2804291 - RNA, 18 nt, Listeria monocytogenes EGD-e
ucagcgguuguuguaauu

SEQ ID NO: 2804292 - RNA, 22 nt, Listeria monocytogenes EGD-e
ucagcuaaauauuuaauuuuau

SEQ ID NO: 2804293 - RNA, 18 nt, Listeria monocytogenes EGD-e
ucagcucuauaauuuaua

SEQ ID NO: 2804294 - RNA, 20 nt, Listeria monocytogenes EGD-e
ucagcucuuuuuuuauuuuc

SEQ ID NO: 2804295 - RNA, 21 nt, Listeria monocytogenes EGD-e
ucagcucuuuuuuuauuuuca

SEQ ID NO: 2804296 - RNA, 19 nt, Listeria monocytogenes EGD-e
ucagcuucgauuuuuucaa

SEQ ID NO: 2804297 - RNA, 16 nt, Listeria monocytogenes EGD-e
ucauaaaacuuucaca

SEQ ID NO: 2804298 - RNA, 24 nt, Listeria monocytogenes EGD-e
ucauaagcuaacaacaagcaaaac

SEQ ID NO: 2804299 - RNA, 16 nt, Listeria monocytogenes EGD-e
ucauaauaggagacau

SEQ ID NO: 2804300 - RNA, 16 nt, Listeria monocytogenes EGD-e
ucauauaauucuaaua

SEQ ID NO: 2804301 - RNA, 22 nt, Listeria monocytogenes EGD-e
ucauauuuggccaauuaaaaua

SEQ ID NO: 2804302 - RNA, 21 nt, Listeria monocytogenes EGD-e
ucaucaacgggcgcuuucaca

SEQ ID NO: 2804303 - RNA, 22 nt, Listeria monocytogenes EGD-e
ucaucaacgggcgcuuucacau

SEQ ID NO: 2804304 - RNA, 13 nt, Listeria monocytogenes EGD-e
ucaucaauaaaau

SEQ ID NO: 2804305 - RNA, 15 nt, Listeria monocytogenes EGD-e
ucaucauaaacauuu

SEQ ID NO: 2804306 - RNA, 21 nt, Listeria monocytogenes EGD-e
ucaucuuaucaaguaauaaga

SEQ ID NO: 2804307 - RNA, 18 nt, Listeria monocytogenes EGD-e
ucaucuuuauaaaaugca

SEQ ID NO: 2804308 - RNA, 19 nt, Listeria monocytogenes EGD-e
ucaugaaacuuuaacaaaa

SEQ ID NO: 2804309 - RNA, 18 nt, Listeria monocytogenes EGD-e
ucaugaagcaaaccauua

SEQ ID NO: 2804310 - RNA, 13 nt, Listeria monocytogenes EGD-e
ucaugaauaaguu

SEQ ID NO: 2804311 - RNA, 16 nt, Listeria monocytogenes EGD-e
ucaugagcuaauuuuu

SEQ ID NO: 2804312 - RNA, 22 nt, Listeria monocytogenes EGD-e
ucaugccuucaaacacuucuaa

SEQ ID NO: 2804313 - RNA, 14 nt, Listeria monocytogenes EGD-e
ucauggaaacaaag

SEQ ID NO: 2804314 - RNA, 22 nt, Listeria monocytogenes EGD-e
ucaugugcuuguaagaagcuuu

SEQ ID NO: 2804315 - RNA, 18 nt, Listeria monocytogenes EGD-e
ucauuaaagcuauauaau

SEQ ID NO: 2804316 - RNA, 15 nt, Listeria monocytogenes EGD-e
ucauuaaauuuagcu

SEQ ID NO: 2804317 - RNA, 17 nt, Listeria monocytogenes EGD-e
ucauuacaaaauuuguc

SEQ ID NO: 2804318 - RNA, 16 nt, Listeria monocytogenes EGD-e
ucauuauaaguguaaa

SEQ ID NO: 2804319 - RNA, 15 nt, Listeria monocytogenes EGD-e
ucauuauuaaacuca

SEQ ID NO: 2804320 - RNA, 13 nt, Listeria monocytogenes EGD-e
ucauucaaugagu

SEQ ID NO: 2804321 - RNA, 22 nt, Listeria monocytogenes EGD-e
ucauucuuuuuuauacgccuuu

SEQ ID NO: 2804322 - RNA, 16 nt, Listeria monocytogenes EGD-e
ucauugagucgcuauu

SEQ ID NO: 2804323 - RNA, 22 nt, Listeria monocytogenes EGD-e
ucauuuaacaucagauuaaaua

SEQ ID NO: 2804324 - RNA, 20 nt, Listeria monocytogenes EGD-e
ucauuucuacaacuggcaca

SEQ ID NO: 2804325 - RNA, 20 nt, Listeria monocytogenes EGD-e
ucauuuuuuugauuaauaaa

SEQ ID NO: 2804326 - RNA, 22 nt, Listeria monocytogenes EGD-e
uccaaacacgaacauaccaaua

SEQ ID NO: 2804327 - RNA, 22 nt, Listeria monocytogenes EGD-e
uccaaagagccauaaaauuagu

SEQ ID NO: 2804328 - RNA, 23 nt, Listeria monocytogenes EGD-e
uccaagaacagcaauuuguuuau

SEQ ID NO: 2804329 - RNA, 19 nt, Listeria monocytogenes EGD-e
uccaagcggguuuucucag

SEQ ID NO: 2804330 - RNA, 20 nt, Listeria monocytogenes EGD-e
uccaagcggguuuucucaga

SEQ ID NO: 2804331 - RNA, 17 nt, Listeria monocytogenes EGD-e
uccaaguuuuuuaauuu

SEQ ID NO: 2804332 - RNA, 15 nt, Listeria monocytogenes EGD-e
uccaauucuuucgcu

SEQ ID NO: 2804333 - RNA, 14 nt, Listeria monocytogenes EGD-e
uccaccagcuacuu

SEQ ID NO: 2804334 - RNA, 22 nt, Listeria monocytogenes EGD-e
uccaccuguauuaaugacuguu

SEQ ID NO: 2804335 - RNA, 18 nt, Listeria monocytogenes EGD-e
uccacgcggcauuucaau

SEQ ID NO: 2804336 - RNA, 20 nt, Listeria monocytogenes EGD-e
uccacuaacuuaucuuucaa

SEQ ID NO: 2804337 - RNA, 16 nt, Listeria monocytogenes EGD-e
uccagcgucuaaaaau

SEQ ID NO: 2804338 - RNA, 22 nt, Listeria monocytogenes EGD-e
ucgucuuagaaaaauguuugca

SEQ ID NO: 2804339 - RNA, 21 nt, Listeria monocytogenes EGD-e
ucgugcgcaacauucaaauca

SEQ ID NO: 2804340 - RNA, 15 nt, Listeria monocytogenes EGD-e
ucguucuuaguuaau

SEQ ID NO: 2804341 - RNA, 22 nt, Listeria monocytogenes EGD-e
ucguucuuaguuaauucuuuuu

SEQ ID NO: 2804342 - RNA, 18 nt, Listeria monocytogenes EGD-e
ucguuucagcucuauaau

SEQ ID NO: 2804343 - RNA, 14 nt, Listeria monocytogenes EGD-e
ucguuuuaaagcuu

SEQ ID NO: 2804344 - RNA, 22 nt, Listeria monocytogenes EGD-e
ucguuuuaaagcuugauuuaau

SEQ ID NO: 2804345 - RNA, 19 nt, Listeria monocytogenes EGD-e
ucguuuuuacuuacaaaag

SEQ ID NO: 2804346 - RNA, 16 nt, Listeria monocytogenes EGD-e
ucuaaaaucauuaaag

SEQ ID NO: 2804347 - RNA, 19 nt, Listeria monocytogenes EGD-e
ucuaaaguuagauuaaaaa

SEQ ID NO: 2804348 - RNA, 21 nt, Listeria monocytogenes EGD-e
ucuaaaguuagauuaaaaauc

SEQ ID NO: 2804349 - RNA, 19 nt, Listeria monocytogenes EGD-e
ucuaaauaaauauuuugca

SEQ ID NO: 2804350 - RNA, 13 nt, Listeria monocytogenes EGD-e
ucuaaauuaacuu

SEQ ID NO: 2804351 - RNA, 15 nt, Listeria monocytogenes EGD-e
ucuaaauuuuaaucu

SEQ ID NO: 2804352 - RNA, 22 nt, Listeria monocytogenes EGD-e
ucuaacauuaauucauuuaauu

SEQ ID NO: 2804353 - RNA, 17 nt, Listeria monocytogenes EGD-e
ucuaagaaaaaaaguua

SEQ ID NO: 2804354 - RNA, 15 nt, Listeria monocytogenes EGD-e
ucuaauaauuuuaau

SEQ ID NO: 2804355 - RNA, 16 nt, Listeria monocytogenes EGD-e
ucuaauaauuuuaauu

SEQ ID NO: 2804356 - RNA, 16 nt, Listeria monocytogenes EGD-e
ucuaauacgacaauac

SEQ ID NO: 2804357 - RNA, 17 nt, Listeria monocytogenes EGD-e
ucuaauagcauaaagua

SEQ ID NO: 2804358 - RNA, 15 nt, Listeria monocytogenes EGD-e
ucuacaacuggcaca

SEQ ID NO: 2804359 - RNA, 18 nt, Listeria monocytogenes EGD-e
ucuacaaguucuuucaug

SEQ ID NO: 2804360 - RNA, 16 nt, Listeria monocytogenes EGD-e
ucuacaggcuauucca

SEQ ID NO: 2804361 - RNA, 16 nt, Listeria monocytogenes EGD-e
ucuacuagugaaauag

SEQ ID NO: 2804362 - RNA, 18 nt, Listeria monocytogenes EGD-e
ucuacuagugaaauagaa

SEQ ID NO: 2804363 - RNA, 11 nt, Listeria monocytogenes EGD-e
ucuacuucuaa

SEQ ID NO: 2804364 - RNA, 14 nt, Listeria monocytogenes EGD-e
ucuagcgucacaau

SEQ ID NO: 2804365 - RNA, 22 nt, Listeria monocytogenes EGD-e
ucuagcgucacaauacccgaag

SEQ ID NO: 2804366 - RNA, 12 nt, Listeria monocytogenes EGD-e
ucuauauucauc

SEQ ID NO: 2804367 - RNA, 20 nt, Listeria monocytogenes EGD-e
ucucauaagagaauaucuau

SEQ ID NO: 2804368 - RNA, 22 nt, Listeria monocytogenes EGD-e
ucucauaagagaauaucuauuc

SEQ ID NO: 2804369 - RNA, 17 nt, Listeria monocytogenes EGD-e
ucucccauuugucccac

SEQ ID NO: 2804370 - RNA, 14 nt, Listeria monocytogenes EGD-e
ucuccuuaaauaaa

SEQ ID NO: 2804371 - RNA, 17 nt, Listeria monocytogenes EGD-e
ucuccuuaaauaaaaac

SEQ ID NO: 2804372 - RNA, 14 nt, Listeria monocytogenes EGD-e
ucugaaaugauuuu

SEQ ID NO: 2804373 - RNA, 16 nt, Listeria monocytogenes EGD-e
ucugagaagccagcau

SEQ ID NO: 2804374 - RNA, 19 nt, Listeria monocytogenes EGD-e
ucugaguagaaaguuaguu

SEQ ID NO: 2804375 - RNA, 23 nt, Listeria monocytogenes EGD-e
ucugauugguccugcugaaauag

SEQ ID NO: 2804376 - RNA, 22 nt, Listeria monocytogenes EGD-e
ucugcauccaagcggguuuucu

SEQ ID NO: 2804377 - RNA, 19 nt, Listeria monocytogenes EGD-e
ucugcuuuuucaaguaaaa

SEQ ID NO: 2804378 - RNA, 15 nt, Listeria monocytogenes EGD-e
ucuggauaaaaauaa

SEQ ID NO: 2804379 - RNA, 15 nt, Listeria monocytogenes EGD-e
ucuggaucauauucu

SEQ ID NO: 2804380 - RNA, 23 nt, Listeria monocytogenes EGD-e
ucuggauuucuccguaagaagaa

SEQ ID NO: 2804381 - RNA, 22 nt, Listeria monocytogenes EGD-e
ucugggcucguugcagaaacaa

SEQ ID NO: 2804382 - RNA, 18 nt, Listeria monocytogenes EGD-e
ucuguuucauuuuuccaa

SEQ ID NO: 2804383 - RNA, 15 nt, Listeria monocytogenes EGD-e
ucuguuuuuucuuug

SEQ ID NO: 2804384 - RNA, 13 nt, Listeria monocytogenes EGD-e
ucuuaaauacgaa

SEQ ID NO: 2804385 - RNA, 17 nt, Listeria monocytogenes EGD-e
ucuuacuauuuucuaau

SEQ ID NO: 2804386 - RNA, 16 nt, Listeria monocytogenes EGD-e
ucuuaggaauuucgaa

SEQ ID NO: 2804387 - RNA, 22 nt, Listeria monocytogenes EGD-e
ucuuaguuaauucuuuuucuga

SEQ ID NO: 2804388 - RNA, 16 nt, Listeria monocytogenes EGD-e
ucuuaugagaguuaua

SEQ ID NO: 2804389 - RNA, 15 nt, Listeria monocytogenes EGD-e
ucuucaauugcuucu

SEQ ID NO: 2804390 - RNA, 13 nt, Listeria monocytogenes EGD-e
ucuucagaaagug

SEQ ID NO: 2804391 - RNA, 16 nt, Listeria monocytogenes EGD-e
ucuucauuuuucuagu

SEQ ID NO: 2804392 - RNA, 18 nt, Listeria monocytogenes EGD-e
ucuuccaccuguauuaau

SEQ ID NO: 2804393 - RNA, 23 nt, Listeria monocytogenes EGD-e
ucuuccauagaauguauacacua

SEQ ID NO: 2804394 - RNA, 17 nt, Listeria monocytogenes EGD-e
ucuuccauauuuucucu

SEQ ID NO: 2804395 - RNA, 19 nt, Listeria monocytogenes EGD-e
ucuuccauauuuucucuaa

SEQ ID NO: 2804396 - RNA, 18 nt, Listeria monocytogenes EGD-e
ucuuccuuuuguuuuaau

SEQ ID NO: 2804397 - RNA, 12 nt, Listeria monocytogenes EGD-e
ucuucuaaaaua

SEQ ID NO: 2804398 - RNA, 13 nt, Listeria monocytogenes EGD-e
ucuucuaagaaaa

SEQ ID NO: 2804399 - RNA, 23 nt, Listeria monocytogenes EGD-e
ucuucuauauuaaugucaauuau

SEQ ID NO: 2804400 - RNA, 22 nt, Listeria monocytogenes EGD-e
ucuucugucacaucuguuccuu

SEQ ID NO: 2804401 - RNA, 19 nt, Listeria monocytogenes EGD-e
ucuucuuugauuuuuucuu

SEQ ID NO: 2804402 - RNA, 20 nt, Listeria monocytogenes EGD-e
ucuugacuuuguuaacuaga

SEQ ID NO: 2804403 - RNA, 22 nt, Listeria monocytogenes EGD-e
ucuugauccaaguuuuuuaauu

SEQ ID NO: 2804404 - RNA, 20 nt, Listeria monocytogenes EGD-e
ucuugaugccaucaggaguu

SEQ ID NO: 2804405 - RNA, 14 nt, Listeria monocytogenes EGD-e
ucuugcaagagcag

SEQ ID NO: 2804406 - RNA, 21 nt, Listeria monocytogenes EGD-e
ucuuggaagaaccuucaagca

SEQ ID NO: 2804407 - RNA, 20 nt, Listeria monocytogenes EGD-e
ucuuguaaaagcgaacuuaa

SEQ ID NO: 2804408 - RNA, 19 nt, Listeria monocytogenes EGD-e
ucuuguguaugagaacaau

SEQ ID NO: 2804409 - RNA, 11 nt, Listeria monocytogenes EGD-e
ucuuuaaaaac

SEQ ID NO: 2804410 - RNA, 13 nt, Listeria monocytogenes EGD-e
ucuuuaaacaagc

SEQ ID NO: 2804411 - RNA, 23 nt, Listeria monocytogenes EGD-e
ucuuuaccauacacauaggucag

SEQ ID NO: 2804412 - RNA, 14 nt, Listeria monocytogenes EGD-e
ucuuuaucuuuccc

SEQ ID NO: 2804413 - RNA, 16 nt, Listeria monocytogenes EGD-e
ucuuuaucuuucccau

SEQ ID NO: 2804414 - RNA, 13 nt, Listeria monocytogenes EGD-e
ucuuuauuuuuug

SEQ ID NO: 2804415 - RNA, 23 nt, Listeria monocytogenes EGD-e
ucuuucacacgauaccaaaguug

SEQ ID NO: 2804416 - RNA, 14 nt, Listeria monocytogenes EGD-e
ucuuucuucuacua

SEQ ID NO: 2804417 - RNA, 14 nt, Listeria monocytogenes EGD-e
ucuuugauuuuuuc

SEQ ID NO: 2804418 - RNA, 16 nt, Listeria monocytogenes EGD-e
ucuuugccuuaaaaua

SEQ ID NO: 2804419 - RNA, 18 nt, Listeria monocytogenes EGD-e
ucuuuguauacuucaaaa

SEQ ID NO: 2804420 - RNA, 21 nt, Listeria monocytogenes EGD-e
ucuuuuacgacuguugccauu

SEQ ID NO: 2804421 - RNA, 15 nt, Listeria monocytogenes EGD-e
ucuuuuauaaaaaua

SEQ ID NO: 2804422 - RNA, 14 nt, Listeria monocytogenes EGD-e
ucuuuuauuuuucu

SEQ ID NO: 2804423 - RNA, 19 nt, Listeria monocytogenes EGD-e
ucuuuuauuuuucuuucuu

SEQ ID NO: 2804424 - RNA, 17 nt, Listeria monocytogenes EGD-e
ucuuuucacaaccaauu

SEQ ID NO: 2804425 - RNA, 12 nt, Listeria monocytogenes EGD-e
ucuuuuccuaau

SEQ ID NO: 2804426 - RNA, 14 nt, Listeria monocytogenes EGD-e
ucuuuuuuuaauuu

SEQ ID NO: 2804427 - RNA, 18 nt, Listeria monocytogenes EGD-e
ucuuuuuuuaauuuuccg

SEQ ID NO: 2804428 - RNA, 13 nt, Listeria monocytogenes EGD-e
ucuuuuuuuagua

SEQ ID NO: 2804429 - RNA, 23 nt, Listeria monocytogenes EGD-e
ucuuuuuuuaguaaacauuucuc

SEQ ID NO: 2804430 - RNA, 12 nt, Listeria monocytogenes EGD-e
ugaaaaaacauc

SEQ ID NO: 2804431 - RNA, 14 nt, Listeria monocytogenes EGD-e
ugaaaagaaaaacc

SEQ ID NO: 2804432 - RNA, 22 nt, Listeria monocytogenes EGD-e
ugaaaagacaccaauuucuguu

SEQ ID NO: 2804433 - RNA, 20 nt, Listeria monocytogenes EGD-e
ugaaaccacuacuaaaucgu

SEQ ID NO: 2804434 - RNA, 16 nt, Listeria monocytogenes EGD-e
ugaaacuuuaacaaaa

SEQ ID NO: 2804435 - RNA, 23 nt, Listeria monocytogenes EGD-e
ugaaagagggcccgaaaaucgag

SEQ ID NO: 2804436 - RNA, 23 nt, Listeria monocytogenes EGD-e
ugaaauaauaccaggaucaaaau

SEQ ID NO: 2804437 - RNA, 13 nt, Listeria monocytogenes EGD-e
ugaaauagaauca

SEQ ID NO: 2804438 - RNA, 17 nt, Listeria monocytogenes EGD-e
ugaaaugauuuuuauuc

SEQ ID NO: 2804439 - RNA, 16 nt, Listeria monocytogenes EGD-e
ugcuucaccaagaaga

SEQ ID NO: 2804440 - RNA, 18 nt, Listeria monocytogenes EGD-e
ugcuucacgugcugcuuu

SEQ ID NO: 2804441 - RNA, 15 nt, Listeria monocytogenes EGD-e
ugcuucguuauaauu

SEQ ID NO: 2804442 - RNA, 14 nt, Listeria monocytogenes EGD-e
ugcuucuaaagcua

SEQ ID NO: 2804443 - RNA, 11 nt, Listeria monocytogenes EGD-e
ugcuucuucca

SEQ ID NO: 2804444 - RNA, 12 nt, Listeria monocytogenes EGD-e
ugcuucuuccau

SEQ ID NO: 2804445 - RNA, 16 nt, Listeria monocytogenes EGD-e
ugcuuuaauuuggaaa

SEQ ID NO: 2804446 - RNA, 15 nt, Listeria monocytogenes EGD-e
ugcuuuccuugcugc

SEQ ID NO: 2804447 - RNA, 20 nt, Listeria monocytogenes EGD-e
ugcuuucguuucagcucuau

SEQ ID NO: 2804448 - RNA, 16 nt, Listeria monocytogenes EGD-e
ugcuuuuauuuuuaaa

SEQ ID NO: 2804449 - RNA, 19 nt, Listeria monocytogenes EGD-e
ugcuuuuucaaguaaaaac

SEQ ID NO: 2804450 - RNA, 13 nt, Listeria monocytogenes EGD-e
ugcuuuuuuuaaa

SEQ ID NO: 2804451 - RNA, 23 nt, Listeria monocytogenes EGD-e
ugcuuuuuuuaaacuauuuuuua

SEQ ID NO: 2804452 - RNA, 18 nt, Listeria monocytogenes EGD-e
uggaaaacauagaaaaag

SEQ ID NO: 2804453 - RNA, 23 nt, Listeria monocytogenes EGD-e
uggaaagaauauccguuucauuu

SEQ ID NO: 2804454 - RNA, 17 nt, Listeria monocytogenes EGD-e
uggaagucaaagguuua

SEQ ID NO: 2804455 - RNA, 18 nt, Listeria monocytogenes EGD-e
uggaagucaaagguuuaa

SEQ ID NO: 2804456 - RNA, 13 nt, Listeria monocytogenes EGD-e
uggaagugaaaau

SEQ ID NO: 2804457 - RNA, 16 nt, Listeria monocytogenes EGD-e
uggacaaugauccgaa

SEQ ID NO: 2804458 - RNA, 13 nt, Listeria monocytogenes EGD-e
uggacuguuuccc

SEQ ID NO: 2804459 - RNA, 13 nt, Listeria monocytogenes EGD-e
uggagauucauaa

SEQ ID NO: 2804460 - RNA, 14 nt, Listeria monocytogenes EGD-e
uggauaaaaaaaua

SEQ ID NO: 2804461 - RNA, 22 nt, Listeria monocytogenes EGD-e
uggauaaaauggcguuuuaaau

SEQ ID NO: 2804462 - RNA, 22 nt, Listeria monocytogenes EGD-e
uggauagagcgaauaagugaau

SEQ ID NO: 2804463 - RNA, 15 nt, Listeria monocytogenes EGD-e
uggauaguuccagcu

SEQ ID NO: 2804464 - RNA, 17 nt, Listeria monocytogenes EGD-e
uggaucauauucuucua

SEQ ID NO: 2804465 - RNA, 17 nt, Listeria monocytogenes EGD-e
uggaugcacuuuuaauu

SEQ ID NO: 2804466 - RNA, 15 nt, Listeria monocytogenes EGD-e
uggauuauucaauuc

SEQ ID NO: 2804467 - RNA, 20 nt, Listeria monocytogenes EGD-e
uggauuucuccguaagaaga

SEQ ID NO: 2804468 - RNA, 16 nt, Listeria monocytogenes EGD-e
uggauuugcuuuauag

SEQ ID NO: 2804469 - RNA, 21 nt, Listeria monocytogenes EGD-e
uggauuuucuagguucuuuuu

SEQ ID NO: 2804470 - RNA, 14 nt, Listeria monocytogenes EGD-e
uggcgauucuucaa

SEQ ID NO: 2804471 - RNA, 16 nt, Listeria monocytogenes EGD-e
uggcgcaagugcuaaa

SEQ ID NO: 2804472 - RNA, 22 nt, Listeria monocytogenes EGD-e
uggcuggcaguuuuuuuagaaa

SEQ ID NO: 2804473 - RNA, 12 nt, Listeria monocytogenes EGD-e
ugggaaugaaua

SEQ ID NO: 2804474 - RNA, 23 nt, Listeria monocytogenes EGD-e
ugggaaugaauagauauucucuu

SEQ ID NO: 2804475 - RNA, 14 nt, Listeria monocytogenes EGD-e
ugggagcuuucuuu

SEQ ID NO: 2804476 - RNA, 16 nt, Listeria monocytogenes EGD-e
ugggaguuuuuuauua

SEQ ID NO: 2804477 - RNA, 21 nt, Listeria monocytogenes EGD-e
ugggaguuuuuuauuauugcu

SEQ ID NO: 2804478 - RNA, 22 nt, Listeria monocytogenes EGD-e
ugggcaaccuaguuuuauuaua

SEQ ID NO: 2804479 - RNA, 16 nt, Listeria monocytogenes EGD-e
ugggcaguccaccagc

SEQ ID NO: 2804480 - RNA, 19 nt, Listeria monocytogenes EGD-e
ugggucgucguauguuuuc

SEQ ID NO: 2804481 - RNA, 17 nt, Listeria monocytogenes EGD-e
ugguacguuuuuuauuu

SEQ ID NO: 2804482 - RNA, 13 nt, Listeria monocytogenes EGD-e
ugguaguuuuaaa

SEQ ID NO: 2804483 - RNA, 14 nt, Listeria monocytogenes EGD-e
ugguaguuuuaaau

SEQ ID NO: 2804484 - RNA, 17 nt, Listeria monocytogenes EGD-e
uggucauauguuucgcc

SEQ ID NO: 2804485 - RNA, 13 nt, Listeria monocytogenes EGD-e
uggucauuuuuua

SEQ ID NO: 2804486 - RNA, 13 nt, Listeria monocytogenes EGD-e
ugguuaauaaggu

SEQ ID NO: 2804487 - RNA, 10 nt, Listeria monocytogenes EGD-e
ugguuauuuc

SEQ ID NO: 2804488 - RNA, 16 nt, Listeria monocytogenes EGD-e
ugguugcauuuggaga

SEQ ID NO: 2804489 - RNA, 23 nt, Listeria monocytogenes EGD-e
ugguuguucuuuuacggcuucaa

SEQ ID NO: 2804490 - RNA, 16 nt, Listeria monocytogenes EGD-e
ugguuuuucuuuuccu

SEQ ID NO: 2804491 - RNA, 14 nt, Listeria monocytogenes EGD-e
uguaaaccguaacu

SEQ ID NO: 2804492 - RNA, 16 nt, Listeria monocytogenes EGD-e
uguaaaccguaacugu

SEQ ID NO: 2804493 - RNA, 19 nt, Listeria monocytogenes EGD-e
uguaaaugcgacauacuuu

SEQ ID NO: 2804494 - RNA, 14 nt, Listeria monocytogenes EGD-e
uguaacaaaaucuu

SEQ ID NO: 2804495 - RNA, 17 nt, Listeria monocytogenes EGD-e
uguaacgucucucauug

SEQ ID NO: 2804496 - RNA, 14 nt, Listeria monocytogenes EGD-e
uguaagaagcuuuu

SEQ ID NO: 2804497 - RNA, 17 nt, Listeria monocytogenes EGD-e
uguaagauaauacguga

SEQ ID NO: 2804498 - RNA, 14 nt, Listeria monocytogenes EGD-e
uguaagguuuuuuu

SEQ ID NO: 2804499 - RNA, 14 nt, Listeria monocytogenes EGD-e
uguaaguguuucua

SEQ ID NO: 2804500 - RNA, 17 nt, Listeria monocytogenes EGD-e
uguaaguguuucuagau

SEQ ID NO: 2804501 - RNA, 16 nt, Listeria monocytogenes EGD-e
uguaauaguauacuuu

SEQ ID NO: 2804502 - RNA, 22 nt, Listeria monocytogenes EGD-e
uguaauaguauacuuuuaauua

SEQ ID NO: 2804503 - RNA, 12 nt, Listeria monocytogenes EGD-e
uguaauaugggg

SEQ ID NO: 2804504 - RNA, 21 nt, Listeria monocytogenes EGD-e
uguaaucacuauugaauguca

SEQ ID NO: 2804505 - RNA, 14 nt, Listeria monocytogenes EGD-e
uguaaucuugaugc

SEQ ID NO: 2804506 - RNA, 15 nt, Listeria monocytogenes EGD-e
uguaauucgaauaag

SEQ ID NO: 2804507 - RNA, 19 nt, Listeria monocytogenes EGD-e
uguaauucuaaauaaauau

SEQ ID NO: 2804508 - RNA, 13 nt, Listeria monocytogenes EGD-e
uguacacauuaua

SEQ ID NO: 2804509 - RNA, 17 nt, Listeria monocytogenes EGD-e
uguagcucauuacaaaa

SEQ ID NO: 2804510 - RNA, 16 nt, Listeria monocytogenes EGD-e
uguaggguuuggaaaa

SEQ ID NO: 2804511 - RNA, 16 nt, Listeria monocytogenes EGD-e
uguauagcuuaaaggu

SEQ ID NO: 2804512 - RNA, 16 nt, Listeria monocytogenes EGD-e
uguauauguuuuauuu

SEQ ID NO: 2804513 - RNA, 13 nt, Listeria monocytogenes EGD-e
uguaucuuaauac

SEQ ID NO: 2804514 - RNA, 18 nt, Listeria monocytogenes EGD-e
ugucaaaccauuauacaa

SEQ ID NO: 2804515 - RNA, 21 nt, Listeria monocytogenes EGD-e
ugucaaaccauuauacaauua

SEQ ID NO: 2804516 - RNA, 22 nt, Listeria monocytogenes EGD-e
ugucaaauucuucuccauacua

SEQ ID NO: 2804517 - RNA, 20 nt, Listeria monocytogenes EGD-e
ugucaaucuaaauuuuaauc

SEQ ID NO: 2804518 - RNA, 17 nt, Listeria monocytogenes EGD-e
ugucauaaaacuuucac

SEQ ID NO: 2804519 - RNA, 19 nt, Listeria monocytogenes EGD-e
ugucauaaaacuuucacaa

SEQ ID NO: 2804520 - RNA, 13 nt, Listeria monocytogenes EGD-e
ugucaucauaaac

SEQ ID NO: 2804521 - RNA, 11 nt, Listeria monocytogenes EGD-e
uguccauugau

SEQ ID NO: 2804522 - RNA, 24 nt, Listeria monocytogenes EGD-e
uguccggacuuaguauuucagcaa

SEQ ID NO: 2804523 - RNA, 15 nt, Listeria monocytogenes EGD-e
ugucgaaaaccuaaa

SEQ ID NO: 2804524 - RNA, 17 nt, Listeria monocytogenes EGD-e
ugucgaaaaccuaaaua

SEQ ID NO: 2804525 - RNA, 13 nt, Listeria monocytogenes EGD-e
ugucguaugcuuu

SEQ ID NO: 2804526 - RNA, 23 nt, Listeria monocytogenes EGD-e
ugucguuucaaagcaucagcuuu

SEQ ID NO: 2804527 - RNA, 14 nt, Listeria monocytogenes EGD-e
ugucuuaaaugaca

SEQ ID NO: 2804528 - RNA, 22 nt, Listeria monocytogenes EGD-e
ugucuucggauuuuucaaauca

SEQ ID NO: 2804529 - RNA, 22 nt, Listeria monocytogenes EGD-e
ugucuucuggaucacuauauaa

SEQ ID NO: 2804530 - RNA, 16 nt, Listeria monocytogenes EGD-e
ugugaaaguuuuauga

SEQ ID NO: 2804531 - RNA, 22 nt, Listeria monocytogenes EGD-e
ugugaaggaaacgaauaaaauc

SEQ ID NO: 2804532 - RNA, 13 nt, Listeria monocytogenes EGD-e
ugugauuguucca

SEQ ID NO: 2804533 - RNA, 14 nt, Listeria monocytogenes EGD-e
ugugauuguuccag

SEQ ID NO: 2804534 - RNA, 16 nt, Listeria monocytogenes EGD-e
ugugcuuuuuuuagua

SEQ ID NO: 2804535 - RNA, 18 nt, Listeria monocytogenes EGD-e
uguggauggcuagcaaca

SEQ ID NO: 2804536 - RNA, 16 nt, Listeria monocytogenes EGD-e
uguguugcuuuuauuu

SEQ ID NO: 2804537 - RNA, 16 nt, Listeria monocytogenes EGD-e
uguuaacuaacaaaau

SEQ ID NO: 2804538 - RNA, 15 nt, Listeria monocytogenes EGD-e
uguuacugugcucuu

SEQ ID NO: 2804539 - RNA, 21 nt, Listeria monocytogenes EGD-e
uguucgcauugauuuuugaau

SEQ ID NO: 2804540 - RNA, 15 nt, Listeria monocytogenes EGD-e
uguucgucgcaucaa

SEQ ID NO: 2804541 - RNA, 16 nt, Listeria monocytogenes EGD-e
uuaucuuucccaucau

SEQ ID NO: 2804542 - RNA, 18 nt, Listeria monocytogenes EGD-e
uuaugaaaaaaaauaaau

SEQ ID NO: 2804543 - RNA, 16 nt, Listeria monocytogenes EGD-e
uuaugacaauuaaaaa

SEQ ID NO: 2804544 - RNA, 14 nt, Listeria monocytogenes EGD-e
uuaugcauaaaaaa

SEQ ID NO: 2804545 - RNA, 18 nt, Listeria monocytogenes EGD-e
uuauggaaaaauccacuc

SEQ ID NO: 2804546 - RNA, 16 nt, Listeria monocytogenes EGD-e
uuaugucggugcauuu

SEQ ID NO: 2804547 - RNA, 19 nt, Listeria monocytogenes EGD-e
uuauuaauaguauaaggau

SEQ ID NO: 2804548 - RNA, 13 nt, Listeria monocytogenes EGD-e
uuauuauugcuuu

SEQ ID NO: 2804549 - RNA, 22 nt, Listeria monocytogenes EGD-e
uuauucauugaacgaacgauaa

SEQ ID NO: 2804550 - RNA, 10 nt, Listeria monocytogenes EGD-e
uuauuuuaac

SEQ ID NO: 2804551 - RNA, 11 nt, Listeria monocytogenes EGD-e
uuauuuuuaaa

SEQ ID NO: 2804552 - RNA, 19 nt, Listeria monocytogenes EGD-e
uuauuuuucagcuaaauau

SEQ ID NO: 2804553 - RNA, 16 nt, Listeria monocytogenes EGD-e
uucaaacacuucuaaa

SEQ ID NO: 2804554 - RNA, 19 nt, Listeria monocytogenes EGD-e
uucaaacgaucagccauuu

SEQ ID NO: 2804555 - RNA, 22 nt, Listeria monocytogenes EGD-e
uucaaacgcagguucaccaaau

SEQ ID NO: 2804556 - RNA, 16 nt, Listeria monocytogenes EGD-e
uucaaagcuacuuuuc

SEQ ID NO: 2804557 - RNA, 17 nt, Listeria monocytogenes EGD-e
uucaaaucaccacaaag

SEQ ID NO: 2804558 - RNA, 19 nt, Listeria monocytogenes EGD-e
uucaagcauuucauaauca

SEQ ID NO: 2804559 - RNA, 21 nt, Listeria monocytogenes EGD-e
uucaaggagcggcucagaucc

SEQ ID NO: 2804560 - RNA, 19 nt, Listeria monocytogenes EGD-e
uucaaugagucaaugccca

SEQ ID NO: 2804561 - RNA, 17 nt, Listeria monocytogenes EGD-e
uucaauuuuauuugguu

SEQ ID NO: 2804562 - RNA, 15 nt, Listeria monocytogenes EGD-e
uucacaaccaauuaa

SEQ ID NO: 2804563 - RNA, 21 nt, Listeria monocytogenes EGD-e
uucacacgauaccaaaguugu

SEQ ID NO: 2804564 - RNA, 19 nt, Listeria monocytogenes EGD-e
uucacaucacuaauuagca

SEQ ID NO: 2804565 - RNA, 14 nt, Listeria monocytogenes EGD-e
uucacaucuucaau

SEQ ID NO: 2804566 - RNA, 24 nt, Listeria monocytogenes EGD-e
uucaccaagaagagcugcaacaga

SEQ ID NO: 2804567 - RNA, 19 nt, Listeria monocytogenes EGD-e
uucaccgugcguucccgca

SEQ ID NO: 2804568 - RNA, 15 nt, Listeria monocytogenes EGD-e
uucacugcauaaaaa

SEQ ID NO: 2804569 - RNA, 14 nt, Listeria monocytogenes EGD-e
uucacugugaacug

SEQ ID NO: 2804570 - RNA, 22 nt, Listeria monocytogenes EGD-e
uucagcaagagcaccaauaaaa

SEQ ID NO: 2804571 - RNA, 13 nt, Listeria monocytogenes EGD-e
uucagccaauucu

SEQ ID NO: 2804572 - RNA, 15 nt, Listeria monocytogenes EGD-e
uucagcuaaauauuu

SEQ ID NO: 2804573 - RNA, 16 nt, Listeria monocytogenes EGD-e
uucagcuaaucguuuu

SEQ ID NO: 2804574 - RNA, 22 nt, Listeria monocytogenes EGD-e
uucaucggagacaguuuguaua

SEQ ID NO: 2804575 - RNA, 21 nt, Listeria monocytogenes EGD-e
uucaugugcuuguaagaagcu

SEQ ID NO: 2804576 - RNA, 18 nt, Listeria monocytogenes EGD-e
uucauuagacaaaaagaa

SEQ ID NO: 2804577 - RNA, 14 nt, Listeria monocytogenes EGD-e
uucauuuaauuguc

SEQ ID NO: 2804578 - RNA, 21 nt, Listeria monocytogenes EGD-e
uucauuuaauugucgaaaacc

SEQ ID NO: 2804579 - RNA, 19 nt, Listeria monocytogenes EGD-e
uucauuuaguacauaaaau

SEQ ID NO: 2804580 - RNA, 15 nt, Listeria monocytogenes EGD-e
uucauuuguuucuuu

SEQ ID NO: 2804581 - RNA, 13 nt, Listeria monocytogenes EGD-e
uuccaacauaaua

SEQ ID NO: 2804582 - RNA, 16 nt, Listeria monocytogenes EGD-e
uuccaaguguuuuagu

SEQ ID NO: 2804583 - RNA, 15 nt, Listeria monocytogenes EGD-e
uuccaccauuuguuu

SEQ ID NO: 2804584 - RNA, 19 nt, Listeria monocytogenes EGD-e
uuccaccauuuguuuuauu

SEQ ID NO: 2804585 - RNA, 21 nt, Listeria monocytogenes EGD-e
uuccaccuguauuaaugacug

SEQ ID NO: 2804586 - RNA, 22 nt, Listeria monocytogenes EGD-e
uuccacuccagcugcuucuaaa

SEQ ID NO: 2804587 - RNA, 18 nt, Listeria monocytogenes EGD-e
uuccaguuaaacaaacac

SEQ ID NO: 2804588 - RNA, 16 nt, Listeria monocytogenes EGD-e
uuccaugacaucuucu

SEQ ID NO: 2804589 - RNA, 14 nt, Listeria monocytogenes EGD-e
uucccagaaaaaaa

SEQ ID NO: 2804590 - RNA, 16 nt, Listeria monocytogenes EGD-e
uucccagaaaaaaaca

SEQ ID NO: 2804591 - RNA, 18 nt, Listeria monocytogenes EGD-e
uuccccaccaggcaaaac

SEQ ID NO: 2804592 - RNA, 13 nt, Listeria monocytogenes EGD-e
uucccgcuacuau

SEQ ID NO: 2804593 - RNA, 19 nt, Listeria monocytogenes EGD-e
uucccguuaaucgaaaaau

SEQ ID NO: 2804594 - RNA, 21 nt, Listeria monocytogenes EGD-e
uucccguuaaucgaaaaauca

SEQ ID NO: 2804595 - RNA, 13 nt, Listeria monocytogenes EGD-e
uucccuccuuuau

SEQ ID NO: 2804596 - RNA, 17 nt, Listeria monocytogenes EGD-e
uucccuccuuuauuuuu

SEQ ID NO: 2804597 - RNA, 20 nt, Listeria monocytogenes EGD-e
uucccuuuacuugcaaaugc

SEQ ID NO: 2804598 - RNA, 17 nt, Listeria monocytogenes EGD-e
uuccgcagcuucaaucu

SEQ ID NO: 2804599 - RNA, 21 nt, Listeria monocytogenes EGD-e
uuccgggcgugguaagccauu

SEQ ID NO: 2804600 - RNA, 22 nt, Listeria monocytogenes EGD-e
uuccgggcgugguaagccauuu

SEQ ID NO: 2804601 - RNA, 14 nt, Listeria monocytogenes EGD-e
uuccuaauuuuacu

SEQ ID NO: 2804602 - RNA, 15 nt, Listeria monocytogenes EGD-e
uuccuaauuuuacuu

SEQ ID NO: 2804603 - RNA, 19 nt, Listeria monocytogenes EGD-e
uuccuaauuuuacuucuac

SEQ ID NO: 2804604 - RNA, 14 nt, Listeria monocytogenes EGD-e
uuccuccaauuuua

SEQ ID NO: 2804605 - RNA, 16 nt, Listeria monocytogenes EGD-e
uuccuccaauuuuacu

SEQ ID NO: 2804606 - RNA, 16 nt, Listeria monocytogenes EGD-e
uuccugauguguugcu

SEQ ID NO: 2804607 - RNA, 19 nt, Listeria monocytogenes EGD-e
uuccuucuuccauuaaucu

SEQ ID NO: 2804608 - RNA, 22 nt, Listeria monocytogenes EGD-e
uuccuugcugcucgcucaucau

SEQ ID NO: 2804609 - RNA, 21 nt, Listeria monocytogenes EGD-e
uuccuuuuguuuuaauaaauc

SEQ ID NO: 2804610 - RNA, 14 nt, Listeria monocytogenes EGD-e
uucgaaagaaaugu

SEQ ID NO: 2804611 - RNA, 23 nt, Listeria monocytogenes EGD-e
uucgaaagcaaaugcauuucucg

SEQ ID NO: 2804612 - RNA, 15 nt, Listeria monocytogenes EGD-e
uucgaaaguuucuuu

SEQ ID NO: 2804613 - RNA, 14 nt, Listeria monocytogenes EGD-e
uucgaauaaagaac

SEQ ID NO: 2804614 - RNA, 11 nt, Listeria monocytogenes EGD-e
uucgagcagcu

SEQ ID NO: 2804615 - RNA, 20 nt, Listeria monocytogenes EGD-e
uucgauaguuccuucuaaua

SEQ ID NO: 2804616 - RNA, 23 nt, Listeria monocytogenes EGD-e
uucgauauuuuuuuguucuggua

SEQ ID NO: 2804617 - RNA, 17 nt, Listeria monocytogenes EGD-e
uucgauuucugcagaau

SEQ ID NO: 2804618 - RNA, 14 nt, Listeria monocytogenes EGD-e
uucgauuuucaacu

SEQ ID NO: 2804619 - RNA, 22 nt, Listeria monocytogenes EGD-e
uucgcaaaaagucaugacagca

SEQ ID NO: 2804620 - RNA, 15 nt, Listeria monocytogenes EGD-e
uucgcaaucaauuua

SEQ ID NO: 2804621 - RNA, 16 nt, Listeria monocytogenes EGD-e
uucggauuuuucaaau

SEQ ID NO: 2804622 - RNA, 18 nt, Listeria monocytogenes EGD-e
uucgguaagaccaccaag

SEQ ID NO: 2804623 - RNA, 14 nt, Listeria monocytogenes EGD-e
uucgguauaaaaca

SEQ ID NO: 2804624 - RNA, 19 nt, Listeria monocytogenes EGD-e
uucgucuuagaaaaauguu

SEQ ID NO: 2804625 - RNA, 14 nt, Listeria monocytogenes EGD-e
uucguuaguauuuc

SEQ ID NO: 2804626 - RNA, 21 nt, Listeria monocytogenes EGD-e
uucguuuuuacuuacaaaagu

SEQ ID NO: 2804627 - RNA, 23 nt, Listeria monocytogenes EGD-e
uucuaaacguucuuccuuuuuca

SEQ ID NO: 2804628 - RNA, 15 nt, Listeria monocytogenes EGD-e
uucuaaauaaauauu

SEQ ID NO: 2804629 - RNA, 18 nt, Listeria monocytogenes EGD-e
uucuaaauuaacuucaug

SEQ ID NO: 2804630 - RNA, 18 nt, Listeria monocytogenes EGD-e
uucuaagucaaaacguuc

SEQ ID NO: 2804631 - RNA, 19 nt, Listeria monocytogenes EGD-e
uucuaaucaaaugcacagc

SEQ ID NO: 2804632 - RNA, 20 nt, Listeria monocytogenes EGD-e
uucuaccguuccuucaagca

SEQ ID NO: 2804633 - RNA, 19 nt, Listeria monocytogenes EGD-e
uucuacuguaccuuuaaaa

SEQ ID NO: 2804634 - RNA, 21 nt, Listeria monocytogenes EGD-e
uucuagccgcucgucuaaauu

SEQ ID NO: 2804635 - RNA, 14 nt, Listeria monocytogenes EGD-e
uucuagugcaucuu

SEQ ID NO: 2804636 - RNA, 12 nt, Listeria monocytogenes EGD-e
uucuauuaauaa

SEQ ID NO: 2804637 - RNA, 21 nt, Listeria monocytogenes EGD-e
uucuauuccuccuaauuguuu

SEQ ID NO: 2804638 - RNA, 16 nt, Listeria monocytogenes EGD-e
uucuauuugucaaucu

SEQ ID NO: 2804639 - RNA, 16 nt, Listeria monocytogenes EGD-e
uucucaaaaauaugcu

SEQ ID NO: 2804640 - RNA, 23 nt, Listeria monocytogenes EGD-e
uucucaggaguuaauucuguuaa

SEQ ID NO: 2804641 - RNA, 23 nt, Listeria monocytogenes EGD-e
uucucgcugcaauuucaaccaau

SEQ ID NO: 2804642 - RNA, 15 nt, Listeria monocytogenes EGD-e
uuuaauugucauaaa

SEQ ID NO: 2804643 - RNA, 14 nt, Listeria monocytogenes EGD-e
uuuaauuuggaaau

SEQ ID NO: 2804644 - RNA, 15 nt, Listeria monocytogenes EGD-e
uuuaauuuuaucugg

SEQ ID NO: 2804645 - RNA, 16 nt, Listeria monocytogenes EGD-e
uuuaccuugaucaaaa

SEQ ID NO: 2804646 - RNA, 21 nt, Listeria monocytogenes EGD-e
uuuaccuuucguuuuuacuua

SEQ ID NO: 2804647 - RNA, 18 nt, Listeria monocytogenes EGD-e
uuuacgacuguugccauu

SEQ ID NO: 2804648 - RNA, 22 nt, Listeria monocytogenes EGD-e
uuuacgcauaucaucaauaaaa

SEQ ID NO: 2804649 - RNA, 14 nt, Listeria monocytogenes EGD-e
uuuacguuguucua

SEQ ID NO: 2804650 - RNA, 13 nt, Listeria monocytogenes EGD-e
uuuacuugcaaau

SEQ ID NO: 2804651 - RNA, 21 nt, Listeria monocytogenes EGD-e
uuuagcaacuucacuaacaaa

SEQ ID NO: 2804652 - RNA, 21 nt, Listeria monocytogenes EGD-e
uuuaggucggguuuuaaaaug

SEQ ID NO: 2804653 - RNA, 22 nt, Listeria monocytogenes EGD-e
uuuaguagagcuucuguuuuuu

SEQ ID NO: 2804654 - RNA, 13 nt, Listeria monocytogenes EGD-e
uuuauaagaaauu

SEQ ID NO: 2804655 - RNA, 17 nt, Listeria monocytogenes EGD-e
uuuauaauuaacaacca

SEQ ID NO: 2804656 - RNA, 22 nt, Listeria monocytogenes EGD-e
uuuauauucuucugucacaucu

SEQ ID NO: 2804657 - RNA, 20 nt, Listeria monocytogenes EGD-e
uuuaucaaacaaaaaaguuc

SEQ ID NO: 2804658 - RNA, 16 nt, Listeria monocytogenes EGD-e
uuuaucaauaauagca

SEQ ID NO: 2804659 - RNA, 20 nt, Listeria monocytogenes EGD-e
uuuaugaaaaaaaauaaaug

SEQ ID NO: 2804660 - RNA, 22 nt, Listeria monocytogenes EGD-e
uuuaugaaaaaaaauaaaugca

SEQ ID NO: 2804661 - RNA, 16 nt, Listeria monocytogenes EGD-e
uuuaugcacuuucaaa

SEQ ID NO: 2804662 - RNA, 15 nt, Listeria monocytogenes EGD-e
uuuaugcauaaaaaa

SEQ ID NO: 2804663 - RNA, 15 nt, Listeria monocytogenes EGD-e
uuuaugcuaaaugaa

SEQ ID NO: 2804664 - RNA, 14 nt, Listeria monocytogenes EGD-e
uuuauuacauuaag

SEQ ID NO: 2804665 - RNA, 22 nt, Listeria monocytogenes EGD-e
uuuauuauaagcaguacuuccu

SEQ ID NO: 2804666 - RNA, 14 nt, Listeria monocytogenes EGD-e
uuuauucauauaaa

SEQ ID NO: 2804667 - RNA, 16 nt, Listeria monocytogenes EGD-e
uuuauucgaauaaaga

SEQ ID NO: 2804668 - RNA, 17 nt, Listeria monocytogenes EGD-e
uuuauuuuucagcuaaa

SEQ ID NO: 2804669 - RNA, 21 nt, Listeria monocytogenes EGD-e
uuucaaaucagcuuccauacu

SEQ ID NO: 2804670 - RNA, 14 nt, Listeria monocytogenes EGD-e
uuucaacaaaacaa

SEQ ID NO: 2804671 - RNA, 18 nt, Listeria monocytogenes EGD-e
uuucacaaguaacucuuc

SEQ ID NO: 2804672 - RNA, 17 nt, Listeria monocytogenes EGD-e
uuucagcuaaucguuuu

SEQ ID NO: 2804673 - RNA, 16 nt, Listeria monocytogenes EGD-e
uuucauauaauuuuuu

SEQ ID NO: 2804674 - RNA, 13 nt, Listeria monocytogenes EGD-e
uuucauucuuucc

SEQ ID NO: 2804675 - RNA, 24 nt, Listeria monocytogenes EGD-e
uuucauuuucuauuccuccuaauu

SEQ ID NO: 2804676 - RNA, 15 nt, Listeria monocytogenes EGD-e
uuuccaaaauggcca

SEQ ID NO: 2804677 - RNA, 19 nt, Listeria monocytogenes EGD-e
uuuccaccauuuguuuuau

SEQ ID NO: 2804678 - RNA, 14 nt, Listeria monocytogenes EGD-e
uuucccagaaaaaa

SEQ ID NO: 2804679 - RNA, 18 nt, Listeria monocytogenes EGD-e
uuucccagaaaaaaacaa

SEQ ID NO: 2804680 - RNA, 19 nt, Listeria monocytogenes EGD-e
uuucccagaaaaaaacaaa

SEQ ID NO: 2804681 - RNA, 19 nt, Listeria monocytogenes EGD-e
uuuccgcaaguucggaacu

SEQ ID NO: 2804682 - RNA, 21 nt, Listeria monocytogenes EGD-e
uuuccuaauuuuacuucuacu

SEQ ID NO: 2804683 - RNA, 20 nt, Listeria monocytogenes EGD-e
uuuccuucauaauuauuuuu

SEQ ID NO: 2804684 - RNA, 17 nt, Listeria monocytogenes EGD-e
uuucgauaucuucaugu

SEQ ID NO: 2804685 - RNA, 16 nt, Listeria monocytogenes EGD-e
uuucgauuaauauacu

SEQ ID NO: 2804686 - RNA, 13 nt, Listeria monocytogenes EGD-e
uuucgccaauuug

SEQ ID NO: 2804687 - RNA, 16 nt, Listeria monocytogenes EGD-e
uuucgccguuggaagu

SEQ ID NO: 2804688 - RNA, 18 nt, Listeria monocytogenes EGD-e
uuucgcuccguauuuaua

SEQ ID NO: 2804689 - RNA, 17 nt, Listeria monocytogenes EGD-e
uuucggaccuuuugcuu

SEQ ID NO: 2804690 - RNA, 13 nt, Listeria monocytogenes EGD-e
uuucggguuuguu

SEQ ID NO: 2804691 - RNA, 15 nt, Listeria monocytogenes EGD-e
uuucguuucagcucu

SEQ ID NO: 2804692 - RNA, 19 nt, Listeria monocytogenes EGD-e
uuucuagugcaucuucuaa

SEQ ID NO: 2804693 - RNA, 18 nt, Listeria monocytogenes EGD-e
uuucuauuccuccuaauu

SEQ ID NO: 2804694 - RNA, 18 nt, Listeria monocytogenes EGD-e
uuucucuaaaucaagccc

SEQ ID NO: 2804695 - RNA, 17 nt, Listeria monocytogenes EGD-e
uuucucuugcuuuaauu

SEQ ID NO: 2804696 - RNA, 14 nt, Listeria monocytogenes EGD-e
uuucuugauuuguu

SEQ ID NO: 2804697 - RNA, 21 nt, Listeria monocytogenes EGD-e
uuucuugcugcauuuucacaa

SEQ ID NO: 2804698 - RNA, 15 nt, Listeria monocytogenes EGD-e
uuucuuucuuuuguu

SEQ ID NO: 2804699 - RNA, 18 nt, Listeria monocytogenes EGD-e
uuucuuugccuuaaaaua

SEQ ID NO: 2804700 - RNA, 12 nt, Listeria monocytogenes EGD-e
uuucuuuuguuc

SEQ ID NO: 2804701 - RNA, 16 nt, Listeria monocytogenes EGD-e
uuucuuuuguucuucu

SEQ ID NO: 2804702 - RNA, 13 nt, Listeria monocytogenes EGD-e
uuugaaaaaacau

SEQ ID NO: 2804703 - RNA, 16 nt, Listeria monocytogenes EGD-e
uuugaaaacugaacaa

SEQ ID NO: 2804704 - RNA, 19 nt, Listeria monocytogenes EGD-e
uuugaauaacuuuccagcg

SEQ ID NO: 2804705 - RNA, 13 nt, Listeria monocytogenes EGD-e
uuugaauaagcaa

SEQ ID NO: 2804706 - RNA, 21 nt, Listeria monocytogenes EGD-e
uuugacaaaaggacaagccca

SEQ ID NO: 2804707 - RNA, 15 nt, Listeria monocytogenes EGD-e
uuugaguuggaauac

SEQ ID NO: 2804708 - RNA, 19 nt, Listeria monocytogenes EGD-e
uuugauuaggcauuucuuu

SEQ ID NO: 2804709 - RNA, 17 nt, Listeria monocytogenes EGD-e
uuugcacaaaaugcaaa

SEQ ID NO: 2804710 - RNA, 19 nt, Listeria monocytogenes EGD-e
uuugcccaccgauaauagg

SEQ ID NO: 2804711 - RNA, 20 nt, Listeria monocytogenes EGD-e
uuugcucgaauucuuuuucu

SEQ ID NO: 2804712 - RNA, 21 nt, Listeria monocytogenes EGD-e
uuugcucgaauucuuuuucuu

SEQ ID NO: 2804713 - RNA, 14 nt, Listeria monocytogenes EGD-e
uuugcuuuaaaaau

SEQ ID NO: 2804714 - RNA, 14 nt, Listeria monocytogenes EGD-e
uuugguuauuucuu

SEQ ID NO: 2804715 - RNA, 18 nt, Listeria monocytogenes EGD-e
uuugguugcuuguuuugu

SEQ ID NO: 2804716 - RNA, 19 nt, Listeria monocytogenes EGD-e
uuugguugcuuguuuuguc

SEQ ID NO: 2804717 - RNA, 12 nt, Listeria monocytogenes EGD-e
uuuguaaaaaua

SEQ ID NO: 2804718 - RNA, 21 nt, Listeria monocytogenes EGD-e
uuuguaacaacuaauuuuucg

SEQ ID NO: 2804719 - RNA, 23 nt, Listeria monocytogenes EGD-e
uuuguaauaguauacuuuuaauu

SEQ ID NO: 2804720 - RNA, 22 nt, Listeria monocytogenes EGD-e
uuuguaggguuuggaaaacaua

SEQ ID NO: 2804721 - RNA, 22 nt, Listeria monocytogenes EGD-e
uuuguauugguuucuuguugaa

SEQ ID NO: 2804722 - RNA, 17 nt, Listeria monocytogenes EGD-e
uuugucaaaccauuaua

SEQ ID NO: 2804723 - RNA, 21 nt, Listeria monocytogenes EGD-e
uuugucaaucuaaauuuuaau

SEQ ID NO: 2804724 - RNA, 16 nt, Listeria monocytogenes EGD-e
uuugucaucauaaaca

SEQ ID NO: 2804725 - RNA, 19 nt, Listeria monocytogenes EGD-e
uuugucccacaaacucauu

SEQ ID NO: 2804726 - RNA, 16 nt, Listeria monocytogenes EGD-e
uuugucuuaaaugaca

SEQ ID NO: 2804727 - RNA, 21 nt, Listeria monocytogenes EGD-e
uuugugcaccaaagacgcuuu

SEQ ID NO: 2804728 - RNA, 14 nt, Listeria monocytogenes EGD-e
uuuguggcaacuuc

SEQ ID NO: 2804729 - RNA, 17 nt, Listeria monocytogenes EGD-e
uuuguggcaacuucugg

SEQ ID NO: 2804730 - RNA, 20 nt, Listeria monocytogenes EGD-e
uuuguucucgccgacaagua

SEQ ID NO: 2804731 - RNA, 15 nt, Listeria monocytogenes EGD-e
uuuguugucaaugua

SEQ ID NO: 2804732 - RNA, 13 nt, Listeria monocytogenes EGD-e
uuuguuuccaacg

SEQ ID NO: 2804733 - RNA, 15 nt, Listeria monocytogenes EGD-e
uuuguuucuuuuguu

SEQ ID NO: 2804734 - RNA, 13 nt, Listeria monocytogenes EGD-e
uuuuaaaauucua

SEQ ID NO: 2804735 - RNA, 17 nt, Listeria monocytogenes EGD-e
uuuuaaacuauuuuuua

SEQ ID NO: 2804736 - RNA, 21 nt, Listeria monocytogenes EGD-e
uuuuaaaggaaaacucuccca

SEQ ID NO: 2804737 - RNA, 18 nt, Listeria monocytogenes EGD-e
uuuuaaauccguugucuu

SEQ ID NO: 2804738 - RNA, 20 nt, Listeria monocytogenes EGD-e
uuuuaaaucuucugccuguu

SEQ ID NO: 2804739 - RNA, 18 nt, Listeria monocytogenes EGD-e
uuuuaacggcuucaaaaa

SEQ ID NO: 2804740 - RNA, 17 nt, Listeria monocytogenes EGD-e
uuuuaaugcgaaaaaug

SEQ ID NO: 2804741 - RNA, 18 nt, Listeria monocytogenes EGD-e
uuuuaauuucaaauggag

SEQ ID NO: 2804742 - RNA, 23 nt, Listeria monocytogenes EGD-e
uuuuaauuuuucuucaacagcuu

SEQ ID NO: 2804743 - RNA, 18 nt, Listeria monocytogenes EGD-e
aaaaaaaguuauauuuaa

SEQ ID NO: 2804744 - RNA, 14 nt, Listeria monocytogenes EGD-e
aaaaacaauaacau

SEQ ID NO: 2804745 - RNA, 22 nt, Listeria monocytogenes EGD-e
aaaaacaucuugacuuuguuaa

SEQ ID NO: 2804746 - RNA, 21 nt, Listeria monocytogenes EGD-e
aaaaacaugauauauuuauaa

SEQ ID NO: 2804747 - RNA, 22 nt, Listeria monocytogenes EGD-e
aaaaacauuauuuugcuaaaga

SEQ ID NO: 2804748 - RNA, 24 nt, Listeria monocytogenes EGD-e
aaaaacuugguuaauauauaguca

SEQ ID NO: 2804749 - RNA, 18 nt, Listeria monocytogenes EGD-e
aaaaagaaaaaacaagga

SEQ ID NO: 2804750 - RNA, 20 nt, Listeria monocytogenes EGD-e
aaaaagagcggaagauguuu

SEQ ID NO: 2804751 - RNA, 19 nt, Listeria monocytogenes EGD-e
aaaaagcugccaccacuua

SEQ ID NO: 2804752 - RNA, 15 nt, Listeria monocytogenes EGD-e
aaaaaggaauuuuuc

SEQ ID NO: 2804753 - RNA, 20 nt, Listeria monocytogenes EGD-e
aaaaagggaugaaaaucuac

SEQ ID NO: 2804754 - RNA, 19 nt, Listeria monocytogenes EGD-e
aaaaagugaccuuugaaaa

SEQ ID NO: 2804755 - RNA, 22 nt, Listeria monocytogenes EGD-e
aaaaagugaccuuugaaaacug

SEQ ID NO: 2804756 - RNA, 23 nt, Listeria monocytogenes EGD-e
aaaaagugaccuuugaaaacuga

SEQ ID NO: 2804757 - RNA, 18 nt, Listeria monocytogenes EGD-e
aaaaagugcguaagauuu

SEQ ID NO: 2804758 - RNA, 23 nt, Listeria monocytogenes EGD-e
aaaaagugcguaagauuuuugcu

SEQ ID NO: 2804759 - RNA, 17 nt, Listeria monocytogenes EGD-e
aaaaaguggcgcuucca

SEQ ID NO: 2804760 - RNA, 18 nt, Listeria monocytogenes EGD-e
aaaaauagcuuucccuuu

SEQ ID NO: 2804761 - RNA, 19 nt, Listeria monocytogenes EGD-e
aaaaaugaaaagaaaaacc

SEQ ID NO: 2804762 - RNA, 19 nt, Listeria monocytogenes EGD-e
aaaaauuucaucguuuucu

SEQ ID NO: 2804763 - RNA, 13 nt, Listeria monocytogenes EGD-e
aaaacaaaagaua

SEQ ID NO: 2804764 - RNA, 16 nt, Listeria monocytogenes EGD-e
aaaacaaggaagaaua

SEQ ID NO: 2804765 - RNA, 21 nt, Listeria monocytogenes EGD-e
aaaacaauaacauuuucucuu

SEQ ID NO: 2804766 - RNA, 20 nt, Listeria monocytogenes EGD-e
aaaacaugauauauuuauaa

SEQ ID NO: 2804767 - RNA, 21 nt, Listeria monocytogenes EGD-e
aaaacaugauauauuuauaaa

SEQ ID NO: 2804768 - RNA, 18 nt, Listeria monocytogenes EGD-e
aaaacauuauuuugcuaa

SEQ ID NO: 2804769 - RNA, 22 nt, Listeria monocytogenes EGD-e
aaaaccuaaauacguauuaccu

SEQ ID NO: 2804770 - RNA, 16 nt, Listeria monocytogenes EGD-e
aaaacgacagauaaau

SEQ ID NO: 2804771 - RNA, 17 nt, Listeria monocytogenes EGD-e
aaaacgacagauaaaua

SEQ ID NO: 2804772 - RNA, 15 nt, Listeria monocytogenes EGD-e
aaaacggaucuuucu

SEQ ID NO: 2804773 - RNA, 22 nt, Listeria monocytogenes EGD-e
aaaacuaaaacgacagauaaau

SEQ ID NO: 2804774 - RNA, 16 nt, Listeria monocytogenes EGD-e
aaaacuaaauuaauuu

SEQ ID NO: 2804775 - RNA, 18 nt, Listeria monocytogenes EGD-e
aaaacugaacaaagaaga

SEQ ID NO: 2804776 - RNA, 21 nt, Listeria monocytogenes EGD-e
aaaagauacuuugaauuaaga

SEQ ID NO: 2804777 - RNA, 14 nt, Listeria monocytogenes EGD-e
aaaagcaaaaaagu

SEQ ID NO: 2804778 - RNA, 15 nt, Listeria monocytogenes EGD-e
aaaagcaaaaaagua

SEQ ID NO: 2804779 - RNA, 17 nt, Listeria monocytogenes EGD-e
aaaagcaaacaaaguac

SEQ ID NO: 2804780 - RNA, 14 nt, Listeria monocytogenes EGD-e
aaaagcaaugagac

SEQ ID NO: 2804781 - RNA, 20 nt, Listeria monocytogenes EGD-e
aaaagcacucgucuaaaaaa

SEQ ID NO: 2804782 - RNA, 13 nt, Listeria monocytogenes EGD-e
aaaaggaaagugc

SEQ ID NO: 2804783 - RNA, 17 nt, Listeria monocytogenes EGD-e
aaaaggacaagcccagc

SEQ ID NO: 2804784 - RNA, 18 nt, Listeria monocytogenes EGD-e
aaaaggacacccauaaua

SEQ ID NO: 2804785 - RNA, 24 nt, Listeria monocytogenes EGD-e
aaaagguaggccacuaacauaaau

SEQ ID NO: 2804786 - RNA, 15 nt, Listeria monocytogenes EGD-e
aaaaguuaagaagcg

SEQ ID NO: 2804787 - RNA, 20 nt, Listeria monocytogenes EGD-e
aaaaguuauauuuaaauagu

SEQ ID NO: 2804788 - RNA, 14 nt, Listeria monocytogenes EGD-e
aaaaguuucaauuu

SEQ ID NO: 2804789 - RNA, 10 nt, Listeria monocytogenes EGD-e
aaaauaaaaa

SEQ ID NO: 2804790 - RNA, 18 nt, Listeria monocytogenes EGD-e
aaaauaaaugcauuucuu

SEQ ID NO: 2804791 - RNA, 19 nt, Listeria monocytogenes EGD-e
aaaauaaucacguuuuugc

SEQ ID NO: 2804792 - RNA, 20 nt, Listeria monocytogenes EGD-e
aaaauacauuuuagcuuauu

SEQ ID NO: 2804793 - RNA, 22 nt, Listeria monocytogenes EGD-e
aaaaucaagcguaccauucacu

SEQ ID NO: 2804794 - RNA, 17 nt, Listeria monocytogenes EGD-e
aaaaucauuaaauuuag

SEQ ID NO: 2804795 - RNA, 14 nt, Listeria monocytogenes EGD-e
aaaaucauuuaaac

SEQ ID NO: 2804796 - RNA, 19 nt, Listeria monocytogenes EGD-e
aaaaucauuucgauaagca

SEQ ID NO: 2804797 - RNA, 22 nt, Listeria monocytogenes EGD-e
aaaaucgcauccucaaacguca

SEQ ID NO: 2804798 - RNA, 17 nt, Listeria monocytogenes EGD-e
aaaaucuuuaaacaagc

SEQ ID NO: 2804799 - RNA, 18 nt, Listeria monocytogenes EGD-e
aaaaucuuuaaacaagcu

SEQ ID NO: 2804800 - RNA, 17 nt, Listeria monocytogenes EGD-e
aaaaucuuuuaauaacu

SEQ ID NO: 2804801 - RNA, 15 nt, Listeria monocytogenes EGD-e
aaaaucuuuuuguuu

SEQ ID NO: 2804802 - RNA, 15 nt, Listeria monocytogenes EGD-e
aaaaugaaaagaaaa

SEQ ID NO: 2804803 - RNA, 18 nt, Listeria monocytogenes EGD-e
aaaaugguuucuuaaaua

SEQ ID NO: 2804804 - RNA, 18 nt, Listeria monocytogenes EGD-e
aaaauuagugccaugaau

SEQ ID NO: 2804805 - RNA, 20 nt, Listeria monocytogenes EGD-e
aaaauucaguuuauaaauac

SEQ ID NO: 2804806 - RNA, 16 nt, Listeria monocytogenes EGD-e
aaaauugcaacaguua

SEQ ID NO: 2804807 - RNA, 23 nt, Listeria monocytogenes EGD-e
aaaauugcaacaguuauuaaaag

SEQ ID NO: 2804808 - RNA, 23 nt, Listeria monocytogenes EGD-e
aaaauuucaucguuuucuacugu

SEQ ID NO: 2804809 - RNA, 16 nt, Listeria monocytogenes EGD-e
aaaauuugucuuuacu

SEQ ID NO: 2804810 - RNA, 22 nt, Listeria monocytogenes EGD-e
aaaauuugucuuuacuacauuu

SEQ ID NO: 2804811 - RNA, 14 nt, Listeria monocytogenes EGD-e
aaacaaacacaaaa

SEQ ID NO: 2804812 - RNA, 21 nt, Listeria monocytogenes EGD-e
aaacaaauuugccaaagagaa

SEQ ID NO: 2804813 - RNA, 20 nt, Listeria monocytogenes EGD-e
aaacaagaggcuuauuccuc

SEQ ID NO: 2804814 - RNA, 21 nt, Listeria monocytogenes EGD-e
aaacaaguccgucaagcccag

SEQ ID NO: 2804815 - RNA, 19 nt, Listeria monocytogenes EGD-e
aaacacgaacauaccaaua

SEQ ID NO: 2804816 - RNA, 20 nt, Listeria monocytogenes EGD-e
aaacagaaacgcuuuguuua

SEQ ID NO: 2804817 - RNA, 13 nt, Listeria monocytogenes EGD-e
aaacagcuuuucu

SEQ ID NO: 2804818 - RNA, 11 nt, Listeria monocytogenes EGD-e
aaacaguacuu

SEQ ID NO: 2804819 - RNA, 19 nt, Listeria monocytogenes EGD-e
aaacaguauuccucauuga

SEQ ID NO: 2804820 - RNA, 23 nt, Listeria monocytogenes EGD-e
aaacaguuagaagaacugcggcu

SEQ ID NO: 2804821 - RNA, 11 nt, Listeria monocytogenes EGD-e
aaacauagaaa

SEQ ID NO: 2804822 - RNA, 22 nt, Listeria monocytogenes EGD-e
aaacauagucagggaauaagaa

SEQ ID NO: 2804823 - RNA, 21 nt, Listeria monocytogenes EGD-e
aaacaugauauauuuauaaac

SEQ ID NO: 2804824 - RNA, 23 nt, Listeria monocytogenes EGD-e
aaacauuauuuugcuaaagaagu

SEQ ID NO: 2804825 - RNA, 21 nt, Listeria monocytogenes EGD-e
aaacauucgguccuuguacua

SEQ ID NO: 2804826 - RNA, 12 nt, Listeria monocytogenes EGD-e
aaacauuugaua

SEQ ID NO: 2804827 - RNA, 13 nt, Listeria monocytogenes EGD-e
aaacauuugauac

SEQ ID NO: 2804828 - RNA, 22 nt, Listeria monocytogenes EGD-e
aaacauuugauacauauuugaa

SEQ ID NO: 2804829 - RNA, 20 nt, Listeria monocytogenes EGD-e
aaaccaucgcaaaagcaaac

SEQ ID NO: 2804830 - RNA, 14 nt, Listeria monocytogenes EGD-e
aaaccauuccguug

SEQ ID NO: 2804831 - RNA, 14 nt, Listeria monocytogenes EGD-e
aaacccgaauaacu

SEQ ID NO: 2804832 - RNA, 15 nt, Listeria monocytogenes EGD-e
aaacccuugauuucu

SEQ ID NO: 2804833 - RNA, 17 nt, Listeria monocytogenes EGD-e
aaaccguaacuguugaa

SEQ ID NO: 2804834 - RNA, 23 nt, Listeria monocytogenes EGD-e
aaaccugcuuggauggacauaau

SEQ ID NO: 2804835 - RNA, 13 nt, Listeria monocytogenes EGD-e
aaacgaagcguuc

SEQ ID NO: 2804836 - RNA, 12 nt, Listeria monocytogenes EGD-e
aaacgaauaaaa

SEQ ID NO: 2804837 - RNA, 18 nt, Listeria monocytogenes EGD-e
aaacgcagguucaccaaa

SEQ ID NO: 2804838 - RNA, 22 nt, Listeria monocytogenes EGD-e
aaacguuccgauacaacaaaau

SEQ ID NO: 2804839 - RNA, 16 nt, Listeria monocytogenes EGD-e
aaacguucuuccuuuu

SEQ ID NO: 2804840 - RNA, 15 nt, Listeria monocytogenes EGD-e
aaacuacugguucuu

SEQ ID NO: 2804841 - RNA, 14 nt, Listeria monocytogenes EGD-e
aaacuaucaauaaa

SEQ ID NO: 2804842 - RNA, 16 nt, Listeria monocytogenes EGD-e
aaacucucccauuugu

SEQ ID NO: 2804843 - RNA, 18 nt, Listeria monocytogenes EGD-e
aaacugaacaaagaagaa

SEQ ID NO: 2804844 - RNA, 21 nt, Listeria monocytogenes EGD-e
aaacugaacaaagaagaagac

SEQ ID NO: 2804845 - RNA, 13 nt, Listeria monocytogenes EGD-e
aaacuguuguucu

SEQ ID NO: 2804846 - RNA, 14 nt, Listeria monocytogenes EGD-e
aaacuguuguucuu

SEQ ID NO: 2804847 - RNA, 18 nt, Listeria monocytogenes EGD-e
aaacuuaucucuucauuu

SEQ ID NO: 2804848 - RNA, 14 nt, Listeria monocytogenes EGD-e
aaacuuuaacaaaa

SEQ ID NO: 2804849 - RNA, 18 nt, Listeria monocytogenes EGD-e
aaacuuuaacaaaaguca

SEQ ID NO: 2804850 - RNA, 13 nt, Listeria monocytogenes EGD-e
aaacuuucuuuuc

SEQ ID NO: 2804851 - RNA, 20 nt, Listeria monocytogenes EGD-e
aaacuuuuucucaaaaauau

SEQ ID NO: 2804852 - RNA, 22 nt, Listeria monocytogenes EGD-e
aaagaaauaacuacuauuuaaa

SEQ ID NO: 2804853 - RNA, 17 nt, Listeria monocytogenes EGD-e
aaagaaauguugcgaaa

SEQ ID NO: 2804854 - RNA, 14 nt, Listeria monocytogenes EGD-e
aaagaagaaaaagu

SEQ ID NO: 2804855 - RNA, 16 nt, Listeria monocytogenes EGD-e
aaagaauaaaacaaaa

SEQ ID NO: 2804856 - RNA, 13 nt, Listeria monocytogenes EGD-e
aaagaauuuuuag

SEQ ID NO: 2804857 - RNA, 14 nt, Listeria monocytogenes EGD-e
aaagagccauaaaa

SEQ ID NO: 2804858 - RNA, 15 nt, Listeria monocytogenes EGD-e
aaagagccauaaaau

SEQ ID NO: 2804859 - RNA, 23 nt, Listeria monocytogenes EGD-e
aaagagcggaagauguuuaaaca

SEQ ID NO: 2804860 - RNA, 19 nt, Listeria monocytogenes EGD-e
aaagagggcccgaaaaucg

SEQ ID NO: 2804861 - RNA, 17 nt, Listeria monocytogenes EGD-e
aaagauacuuugaauua

SEQ ID NO: 2804862 - RNA, 18 nt, Listeria monocytogenes EGD-e
aaagauacuuugaauuaa

SEQ ID NO: 2804863 - RNA, 14 nt, Listeria monocytogenes EGD-e
aaagcaaacaaagu

SEQ ID NO: 2804864 - RNA, 17 nt, Listeria monocytogenes EGD-e
aaagcaguagacuaaau

SEQ ID NO: 2804865 - RNA, 17 nt, Listeria monocytogenes EGD-e
aaagcaugaauuuuuau

SEQ ID NO: 2804866 - RNA, 21 nt, Listeria monocytogenes EGD-e
aaagcguuuuucugcauccaa

SEQ ID NO: 2804867 - RNA, 19 nt, Listeria monocytogenes EGD-e
aaagcguuuuuuauuuuuc

SEQ ID NO: 2804868 - RNA, 14 nt, Listeria monocytogenes EGD-e
aaagcuaagcauua

SEQ ID NO: 2804869 - RNA, 19 nt, Listeria monocytogenes EGD-e
aaagcuaagcauuauaaaa

SEQ ID NO: 2804870 - RNA, 13 nt, Listeria monocytogenes EGD-e
aaagcugccacca

SEQ ID NO: 2804871 - RNA, 14 nt, Listeria monocytogenes EGD-e
aaagcugccaccac

SEQ ID NO: 2804872 - RNA, 20 nt, Listeria monocytogenes EGD-e
aaagcuguuuucaacaaaac

SEQ ID NO: 2804873 - RNA, 16 nt, Listeria monocytogenes EGD-e
aaaggaaauaauucca

SEQ ID NO: 2804874 - RNA, 18 nt, Listeria monocytogenes EGD-e
aaaggaauugcuucuccg

SEQ ID NO: 2804875 - RNA, 15 nt, Listeria monocytogenes EGD-e
aaaggacaagcccag

SEQ ID NO: 2804876 - RNA, 14 nt, Listeria monocytogenes EGD-e
aaaggagaaaaagu

SEQ ID NO: 2804877 - RNA, 14 nt, Listeria monocytogenes EGD-e
aaaggcaacaaaga

SEQ ID NO: 2804878 - RNA, 15 nt, Listeria monocytogenes EGD-e
aaaggcaacaaagaa

SEQ ID NO: 2804879 - RNA, 16 nt, Listeria monocytogenes EGD-e
aaaggcaacaaagaag

SEQ ID NO: 2804880 - RNA, 18 nt, Listeria monocytogenes EGD-e
aaaggcaacaaagaagaa

SEQ ID NO: 2804881 - RNA, 18 nt, Listeria monocytogenes EGD-e
aaagguauccuuauuaau

SEQ ID NO: 2804882 - RNA, 17 nt, Listeria monocytogenes EGD-e
aaaguaaaaucuuuuaa

SEQ ID NO: 2804883 - RNA, 14 nt, Listeria monocytogenes EGD-e
aaaguaccaauguu

SEQ ID NO: 2804884 - RNA, 22 nt, Listeria monocytogenes EGD-e
aaaguagauuccgcuaaaacua

SEQ ID NO: 2804885 - RNA, 23 nt, Listeria monocytogenes EGD-e
aaagugaccuuugaaaacugaac

SEQ ID NO: 2804886 - RNA, 18 nt, Listeria monocytogenes EGD-e
aaagugcgcuuauuuuuu

SEQ ID NO: 2804887 - RNA, 21 nt, Listeria monocytogenes EGD-e
aaaguggaccccgaucaauag

SEQ ID NO: 2804888 - RNA, 15 nt, Listeria monocytogenes EGD-e
aaaguuagauuaaaa

SEQ ID NO: 2804889 - RNA, 19 nt, Listeria monocytogenes EGD-e
aaaguuagauuaaaaaucu

SEQ ID NO: 2804890 - RNA, 20 nt, Listeria monocytogenes EGD-e
aaaguuaguugcuuuuguuu

SEQ ID NO: 2804891 - RNA, 17 nt, Listeria monocytogenes EGD-e
aaaguuauauuuaaaua

SEQ ID NO: 2804892 - RNA, 12 nt, Listeria monocytogenes EGD-e
aaaguuguuucu

SEQ ID NO: 2804893 - RNA, 17 nt, Listeria monocytogenes EGD-e
aaaguuucuuuuugauu

SEQ ID NO: 2804894 - RNA, 18 nt, Listeria monocytogenes EGD-e
aaaguuucuuuuugauua

SEQ ID NO: 2804895 - RNA, 12 nt, Listeria monocytogenes EGD-e
aaauaaaaccau

SEQ ID NO: 2804896 - RNA, 12 nt, Listeria monocytogenes EGD-e
aaauaaacaaau

SEQ ID NO: 2804897 - RNA, 21 nt, Listeria monocytogenes EGD-e
aaauaaauaggcccauuaaaa

SEQ ID NO: 2804898 - RNA, 16 nt, Listeria monocytogenes EGD-e
aaauaaauauuuugca

SEQ ID NO: 2804899 - RNA, 17 nt, Listeria monocytogenes EGD-e
aaauacgaaaaacauua

SEQ ID NO: 2804900 - RNA, 16 nt, Listeria monocytogenes EGD-e
aaauacgccucuaaag

SEQ ID NO: 2804901 - RNA, 15 nt, Listeria monocytogenes EGD-e
aaauacuuggagagu

SEQ ID NO: 2804902 - RNA, 13 nt, Listeria monocytogenes EGD-e
aaauagaaucaga

SEQ ID NO: 2804903 - RNA, 19 nt, Listeria monocytogenes EGD-e
aaauagacgaccauauaau

SEQ ID NO: 2804904 - RNA, 14 nt, Listeria monocytogenes EGD-e
aaauagcauucaca

SEQ ID NO: 2804905 - RNA, 17 nt, Listeria monocytogenes EGD-e
aaauagccaagauuaaa

SEQ ID NO: 2804906 - RNA, 18 nt, Listeria monocytogenes EGD-e
aaauagccaagauuaaaa

SEQ ID NO: 2804907 - RNA, 23 nt, Listeria monocytogenes EGD-e
aaauagcuuugucuuaaaugaca

SEQ ID NO: 2804908 - RNA, 16 nt, Listeria monocytogenes EGD-e
aaauaggcaaaucuuu

SEQ ID NO: 2804909 - RNA, 19 nt, Listeria monocytogenes EGD-e
aaauauacacaaaguaaaa

SEQ ID NO: 2804910 - RNA, 21 nt, Listeria monocytogenes EGD-e
aaauauagucuacuuuuaaaa

SEQ ID NO: 2804911 - RNA, 22 nt, Listeria monocytogenes EGD-e
aaauaucaccauuacuauuaau

SEQ ID NO: 2804912 - RNA, 15 nt, Listeria monocytogenes EGD-e
aaauauguuuaaucu

SEQ ID NO: 2804913 - RNA, 18 nt, Listeria monocytogenes EGD-e
aaauauugaauagaacua

SEQ ID NO: 2804914 - RNA, 24 nt, Listeria monocytogenes EGD-e
aaauauuuugcagugaugguggaa

SEQ ID NO: 2804915 - RNA, 14 nt, Listeria monocytogenes EGD-e
aaaucaaacuuaua

SEQ ID NO: 2804916 - RNA, 17 nt, Listeria monocytogenes EGD-e
aaaucaagcgguaaaua

SEQ ID NO: 2804917 - RNA, 18 nt, Listeria monocytogenes EGD-e
aaaucaagcguaccauuc

SEQ ID NO: 2804918 - RNA, 18 nt, Listeria monocytogenes EGD-e
aaaucaccacaaaggaca

SEQ ID NO: 2804919 - RNA, 19 nt, Listeria monocytogenes EGD-e
aaaucacuucuuaagaauu

SEQ ID NO: 2804920 - RNA, 12 nt, Listeria monocytogenes EGD-e
aaaucauaauaa

SEQ ID NO: 2804921 - RNA, 22 nt, Listeria monocytogenes EGD-e
aaaucaugccuucaaacacuuc

SEQ ID NO: 2804922 - RNA, 22 nt, Listeria monocytogenes EGD-e
aaaucauuucgauaagcacaaa

SEQ ID NO: 2804923 - RNA, 21 nt, Listeria monocytogenes EGD-e
aaauccagagcugauuauauc

SEQ ID NO: 2804924 - RNA, 14 nt, Listeria monocytogenes EGD-e
aaauccauuucauu

SEQ ID NO: 2804925 - RNA, 20 nt, Listeria monocytogenes EGD-e
aaauccauuucauucuuuuu

SEQ ID NO: 2804926 - RNA, 21 nt, Listeria monocytogenes EGD-e
aaauccgcuucguuucauuuc

SEQ ID NO: 2804927 - RNA, 20 nt, Listeria monocytogenes EGD-e
aaaucgaggaaguugcaaua

SEQ ID NO: 2804928 - RNA, 18 nt, Listeria monocytogenes EGD-e
aaaucgcgcaaacaguua

SEQ ID NO: 2804929 - RNA, 16 nt, Listeria monocytogenes EGD-e
aaaucggucaauugca

SEQ ID NO: 2804930 - RNA, 17 nt, Listeria monocytogenes EGD-e
aaaucucaugaaacuuu

SEQ ID NO: 2804931 - RNA, 20 nt, Listeria monocytogenes EGD-e
aaaucuuuaaacaagcuuug

SEQ ID NO: 2804932 - RNA, 23 nt, Listeria monocytogenes EGD-e
aaaucuuucacacgauaccaaag

SEQ ID NO: 2804933 - RNA, 21 nt, Listeria monocytogenes EGD-e
aaaugacaaagcuauuuuuua

SEQ ID NO: 2804934 - RNA, 14 nt, Listeria monocytogenes EGD-e
aaaugcauuucuua

SEQ ID NO: 2804935 - RNA, 23 nt, Listeria monocytogenes EGD-e
aaaugcauuucuuacuauuuucu

SEQ ID NO: 2804936 - RNA, 17 nt, Listeria monocytogenes EGD-e
aaaugcuaauuuauuua

SEQ ID NO: 2804937 - RNA, 17 nt, Listeria monocytogenes EGD-e
aaaugcucaucaagaaa

SEQ ID NO: 2804938 - RNA, 19 nt, Listeria monocytogenes EGD-e
aaaugcuucgacguuuaau

SEQ ID NO: 2804939 - RNA, 12 nt, Listeria monocytogenes EGD-e
aaaugcuuuaac

SEQ ID NO: 2804940 - RNA, 22 nt, Listeria monocytogenes EGD-e
aaaugcuuuaacugguuccauu

SEQ ID NO: 2804941 - RNA, 16 nt, Listeria monocytogenes EGD-e
aaauggauaaaaaaau

SEQ ID NO: 2804942 - RNA, 17 nt, Listeria monocytogenes EGD-e
aaauggauugcagguaa

SEQ ID NO: 2804943 - RNA, 17 nt, Listeria monocytogenes EGD-e
aaauggcguuuuaaauc

SEQ ID NO: 2804944 - RNA, 16 nt, Listeria monocytogenes EGD-e
aaauggcugaugacua

SEQ ID NO: 2804945 - RNA, 17 nt, Listeria monocytogenes EGD-e
aaauggcugaugacuaa

SEQ ID NO: 2804946 - RNA, 22 nt, Listeria monocytogenes EGD-e
aaaugggcaguuacuuuaccuu

SEQ ID NO: 2804947 - RNA, 22 nt, Listeria monocytogenes EGD-e
aaaugguacguugguuguucuu

SEQ ID NO: 2804948 - RNA, 20 nt, Listeria monocytogenes EGD-e
aaaugguucacuuucuugcu

SEQ ID NO: 2804949 - RNA, 19 nt, Listeria monocytogenes EGD-e
aaaugguuucuuaaauacg

SEQ ID NO: 2804950 - RNA, 19 nt, Listeria monocytogenes EGD-e
aaauuaaauuuuuuugaaa

SEQ ID NO: 2804951 - RNA, 22 nt, Listeria monocytogenes EGD-e
aaauuaaauuuuuuugaaaaaa

SEQ ID NO: 2804952 - RNA, 21 nt, Listeria monocytogenes EGD-e
aaauuaaugccaguauuuuga

SEQ ID NO: 2804953 - RNA, 17 nt, Listeria monocytogenes EGD-e
aaauuaccuaaugaaua

SEQ ID NO: 2804954 - RNA, 22 nt, Listeria monocytogenes EGD-e
aaauuaccuaaugaauaagcaa

SEQ ID NO: 2804955 - RNA, 17 nt, Listeria monocytogenes EGD-e
aaauuacguuucacuuu

SEQ ID NO: 2804956 - RNA, 18 nt, Listeria monocytogenes EGD-e
aaauuacguuucacuuua

SEQ ID NO: 2804957 - RNA, 18 nt, Listeria monocytogenes EGD-e
aaauuacugaauaaguaa

SEQ ID NO: 2804958 - RNA, 15 nt, Listeria monocytogenes EGD-e
aaauuauuagaauuc

SEQ ID NO: 2804959 - RNA, 14 nt, Listeria monocytogenes EGD-e
aaauucaauuuaua

SEQ ID NO: 2804960 - RNA, 15 nt, Listeria monocytogenes EGD-e
aaauucaauuuauau

SEQ ID NO: 2804961 - RNA, 15 nt, Listeria monocytogenes EGD-e
aaauucaguuuauaa

SEQ ID NO: 2804962 - RNA, 21 nt, Listeria monocytogenes EGD-e
aaauucaguuuauaaauaccu

SEQ ID NO: 2804963 - RNA, 22 nt, Listeria monocytogenes EGD-e
aaauucaguuuauaaauaccug

SEQ ID NO: 2804964 - RNA, 19 nt, Listeria monocytogenes EGD-e
aaauucccggucauuuuca

SEQ ID NO: 2804965 - RNA, 14 nt, Listeria monocytogenes EGD-e
aaauucuauuaaua

SEQ ID NO: 2804966 - RNA, 15 nt, Listeria monocytogenes EGD-e
aaauucuauuaauaa

SEQ ID NO: 2804967 - RNA, 16 nt, Listeria monocytogenes EGD-e
aaauucuauuaauaau

SEQ ID NO: 2804968 - RNA, 19 nt, Listeria monocytogenes EGD-e
aaauucuauuaauaaugau

SEQ ID NO: 2804969 - RNA, 20 nt, Listeria monocytogenes EGD-e
aaauucugaaaugauuuuua

SEQ ID NO: 2804970 - RNA, 21 nt, Listeria monocytogenes EGD-e
aaauugcaacaguuauuaaaa

SEQ ID NO: 2804971 - RNA, 19 nt, Listeria monocytogenes EGD-e
aaauuggauuauucaauuc

SEQ ID NO: 2804972 - RNA, 15 nt, Listeria monocytogenes EGD-e
aaauugugaaauuuu

SEQ ID NO: 2804973 - RNA, 12 nt, Listeria monocytogenes EGD-e
aaauuucaucgu

SEQ ID NO: 2804974 - RNA, 18 nt, Listeria monocytogenes EGD-e
aaauuugcccaccgauaa

SEQ ID NO: 2804975 - RNA, 16 nt, Listeria monocytogenes EGD-e
aacaaaagucacagcg

SEQ ID NO: 2804976 - RNA, 17 nt, Listeria monocytogenes EGD-e
aacaaacacaaaaugcu

SEQ ID NO: 2804977 - RNA, 13 nt, Listeria monocytogenes EGD-e
aacaaccaucaaa

SEQ ID NO: 2804978 - RNA, 16 nt, Listeria monocytogenes EGD-e
aacaaccaucaaacuc

SEQ ID NO: 2804979 - RNA, 14 nt, Listeria monocytogenes EGD-e
aacaacccauuugc

SEQ ID NO: 2804980 - RNA, 22 nt, Listeria monocytogenes EGD-e
aacaacugcuaacacgagagaa

SEQ ID NO: 2804981 - RNA, 21 nt, Listeria monocytogenes EGD-e
aacaagaggcuuauuccucca

SEQ ID NO: 2804982 - RNA, 23 nt, Listeria monocytogenes EGD-e
aacaaucaguccaucuuccgcuu

SEQ ID NO: 2804983 - RNA, 23 nt, Listeria monocytogenes EGD-e
aacaaucgcgucuacuuuuccga

SEQ ID NO: 2804984 - RNA, 15 nt, Listeria monocytogenes EGD-e
aacaaucugaacuga

SEQ ID NO: 2804985 - RNA, 16 nt, Listeria monocytogenes EGD-e
aacacgagagaaaugg

SEQ ID NO: 2804986 - RNA, 12 nt, Listeria monocytogenes EGD-e
aacacuucuaaa

SEQ ID NO: 2804987 - RNA, 15 nt, Listeria monocytogenes EGD-e
aacacuucuaaaaca

SEQ ID NO: 2804988 - RNA, 17 nt, Listeria monocytogenes EGD-e
aacacuucuaaaacagg

SEQ ID NO: 2804989 - RNA, 19 nt, Listeria monocytogenes EGD-e
aacagauaguuguuccauu

SEQ ID NO: 2804990 - RNA, 13 nt, Listeria monocytogenes EGD-e
aacaguuauuaaa

SEQ ID NO: 2804991 - RNA, 14 nt, Listeria monocytogenes EGD-e
aacaguuauuaaaa

SEQ ID NO: 2804992 - RNA, 15 nt, Listeria monocytogenes EGD-e
aacaguuauuaaaag

SEQ ID NO: 2804993 - RNA, 23 nt, Listeria monocytogenes EGD-e
aacauaaaaagcugccaccacuu

SEQ ID NO: 2804994 - RNA, 19 nt, Listeria monocytogenes EGD-e
aacauagcuacaauuaaaa

SEQ ID NO: 2804995 - RNA, 16 nt, Listeria monocytogenes EGD-e
aacaucacaccuugug

SEQ ID NO: 2804996 - RNA, 13 nt, Listeria monocytogenes EGD-e
aacaucagauuaa

SEQ ID NO: 2804997 - RNA, 17 nt, Listeria monocytogenes EGD-e
aacaucagauuaaauau

SEQ ID NO: 2804998 - RNA, 18 nt, Listeria monocytogenes EGD-e
aacaucagauuaaauaua

SEQ ID NO: 2804999 - RNA, 19 nt, Listeria monocytogenes EGD-e
aacaucagauuaaauauag

SEQ ID NO: 2805000 - RNA, 17 nt, Listeria monocytogenes EGD-e
aacaucucgucaaugaa

SEQ ID NO: 2805001 - RNA, 18 nt, Listeria monocytogenes EGD-e
aacaucucgucaaugaau

SEQ ID NO: 2805002 - RNA, 19 nt, Listeria monocytogenes EGD-e
aacaucugcuauuuuugaa

SEQ ID NO: 2805003 - RNA, 20 nt, Listeria monocytogenes EGD-e
aacaucuuuguauacuucaa

SEQ ID NO: 2805004 - RNA, 15 nt, Listeria monocytogenes EGD-e
aacaugauauauuua

SEQ ID NO: 2805005 - RNA, 18 nt, Listeria monocytogenes EGD-e
aacaugauauauuuauaa

SEQ ID NO: 2805006 - RNA, 15 nt, Listeria monocytogenes EGD-e
aacauuaaaccucuu

SEQ ID NO: 2805007 - RNA, 14 nt, Listeria monocytogenes EGD-e
aacauucaaaucac

SEQ ID NO: 2805008 - RNA, 19 nt, Listeria monocytogenes EGD-e
aacauucaaaucaccacaa

SEQ ID NO: 2805009 - RNA, 21 nt, Listeria monocytogenes EGD-e
aacauuucucccucauccuuu

SEQ ID NO: 2805010 - RNA, 23 nt, Listeria monocytogenes EGD-e
aacauuuucauucuuuccccuuu

SEQ ID NO: 2805011 - RNA, 13 nt, Listeria monocytogenes EGD-e
aaccaaauaugcu

SEQ ID NO: 2805012 - RNA, 23 nt, Listeria monocytogenes EGD-e
aaccaaauaugcuauacaacaca

SEQ ID NO: 2805013 - RNA, 17 nt, Listeria monocytogenes EGD-e
aaccaaauuucuguuau

SEQ ID NO: 2805014 - RNA, 15 nt, Listeria monocytogenes EGD-e
aaccaacaccaaauu

SEQ ID NO: 2805015 - RNA, 12 nt, Listeria monocytogenes EGD-e
aaccaagcaaua

SEQ ID NO: 2805016 - RNA, 17 nt, Listeria monocytogenes EGD-e
aaccaaucauggaaaca

SEQ ID NO: 2805017 - RNA, 20 nt, Listeria monocytogenes EGD-e
aaccaaucauggaaacaaag

SEQ ID NO: 2805018 - RNA, 14 nt, Listeria monocytogenes EGD-e
aaccacuuuugcau

SEQ ID NO: 2805019 - RNA, 16 nt, Listeria monocytogenes EGD-e
aaccagaaacgccaau

SEQ ID NO: 2805020 - RNA, 19 nt, Listeria monocytogenes EGD-e
aaccaguaaaacaagaggc

SEQ ID NO: 2805021 - RNA, 17 nt, Listeria monocytogenes EGD-e
aaccauuacgauaagca

SEQ ID NO: 2805022 - RNA, 20 nt, Listeria monocytogenes EGD-e
aaccauuauacaauuaauaa

SEQ ID NO: 2805023 - RNA, 15 nt, Listeria monocytogenes EGD-e
aaccauuauuuggaa

SEQ ID NO: 2805024 - RNA, 19 nt, Listeria monocytogenes EGD-e
aaccauucgaaagcaaaug

SEQ ID NO: 2805025 - RNA, 22 nt, Listeria monocytogenes EGD-e
aacccacccaauuguuuuacca

SEQ ID NO: 2805026 - RNA, 12 nt, Listeria monocytogenes EGD-e
aaccccaaaaug

SEQ ID NO: 2805027 - RNA, 13 nt, Listeria monocytogenes EGD-e
aacccuugauuuc

SEQ ID NO: 2805028 - RNA, 17 nt, Listeria monocytogenes EGD-e
aacccuuugaauugauu

SEQ ID NO: 2805029 - RNA, 20 nt, Listeria monocytogenes EGD-e
aaccgccaaaaagcaggaug

SEQ ID NO: 2805030 - RNA, 15 nt, Listeria monocytogenes EGD-e
aaccggaucaucacu

SEQ ID NO: 2805031 - RNA, 14 nt, Listeria monocytogenes EGD-e
aaccguauuuaaua

SEQ ID NO: 2805032 - RNA, 22 nt, Listeria monocytogenes EGD-e
aaccuauuugguacuugugaaa

SEQ ID NO: 2805033 - RNA, 18 nt, Listeria monocytogenes EGD-e
aaccucgcaaaaaauaau

SEQ ID NO: 2805034 - RNA, 14 nt, Listeria monocytogenes EGD-e
aaccuuaugacgag

SEQ ID NO: 2805035 - RNA, 16 nt, Listeria monocytogenes EGD-e
aaccuucaagcauauu

SEQ ID NO: 2805036 - RNA, 16 nt, Listeria monocytogenes EGD-e
aaccuucaucguuuaa

SEQ ID NO: 2805037 - RNA, 17 nt, Listeria monocytogenes EGD-e
aacgaacggggcaucau

SEQ ID NO: 2805038 - RNA, 23 nt, Listeria monocytogenes EGD-e
aacgaauccuuggaaaaaugauu

SEQ ID NO: 2805039 - RNA, 20 nt, Listeria monocytogenes EGD-e
aacgacaaaugguucacuuu

SEQ ID NO: 2805040 - RNA, 14 nt, Listeria monocytogenes EGD-e
aacgauaaagcggu

SEQ ID NO: 2805041 - RNA, 12 nt, Listeria monocytogenes EGD-e
aacgaucagcca

SEQ ID NO: 2805042 - RNA, 23 nt, Listeria monocytogenes EGD-e
aacgcagguucaccaaaugcuuc

SEQ ID NO: 2805043 - RNA, 17 nt, Listeria monocytogenes EGD-e
aacgcuaucaaucauca

SEQ ID NO: 2805044 - RNA, 20 nt, Listeria monocytogenes EGD-e
aacgcuuuuucaaaaucaag

SEQ ID NO: 2805045 - RNA, 21 nt, Listeria monocytogenes EGD-e
aacggaaacuaucaauaaauc

SEQ ID NO: 2805046 - RNA, 21 nt, Listeria monocytogenes EGD-e
aacggaucuuucucauaagcu

SEQ ID NO: 2805047 - RNA, 14 nt, Listeria monocytogenes EGD-e
aacggguuucccug

SEQ ID NO: 2805048 - RNA, 18 nt, Listeria monocytogenes EGD-e
aacgguuuucaugaagca

SEQ ID NO: 2805049 - RNA, 19 nt, Listeria monocytogenes EGD-e
aacguuccgauacaacaaa

SEQ ID NO: 2805050 - RNA, 21 nt, Listeria monocytogenes EGD-e
aacuaaaacgacagauaaaua

SEQ ID NO: 2805051 - RNA, 12 nt, Listeria monocytogenes EGD-e
aacuaacaaaau

SEQ ID NO: 2805052 - RNA, 13 nt, Listeria monocytogenes EGD-e
aacuacauacuua

SEQ ID NO: 2805053 - RNA, 15 nt, Listeria monocytogenes EGD-e
aacuacuucaacuaa

SEQ ID NO: 2805054 - RNA, 22 nt, Listeria monocytogenes EGD-e
aacuagauagaguaagauauaa

SEQ ID NO: 2805055 - RNA, 18 nt, Listeria monocytogenes EGD-e
aacuagauuuaauaaauu

SEQ ID NO: 2805056 - RNA, 19 nt, Listeria monocytogenes EGD-e
aacuagauuuaauaaauua

SEQ ID NO: 2805057 - RNA, 19 nt, Listeria monocytogenes EGD-e
aacuaguaauuuaauugcu

SEQ ID NO: 2805058 - RNA, 11 nt, Listeria monocytogenes EGD-e
aacuauuuuuu

SEQ ID NO: 2805059 - RNA, 20 nt, Listeria monocytogenes EGD-e
aacucaaaguaacuuuauca

SEQ ID NO: 2805060 - RNA, 18 nt, Listeria monocytogenes EGD-e
aacuccccagugaaaaua

SEQ ID NO: 2805061 - RNA, 18 nt, Listeria monocytogenes EGD-e
aacucucuuucugccuac

SEQ ID NO: 2805062 - RNA, 21 nt, Listeria monocytogenes EGD-e
aacucuuucugaaaauguugc

SEQ ID NO: 2805063 - RNA, 16 nt, Listeria monocytogenes EGD-e
aacugauuuuuuggug

SEQ ID NO: 2805064 - RNA, 18 nt, Listeria monocytogenes EGD-e
aacugguuccauuaaauc

SEQ ID NO: 2805065 - RNA, 19 nt, Listeria monocytogenes EGD-e
aacuguuguucuugccaaa

SEQ ID NO: 2805066 - RNA, 20 nt, Listeria monocytogenes EGD-e
aacuuacucgaguauaugcu

SEQ ID NO: 2805067 - RNA, 13 nt, Listeria monocytogenes EGD-e
aacuuaucucuuc

SEQ ID NO: 2805068 - RNA, 13 nt, Listeria monocytogenes EGD-e
aacuucaaaauua

SEQ ID NO: 2805069 - RNA, 16 nt, Listeria monocytogenes EGD-e
aacuucaaaauuacua

SEQ ID NO: 2805070 - RNA, 14 nt, Listeria monocytogenes EGD-e
aacuucaccacuuc

SEQ ID NO: 2805071 - RNA, 16 nt, Listeria monocytogenes EGD-e
aacuucacuaacaaaa

SEQ ID NO: 2805072 - RNA, 21 nt, Listeria monocytogenes EGD-e
aacuucacuaacaaaauaaua

SEQ ID NO: 2805073 - RNA, 15 nt, Listeria monocytogenes EGD-e
aacuugcaucuucug

SEQ ID NO: 2805074 - RNA, 19 nt, Listeria monocytogenes EGD-e
aacuugcaucuucuguuaa

SEQ ID NO: 2805075 - RNA, 11 nt, Listeria monocytogenes EGD-e
aacuuucacaa

SEQ ID NO: 2805076 - RNA, 18 nt, Listeria monocytogenes EGD-e
aacuuuuccuucuacauu

SEQ ID NO: 2805077 - RNA, 17 nt, Listeria monocytogenes EGD-e
aacuuuuucucaaaaau

SEQ ID NO: 2805078 - RNA, 21 nt, Listeria monocytogenes EGD-e
aagaaaaaaaguuauauuuaa

SEQ ID NO: 2805079 - RNA, 20 nt, Listeria monocytogenes EGD-e
aagaaaaaccgagaaaucuc

SEQ ID NO: 2805080 - RNA, 20 nt, Listeria monocytogenes EGD-e
aagaaauguugcgaaacaac

SEQ ID NO: 2805081 - RNA, 21 nt, Listeria monocytogenes EGD-e
aagaaauuaaauuuuuuugaa

SEQ ID NO: 2805082 - RNA, 17 nt, Listeria monocytogenes EGD-e
aagaacagcaauuuguu

SEQ ID NO: 2805083 - RNA, 12 nt, Listeria monocytogenes EGD-e
aagaaccuucaa

SEQ ID NO: 2805084 - RNA, 16 nt, Listeria monocytogenes EGD-e
aagaacgaauguuaaa

SEQ ID NO: 2805085 - RNA, 22 nt, Listeria monocytogenes EGD-e
aagaacugcggcuaauaacauu

SEQ ID NO: 2805086 - RNA, 12 nt, Listeria monocytogenes EGD-e
aagaagaaaaag

SEQ ID NO: 2805087 - RNA, 14 nt, Listeria monocytogenes EGD-e
aagaagaaaaagug

SEQ ID NO: 2805088 - RNA, 15 nt, Listeria monocytogenes EGD-e
aagaagacgaaaagc

SEQ ID NO: 2805089 - RNA, 16 nt, Listeria monocytogenes EGD-e
aagaagagcugcaaca

SEQ ID NO: 2805090 - RNA, 16 nt, Listeria monocytogenes EGD-e
aagaagauauuuugcu

SEQ ID NO: 2805091 - RNA, 18 nt, Listeria monocytogenes EGD-e
aagaagggcuuuuuuccu

SEQ ID NO: 2805092 - RNA, 23 nt, Listeria monocytogenes EGD-e
aagaagucuuuuuguaaaggaua

SEQ ID NO: 2805093 - RNA, 14 nt, Listeria monocytogenes EGD-e
aagaauaaugacgc

SEQ ID NO: 2805094 - RNA, 16 nt, Listeria monocytogenes EGD-e
aagaauaguacauagu

SEQ ID NO: 2805095 - RNA, 16 nt, Listeria monocytogenes EGD-e
aagacaccaauuucug

SEQ ID NO: 2805096 - RNA, 16 nt, Listeria monocytogenes EGD-e
aagaccaccaagaaua

SEQ ID NO: 2805097 - RNA, 14 nt, Listeria monocytogenes EGD-e
aagaccuucuuuua

SEQ ID NO: 2805098 - RNA, 12 nt, Listeria monocytogenes EGD-e
aagagauaaguu

SEQ ID NO: 2805099 - RNA, 17 nt, Listeria monocytogenes EGD-e
aagagcaccaauaaaac

SEQ ID NO: 2805100 - RNA, 16 nt, Listeria monocytogenes EGD-e
aagagcggaagauguu

SEQ ID NO: 2805101 - RNA, 19 nt, Listeria monocytogenes EGD-e
aagaggcuuauuccuccaa

SEQ ID NO: 2805102 - RNA, 14 nt, Listeria monocytogenes EGD-e
aagauaaacuaauu

SEQ ID NO: 2805103 - RNA, 20 nt, Listeria monocytogenes EGD-e
aagaucccaaacucccuuuu

SEQ ID NO: 2805104 - RNA, 14 nt, Listeria monocytogenes EGD-e
aagauuaaaaauag

SEQ ID NO: 2805105 - RNA, 20 nt, Listeria monocytogenes EGD-e
aagauuauggaaaaauccac

SEQ ID NO: 2805106 - RNA, 15 nt, Listeria monocytogenes EGD-e
aagauuuugcucagc

SEQ ID NO: 2805107 - RNA, 17 nt, Listeria monocytogenes EGD-e
aagauuuuguacauaaa

SEQ ID NO: 2805108 - RNA, 22 nt, Listeria monocytogenes EGD-e
aagauuuuguacauaaaagcau

SEQ ID NO: 2805109 - RNA, 16 nt, Listeria monocytogenes EGD-e
aagauuuuugcucagu

SEQ ID NO: 2805110 - RNA, 14 nt, Listeria monocytogenes EGD-e
aagcaaacaaagua

SEQ ID NO: 2805111 - RNA, 19 nt, Listeria monocytogenes EGD-e
aagcaacgguaaacaaccc

SEQ ID NO: 2805112 - RNA, 13 nt, Listeria monocytogenes EGD-e
aagcaacucuuuu

SEQ ID NO: 2805113 - RNA, 15 nt, Listeria monocytogenes EGD-e
aagcaauaacaucuu

SEQ ID NO: 2805114 - RNA, 15 nt, Listeria monocytogenes EGD-e
aagcacauguccauu

SEQ ID NO: 2805115 - RNA, 18 nt, Listeria monocytogenes EGD-e
aagcaugaauuuuuauac

SEQ ID NO: 2805116 - RNA, 22 nt, Listeria monocytogenes EGD-e
aagccaaaucgcggauaauaau

SEQ ID NO: 2805117 - RNA, 22 nt, Listeria monocytogenes EGD-e
aagcccagcacaaguuccaaaa

SEQ ID NO: 2805118 - RNA, 15 nt, Listeria monocytogenes EGD-e
aagcgacauuaaaua

SEQ ID NO: 2805119 - RNA, 17 nt, Listeria monocytogenes EGD-e
aagcuaagcauuauaaa

SEQ ID NO: 2805120 - RNA, 18 nt, Listeria monocytogenes EGD-e
aagcuaagcauuauaaaa

SEQ ID NO: 2805121 - RNA, 21 nt, Listeria monocytogenes EGD-e
aagcuaagcauuauaaaaagu

SEQ ID NO: 2805122 - RNA, 22 nt, Listeria monocytogenes EGD-e
aagcuacuuuucgaaucccuuu

SEQ ID NO: 2805123 - RNA, 12 nt, Listeria monocytogenes EGD-e
aagcuauauaau

SEQ ID NO: 2805124 - RNA, 22 nt, Listeria monocytogenes EGD-e
aagcucccaauuuaauuuggga

SEQ ID NO: 2805125 - RNA, 16 nt, Listeria monocytogenes EGD-e
aagcugaugcauggaa

SEQ ID NO: 2805126 - RNA, 23 nt, Listeria monocytogenes EGD-e
aagcuguuuucaacaaaacaaac

SEQ ID NO: 2805127 - RNA, 18 nt, Listeria monocytogenes EGD-e
aaggaaacgaauaaaauc

SEQ ID NO: 2805128 - RNA, 17 nt, Listeria monocytogenes EGD-e
aaggagcagaaaaacug

SEQ ID NO: 2805129 - RNA, 23 nt, Listeria monocytogenes EGD-e
aaggagcggcucagauccuucaa

SEQ ID NO: 2805130 - RNA, 14 nt, Listeria monocytogenes EGD-e
aaggauuugucacu

SEQ ID NO: 2805131 - RNA, 18 nt, Listeria monocytogenes EGD-e
aaggauuugucacuugga

SEQ ID NO: 2805132 - RNA, 15 nt, Listeria monocytogenes EGD-e
aaggcaacaaagaag

SEQ ID NO: 2805133 - RNA, 19 nt, Listeria monocytogenes EGD-e
aaggcaacaaagaagaaaa

SEQ ID NO: 2805134 - RNA, 14 nt, Listeria monocytogenes EGD-e
aaggcuuuuuaugc

SEQ ID NO: 2805135 - RNA, 20 nt, Listeria monocytogenes EGD-e
aagggaagcuuuugcuacac

SEQ ID NO: 2805136 - RNA, 19 nt, Listeria monocytogenes EGD-e
aagggcuuuuuuguaauag

SEQ ID NO: 2805137 - RNA, 16 nt, Listeria monocytogenes EGD-e
aaguaacauagcuaca

SEQ ID NO: 2805138 - RNA, 18 nt, Listeria monocytogenes EGD-e
aaguaacuaaaaaucauu

SEQ ID NO: 2805139 - RNA, 13 nt, Listeria monocytogenes EGD-e
aaguaacuuuauc

SEQ ID NO: 2805140 - RNA, 19 nt, Listeria monocytogenes EGD-e
aaguaaugguguaaucacu

SEQ ID NO: 2805141 - RNA, 22 nt, Listeria monocytogenes EGD-e
aaguacaaccguugucauccca

SEQ ID NO: 2805142 - RNA, 13 nt, Listeria monocytogenes EGD-e
aaguacaauuuuc

SEQ ID NO: 2805143 - RNA, 22 nt, Listeria monocytogenes EGD-e
aaguacaauuuucauuuaacau

SEQ ID NO: 2805144 - RNA, 17 nt, Listeria monocytogenes EGD-e
aaguacuuugaauugcu

SEQ ID NO: 2805145 - RNA, 21 nt, Listeria monocytogenes EGD-e
aaguagcaggacaugcuaaau

SEQ ID NO: 2805146 - RNA, 13 nt, Listeria monocytogenes EGD-e
aaguagcauuuuc

SEQ ID NO: 2805147 - RNA, 16 nt, Listeria monocytogenes EGD-e
aaguauucagcaggca

SEQ ID NO: 2805148 - RNA, 18 nt, Listeria monocytogenes EGD-e
aagucaaaacguucgagc

SEQ ID NO: 2805149 - RNA, 13 nt, Listeria monocytogenes EGD-e
aagucaugacagc

SEQ ID NO: 2805150 - RNA, 15 nt, Listeria monocytogenes EGD-e
aaguccgucaagccc

SEQ ID NO: 2805151 - RNA, 23 nt, Listeria monocytogenes EGD-e
aagucguuauguaauucuaaaua

SEQ ID NO: 2805152 - RNA, 17 nt, Listeria monocytogenes EGD-e
aagucuauuucagcuaa

SEQ ID NO: 2805153 - RNA, 21 nt, Listeria monocytogenes EGD-e
aagucugcuuuuucaaguaaa

SEQ ID NO: 2805154 - RNA, 21 nt, Listeria monocytogenes EGD-e
aagucuuuuuguaaaggauaa

SEQ ID NO: 2805155 - RNA, 23 nt, Listeria monocytogenes EGD-e
aagugaauugauggauuccuaaa

SEQ ID NO: 2805156 - RNA, 15 nt, Listeria monocytogenes EGD-e
aagugaccuuugaaa

SEQ ID NO: 2805157 - RNA, 17 nt, Listeria monocytogenes EGD-e
aagugaccuuugaaaac

SEQ ID NO: 2805158 - RNA, 18 nt, Listeria monocytogenes EGD-e
aagugaccuuugaaaacu

SEQ ID NO: 2805159 - RNA, 15 nt, Listeria monocytogenes EGD-e
aagugcguaagauuu

SEQ ID NO: 2805160 - RNA, 18 nt, Listeria monocytogenes EGD-e
aagugcugcgccaacaaa

SEQ ID NO: 2805161 - RNA, 21 nt, Listeria monocytogenes EGD-e
aaguggcgcaagugcuaaaau

SEQ ID NO: 2805162 - RNA, 17 nt, Listeria monocytogenes EGD-e
aaguguaaaaguuaaga

SEQ ID NO: 2805163 - RNA, 17 nt, Listeria monocytogenes EGD-e
aagugugauuguuccag

SEQ ID NO: 2805164 - RNA, 21 nt, Listeria monocytogenes EGD-e
aaguucaugacgcgcaucuuc

SEQ ID NO: 2805165 - RNA, 22 nt, Listeria monocytogenes EGD-e
aaguuuacaauggaaugacaaa

SEQ ID NO: 2805166 - RNA, 20 nt, Listeria monocytogenes EGD-e
aaguuugggcauuacgaaag

SEQ ID NO: 2805167 - RNA, 14 nt, Listeria monocytogenes EGD-e
aaguuuuuugguua

SEQ ID NO: 2805168 - RNA, 14 nt, Listeria monocytogenes EGD-e
aauaaaaaaauaca

SEQ ID NO: 2805169 - RNA, 23 nt, Listeria monocytogenes EGD-e
aauaaaaucauuccacuuuuaaa

SEQ ID NO: 2805170 - RNA, 21 nt, Listeria monocytogenes EGD-e
aauaaaauggauaaaaaaaua

SEQ ID NO: 2805171 - RNA, 18 nt, Listeria monocytogenes EGD-e
aauaaaguuguaagauaa

SEQ ID NO: 2805172 - RNA, 20 nt, Listeria monocytogenes EGD-e
aauaaauaggcccauuaaaa

SEQ ID NO: 2805173 - RNA, 16 nt, Listeria monocytogenes EGD-e
aauaaauauuuugcag

SEQ ID NO: 2805174 - RNA, 13 nt, Listeria monocytogenes EGD-e
aauaacaagaaua

SEQ ID NO: 2805175 - RNA, 12 nt, Listeria monocytogenes EGD-e
aauaacaaucca

SEQ ID NO: 2805176 - RNA, 12 nt, Listeria monocytogenes EGD-e
aauaacaucuuu

SEQ ID NO: 2805177 - RNA, 16 nt, Listeria monocytogenes EGD-e
aauaacaucuuuaaaa

SEQ ID NO: 2805178 - RNA, 19 nt, Listeria monocytogenes EGD-e
aauaacauuaaaccucuuu

SEQ ID NO: 2805179 - RNA, 14 nt, Listeria monocytogenes EGD-e
aauaacauuuucuc

SEQ ID NO: 2805180 - RNA, 22 nt, Listeria monocytogenes EGD-e
aauaaccaaucauggaaacaaa

SEQ ID NO: 2805181 - RNA, 22 nt, Listeria monocytogenes EGD-e
aauaacgaacggggcaucauuu

SEQ ID NO: 2805182 - RNA, 21 nt, Listeria monocytogenes EGD-e
aauaacggaaacuaucaauaa

SEQ ID NO: 2805183 - RNA, 20 nt, Listeria monocytogenes EGD-e
aauaacguugcauuaaaaag

SEQ ID NO: 2805184 - RNA, 16 nt, Listeria monocytogenes EGD-e
aauaaguauucaaauu

SEQ ID NO: 2805185 - RNA, 13 nt, Listeria monocytogenes EGD-e
aauaagucaauga

SEQ ID NO: 2805186 - RNA, 22 nt, Listeria monocytogenes EGD-e
aauaaguccaaagagccauaaa

SEQ ID NO: 2805187 - RNA, 17 nt, Listeria monocytogenes EGD-e
aauaauaauaaguauag

SEQ ID NO: 2805188 - RNA, 21 nt, Listeria monocytogenes EGD-e
aauaauaccaggaucaaaaug

SEQ ID NO: 2805189 - RNA, 12 nt, Listeria monocytogenes EGD-e
aauaauaucuuc

SEQ ID NO: 2805190 - RNA, 17 nt, Listeria monocytogenes EGD-e
aauaaugugguucguua

SEQ ID NO: 2805191 - RNA, 16 nt, Listeria monocytogenes EGD-e
aauaauuagaggauuu

SEQ ID NO: 2805192 - RNA, 21 nt, Listeria monocytogenes EGD-e
aauacaggccacgugcaccug

SEQ ID NO: 2805193 - RNA, 19 nt, Listeria monocytogenes EGD-e
aauacauaacuucgguugu

SEQ ID NO: 2805194 - RNA, 17 nt, Listeria monocytogenes EGD-e
aauacaugaccgccaau

SEQ ID NO: 2805195 - RNA, 22 nt, Listeria monocytogenes EGD-e
aauacauuuuagcuuauuaauu

SEQ ID NO: 2805196 - RNA, 19 nt, Listeria monocytogenes EGD-e
aauaccauguuuauuuaau

SEQ ID NO: 2805197 - RNA, 15 nt, Listeria monocytogenes EGD-e
aauaccgaaugcaau

SEQ ID NO: 2805198 - RNA, 15 nt, Listeria monocytogenes EGD-e
aauacgacaauacca

SEQ ID NO: 2805199 - RNA, 18 nt, Listeria monocytogenes EGD-e
aauacgacaccaauuuua

SEQ ID NO: 2805200 - RNA, 14 nt, Listeria monocytogenes EGD-e
aauacgcauuucac

SEQ ID NO: 2805201 - RNA, 23 nt, Listeria monocytogenes EGD-e
aauacgcgcuggauaaagaccua

SEQ ID NO: 2805202 - RNA, 14 nt, Listeria monocytogenes EGD-e
aauacgugaaaauc

SEQ ID NO: 2805203 - RNA, 21 nt, Listeria monocytogenes EGD-e
aauacuaacgcuuuuucagca

SEQ ID NO: 2805204 - RNA, 18 nt, Listeria monocytogenes EGD-e
aauacuguuuuauauuuu

SEQ ID NO: 2805205 - RNA, 20 nt, Listeria monocytogenes EGD-e
aauacuguuuuugauuuaau

SEQ ID NO: 2805206 - RNA, 22 nt, Listeria monocytogenes EGD-e
aauagagcuuuuaaauauaccg

SEQ ID NO: 2805207 - RNA, 19 nt, Listeria monocytogenes EGD-e
aauagauauucucuuauga

SEQ ID NO: 2805208 - RNA, 18 nt, Listeria monocytogenes EGD-e
aauagcacagcuaccaca

SEQ ID NO: 2805209 - RNA, 15 nt, Listeria monocytogenes EGD-e
aauagccaagauuaa

SEQ ID NO: 2805210 - RNA, 20 nt, Listeria monocytogenes EGD-e
aauagcuuugucuuaaauga

SEQ ID NO: 2805211 - RNA, 16 nt, Listeria monocytogenes EGD-e
aauaggauuaaaauaa

SEQ ID NO: 2805212 - RNA, 14 nt, Listeria monocytogenes EGD-e
aauaggauuuuacu

SEQ ID NO: 2805213 - RNA, 21 nt, Listeria monocytogenes EGD-e
aauaggcccauuaaaaagcuu

SEQ ID NO: 2805214 - RNA, 17 nt, Listeria monocytogenes EGD-e
aauaguaguuauuucuu

SEQ ID NO: 2805215 - RNA, 13 nt, Listeria monocytogenes EGD-e
aauaguccccagu

SEQ ID NO: 2805216 - RNA, 20 nt, Listeria monocytogenes EGD-e
aauaguuuugucaaaccauu

SEQ ID NO: 2805217 - RNA, 18 nt, Listeria monocytogenes EGD-e
aauauaaugauucaaagc

SEQ ID NO: 2805218 - RNA, 17 nt, Listeria monocytogenes EGD-e
aauauacacaaaguaaa

SEQ ID NO: 2805219 - RNA, 21 nt, Listeria monocytogenes EGD-e
aauauaccgaccaucaguagu

SEQ ID NO: 2805220 - RNA, 15 nt, Listeria monocytogenes EGD-e
aauauagcuucaaac

SEQ ID NO: 2805221 - RNA, 22 nt, Listeria monocytogenes EGD-e
aauauccauaaagcuaagcauu

SEQ ID NO: 2805222 - RNA, 12 nt, Listeria monocytogenes EGD-e
aauauccuuguu

SEQ ID NO: 2805223 - RNA, 13 nt, Listeria monocytogenes EGD-e
aauaucuucuaua

SEQ ID NO: 2805224 - RNA, 20 nt, Listeria monocytogenes EGD-e
aauauguuuaaucuaaaucu

SEQ ID NO: 2805225 - RNA, 18 nt, Listeria monocytogenes EGD-e
aauauuagaaaaucauuu

SEQ ID NO: 2805226 - RNA, 13 nt, Listeria monocytogenes EGD-e
aauauuauaucca

SEQ ID NO: 2805227 - RNA, 16 nt, Listeria monocytogenes EGD-e
aaucaagauuuuguac

SEQ ID NO: 2805228 - RNA, 19 nt, Listeria monocytogenes EGD-e
aaucaauuuacguuguucu

SEQ ID NO: 2805229 - RNA, 21 nt, Listeria monocytogenes EGD-e
aaucacuucuuaagaauuccg

SEQ ID NO: 2805230 - RNA, 22 nt, Listeria monocytogenes EGD-e
aaucagagaaaccgcuaacgcc

SEQ ID NO: 2805231 - RNA, 21 nt, Listeria monocytogenes EGD-e
aaucagagagccuggauuuuc

SEQ ID NO: 2805232 - RNA, 21 nt, Listeria monocytogenes EGD-e
aaucagcaucuggaucaggau

SEQ ID NO: 2805233 - RNA, 22 nt, Listeria monocytogenes EGD-e
aaucagcaucuggaucaggaua

SEQ ID NO: 2805234 - RNA, 22 nt, Listeria monocytogenes EGD-e
aaucaguucaacuacuucaacu

SEQ ID NO: 2805235 - RNA, 14 nt, Listeria monocytogenes EGD-e
aaucaugccuucaa

SEQ ID NO: 2805236 - RNA, 20 nt, Listeria monocytogenes EGD-e
aaucaugccuucaaacacuu

SEQ ID NO: 2805237 - RNA, 22 nt, Listeria monocytogenes EGD-e
aaucaugccuucaaacacuucu

SEQ ID NO: 2805238 - RNA, 20 nt, Listeria monocytogenes EGD-e
aaucauggaaacaaaguauu

SEQ ID NO: 2805239 - RNA, 18 nt, Listeria monocytogenes EGD-e
aaucauuaauauaaagau

SEQ ID NO: 2805240 - RNA, 19 nt, Listeria monocytogenes EGD-e
aaucauugggaauucguua

SEQ ID NO: 2805241 - RNA, 15 nt, Listeria monocytogenes EGD-e
aaucauuuauuuucc

SEQ ID NO: 2805242 - RNA, 17 nt, Listeria monocytogenes EGD-e
aaucauuuauuuucccu

SEQ ID NO: 2805243 - RNA, 21 nt, Listeria monocytogenes EGD-e
aaucauuucgauaagcacaaa

SEQ ID NO: 2805244 - RNA, 14 nt, Listeria monocytogenes EGD-e
aauccaauaauaug

SEQ ID NO: 2805245 - RNA, 18 nt, Listeria monocytogenes EGD-e
aauccagcgucuaaaaau

SEQ ID NO: 2805246 - RNA, 18 nt, Listeria monocytogenes EGD-e
aauccauuucauucuuuu

SEQ ID NO: 2805247 - RNA, 14 nt, Listeria monocytogenes EGD-e
aaucccacaaaaaa

SEQ ID NO: 2805248 - RNA, 14 nt, Listeria monocytogenes EGD-e
aaucccagcuuuuc

SEQ ID NO: 2805249 - RNA, 16 nt, Listeria monocytogenes EGD-e
aaucccuauaaaaaca

SEQ ID NO: 2805250 - RNA, 13 nt, Listeria monocytogenes EGD-e
aauccgaauucca

SEQ ID NO: 2805251 - RNA, 15 nt, Listeria monocytogenes EGD-e
aauccgcuucguuuc

SEQ ID NO: 2805252 - RNA, 15 nt, Listeria monocytogenes EGD-e
aauccuuggaaaaau

SEQ ID NO: 2805253 - RNA, 21 nt, Listeria monocytogenes EGD-e
aaucgagucaccgaauccaaa

SEQ ID NO: 2805254 - RNA, 12 nt, Listeria monocytogenes EGD-e
aaucgcagcaga

SEQ ID NO: 2805255 - RNA, 19 nt, Listeria monocytogenes EGD-e
aaucgcagggcagaaaaca

SEQ ID NO: 2805256 - RNA, 22 nt, Listeria monocytogenes EGD-e
aaucgccaguugcugaauauca

SEQ ID NO: 2805257 - RNA, 18 nt, Listeria monocytogenes EGD-e
aaucgcgucuacuuuucc

SEQ ID NO: 2805258 - RNA, 15 nt, Listeria monocytogenes EGD-e
aaucuaaaucuagua

SEQ ID NO: 2805259 - RNA, 13 nt, Listeria monocytogenes EGD-e
aaucuaguacgaa

SEQ ID NO: 2805260 - RNA, 19 nt, Listeria monocytogenes EGD-e
aaucuagucguuucaacuc

SEQ ID NO: 2805261 - RNA, 17 nt, Listeria monocytogenes EGD-e
aaucucacaauuuaagu

SEQ ID NO: 2805262 - RNA, 15 nt, Listeria monocytogenes EGD-e
aaucucaucaccagc

SEQ ID NO: 2805263 - RNA, 16 nt, Listeria monocytogenes EGD-e
aaucucaucaccagcu

SEQ ID NO: 2805264 - RNA, 17 nt, Listeria monocytogenes EGD-e
aaucugauuaaaaguuu

SEQ ID NO: 2805265 - RNA, 16 nt, Listeria monocytogenes EGD-e
aaucuggauaaaaaua

SEQ ID NO: 2805266 - RNA, 17 nt, Listeria monocytogenes EGD-e
aaucuggauaaaaauaa

SEQ ID NO: 2805267 - RNA, 16 nt, Listeria monocytogenes EGD-e
aaucuguaaaaauaaa

SEQ ID NO: 2805268 - RNA, 15 nt, Listeria monocytogenes EGD-e
aaucuucuugcuuca

SEQ ID NO: 2805269 - RNA, 15 nt, Listeria monocytogenes EGD-e
aaucuuucacacgau

SEQ ID NO: 2805270 - RNA, 20 nt, Listeria monocytogenes EGD-e
aaucuuucacacgauaccaa

SEQ ID NO: 2805271 - RNA, 22 nt, Listeria monocytogenes EGD-e
aaucuuucacacgauaccaaag

SEQ ID NO: 2805272 - RNA, 14 nt, Listeria monocytogenes EGD-e
aaugaaaagaaaaa

SEQ ID NO: 2805273 - RNA, 17 nt, Listeria monocytogenes EGD-e
aaugaccuaguuaaucu

SEQ ID NO: 2805274 - RNA, 17 nt, Listeria monocytogenes EGD-e
aaugagcccaaaaauaa

SEQ ID NO: 2805275 - RNA, 23 nt, Listeria monocytogenes EGD-e
aaugagcuccuucaagaccaaga

SEQ ID NO: 2805276 - RNA, 15 nt, Listeria monocytogenes EGD-e
aaugauaucaucaau

SEQ ID NO: 2805277 - RNA, 13 nt, Listeria monocytogenes EGD-e
aaugauauuauga

SEQ ID NO: 2805278 - RNA, 20 nt, Listeria monocytogenes EGD-e
aaugauccgaaccaagcaca

SEQ ID NO: 2805279 - RNA, 16 nt, Listeria monocytogenes EGD-e
aaugauucaaagcuac

SEQ ID NO: 2805280 - RNA, 22 nt, Listeria monocytogenes EGD-e
aaugauuucuauaaaaaugaua

SEQ ID NO: 2805281 - RNA, 23 nt, Listeria monocytogenes EGD-e
aaugauuuuuaucuaaaucuuuu

SEQ ID NO: 2805282 - RNA, 15 nt, Listeria monocytogenes EGD-e
aaugcaauccauguu

SEQ ID NO: 2805283 - RNA, 18 nt, Listeria monocytogenes EGD-e
aaugcaucucccucuuuu

SEQ ID NO: 2805284 - RNA, 18 nt, Listeria monocytogenes EGD-e
aaugcgacauacuuuuua

SEQ ID NO: 2805285 - RNA, 15 nt, Listeria monocytogenes EGD-e
aaugcgguaacuaaa

SEQ ID NO: 2805286 - RNA, 19 nt, Listeria monocytogenes EGD-e
aaugcuaauuuauuuagaa

SEQ ID NO: 2805287 - RNA, 17 nt, Listeria monocytogenes EGD-e
aaugcucaccuucuuuu

SEQ ID NO: 2805288 - RNA, 20 nt, Listeria monocytogenes EGD-e
aaugcuucgacguuuaauuc

SEQ ID NO: 2805289 - RNA, 13 nt, Listeria monocytogenes EGD-e
aaugcuuuaacug

SEQ ID NO: 2805290 - RNA, 16 nt, Listeria monocytogenes EGD-e
aaugcuuuagcagcaa

SEQ ID NO: 2805291 - RNA, 18 nt, Listeria monocytogenes EGD-e
aaugcuuugguauuauuc

SEQ ID NO: 2805292 - RNA, 15 nt, Listeria monocytogenes EGD-e
aauggauaaaaaaau

SEQ ID NO: 2805293 - RNA, 16 nt, Listeria monocytogenes EGD-e
aauggcgagauguuuu

SEQ ID NO: 2805294 - RNA, 20 nt, Listeria monocytogenes EGD-e
aaugguugcauuuggagaaa

SEQ ID NO: 2805295 - RNA, 20 nt, Listeria monocytogenes EGD-e
aaugugaccuuaaauuauac

SEQ ID NO: 2805296 - RNA, 16 nt, Listeria monocytogenes EGD-e
aauguugcgaaacaac

SEQ ID NO: 2805297 - RNA, 17 nt, Listeria monocytogenes EGD-e
aauuaaaaguuguauag

SEQ ID NO: 2805298 - RNA, 13 nt, Listeria monocytogenes EGD-e
aauuaaaauaguu

SEQ ID NO: 2805299 - RNA, 18 nt, Listeria monocytogenes EGD-e
aauuaagaaguacaauaa

SEQ ID NO: 2805300 - RNA, 23 nt, Listeria monocytogenes EGD-e
aauuaauauccacccuagcuaua

SEQ ID NO: 2805301 - RNA, 17 nt, Listeria monocytogenes EGD-e
aauuaccuaaugaauaa

SEQ ID NO: 2805302 - RNA, 15 nt, Listeria monocytogenes EGD-e
aauuacuaaaaaggu

SEQ ID NO: 2805303 - RNA, 13 nt, Listeria monocytogenes EGD-e
aauuacuucacca

SEQ ID NO: 2805304 - RNA, 20 nt, Listeria monocytogenes EGD-e
aauuauacuauaaagaacua

SEQ ID NO: 2805305 - RNA, 18 nt, Listeria monocytogenes EGD-e
aauuaucccguuuguuaa

SEQ ID NO: 2805306 - RNA, 12 nt, Listeria monocytogenes EGD-e
aauuaucuagcu

SEQ ID NO: 2805307 - RNA, 14 nt, Listeria monocytogenes EGD-e
aauuauggcauaaa

SEQ ID NO: 2805308 - RNA, 19 nt, Listeria monocytogenes EGD-e
aauuauggcauaaaaaauc

SEQ ID NO: 2805309 - RNA, 21 nt, Listeria monocytogenes EGD-e
aauuauuucaagguucaucca

SEQ ID NO: 2805310 - RNA, 14 nt, Listeria monocytogenes EGD-e
aauuauuuuuguaa

SEQ ID NO: 2805311 - RNA, 12 nt, Listeria monocytogenes EGD-e
aauucaguuuau

SEQ ID NO: 2805312 - RNA, 21 nt, Listeria monocytogenes EGD-e
aauucaguuuauaaauaccug

SEQ ID NO: 2805313 - RNA, 19 nt, Listeria monocytogenes EGD-e
aauucccggucauuuucac

SEQ ID NO: 2805314 - RNA, 18 nt, Listeria monocytogenes EGD-e
aauuccugcuaaaaccau

SEQ ID NO: 2805315 - RNA, 15 nt, Listeria monocytogenes EGD-e
aauucggcuucaaaa

SEQ ID NO: 2805316 - RNA, 23 nt, Listeria monocytogenes EGD-e
aauucggcuucaaaacucucuuu

SEQ ID NO: 2805317 - RNA, 17 nt, Listeria monocytogenes EGD-e
aauucuaaauaaauauu

SEQ ID NO: 2805318 - RNA, 19 nt, Listeria monocytogenes EGD-e
aauucuguuaaaggagaaa

SEQ ID NO: 2805319 - RNA, 21 nt, Listeria monocytogenes EGD-e
aauucuguuaaaggagaaaaa

SEQ ID NO: 2805320 - RNA, 22 nt, Listeria monocytogenes EGD-e
aauucuguuaaaggagaaaaag

SEQ ID NO: 2805321 - RNA, 16 nt, Listeria monocytogenes EGD-e
aauucuucgcuuguuu

SEQ ID NO: 2805322 - RNA, 16 nt, Listeria monocytogenes EGD-e
aauugcaacuuuucuu

SEQ ID NO: 2805323 - RNA, 20 nt, Listeria monocytogenes EGD-e
aauugcucguucuuaguuaa

SEQ ID NO: 2805324 - RNA, 23 nt, Listeria monocytogenes EGD-e
aauugcucguucuuaguuaauuc

SEQ ID NO: 2805325 - RNA, 23 nt, Listeria monocytogenes EGD-e
aauugguuuuacaccauuuuguu

SEQ ID NO: 2805326 - RNA, 21 nt, Listeria monocytogenes EGD-e
aauuguaauuccgugaaauuc

SEQ ID NO: 2805327 - RNA, 15 nt, Listeria monocytogenes EGD-e
aauuguauaaguacu

SEQ ID NO: 2805328 - RNA, 14 nt, Listeria monocytogenes EGD-e
aauuuaauugugcu

SEQ ID NO: 2805329 - RNA, 23 nt, Listeria monocytogenes EGD-e
aauuuacguuguucuaacauuaa

SEQ ID NO: 2805330 - RNA, 15 nt, Listeria monocytogenes EGD-e
aauuucaaccaauuc

SEQ ID NO: 2805331 - RNA, 14 nt, Listeria monocytogenes EGD-e
aauuucaucguuuu

SEQ ID NO: 2805332 - RNA, 17 nt, Listeria monocytogenes EGD-e
aauuuccuuuacagaaa

SEQ ID NO: 2805333 - RNA, 20 nt, Listeria monocytogenes EGD-e
aauuucuuuugacaaaagga

SEQ ID NO: 2805334 - RNA, 13 nt, Listeria monocytogenes EGD-e
aauuugauugccu

SEQ ID NO: 2805335 - RNA, 20 nt, Listeria monocytogenes EGD-e
aauuugauugccugaaauaa

SEQ ID NO: 2805336 - RNA, 14 nt, Listeria monocytogenes EGD-e
aauuuggaaauaau

SEQ ID NO: 2805337 - RNA, 18 nt, Listeria monocytogenes EGD-e
aauuuguuuauccguuaa

SEQ ID NO: 2805338 - RNA, 11 nt, Listeria monocytogenes EGD-e
aauuuuaaauc

SEQ ID NO: 2805339 - RNA, 22 nt, Listeria monocytogenes EGD-e
aauuuuaaauccguugucuucu

SEQ ID NO: 2805340 - RNA, 13 nt, Listeria monocytogenes EGD-e
aauuuuaggcgua

SEQ ID NO: 2805341 - RNA, 19 nt, Listeria monocytogenes EGD-e
aauuuuaggcguaucuuuu

SEQ ID NO: 2805342 - RNA, 21 nt, Listeria monocytogenes EGD-e
aauuuuaggcguaucuuuucc

SEQ ID NO: 2805343 - RNA, 17 nt, Listeria monocytogenes EGD-e
aauuuucauuuaacauc

SEQ ID NO: 2805344 - RNA, 17 nt, Listeria monocytogenes EGD-e
aauuuucauuuguuucu

SEQ ID NO: 2805345 - RNA, 16 nt, Listeria monocytogenes EGD-e
aauuuuugcauccacu

SEQ ID NO: 2805346 - RNA, 15 nt, Listeria monocytogenes EGD-e
aauuuuuuugaaaaa

SEQ ID NO: 2805347 - RNA, 16 nt, Listeria monocytogenes EGD-e
aauuuuuuugaaaaaa

SEQ ID NO: 2805348 - RNA, 18 nt, Listeria monocytogenes EGD-e
aauuuuuuugaaaaaaca

SEQ ID NO: 2805349 - RNA, 19 nt, Listeria monocytogenes EGD-e
aauuuuuuugaaaaaacau

SEQ ID NO: 2805350 - RNA, 14 nt, Listeria monocytogenes EGD-e
acaaaaagaaaaaa

SEQ ID NO: 2805351 - RNA, 16 nt, Listeria monocytogenes EGD-e
acaaaagauagacaca

SEQ ID NO: 2805352 - RNA, 16 nt, Listeria monocytogenes EGD-e
acaaaaguggaaaugu

SEQ ID NO: 2805353 - RNA, 17 nt, Listeria monocytogenes EGD-e
acaaaaucuuuaaacaa

SEQ ID NO: 2805354 - RNA, 21 nt, Listeria monocytogenes EGD-e
acaaaaugcucaucaagaaau

SEQ ID NO: 2805355 - RNA, 13 nt, Listeria monocytogenes EGD-e
acaaacacaaaau

SEQ ID NO: 2805356 - RNA, 21 nt, Listeria monocytogenes EGD-e
acaaacuuuuccuucuacauu

SEQ ID NO: 2805357 - RNA, 12 nt, Listeria monocytogenes EGD-e
acaaagaagaaa

SEQ ID NO: 2805358 - RNA, 15 nt, Listeria monocytogenes EGD-e
acaaagaagaaaaag

SEQ ID NO: 2805359 - RNA, 12 nt, Listeria monocytogenes EGD-e
acaaagaagaag

SEQ ID NO: 2805360 - RNA, 15 nt, Listeria monocytogenes EGD-e
acaaagcuauuuuuu

SEQ ID NO: 2805361 - RNA, 23 nt, Listeria monocytogenes EGD-e
acaaaggacaacagguuuugugu

SEQ ID NO: 2805362 - RNA, 15 nt, Listeria monocytogenes EGD-e
acaaaguaacuaaaa

SEQ ID NO: 2805363 - RNA, 18 nt, Listeria monocytogenes EGD-e
acaaauucugaaaugauu

SEQ ID NO: 2805364 - RNA, 19 nt, Listeria monocytogenes EGD-e
acaaauuugccaaagagaa

SEQ ID NO: 2805365 - RNA, 20 nt, Listeria monocytogenes EGD-e
acaaauuugccaaagagaaa

SEQ ID NO: 2805366 - RNA, 14 nt, Listeria monocytogenes EGD-e
acaacaaaauaauc

SEQ ID NO: 2805367 - RNA, 13 nt, Listeria monocytogenes EGD-e
acaacaagcaaaa

SEQ ID NO: 2805368 - RNA, 16 nt, Listeria monocytogenes EGD-e
acaacagguuuugugu

SEQ ID NO: 2805369 - RNA, 12 nt, Listeria monocytogenes EGD-e
acaacaugcgua

SEQ ID NO: 2805370 - RNA, 12 nt, Listeria monocytogenes EGD-e
acaaccaucaaa

SEQ ID NO: 2805371 - RNA, 14 nt, Listeria monocytogenes EGD-e
acaaccaucaaacu

SEQ ID NO: 2805372 - RNA, 14 nt, Listeria monocytogenes EGD-e
acaaccauuuuguu

SEQ ID NO: 2805373 - RNA, 15 nt, Listeria monocytogenes EGD-e
acaacuaauuuuucg

SEQ ID NO: 2805374 - RNA, 23 nt, Listeria monocytogenes EGD-e
acaacuggcacagcgcuuaaaaa

SEQ ID NO: 2805375 - RNA, 12 nt, Listeria monocytogenes EGD-e
acaagcccagca

SEQ ID NO: 2805376 - RNA, 16 nt, Listeria monocytogenes EGD-e
acaaguaacucuucca

SEQ ID NO: 2805377 - RNA, 17 nt, Listeria monocytogenes EGD-e
acaaguaacucuuccaa

SEQ ID NO: 2805378 - RNA, 22 nt, Listeria monocytogenes EGD-e
acaauaacauuuucucuuguaa

SEQ ID NO: 2805379 - RNA, 24 nt, Listeria monocytogenes EGD-e
acaaucgcauccacuaaauuauca

SEQ ID NO: 2805380 - RNA, 17 nt, Listeria monocytogenes EGD-e
acaaucgcgucuacuuu

SEQ ID NO: 2805381 - RNA, 15 nt, Listeria monocytogenes EGD-e
acaaugaugguuuug

SEQ ID NO: 2805382 - RNA, 20 nt, Listeria monocytogenes EGD-e
acaauggaaugacaaaauua

SEQ ID NO: 2805383 - RNA, 12 nt, Listeria monocytogenes EGD-e
acaauuaaaaua

SEQ ID NO: 2805384 - RNA, 20 nt, Listeria monocytogenes EGD-e
acacaaaaugcucaucaaga

SEQ ID NO: 2805385 - RNA, 13 nt, Listeria monocytogenes EGD-e
acacauuauacga

SEQ ID NO: 2805386 - RNA, 22 nt, Listeria monocytogenes EGD-e
acaccacucuuuuauaaaaaua

SEQ ID NO: 2805387 - RNA, 20 nt, Listeria monocytogenes EGD-e
acacggugaugaaaccaaau

SEQ ID NO: 2805388 - RNA, 14 nt, Listeria monocytogenes EGD-e
acacguuccccacc

SEQ ID NO: 2805389 - RNA, 23 nt, Listeria monocytogenes EGD-e
acacuaaauugauaccaaauugu

SEQ ID NO: 2805390 - RNA, 18 nt, Listeria monocytogenes EGD-e
acagauaguuguuccauu

SEQ ID NO: 2805391 - RNA, 18 nt, Listeria monocytogenes EGD-e
acagcaauggccggauau

SEQ ID NO: 2805392 - RNA, 13 nt, Listeria monocytogenes EGD-e
acaguauuccuca

SEQ ID NO: 2805393 - RNA, 11 nt, Listeria monocytogenes EGD-e
acauaaaaagc

SEQ ID NO: 2805394 - RNA, 19 nt, Listeria monocytogenes EGD-e
acauaaucccacaaaaaau

SEQ ID NO: 2805395 - RNA, 18 nt, Listeria monocytogenes EGD-e
acauagcuacaauuaaaa

SEQ ID NO: 2805396 - RNA, 15 nt, Listeria monocytogenes EGD-e
acauaguuauaaaua

SEQ ID NO: 2805397 - RNA, 17 nt, Listeria monocytogenes EGD-e
acauaguuauaaauacu

SEQ ID NO: 2805398 - RNA, 17 nt, Listeria monocytogenes EGD-e
acauauuugaacccuuu

SEQ ID NO: 2805399 - RNA, 18 nt, Listeria monocytogenes EGD-e
acauauuugaacccuuug

SEQ ID NO: 2805400 - RNA, 20 nt, Listeria monocytogenes EGD-e
acauccgcaugaauuuuugc

SEQ ID NO: 2805401 - RNA, 22 nt, Listeria monocytogenes EGD-e
acauccuucagccaauucuucc

SEQ ID NO: 2805402 - RNA, 19 nt, Listeria monocytogenes EGD-e
acaucugcuauuuuugaau

SEQ ID NO: 2805403 - RNA, 15 nt, Listeria monocytogenes EGD-e
acaucuguuccuuug

SEQ ID NO: 2805404 - RNA, 18 nt, Listeria monocytogenes EGD-e
acaucuucaauugcuucu

SEQ ID NO: 2805405 - RNA, 19 nt, Listeria monocytogenes EGD-e
acaucuuuguauacuucaa

SEQ ID NO: 2805406 - RNA, 16 nt, Listeria monocytogenes EGD-e
acaugaauuacuucac

SEQ ID NO: 2805407 - RNA, 19 nt, Listeria monocytogenes EGD-e
acaugaccgccaauuuuac

SEQ ID NO: 2805408 - RNA, 21 nt, Listeria monocytogenes EGD-e
acauuaaaccgauaauuuuca

SEQ ID NO: 2805409 - RNA, 15 nt, Listeria monocytogenes EGD-e
acauucaaaucacca

SEQ ID NO: 2805410 - RNA, 12 nt, Listeria monocytogenes EGD-e
acauugaaaaaa

SEQ ID NO: 2805411 - RNA, 14 nt, Listeria monocytogenes EGD-e
acauuuucucuugu

SEQ ID NO: 2805412 - RNA, 12 nt, Listeria monocytogenes EGD-e
acauuuuugcuu

SEQ ID NO: 2805413 - RNA, 17 nt, Listeria monocytogenes EGD-e
accaacuucgagcagcu

SEQ ID NO: 2805414 - RNA, 18 nt, Listeria monocytogenes EGD-e
accaagggugaucaauca

SEQ ID NO: 2805415 - RNA, 13 nt, Listeria monocytogenes EGD-e
accaauaaaaccu

SEQ ID NO: 2805416 - RNA, 17 nt, Listeria monocytogenes EGD-e
accaaucauggaaacaa

SEQ ID NO: 2805417 - RNA, 15 nt, Listeria monocytogenes EGD-e
accaaugcuuucuag

SEQ ID NO: 2805418 - RNA, 16 nt, Listeria monocytogenes EGD-e
accaaugcuuucuagc

SEQ ID NO: 2805419 - RNA, 18 nt, Listeria monocytogenes EGD-e
accaauuucuuuuuaacg

SEQ ID NO: 2805420 - RNA, 21 nt, Listeria monocytogenes EGD-e
accaccauaagacauaacaag

SEQ ID NO: 2805421 - RNA, 18 nt, Listeria monocytogenes EGD-e
accaccuugaauccgacc

SEQ ID NO: 2805422 - RNA, 21 nt, Listeria monocytogenes EGD-e
accacucuuuuauaaaaauac

SEQ ID NO: 2805423 - RNA, 22 nt, Listeria monocytogenes EGD-e
accacucuuuuauaaaaauaca

SEQ ID NO: 2805424 - RNA, 21 nt, Listeria monocytogenes EGD-e
accagcuacuucggggcaaaa

SEQ ID NO: 2805425 - RNA, 22 nt, Listeria monocytogenes EGD-e
accagugugguuuacucccuuu

SEQ ID NO: 2805426 - RNA, 23 nt, Listeria monocytogenes EGD-e
accagugugguuuacucccuuuu

SEQ ID NO: 2805427 - RNA, 19 nt, Listeria monocytogenes EGD-e
accauaagacauaacaagu

SEQ ID NO: 2805428 - RNA, 17 nt, Listeria monocytogenes EGD-e
accauauaaucaauauc

SEQ ID NO: 2805429 - RNA, 22 nt, Listeria monocytogenes EGD-e
accauauccggugagccuaagu

SEQ ID NO: 2805430 - RNA, 12 nt, Listeria monocytogenes EGD-e
accaucgcaaaa

SEQ ID NO: 2805431 - RNA, 17 nt, Listeria monocytogenes EGD-e
accaucuuuuaucuucc

SEQ ID NO: 2805432 - RNA, 12 nt, Listeria monocytogenes EGD-e
accauuauacaa

SEQ ID NO: 2805433 - RNA, 20 nt, Listeria monocytogenes EGD-e
accauuccguugaaagaggg

SEQ ID NO: 2805434 - RNA, 12 nt, Listeria monocytogenes EGD-e
accauucgaguu

SEQ ID NO: 2805435 - RNA, 20 nt, Listeria monocytogenes EGD-e
accauuuguuuuauuuuggu

SEQ ID NO: 2805436 - RNA, 18 nt, Listeria monocytogenes EGD-e
accauuuuguucuaagaa

SEQ ID NO: 2805437 - RNA, 15 nt, Listeria monocytogenes EGD-e
acccaauuguuuuac

SEQ ID NO: 2805438 - RNA, 13 nt, Listeria monocytogenes EGD-e
acccauaauauua

SEQ ID NO: 2805439 - RNA, 16 nt, Listeria monocytogenes EGD-e
acccgcguuuucuaac

SEQ ID NO: 2805440 - RNA, 15 nt, Listeria monocytogenes EGD-e
accgcgcgaugcuga

SEQ ID NO: 2805441 - RNA, 19 nt, Listeria monocytogenes EGD-e
accggucugugauuacucc

SEQ ID NO: 2805442 - RNA, 11 nt, Listeria monocytogenes EGD-e
accuaaagcau

SEQ ID NO: 2805443 - RNA, 23 nt, Listeria monocytogenes EGD-e
accuaguaguuaacgguuuucau

SEQ ID NO: 2805444 - RNA, 20 nt, Listeria monocytogenes EGD-e
accuaguuuuauuauauuuu

SEQ ID NO: 2805445 - RNA, 15 nt, Listeria monocytogenes EGD-e
accugcaagcgaauu

SEQ ID NO: 2805446 - RNA, 19 nt, Listeria monocytogenes EGD-e
accuucaucguuuaacaua

SEQ ID NO: 2805447 - RNA, 15 nt, Listeria monocytogenes EGD-e
accuugaucaaaauu

SEQ ID NO: 2805448 - RNA, 22 nt, Listeria monocytogenes EGD-e
accuugcucccgcgcuaaucuu

SEQ ID NO: 2805449 - RNA, 20 nt, Listeria monocytogenes EGD-e
accuuugaaaacugaacaaa

SEQ ID NO: 2805450 - RNA, 11 nt, Listeria monocytogenes EGD-e
acgaaaagcaa

SEQ ID NO: 2805451 - RNA, 12 nt, Listeria monocytogenes EGD-e
acgaaaagcaau

SEQ ID NO: 2805452 - RNA, 14 nt, Listeria monocytogenes EGD-e
acgaaaagcaauga

SEQ ID NO: 2805453 - RNA, 18 nt, Listeria monocytogenes EGD-e
acgaaagcaacaacugcu

SEQ ID NO: 2805454 - RNA, 22 nt, Listeria monocytogenes EGD-e
acgaaagcaacaacugcuuucg

SEQ ID NO: 2805455 - RNA, 13 nt, Listeria monocytogenes EGD-e
acgaaaucaaacu

SEQ ID NO: 2805456 - RNA, 15 nt, Listeria monocytogenes EGD-e
acgaaaucaaacuua

SEQ ID NO: 2805457 - RNA, 13 nt, Listeria monocytogenes EGD-e
acgaauccuugga

SEQ ID NO: 2805458 - RNA, 14 nt, Listeria monocytogenes EGD-e
acgaauccuuggaa

SEQ ID NO: 2805459 - RNA, 20 nt, Listeria monocytogenes EGD-e
acgacguuuaucaauaauag

SEQ ID NO: 2805460 - RNA, 22 nt, Listeria monocytogenes EGD-e
acgaguuuguuuaggauauuuu

SEQ ID NO: 2805461 - RNA, 16 nt, Listeria monocytogenes EGD-e
acgauaacuuucucuu

SEQ ID NO: 2805462 - RNA, 23 nt, Listeria monocytogenes EGD-e
acgauagauuuuaauuucuuuug

SEQ ID NO: 2805463 - RNA, 12 nt, Listeria monocytogenes EGD-e
acgaucuacuuc

SEQ ID NO: 2805464 - RNA, 16 nt, Listeria monocytogenes EGD-e
acgauggaaccauuca

SEQ ID NO: 2805465 - RNA, 18 nt, Listeria monocytogenes EGD-e
acgauggaaccauucacu

SEQ ID NO: 2805466 - RNA, 23 nt, Listeria monocytogenes EGD-e
acgauuugucuucggauuuuuca

SEQ ID NO: 2805467 - RNA, 22 nt, Listeria monocytogenes EGD-e
acgcaaugcugaauguuuucuu

SEQ ID NO: 2805468 - RNA, 23 nt, Listeria monocytogenes EGD-e
acgcaauuuuaggcguaucuuuu

SEQ ID NO: 2805469 - RNA, 17 nt, Listeria monocytogenes EGD-e
acgcagguucaccaaau

SEQ ID NO: 2805470 - RNA, 20 nt, Listeria monocytogenes EGD-e
acgcauaucaucaauaaaau

SEQ ID NO: 2805471 - RNA, 22 nt, Listeria monocytogenes EGD-e
acgccacgagcagauacuguuc

SEQ ID NO: 2805472 - RNA, 14 nt, Listeria monocytogenes EGD-e
acgcgacaaaguaa

SEQ ID NO: 2805473 - RNA, 18 nt, Listeria monocytogenes EGD-e
acggucuuuuuuucuuua

SEQ ID NO: 2805474 - RNA, 22 nt, Listeria monocytogenes EGD-e
acguaugcgguagccugcucgc

SEQ ID NO: 2805475 - RNA, 18 nt, Listeria monocytogenes EGD-e
acguuccaguuaaacaaa

SEQ ID NO: 2805476 - RNA, 19 nt, Listeria monocytogenes EGD-e
acguucgagcagcauccau

SEQ ID NO: 2805477 - RNA, 21 nt, Listeria monocytogenes EGD-e
acguuuaauucggcuucaaaa

SEQ ID NO: 2805478 - RNA, 18 nt, Listeria monocytogenes EGD-e
acuaaauuaauuugacca

SEQ ID NO: 2805479 - RNA, 19 nt, Listeria monocytogenes EGD-e
acuaaauuaauuugaccac

SEQ ID NO: 2805480 - RNA, 13 nt, Listeria monocytogenes EGD-e
acuaaauuaucau

SEQ ID NO: 2805481 - RNA, 14 nt, Listeria monocytogenes EGD-e
acuaacaaaauaau

SEQ ID NO: 2805482 - RNA, 17 nt, Listeria monocytogenes EGD-e
acuaaguuuagccccaa

SEQ ID NO: 2805483 - RNA, 13 nt, Listeria monocytogenes EGD-e
acuacauuuuguu

SEQ ID NO: 2805484 - RNA, 17 nt, Listeria monocytogenes EGD-e
acuacuaauuguuaccg

SEQ ID NO: 2805485 - RNA, 16 nt, Listeria monocytogenes EGD-e
acuacuggauaaaaug

SEQ ID NO: 2805486 - RNA, 14 nt, Listeria monocytogenes EGD-e
acuagaaaaaugaa

SEQ ID NO: 2805487 - RNA, 22 nt, Listeria monocytogenes EGD-e
acuagaacggugaaaaugggga

SEQ ID NO: 2805488 - RNA, 16 nt, Listeria monocytogenes EGD-e
acuaguuguaaaccgu

SEQ ID NO: 2805489 - RNA, 18 nt, Listeria monocytogenes EGD-e
acuaucaugacuaaaaag

SEQ ID NO: 2805490 - RNA, 16 nt, Listeria monocytogenes EGD-e
acuauugaauguucua

SEQ ID NO: 2805491 - RNA, 18 nt, Listeria monocytogenes EGD-e
acuauuuucuaaucaaau

SEQ ID NO: 2805492 - RNA, 19 nt, Listeria monocytogenes EGD-e
acucaaugaaaagcaaguu

SEQ ID NO: 2805493 - RNA, 23 nt, Listeria monocytogenes EGD-e
acuccaaaauaaaauggauaaaa

SEQ ID NO: 2805494 - RNA, 16 nt, Listeria monocytogenes EGD-e
acucgaguauaugcua

SEQ ID NO: 2805495 - RNA, 16 nt, Listeria monocytogenes EGD-e
acucggggugaaaaug

SEQ ID NO: 2805496 - RNA, 14 nt, Listeria monocytogenes EGD-e
acucgucuaaaaaa

SEQ ID NO: 2805497 - RNA, 19 nt, Listeria monocytogenes EGD-e
acucucuucagaaaguggu

SEQ ID NO: 2805498 - RNA, 16 nt, Listeria monocytogenes EGD-e
acucuuuaaauccauu

SEQ ID NO: 2805499 - RNA, 16 nt, Listeria monocytogenes EGD-e
acucuuucugaaaaug

SEQ ID NO: 2805500 - RNA, 16 nt, Listeria monocytogenes EGD-e
acucuuuuauaaaaau

SEQ ID NO: 2805501 - RNA, 16 nt, Listeria monocytogenes EGD-e
acugaacaaagaagaa

SEQ ID NO: 2805502 - RNA, 23 nt, Listeria monocytogenes EGD-e
acugaacaaagaagaagacgaaa

SEQ ID NO: 2805503 - RNA, 16 nt, Listeria monocytogenes EGD-e
acugacuagaaauuaa

SEQ ID NO: 2805504 - RNA, 14 nt, Listeria monocytogenes EGD-e
acugcaaucauuua

SEQ ID NO: 2805505 - RNA, 16 nt, Listeria monocytogenes EGD-e
acugcauaaaaaacau

SEQ ID NO: 2805506 - RNA, 15 nt, Listeria monocytogenes EGD-e
acugcggcauagaaa

SEQ ID NO: 2805507 - RNA, 18 nt, Listeria monocytogenes EGD-e
acugcggcauagaaagua

SEQ ID NO: 2805508 - RNA, 18 nt, Listeria monocytogenes EGD-e
acugcggcuaauaacauu

SEQ ID NO: 2805509 - RNA, 18 nt, Listeria monocytogenes EGD-e
acugcuaacacgagagaa

SEQ ID NO: 2805510 - RNA, 20 nt, Listeria monocytogenes EGD-e
acuggacaaugauccgaacc

SEQ ID NO: 2805511 - RNA, 17 nt, Listeria monocytogenes EGD-e
acugucgcaaaaaucau

SEQ ID NO: 2805512 - RNA, 16 nt, Listeria monocytogenes EGD-e
acugugcucuuugcuu

SEQ ID NO: 2805513 - RNA, 12 nt, Listeria monocytogenes EGD-e
acuguuguucuu

SEQ ID NO: 2805514 - RNA, 16 nt, Listeria monocytogenes EGD-e
acuguuguucuugcca

SEQ ID NO: 2805515 - RNA, 16 nt, Listeria monocytogenes EGD-e
acuuaaaucacuucuu

SEQ ID NO: 2805516 - RNA, 22 nt, Listeria monocytogenes EGD-e
acuuaauucuugaauguuuuca

SEQ ID NO: 2805517 - RNA, 15 nt, Listeria monocytogenes EGD-e
acuuacaaaagugga

SEQ ID NO: 2805518 - RNA, 18 nt, Listeria monocytogenes EGD-e
acuuacaaaaguggaaau

SEQ ID NO: 2805519 - RNA, 19 nt, Listeria monocytogenes EGD-e
acuuacugcaaucauuuau

SEQ ID NO: 2805520 - RNA, 22 nt, Listeria monocytogenes EGD-e
acuuacugcaaucauuuauuuu

SEQ ID NO: 2805521 - RNA, 13 nt, Listeria monocytogenes EGD-e
acuuauaaugcag

SEQ ID NO: 2805522 - RNA, 20 nt, Listeria monocytogenes EGD-e
acuuaucucuucauuuuucu

SEQ ID NO: 2805523 - RNA, 14 nt, Listeria monocytogenes EGD-e
acuucaacuaaacg

SEQ ID NO: 2805524 - RNA, 16 nt, Listeria monocytogenes EGD-e
acuucacuaacaaaau

SEQ ID NO: 2805525 - RNA, 23 nt, Listeria monocytogenes EGD-e
acuucacuaacaaaauaauaaua

SEQ ID NO: 2805526 - RNA, 17 nt, Listeria monocytogenes EGD-e
acuucaugugcuuuuuu

SEQ ID NO: 2805527 - RNA, 21 nt, Listeria monocytogenes EGD-e
acuucauuagacaaaaagaaa

SEQ ID NO: 2805528 - RNA, 21 nt, Listeria monocytogenes EGD-e
acuucggggcaaaaaggaauu

SEQ ID NO: 2805529 - RNA, 17 nt, Listeria monocytogenes EGD-e
acuucuaccguuccuuc

SEQ ID NO: 2805530 - RNA, 16 nt, Listeria monocytogenes EGD-e
acuucuggauuugcuu

SEQ ID NO: 2805531 - RNA, 18 nt, Listeria monocytogenes EGD-e
acuucuuaagaauuccgu

SEQ ID NO: 2805532 - RNA, 14 nt, Listeria monocytogenes EGD-e
acuucuuccaccug

SEQ ID NO: 2805533 - RNA, 16 nt, Listeria monocytogenes EGD-e
acuugcuuuuuuuaaa

SEQ ID NO: 2805534 - RNA, 17 nt, Listeria monocytogenes EGD-e
acuugcuuuuuuuaaac

SEQ ID NO: 2805535 - RNA, 19 nt, Listeria monocytogenes EGD-e
acuuuauaacuuucaccag

SEQ ID NO: 2805536 - RNA, 20 nt, Listeria monocytogenes EGD-e
acuuuaucccagaaagaauu

SEQ ID NO: 2805537 - RNA, 13 nt, Listeria monocytogenes EGD-e
acuuucaaaucag

SEQ ID NO: 2805538 - RNA, 20 nt, Listeria monocytogenes EGD-e
acuuucgacaguuucuuuuu

SEQ ID NO: 2805539 - RNA, 19 nt, Listeria monocytogenes EGD-e
acuuucucuugcuuuaauu

SEQ ID NO: 2805540 - RNA, 18 nt, Listeria monocytogenes EGD-e
acuuucuuguuucauaua

SEQ ID NO: 2805541 - RNA, 18 nt, Listeria monocytogenes EGD-e
acuuuuauugcacuauuu

SEQ ID NO: 2805542 - RNA, 15 nt, Listeria monocytogenes EGD-e
acuuuucgaaucccu

SEQ ID NO: 2805543 - RNA, 17 nt, Listeria monocytogenes EGD-e
acuuuuuucuauauuca

SEQ ID NO: 2805544 - RNA, 11 nt, Listeria monocytogenes EGD-e
agaaaaaaaca

SEQ ID NO: 2805545 - RNA, 13 nt, Listeria monocytogenes EGD-e
agaaaaaaacaaa

SEQ ID NO: 2805546 - RNA, 14 nt, Listeria monocytogenes EGD-e
agaaaaaaacaaau

SEQ ID NO: 2805547 - RNA, 14 nt, Listeria monocytogenes EGD-e
agaaaaaacaagga

SEQ ID NO: 2805548 - RNA, 16 nt, Listeria monocytogenes EGD-e
agaaaaaguuucaauu

SEQ ID NO: 2805549 - RNA, 14 nt, Listeria monocytogenes EGD-e
agaaaaauaauccu

SEQ ID NO: 2805550 - RNA, 14 nt, Listeria monocytogenes EGD-e
agaaaacagaaagc

SEQ ID NO: 2805551 - RNA, 15 nt, Listeria monocytogenes EGD-e
agaaaacagaaagcu

SEQ ID NO: 2805552 - RNA, 23 nt, Listeria monocytogenes EGD-e
agaaaacagaaagcuguuuucaa

SEQ ID NO: 2805553 - RNA, 20 nt, Listeria monocytogenes EGD-e
agaaaccccgccaccaguca

SEQ ID NO: 2805554 - RNA, 22 nt, Listeria monocytogenes EGD-e
agaaaccccgccaccagucaca

SEQ ID NO: 2805555 - RNA, 23 nt, Listeria monocytogenes EGD-e
agaaacgcuuuguuuagccuuuu

SEQ ID NO: 2805556 - RNA, 17 nt, Listeria monocytogenes EGD-e
agaaacuuucuuuucuu

SEQ ID NO: 2805557 - RNA, 16 nt, Listeria monocytogenes EGD-e
agaaagccuuuauuga

SEQ ID NO: 2805558 - RNA, 21 nt, Listeria monocytogenes EGD-e
agaaagcuguuuucaacaaaa

SEQ ID NO: 2805559 - RNA, 23 nt, Listeria monocytogenes EGD-e
agaaagcuguuuucaacaaaaca

SEQ ID NO: 2805560 - RNA, 23 nt, Listeria monocytogenes EGD-e
agaaaguuggguaugacuuaaau

SEQ ID NO: 2805561 - RNA, 22 nt, Listeria monocytogenes EGD-e
agaaaucgccuugauguggaua

SEQ ID NO: 2805562 - RNA, 19 nt, Listeria monocytogenes EGD-e
agaaaucucaugaaacuuu

SEQ ID NO: 2805563 - RNA, 20 nt, Listeria monocytogenes EGD-e
agaaauggauugcagguaau

SEQ ID NO: 2805564 - RNA, 19 nt, Listeria monocytogenes EGD-e
agaaauuaccuaaugaaua

SEQ ID NO: 2805565 - RNA, 17 nt, Listeria monocytogenes EGD-e
agaaauuacguuucacu

SEQ ID NO: 2805566 - RNA, 21 nt, Listeria monocytogenes EGD-e
agaacgaauguuaaauucauu

SEQ ID NO: 2805567 - RNA, 23 nt, Listeria monocytogenes EGD-e
agaacuagauuuaauaaauuaga

SEQ ID NO: 2805568 - RNA, 18 nt, Listeria monocytogenes EGD-e
agaagaagacgaaaagca

SEQ ID NO: 2805569 - RNA, 20 nt, Listeria monocytogenes EGD-e
agaagaugcacuagaaaaau

SEQ ID NO: 2805570 - RNA, 15 nt, Listeria monocytogenes EGD-e
agaagcaauuagucc

SEQ ID NO: 2805571 - RNA, 15 nt, Listeria monocytogenes EGD-e
agaagccaauucacu

SEQ ID NO: 2805572 - RNA, 22 nt, Listeria monocytogenes EGD-e
agaagguucaucacuuguugau

SEQ ID NO: 2805573 - RNA, 13 nt, Listeria monocytogenes EGD-e
agaauaaaacaaa

SEQ ID NO: 2805574 - RNA, 14 nt, Listeria monocytogenes EGD-e
agaauaaaacaaaa

SEQ ID NO: 2805575 - RNA, 17 nt, Listeria monocytogenes EGD-e
agaauauggacauacuu

SEQ ID NO: 2805576 - RNA, 23 nt, Listeria monocytogenes EGD-e
agaaugagcuccuucaagaccaa

SEQ ID NO: 2805577 - RNA, 19 nt, Listeria monocytogenes EGD-e
agacaaguccggcgauaau

SEQ ID NO: 2805578 - RNA, 18 nt, Listeria monocytogenes EGD-e
agacauuaaaccgauaau

SEQ ID NO: 2805579 - RNA, 15 nt, Listeria monocytogenes EGD-e
agaccaccaagaaua

SEQ ID NO: 2805580 - RNA, 20 nt, Listeria monocytogenes EGD-e
agacgaccauauaaucaaua

SEQ ID NO: 2805581 - RNA, 19 nt, Listeria monocytogenes EGD-e
agacuaaauugucuacugc

SEQ ID NO: 2805582 - RNA, 18 nt, Listeria monocytogenes EGD-e
agacuuuuuuuuauaaga

SEQ ID NO: 2805583 - RNA, 17 nt, Listeria monocytogenes EGD-e
agagaaacuuuuucuca

SEQ ID NO: 2805584 - RNA, 19 nt, Listeria monocytogenes EGD-e
agagagccuggauuuucua

SEQ ID NO: 2805585 - RNA, 18 nt, Listeria monocytogenes EGD-e
agagccuggauuuucuag

SEQ ID NO: 2805586 - RNA, 22 nt, Listeria monocytogenes EGD-e
agagcgauggaguuuguaacaa

SEQ ID NO: 2805587 - RNA, 15 nt, Listeria monocytogenes EGD-e
agagcuagaaagccu

SEQ ID NO: 2805588 - RNA, 20 nt, Listeria monocytogenes EGD-e
agagcuucuguuuuuucuuu

SEQ ID NO: 2805589 - RNA, 13 nt, Listeria monocytogenes EGD-e
agaggauuuucac

SEQ ID NO: 2805590 - RNA, 23 nt, Listeria monocytogenes EGD-e
agagguuuugcacaaaaugcaaa

SEQ ID NO: 2805591 - RNA, 13 nt, Listeria monocytogenes EGD-e
agauaaauuacug

SEQ ID NO: 2805592 - RNA, 20 nt, Listeria monocytogenes EGD-e
agauaacucaaaguaacuuu

SEQ ID NO: 2805593 - RNA, 14 nt, Listeria monocytogenes EGD-e
agauaaguuuucau

SEQ ID NO: 2805594 - RNA, 22 nt, Listeria monocytogenes EGD-e
agauaaguuuucauauaagugu

SEQ ID NO: 2805595 - RNA, 20 nt, Listeria monocytogenes EGD-e
agauaucuacaaguucuuuc

SEQ ID NO: 2805596 - RNA, 17 nt, Listeria monocytogenes EGD-e
agaucaaaagcaaaaaa

SEQ ID NO: 2805597 - RNA, 18 nt, Listeria monocytogenes EGD-e
agauccuucaauaauaua

SEQ ID NO: 2805598 - RNA, 21 nt, Listeria monocytogenes EGD-e
agaugcacuagaaaaaugaag

SEQ ID NO: 2805599 - RNA, 23 nt, Listeria monocytogenes EGD-e
agauguuuuuauuuauauagaag

SEQ ID NO: 2805600 - RNA, 14 nt, Listeria monocytogenes EGD-e
agauuaaauauagu

SEQ ID NO: 2805601 - RNA, 15 nt, Listeria monocytogenes EGD-e
agauucauaaacaaa

SEQ ID NO: 2805602 - RNA, 18 nt, Listeria monocytogenes EGD-e
agauugauguuguaaaua

SEQ ID NO: 2805603 - RNA, 23 nt, Listeria monocytogenes EGD-e
agauugcauucugugauggaagu

SEQ ID NO: 2805604 - RNA, 17 nt, Listeria monocytogenes EGD-e
agauuuggucauuuuuu

SEQ ID NO: 2805605 - RNA, 18 nt, Listeria monocytogenes EGD-e
agauuuuaauuucuuuug

SEQ ID NO: 2805606 - RNA, 21 nt, Listeria monocytogenes EGD-e
agauuuucaucccuuuuuuca

SEQ ID NO: 2805607 - RNA, 20 nt, Listeria monocytogenes EGD-e
agauuuugcgaaagcuguaa

SEQ ID NO: 2805608 - RNA, 16 nt, Listeria monocytogenes EGD-e
agauuuuguacauaaa

SEQ ID NO: 2805609 - RNA, 18 nt, Listeria monocytogenes EGD-e
agcaaaaaaguaggccua

SEQ ID NO: 2805610 - RNA, 12 nt, Listeria monocytogenes EGD-e
agcaaaacauuu

SEQ ID NO: 2805611 - RNA, 22 nt, Listeria monocytogenes EGD-e
agcaaaacauuuucauucuuuc

SEQ ID NO: 2805612 - RNA, 16 nt, Listeria monocytogenes EGD-e
agcaaacaaaguacca

SEQ ID NO: 2805613 - RNA, 17 nt, Listeria monocytogenes EGD-e
agcaaaugcauuucucg

SEQ ID NO: 2805614 - RNA, 15 nt, Listeria monocytogenes EGD-e
agcaacgguaaacaa

SEQ ID NO: 2805615 - RNA, 15 nt, Listeria monocytogenes EGD-e
agcaacuucacuaac

SEQ ID NO: 2805616 - RNA, 18 nt, Listeria monocytogenes EGD-e
agcaagagcaccaauaaa

SEQ ID NO: 2805617 - RNA, 19 nt, Listeria monocytogenes EGD-e
agcaagagcaccaauaaaa

SEQ ID NO: 2805618 - RNA, 20 nt, Listeria monocytogenes EGD-e
agcaagagcaccaauaaaac

SEQ ID NO: 2805619 - RNA, 15 nt, Listeria monocytogenes EGD-e
agcaaguagcuuagg

SEQ ID NO: 2805620 - RNA, 15 nt, Listeria monocytogenes EGD-e
agcaauaacaucuuu

SEQ ID NO: 2805621 - RNA, 19 nt, Listeria monocytogenes EGD-e
agcaauggccggauaugcu

SEQ ID NO: 2805622 - RNA, 14 nt, Listeria monocytogenes EGD-e
agcacagcuaccac

SEQ ID NO: 2805623 - RNA, 16 nt, Listeria monocytogenes EGD-e
agcaccaauaaaaccu

SEQ ID NO: 2805624 - RNA, 17 nt, Listeria monocytogenes EGD-e
agcacgcgcguucauuc

SEQ ID NO: 2805625 - RNA, 21 nt, Listeria monocytogenes EGD-e
agcacuaaugcucaccuucuu

SEQ ID NO: 2805626 - RNA, 17 nt, Listeria monocytogenes EGD-e
agcagaagccccuugga

SEQ ID NO: 2805627 - RNA, 22 nt, Listeria monocytogenes EGD-e
agcagauuuugcgaaagcugua

SEQ ID NO: 2805628 - RNA, 22 nt, Listeria monocytogenes EGD-e
agcaggguggccgugauaaaua

SEQ ID NO: 2805629 - RNA, 14 nt, Listeria monocytogenes EGD-e
agcauaauagaaag

SEQ ID NO: 2805630 - RNA, 16 nt, Listeria monocytogenes EGD-e
agcaucgaauacuaac

SEQ ID NO: 2805631 - RNA, 14 nt, Listeria monocytogenes EGD-e
agcaucggucaaau

SEQ ID NO: 2805632 - RNA, 16 nt, Listeria monocytogenes EGD-e
agcaucggucaaaucu

SEQ ID NO: 2805633 - RNA, 17 nt, Listeria monocytogenes EGD-e
agcaucuaguagcaauu

SEQ ID NO: 2805634 - RNA, 22 nt, Listeria monocytogenes EGD-e
agcaucuuggcaugaugaaaag

SEQ ID NO: 2805635 - RNA, 15 nt, Listeria monocytogenes EGD-e
agcaucuuuuucuug

SEQ ID NO: 2805636 - RNA, 14 nt, Listeria monocytogenes EGD-e
agcaugagagugac

SEQ ID NO: 2805637 - RNA, 19 nt, Listeria monocytogenes EGD-e
agcauguccaagcacagca

SEQ ID NO: 2805638 - RNA, 19 nt, Listeria monocytogenes EGD-e
agcauuucauaaucaaaua

SEQ ID NO: 2805639 - RNA, 16 nt, Listeria monocytogenes EGD-e
agccaaugaccuaguu

SEQ ID NO: 2805640 - RNA, 13 nt, Listeria monocytogenes EGD-e
agccaguuuucau

SEQ ID NO: 2805641 - RNA, 15 nt, Listeria monocytogenes EGD-e
agccauaaaauuagu

SEQ ID NO: 2805642 - RNA, 23 nt, Listeria monocytogenes EGD-e
agccauuucucgcugcaauuuca

SEQ ID NO: 2805643 - RNA, 20 nt, Listeria monocytogenes EGD-e
agccgcucgucuaaauugag

SEQ ID NO: 2805644 - RNA, 16 nt, Listeria monocytogenes EGD-e
agccuccgcuuugguu

SEQ ID NO: 2805645 - RNA, 12 nt, Listeria monocytogenes EGD-e
agcgaagucaau

SEQ ID NO: 2805646 - RNA, 14 nt, Listeria monocytogenes EGD-e
agcgaauaagugaa

SEQ ID NO: 2805647 - RNA, 13 nt, Listeria monocytogenes EGD-e
agcgaugugggaa

SEQ ID NO: 2805648 - RNA, 19 nt, Listeria monocytogenes EGD-e
agcgaugugggaaugaaua

SEQ ID NO: 2805649 - RNA, 22 nt, Listeria monocytogenes EGD-e
agcgcagaaugaagccauuccc

SEQ ID NO: 2805650 - RNA, 17 nt, Listeria monocytogenes EGD-e
agcgcaucucuaacagu

SEQ ID NO: 2805651 - RNA, 20 nt, Listeria monocytogenes EGD-e
agcgcuggcagcuuuugaaa

SEQ ID NO: 2805652 - RNA, 17 nt, Listeria monocytogenes EGD-e
agcgcuuaaaaauuuug

SEQ ID NO: 2805653 - RNA, 14 nt, Listeria monocytogenes EGD-e
agcggucaaucauu

SEQ ID NO: 2805654 - RNA, 15 nt, Listeria monocytogenes EGD-e
agcguucaagugaua

SEQ ID NO: 2805655 - RNA, 18 nt, Listeria monocytogenes EGD-e
agcuaacaacaagcaaaa

SEQ ID NO: 2805656 - RNA, 12 nt, Listeria monocytogenes EGD-e
agcuaauuuuuu

SEQ ID NO: 2805657 - RNA, 16 nt, Listeria monocytogenes EGD-e
agcuacaauuaaaaua

SEQ ID NO: 2805658 - RNA, 19 nt, Listeria monocytogenes EGD-e
agcuacagcuguaaaugaa

SEQ ID NO: 2805659 - RNA, 23 nt, Listeria monocytogenes EGD-e
agcuacuucggggcaaaaaggaa

SEQ ID NO: 2805660 - RNA, 17 nt, Listeria monocytogenes EGD-e
agcuaugcguuacacuu

SEQ ID NO: 2805661 - RNA, 14 nt, Listeria monocytogenes EGD-e
agcuauuguaaaug

SEQ ID NO: 2805662 - RNA, 18 nt, Listeria monocytogenes EGD-e
agcuauuuuuuauacucu

SEQ ID NO: 2805663 - RNA, 20 nt, Listeria monocytogenes EGD-e
agcuccugccguauguccag

SEQ ID NO: 2805664 - RNA, 16 nt, Listeria monocytogenes EGD-e
agcuccuucaagacca

SEQ ID NO: 2805665 - RNA, 16 nt, Listeria monocytogenes EGD-e
agcucuuucuucuacu

SEQ ID NO: 2805666 - RNA, 16 nt, Listeria monocytogenes EGD-e
agcugcaacagauagu

SEQ ID NO: 2805667 - RNA, 21 nt, Listeria monocytogenes EGD-e
agcuguuuucaacaaaacaaa

SEQ ID NO: 2805668 - RNA, 11 nt, Listeria monocytogenes EGD-e
agcuucaauca

SEQ ID NO: 2805669 - RNA, 18 nt, Listeria monocytogenes EGD-e
agcuucacgcaaugcuuu

SEQ ID NO: 2805670 - RNA, 20 nt, Listeria monocytogenes EGD-e
agcuuccauacuuucugcca

SEQ ID NO: 2805671 - RNA, 22 nt, Listeria monocytogenes EGD-e
agcuuccauacuuucugccaaa

SEQ ID NO: 2805672 - RNA, 18 nt, Listeria monocytogenes EGD-e
agcuucccguuaaucgaa

SEQ ID NO: 2805673 - RNA, 22 nt, Listeria monocytogenes EGD-e
agcuucccguuaaucgaaaaau

SEQ ID NO: 2805674 - RNA, 16 nt, Listeria monocytogenes EGD-e
agcuugauaauuuuuu

SEQ ID NO: 2805675 - RNA, 16 nt, Listeria monocytogenes EGD-e
agcuuuucuauagcuu

SEQ ID NO: 2805676 - RNA, 17 nt, Listeria monocytogenes EGD-e
agcuuuugaaaccauuc

SEQ ID NO: 2805677 - RNA, 18 nt, Listeria monocytogenes EGD-e
agcuuuuuuuauuuugcg

SEQ ID NO: 2805678 - RNA, 14 nt, Listeria monocytogenes EGD-e
aggaacuacauacu

SEQ ID NO: 2805679 - RNA, 15 nt, Listeria monocytogenes EGD-e
aggaacuacauacuu

SEQ ID NO: 2805680 - RNA, 13 nt, Listeria monocytogenes EGD-e
aggaauacuguuu

SEQ ID NO: 2805681 - RNA, 18 nt, Listeria monocytogenes EGD-e
aggaauuugccaaucaau

SEQ ID NO: 2805682 - RNA, 13 nt, Listeria monocytogenes EGD-e
aggaauuuuucca

SEQ ID NO: 2805683 - RNA, 14 nt, Listeria monocytogenes EGD-e
aggacaagcccagc

SEQ ID NO: 2805684 - RNA, 19 nt, Listeria monocytogenes EGD-e
aggacaugcuaaauaaaac

SEQ ID NO: 2805685 - RNA, 22 nt, Listeria monocytogenes EGD-e
aggacaugcuaaauaaaaccau

SEQ ID NO: 2805686 - RNA, 19 nt, Listeria monocytogenes EGD-e
aggagaaggcuuuuuaugc

SEQ ID NO: 2805687 - RNA, 12 nt, Listeria monocytogenes EGD-e
aggaguuucuuu

SEQ ID NO: 2805688 - RNA, 11 nt, Listeria monocytogenes EGD-e
aggauaaaaau

SEQ ID NO: 2805689 - RNA, 12 nt, Listeria monocytogenes EGD-e
aggauuuucacc

SEQ ID NO: 2805690 - RNA, 14 nt, Listeria monocytogenes EGD-e
aggcaaaucuuucg

SEQ ID NO: 2805691 - RNA, 13 nt, Listeria monocytogenes EGD-e
aggcaacaaagaa

SEQ ID NO: 2805692 - RNA, 14 nt, Listeria monocytogenes EGD-e
aggcaacaaagaag

SEQ ID NO: 2805693 - RNA, 15 nt, Listeria monocytogenes EGD-e
aggcaacaaagaaga

SEQ ID NO: 2805694 - RNA, 16 nt, Listeria monocytogenes EGD-e
aggcaacaaagaagaa

SEQ ID NO: 2805695 - RNA, 14 nt, Listeria monocytogenes EGD-e
aggcauguaucuua

SEQ ID NO: 2805696 - RNA, 16 nt, Listeria monocytogenes EGD-e
aggccacuaacauaaa

SEQ ID NO: 2805697 - RNA, 14 nt, Listeria monocytogenes EGD-e
aggcgaauccuuuu

SEQ ID NO: 2805698 - RNA, 23 nt, Listeria monocytogenes EGD-e
aggcgaauccuuuuagugucagu

SEQ ID NO: 2805699 - RNA, 17 nt, Listeria monocytogenes EGD-e
aggcgcucuuuaauaau

SEQ ID NO: 2805700 - RNA, 21 nt, Listeria monocytogenes EGD-e
aggcguaucuuuuccaaaaug

SEQ ID NO: 2805701 - RNA, 15 nt, Listeria monocytogenes EGD-e
aggcuuauuccucca

SEQ ID NO: 2805702 - RNA, 17 nt, Listeria monocytogenes EGD-e
agggaagcuuuugcuac

SEQ ID NO: 2805703 - RNA, 23 nt, Listeria monocytogenes EGD-e
agggaagcuuuugcuacacccau

SEQ ID NO: 2805704 - RNA, 15 nt, Listeria monocytogenes EGD-e
agggcagaaaacaga

SEQ ID NO: 2805705 - RNA, 17 nt, Listeria monocytogenes EGD-e
agggcagaaaacagaaa

SEQ ID NO: 2805706 - RNA, 18 nt, Listeria monocytogenes EGD-e
agggcagaaaacagaaag

SEQ ID NO: 2805707 - RNA, 14 nt, Listeria monocytogenes EGD-e
agggcuauuuuucc

SEQ ID NO: 2805708 - RNA, 15 nt, Listeria monocytogenes EGD-e
agggcuuuuuuccuu

SEQ ID NO: 2805709 - RNA, 14 nt, Listeria monocytogenes EGD-e
aggguaauauaaau

SEQ ID NO: 2805710 - RNA, 14 nt, Listeria monocytogenes EGD-e
agggugaucaauca

SEQ ID NO: 2805711 - RNA, 15 nt, Listeria monocytogenes EGD-e
agggugaucaaucag

SEQ ID NO: 2805712 - RNA, 22 nt, Listeria monocytogenes EGD-e
agguaacaucuuccacuccagc

SEQ ID NO: 2805713 - RNA, 22 nt, Listeria monocytogenes EGD-e
agguuuuuuuaugcauaaaaaa

SEQ ID NO: 2805714 - RNA, 16 nt, Listeria monocytogenes EGD-e
aguaaaaucuuuuaau

SEQ ID NO: 2805715 - RNA, 18 nt, Listeria monocytogenes EGD-e
aguaaacauuucucccuc

SEQ ID NO: 2805716 - RNA, 23 nt, Listeria monocytogenes EGD-e
aguaaauggcugaugacuaacua

SEQ ID NO: 2805717 - RNA, 23 nt, Listeria monocytogenes EGD-e
aguaacauagcuacaauuaaaau

SEQ ID NO: 2805718 - RNA, 22 nt, Listeria monocytogenes EGD-e
aguaacuaaaaaucauuuaaac

SEQ ID NO: 2805719 - RNA, 15 nt, Listeria monocytogenes EGD-e
aguaacucuuccaaa

SEQ ID NO: 2805720 - RNA, 16 nt, Listeria monocytogenes EGD-e
aguaacucuuccaaaa

SEQ ID NO: 2805721 - RNA, 19 nt, Listeria monocytogenes EGD-e
aguaacucuuccaaaauca

SEQ ID NO: 2805722 - RNA, 13 nt, Listeria monocytogenes EGD-e
aguaacuuuauca

SEQ ID NO: 2805723 - RNA, 16 nt, Listeria monocytogenes EGD-e
aguaagggugaagcuu

SEQ ID NO: 2805724 - RNA, 19 nt, Listeria monocytogenes EGD-e
aguaagggugaagcuuccu

SEQ ID NO: 2805725 - RNA, 13 nt, Listeria monocytogenes EGD-e
aguacaauuauag

SEQ ID NO: 2805726 - RNA, 17 nt, Listeria monocytogenes EGD-e
aguacauaguuauaaau

SEQ ID NO: 2805727 - RNA, 14 nt, Listeria monocytogenes EGD-e
aguacuucuauuga

SEQ ID NO: 2805728 - RNA, 23 nt, Listeria monocytogenes EGD-e
aguacuuugaauugcucguucuu

SEQ ID NO: 2805729 - RNA, 19 nt, Listeria monocytogenes EGD-e
aguagaaaguuaguugcuu

SEQ ID NO: 2805730 - RNA, 23 nt, Listeria monocytogenes EGD-e
aguagagcuucuguuuuuucuuu

SEQ ID NO: 2805731 - RNA, 12 nt, Listeria monocytogenes EGD-e
aguaguuuacuu

SEQ ID NO: 2805732 - RNA, 19 nt, Listeria monocytogenes EGD-e
aguauacuuuuaauuaaaa

SEQ ID NO: 2805733 - RNA, 17 nt, Listeria monocytogenes EGD-e
aguauuccuaucacaaa

SEQ ID NO: 2805734 - RNA, 16 nt, Listeria monocytogenes EGD-e
aguauuccucaaugag

SEQ ID NO: 2805735 - RNA, 17 nt, Listeria monocytogenes EGD-e
aguauuuuguuccaaca

SEQ ID NO: 2805736 - RNA, 19 nt, Listeria monocytogenes EGD-e
agucacagcguauccacca

SEQ ID NO: 2805737 - RNA, 21 nt, Listeria monocytogenes EGD-e
agucacagcguauccaccaaa

SEQ ID NO: 2805738 - RNA, 19 nt, Listeria monocytogenes EGD-e
agucaucggcuuuuuuuau

SEQ ID NO: 2805739 - RNA, 19 nt, Listeria monocytogenes EGD-e
agucaugacagcaucuuuu

SEQ ID NO: 2805740 - RNA, 15 nt, Listeria monocytogenes EGD-e
aguccaccagcuacu

SEQ ID NO: 2805741 - RNA, 22 nt, Listeria monocytogenes EGD-e
agucuggauuucuccguaagaa

SEQ ID NO: 2805742 - RNA, 15 nt, Listeria monocytogenes EGD-e
agugaaaauuggauu

SEQ ID NO: 2805743 - RNA, 19 nt, Listeria monocytogenes EGD-e
agugcaucuucuaagaaaa

SEQ ID NO: 2805744 - RNA, 20 nt, Listeria monocytogenes EGD-e
agugcaucuucuaagaaaaa

SEQ ID NO: 2805745 - RNA, 13 nt, Listeria monocytogenes EGD-e
aguguauuuacaa

SEQ ID NO: 2805746 - RNA, 22 nt, Listeria monocytogenes EGD-e
agugugguuuacucccuuuuuc

SEQ ID NO: 2805747 - RNA, 16 nt, Listeria monocytogenes EGD-e
aguuaaaccauaaaaa

SEQ ID NO: 2805748 - RNA, 15 nt, Listeria monocytogenes EGD-e
aguuaacgguuuuca

SEQ ID NO: 2805749 - RNA, 12 nt, Listeria monocytogenes EGD-e
aguuaagaagcg

SEQ ID NO: 2805750 - RNA, 22 nt, Listeria monocytogenes EGD-e
aguuacuccuccaaauuauaau

SEQ ID NO: 2805751 - RNA, 12 nt, Listeria monocytogenes EGD-e
aguuauuucuuu

SEQ ID NO: 2805752 - RNA, 21 nt, Listeria monocytogenes EGD-e
aguucaugacgcgcaucuucg

SEQ ID NO: 2805753 - RNA, 21 nt, Listeria monocytogenes EGD-e
aguuccaucuucuaaugccgc

SEQ ID NO: 2805754 - RNA, 14 nt, Listeria monocytogenes EGD-e
aguucgaauuccgu

SEQ ID NO: 2805755 - RNA, 15 nt, Listeria monocytogenes EGD-e
aguugcauaccuaaa

SEQ ID NO: 2805756 - RNA, 15 nt, Listeria monocytogenes EGD-e
aguugcuuuagaaua

SEQ ID NO: 2805757 - RNA, 17 nt, Listeria monocytogenes EGD-e
aguugguaguuuuaaau

SEQ ID NO: 2805758 - RNA, 18 nt, Listeria monocytogenes EGD-e
aguugguaguuuuaaauu

SEQ ID NO: 2805759 - RNA, 23 nt, Listeria monocytogenes EGD-e
aguuguaaaccguaacuguugaa

SEQ ID NO: 2805760 - RNA, 22 nt, Listeria monocytogenes EGD-e
aguuguucaggguuuguuccac

SEQ ID NO: 2805761 - RNA, 19 nt, Listeria monocytogenes EGD-e
aguuguuccauuuugucaa

SEQ ID NO: 2805762 - RNA, 17 nt, Listeria monocytogenes EGD-e
aguuguugcagcccaac

SEQ ID NO: 2805763 - RNA, 15 nt, Listeria monocytogenes EGD-e
aguuucuguucuuua

SEQ ID NO: 2805764 - RNA, 23 nt, Listeria monocytogenes EGD-e
aguuuguaacaacuaauuuuucg

SEQ ID NO: 2805765 - RNA, 19 nt, Listeria monocytogenes EGD-e
aguuuuaugacaauuaaaa

SEQ ID NO: 2805766 - RNA, 21 nt, Listeria monocytogenes EGD-e
aguuuuuuaauuuuucuucaa

SEQ ID NO: 2805767 - RNA, 19 nt, Listeria monocytogenes EGD-e
aguuuuuuuagaaauaugu

SEQ ID NO: 2805768 - RNA, 20 nt, Listeria monocytogenes EGD-e
auaaaaaaagccaaugaccu

SEQ ID NO: 2805769 - RNA, 12 nt, Listeria monocytogenes EGD-e
auaaaaaaauac

SEQ ID NO: 2805770 - RNA, 20 nt, Listeria monocytogenes EGD-e
auaaaaacacgcagcggacu

SEQ ID NO: 2805771 - RNA, 23 nt, Listeria monocytogenes EGD-e
auaaaaaguaacauagcuacaau

SEQ ID NO: 2805772 - RNA, 20 nt, Listeria monocytogenes EGD-e
auaaaacaaaagauagacac

SEQ ID NO: 2805773 - RNA, 19 nt, Listeria monocytogenes EGD-e
auaaaaccauucaucuaau

SEQ ID NO: 2805774 - RNA, 18 nt, Listeria monocytogenes EGD-e
auaaaagaggauuuucca

SEQ ID NO: 2805775 - RNA, 15 nt, Listeria monocytogenes EGD-e
auaaaaucauaauag

SEQ ID NO: 2805776 - RNA, 18 nt, Listeria monocytogenes EGD-e
auaaaauggauaaaaaaa

SEQ ID NO: 2805777 - RNA, 19 nt, Listeria monocytogenes EGD-e
auaaaauuagugccaugaa

SEQ ID NO: 2805778 - RNA, 17 nt, Listeria monocytogenes EGD-e
auaaaccguuaccauaa

SEQ ID NO: 2805779 - RNA, 22 nt, Listeria monocytogenes EGD-e
auaaacguuccaguuaaacaaa

SEQ ID NO: 2805780 - RNA, 22 nt, Listeria monocytogenes EGD-e
auaaacuaauuacuaaaaaggu

SEQ ID NO: 2805781 - RNA, 17 nt, Listeria monocytogenes EGD-e
auaaagaaauaacuacu

SEQ ID NO: 2805782 - RNA, 17 nt, Listeria monocytogenes EGD-e
auaaagaacuuacagaa

SEQ ID NO: 2805783 - RNA, 13 nt, Listeria monocytogenes EGD-e
auaaaguuaacuu

SEQ ID NO: 2805784 - RNA, 13 nt, Listeria monocytogenes EGD-e
auaaaguuuuuug

SEQ ID NO: 2805785 - RNA, 17 nt, Listeria monocytogenes EGD-e
auaaauaacaagaauaa

SEQ ID NO: 2805786 - RNA, 23 nt, Listeria monocytogenes EGD-e
auaaauaggcccauuaaaaagcu

SEQ ID NO: 2805787 - RNA, 17 nt, Listeria monocytogenes EGD-e
auaaauauagcuucaaa

SEQ ID NO: 2805788 - RNA, 20 nt, Listeria monocytogenes EGD-e
auaaauaugcgcagaaaguu

SEQ ID NO: 2805789 - RNA, 14 nt, Listeria monocytogenes EGD-e
auaaauauuuugca

SEQ ID NO: 2805790 - RNA, 15 nt, Listeria monocytogenes EGD-e
auaaaugcauuucuu

SEQ ID NO: 2805791 - RNA, 16 nt, Listeria monocytogenes EGD-e
auaaauuacugaauaa

SEQ ID NO: 2805792 - RNA, 23 nt, Listeria monocytogenes EGD-e
auaacauuuucucuuguaaaagc

SEQ ID NO: 2805793 - RNA, 17 nt, Listeria monocytogenes EGD-e
auaaccauugauaucca

SEQ ID NO: 2805794 - RNA, 18 nt, Listeria monocytogenes EGD-e
auaaccauugauauccag

SEQ ID NO: 2805795 - RNA, 14 nt, Listeria monocytogenes EGD-e
auaaccccaaaaug

SEQ ID NO: 2805796 - RNA, 15 nt, Listeria monocytogenes EGD-e
auaaccccaaaaugc

SEQ ID NO: 2805797 - RNA, 17 nt, Listeria monocytogenes EGD-e
auaaccgccaaaaagca

SEQ ID NO: 2805798 - RNA, 19 nt, Listeria monocytogenes EGD-e
auaacucaaaguaacuuua

SEQ ID NO: 2805799 - RNA, 15 nt, Listeria monocytogenes EGD-e
auaacuuuccagcgg

SEQ ID NO: 2805800 - RNA, 16 nt, Listeria monocytogenes EGD-e
auaacuuucucuugcu

SEQ ID NO: 2805801 - RNA, 15 nt, Listeria monocytogenes EGD-e
auaacuuuuuuucuu

SEQ ID NO: 2805802 - RNA, 16 nt, Listeria monocytogenes EGD-e
auaagaagauauuuug

SEQ ID NO: 2805803 - RNA, 16 nt, Listeria monocytogenes EGD-e
auaagacauaacaagu

SEQ ID NO: 2805804 - RNA, 19 nt, Listeria monocytogenes EGD-e
auaagcaacgguaaacaac

SEQ ID NO: 2805805 - RNA, 16 nt, Listeria monocytogenes EGD-e
auaagcacaaauuauu

SEQ ID NO: 2805806 - RNA, 17 nt, Listeria monocytogenes EGD-e
auaagcgaauauccgau

SEQ ID NO: 2805807 - RNA, 19 nt, Listeria monocytogenes EGD-e
auaagcggguguccaaaaa

SEQ ID NO: 2805808 - RNA, 20 nt, Listeria monocytogenes EGD-e
auaagcuaacaacaagcaaa

SEQ ID NO: 2805809 - RNA, 14 nt, Listeria monocytogenes EGD-e
auaagcuucauaaa

SEQ ID NO: 2805810 - RNA, 19 nt, Listeria monocytogenes EGD-e
auaaggguuuucagcucuu

SEQ ID NO: 2805811 - RNA, 16 nt, Listeria monocytogenes EGD-e
auaagugaauugaugg

SEQ ID NO: 2805812 - RNA, 20 nt, Listeria monocytogenes EGD-e
auaaguuaaucauuaaauau

SEQ ID NO: 2805813 - RNA, 23 nt, Listeria monocytogenes EGD-e
auaaguuuucauauaaguguuag

SEQ ID NO: 2805814 - RNA, 22 nt, Listeria monocytogenes EGD-e
auaauacaaacuuuuccuucua

SEQ ID NO: 2805815 - RNA, 21 nt, Listeria monocytogenes EGD-e
auaauaccaggaucaaaaugg

SEQ ID NO: 2805816 - RNA, 17 nt, Listeria monocytogenes EGD-e
auaauacgcgccaaaga

SEQ ID NO: 2805817 - RNA, 19 nt, Listeria monocytogenes EGD-e
auaauagguccgauaauac

SEQ ID NO: 2805818 - RNA, 20 nt, Listeria monocytogenes EGD-e
auaauaucuucuauauuaau

SEQ ID NO: 2805819 - RNA, 15 nt, Listeria monocytogenes EGD-e
auaaucaagauuuug

SEQ ID NO: 2805820 - RNA, 19 nt, Listeria monocytogenes EGD-e
auaaucaauaucuuuauuu

SEQ ID NO: 2805821 - RNA, 19 nt, Listeria monocytogenes EGD-e
auaaucaauccgccaacca

SEQ ID NO: 2805822 - RNA, 16 nt, Listeria monocytogenes EGD-e
auaaucccacaaaaaa

SEQ ID NO: 2805823 - RNA, 14 nt, Listeria monocytogenes EGD-e
auaaugcagauuaa

SEQ ID NO: 2805824 - RNA, 21 nt, Listeria monocytogenes EGD-e
auaauggaaaaauaaucacgu

SEQ ID NO: 2805825 - RNA, 13 nt, Listeria monocytogenes EGD-e
auaauuauuuuug

SEQ ID NO: 2805826 - RNA, 15 nt, Listeria monocytogenes EGD-e
auaauuccauuuaau

SEQ ID NO: 2805827 - RNA, 17 nt, Listeria monocytogenes EGD-e
auaauuccauuuaauuu

SEQ ID NO: 2805828 - RNA, 21 nt, Listeria monocytogenes EGD-e
auaauucggcaaacagcuuuu

SEQ ID NO: 2805829 - RNA, 17 nt, Listeria monocytogenes EGD-e
auaauucugcuaacagc

SEQ ID NO: 2805830 - RNA, 21 nt, Listeria monocytogenes EGD-e
auaauuuucauuuguuucuuu

SEQ ID NO: 2805831 - RNA, 15 nt, Listeria monocytogenes EGD-e
auacaaacuuuuccu

SEQ ID NO: 2805832 - RNA, 14 nt, Listeria monocytogenes EGD-e
auacaacaaaauaa

SEQ ID NO: 2805833 - RNA, 18 nt, Listeria monocytogenes EGD-e
auacaauuaauaauaaug

SEQ ID NO: 2805834 - RNA, 15 nt, Listeria monocytogenes EGD-e
auacacaaaguaaaa

SEQ ID NO: 2805835 - RNA, 15 nt, Listeria monocytogenes EGD-e
auacacauaggucag

SEQ ID NO: 2805836 - RNA, 18 nt, Listeria monocytogenes EGD-e
auacacauaggucaggau

SEQ ID NO: 2805837 - RNA, 13 nt, Listeria monocytogenes EGD-e
auacauugaaaaa

SEQ ID NO: 2805838 - RNA, 23 nt, Listeria monocytogenes EGD-e
auacccggcugggaguuuuuuau

SEQ ID NO: 2805839 - RNA, 12 nt, Listeria monocytogenes EGD-e
auacccuuuuuu

SEQ ID NO: 2805840 - RNA, 13 nt, Listeria monocytogenes EGD-e
auaccuaaagcau

SEQ ID NO: 2805841 - RNA, 23 nt, Listeria monocytogenes EGD-e
auacgaacaaacguucuugaaau

SEQ ID NO: 2805842 - RNA, 21 nt, Listeria monocytogenes EGD-e
auacgugaaaaucuuguugcg

SEQ ID NO: 2805843 - RNA, 17 nt, Listeria monocytogenes EGD-e
auacuaacgcuuuuuca

SEQ ID NO: 2805844 - RNA, 22 nt, Listeria monocytogenes EGD-e
auacuauugaauguucuaaaau

SEQ ID NO: 2805845 - RNA, 19 nt, Listeria monocytogenes EGD-e
auacuguuuuugauuuaau

SEQ ID NO: 2805846 - RNA, 20 nt, Listeria monocytogenes EGD-e
auacuuuuuucuauauucau

SEQ ID NO: 2805847 - RNA, 19 nt, Listeria monocytogenes EGD-e
auagagcgaauaagugaau

SEQ ID NO: 2805848 - RNA, 17 nt, Listeria monocytogenes EGD-e
auagagcuuuuaaauau

SEQ ID NO: 2805849 - RNA, 20 nt, Listeria monocytogenes EGD-e
auagauacucuuuaaaucca

SEQ ID NO: 2805850 - RNA, 22 nt, Listeria monocytogenes EGD-e
auagauacucuuuaaauccauu

SEQ ID NO: 2805851 - RNA, 13 nt, Listeria monocytogenes EGD-e
auagauugauguu

SEQ ID NO: 2805852 - RNA, 14 nt, Listeria monocytogenes EGD-e
auagcagagcucca

SEQ ID NO: 2805853 - RNA, 16 nt, Listeria monocytogenes EGD-e
auagcauaauagaaag

SEQ ID NO: 2805854 - RNA, 20 nt, Listeria monocytogenes EGD-e
auagcuuaaagguuuuguuu

SEQ ID NO: 2805855 - RNA, 13 nt, Listeria monocytogenes EGD-e
auagcuucaaacg

SEQ ID NO: 2805856 - RNA, 21 nt, Listeria monocytogenes EGD-e
auagcuucaaacgcagguuca

SEQ ID NO: 2805857 - RNA, 16 nt, Listeria monocytogenes EGD-e
auagcuuuaucuuuuc

SEQ ID NO: 2805858 - RNA, 14 nt, Listeria monocytogenes EGD-e
auagcuuugucuua

SEQ ID NO: 2805859 - RNA, 15 nt, Listeria monocytogenes EGD-e
auaggaauuuggugc

SEQ ID NO: 2805860 - RNA, 22 nt, Listeria monocytogenes EGD-e
auaggaauuuggugcaagccgu

SEQ ID NO: 2805861 - RNA, 22 nt, Listeria monocytogenes EGD-e
auagguugggcugcaacaacua

SEQ ID NO: 2805862 - RNA, 17 nt, Listeria monocytogenes EGD-e
auagucuacuuuuaaaa

SEQ ID NO: 2805863 - RNA, 13 nt, Listeria monocytogenes EGD-e
auaguuguuccau

SEQ ID NO: 2805864 - RNA, 17 nt, Listeria monocytogenes EGD-e
auaguuuucuacuacac

SEQ ID NO: 2805865 - RNA, 20 nt, Listeria monocytogenes EGD-e
auauaaaacaguauuccuca

SEQ ID NO: 2805866 - RNA, 16 nt, Listeria monocytogenes EGD-e
auauaagcugacaguu

SEQ ID NO: 2805867 - RNA, 21 nt, Listeria monocytogenes EGD-e
auauaaucuacuguauauguu

SEQ ID NO: 2805868 - RNA, 15 nt, Listeria monocytogenes EGD-e
auauaauuuuuucau

SEQ ID NO: 2805869 - RNA, 11 nt, Listeria monocytogenes EGD-e
auauagcuuca

SEQ ID NO: 2805870 - RNA, 21 nt, Listeria monocytogenes EGD-e
auauagucuacuuuuaaaauu

SEQ ID NO: 2805871 - RNA, 10 nt, Listeria monocytogenes EGD-e
auauauguag

SEQ ID NO: 2805872 - RNA, 13 nt, Listeria monocytogenes EGD-e
auauauucaaaau

SEQ ID NO: 2805873 - RNA, 16 nt, Listeria monocytogenes EGD-e
auaucaaaguaaaaua

SEQ ID NO: 2805874 - RNA, 10 nt, Listeria monocytogenes EGD-e
auaucaccaa

SEQ ID NO: 2805875 - RNA, 16 nt, Listeria monocytogenes EGD-e
auaucaccaacaauua

SEQ ID NO: 2805876 - RNA, 21 nt, Listeria monocytogenes EGD-e
auaucaucaauaaaaugcaca

SEQ ID NO: 2805877 - RNA, 23 nt, Listeria monocytogenes EGD-e
auaucaucaauaaaaugcacaug

SEQ ID NO: 2805878 - RNA, 16 nt, Listeria monocytogenes EGD-e
auauccaguauuuccc

SEQ ID NO: 2805879 - RNA, 19 nt, Listeria monocytogenes EGD-e
auauccauaaagcuaagca

SEQ ID NO: 2805880 - RNA, 21 nt, Listeria monocytogenes EGD-e
auauccauugcaaucaucuua

SEQ ID NO: 2805881 - RNA, 16 nt, Listeria monocytogenes EGD-e
auauccuaacuccugc

SEQ ID NO: 2805882 - RNA, 17 nt, Listeria monocytogenes EGD-e
auauccuaacuccugca

SEQ ID NO: 2805883 - RNA, 19 nt, Listeria monocytogenes EGD-e
auaucuacaggcuauucca

SEQ ID NO: 2805884 - RNA, 23 nt, Listeria monocytogenes EGD-e
auaucuacaggcuauuccagcua

SEQ ID NO: 2805885 - RNA, 16 nt, Listeria monocytogenes EGD-e
auaucuuuauuuuuug

SEQ ID NO: 2805886 - RNA, 16 nt, Listeria monocytogenes EGD-e
auaucuuuugagauaa

SEQ ID NO: 2805887 - RNA, 22 nt, Listeria monocytogenes EGD-e
auaugauaaccgcuaucuacau

SEQ ID NO: 2805888 - RNA, 22 nt, Listeria monocytogenes EGD-e
auaugcagguaaaacagcaagu

SEQ ID NO: 2805889 - RNA, 17 nt, Listeria monocytogenes EGD-e
auauggacauacuucau

SEQ ID NO: 2805890 - RNA, 22 nt, Listeria monocytogenes EGD-e
auauggacauacuucaugugcu

SEQ ID NO: 2805891 - RNA, 16 nt, Listeria monocytogenes EGD-e
auauuaaugucaauua

SEQ ID NO: 2805892 - RNA, 14 nt, Listeria monocytogenes EGD-e
auauucaaaauggu

SEQ ID NO: 2805893 - RNA, 9 nt, Listeria monocytogenes EGD-e
auauucauu

SEQ ID NO: 2805894 - RNA, 20 nt, Listeria monocytogenes EGD-e
auauuccaaaaucgcauccu

SEQ ID NO: 2805895 - RNA, 13 nt, Listeria monocytogenes EGD-e
auauucuucuaaa

SEQ ID NO: 2805896 - RNA, 17 nt, Listeria monocytogenes EGD-e
auauucuucuaaaauaa

SEQ ID NO: 2805897 - RNA, 22 nt, Listeria monocytogenes EGD-e
auauucuucugucacaucuguu

SEQ ID NO: 2805898 - RNA, 12 nt, Listeria monocytogenes EGD-e
auauuuucucua

SEQ ID NO: 2805899 - RNA, 19 nt, Listeria monocytogenes EGD-e
auauuuugcucaagugaac

SEQ ID NO: 2805900 - RNA, 21 nt, Listeria monocytogenes EGD-e
auauuuugcucaagugaacgu

SEQ ID NO: 2805901 - RNA, 13 nt, Listeria monocytogenes EGD-e
aucaaaauucagu

SEQ ID NO: 2805902 - RNA, 19 nt, Listeria monocytogenes EGD-e
aucaaaauucaguuuauaa

SEQ ID NO: 2805903 - RNA, 12 nt, Listeria monocytogenes EGD-e
aucaaacaaaaa

SEQ ID NO: 2805904 - RNA, 22 nt, Listeria monocytogenes EGD-e
aucaaaguaaaauacguugucu

SEQ ID NO: 2805905 - RNA, 13 nt, Listeria monocytogenes EGD-e
aucaaauaaccau

SEQ ID NO: 2805906 - RNA, 14 nt, Listeria monocytogenes EGD-e
aucaaauacaugac

SEQ ID NO: 2805907 - RNA, 16 nt, Listeria monocytogenes EGD-e
aucaaauccaagcaca

SEQ ID NO: 2805908 - RNA, 17 nt, Listeria monocytogenes EGD-e
aucaaauccaagcacau

SEQ ID NO: 2805909 - RNA, 15 nt, Listeria monocytogenes EGD-e
aucaaaugcacagca

SEQ ID NO: 2805910 - RNA, 23 nt, Listeria monocytogenes EGD-e
aucaaaugcacagcagaaacuuu

SEQ ID NO: 2805911 - RNA, 12 nt, Listeria monocytogenes EGD-e
aucaaccacuuu

SEQ ID NO: 2805912 - RNA, 19 nt, Listeria monocytogenes EGD-e
aucaacgggcgcuuucaca

SEQ ID NO: 2805913 - RNA, 23 nt, Listeria monocytogenes EGD-e
aucaacgggcgcuuucacaucuu

SEQ ID NO: 2805914 - RNA, 15 nt, Listeria monocytogenes EGD-e
aucaagaaauuaaau

SEQ ID NO: 2805915 - RNA, 17 nt, Listeria monocytogenes EGD-e
aucaagauuuugcucag

SEQ ID NO: 2805916 - RNA, 14 nt, Listeria monocytogenes EGD-e
aucaagauuuugua

SEQ ID NO: 2805917 - RNA, 21 nt, Listeria monocytogenes EGD-e
aucaagauuuuguacauaaaa

SEQ ID NO: 2805918 - RNA, 20 nt, Listeria monocytogenes EGD-e
aucaagcguaccauucacuu

SEQ ID NO: 2805919 - RNA, 15 nt, Listeria monocytogenes EGD-e
aucaagggaagcuuu

SEQ ID NO: 2805920 - RNA, 16 nt, Listeria monocytogenes EGD-e
aucaagggaagcuuuu

SEQ ID NO: 2805921 - RNA, 16 nt, Listeria monocytogenes EGD-e
aucaauaaagaagcau

SEQ ID NO: 2805922 - RNA, 15 nt, Listeria monocytogenes EGD-e
aucaauaaauccagc

SEQ ID NO: 2805923 - RNA, 21 nt, Listeria monocytogenes EGD-e
aucaauaacaauccaaccauu

SEQ ID NO: 2805924 - RNA, 22 nt, Listeria monocytogenes EGD-e
aucaauaucggcauuugaauaa

SEQ ID NO: 2805925 - RNA, 17 nt, Listeria monocytogenes EGD-e
aucaauaucuuuauuuu

SEQ ID NO: 2805926 - RNA, 19 nt, Listeria monocytogenes EGD-e
aucaauaucuuuauuuuuu

SEQ ID NO: 2805927 - RNA, 13 nt, Listeria monocytogenes EGD-e
aucaaucaucacg

SEQ ID NO: 2805928 - RNA, 11 nt, Listeria monocytogenes EGD-e
aucaauccgcc

SEQ ID NO: 2805929 - RNA, 20 nt, Listeria monocytogenes EGD-e
aucaauugguuuuacaccau

SEQ ID NO: 2805930 - RNA, 16 nt, Listeria monocytogenes EGD-e
aucacuaauuagcaua

SEQ ID NO: 2805931 - RNA, 20 nt, Listeria monocytogenes EGD-e
aucacuauugaaugucacuu

SEQ ID NO: 2805932 - RNA, 13 nt, Listeria monocytogenes EGD-e
aucauaaucccag

SEQ ID NO: 2805933 - RNA, 18 nt, Listeria monocytogenes EGD-e
aucauaaucccaguagua

SEQ ID NO: 2805934 - RNA, 23 nt, Listeria monocytogenes EGD-e
aucauauucuucuaaaauaacau

SEQ ID NO: 2805935 - RNA, 16 nt, Listeria monocytogenes EGD-e
aucaucaauaauaaua

SEQ ID NO: 2805936 - RNA, 12 nt, Listeria monocytogenes EGD-e
aucaucaauuaa

SEQ ID NO: 2805937 - RNA, 15 nt, Listeria monocytogenes EGD-e
aucaucaauuaaauu

SEQ ID NO: 2805938 - RNA, 23 nt, Listeria monocytogenes EGD-e
aucaugccagcuucuuccauuug

SEQ ID NO: 2805939 - RNA, 20 nt, Listeria monocytogenes EGD-e
aucaugccuucaaacacuuc

SEQ ID NO: 2805940 - RNA, 20 nt, Listeria monocytogenes EGD-e
aucauggaaacgacauccuu

SEQ ID NO: 2805941 - RNA, 17 nt, Listeria monocytogenes EGD-e
aucauuaaauauacaca

SEQ ID NO: 2805942 - RNA, 14 nt, Listeria monocytogenes EGD-e
aucauuaaauuuag

SEQ ID NO: 2805943 - RNA, 15 nt, Listeria monocytogenes EGD-e
aucauuaaccuacuu

SEQ ID NO: 2805944 - RNA, 17 nt, Listeria monocytogenes EGD-e
aucauuaauauaaagau

SEQ ID NO: 2805945 - RNA, 16 nt, Listeria monocytogenes EGD-e
aucauugcuuuguguu

SEQ ID NO: 2805946 - RNA, 17 nt, Listeria monocytogenes EGD-e
aucauuuauuuucccuc

SEQ ID NO: 2805947 - RNA, 13 nt, Listeria monocytogenes EGD-e
auccaaacacgaa

SEQ ID NO: 2805948 - RNA, 13 nt, Listeria monocytogenes EGD-e
auccaauuucugu

SEQ ID NO: 2805949 - RNA, 21 nt, Listeria monocytogenes EGD-e
auccacauaacggaaauuccc

SEQ ID NO: 2805950 - RNA, 22 nt, Listeria monocytogenes EGD-e
auccacauaacggaaauucccg

SEQ ID NO: 2805951 - RNA, 17 nt, Listeria monocytogenes EGD-e
auccacgauggaaccau

SEQ ID NO: 2805952 - RNA, 18 nt, Listeria monocytogenes EGD-e
auccagcgucuaaaaaug

SEQ ID NO: 2805953 - RNA, 16 nt, Listeria monocytogenes EGD-e
auccagcguuaaucuu

SEQ ID NO: 2805954 - RNA, 21 nt, Listeria monocytogenes EGD-e
auccauguuguuuuagauaag

SEQ ID NO: 2805955 - RNA, 18 nt, Listeria monocytogenes EGD-e
auccauuucauucuuuuu

SEQ ID NO: 2805956 - RNA, 13 nt, Listeria monocytogenes EGD-e
auccauuuuucuu

SEQ ID NO: 2805957 - RNA, 12 nt, Listeria monocytogenes EGD-e
aucccaauagaa

SEQ ID NO: 2805958 - RNA, 17 nt, Listeria monocytogenes EGD-e
aucccacaaaaaauacg

SEQ ID NO: 2805959 - RNA, 15 nt, Listeria monocytogenes EGD-e
aucccagcuuuuccu

SEQ ID NO: 2805960 - RNA, 18 nt, Listeria monocytogenes EGD-e
auccgucacgucccauug

SEQ ID NO: 2805961 - RNA, 19 nt, Listeria monocytogenes EGD-e
auccuaacuccugcauugu

SEQ ID NO: 2805962 - RNA, 22 nt, Listeria monocytogenes EGD-e
auccucauauuuggccaauuaa

SEQ ID NO: 2805963 - RNA, 17 nt, Listeria monocytogenes EGD-e
auccuguaauucgaaua

SEQ ID NO: 2805964 - RNA, 21 nt, Listeria monocytogenes EGD-e
auccuuggaaaaaugauucua

SEQ ID NO: 2805965 - RNA, 20 nt, Listeria monocytogenes EGD-e
auccuuguuguucuaauaau

SEQ ID NO: 2805966 - RNA, 14 nt, Listeria monocytogenes EGD-e
aucgaggaaguugc

SEQ ID NO: 2805967 - RNA, 23 nt, Listeria monocytogenes EGD-e
aucgauguuaccacgaguugcuu

SEQ ID NO: 2805968 - RNA, 17 nt, Listeria monocytogenes EGD-e
aucgcaaaagcaaacaa

SEQ ID NO: 2805969 - RNA, 13 nt, Listeria monocytogenes EGD-e
aucgcagggcaga

SEQ ID NO: 2805970 - RNA, 18 nt, Listeria monocytogenes EGD-e
aucgcagggcagaaaaca

SEQ ID NO: 2805971 - RNA, 21 nt, Listeria monocytogenes EGD-e
aucgcagggcagaaaacagaa

SEQ ID NO: 2805972 - RNA, 14 nt, Listeria monocytogenes EGD-e
aucgccaaagccag

SEQ ID NO: 2805973 - RNA, 17 nt, Listeria monocytogenes EGD-e
aucgcgguagcuucaau

SEQ ID NO: 2805974 - RNA, 20 nt, Listeria monocytogenes EGD-e
aucggggaaauaguuuuguc

SEQ ID NO: 2805975 - RNA, 17 nt, Listeria monocytogenes EGD-e
aucguugugcuuucccc

SEQ ID NO: 2805976 - RNA, 20 nt, Listeria monocytogenes EGD-e
aucguuuuaaagcuugauuu

SEQ ID NO: 2805977 - RNA, 13 nt, Listeria monocytogenes EGD-e
aucuaaaaucauu

SEQ ID NO: 2805978 - RNA, 16 nt, Listeria monocytogenes EGD-e
aucuaaaaucauuaaa

SEQ ID NO: 2805979 - RNA, 19 nt, Listeria monocytogenes EGD-e
aucuacaacuagauuuuca

SEQ ID NO: 2805980 - RNA, 22 nt, Listeria monocytogenes EGD-e
aucuacagguguauucgucuuu

SEQ ID NO: 2805981 - RNA, 17 nt, Listeria monocytogenes EGD-e
aucuaguacgaaaucaa

SEQ ID NO: 2805982 - RNA, 21 nt, Listeria monocytogenes EGD-e
aucuaguacgaaaucaaacuu

SEQ ID NO: 2805983 - RNA, 22 nt, Listeria monocytogenes EGD-e
aucuaguagcaauuuuaaaucu

SEQ ID NO: 2805984 - RNA, 16 nt, Listeria monocytogenes EGD-e
aucucacaauuuaagu

SEQ ID NO: 2805985 - RNA, 19 nt, Listeria monocytogenes EGD-e
aucucaucaccagcuucua

SEQ ID NO: 2805986 - RNA, 19 nt, Listeria monocytogenes EGD-e
aucuccgaauacuuucaau

SEQ ID NO: 2805987 - RNA, 22 nt, Listeria monocytogenes EGD-e
aucugaacugacuagaaauuaa

SEQ ID NO: 2805988 - RNA, 15 nt, Listeria monocytogenes EGD-e
aucugagaagccagc

SEQ ID NO: 2805989 - RNA, 13 nt, Listeria monocytogenes EGD-e
aucugauuaaaag

SEQ ID NO: 2805990 - RNA, 21 nt, Listeria monocytogenes EGD-e
aucugcuaauacuauugaaug

SEQ ID NO: 2805991 - RNA, 22 nt, Listeria monocytogenes EGD-e
aucugcuucguccagcugcuuc

SEQ ID NO: 2805992 - RNA, 15 nt, Listeria monocytogenes EGD-e
aucuggauaaaaaua

SEQ ID NO: 2805993 - RNA, 16 nt, Listeria monocytogenes EGD-e
aucuggauaaaaauaa

SEQ ID NO: 2805994 - RNA, 15 nt, Listeria monocytogenes EGD-e
aucugggcucguugc

SEQ ID NO: 2805995 - RNA, 13 nt, Listeria monocytogenes EGD-e
aucuguacuccuu

SEQ ID NO: 2805996 - RNA, 21 nt, Listeria monocytogenes EGD-e
aucuuccgcuucggcaacaag

SEQ ID NO: 2805997 - RNA, 18 nt, Listeria monocytogenes EGD-e
aucuucuagcgucacaau

SEQ ID NO: 2805998 - RNA, 16 nt, Listeria monocytogenes EGD-e
aucuugacuuuguuaa

SEQ ID NO: 2805999 - RNA, 14 nt, Listeria monocytogenes EGD-e
aucuugaugccauc

SEQ ID NO: 2806000 - RNA, 14 nt, Listeria monocytogenes EGD-e
aucuuuauaaaaug

SEQ ID NO: 2806001 - RNA, 17 nt, Listeria monocytogenes EGD-e
aucuuuauaaaaugcau

SEQ ID NO: 2806002 - RNA, 22 nt, Listeria monocytogenes EGD-e
aucuuucaaacguuccgauaca

SEQ ID NO: 2806003 - RNA, 15 nt, Listeria monocytogenes EGD-e
aucuuuuaucuuccc

SEQ ID NO: 2806004 - RNA, 16 nt, Listeria monocytogenes EGD-e
aucuuuuaucuucccc

SEQ ID NO: 2806005 - RNA, 15 nt, Listeria monocytogenes EGD-e
aucuuuuccaaaaug

SEQ ID NO: 2806006 - RNA, 13 nt, Listeria monocytogenes EGD-e
aucuuuuccuucu

SEQ ID NO: 2806007 - RNA, 15 nt, Listeria monocytogenes EGD-e
aucuuuugagauaau

SEQ ID NO: 2806008 - RNA, 21 nt, Listeria monocytogenes EGD-e
augaaaacuuaucucuucauu

SEQ ID NO: 2806009 - RNA, 23 nt, Listeria monocytogenes EGD-e
augaaaagacaccaauuucuguu

SEQ ID NO: 2806010 - RNA, 22 nt, Listeria monocytogenes EGD-e
augaaaccaaauaugcuauaca

SEQ ID NO: 2806011 - RNA, 21 nt, Listeria monocytogenes EGD-e
augaaacuuuaacaaaaguca

SEQ ID NO: 2806012 - RNA, 19 nt, Listeria monocytogenes EGD-e
augaacacccgguccuuca

SEQ ID NO: 2806013 - RNA, 20 nt, Listeria monocytogenes EGD-e
augaacacccgguccuucaa

SEQ ID NO: 2806014 - RNA, 20 nt, Listeria monocytogenes EGD-e
augaagagauaaguuuucau

SEQ ID NO: 2806015 - RNA, 13 nt, Listeria monocytogenes EGD-e
augaauagauauu

SEQ ID NO: 2806016 - RNA, 22 nt, Listeria monocytogenes EGD-e
augaauagauauucucuuauga

SEQ ID NO: 2806017 - RNA, 13 nt, Listeria monocytogenes EGD-e
augaauauuagaa

SEQ ID NO: 2806018 - RNA, 20 nt, Listeria monocytogenes EGD-e
augaauauuagaaaaucauu

SEQ ID NO: 2806019 - RNA, 17 nt, Listeria monocytogenes EGD-e
augaauucugggugaua

SEQ ID NO: 2806020 - RNA, 22 nt, Listeria monocytogenes EGD-e
augacagcaucuuuuucuugcu

SEQ ID NO: 2806021 - RNA, 23 nt, Listeria monocytogenes EGD-e
augacaucuucuagcgucacaau

SEQ ID NO: 2806022 - RNA, 14 nt, Listeria monocytogenes EGD-e
augaccaaaucugc

SEQ ID NO: 2806023 - RNA, 16 nt, Listeria monocytogenes EGD-e
augacgcucuucuaca

SEQ ID NO: 2806024 - RNA, 18 nt, Listeria monocytogenes EGD-e
augagaguuauaaagaaa

SEQ ID NO: 2806025 - RNA, 19 nt, Listeria monocytogenes EGD-e
augagaguuauaaagaaau

SEQ ID NO: 2806026 - RNA, 21 nt, Listeria monocytogenes EGD-e
augagaguuauaaagaaauaa

SEQ ID NO: 2806027 - RNA, 18 nt, Listeria monocytogenes EGD-e
augagcaaucguauguuu

SEQ ID NO: 2806028 - RNA, 14 nt, Listeria monocytogenes EGD-e
augagcuaauuuuu

SEQ ID NO: 2806029 - RNA, 18 nt, Listeria monocytogenes EGD-e
augaguggcggauaaggu

SEQ ID NO: 2806030 - RNA, 12 nt, Listeria monocytogenes EGD-e
augauaaccaga

SEQ ID NO: 2806031 - RNA, 19 nt, Listeria monocytogenes EGD-e
augauaaccgcuaucuaca

SEQ ID NO: 2806032 - RNA, 21 nt, Listeria monocytogenes EGD-e
augauaaugugaccuuaaauu

SEQ ID NO: 2806033 - RNA, 13 nt, Listeria monocytogenes EGD-e
augauccgaacca

SEQ ID NO: 2806034 - RNA, 14 nt, Listeria monocytogenes EGD-e
augaugaaaagaca

SEQ ID NO: 2806035 - RNA, 22 nt, Listeria monocytogenes EGD-e
augaugguuuuggguauauuuu

SEQ ID NO: 2806036 - RNA, 17 nt, Listeria monocytogenes EGD-e
augauucaaagcuacuu

SEQ ID NO: 2806037 - RNA, 15 nt, Listeria monocytogenes EGD-e
augauucuaguuugu

SEQ ID NO: 2806038 - RNA, 17 nt, Listeria monocytogenes EGD-e
augauuguucuuuaaaa

SEQ ID NO: 2806039 - RNA, 15 nt, Listeria monocytogenes EGD-e
augauuuucauuaaa

SEQ ID NO: 2806040 - RNA, 18 nt, Listeria monocytogenes EGD-e
augcaaaaccucuuuuuu

SEQ ID NO: 2806041 - RNA, 22 nt, Listeria monocytogenes EGD-e
augcacuuucaaaucagcuucc

SEQ ID NO: 2806042 - RNA, 21 nt, Listeria monocytogenes EGD-e
augcagauuaacccaauuuug

SEQ ID NO: 2806043 - RNA, 16 nt, Listeria monocytogenes EGD-e
augcauggaacgguau

SEQ ID NO: 2806044 - RNA, 16 nt, Listeria monocytogenes EGD-e
augcgaaaaaugaaaa

SEQ ID NO: 2806045 - RNA, 12 nt, Listeria monocytogenes EGD-e
augcgcauguuu

SEQ ID NO: 2806046 - RNA, 19 nt, Listeria monocytogenes EGD-e
augcgguaacuaaaauauu

SEQ ID NO: 2806047 - RNA, 13 nt, Listeria monocytogenes EGD-e
augcuaaauaaaa

SEQ ID NO: 2806048 - RNA, 12 nt, Listeria monocytogenes EGD-e
augcuaggccua

SEQ ID NO: 2806049 - RNA, 20 nt, Listeria monocytogenes EGD-e
augcugaauguuuucuucca

SEQ ID NO: 2806050 - RNA, 19 nt, Listeria monocytogenes EGD-e
augcuucgacguuuaauuc

SEQ ID NO: 2806051 - RNA, 15 nt, Listeria monocytogenes EGD-e
auggaaccauucacu

SEQ ID NO: 2806052 - RNA, 15 nt, Listeria monocytogenes EGD-e
auggagcuauuguaa

SEQ ID NO: 2806053 - RNA, 19 nt, Listeria monocytogenes EGD-e
auggaguuuguaacaacua

SEQ ID NO: 2806054 - RNA, 15 nt, Listeria monocytogenes EGD-e
auggcauaaaaaauc

SEQ ID NO: 2806055 - RNA, 13 nt, Listeria monocytogenes EGD-e
auggggauuuuac

SEQ ID NO: 2806056 - RNA, 16 nt, Listeria monocytogenes EGD-e
augguauacuauacaa

SEQ ID NO: 2806057 - RNA, 22 nt, Listeria monocytogenes EGD-e
augguauuguuuuuugauuuuu

SEQ ID NO: 2806058 - RNA, 15 nt, Listeria monocytogenes EGD-e
augguucaaaaagau

SEQ ID NO: 2806059 - RNA, 19 nt, Listeria monocytogenes EGD-e
auguaauucuaaauaaaua

SEQ ID NO: 2806060 - RNA, 21 nt, Listeria monocytogenes EGD-e
auguauacacuaguauuccua

SEQ ID NO: 2806061 - RNA, 22 nt, Listeria monocytogenes EGD-e
auguauauuccggaaugcgcgc

SEQ ID NO: 2806062 - RNA, 17 nt, Listeria monocytogenes EGD-e
auguaucuaaaaucauu

SEQ ID NO: 2806063 - RNA, 18 nt, Listeria monocytogenes EGD-e
auguccaagcacagcaau

SEQ ID NO: 2806064 - RNA, 14 nt, Listeria monocytogenes EGD-e
augucguaugcuuu

SEQ ID NO: 2806065 - RNA, 21 nt, Listeria monocytogenes EGD-e
augucguaugcuuuaugaagu

SEQ ID NO: 2806066 - RNA, 14 nt, Listeria monocytogenes EGD-e
augucuuuuugugu

SEQ ID NO: 2806067 - RNA, 20 nt, Listeria monocytogenes EGD-e
auguuaccacgaguugcuuu

SEQ ID NO: 2806068 - RNA, 13 nt, Listeria monocytogenes EGD-e
auguucuaaaaua

SEQ ID NO: 2806069 - RNA, 19 nt, Listeria monocytogenes EGD-e
auuaaaaaggaauuuuucc

SEQ ID NO: 2806070 - RNA, 19 nt, Listeria monocytogenes EGD-e
auuaaaaggacacccauaa

SEQ ID NO: 2806071 - RNA, 16 nt, Listeria monocytogenes EGD-e
auuaaaaguuguauag

SEQ ID NO: 2806072 - RNA, 19 nt, Listeria monocytogenes EGD-e
auuaaaauaguuuuuuuca

SEQ ID NO: 2806073 - RNA, 19 nt, Listeria monocytogenes EGD-e
auuaaaugaccaaugcuuu

SEQ ID NO: 2806074 - RNA, 13 nt, Listeria monocytogenes EGD-e
auuaaauuauaca

SEQ ID NO: 2806075 - RNA, 16 nt, Listeria monocytogenes EGD-e
auuaaauuuuuuugaa

SEQ ID NO: 2806076 - RNA, 18 nt, Listeria monocytogenes EGD-e
auuaaauuuuuuugaaaa

SEQ ID NO: 2806077 - RNA, 21 nt, Listeria monocytogenes EGD-e
auuaaauuuuuuugaaaaaac

SEQ ID NO: 2806078 - RNA, 15 nt, Listeria monocytogenes EGD-e
auuaagaaguacaau

SEQ ID NO: 2806079 - RNA, 23 nt, Listeria monocytogenes EGD-e
auuaauaaugauuucuauaaaaa

SEQ ID NO: 2806080 - RNA, 19 nt, Listeria monocytogenes EGD-e
auuaauaguauaaggauac

SEQ ID NO: 2806081 - RNA, 14 nt, Listeria monocytogenes EGD-e
auuaaugauuucaa

SEQ ID NO: 2806082 - RNA, 17 nt, Listeria monocytogenes EGD-e
auuaaugccaguauuuu

SEQ ID NO: 2806083 - RNA, 22 nt, Listeria monocytogenes EGD-e
auuaccuaaugaauaagcaauu

SEQ ID NO: 2806084 - RNA, 23 nt, Listeria monocytogenes EGD-e
auuacggaucgcgguagcuucaa

SEQ ID NO: 2806085 - RNA, 14 nt, Listeria monocytogenes EGD-e
auuacucgguucaa

SEQ ID NO: 2806086 - RNA, 13 nt, Listeria monocytogenes EGD-e
auuagacaaaaag

SEQ ID NO: 2806087 - RNA, 15 nt, Listeria monocytogenes EGD-e
auuagacaaaaagaa

SEQ ID NO: 2806088 - RNA, 18 nt, Listeria monocytogenes EGD-e
auuagugccaugaauauu

SEQ ID NO: 2806089 - RNA, 18 nt, Listeria monocytogenes EGD-e
auuauaaaaaguaacaua

SEQ ID NO: 2806090 - RNA, 16 nt, Listeria monocytogenes EGD-e
auuauaaaaaguggcu

SEQ ID NO: 2806091 - RNA, 18 nt, Listeria monocytogenes EGD-e
auuauacaauuaauaaua

SEQ ID NO: 2806092 - RNA, 19 nt, Listeria monocytogenes EGD-e
auuauacaauuaauaauaa

SEQ ID NO: 2806093 - RNA, 13 nt, Listeria monocytogenes EGD-e
auuauacauuucc

SEQ ID NO: 2806094 - RNA, 15 nt, Listeria monocytogenes EGD-e
auuauacuauaaaga

SEQ ID NO: 2806095 - RNA, 17 nt, Listeria monocytogenes EGD-e
auuauauuuuagcuauu

SEQ ID NO: 2806096 - RNA, 15 nt, Listeria monocytogenes EGD-e
auuauccuguaauuc

SEQ ID NO: 2806097 - RNA, 23 nt, Listeria monocytogenes EGD-e
auuauccuguaauucgaauaaga

SEQ ID NO: 2806098 - RNA, 16 nt, Listeria monocytogenes EGD-e
auuaugauuuguuucu

SEQ ID NO: 2806099 - RNA, 17 nt, Listeria monocytogenes EGD-e
auuaugauuuguuucug

SEQ ID NO: 2806100 - RNA, 19 nt, Listeria monocytogenes EGD-e
auuauggcauaaaaaaucu

SEQ ID NO: 2806101 - RNA, 14 nt, Listeria monocytogenes EGD-e
auuauuuugcuaaa

SEQ ID NO: 2806102 - RNA, 14 nt, Listeria monocytogenes EGD-e
auuauuuuuguaau

SEQ ID NO: 2806103 - RNA, 15 nt, Listeria monocytogenes EGD-e
auucaaagcuacuuu

SEQ ID NO: 2806104 - RNA, 16 nt, Listeria monocytogenes EGD-e
auucaauuuauauuuu

SEQ ID NO: 2806105 - RNA, 18 nt, Listeria monocytogenes EGD-e
auucacgguguugaauaa

SEQ ID NO: 2806106 - RNA, 16 nt, Listeria monocytogenes EGD-e
auucaguuuauaaaua

SEQ ID NO: 2806107 - RNA, 14 nt, Listeria monocytogenes EGD-e
auucauaaacaaaa

SEQ ID NO: 2806108 - RNA, 19 nt, Listeria monocytogenes EGD-e
auucauauaaaguuuuuug

SEQ ID NO: 2806109 - RNA, 15 nt, Listeria monocytogenes EGD-e
auucaucuaauuuag

SEQ ID NO: 2806110 - RNA, 22 nt, Listeria monocytogenes EGD-e
auucauuauuaaacucauaacg

SEQ ID NO: 2806111 - RNA, 22 nt, Listeria monocytogenes EGD-e
auuccaaaaucgcauccucaaa

SEQ ID NO: 2806112 - RNA, 22 nt, Listeria monocytogenes EGD-e
auucccacagaucaaaagcaaa

SEQ ID NO: 2806113 - RNA, 16 nt, Listeria monocytogenes EGD-e
auucccuuuuuuuacu

SEQ ID NO: 2806114 - RNA, 15 nt, Listeria monocytogenes EGD-e
auuccguucauuuga

SEQ ID NO: 2806115 - RNA, 23 nt, Listeria monocytogenes EGD-e
auuccguucauuugaaaaagggc

SEQ ID NO: 2806116 - RNA, 13 nt, Listeria monocytogenes EGD-e
auuccucaaugag

SEQ ID NO: 2806117 - RNA, 13 nt, Listeria monocytogenes EGD-e
auuccucauugag

SEQ ID NO: 2806118 - RNA, 18 nt, Listeria monocytogenes EGD-e
auuccucauugaggaaua

SEQ ID NO: 2806119 - RNA, 11 nt, Listeria monocytogenes EGD-e
auuccuccaau

SEQ ID NO: 2806120 - RNA, 14 nt, Listeria monocytogenes EGD-e
auuccuccuaauug

SEQ ID NO: 2806121 - RNA, 16 nt, Listeria monocytogenes EGD-e
auucgaauaaagaacu

SEQ ID NO: 2806122 - RNA, 23 nt, Listeria monocytogenes EGD-e
auucgguauguuuuaauuucaaa

SEQ ID NO: 2806123 - RNA, 15 nt, Listeria monocytogenes EGD-e
auucgucuuagaaaa

SEQ ID NO: 2806124 - RNA, 13 nt, Listeria monocytogenes EGD-e
auucuaaauaaau

SEQ ID NO: 2806125 - RNA, 20 nt, Listeria monocytogenes EGD-e
auucuagccgcucgucuaaa

SEQ ID NO: 2806126 - RNA, 17 nt, Listeria monocytogenes EGD-e
auucuauuaauaaugau

SEQ ID NO: 2806127 - RNA, 18 nt, Listeria monocytogenes EGD-e
auucugaaaugauuuuua

SEQ ID NO: 2806128 - RNA, 14 nt, Listeria monocytogenes EGD-e
auucugcuaacagc

SEQ ID NO: 2806129 - RNA, 19 nt, Listeria monocytogenes EGD-e
auucuguuaaaggagaaaa

SEQ ID NO: 2806130 - RNA, 15 nt, Listeria monocytogenes EGD-e
auucuucaauacguu

SEQ ID NO: 2806131 - RNA, 16 nt, Listeria monocytogenes EGD-e
auucuucgcuuguuuu

SEQ ID NO: 2806132 - RNA, 19 nt, Listeria monocytogenes EGD-e
auucuucgcuuguuuugau

SEQ ID NO: 2806133 - RNA, 17 nt, Listeria monocytogenes EGD-e
auucuugaauguuuuca

SEQ ID NO: 2806134 - RNA, 13 nt, Listeria monocytogenes EGD-e
auucuuuuucuuc

SEQ ID NO: 2806135 - RNA, 20 nt, Listeria monocytogenes EGD-e
auugaauagaacuauaacca

SEQ ID NO: 2806136 - RNA, 22 nt, Listeria monocytogenes EGD-e
auugagcgguuuuguuuccaac

SEQ ID NO: 2806137 - RNA, 16 nt, Listeria monocytogenes EGD-e
auugagugcuuucguu

SEQ ID NO: 2806138 - RNA, 20 nt, Listeria monocytogenes EGD-e
auugcaacaguuauuaaaag

SEQ ID NO: 2806139 - RNA, 21 nt, Listeria monocytogenes EGD-e
auugcaacaguuauuaaaagg

SEQ ID NO: 2806140 - RNA, 17 nt, Listeria monocytogenes EGD-e
auugcaagcaccauauc

SEQ ID NO: 2806141 - RNA, 23 nt, Listeria monocytogenes EGD-e
auugcaugagcaaucguauguuu

SEQ ID NO: 2806142 - RNA, 13 nt, Listeria monocytogenes EGD-e
auugcgucacaau

SEQ ID NO: 2806143 - RNA, 19 nt, Listeria monocytogenes EGD-e
auugcuuccccauaguaaa

SEQ ID NO: 2806144 - RNA, 20 nt, Listeria monocytogenes EGD-e
auugcuuccccauaguaaaa

SEQ ID NO: 2806145 - RNA, 22 nt, Listeria monocytogenes EGD-e
auugcuucuccguuuuccacca

SEQ ID NO: 2806146 - RNA, 19 nt, Listeria monocytogenes EGD-e
auugcuucuuuuuucuucc

SEQ ID NO: 2806147 - RNA, 21 nt, Listeria monocytogenes EGD-e
auugcuuuguguuaauaaaau

SEQ ID NO: 2806148 - RNA, 19 nt, Listeria monocytogenes EGD-e
auuguaccgcuugauguuu

SEQ ID NO: 2806149 - RNA, 22 nt, Listeria monocytogenes EGD-e
auuguagcucauuacaaaauuu

SEQ ID NO: 2806150 - RNA, 20 nt, Listeria monocytogenes EGD-e
auugucauaaaacuuucaca

SEQ ID NO: 2806151 - RNA, 18 nt, Listeria monocytogenes EGD-e
auuguuaauagaagccaa

SEQ ID NO: 2806152 - RNA, 21 nt, Listeria monocytogenes EGD-e
auuguucuuuaaaaacaguac

SEQ ID NO: 2806153 - RNA, 20 nt, Listeria monocytogenes EGD-e
auuuaauaguagcacuccuu

SEQ ID NO: 2806154 - RNA, 21 nt, Listeria monocytogenes EGD-e
auuuaaucauuaaccuacuuu

SEQ ID NO: 2806155 - RNA, 15 nt, Listeria monocytogenes EGD-e
auuuaauuguaauuc

SEQ ID NO: 2806156 - RNA, 22 nt, Listeria monocytogenes EGD-e
auuuaauugucgaaaaccuaaa

SEQ ID NO: 2806157 - RNA, 23 nt, Listeria monocytogenes EGD-e
auuuaauugucgaaaaccuaaau

SEQ ID NO: 2806158 - RNA, 22 nt, Listeria monocytogenes EGD-e
auuuacguuguucuaacauuaa

SEQ ID NO: 2806159 - RNA, 19 nt, Listeria monocytogenes EGD-e
auuuagaggcguacuaaaa

SEQ ID NO: 2806160 - RNA, 19 nt, Listeria monocytogenes EGD-e
auuuauauuuuaaagagag

SEQ ID NO: 2806161 - RNA, 15 nt, Listeria monocytogenes EGD-e
auuuauuauuguuaa

SEQ ID NO: 2806162 - RNA, 15 nt, Listeria monocytogenes EGD-e
auuuauuuagaaauc

SEQ ID NO: 2806163 - RNA, 16 nt, Listeria monocytogenes EGD-e
auuucaaauggagcua

SEQ ID NO: 2806164 - RNA, 22 nt, Listeria monocytogenes EGD-e
auuucaaucgcagcagauuuug

SEQ ID NO: 2806165 - RNA, 22 nt, Listeria monocytogenes EGD-e
auuucagcuaaucguuuuaaag

SEQ ID NO: 2806166 - RNA, 19 nt, Listeria monocytogenes EGD-e
auuucauaaucaaauacau

SEQ ID NO: 2806167 - RNA, 17 nt, Listeria monocytogenes EGD-e
auuucaucguuuucuac

SEQ ID NO: 2806168 - RNA, 12 nt, Listeria monocytogenes EGD-e
auuucaucuuuu

SEQ ID NO: 2806169 - RNA, 13 nt, Listeria monocytogenes EGD-e
auuucauuuuaau

SEQ ID NO: 2806170 - RNA, 17 nt, Listeria monocytogenes EGD-e
auuuccaaguguuuuag

SEQ ID NO: 2806171 - RNA, 22 nt, Listeria monocytogenes EGD-e
auuucuauaaaaaugauaaugu

SEQ ID NO: 2806172 - RNA, 17 nt, Listeria monocytogenes EGD-e
auuucucccucauccuu

SEQ ID NO: 2806173 - RNA, 21 nt, Listeria monocytogenes EGD-e
auuucucccucauccuuucuu

SEQ ID NO: 2806174 - RNA, 15 nt, Listeria monocytogenes EGD-e
auuucuccguaagaa

SEQ ID NO: 2806175 - RNA, 23 nt, Listeria monocytogenes EGD-e
auuucugcagaaugagcuccuuc

SEQ ID NO: 2806176 - RNA, 23 nt, Listeria monocytogenes EGD-e
auuucuggguguuuauucauaua

SEQ ID NO: 2806177 - RNA, 20 nt, Listeria monocytogenes EGD-e
auuucuguuaugaacagaag

SEQ ID NO: 2806178 - RNA, 13 nt, Listeria monocytogenes EGD-e
auuucuguuuugu

SEQ ID NO: 2806179 - RNA, 20 nt, Listeria monocytogenes EGD-e
auuucuuuaucuuucccauc

SEQ ID NO: 2806180 - RNA, 13 nt, Listeria monocytogenes EGD-e
auuugaaaaaggg

SEQ ID NO: 2806181 - RNA, 22 nt, Listeria monocytogenes EGD-e
auuugaacccuuugaauugauu

SEQ ID NO: 2806182 - RNA, 18 nt, Listeria monocytogenes EGD-e
auuugauugccugaaaua

SEQ ID NO: 2806183 - RNA, 14 nt, Listeria monocytogenes EGD-e
auuugccaaucaau

SEQ ID NO: 2806184 - RNA, 17 nt, Listeria monocytogenes EGD-e
auuugcucgaauucuuu

SEQ ID NO: 2806185 - RNA, 17 nt, Listeria monocytogenes EGD-e
auuuggccaauuaaaau

SEQ ID NO: 2806186 - RNA, 14 nt, Listeria monocytogenes EGD-e
auuuguuucugguu

SEQ ID NO: 2806187 - RNA, 18 nt, Listeria monocytogenes EGD-e
auuuuaaucauugcuuug

SEQ ID NO: 2806188 - RNA, 17 nt, Listeria monocytogenes EGD-e
auuuuaggcguaucuuu

SEQ ID NO: 2806189 - RNA, 18 nt, Listeria monocytogenes EGD-e
auuuucauuaaacggcuu

SEQ ID NO: 2806190 - RNA, 16 nt, Listeria monocytogenes EGD-e
auuuucauuuguuucu

SEQ ID NO: 2806191 - RNA, 20 nt, Listeria monocytogenes EGD-e
auuuucauuuguuucuuuug

SEQ ID NO: 2806192 - RNA, 16 nt, Listeria monocytogenes EGD-e
auuuucccuccuuuau

SEQ ID NO: 2806193 - RNA, 22 nt, Listeria monocytogenes EGD-e
auuuucccuccuuuauuuuuua

SEQ ID NO: 2806194 - RNA, 20 nt, Listeria monocytogenes EGD-e
auuuuccgcagcuucaaucu

SEQ ID NO: 2806195 - RNA, 15 nt, Listeria monocytogenes EGD-e
auuuugauaggcucu

SEQ ID NO: 2806196 - RNA, 17 nt, Listeria monocytogenes EGD-e
auuuugcggaaauauca

SEQ ID NO: 2806197 - RNA, 18 nt, Listeria monocytogenes EGD-e
auuuugcggaaauaucac

SEQ ID NO: 2806198 - RNA, 19 nt, Listeria monocytogenes EGD-e
auuuugguuauuucuuuau

SEQ ID NO: 2806199 - RNA, 23 nt, Listeria monocytogenes EGD-e
auuuugguuuggucaacaucauu

SEQ ID NO: 2806200 - RNA, 16 nt, Listeria monocytogenes EGD-e
auuuugucaauccauu

SEQ ID NO: 2806201 - RNA, 17 nt, Listeria monocytogenes EGD-e
auuuuguucuaagaauu

SEQ ID NO: 2806202 - RNA, 17 nt, Listeria monocytogenes EGD-e
auuuuuauuccguucau

SEQ ID NO: 2806203 - RNA, 16 nt, Listeria monocytogenes EGD-e
auuuuucaaaucaauu

SEQ ID NO: 2806204 - RNA, 18 nt, Listeria monocytogenes EGD-e
auuuuucagcuaaauauu

SEQ ID NO: 2806205 - RNA, 11 nt, Listeria monocytogenes EGD-e
auuuuuccaag

SEQ ID NO: 2806206 - RNA, 23 nt, Listeria monocytogenes EGD-e
auuuuucgauuggcgauucuuca

SEQ ID NO: 2806207 - RNA, 19 nt, Listeria monocytogenes EGD-e
auuuuuugcgcguucuucu

SEQ ID NO: 2806208 - RNA, 16 nt, Listeria monocytogenes EGD-e
auuuuuuucgaaagaa

SEQ ID NO: 2806209 - RNA, 22 nt, Listeria monocytogenes EGD-e
auuuuuuugaacggguuucccu

SEQ ID NO: 2806210 - RNA, 15 nt, Listeria monocytogenes EGD-e
auuuuuuugauuaau

SEQ ID NO: 2806211 - RNA, 23 nt, Listeria monocytogenes EGD-e
caaaaacaaccaucaaacucuuu

SEQ ID NO: 2806212 - RNA, 15 nt, Listeria monocytogenes EGD-e
caaaaagauacuuug

SEQ ID NO: 2806213 - RNA, 21 nt, Listeria monocytogenes EGD-e
caaaaagauuauggaaaaauc

SEQ ID NO: 2806214 - RNA, 16 nt, Listeria monocytogenes EGD-e
caaaagcaaaaaagua

SEQ ID NO: 2806215 - RNA, 17 nt, Listeria monocytogenes EGD-e
caaaaggacaagcccag

SEQ ID NO: 2806216 - RNA, 12 nt, Listeria monocytogenes EGD-e
caaaagucacag

SEQ ID NO: 2806217 - RNA, 17 nt, Listeria monocytogenes EGD-e
caaaaguggaaauguuc

SEQ ID NO: 2806218 - RNA, 13 nt, Listeria monocytogenes EGD-e
caaaauaauaaua

SEQ ID NO: 2806219 - RNA, 10 nt, Listeria monocytogenes EGD-e
caaaaucaag

SEQ ID NO: 2806220 - RNA, 20 nt, Listeria monocytogenes EGD-e
caaaaucaugccuucaaaca

SEQ ID NO: 2806221 - RNA, 14 nt, Listeria monocytogenes EGD-e
caaaaucgcauccu

SEQ ID NO: 2806222 - RNA, 16 nt, Listeria monocytogenes EGD-e
caaaaugcaaaaccuc

SEQ ID NO: 2806223 - RNA, 21 nt, Listeria monocytogenes EGD-e
caaaaugggcaguuacuuuac

SEQ ID NO: 2806224 - RNA, 18 nt, Listeria monocytogenes EGD-e
caaaauuacuauuuggau

SEQ ID NO: 2806225 - RNA, 15 nt, Listeria monocytogenes EGD-e
caaaauucaguuuau

SEQ ID NO: 2806226 - RNA, 16 nt, Listeria monocytogenes EGD-e
caaacaaaaaaguucu

SEQ ID NO: 2806227 - RNA, 15 nt, Listeria monocytogenes EGD-e
caaacaaaguaccaa

SEQ ID NO: 2806228 - RNA, 15 nt, Listeria monocytogenes EGD-e
caaacacuucuaaaa

SEQ ID NO: 2806229 - RNA, 20 nt, Listeria monocytogenes EGD-e
caaacacuucuaaaacaggc

SEQ ID NO: 2806230 - RNA, 18 nt, Listeria monocytogenes EGD-e
caaacgcagguucaccaa

SEQ ID NO: 2806231 - RNA, 15 nt, Listeria monocytogenes EGD-e
caaacgcuuuuucaa

SEQ ID NO: 2806232 - RNA, 22 nt, Listeria monocytogenes EGD-e
caaacguuccgauacaacaaaa

SEQ ID NO: 2806233 - RNA, 23 nt, Listeria monocytogenes EGD-e
caaagaagaagacgaaaagcaau

SEQ ID NO: 2806234 - RNA, 20 nt, Listeria monocytogenes EGD-e
caaagagaaacuuuuucuca

SEQ ID NO: 2806235 - RNA, 16 nt, Listeria monocytogenes EGD-e
caaagagccauaaaau

SEQ ID NO: 2806236 - RNA, 18 nt, Listeria monocytogenes EGD-e
caaagagccauaaaauua

SEQ ID NO: 2806237 - RNA, 20 nt, Listeria monocytogenes EGD-e
caaagcguucaagugauaca

SEQ ID NO: 2806238 - RNA, 22 nt, Listeria monocytogenes EGD-e
caaagcguuuuuuauuuuucag

SEQ ID NO: 2806239 - RNA, 21 nt, Listeria monocytogenes EGD-e
caaagcuacuuuucgaauccc

SEQ ID NO: 2806240 - RNA, 13 nt, Listeria monocytogenes EGD-e
caaaguaaaauac

SEQ ID NO: 2806241 - RNA, 15 nt, Listeria monocytogenes EGD-e
caaaguauugugcua

SEQ ID NO: 2806242 - RNA, 22 nt, Listeria monocytogenes EGD-e
caaaguauugugcuaaguagac

SEQ ID NO: 2806243 - RNA, 16 nt, Listeria monocytogenes EGD-e
caaauagagccaagcu

SEQ ID NO: 2806244 - RNA, 18 nt, Listeria monocytogenes EGD-e
caaauaugcuauacaaca

SEQ ID NO: 2806245 - RNA, 20 nt, Listeria monocytogenes EGD-e
caaaucuggauaaaaauaac

SEQ ID NO: 2806246 - RNA, 15 nt, Listeria monocytogenes EGD-e
caaauggagcuauug

SEQ ID NO: 2806247 - RNA, 16 nt, Listeria monocytogenes EGD-e
caaauuauuagaauuc

SEQ ID NO: 2806248 - RNA, 15 nt, Listeria monocytogenes EGD-e
caaauucaugcaagc

SEQ ID NO: 2806249 - RNA, 20 nt, Listeria monocytogenes EGD-e
caaauucugaaaugauuuuu

SEQ ID NO: 2806250 - RNA, 21 nt, Listeria monocytogenes EGD-e
caaauucugaaaugauuuuua

SEQ ID NO: 2806251 - RNA, 12 nt, Listeria monocytogenes EGD-e
caacaaaacaaa

SEQ ID NO: 2806252 - RNA, 12 nt, Listeria monocytogenes EGD-e
caacaaaauaau

SEQ ID NO: 2806253 - RNA, 13 nt, Listeria monocytogenes EGD-e
caacaaaauaauc

SEQ ID NO: 2806254 - RNA, 18 nt, Listeria monocytogenes EGD-e
caacaaaauaaucaaucc

SEQ ID NO: 2806255 - RNA, 13 nt, Listeria monocytogenes EGD-e
caacaaagaagaa

SEQ ID NO: 2806256 - RNA, 14 nt, Listeria monocytogenes EGD-e
caacaaagaagaaa

SEQ ID NO: 2806257 - RNA, 18 nt, Listeria monocytogenes EGD-e
caacaaagaagaaaaagu

SEQ ID NO: 2806258 - RNA, 17 nt, Listeria monocytogenes EGD-e
caacaaucguacccgua

SEQ ID NO: 2806259 - RNA, 18 nt, Listeria monocytogenes EGD-e
caacaaucugaacugacu

SEQ ID NO: 2806260 - RNA, 15 nt, Listeria monocytogenes EGD-e
caacaauuacuucca

SEQ ID NO: 2806261 - RNA, 19 nt, Listeria monocytogenes EGD-e
caacagauaguuguuccau

SEQ ID NO: 2806262 - RNA, 15 nt, Listeria monocytogenes EGD-e
caacauucaaaucac

SEQ ID NO: 2806263 - RNA, 16 nt, Listeria monocytogenes EGD-e
caacauucaaaucacc

SEQ ID NO: 2806264 - RNA, 21 nt, Listeria monocytogenes EGD-e
caacauucaaaucaccacaaa

SEQ ID NO: 2806265 - RNA, 20 nt, Listeria monocytogenes EGD-e
caaccaagcaauaacaucuu

SEQ ID NO: 2806266 - RNA, 21 nt, Listeria monocytogenes EGD-e
caaccaagcaauaacaucuuu

SEQ ID NO: 2806267 - RNA, 19 nt, Listeria monocytogenes EGD-e
caaccaguauuccuagcac

SEQ ID NO: 2806268 - RNA, 23 nt, Listeria monocytogenes EGD-e
caacgguaaacaacccauuugca

SEQ ID NO: 2806269 - RNA, 15 nt, Listeria monocytogenes EGD-e
caacguguaccuuau

SEQ ID NO: 2806270 - RNA, 22 nt, Listeria monocytogenes EGD-e
caacguguaccuuauuaacuaa

SEQ ID NO: 2806271 - RNA, 19 nt, Listeria monocytogenes EGD-e
caacucucuucagaaagug

SEQ ID NO: 2806272 - RNA, 14 nt, Listeria monocytogenes EGD-e
caacuucaaaauua

SEQ ID NO: 2806273 - RNA, 14 nt, Listeria monocytogenes EGD-e
caacuucacuaaca

SEQ ID NO: 2806274 - RNA, 17 nt, Listeria monocytogenes EGD-e
caagaacagcaauuugu

SEQ ID NO: 2806275 - RNA, 20 nt, Listeria monocytogenes EGD-e
caagaauaaugacgccacca

SEQ ID NO: 2806276 - RNA, 21 nt, Listeria monocytogenes EGD-e
caagagcaccaauaaaaccug

SEQ ID NO: 2806277 - RNA, 18 nt, Listeria monocytogenes EGD-e
caagagcagggcuauuuu

SEQ ID NO: 2806278 - RNA, 14 nt, Listeria monocytogenes EGD-e
caagauucuucuaa

SEQ ID NO: 2806279 - RNA, 14 nt, Listeria monocytogenes EGD-e
caagcaaaacauuu

SEQ ID NO: 2806280 - RNA, 20 nt, Listeria monocytogenes EGD-e
caagcaauaacaucuuuaaa

SEQ ID NO: 2806281 - RNA, 19 nt, Listeria monocytogenes EGD-e
caagcauuucauaaucaaa

SEQ ID NO: 2806282 - RNA, 18 nt, Listeria monocytogenes EGD-e
caagcguacggaauuuau

SEQ ID NO: 2806283 - RNA, 21 nt, Listeria monocytogenes EGD-e
caaggguaauauaaauuugcc

SEQ ID NO: 2806284 - RNA, 21 nt, Listeria monocytogenes EGD-e
caagggugaucaaucaguuca

SEQ ID NO: 2806285 - RNA, 12 nt, Listeria monocytogenes EGD-e
caaguaaaaaca

SEQ ID NO: 2806286 - RNA, 14 nt, Listeria monocytogenes EGD-e
caaguaauaagaag

SEQ ID NO: 2806287 - RNA, 18 nt, Listeria monocytogenes EGD-e
caaguacuuugaauugcu

SEQ ID NO: 2806288 - RNA, 17 nt, Listeria monocytogenes EGD-e
caaguccgucaagccca

SEQ ID NO: 2806289 - RNA, 22 nt, Listeria monocytogenes EGD-e
caagugaacguacaacuaaaga

SEQ ID NO: 2806290 - RNA, 15 nt, Listeria monocytogenes EGD-e
caagugcuaaaauaa

SEQ ID NO: 2806291 - RNA, 12 nt, Listeria monocytogenes EGD-e
caauaaaguuaa

SEQ ID NO: 2806292 - RNA, 19 nt, Listeria monocytogenes EGD-e
caauaacaucuuuaaaaac

SEQ ID NO: 2806293 - RNA, 24 nt, Listeria monocytogenes EGD-e
caauaauaguugauauauucacau

SEQ ID NO: 2806294 - RNA, 18 nt, Listeria monocytogenes EGD-e
caauaaugugguucguua

SEQ ID NO: 2806295 - RNA, 21 nt, Listeria monocytogenes EGD-e
caauaccauguuuauuuaaua

SEQ ID NO: 2806296 - RNA, 22 nt, Listeria monocytogenes EGD-e
caauaccauguuuauuuaauaa

SEQ ID NO: 2806297 - RNA, 14 nt, Listeria monocytogenes EGD-e
caauagaaaccauc

SEQ ID NO: 2806298 - RNA, 17 nt, Listeria monocytogenes EGD-e
caauaucuuuauuuuuu

SEQ ID NO: 2806299 - RNA, 17 nt, Listeria monocytogenes EGD-e
caaucaauugguuuuac

SEQ ID NO: 2806300 - RNA, 15 nt, Listeria monocytogenes EGD-e
caaucaguucaacua

SEQ ID NO: 2806301 - RNA, 15 nt, Listeria monocytogenes EGD-e
caaucauuuauuuuc

SEQ ID NO: 2806302 - RNA, 16 nt, Listeria monocytogenes EGD-e
caaucauuuauuuucc

SEQ ID NO: 2806303 - RNA, 17 nt, Listeria monocytogenes EGD-e
caaucauuuauuuuccc

SEQ ID NO: 2806304 - RNA, 16 nt, Listeria monocytogenes EGD-e
caaucccagcuuuucc

SEQ ID NO: 2806305 - RNA, 13 nt, Listeria monocytogenes EGD-e
caaucgcagcaga

SEQ ID NO: 2806306 - RNA, 14 nt, Listeria monocytogenes EGD-e
caaucgcagcagau

SEQ ID NO: 2806307 - RNA, 15 nt, Listeria monocytogenes EGD-e
caaucucaucaccag

SEQ ID NO: 2806308 - RNA, 21 nt, Listeria monocytogenes EGD-e
caaucucaucaccagcuucua

SEQ ID NO: 2806309 - RNA, 19 nt, Listeria monocytogenes EGD-e
caaucugaacugacuagaa

SEQ ID NO: 2806310 - RNA, 16 nt, Listeria monocytogenes EGD-e
caaugaccuaguuaau

SEQ ID NO: 2806311 - RNA, 20 nt, Listeria monocytogenes EGD-e
caaugaccuaguuaaucuaa

SEQ ID NO: 2806312 - RNA, 13 nt, Listeria monocytogenes EGD-e
caaugcccaguaa

SEQ ID NO: 2806313 - RNA, 13 nt, Listeria monocytogenes EGD-e
caauuaaaauacg

SEQ ID NO: 2806314 - RNA, 17 nt, Listeria monocytogenes EGD-e
caauuaagucugcuucu

SEQ ID NO: 2806315 - RNA, 22 nt, Listeria monocytogenes EGD-e
caauuacgcuuuaguuuguacu

SEQ ID NO: 2806316 - RNA, 19 nt, Listeria monocytogenes EGD-e
caauuauucgcucgucaaa

SEQ ID NO: 2806317 - RNA, 18 nt, Listeria monocytogenes EGD-e
caauucccaggcugcuug

SEQ ID NO: 2806318 - RNA, 22 nt, Listeria monocytogenes EGD-e
caauucucguaauguugcauag

SEQ ID NO: 2806319 - RNA, 23 nt, Listeria monocytogenes EGD-e
caauucuuccacaucugaaaaag

SEQ ID NO: 2806320 - RNA, 15 nt, Listeria monocytogenes EGD-e
caauuggaacaucuu

SEQ ID NO: 2806321 - RNA, 20 nt, Listeria monocytogenes EGD-e
caauuggaacaucuuuguau

SEQ ID NO: 2806322 - RNA, 21 nt, Listeria monocytogenes EGD-e
caauuuauauuuuaaagagag

SEQ ID NO: 2806323 - RNA, 15 nt, Listeria monocytogenes EGD-e
caauuucaaccaauu

SEQ ID NO: 2806324 - RNA, 19 nt, Listeria monocytogenes EGD-e
caauuucgccguuggaagu

SEQ ID NO: 2806325 - RNA, 22 nt, Listeria monocytogenes EGD-e
caauuucuucgugcgcaacauu

SEQ ID NO: 2806326 - RNA, 13 nt, Listeria monocytogenes EGD-e
caauuucuuuuua

SEQ ID NO: 2806327 - RNA, 22 nt, Listeria monocytogenes EGD-e
caauuuuacgcauaucaucaau

SEQ ID NO: 2806328 - RNA, 11 nt, Listeria monocytogenes EGD-e
caauuuugcuu

SEQ ID NO: 2806329 - RNA, 13 nt, Listeria monocytogenes EGD-e
cacaaaguaaaaa

SEQ ID NO: 2806330 - RNA, 15 nt, Listeria monocytogenes EGD-e
cacaaguuccaaaaa

SEQ ID NO: 2806331 - RNA, 18 nt, Listeria monocytogenes EGD-e
cacaaguuccaaaaauag

SEQ ID NO: 2806332 - RNA, 14 nt, Listeria monocytogenes EGD-e
cacagcaauggccg

SEQ ID NO: 2806333 - RNA, 16 nt, Listeria monocytogenes EGD-e
cacagcaauggccgga

SEQ ID NO: 2806334 - RNA, 14 nt, Listeria monocytogenes EGD-e
cacagcgcuuaaaa

SEQ ID NO: 2806335 - RNA, 16 nt, Listeria monocytogenes EGD-e
cacagcgcuuaaaaau

SEQ ID NO: 2806336 - RNA, 20 nt, Listeria monocytogenes EGD-e
cacagcguauccaccaaaaa

SEQ ID NO: 2806337 - RNA, 18 nt, Listeria monocytogenes EGD-e
cacaugauaaccagaaac

SEQ ID NO: 2806338 - RNA, 17 nt, Listeria monocytogenes EGD-e
cacauguccauugaugc

SEQ ID NO: 2806339 - RNA, 20 nt, Listeria monocytogenes EGD-e
cacauuguagcgauucccuu

SEQ ID NO: 2806340 - RNA, 19 nt, Listeria monocytogenes EGD-e
caccaagcgcuuccucgac

SEQ ID NO: 2806341 - RNA, 14 nt, Listeria monocytogenes EGD-e
caccaauaaaaccu

SEQ ID NO: 2806342 - RNA, 19 nt, Listeria monocytogenes EGD-e
caccaauuucuguuuuguu

SEQ ID NO: 2806343 - RNA, 20 nt, Listeria monocytogenes EGD-e
caccacucuuuuauaaaaau

SEQ ID NO: 2806344 - RNA, 21 nt, Listeria monocytogenes EGD-e
caccacucuuuuauaaaaaua

SEQ ID NO: 2806345 - RNA, 13 nt, Listeria monocytogenes EGD-e
caccacuucuucc

SEQ ID NO: 2806346 - RNA, 18 nt, Listeria monocytogenes EGD-e
cacccgguccuucaaucg

SEQ ID NO: 2806347 - RNA, 21 nt, Listeria monocytogenes EGD-e
caccgaacuagcaucagcuuu

SEQ ID NO: 2806348 - RNA, 14 nt, Listeria monocytogenes EGD-e
caccgugcguuccc

SEQ ID NO: 2806349 - RNA, 22 nt, Listeria monocytogenes EGD-e
caccuucuuuuugcuuuaaaaa

SEQ ID NO: 2806350 - RNA, 16 nt, Listeria monocytogenes EGD-e
cacggugaugaaacca

SEQ ID NO: 2806351 - RNA, 13 nt, Listeria monocytogenes EGD-e
cacguuuuugcuc

SEQ ID NO: 2806352 - RNA, 20 nt, Listeria monocytogenes EGD-e
cacuaacuuaucuuucaaac

SEQ ID NO: 2806353 - RNA, 22 nt, Listeria monocytogenes EGD-e
cacuaacuuaucuuucaaacgu

SEQ ID NO: 2806354 - RNA, 15 nt, Listeria monocytogenes EGD-e
cacucgucuaaaaaa

SEQ ID NO: 2806355 - RNA, 21 nt, Listeria monocytogenes EGD-e
cacuggagcugauuuuauuuu

SEQ ID NO: 2806356 - RNA, 20 nt, Listeria monocytogenes EGD-e
cacugugaacugauuuuuug

SEQ ID NO: 2806357 - RNA, 16 nt, Listeria monocytogenes EGD-e
cacuucuaccguuccu

SEQ ID NO: 2806358 - RNA, 15 nt, Listeria monocytogenes EGD-e
cacuucuuaagaauu

SEQ ID NO: 2806359 - RNA, 15 nt, Listeria monocytogenes EGD-e
cacuucuuccaccug

SEQ ID NO: 2806360 - RNA, 21 nt, Listeria monocytogenes EGD-e
cacuuuaucccagaaagaauu

SEQ ID NO: 2806361 - RNA, 17 nt, Listeria monocytogenes EGD-e
cagaaaccccgccacca

SEQ ID NO: 2806362 - RNA, 16 nt, Listeria monocytogenes EGD-e
cagaaacuuucuuuuc

SEQ ID NO: 2806363 - RNA, 17 nt, Listeria monocytogenes EGD-e
cagaaacuuucuuuucu

SEQ ID NO: 2806364 - RNA, 22 nt, Listeria monocytogenes EGD-e
cagaaagcuguuuucaacaaaa

SEQ ID NO: 2806365 - RNA, 23 nt, Listeria monocytogenes EGD-e
cagaagcgaugugggaaugaaua

SEQ ID NO: 2806366 - RNA, 24 nt, Listeria monocytogenes EGD-e
cagaagcgaugugggaaugaauag

SEQ ID NO: 2806367 - RNA, 23 nt, Listeria monocytogenes EGD-e
cagaaggggcugugaaggaaacg

SEQ ID NO: 2806368 - RNA, 13 nt, Listeria monocytogenes EGD-e
cagagaaaccgcu

SEQ ID NO: 2806369 - RNA, 15 nt, Listeria monocytogenes EGD-e
cagauaguuguucca

SEQ ID NO: 2806370 - RNA, 15 nt, Listeria monocytogenes EGD-e
cagauccuucaauaa

SEQ ID NO: 2806371 - RNA, 18 nt, Listeria monocytogenes EGD-e
cagauuuggucauuuuuu

SEQ ID NO: 2806372 - RNA, 19 nt, Listeria monocytogenes EGD-e
cagcaagugugauuguucc

SEQ ID NO: 2806373 - RNA, 20 nt, Listeria monocytogenes EGD-e
cagcaagugugauuguucca

SEQ ID NO: 2806374 - RNA, 15 nt, Listeria monocytogenes EGD-e
cagcacaaguuccaa

SEQ ID NO: 2806375 - RNA, 18 nt, Listeria monocytogenes EGD-e
cagcacaaguuccaaaaa

SEQ ID NO: 2806376 - RNA, 20 nt, Listeria monocytogenes EGD-e
cagcagaaacuuucuuuucu

SEQ ID NO: 2806377 - RNA, 16 nt, Listeria monocytogenes EGD-e
cagcaguuuucauuaa

SEQ ID NO: 2806378 - RNA, 22 nt, Listeria monocytogenes EGD-e
cagcauguccaagcacagcaau

SEQ ID NO: 2806379 - RNA, 23 nt, Listeria monocytogenes EGD-e
cagcauuuuuacgauuugucuuc

SEQ ID NO: 2806380 - RNA, 14 nt, Listeria monocytogenes EGD-e
cagccauuuuggaa

SEQ ID NO: 2806381 - RNA, 20 nt, Listeria monocytogenes EGD-e
cagcgucuaaaaaugcagaa

SEQ ID NO: 2806382 - RNA, 23 nt, Listeria monocytogenes EGD-e
cagcuaaauauuuaauuuuaucu

SEQ ID NO: 2806383 - RNA, 20 nt, Listeria monocytogenes EGD-e
cagcuaccacaagaagggcu

SEQ ID NO: 2806384 - RNA, 21 nt, Listeria monocytogenes EGD-e
cagcuaccacaagaagggcuu

SEQ ID NO: 2806385 - RNA, 20 nt, Listeria monocytogenes EGD-e
cagcuccauuaaaugaccaa

SEQ ID NO: 2806386 - RNA, 15 nt, Listeria monocytogenes EGD-e
cagcuucgauuuuuu

SEQ ID NO: 2806387 - RNA, 18 nt, Listeria monocytogenes EGD-e
cagcuucgauuuuuucaa

SEQ ID NO: 2806388 - RNA, 18 nt, Listeria monocytogenes EGD-e
cagcuucuaagucaaaac

SEQ ID NO: 2806389 - RNA, 17 nt, Listeria monocytogenes EGD-e
cagcuugauaauuuuuu

SEQ ID NO: 2806390 - RNA, 20 nt, Listeria monocytogenes EGD-e
cagcuugauaauuuuuuucg

SEQ ID NO: 2806391 - RNA, 13 nt, Listeria monocytogenes EGD-e
cagcuugauuaaa

SEQ ID NO: 2806392 - RNA, 18 nt, Listeria monocytogenes EGD-e
cagcuuuuccuagaacua

SEQ ID NO: 2806393 - RNA, 19 nt, Listeria monocytogenes EGD-e
cagcuuuuccuagaacuaa

SEQ ID NO: 2806394 - RNA, 15 nt, Listeria monocytogenes EGD-e
cagcuuuugaaacca

SEQ ID NO: 2806395 - RNA, 13 nt, Listeria monocytogenes EGD-e
cagcuuuugucca

SEQ ID NO: 2806396 - RNA, 12 nt, Listeria monocytogenes EGD-e
caggaagcccau

SEQ ID NO: 2806397 - RNA, 21 nt, Listeria monocytogenes EGD-e
caggaguuucuuuaccauaca

SEQ ID NO: 2806398 - RNA, 16 nt, Listeria monocytogenes EGD-e
caggauuaaaaguuga

SEQ ID NO: 2806399 - RNA, 23 nt, Listeria monocytogenes EGD-e
caggcacgucaaauggcgcagga

SEQ ID NO: 2806400 - RNA, 13 nt, Listeria monocytogenes EGD-e
cagggcuauuuuu

SEQ ID NO: 2806401 - RNA, 16 nt, Listeria monocytogenes EGD-e
cagguaaaacagcaag

SEQ ID NO: 2806402 - RNA, 18 nt, Listeria monocytogenes EGD-e
cagguucaccaaaugcuu

SEQ ID NO: 2806403 - RNA, 19 nt, Listeria monocytogenes EGD-e
cagguucaccaaaugcuuc

SEQ ID NO: 2806404 - RNA, 16 nt, Listeria monocytogenes EGD-e
caguacuucuauugac

SEQ ID NO: 2806405 - RNA, 14 nt, Listeria monocytogenes EGD-e
caguagacuaaauu

SEQ ID NO: 2806406 - RNA, 18 nt, Listeria monocytogenes EGD-e
caguagacuaaauugucu

SEQ ID NO: 2806407 - RNA, 21 nt, Listeria monocytogenes EGD-e
caguaguugguaguuuuaaau

SEQ ID NO: 2806408 - RNA, 20 nt, Listeria monocytogenes EGD-e
cagucacaaacgcuuuuuca

SEQ ID NO: 2806409 - RNA, 23 nt, Listeria monocytogenes EGD-e
caguccuguaacgucucucauug

SEQ ID NO: 2806410 - RNA, 22 nt, Listeria monocytogenes EGD-e
cagugugguuuacucccuuuuu

SEQ ID NO: 2806411 - RNA, 19 nt, Listeria monocytogenes EGD-e
caguuaaacaaacacaaaa

SEQ ID NO: 2806412 - RNA, 20 nt, Listeria monocytogenes EGD-e
caguuagaaccguauuuaau

SEQ ID NO: 2806413 - RNA, 14 nt, Listeria monocytogenes EGD-e
caguuauuaaaagg

SEQ ID NO: 2806414 - RNA, 17 nt, Listeria monocytogenes EGD-e
caguuuauaaauaccug

SEQ ID NO: 2806415 - RNA, 22 nt, Listeria monocytogenes EGD-e
cauaaacauuugauacauauuu

SEQ ID NO: 2806416 - RNA, 14 nt, Listeria monocytogenes EGD-e
cauaaaucgccaca

SEQ ID NO: 2806417 - RNA, 15 nt, Listeria monocytogenes EGD-e
cauaaauugauucug

SEQ ID NO: 2806418 - RNA, 20 nt, Listeria monocytogenes EGD-e
cauaagcuaacaacaagcaa

SEQ ID NO: 2806419 - RNA, 18 nt, Listeria monocytogenes EGD-e
cauaauaggagacauuaa

SEQ ID NO: 2806420 - RNA, 22 nt, Listeria monocytogenes EGD-e
cauaauaggagacauuaaaccg

SEQ ID NO: 2806421 - RNA, 14 nt, Listeria monocytogenes EGD-e
cauaaucaaauaca

SEQ ID NO: 2806422 - RNA, 17 nt, Listeria monocytogenes EGD-e
cauaaucccacaaaaaa

SEQ ID NO: 2806423 - RNA, 12 nt, Listeria monocytogenes EGD-e
cauaauuauuuu

SEQ ID NO: 2806424 - RNA, 15 nt, Listeria monocytogenes EGD-e
cauaauuauuuuugu

SEQ ID NO: 2806425 - RNA, 21 nt, Listeria monocytogenes EGD-e
cauacgaguucuacuugcgaa

SEQ ID NO: 2806426 - RNA, 22 nt, Listeria monocytogenes EGD-e
cauacgauugggcggaaauaaa

SEQ ID NO: 2806427 - RNA, 14 nt, Listeria monocytogenes EGD-e
cauacuuuuuaucu

SEQ ID NO: 2806428 - RNA, 13 nt, Listeria monocytogenes EGD-e
cauaguaaaaaaa

SEQ ID NO: 2806429 - RNA, 18 nt, Listeria monocytogenes EGD-e
cauagucagggaauaaga

SEQ ID NO: 2806430 - RNA, 15 nt, Listeria monocytogenes EGD-e
cauauaaaguuuuuu

SEQ ID NO: 2806431 - RNA, 15 nt, Listeria monocytogenes EGD-e
cauauaaucuacugu

SEQ ID NO: 2806432 - RNA, 16 nt, Listeria monocytogenes EGD-e
cauauaaucuacugua

SEQ ID NO: 2806433 - RNA, 20 nt, Listeria monocytogenes EGD-e
cauauaauucuaauagcaua

SEQ ID NO: 2806434 - RNA, 20 nt, Listeria monocytogenes EGD-e
cauaucaccaacaauuacuu

SEQ ID NO: 2806435 - RNA, 23 nt, Listeria monocytogenes EGD-e
cauaucaccaacaauuacuucca

SEQ ID NO: 2806436 - RNA, 22 nt, Listeria monocytogenes EGD-e
cauauccggcguacuuaaauca

SEQ ID NO: 2806437 - RNA, 18 nt, Listeria monocytogenes EGD-e
cauaucuacaggcuauuc

SEQ ID NO: 2806438 - RNA, 19 nt, Listeria monocytogenes EGD-e
cauauuuggccaauuaaaa

SEQ ID NO: 2806439 - RNA, 13 nt, Listeria monocytogenes EGD-e
cauauuuucucua

SEQ ID NO: 2806440 - RNA, 15 nt, Listeria monocytogenes EGD-e
caucaacgggcgcuu

SEQ ID NO: 2806441 - RNA, 20 nt, Listeria monocytogenes EGD-e
caucacuuaauucuugaaug

SEQ ID NO: 2806442 - RNA, 16 nt, Listeria monocytogenes EGD-e
caucaguaguaaagca

SEQ ID NO: 2806443 - RNA, 13 nt, Listeria monocytogenes EGD-e
caucauaaacauu

SEQ ID NO: 2806444 - RNA, 14 nt, Listeria monocytogenes EGD-e
caucauaaacauuu

SEQ ID NO: 2806445 - RNA, 21 nt, Listeria monocytogenes EGD-e
caucauauaauucuaauagca

SEQ ID NO: 2806446 - RNA, 13 nt, Listeria monocytogenes EGD-e
caucauaucuaca

SEQ ID NO: 2806447 - RNA, 15 nt, Listeria monocytogenes EGD-e
caucccaacucucuu

SEQ ID NO: 2806448 - RNA, 14 nt, Listeria monocytogenes EGD-e
cauccuuuuuucug

SEQ ID NO: 2806449 - RNA, 19 nt, Listeria monocytogenes EGD-e
caucgaauacuaacgcuuu

SEQ ID NO: 2806450 - RNA, 13 nt, Listeria monocytogenes EGD-e
caucgcagcagaa

SEQ ID NO: 2806451 - RNA, 23 nt, Listeria monocytogenes EGD-e
caucuguuccuuugcuaucaacc

SEQ ID NO: 2806452 - RNA, 15 nt, Listeria monocytogenes EGD-e
caucuuaucaaguaa

SEQ ID NO: 2806453 - RNA, 18 nt, Listeria monocytogenes EGD-e
caucuuaucaaguaauaa

SEQ ID NO: 2806454 - RNA, 13 nt, Listeria monocytogenes EGD-e
caucuuccgcuuc

SEQ ID NO: 2806455 - RNA, 16 nt, Listeria monocytogenes EGD-e
caucuucuaagaaaaa

SEQ ID NO: 2806456 - RNA, 18 nt, Listeria monocytogenes EGD-e
caucuucucgaauaccag

SEQ ID NO: 2806457 - RNA, 14 nt, Listeria monocytogenes EGD-e
caucuuuguauacu

SEQ ID NO: 2806458 - RNA, 19 nt, Listeria monocytogenes EGD-e
caugaauuuuugcauccac

SEQ ID NO: 2806459 - RNA, 14 nt, Listeria monocytogenes EGD-e
caugacaucuucua

SEQ ID NO: 2806460 - RNA, 23 nt, Listeria monocytogenes EGD-e
caugacaucuucuagcgucacaa

SEQ ID NO: 2806461 - RNA, 22 nt, Listeria monocytogenes EGD-e
caugaccuagccagacaucuuu

SEQ ID NO: 2806462 - RNA, 20 nt, Listeria monocytogenes EGD-e
caugacuaaaaagcaacucu

SEQ ID NO: 2806463 - RNA, 13 nt, Listeria monocytogenes EGD-e
caugagcuaauuu

SEQ ID NO: 2806464 - RNA, 20 nt, Listeria monocytogenes EGD-e
caugaugauuguucuuuaaa

SEQ ID NO: 2806465 - RNA, 14 nt, Listeria monocytogenes EGD-e
caugcuaaauaaaa

SEQ ID NO: 2806466 - RNA, 23 nt, Listeria monocytogenes EGD-e
caugugcuuguaagaagcuuuua

SEQ ID NO: 2806467 - RNA, 21 nt, Listeria monocytogenes EGD-e
cauuaaaaaggaauuuuucca

SEQ ID NO: 2806468 - RNA, 12 nt, Listeria monocytogenes EGD-e
cauuaaauuuag

SEQ ID NO: 2806469 - RNA, 12 nt, Listeria monocytogenes EGD-e
cauuacuuuaau

SEQ ID NO: 2806470 - RNA, 23 nt, Listeria monocytogenes EGD-e
cauuauuuggaaucucacaauuu

SEQ ID NO: 2806471 - RNA, 12 nt, Listeria monocytogenes EGD-e
cauucaaaucac

SEQ ID NO: 2806472 - RNA, 15 nt, Listeria monocytogenes EGD-e
cauucaaaucaccac

SEQ ID NO: 2806473 - RNA, 18 nt, Listeria monocytogenes EGD-e
cauucaaaucaccacaaa

SEQ ID NO: 2806474 - RNA, 22 nt, Listeria monocytogenes EGD-e
cauucaaaucaccacaaaggac

SEQ ID NO: 2806475 - RNA, 14 nt, Listeria monocytogenes EGD-e
cauucaauacuuuu

SEQ ID NO: 2806476 - RNA, 15 nt, Listeria monocytogenes EGD-e
cauucgaaagcaaau

SEQ ID NO: 2806477 - RNA, 18 nt, Listeria monocytogenes EGD-e
cauucgaguuucuguucu

SEQ ID NO: 2806478 - RNA, 16 nt, Listeria monocytogenes EGD-e
cauucgguaaucuagu

SEQ ID NO: 2806479 - RNA, 17 nt, Listeria monocytogenes EGD-e
cauucuuuccccuuuuu

SEQ ID NO: 2806480 - RNA, 12 nt, Listeria monocytogenes EGD-e
cauugauaucca

SEQ ID NO: 2806481 - RNA, 20 nt, Listeria monocytogenes EGD-e
cauugauauccaguauuucc

SEQ ID NO: 2806482 - RNA, 22 nt, Listeria monocytogenes EGD-e
cauugauauccaguauuucccc

SEQ ID NO: 2806483 - RNA, 22 nt, Listeria monocytogenes EGD-e
cauugcgggcaaauucaacagu

SEQ ID NO: 2806484 - RNA, 23 nt, Listeria monocytogenes EGD-e
cauuguagcgauucccuuuuuuu

SEQ ID NO: 2806485 - RNA, 14 nt, Listeria monocytogenes EGD-e
cauuguuaaauuau

SEQ ID NO: 2806486 - RNA, 22 nt, Listeria monocytogenes EGD-e
cauuguugcggcaguaguuuac

SEQ ID NO: 2806487 - RNA, 20 nt, Listeria monocytogenes EGD-e
cauuuaacaucagauuaaau

SEQ ID NO: 2806488 - RNA, 15 nt, Listeria monocytogenes EGD-e
cauuuaauuuacugg

SEQ ID NO: 2806489 - RNA, 17 nt, Listeria monocytogenes EGD-e
cauuucacaccacucuu

SEQ ID NO: 2806490 - RNA, 20 nt, Listeria monocytogenes EGD-e
cauuucauaaucaaauacau

SEQ ID NO: 2806491 - RNA, 14 nt, Listeria monocytogenes EGD-e
cauuucgauaacuu

SEQ ID NO: 2806492 - RNA, 14 nt, Listeria monocytogenes EGD-e
cauuucuacaacug

SEQ ID NO: 2806493 - RNA, 14 nt, Listeria monocytogenes EGD-e
cauuugaaaaaggg

SEQ ID NO: 2806494 - RNA, 13 nt, Listeria monocytogenes EGD-e
cauuuguuucuuu

SEQ ID NO: 2806495 - RNA, 15 nt, Listeria monocytogenes EGD-e
cauuuguuuuauuuu

SEQ ID NO: 2806496 - RNA, 15 nt, Listeria monocytogenes EGD-e
cauuuucacugcaua

SEQ ID NO: 2806497 - RNA, 16 nt, Listeria monocytogenes EGD-e
cauuuuucucaggagu

SEQ ID NO: 2806498 - RNA, 17 nt, Listeria monocytogenes EGD-e
ccaaaaugcuaauuuau

SEQ ID NO: 2806499 - RNA, 17 nt, Listeria monocytogenes EGD-e
ccaaacucccuuuuuga

SEQ ID NO: 2806500 - RNA, 17 nt, Listeria monocytogenes EGD-e
ccaaagacgcuuuuuuc

SEQ ID NO: 2806501 - RNA, 11 nt, Listeria monocytogenes EGD-e
ccaaagagaaa

SEQ ID NO: 2806502 - RNA, 16 nt, Listeria monocytogenes EGD-e
ccaaagauuaucccca

SEQ ID NO: 2806503 - RNA, 20 nt, Listeria monocytogenes EGD-e
ccaaauaugcuauacaacac

SEQ ID NO: 2806504 - RNA, 17 nt, Listeria monocytogenes EGD-e
ccaaaucugcgaauaac

SEQ ID NO: 2806505 - RNA, 18 nt, Listeria monocytogenes EGD-e
ccaaauuauaauuuaauu

SEQ ID NO: 2806506 - RNA, 21 nt, Listeria monocytogenes EGD-e
ccaaauuauaauuuaauucgc

SEQ ID NO: 2806507 - RNA, 13 nt, Listeria monocytogenes EGD-e
ccaaauuguaccg

SEQ ID NO: 2806508 - RNA, 19 nt, Listeria monocytogenes EGD-e
ccaacaauuacuuccauga

SEQ ID NO: 2806509 - RNA, 14 nt, Listeria monocytogenes EGD-e
ccaacguuuuaauu

SEQ ID NO: 2806510 - RNA, 14 nt, Listeria monocytogenes EGD-e
ccaagcacagcaau

SEQ ID NO: 2806511 - RNA, 19 nt, Listeria monocytogenes EGD-e
ccaagcggguuuucucaga

SEQ ID NO: 2806512 - RNA, 22 nt, Listeria monocytogenes EGD-e
ccaagcuucccguuaaucgaaa

SEQ ID NO: 2806513 - RNA, 13 nt, Listeria monocytogenes EGD-e
ccaaguucuguug

SEQ ID NO: 2806514 - RNA, 13 nt, Listeria monocytogenes EGD-e
ccaaguuuuuuaa

SEQ ID NO: 2806515 - RNA, 20 nt, Listeria monocytogenes EGD-e
ccaauaacgaguaauggagc

SEQ ID NO: 2806516 - RNA, 18 nt, Listeria monocytogenes EGD-e
ccaauaauaguugauaua

SEQ ID NO: 2806517 - RNA, 20 nt, Listeria monocytogenes EGD-e
ccaauaauaugauaaccgcu

SEQ ID NO: 2806518 - RNA, 16 nt, Listeria monocytogenes EGD-e
ccaaucauggaaacaa

SEQ ID NO: 2806519 - RNA, 22 nt, Listeria monocytogenes EGD-e
ccacaagaagggcuuuuuuccu

SEQ ID NO: 2806520 - RNA, 21 nt, Listeria monocytogenes EGD-e
ccacagaucaaaagcaaaaaa

SEQ ID NO: 2806521 - RNA, 12 nt, Listeria monocytogenes EGD-e
ccaccagucaca

SEQ ID NO: 2806522 - RNA, 21 nt, Listeria monocytogenes EGD-e
ccacgcggcauuucaaucgca

SEQ ID NO: 2806523 - RNA, 18 nt, Listeria monocytogenes EGD-e
ccacuuuugcaugaccua

SEQ ID NO: 2806524 - RNA, 15 nt, Listeria monocytogenes EGD-e
ccagaaaaaaacaaa

SEQ ID NO: 2806525 - RNA, 17 nt, Listeria monocytogenes EGD-e
ccagaaagaauuuuuag

SEQ ID NO: 2806526 - RNA, 22 nt, Listeria monocytogenes EGD-e
ccagcacaaguuccaaaaauag

SEQ ID NO: 2806527 - RNA, 23 nt, Listeria monocytogenes EGD-e
ccagcuagacaagcacuuacugc

SEQ ID NO: 2806528 - RNA, 17 nt, Listeria monocytogenes EGD-e
ccaguaguaagggugaa

SEQ ID NO: 2806529 - RNA, 22 nt, Listeria monocytogenes EGD-e
ccaguaguugguaguuuuaaau

SEQ ID NO: 2806530 - RNA, 18 nt, Listeria monocytogenes EGD-e
ccagucacaaacgcuuuu

SEQ ID NO: 2806531 - RNA, 22 nt, Listeria monocytogenes EGD-e
ccagucacaaacgcuuuuucaa

SEQ ID NO: 2806532 - RNA, 19 nt, Listeria monocytogenes EGD-e
ccagugaugguauuguuuu

SEQ ID NO: 2806533 - RNA, 18 nt, Listeria monocytogenes EGD-e
ccaguuaaacaaacacaa

SEQ ID NO: 2806534 - RNA, 17 nt, Listeria monocytogenes EGD-e
ccauaagacauaacaag

SEQ ID NO: 2806535 - RNA, 19 nt, Listeria monocytogenes EGD-e
ccauaagacauaacaagua

SEQ ID NO: 2806536 - RNA, 19 nt, Listeria monocytogenes EGD-e
ccauacuagguguauagaa

SEQ ID NO: 2806537 - RNA, 21 nt, Listeria monocytogenes EGD-e
ccauacuuucugccaaauugg

SEQ ID NO: 2806538 - RNA, 15 nt, Listeria monocytogenes EGD-e
ccauauaaucaauau

SEQ ID NO: 2806539 - RNA, 16 nt, Listeria monocytogenes EGD-e
ccauauaaucaauauc

SEQ ID NO: 2806540 - RNA, 12 nt, Listeria monocytogenes EGD-e
ccauaucaccaa

SEQ ID NO: 2806541 - RNA, 15 nt, Listeria monocytogenes EGD-e
ccaucauaaucccag

SEQ ID NO: 2806542 - RNA, 18 nt, Listeria monocytogenes EGD-e
ccaucauaaucccaguag

SEQ ID NO: 2806543 - RNA, 17 nt, Listeria monocytogenes EGD-e
ccauccugauaacguau

SEQ ID NO: 2806544 - RNA, 13 nt, Listeria monocytogenes EGD-e
ccaucgcagcaga

SEQ ID NO: 2806545 - RNA, 18 nt, Listeria monocytogenes EGD-e
ccaucgccgccuauuauu

SEQ ID NO: 2806546 - RNA, 22 nt, Listeria monocytogenes EGD-e
ccaucugggcucguugcagaaa

SEQ ID NO: 2806547 - RNA, 17 nt, Listeria monocytogenes EGD-e
ccaucuucuaaugccgc

SEQ ID NO: 2806548 - RNA, 19 nt, Listeria monocytogenes EGD-e
ccauucacugauuuauuau

SEQ ID NO: 2806549 - RNA, 17 nt, Listeria monocytogenes EGD-e
ccauugcccagcuuaau

SEQ ID NO: 2806550 - RNA, 18 nt, Listeria monocytogenes EGD-e
ccauugcgaauaacaagc

SEQ ID NO: 2806551 - RNA, 12 nt, Listeria monocytogenes EGD-e
ccauuuguucuc

SEQ ID NO: 2806552 - RNA, 16 nt, Listeria monocytogenes EGD-e
ccauuuuguucuaaga

SEQ ID NO: 2806553 - RNA, 12 nt, Listeria monocytogenes EGD-e
ccauuuuucuuc

SEQ ID NO: 2806554 - RNA, 13 nt, Listeria monocytogenes EGD-e
cccaagauucuuc

SEQ ID NO: 2806555 - RNA, 16 nt, Listeria monocytogenes EGD-e
cccaagauucuucuaa

SEQ ID NO: 2806556 - RNA, 16 nt, Listeria monocytogenes EGD-e
cccagaaaaaaacaaa

SEQ ID NO: 2806557 - RNA, 18 nt, Listeria monocytogenes EGD-e
cccagaaaaaaacaaauu

SEQ ID NO: 2806558 - RNA, 22 nt, Listeria monocytogenes EGD-e
cccagcacaaguuccaaaaaua

SEQ ID NO: 2806559 - RNA, 12 nt, Listeria monocytogenes EGD-e
cccagcuuuucc

SEQ ID NO: 2806560 - RNA, 20 nt, Listeria monocytogenes EGD-e
cccauacuaaucaauaaaga

SEQ ID NO: 2806561 - RNA, 23 nt, Listeria monocytogenes EGD-e
cccgcaaauucaugcaagcgcag

SEQ ID NO: 2806562 - RNA, 14 nt, Listeria monocytogenes EGD-e
cccuauaaaaacau

SEQ ID NO: 2806563 - RNA, 16 nt, Listeria monocytogenes EGD-e
cccuccuuuauuuuuu

SEQ ID NO: 2806564 - RNA, 13 nt, Listeria monocytogenes EGD-e
cccuuucggaccu

SEQ ID NO: 2806565 - RNA, 21 nt, Listeria monocytogenes EGD-e
cccuuuuuuuacauuuuugcu

SEQ ID NO: 2806566 - RNA, 19 nt, Listeria monocytogenes EGD-e
ccgaaucgaguuuuuauuc

SEQ ID NO: 2806567 - RNA, 18 nt, Listeria monocytogenes EGD-e
ccgauaauagguccgaua

SEQ ID NO: 2806568 - RNA, 21 nt, Listeria monocytogenes EGD-e
ccgauaauuuucauuuguuuc

SEQ ID NO: 2806569 - RNA, 18 nt, Listeria monocytogenes EGD-e
ccgauacaacaaaauaau

SEQ ID NO: 2806570 - RNA, 23 nt, Listeria monocytogenes EGD-e
ccgauacaacaaaauaaucaauc

SEQ ID NO: 2806571 - RNA, 13 nt, Listeria monocytogenes EGD-e
ccgcagcuucaau

SEQ ID NO: 2806572 - RNA, 17 nt, Listeria monocytogenes EGD-e
ccgccuauuauuucugc

SEQ ID NO: 2806573 - RNA, 22 nt, Listeria monocytogenes EGD-e
ccgcuugauguuuuugcuucuc

SEQ ID NO: 2806574 - RNA, 13 nt, Listeria monocytogenes EGD-e
ccgguuuggaugu

SEQ ID NO: 2806575 - RNA, 19 nt, Listeria monocytogenes EGD-e
ccgugaaauucuucgcuug

SEQ ID NO: 2806576 - RNA, 23 nt, Listeria monocytogenes EGD-e
ccgugagaacgacaaaugguuca

SEQ ID NO: 2806577 - RNA, 22 nt, Listeria monocytogenes EGD-e
ccguucauuugaaaaagggcug

SEQ ID NO: 2806578 - RNA, 12 nt, Listeria monocytogenes EGD-e
ccuaaaucagca

SEQ ID NO: 2806579 - RNA, 15 nt, Listeria monocytogenes EGD-e
ccuaauuguuuuguu

SEQ ID NO: 2806580 - RNA, 16 nt, Listeria monocytogenes EGD-e
ccuaauuuuacuucua

SEQ ID NO: 2806581 - RNA, 14 nt, Listeria monocytogenes EGD-e
ccuagaacuaauuc

SEQ ID NO: 2806582 - RNA, 16 nt, Listeria monocytogenes EGD-e
ccuagaacuaauucua

SEQ ID NO: 2806583 - RNA, 18 nt, Listeria monocytogenes EGD-e
ccuagccagacaucuuug

SEQ ID NO: 2806584 - RNA, 16 nt, Listeria monocytogenes EGD-e
ccuaucacaaaccaaa

SEQ ID NO: 2806585 - RNA, 13 nt, Listeria monocytogenes EGD-e
ccuccuuuauuuu

SEQ ID NO: 2806586 - RNA, 21 nt, Listeria monocytogenes EGD-e
ccucuaagucugcuuuuucaa

SEQ ID NO: 2806587 - RNA, 20 nt, Listeria monocytogenes EGD-e
ccugaaacauagucagggaa

SEQ ID NO: 2806588 - RNA, 13 nt, Listeria monocytogenes EGD-e
ccugaaagaacug

SEQ ID NO: 2806589 - RNA, 19 nt, Listeria monocytogenes EGD-e
ccugaauaagucgaaagug

SEQ ID NO: 2806590 - RNA, 20 nt, Listeria monocytogenes EGD-e
ccugcgucuucuacuuuuac

SEQ ID NO: 2806591 - RNA, 14 nt, Listeria monocytogenes EGD-e
ccugcuaaaaccau

SEQ ID NO: 2806592 - RNA, 11 nt, Listeria monocytogenes EGD-e
ccuuaaaauaa

SEQ ID NO: 2806593 - RNA, 15 nt, Listeria monocytogenes EGD-e
ccuuaaauaaaaacu

SEQ ID NO: 2806594 - RNA, 14 nt, Listeria monocytogenes EGD-e
ccuucaagcauauu

SEQ ID NO: 2806595 - RNA, 16 nt, Listeria monocytogenes EGD-e
ccuucaagcauauuaa

SEQ ID NO: 2806596 - RNA, 12 nt, Listeria monocytogenes EGD-e
ccuucaagcauu

SEQ ID NO: 2806597 - RNA, 13 nt, Listeria monocytogenes EGD-e
ccuucaauaauau

SEQ ID NO: 2806598 - RNA, 17 nt, Listeria monocytogenes EGD-e
ccuucauaauuauuuuu

SEQ ID NO: 2806599 - RNA, 18 nt, Listeria monocytogenes EGD-e
ccuucauaauuauuuuug

SEQ ID NO: 2806600 - RNA, 18 nt, Listeria monocytogenes EGD-e
ccuucaucguuuaacaua

SEQ ID NO: 2806601 - RNA, 21 nt, Listeria monocytogenes EGD-e
ccuucuaauacgacaccaauu

SEQ ID NO: 2806602 - RNA, 14 nt, Listeria monocytogenes EGD-e
ccuugaucaaaauu

SEQ ID NO: 2806603 - RNA, 21 nt, Listeria monocytogenes EGD-e
ccuugcugcucgcucaucauc

SEQ ID NO: 2806604 - RNA, 17 nt, Listeria monocytogenes EGD-e
ccuuguuuuuuguauuc

SEQ ID NO: 2806605 - RNA, 13 nt, Listeria monocytogenes EGD-e
ccuuuacuugcaa

SEQ ID NO: 2806606 - RNA, 13 nt, Listeria monocytogenes EGD-e
ccuuuauuuuuua

SEQ ID NO: 2806607 - RNA, 15 nt, Listeria monocytogenes EGD-e
ccuuucuuuuuuaau

SEQ ID NO: 2806608 - RNA, 21 nt, Listeria monocytogenes EGD-e
ccuuugaauugauuuuuuuga

SEQ ID NO: 2806609 - RNA, 21 nt, Listeria monocytogenes EGD-e
ccuuuguuacgggugagcuuc

SEQ ID NO: 2806610 - RNA, 11 nt, Listeria monocytogenes EGD-e
ccuuuuuucau

SEQ ID NO: 2806611 - RNA, 23 nt, Listeria monocytogenes EGD-e
cgaaaaacauuauuuugcuaaag

SEQ ID NO: 2806612 - RNA, 22 nt, Listeria monocytogenes EGD-e
cgaaaaaucauuaaauuuagcu

SEQ ID NO: 2806613 - RNA, 15 nt, Listeria monocytogenes EGD-e
cgaaaagcaaugaga

SEQ ID NO: 2806614 - RNA, 13 nt, Listeria monocytogenes EGD-e
cgaaagaauaaaa

SEQ ID NO: 2806615 - RNA, 15 nt, Listeria monocytogenes EGD-e
cgaaagaauaaaaca

SEQ ID NO: 2806616 - RNA, 18 nt, Listeria monocytogenes EGD-e
cgaacauaccaauaacga

SEQ ID NO: 2806617 - RNA, 17 nt, Listeria monocytogenes EGD-e
cgaauaaaaucauaaua

SEQ ID NO: 2806618 - RNA, 11 nt, Listeria monocytogenes EGD-e
cgaauaagaac

SEQ ID NO: 2806619 - RNA, 14 nt, Listeria monocytogenes EGD-e
cgaauagcauaaua

SEQ ID NO: 2806620 - RNA, 15 nt, Listeria monocytogenes EGD-e
cgaauagcauaauag

SEQ ID NO: 2806621 - RNA, 17 nt, Listeria monocytogenes EGD-e
cgaaucaagauuuugcu

SEQ ID NO: 2806622 - RNA, 23 nt, Listeria monocytogenes EGD-e
cgaauccuuuuagugucaguccu

SEQ ID NO: 2806623 - RNA, 13 nt, Listeria monocytogenes EGD-e
cgaaugaacuuca

SEQ ID NO: 2806624 - RNA, 17 nt, Listeria monocytogenes EGD-e
cgaauguuaaauucauu

SEQ ID NO: 2806625 - RNA, 15 nt, Listeria monocytogenes EGD-e
cgaauucuuuuucuu

SEQ ID NO: 2806626 - RNA, 12 nt, Listeria monocytogenes EGD-e
cgaauuuuucaa

SEQ ID NO: 2806627 - RNA, 21 nt, Listeria monocytogenes EGD-e
cgaauuuuucaaggcuuucuu

SEQ ID NO: 2806628 - RNA, 18 nt, Listeria monocytogenes EGD-e
cgacaaaugguucacuuu

SEQ ID NO: 2806629 - RNA, 18 nt, Listeria monocytogenes EGD-e
cgacaauaccauguuuau

SEQ ID NO: 2806630 - RNA, 23 nt, Listeria monocytogenes EGD-e
cgacaauuaugucggugcauuuu

SEQ ID NO: 2806631 - RNA, 16 nt, Listeria monocytogenes EGD-e
cgacaguuucuuuuug

SEQ ID NO: 2806632 - RNA, 15 nt, Listeria monocytogenes EGD-e
cgacguuuaucaaua

SEQ ID NO: 2806633 - RNA, 17 nt, Listeria monocytogenes EGD-e
cgacguuuaucaauaau

SEQ ID NO: 2806634 - RNA, 19 nt, Listeria monocytogenes EGD-e
cgaguacaauuauaguuug

SEQ ID NO: 2806635 - RNA, 18 nt, Listeria monocytogenes EGD-e
cgauaaagcgguaucccu

SEQ ID NO: 2806636 - RNA, 12 nt, Listeria monocytogenes EGD-e
cgauaacguguu

SEQ ID NO: 2806637 - RNA, 15 nt, Listeria monocytogenes EGD-e
cgauaagcaucuagu

SEQ ID NO: 2806638 - RNA, 15 nt, Listeria monocytogenes EGD-e
cgauaauuuucauuu

SEQ ID NO: 2806639 - RNA, 16 nt, Listeria monocytogenes EGD-e
cgauacaacaaaauaa

SEQ ID NO: 2806640 - RNA, 12 nt, Listeria monocytogenes EGD-e
cgauaguuccuu

SEQ ID NO: 2806641 - RNA, 18 nt, Listeria monocytogenes EGD-e
cgauauuuuuuuguucug

SEQ ID NO: 2806642 - RNA, 16 nt, Listeria monocytogenes EGD-e
cgaucagccauuuuac

SEQ ID NO: 2806643 - RNA, 13 nt, Listeria monocytogenes EGD-e
cgauggaaccauu

SEQ ID NO: 2806644 - RNA, 19 nt, Listeria monocytogenes EGD-e
cgaugugggaaugaauaga

SEQ ID NO: 2806645 - RNA, 12 nt, Listeria monocytogenes EGD-e
cgauguuaccac

SEQ ID NO: 2806646 - RNA, 21 nt, Listeria monocytogenes EGD-e
cgauguuaccacgaguugcuu

SEQ ID NO: 2806647 - RNA, 22 nt, Listeria monocytogenes EGD-e
cgauguucauuacuucagccac

SEQ ID NO: 2806648 - RNA, 20 nt, Listeria monocytogenes EGD-e
cgauugucguuaguaaguuc

SEQ ID NO: 2806649 - RNA, 16 nt, Listeria monocytogenes EGD-e
cgcaagugcuaaaaua

SEQ ID NO: 2806650 - RNA, 17 nt, Listeria monocytogenes EGD-e
cgcacguuuuaguggag

SEQ ID NO: 2806651 - RNA, 15 nt, Listeria monocytogenes EGD-e
cgcaucugcuaauac

SEQ ID NO: 2806652 - RNA, 14 nt, Listeria monocytogenes EGD-e
cgcaucuucguaua

SEQ ID NO: 2806653 - RNA, 19 nt, Listeria monocytogenes EGD-e
cgcaucuucguauauuuua

SEQ ID NO: 2806654 - RNA, 17 nt, Listeria monocytogenes EGD-e
cgcauugauuuuugaau

SEQ ID NO: 2806655 - RNA, 19 nt, Listeria monocytogenes EGD-e
cgccaccaacuucgagcag

SEQ ID NO: 2806656 - RNA, 15 nt, Listeria monocytogenes EGD-e
cgccagcuucacgca

SEQ ID NO: 2806657 - RNA, 19 nt, Listeria monocytogenes EGD-e
cgccaguugcugaauauca

SEQ ID NO: 2806658 - RNA, 14 nt, Listeria monocytogenes EGD-e
cgccuauuauuucu

SEQ ID NO: 2806659 - RNA, 23 nt, Listeria monocytogenes EGD-e
cgcgccauuugccaucgcagcag

SEQ ID NO: 2806660 - RNA, 17 nt, Listeria monocytogenes EGD-e
cgcguucauucgguaag

SEQ ID NO: 2806661 - RNA, 19 nt, Listeria monocytogenes EGD-e
cgcguucuugucuugcaag

SEQ ID NO: 2806662 - RNA, 13 nt, Listeria monocytogenes EGD-e
cgcuaaucuucuu

SEQ ID NO: 2806663 - RNA, 22 nt, Listeria monocytogenes EGD-e
cgcuccguauuuauauucuucu

SEQ ID NO: 2806664 - RNA, 20 nt, Listeria monocytogenes EGD-e
cgcugauauccauugcaauc

SEQ ID NO: 2806665 - RNA, 15 nt, Listeria monocytogenes EGD-e
cgcugccuuaagcaa

SEQ ID NO: 2806666 - RNA, 15 nt, Listeria monocytogenes EGD-e
cgcuguccauuccaa

SEQ ID NO: 2806667 - RNA, 21 nt, Listeria monocytogenes EGD-e
cgcuucggcaacaagagauaa

SEQ ID NO: 2806668 - RNA, 20 nt, Listeria monocytogenes EGD-e
cgcuuucaaacgaucagcca

SEQ ID NO: 2806669 - RNA, 12 nt, Listeria monocytogenes EGD-e
cgcuuugguucc

SEQ ID NO: 2806670 - RNA, 21 nt, Listeria monocytogenes EGD-e
cggaaauucccggucauuuuc

SEQ ID NO: 2806671 - RNA, 21 nt, Listeria monocytogenes EGD-e
cggagacaguuuguauaagag

SEQ ID NO: 2806672 - RNA, 20 nt, Listeria monocytogenes EGD-e
cggaucgcgguagcuucaau

SEQ ID NO: 2806673 - RNA, 14 nt, Listeria monocytogenes EGD-e
cggauuuuucaaau

SEQ ID NO: 2806674 - RNA, 20 nt, Listeria monocytogenes EGD-e
cggcauuucaaucgcagcag

SEQ ID NO: 2806675 - RNA, 18 nt, Listeria monocytogenes EGD-e
cggccuccuguugcacca

SEQ ID NO: 2806676 - RNA, 14 nt, Listeria monocytogenes EGD-e
cggcuuauuauaac

SEQ ID NO: 2806677 - RNA, 22 nt, Listeria monocytogenes EGD-e
cgggaacgaauccuuggaaaaa

SEQ ID NO: 2806678 - RNA, 15 nt, Listeria monocytogenes EGD-e
cggggaaauaguuuu

SEQ ID NO: 2806679 - RNA, 17 nt, Listeria monocytogenes EGD-e
cggggacuugggguacu

SEQ ID NO: 2806680 - RNA, 14 nt, Listeria monocytogenes EGD-e
cgguccuucaaucg

SEQ ID NO: 2806681 - RNA, 16 nt, Listeria monocytogenes EGD-e
cgguuaauuuccauuu

SEQ ID NO: 2806682 - RNA, 23 nt, Listeria monocytogenes EGD-e
cgguuuucaugaagcaaaccauu

SEQ ID NO: 2806683 - RNA, 15 nt, Listeria monocytogenes EGD-e
cgguuuuguuuccaa

SEQ ID NO: 2806684 - RNA, 17 nt, Listeria monocytogenes EGD-e
cguaacgggucgcuguc

SEQ ID NO: 2806685 - RNA, 17 nt, Listeria monocytogenes EGD-e
cguaauauauucaaaau

SEQ ID NO: 2806686 - RNA, 21 nt, Listeria monocytogenes EGD-e
cguaauauauucaaaauggua

SEQ ID NO: 2806687 - RNA, 20 nt, Listeria monocytogenes EGD-e
cguacaugaugauuguucuu

SEQ ID NO: 2806688 - RNA, 17 nt, Listeria monocytogenes EGD-e
cguacgauugcuucacc

SEQ ID NO: 2806689 - RNA, 21 nt, Listeria monocytogenes EGD-e
cguagcagauguaucuaaaau

SEQ ID NO: 2806690 - RNA, 14 nt, Listeria monocytogenes EGD-e
cguaucaauaacaa

SEQ ID NO: 2806691 - RNA, 13 nt, Listeria monocytogenes EGD-e
cguauccagccgc

SEQ ID NO: 2806692 - RNA, 23 nt, Listeria monocytogenes EGD-e
cguauuaucaauuacgcuuuagu

SEQ ID NO: 2806693 - RNA, 19 nt, Listeria monocytogenes EGD-e
cgucaaagcguucaaguga

SEQ ID NO: 2806694 - RNA, 20 nt, Listeria monocytogenes EGD-e
cgucauagauacucuuuaaa

SEQ ID NO: 2806695 - RNA, 21 nt, Listeria monocytogenes EGD-e
cgucccauugcgaauaacaag

SEQ ID NO: 2806696 - RNA, 18 nt, Listeria monocytogenes EGD-e
cgucgcaucaaucgccag

SEQ ID NO: 2806697 - RNA, 14 nt, Listeria monocytogenes EGD-e
cgucuuagaaaaau

SEQ ID NO: 2806698 - RNA, 24 nt, Listeria monocytogenes EGD-e
cgucuuuucaacuccccagugaaa

SEQ ID NO: 2806699 - RNA, 20 nt, Listeria monocytogenes EGD-e
cgugcuaauucuguuaaaug

SEQ ID NO: 2806700 - RNA, 17 nt, Listeria monocytogenes EGD-e
cguguugauaaagauaa

SEQ ID NO: 2806701 - RNA, 22 nt, Listeria monocytogenes EGD-e
cguuaguaaacuugcaucuucu

SEQ ID NO: 2806702 - RNA, 17 nt, Listeria monocytogenes EGD-e
cguuccaguuaaacaaa

SEQ ID NO: 2806703 - RNA, 21 nt, Listeria monocytogenes EGD-e
cguucccgcaaauucaugcaa

SEQ ID NO: 2806704 - RNA, 17 nt, Listeria monocytogenes EGD-e
cguuccgauacaacaaa

SEQ ID NO: 2806705 - RNA, 18 nt, Listeria monocytogenes EGD-e
cguuuaaagcguuuuucu

SEQ ID NO: 2806706 - RNA, 19 nt, Listeria monocytogenes EGD-e
cguuuaaagcguuuuucug

SEQ ID NO: 2806707 - RNA, 13 nt, Listeria monocytogenes EGD-e
cguuuaucaauaa

SEQ ID NO: 2806708 - RNA, 13 nt, Listeria monocytogenes EGD-e
cguuucaacccac

SEQ ID NO: 2806709 - RNA, 19 nt, Listeria monocytogenes EGD-e
cguuucacuuuaucccaga

SEQ ID NO: 2806710 - RNA, 14 nt, Listeria monocytogenes EGD-e
cguuuuccaccauu

SEQ ID NO: 2806711 - RNA, 12 nt, Listeria monocytogenes EGD-e
cguuuuuacuua

SEQ ID NO: 2806712 - RNA, 17 nt, Listeria monocytogenes EGD-e
cuaaaaagguauccuua

SEQ ID NO: 2806713 - RNA, 17 nt, Listeria monocytogenes EGD-e
cuaaaacaggcguaaua

SEQ ID NO: 2806714 - RNA, 19 nt, Listeria monocytogenes EGD-e
cuaaaacaggcguaauaaa

SEQ ID NO: 2806715 - RNA, 18 nt, Listeria monocytogenes EGD-e
cuaaacgaccaucugggc

SEQ ID NO: 2806716 - RNA, 17 nt, Listeria monocytogenes EGD-e
cuaaaggcaacaaagaa

SEQ ID NO: 2806717 - RNA, 16 nt, Listeria monocytogenes EGD-e
cuaaaguuagauuaaa

SEQ ID NO: 2806718 - RNA, 20 nt, Listeria monocytogenes EGD-e
cuaaaguuagauuaaaaauc

SEQ ID NO: 2806719 - RNA, 14 nt, Listeria monocytogenes EGD-e
cuaaauaaauauuu

SEQ ID NO: 2806720 - RNA, 15 nt, Listeria monocytogenes EGD-e
cuaaauacguauuac

SEQ ID NO: 2806721 - RNA, 13 nt, Listeria monocytogenes EGD-e
cuaaaucuuuucg

SEQ ID NO: 2806722 - RNA, 17 nt, Listeria monocytogenes EGD-e
cuaaauuaauuugacca

SEQ ID NO: 2806723 - RNA, 17 nt, Listeria monocytogenes EGD-e
cuaaauugauaccaaau

SEQ ID NO: 2806724 - RNA, 19 nt, Listeria monocytogenes EGD-e
cuaaauugugaaauuuuua

SEQ ID NO: 2806725 - RNA, 18 nt, Listeria monocytogenes EGD-e
cuaacaauuuauacacau

SEQ ID NO: 2806726 - RNA, 15 nt, Listeria monocytogenes EGD-e
cuaacacuuauauga

SEQ ID NO: 2806727 - RNA, 15 nt, Listeria monocytogenes EGD-e
cuaagaaaaaaaguu

SEQ ID NO: 2806728 - RNA, 21 nt, Listeria monocytogenes EGD-e
cuaagaaaaaaaguuauauuu

SEQ ID NO: 2806729 - RNA, 13 nt, Listeria monocytogenes EGD-e
cuaagaagagucc

SEQ ID NO: 2806730 - RNA, 17 nt, Listeria monocytogenes EGD-e
cuaagucaucggcuuuu

SEQ ID NO: 2806731 - RNA, 15 nt, Listeria monocytogenes EGD-e
cuaaguuaaaccaua

SEQ ID NO: 2806732 - RNA, 15 nt, Listeria monocytogenes EGD-e
cuaaguuuucuaaac

SEQ ID NO: 2806733 - RNA, 21 nt, Listeria monocytogenes EGD-e
cuaauaacauuaaaccucuuu

SEQ ID NO: 2806734 - RNA, 13 nt, Listeria monocytogenes EGD-e
cuaauaauuuuaa

SEQ ID NO: 2806735 - RNA, 20 nt, Listeria monocytogenes EGD-e
cuaauacgacaccaauuuua

SEQ ID NO: 2806736 - RNA, 20 nt, Listeria monocytogenes EGD-e
cuaaucaaaugcacagcaga

SEQ ID NO: 2806737 - RNA, 21 nt, Listeria monocytogenes EGD-e
cuaauccagcuugauuaaaac

SEQ ID NO: 2806738 - RNA, 15 nt, Listeria monocytogenes EGD-e
cuaauuagcauaaua

SEQ ID NO: 2806739 - RNA, 21 nt, Listeria monocytogenes EGD-e
cuaauuuaggggcauaucuuu

SEQ ID NO: 2806740 - RNA, 17 nt, Listeria monocytogenes EGD-e
cuaauuuuacuucuacu

SEQ ID NO: 2806741 - RNA, 19 nt, Listeria monocytogenes EGD-e
cuaauuuuacuucuacuug

SEQ ID NO: 2806742 - RNA, 14 nt, Listeria monocytogenes EGD-e
cuaauuuuuuuaua

SEQ ID NO: 2806743 - RNA, 17 nt, Listeria monocytogenes EGD-e
cuaauuuuuuuauaccu

SEQ ID NO: 2806744 - RNA, 16 nt, Listeria monocytogenes EGD-e
cuacaacuggcacagc

SEQ ID NO: 2806745 - RNA, 15 nt, Listeria monocytogenes EGD-e
cuacaauuaaaauag

SEQ ID NO: 2806746 - RNA, 14 nt, Listeria monocytogenes EGD-e
cuacauacuuauag

SEQ ID NO: 2806747 - RNA, 15 nt, Listeria monocytogenes EGD-e
cuacgacgcuuuagc

SEQ ID NO: 2806748 - RNA, 18 nt, Listeria monocytogenes EGD-e
cuacuagugaaauagaau

SEQ ID NO: 2806749 - RNA, 14 nt, Listeria monocytogenes EGD-e
cuacuggauaaaau

SEQ ID NO: 2806750 - RNA, 20 nt, Listeria monocytogenes EGD-e
cuacuggguaaguagcauuu

SEQ ID NO: 2806751 - RNA, 18 nt, Listeria monocytogenes EGD-e
cuacuucuaaauaguccc

SEQ ID NO: 2806752 - RNA, 21 nt, Listeria monocytogenes EGD-e
cuacuucuaaauuaacuucau

SEQ ID NO: 2806753 - RNA, 19 nt, Listeria monocytogenes EGD-e
cuacuuuuuuuauuuaccu

SEQ ID NO: 2806754 - RNA, 23 nt, Listeria monocytogenes EGD-e
cuagauuuagaggcguacuaaaa

SEQ ID NO: 2806755 - RNA, 12 nt, Listeria monocytogenes EGD-e
cuagcaauuucg

SEQ ID NO: 2806756 - RNA, 19 nt, Listeria monocytogenes EGD-e
cuagccagacaucuuugcc

SEQ ID NO: 2806757 - RNA, 12 nt, Listeria monocytogenes EGD-e
cuagcuauacau

SEQ ID NO: 2806758 - RNA, 23 nt, Listeria monocytogenes EGD-e
cuagcuuugucuagguuuucuuu

SEQ ID NO: 2806759 - RNA, 13 nt, Listeria monocytogenes EGD-e
cuagguucuuuuu

SEQ ID NO: 2806760 - RNA, 16 nt, Listeria monocytogenes EGD-e
cuagguuuucuuuuuu

SEQ ID NO: 2806761 - RNA, 15 nt, Listeria monocytogenes EGD-e
cuaguaauuuaauug

SEQ ID NO: 2806762 - RNA, 18 nt, Listeria monocytogenes EGD-e
cuaguagcaauuuuaaau

SEQ ID NO: 2806763 - RNA, 14 nt, Listeria monocytogenes EGD-e
cuaguuguaaaccg

SEQ ID NO: 2806764 - RNA, 13 nt, Listeria monocytogenes EGD-e
cuauaaaaacaug

SEQ ID NO: 2806765 - RNA, 16 nt, Listeria monocytogenes EGD-e
cuauaaaaacaugaua

SEQ ID NO: 2806766 - RNA, 19 nt, Listeria monocytogenes EGD-e
cuauaaagaacuagauuua

SEQ ID NO: 2806767 - RNA, 16 nt, Listeria monocytogenes EGD-e
cuauacauugaaaaaa

SEQ ID NO: 2806768 - RNA, 20 nt, Listeria monocytogenes EGD-e
cuauauucauccucauauuu

SEQ ID NO: 2806769 - RNA, 13 nt, Listeria monocytogenes EGD-e
cuaucaaccacuu

SEQ ID NO: 2806770 - RNA, 14 nt, Listeria monocytogenes EGD-e
cuaucaucuucucg

SEQ ID NO: 2806771 - RNA, 16 nt, Listeria monocytogenes EGD-e
cuauuccuccuaauug

SEQ ID NO: 2806772 - RNA, 23 nt, Listeria monocytogenes EGD-e
cuauucuauuuaucaaacaaaaa

SEQ ID NO: 2806773 - RNA, 18 nt, Listeria monocytogenes EGD-e
cuauugaauguucuaaaa

SEQ ID NO: 2806774 - RNA, 23 nt, Listeria monocytogenes EGD-e
cuauuguaaauguugguguagga

SEQ ID NO: 2806775 - RNA, 21 nt, Listeria monocytogenes EGD-e
cuauuuaaauauaacuuuuuu

SEQ ID NO: 2806776 - RNA, 23 nt, Listeria monocytogenes EGD-e
cuauuucagcuaaucguuuuaaa

SEQ ID NO: 2806777 - RNA, 19 nt, Listeria monocytogenes EGD-e
cuauuuggauacaaguguc

SEQ ID NO: 2806778 - RNA, 14 nt, Listeria monocytogenes EGD-e
cuauuuuuuugcuu

SEQ ID NO: 2806779 - RNA, 20 nt, Listeria monocytogenes EGD-e
cuauuuuuuugcuuuuuaag

SEQ ID NO: 2806780 - RNA, 20 nt, Listeria monocytogenes EGD-e
cucaagugaacguacaacua

SEQ ID NO: 2806781 - RNA, 14 nt, Listeria monocytogenes EGD-e
cucacaauuuaagu

SEQ ID NO: 2806782 - RNA, 21 nt, Listeria monocytogenes EGD-e
cucaggaguuaauucuguuaa

SEQ ID NO: 2806783 - RNA, 13 nt, Listeria monocytogenes EGD-e
cucauaagagaau

SEQ ID NO: 2806784 - RNA, 17 nt, Listeria monocytogenes EGD-e
cucauaagcuucauaaa

SEQ ID NO: 2806785 - RNA, 21 nt, Listeria monocytogenes EGD-e
cucauauuuggccaauuaaaa

SEQ ID NO: 2806786 - RNA, 23 nt, Listeria monocytogenes EGD-e
cucauauuuggccaauuaaaaua

SEQ ID NO: 2806787 - RNA, 18 nt, Listeria monocytogenes EGD-e
cucaucaccagcuucuaa

SEQ ID NO: 2806788 - RNA, 22 nt, Listeria monocytogenes EGD-e
cucauguucaaucucaucacca

SEQ ID NO: 2806789 - RNA, 20 nt, Listeria monocytogenes EGD-e
cucauuacucgguucaauua

SEQ ID NO: 2806790 - RNA, 19 nt, Listeria monocytogenes EGD-e
cucauugaggaauacuguu

SEQ ID NO: 2806791 - RNA, 17 nt, Listeria monocytogenes EGD-e
cucauuuuucuugcugg

SEQ ID NO: 2806792 - RNA, 13 nt, Listeria monocytogenes EGD-e
cuccaaaauaaaa

SEQ ID NO: 2806793 - RNA, 20 nt, Listeria monocytogenes EGD-e
cuccaauaauaguugauaua

SEQ ID NO: 2806794 - RNA, 14 nt, Listeria monocytogenes EGD-e
cuccguauccagcc

SEQ ID NO: 2806795 - RNA, 14 nt, Listeria monocytogenes EGD-e
cuccguauuuauau

SEQ ID NO: 2806796 - RNA, 18 nt, Listeria monocytogenes EGD-e
cuccguauuuauauucuu

SEQ ID NO: 2806797 - RNA, 14 nt, Listeria monocytogenes EGD-e
cuccuaauuguuuu

SEQ ID NO: 2806798 - RNA, 23 nt, Listeria monocytogenes EGD-e
cuccugccguauguccagucacu

SEQ ID NO: 2806799 - RNA, 16 nt, Listeria monocytogenes EGD-e
cuccuuuauuuuuuau

SEQ ID NO: 2806800 - RNA, 20 nt, Listeria monocytogenes EGD-e
cuccuuuauuuuuuauuuua

SEQ ID NO: 2806801 - RNA, 14 nt, Listeria monocytogenes EGD-e
cucgaauucuuuuu

SEQ ID NO: 2806802 - RNA, 14 nt, Listeria monocytogenes EGD-e
cucgacuucaagga

SEQ ID NO: 2806803 - RNA, 16 nt, Listeria monocytogenes EGD-e
cucgauaacguguuua

SEQ ID NO: 2806804 - RNA, 18 nt, Listeria monocytogenes EGD-e
cucgcucuguuucauuuu

SEQ ID NO: 2806805 - RNA, 18 nt, Listeria monocytogenes EGD-e
cucuaagucugcuuuuuc

SEQ ID NO: 2806806 - RNA, 23 nt, Listeria monocytogenes EGD-e
cucuaagucugcuuuuucaagua

SEQ ID NO: 2806807 - RNA, 11 nt, Listeria monocytogenes EGD-e
cucucccauuu

SEQ ID NO: 2806808 - RNA, 14 nt, Listeria monocytogenes EGD-e
cucuguuucauuuu

SEQ ID NO: 2806809 - RNA, 18 nt, Listeria monocytogenes EGD-e
cucuucgccaccuucaau

SEQ ID NO: 2806810 - RNA, 23 nt, Listeria monocytogenes EGD-e
cucuuuaaauccauuucauucuu

SEQ ID NO: 2806811 - RNA, 18 nt, Listeria monocytogenes EGD-e
cucuuucugccuaccaaa

SEQ ID NO: 2806812 - RNA, 21 nt, Listeria monocytogenes EGD-e
cucuuuuuuuaguaaacauuu

SEQ ID NO: 2806813 - RNA, 22 nt, Listeria monocytogenes EGD-e
cugaaaauguugcaauuuugcu

SEQ ID NO: 2806814 - RNA, 14 nt, Listeria monocytogenes EGD-e
cugaaauagcauuc

SEQ ID NO: 2806815 - RNA, 18 nt, Listeria monocytogenes EGD-e
cugaacugacuagaaauu

SEQ ID NO: 2806816 - RNA, 14 nt, Listeria monocytogenes EGD-e
cugaauaaguaaua

SEQ ID NO: 2806817 - RNA, 12 nt, Listeria monocytogenes EGD-e
cugauuuauuau

SEQ ID NO: 2806818 - RNA, 19 nt, Listeria monocytogenes EGD-e
cugauuuuauuuuuauuau

SEQ ID NO: 2806819 - RNA, 22 nt, Listeria monocytogenes EGD-e
cugcaacaacuaacacuuauau

SEQ ID NO: 2806820 - RNA, 22 nt, Listeria monocytogenes EGD-e
cugcaagcgaauuaauaaaaga

SEQ ID NO: 2806821 - RNA, 22 nt, Listeria monocytogenes EGD-e
cugcaaucauuuauuuucccuc

SEQ ID NO: 2806822 - RNA, 20 nt, Listeria monocytogenes EGD-e
cugcaauuucaaccaauucu

SEQ ID NO: 2806823 - RNA, 15 nt, Listeria monocytogenes EGD-e
cugcagaaugagcuc

SEQ ID NO: 2806824 - RNA, 22 nt, Listeria monocytogenes EGD-e
cugcauccaagcggguuuucuc

SEQ ID NO: 2806825 - RNA, 21 nt, Listeria monocytogenes EGD-e
cugcauuucauuuuaaucauu

SEQ ID NO: 2806826 - RNA, 12 nt, Listeria monocytogenes EGD-e
cugccaaauugg

SEQ ID NO: 2806827 - RNA, 11 nt, Listeria monocytogenes EGD-e
cugccaccacu

SEQ ID NO: 2806828 - RNA, 13 nt, Listeria monocytogenes EGD-e
cugccaccacuua

SEQ ID NO: 2806829 - RNA, 13 nt, Listeria monocytogenes EGD-e
cugccguaugucc

SEQ ID NO: 2806830 - RNA, 14 nt, Listeria monocytogenes EGD-e
cugccguaugucca

SEQ ID NO: 2806831 - RNA, 12 nt, Listeria monocytogenes EGD-e
cugcuaaaacca

SEQ ID NO: 2806832 - RNA, 20 nt, Listeria monocytogenes EGD-e
cugcuaaaggcaacaaagaa

SEQ ID NO: 2806833 - RNA, 21 nt, Listeria monocytogenes EGD-e
cugcuucguccagcugcuuca

SEQ ID NO: 2806834 - RNA, 11 nt, Listeria monocytogenes EGD-e
cugcuuuuuca

SEQ ID NO: 2806835 - RNA, 11 nt, Listeria monocytogenes EGD-e
cuggaagagcg

SEQ ID NO: 2806836 - RNA, 16 nt, Listeria monocytogenes EGD-e
cuggauaaaaauaacg

SEQ ID NO: 2806837 - RNA, 17 nt, Listeria monocytogenes EGD-e
cuggauaaagaccuaaa

SEQ ID NO: 2806838 - RNA, 16 nt, Listeria monocytogenes EGD-e
cuggauuucuccguaa

SEQ ID NO: 2806839 - RNA, 21 nt, Listeria monocytogenes EGD-e
cuggauuucuccguaagaaga

SEQ ID NO: 2806840 - RNA, 23 nt, Listeria monocytogenes EGD-e
cugggaauauccuuguuguucua

SEQ ID NO: 2806841 - RNA, 20 nt, Listeria monocytogenes EGD-e
cugggaguuuuuuauuauug

SEQ ID NO: 2806842 - RNA, 21 nt, Listeria monocytogenes EGD-e
cugguucgauuucugcagaau

SEQ ID NO: 2806843 - RNA, 13 nt, Listeria monocytogenes EGD-e
cuguaaaaauaaa

SEQ ID NO: 2806844 - RNA, 19 nt, Listeria monocytogenes EGD-e
cuguaacaaaaucuuuuug

SEQ ID NO: 2806845 - RNA, 18 nt, Listeria monocytogenes EGD-e
cuguaauucgaauaagaa

SEQ ID NO: 2806846 - RNA, 22 nt, Listeria monocytogenes EGD-e
cuguaccggucugugauuacuc

SEQ ID NO: 2806847 - RNA, 18 nt, Listeria monocytogenes EGD-e
cuguaucgccaacuucuu

SEQ ID NO: 2806848 - RNA, 12 nt, Listeria monocytogenes EGD-e
cuguauuaaucc

SEQ ID NO: 2806849 - RNA, 17 nt, Listeria monocytogenes EGD-e
cuguuaaaugauuuuua

SEQ ID NO: 2806850 - RNA, 18 nt, Listeria monocytogenes EGD-e
cuguuacugugcucuuug

SEQ ID NO: 2806851 - RNA, 15 nt, Listeria monocytogenes EGD-e
cuguucguacauuuu

SEQ ID NO: 2806852 - RNA, 14 nt, Listeria monocytogenes EGD-e
cuguugcuaacaca

SEQ ID NO: 2806853 - RNA, 15 nt, Listeria monocytogenes EGD-e
cuguuguuuaauaug

SEQ ID NO: 2806854 - RNA, 17 nt, Listeria monocytogenes EGD-e
cuguuucauuuuuccaa

SEQ ID NO: 2806855 - RNA, 18 nt, Listeria monocytogenes EGD-e
cuguuuucaacaaaacaa

SEQ ID NO: 2806856 - RNA, 19 nt, Listeria monocytogenes EGD-e
cuguuuucaacaaaacaaa

SEQ ID NO: 2806857 - RNA, 13 nt, Listeria monocytogenes EGD-e
cuuaaaaauuuug

SEQ ID NO: 2806858 - RNA, 18 nt, Listeria monocytogenes EGD-e
cuuaaaauaaaaaaauac

SEQ ID NO: 2806859 - RNA, 15 nt, Listeria monocytogenes EGD-e
cuuaaagguuuuguu

SEQ ID NO: 2806860 - RNA, 15 nt, Listeria monocytogenes EGD-e
cuuaaauaaaaacua

SEQ ID NO: 2806861 - RNA, 16 nt, Listeria monocytogenes EGD-e
cuuaaaucacuucuua

SEQ ID NO: 2806862 - RNA, 15 nt, Listeria monocytogenes EGD-e
cuuaacgaauuuuuc

SEQ ID NO: 2806863 - RNA, 17 nt, Listeria monocytogenes EGD-e
cuuaacgaauuuuucaa

SEQ ID NO: 2806864 - RNA, 17 nt, Listeria monocytogenes EGD-e
cuuacuauuuucuaauc

SEQ ID NO: 2806865 - RNA, 17 nt, Listeria monocytogenes EGD-e
cuuacugcaaucauuua

SEQ ID NO: 2806866 - RNA, 15 nt, Listeria monocytogenes EGD-e
cuuagaaaaauguuu

SEQ ID NO: 2806867 - RNA, 15 nt, Listeria monocytogenes EGD-e
cuuagaagaugcacu

SEQ ID NO: 2806868 - RNA, 15 nt, Listeria monocytogenes EGD-e
cuuaguuaauucuuu

SEQ ID NO: 2806869 - RNA, 18 nt, Listeria monocytogenes EGD-e
cuuaguuaauucuuuuuc

SEQ ID NO: 2806870 - RNA, 17 nt, Listeria monocytogenes EGD-e
cuuauaaugcagauuaa

SEQ ID NO: 2806871 - RNA, 18 nt, Listeria monocytogenes EGD-e
cuuaucucuucauuuuuc

SEQ ID NO: 2806872 - RNA, 21 nt, Listeria monocytogenes EGD-e
cuuaugagaguuauaaagaaa

SEQ ID NO: 2806873 - RNA, 20 nt, Listeria monocytogenes EGD-e
cuuauuaauuauggcauaaa

SEQ ID NO: 2806874 - RNA, 21 nt, Listeria monocytogenes EGD-e
cuuauuauaaccccaaaaugc

SEQ ID NO: 2806875 - RNA, 20 nt, Listeria monocytogenes EGD-e
cuuauuuuaacggcuucaaa

SEQ ID NO: 2806876 - RNA, 14 nt, Listeria monocytogenes EGD-e
cuucaaaacucucu

SEQ ID NO: 2806877 - RNA, 22 nt, Listeria monocytogenes EGD-e
cuucaaacgcagguucaccaaa

SEQ ID NO: 2806878 - RNA, 14 nt, Listeria monocytogenes EGD-e
cuucaagcauuuca

SEQ ID NO: 2806879 - RNA, 18 nt, Listeria monocytogenes EGD-e
cuucaagcauuucauaau

SEQ ID NO: 2806880 - RNA, 20 nt, Listeria monocytogenes EGD-e
cuucaaucccagcuuuuccu

SEQ ID NO: 2806881 - RNA, 18 nt, Listeria monocytogenes EGD-e
cuucaaucggaacaccaa

SEQ ID NO: 2806882 - RNA, 22 nt, Listeria monocytogenes EGD-e
cuucaauugcuucuuuuuucuu

SEQ ID NO: 2806883 - RNA, 23 nt, Listeria monocytogenes EGD-e
cuucaauugcuucuuuuuucuuc

SEQ ID NO: 2806884 - RNA, 14 nt, Listeria monocytogenes EGD-e
cuucaccaagaaga

SEQ ID NO: 2806885 - RNA, 16 nt, Listeria monocytogenes EGD-e
cuucaccaguaacgcc

SEQ ID NO: 2806886 - RNA, 15 nt, Listeria monocytogenes EGD-e
cuucacgugcugcuu

SEQ ID NO: 2806887 - RNA, 20 nt, Listeria monocytogenes EGD-e
cuucacgugcugcuuuccuu

SEQ ID NO: 2806888 - RNA, 12 nt, Listeria monocytogenes EGD-e
cuucagaaagug

SEQ ID NO: 2806889 - RNA, 15 nt, Listeria monocytogenes EGD-e
cuucaucguuuaaca

SEQ ID NO: 2806890 - RNA, 14 nt, Listeria monocytogenes EGD-e
cuucaucuuuauaa

SEQ ID NO: 2806891 - RNA, 16 nt, Listeria monocytogenes EGD-e
cuucauuagacaaaaa

SEQ ID NO: 2806892 - RNA, 19 nt, Listeria monocytogenes EGD-e
cuucauuagacaaaaagaa

SEQ ID NO: 2806893 - RNA, 13 nt, Listeria monocytogenes EGD-e
cuucauuuuucua

SEQ ID NO: 2806894 - RNA, 20 nt, Listeria monocytogenes EGD-e
cuuccacuccagcugcuucu

SEQ ID NO: 2806895 - RNA, 19 nt, Listeria monocytogenes EGD-e
cuuccauagaauguauaca

SEQ ID NO: 2806896 - RNA, 22 nt, Listeria monocytogenes EGD-e
cuuccauauuuucucuaaauca

SEQ ID NO: 2806897 - RNA, 14 nt, Listeria monocytogenes EGD-e
cuuccuuuuguuuu

SEQ ID NO: 2806898 - RNA, 19 nt, Listeria monocytogenes EGD-e
cuucgauugcaucucuuuu

SEQ ID NO: 2806899 - RNA, 12 nt, Listeria monocytogenes EGD-e
cuucgcuuguuu

SEQ ID NO: 2806900 - RNA, 13 nt, Listeria monocytogenes EGD-e
cuucguccagcug

SEQ ID NO: 2806901 - RNA, 20 nt, Listeria monocytogenes EGD-e
cuucguuucauuucaucuuu

SEQ ID NO: 2806902 - RNA, 12 nt, Listeria monocytogenes EGD-e
cuucuaacaauu

SEQ ID NO: 2806903 - RNA, 15 nt, Listeria monocytogenes EGD-e
cuucuacuagugaaa

SEQ ID NO: 2806904 - RNA, 17 nt, Listeria monocytogenes EGD-e
cuucuagcgucacaaua

SEQ ID NO: 2806905 - RNA, 17 nt, Listeria monocytogenes EGD-e
cuucuauuugucaaucu

SEQ ID NO: 2806906 - RNA, 14 nt, Listeria monocytogenes EGD-e
cuucucuccaauca

SEQ ID NO: 2806907 - RNA, 15 nt, Listeria monocytogenes EGD-e
cuucugucacaucug

SEQ ID NO: 2806908 - RNA, 15 nt, Listeria monocytogenes EGD-e
cuucuuugauuuuuu

SEQ ID NO: 2806909 - RNA, 18 nt, Listeria monocytogenes EGD-e
cuucuuugauuuuuucuu

SEQ ID NO: 2806910 - RNA, 19 nt, Listeria monocytogenes EGD-e
cuucuuugauuuuuucuuc

SEQ ID NO: 2806911 - RNA, 13 nt, Listeria monocytogenes EGD-e
cuucuuuuuucuu

SEQ ID NO: 2806912 - RNA, 23 nt, Listeria monocytogenes EGD-e
cuugaaaaauuucaucguuuucu

SEQ ID NO: 2806913 - RNA, 15 nt, Listeria monocytogenes EGD-e
cuugauaauuuuuuu

SEQ ID NO: 2806914 - RNA, 19 nt, Listeria monocytogenes EGD-e
cuugauuuaauuguaauuc

SEQ ID NO: 2806915 - RNA, 15 nt, Listeria monocytogenes EGD-e
cuugauuuguuuuau

SEQ ID NO: 2806916 - RNA, 23 nt, Listeria monocytogenes EGD-e
cuugauuuguuuuauuacauuaa

SEQ ID NO: 2806917 - RNA, 14 nt, Listeria monocytogenes EGD-e
cuugcaaaugcuuu

SEQ ID NO: 2806918 - RNA, 13 nt, Listeria monocytogenes EGD-e
cuugcaagagcag

SEQ ID NO: 2806919 - RNA, 15 nt, Listeria monocytogenes EGD-e
cuugcacuuggaacg

SEQ ID NO: 2806920 - RNA, 20 nt, Listeria monocytogenes EGD-e
cuugcauagauggaagaagu

SEQ ID NO: 2806921 - RNA, 22 nt, Listeria monocytogenes EGD-e
cuugcaucuucuguuaacauuu

SEQ ID NO: 2806922 - RNA, 15 nt, Listeria monocytogenes EGD-e
cuugcuuuaauuugg

SEQ ID NO: 2806923 - RNA, 19 nt, Listeria monocytogenes EGD-e
cuuggacuguuuccccguc

SEQ ID NO: 2806924 - RNA, 16 nt, Listeria monocytogenes EGD-e
cuuguacacauuauac

SEQ ID NO: 2806925 - RNA, 18 nt, Listeria monocytogenes EGD-e
cuugugugguguuuuuug

SEQ ID NO: 2806926 - RNA, 12 nt, Listeria monocytogenes EGD-e
cuuguuccauua

SEQ ID NO: 2806927 - RNA, 19 nt, Listeria monocytogenes EGD-e
cuuguuuagcugcuacgau

SEQ ID NO: 2806928 - RNA, 14 nt, Listeria monocytogenes EGD-e
cuuguuucgcguuu

SEQ ID NO: 2806929 - RNA, 21 nt, Listeria monocytogenes EGD-e
cuuguuuugucgauaguucac

SEQ ID NO: 2806930 - RNA, 20 nt, Listeria monocytogenes EGD-e
cuuuaaaaacaguacuucua

SEQ ID NO: 2806931 - RNA, 19 nt, Listeria monocytogenes EGD-e
cuuuaaaaacaguuucuuu

SEQ ID NO: 2806932 - RNA, 23 nt, Listeria monocytogenes EGD-e
cuuuaaaagcuuccucauucaca

SEQ ID NO: 2806933 - RNA, 22 nt, Listeria monocytogenes EGD-e
cuuuaaaauccaauaauaugau

SEQ ID NO: 2806934 - RNA, 18 nt, Listeria monocytogenes EGD-e
cuuuacauaauucauuga

SEQ ID NO: 2806935 - RNA, 18 nt, Listeria monocytogenes EGD-e
cuuuacuacauuuuguug

SEQ ID NO: 2806936 - RNA, 20 nt, Listeria monocytogenes EGD-e
cuuuacuugcaaaugcuuua

SEQ ID NO: 2806937 - RNA, 19 nt, Listeria monocytogenes EGD-e
cuuuauaacucucauaaga

SEQ ID NO: 2806938 - RNA, 17 nt, Listeria monocytogenes EGD-e
cuuuaucauucaaugag

SEQ ID NO: 2806939 - RNA, 17 nt, Listeria monocytogenes EGD-e
cuuuaucuuucccauca

SEQ ID NO: 2806940 - RNA, 18 nt, Listeria monocytogenes EGD-e
cuuuaucuuuuccuucua

SEQ ID NO: 2806941 - RNA, 23 nt, Listeria monocytogenes EGD-e
cuuuaugaagugauguaucuaau

SEQ ID NO: 2806942 - RNA, 17 nt, Listeria monocytogenes EGD-e
cuuuauuuuuuauuuua

SEQ ID NO: 2806943 - RNA, 16 nt, Listeria monocytogenes EGD-e
cuuuccccuuuuuaga

SEQ ID NO: 2806944 - RNA, 13 nt, Listeria monocytogenes EGD-e
cuuucguuuuuac

SEQ ID NO: 2806945 - RNA, 16 nt, Listeria monocytogenes EGD-e
cuuucugccuaccaaa

SEQ ID NO: 2806946 - RNA, 12 nt, Listeria monocytogenes EGD-e
cuuucuuuuguu

SEQ ID NO: 2806947 - RNA, 14 nt, Listeria monocytogenes EGD-e
cuuucuuuuguucu

SEQ ID NO: 2806948 - RNA, 21 nt, Listeria monocytogenes EGD-e
cuuugaauugauuuuuuugaa

SEQ ID NO: 2806949 - RNA, 19 nt, Listeria monocytogenes EGD-e
cuuugaauugcucguucuu

SEQ ID NO: 2806950 - RNA, 21 nt, Listeria monocytogenes EGD-e
cuuugauuaauuuaucuuuua

SEQ ID NO: 2806951 - RNA, 18 nt, Listeria monocytogenes EGD-e
cuuugcuuguguaacaua

SEQ ID NO: 2806952 - RNA, 21 nt, Listeria monocytogenes EGD-e
cuuuguauacuucaaaaccuu

SEQ ID NO: 2806953 - RNA, 20 nt, Listeria monocytogenes EGD-e
cuuugucaucauaaacauuu

SEQ ID NO: 2806954 - RNA, 21 nt, Listeria monocytogenes EGD-e
cuuuguguuaauaaaaucauu

SEQ ID NO: 2806955 - RNA, 17 nt, Listeria monocytogenes EGD-e
cuuuuaaagcuuuuaaa

SEQ ID NO: 2806956 - RNA, 12 nt, Listeria monocytogenes EGD-e
cuuuuauaaaaa

SEQ ID NO: 2806957 - RNA, 15 nt, Listeria monocytogenes EGD-e
cuuuuauaaaaauac

SEQ ID NO: 2806958 - RNA, 12 nt, Listeria monocytogenes EGD-e
cuuuuaucuucc

SEQ ID NO: 2806959 - RNA, 15 nt, Listeria monocytogenes EGD-e
cuuuuauuuuuaaag

SEQ ID NO: 2806960 - RNA, 13 nt, Listeria monocytogenes EGD-e
cuuuuccaaaaug

SEQ ID NO: 2806961 - RNA, 18 nt, Listeria monocytogenes EGD-e
cuuuuccaaaauggccaa

SEQ ID NO: 2806962 - RNA, 21 nt, Listeria monocytogenes EGD-e
cuuuuccuaauuuuacuucua

SEQ ID NO: 2806963 - RNA, 19 nt, Listeria monocytogenes EGD-e
cuuuuccuagaacuaauuc

SEQ ID NO: 2806964 - RNA, 14 nt, Listeria monocytogenes EGD-e
cuuuuguucuucua

SEQ ID NO: 2806965 - RNA, 13 nt, Listeria monocytogenes EGD-e
cuuuuguuuuaau

SEQ ID NO: 2806966 - RNA, 14 nt, Listeria monocytogenes EGD-e
cuuuuguuuuaaua

SEQ ID NO: 2806967 - RNA, 11 nt, Listeria monocytogenes EGD-e
cuuuuuaaguc

SEQ ID NO: 2806968 - RNA, 17 nt, Listeria monocytogenes EGD-e
cuuuuuagaaugaagau

SEQ ID NO: 2806969 - RNA, 20 nt, Listeria monocytogenes EGD-e
cuuuuucugaguagaaaguu

SEQ ID NO: 2806970 - RNA, 15 nt, Listeria monocytogenes EGD-e
cuuuuugcuuuaaaa

SEQ ID NO: 2806971 - RNA, 10 nt, Listeria monocytogenes EGD-e
cuuuuuuccu

SEQ ID NO: 2806972 - RNA, 17 nt, Listeria monocytogenes EGD-e
cuuuuuucgaugauaau

SEQ ID NO: 2806973 - RNA, 19 nt, Listeria monocytogenes EGD-e
cuuuuuuuaaacuauuuuu

SEQ ID NO: 2806974 - RNA, 19 nt, Listeria monocytogenes EGD-e
gaaaaaaguguauuuacaa

SEQ ID NO: 2806975 - RNA, 18 nt, Listeria monocytogenes EGD-e
gaaaaaguuguuucuaau

SEQ ID NO: 2806976 - RNA, 17 nt, Listeria monocytogenes EGD-e
gaaaaaucauuaaauuu

SEQ ID NO: 2806977 - RNA, 22 nt, Listeria monocytogenes EGD-e
gaaaaauguuugcaucccauaa

SEQ ID NO: 2806978 - RNA, 14 nt, Listeria monocytogenes EGD-e
gaaaacagaaagcu

SEQ ID NO: 2806979 - RNA, 19 nt, Listeria monocytogenes EGD-e
gaaaacugaacaaagaaga

SEQ ID NO: 2806980 - RNA, 20 nt, Listeria monocytogenes EGD-e
gaaaacugaacaaagaagaa

SEQ ID NO: 2806981 - RNA, 13 nt, Listeria monocytogenes EGD-e
gaaaagacaccaa

SEQ ID NO: 2806982 - RNA, 13 nt, Listeria monocytogenes EGD-e
gaaaagcaaugag

SEQ ID NO: 2806983 - RNA, 20 nt, Listeria monocytogenes EGD-e
gaaaaugagcccaaaaauaa

SEQ ID NO: 2806984 - RNA, 22 nt, Listeria monocytogenes EGD-e
gaaaaugagcccaaaaauaagu

SEQ ID NO: 2806985 - RNA, 22 nt, Listeria monocytogenes EGD-e
gaaacaaaguauugugcuaagu

SEQ ID NO: 2806986 - RNA, 20 nt, Listeria monocytogenes EGD-e
gaaaccaucgcaaaagcaaa

SEQ ID NO: 2806987 - RNA, 21 nt, Listeria monocytogenes EGD-e
gaaaccaucgcaaaagcaaac

SEQ ID NO: 2806988 - RNA, 21 nt, Listeria monocytogenes EGD-e
gaaaccauuccguugaaagag

SEQ ID NO: 2806989 - RNA, 20 nt, Listeria monocytogenes EGD-e
gaaacuaucaauaaauccag

SEQ ID NO: 2806990 - RNA, 13 nt, Listeria monocytogenes EGD-e
gaaagcaaaugca

SEQ ID NO: 2806991 - RNA, 20 nt, Listeria monocytogenes EGD-e
gaaagcuguuuucaacaaaa

SEQ ID NO: 2806992 - RNA, 16 nt, Listeria monocytogenes EGD-e
gaaaguuuuaugacaa

SEQ ID NO: 2806993 - RNA, 17 nt, Listeria monocytogenes EGD-e
gaaauaaccauuccauc

SEQ ID NO: 2806994 - RNA, 18 nt, Listeria monocytogenes EGD-e
gaaauaguuuugucaaac

SEQ ID NO: 2806995 - RNA, 12 nt, Listeria monocytogenes EGD-e
gaaaucaagcgg

SEQ ID NO: 2806996 - RNA, 17 nt, Listeria monocytogenes EGD-e
gaaaucucacuaaacau

SEQ ID NO: 2806997 - RNA, 19 nt, Listeria monocytogenes EGD-e
gaaauggauugcagguaau

SEQ ID NO: 2806998 - RNA, 14 nt, Listeria monocytogenes EGD-e
gaaauuaaaagcua

SEQ ID NO: 2806999 - RNA, 20 nt, Listeria monocytogenes EGD-e
gaaauuaaaagcuaauuauu

SEQ ID NO: 2807000 - RNA, 21 nt, Listeria monocytogenes EGD-e
gaaauuaaauuuuuuugaaaa

SEQ ID NO: 2807001 - RNA, 18 nt, Listeria monocytogenes EGD-e
gaaauuaccuaaugaaua

SEQ ID NO: 2807002 - RNA, 19 nt, Listeria monocytogenes EGD-e
gaacaacaugcguaaacuu

SEQ ID NO: 2807003 - RNA, 22 nt, Listeria monocytogenes EGD-e
gaacaacaugcguaaacuuuug

SEQ ID NO: 2807004 - RNA, 17 nt, Listeria monocytogenes EGD-e
gaacacccgguccuuca

SEQ ID NO: 2807005 - RNA, 18 nt, Listeria monocytogenes EGD-e
gaacacccgguccuucaa

SEQ ID NO: 2807006 - RNA, 16 nt, Listeria monocytogenes EGD-e
gaaccaagcacauccg

SEQ ID NO: 2807007 - RNA, 19 nt, Listeria monocytogenes EGD-e
gaacgaauccuuggaaaaa

SEQ ID NO: 2807008 - RNA, 23 nt, Listeria monocytogenes EGD-e
gaacgauaaagcgguaucccuca

SEQ ID NO: 2807009 - RNA, 20 nt, Listeria monocytogenes EGD-e
gaacuagauuuaauaaauua

SEQ ID NO: 2807010 - RNA, 19 nt, Listeria monocytogenes EGD-e
gaacugcggcuaauaacau

SEQ ID NO: 2807011 - RNA, 22 nt, Listeria monocytogenes EGD-e
gaacuuacagaagcauuuucau

SEQ ID NO: 2807012 - RNA, 14 nt, Listeria monocytogenes EGD-e
gaacuucaccacuu

SEQ ID NO: 2807013 - RNA, 20 nt, Listeria monocytogenes EGD-e
gaacuucaccacuucuucca

SEQ ID NO: 2807014 - RNA, 15 nt, Listeria monocytogenes EGD-e
gaagaagacgaaaag

SEQ ID NO: 2807015 - RNA, 20 nt, Listeria monocytogenes EGD-e
gaagaguccgccgacagccc

SEQ ID NO: 2807016 - RNA, 20 nt, Listeria monocytogenes EGD-e
gaagcaauuagucccauuac

SEQ ID NO: 2807017 - RNA, 12 nt, Listeria monocytogenes EGD-e
gaagcauuuuca

SEQ ID NO: 2807018 - RNA, 19 nt, Listeria monocytogenes EGD-e
gaagccggggacuuggggu

SEQ ID NO: 2807019 - RNA, 14 nt, Listeria monocytogenes EGD-e
gaagcgaugauuuu

SEQ ID NO: 2807020 - RNA, 20 nt, Listeria monocytogenes EGD-e
gaaguacaauaaaguuaacu

SEQ ID NO: 2807021 - RNA, 18 nt, Listeria monocytogenes EGD-e
gaauaaaacaaaagauag

SEQ ID NO: 2807022 - RNA, 15 nt, Listeria monocytogenes EGD-e
gaauaaaaucauaau

SEQ ID NO: 2807023 - RNA, 12 nt, Listeria monocytogenes EGD-e
gaauaaaucaag

SEQ ID NO: 2807024 - RNA, 14 nt, Listeria monocytogenes EGD-e
gaauaacagauuug

SEQ ID NO: 2807025 - RNA, 20 nt, Listeria monocytogenes EGD-e
gaauaaccaaucauggaaac

SEQ ID NO: 2807026 - RNA, 14 nt, Listeria monocytogenes EGD-e
gaauaacuuuccag

SEQ ID NO: 2807027 - RNA, 15 nt, Listeria monocytogenes EGD-e
gaauaagaaauuacc

SEQ ID NO: 2807028 - RNA, 17 nt, Listeria monocytogenes EGD-e
gaauaagaaauuaccua

SEQ ID NO: 2807029 - RNA, 20 nt, Listeria monocytogenes EGD-e
gaauaagugaauugauggau

SEQ ID NO: 2807030 - RNA, 12 nt, Listeria monocytogenes EGD-e
gaauaccagcag

SEQ ID NO: 2807031 - RNA, 15 nt, Listeria monocytogenes EGD-e
gaauacuaacgcuuu

SEQ ID NO: 2807032 - RNA, 20 nt, Listeria monocytogenes EGD-e
gaauacuaacgcuuuuucag

SEQ ID NO: 2807033 - RNA, 15 nt, Listeria monocytogenes EGD-e
gaauacuguuuuuga

SEQ ID NO: 2807034 - RNA, 18 nt, Listeria monocytogenes EGD-e
gaauagagcuuuuaaaua

SEQ ID NO: 2807035 - RNA, 18 nt, Listeria monocytogenes EGD-e
gaauagcauaauagaaag

SEQ ID NO: 2807036 - RNA, 15 nt, Listeria monocytogenes EGD-e
gaauauccguuucau

SEQ ID NO: 2807037 - RNA, 16 nt, Listeria monocytogenes EGD-e
gaauauggacauacuu

SEQ ID NO: 2807038 - RNA, 22 nt, Listeria monocytogenes EGD-e
gaaucauuaauauaaagaucca

SEQ ID NO: 2807039 - RNA, 18 nt, Listeria monocytogenes EGD-e
gaaugaacuucaccacuu

SEQ ID NO: 2807040 - RNA, 14 nt, Listeria monocytogenes EGD-e
gaaugaauagauau

SEQ ID NO: 2807041 - RNA, 13 nt, Listeria monocytogenes EGD-e
gaaugagcuccuu

SEQ ID NO: 2807042 - RNA, 18 nt, Listeria monocytogenes EGD-e
gaauuccugcuaaaacca

SEQ ID NO: 2807043 - RNA, 19 nt, Listeria monocytogenes EGD-e
gaauugauggauuccuaaa

SEQ ID NO: 2807044 - RNA, 11 nt, Listeria monocytogenes EGD-e
gaauugcuucu

SEQ ID NO: 2807045 - RNA, 18 nt, Listeria monocytogenes EGD-e
gaauuucgaaauuaaaag

SEQ ID NO: 2807046 - RNA, 22 nt, Listeria monocytogenes EGD-e
gaauuuuugcauccacuaacuu

SEQ ID NO: 2807047 - RNA, 13 nt, Listeria monocytogenes EGD-e
gacaaaaagaaaa

SEQ ID NO: 2807048 - RNA, 22 nt, Listeria monocytogenes EGD-e
gacaaaaggacaagcccagcac

SEQ ID NO: 2807049 - RNA, 21 nt, Listeria monocytogenes EGD-e
gacaaaguaacuaaaaaucau

SEQ ID NO: 2807050 - RNA, 12 nt, Listeria monocytogenes EGD-e
gacaaaugguuc

SEQ ID NO: 2807051 - RNA, 20 nt, Listeria monocytogenes EGD-e
gacaagagcgagagcaccaa

SEQ ID NO: 2807052 - RNA, 16 nt, Listeria monocytogenes EGD-e
gacaagcgacaaacca

SEQ ID NO: 2807053 - RNA, 21 nt, Listeria monocytogenes EGD-e
gacacacggugaugaaaccaa

SEQ ID NO: 2807054 - RNA, 15 nt, Listeria monocytogenes EGD-e
gacaccaauuucugu

SEQ ID NO: 2807055 - RNA, 14 nt, Listeria monocytogenes EGD-e
gacacccauaauag

SEQ ID NO: 2807056 - RNA, 13 nt, Listeria monocytogenes EGD-e
gacagauaaauau

SEQ ID NO: 2807057 - RNA, 23 nt, Listeria monocytogenes EGD-e
gacaguugcuguuacugugcucu

SEQ ID NO: 2807058 - RNA, 20 nt, Listeria monocytogenes EGD-e
gacauaaucccacaaaaaau

SEQ ID NO: 2807059 - RNA, 17 nt, Listeria monocytogenes EGD-e
gacauacuucaugugcu

SEQ ID NO: 2807060 - RNA, 20 nt, Listeria monocytogenes EGD-e
gacaugcuaaauaaaaccau

SEQ ID NO: 2807061 - RNA, 22 nt, Listeria monocytogenes EGD-e
gacauguuggauacuaagugcu

SEQ ID NO: 2807062 - RNA, 12 nt, Listeria monocytogenes EGD-e
gaccauauaauc

SEQ ID NO: 2807063 - RNA, 12 nt, Listeria monocytogenes EGD-e
gaccuucuuuua

SEQ ID NO: 2807064 - RNA, 13 nt, Listeria monocytogenes EGD-e
gacgaaaagcaau

SEQ ID NO: 2807065 - RNA, 17 nt, Listeria monocytogenes EGD-e
gacgacguuuaucaaua

SEQ ID NO: 2807066 - RNA, 19 nt, Listeria monocytogenes EGD-e
gacgacguuuaucaauaau

SEQ ID NO: 2807067 - RNA, 15 nt, Listeria monocytogenes EGD-e
gacgagaaaugaauu

SEQ ID NO: 2807068 - RNA, 13 nt, Listeria monocytogenes EGD-e
gacgcuuuuuuca

SEQ ID NO: 2807069 - RNA, 13 nt, Listeria monocytogenes EGD-e
gacuguuguuuca

SEQ ID NO: 2807070 - RNA, 13 nt, Listeria monocytogenes EGD-e
gacuuacuuguuu

SEQ ID NO: 2807071 - RNA, 20 nt, Listeria monocytogenes EGD-e
gacuuacuuguuuauauuca

SEQ ID NO: 2807072 - RNA, 17 nt, Listeria monocytogenes EGD-e
gacuucuuagggagaag

SEQ ID NO: 2807073 - RNA, 17 nt, Listeria monocytogenes EGD-e
gacuuuugcagcuggaa

SEQ ID NO: 2807074 - RNA, 11 nt, Listeria monocytogenes EGD-e
gagaaauggau

SEQ ID NO: 2807075 - RNA, 12 nt, Listeria monocytogenes EGD-e
gagaaauggauu

SEQ ID NO: 2807076 - RNA, 20 nt, Listeria monocytogenes EGD-e
gagagcuagaaagccuuuau

SEQ ID NO: 2807077 - RNA, 18 nt, Listeria monocytogenes EGD-e
gagaguuauaaagaaaua

SEQ ID NO: 2807078 - RNA, 20 nt, Listeria monocytogenes EGD-e
gagaguuauaaagaaauaac

SEQ ID NO: 2807079 - RNA, 20 nt, Listeria monocytogenes EGD-e
gagcaagugugaaaaucgag

SEQ ID NO: 2807080 - RNA, 13 nt, Listeria monocytogenes EGD-e
gagcagcuccauu

SEQ ID NO: 2807081 - RNA, 16 nt, Listeria monocytogenes EGD-e
gagccauaaaauuagu

SEQ ID NO: 2807082 - RNA, 20 nt, Listeria monocytogenes EGD-e
gagccuggauuuucuagguu

SEQ ID NO: 2807083 - RNA, 18 nt, Listeria monocytogenes EGD-e
gagcgguuuuguuuccaa

SEQ ID NO: 2807084 - RNA, 19 nt, Listeria monocytogenes EGD-e
gagcuucuguuuuuucuuu

SEQ ID NO: 2807085 - RNA, 16 nt, Listeria monocytogenes EGD-e
gagugagguguaauau

SEQ ID NO: 2807086 - RNA, 16 nt, Listeria monocytogenes EGD-e
gaguuauaaagaaaua

SEQ ID NO: 2807087 - RNA, 22 nt, Listeria monocytogenes EGD-e
gaguuucuuuaccauacacaua

SEQ ID NO: 2807088 - RNA, 15 nt, Listeria monocytogenes EGD-e
gaguuuguaacaacu

SEQ ID NO: 2807089 - RNA, 23 nt, Listeria monocytogenes EGD-e
gauaaaauggcguuuuaaauccu

SEQ ID NO: 2807090 - RNA, 18 nt, Listeria monocytogenes EGD-e
gauaaacuaauuacuaaa

SEQ ID NO: 2807091 - RNA, 16 nt, Listeria monocytogenes EGD-e
gauaaagauaauaacc

SEQ ID NO: 2807092 - RNA, 17 nt, Listeria monocytogenes EGD-e
gauaaauauagcuucaa

SEQ ID NO: 2807093 - RNA, 22 nt, Listeria monocytogenes EGD-e
gauaacuuucucuugcuuuaau

SEQ ID NO: 2807094 - RNA, 23 nt, Listeria monocytogenes EGD-e
gauaagcacaaauuauuagaauu

SEQ ID NO: 2807095 - RNA, 16 nt, Listeria monocytogenes EGD-e
gauaaguuuucauaua

SEQ ID NO: 2807096 - RNA, 22 nt, Listeria monocytogenes EGD-e
gauaaguuuucauauaaguguu

SEQ ID NO: 2807097 - RNA, 17 nt, Listeria monocytogenes EGD-e
gauaauauugauaaaac

SEQ ID NO: 2807098 - RNA, 20 nt, Listeria monocytogenes EGD-e
gauaaugugaccuuaaauua

SEQ ID NO: 2807099 - RNA, 23 nt, Listeria monocytogenes EGD-e
gauaaugugaccuuaaauuauac

SEQ ID NO: 2807100 - RNA, 14 nt, Listeria monocytogenes EGD-e
gauacucuuuaaau

SEQ ID NO: 2807101 - RNA, 14 nt, Listeria monocytogenes EGD-e
gauaguuccagcua

SEQ ID NO: 2807102 - RNA, 17 nt, Listeria monocytogenes EGD-e
gauaguuccuucuaaua

SEQ ID NO: 2807103 - RNA, 16 nt, Listeria monocytogenes EGD-e
gauauccaguauuucc

SEQ ID NO: 2807104 - RNA, 23 nt, Listeria monocytogenes EGD-e
gauaucuacaaguucuuucaugu

SEQ ID NO: 2807105 - RNA, 14 nt, Listeria monocytogenes EGD-e
gauauuuugcucaa

SEQ ID NO: 2807106 - RNA, 14 nt, Listeria monocytogenes EGD-e
gaucaaaaugggca

SEQ ID NO: 2807107 - RNA, 21 nt, Listeria monocytogenes EGD-e
gaucauauucuucuaaaauaa

SEQ ID NO: 2807108 - RNA, 19 nt, Listeria monocytogenes EGD-e
gauccacgauggaaccauu

SEQ ID NO: 2807109 - RNA, 19 nt, Listeria monocytogenes EGD-e
gaucuuccgguaucaugaa

SEQ ID NO: 2807110 - RNA, 21 nt, Listeria monocytogenes EGD-e
gaucuugcauuuuggcuaaag

SEQ ID NO: 2807111 - RNA, 17 nt, Listeria monocytogenes EGD-e
gaugcacuagaaaaaug

SEQ ID NO: 2807112 - RNA, 14 nt, Listeria monocytogenes EGD-e
gauggaagaagugg

SEQ ID NO: 2807113 - RNA, 13 nt, Listeria monocytogenes EGD-e
gauggaaguaaug

SEQ ID NO: 2807114 - RNA, 21 nt, Listeria monocytogenes EGD-e
gauggagauucauaaacaaaa

SEQ ID NO: 2807115 - RNA, 18 nt, Listeria monocytogenes EGD-e
gaugguauacuauacaag

SEQ ID NO: 2807116 - RNA, 14 nt, Listeria monocytogenes EGD-e
gaugguauuguuuu

SEQ ID NO: 2807117 - RNA, 21 nt, Listeria monocytogenes EGD-e
gauguguugcuuuuauuuuua

SEQ ID NO: 2807118 - RNA, 18 nt, Listeria monocytogenes EGD-e
gauguuuaaacaucuucc

SEQ ID NO: 2807119 - RNA, 13 nt, Listeria monocytogenes EGD-e
gauguuuuugcuu

SEQ ID NO: 2807120 - RNA, 12 nt, Listeria monocytogenes EGD-e
gauuaaauauag

SEQ ID NO: 2807121 - RNA, 18 nt, Listeria monocytogenes EGD-e
gauuaauuuaucuuuuac

SEQ ID NO: 2807122 - RNA, 16 nt, Listeria monocytogenes EGD-e
gauuacuccaaaauaa

SEQ ID NO: 2807123 - RNA, 20 nt, Listeria monocytogenes EGD-e
gauuacuccaaaauaaaaug

SEQ ID NO: 2807124 - RNA, 21 nt, Listeria monocytogenes EGD-e
gauuacuccaaaauaaaaugg

SEQ ID NO: 2807125 - RNA, 17 nt, Listeria monocytogenes EGD-e
gauucgucuuagaaaaa

SEQ ID NO: 2807126 - RNA, 12 nt, Listeria monocytogenes EGD-e
gauucucuucua

SEQ ID NO: 2807127 - RNA, 14 nt, Listeria monocytogenes EGD-e
gauucucuucuaac

SEQ ID NO: 2807128 - RNA, 17 nt, Listeria monocytogenes EGD-e
gauugcagguaauuuaa

SEQ ID NO: 2807129 - RNA, 21 nt, Listeria monocytogenes EGD-e
gauugccugaaauaauaccag

SEQ ID NO: 2807130 - RNA, 17 nt, Listeria monocytogenes EGD-e
gauuggcgauucuucaa

SEQ ID NO: 2807131 - RNA, 18 nt, Listeria monocytogenes EGD-e
gauugggcggaaauaaaa

SEQ ID NO: 2807132 - RNA, 14 nt, Listeria monocytogenes EGD-e
gauugguccugcug

SEQ ID NO: 2807133 - RNA, 19 nt, Listeria monocytogenes EGD-e
gauuugucacuuggaaaag

SEQ ID NO: 2807134 - RNA, 15 nt, Listeria monocytogenes EGD-e
gauuuuguacauaaa

SEQ ID NO: 2807135 - RNA, 18 nt, Listeria monocytogenes EGD-e
gauuuuguuguuuuccca

SEQ ID NO: 2807136 - RNA, 22 nt, Listeria monocytogenes EGD-e
gauuuuguuguuuucccagaaa

SEQ ID NO: 2807137 - RNA, 14 nt, Listeria monocytogenes EGD-e
gauuuuucaaauca

SEQ ID NO: 2807138 - RNA, 20 nt, Listeria monocytogenes EGD-e
gauuuuugggguuucauaua

SEQ ID NO: 2807139 - RNA, 17 nt, Listeria monocytogenes EGD-e
gcaaaacauuuucauuc

SEQ ID NO: 2807140 - RNA, 14 nt, Listeria monocytogenes EGD-e
gcaaaagcaaacaa

SEQ ID NO: 2807141 - RNA, 16 nt, Listeria monocytogenes EGD-e
gcaaaagcaguagacu

SEQ ID NO: 2807142 - RNA, 16 nt, Listeria monocytogenes EGD-e
gcaaacagcuuuucua

SEQ ID NO: 2807143 - RNA, 19 nt, Listeria monocytogenes EGD-e
gcaaacugcucagaaggaa

SEQ ID NO: 2807144 - RNA, 18 nt, Listeria monocytogenes EGD-e
gcaaaucuuucggcacac

SEQ ID NO: 2807145 - RNA, 18 nt, Listeria monocytogenes EGD-e
gcaaaugcauuucucgau

SEQ ID NO: 2807146 - RNA, 18 nt, Listeria monocytogenes EGD-e
gcaacaaagaagaaaaag

SEQ ID NO: 2807147 - RNA, 16 nt, Listeria monocytogenes EGD-e
gcaacaguuauuaaaa

SEQ ID NO: 2807148 - RNA, 17 nt, Listeria monocytogenes EGD-e
gcaacaguuauuaaaag

SEQ ID NO: 2807149 - RNA, 15 nt, Listeria monocytogenes EGD-e
gcaacauucaaauca

SEQ ID NO: 2807150 - RNA, 15 nt, Listeria monocytogenes EGD-e
gcaacuucuggauuu

SEQ ID NO: 2807151 - RNA, 15 nt, Listeria monocytogenes EGD-e
gcaagcgaauuaaua

SEQ ID NO: 2807152 - RNA, 19 nt, Listeria monocytogenes EGD-e
gcaauaagcgaauauccga

SEQ ID NO: 2807153 - RNA, 15 nt, Listeria monocytogenes EGD-e
gcaaucaauuuacgu

SEQ ID NO: 2807154 - RNA, 13 nt, Listeria monocytogenes EGD-e
gcaaucauuuauu

SEQ ID NO: 2807155 - RNA, 18 nt, Listeria monocytogenes EGD-e
gcaauccauguuguuuua

SEQ ID NO: 2807156 - RNA, 18 nt, Listeria monocytogenes EGD-e
gcaaucguauguuuuuga

SEQ ID NO: 2807157 - RNA, 16 nt, Listeria monocytogenes EGD-e
gcaauuucggaagauc

SEQ ID NO: 2807158 - RNA, 16 nt, Listeria monocytogenes EGD-e
gcaauuuuaggcguau

SEQ ID NO: 2807159 - RNA, 12 nt, Listeria monocytogenes EGD-e
gcacauccgcau

SEQ ID NO: 2807160 - RNA, 13 nt, Listeria monocytogenes EGD-e
gcaccaaaaauac

SEQ ID NO: 2807161 - RNA, 15 nt, Listeria monocytogenes EGD-e
gcaccaauaaaaccu

SEQ ID NO: 2807162 - RNA, 21 nt, Listeria monocytogenes EGD-e
gcacgucaaauggcgcaggaa

SEQ ID NO: 2807163 - RNA, 22 nt, Listeria monocytogenes EGD-e
gcacguuuuaguggagcucuuu

SEQ ID NO: 2807164 - RNA, 13 nt, Listeria monocytogenes EGD-e
gcacuaauuucau

SEQ ID NO: 2807165 - RNA, 16 nt, Listeria monocytogenes EGD-e
gcacuuucaaaucagc

SEQ ID NO: 2807166 - RNA, 15 nt, Listeria monocytogenes EGD-e
gcagaaaacagaaag

SEQ ID NO: 2807167 - RNA, 21 nt, Listeria monocytogenes EGD-e
gcagaaaguuggguaugacuu

SEQ ID NO: 2807168 - RNA, 23 nt, Listeria monocytogenes EGD-e
gcagaaggggcugugaaggaaac

SEQ ID NO: 2807169 - RNA, 19 nt, Listeria monocytogenes EGD-e
gcagaaugagcuccuucaa

SEQ ID NO: 2807170 - RNA, 18 nt, Listeria monocytogenes EGD-e
gcagcaagugugauuguu

SEQ ID NO: 2807171 - RNA, 18 nt, Listeria monocytogenes EGD-e
gcagcugauuuuuggggu

SEQ ID NO: 2807172 - RNA, 23 nt, Listeria monocytogenes EGD-e
gcaggcacgucaaauggcgcagg

SEQ ID NO: 2807173 - RNA, 14 nt, Listeria monocytogenes EGD-e
gcagggcagaaaac

SEQ ID NO: 2807174 - RNA, 17 nt, Listeria monocytogenes EGD-e
gcagggcuauuuuuccg

SEQ ID NO: 2807175 - RNA, 22 nt, Listeria monocytogenes EGD-e
gcaggguggccgugauaaauaa

SEQ ID NO: 2807176 - RNA, 19 nt, Listeria monocytogenes EGD-e
gcagguucaccaaaugcuu

SEQ ID NO: 2807177 - RNA, 13 nt, Listeria monocytogenes EGD-e
gcaguagacuaaa

SEQ ID NO: 2807178 - RNA, 13 nt, Listeria monocytogenes EGD-e
gcaguaguuuacu

SEQ ID NO: 2807179 - RNA, 16 nt, Listeria monocytogenes EGD-e
gcauacgaguucuacu

SEQ ID NO: 2807180 - RNA, 14 nt, Listeria monocytogenes EGD-e
gcauagauggaaga

SEQ ID NO: 2807181 - RNA, 16 nt, Listeria monocytogenes EGD-e
gcauaucaucaauaaa

SEQ ID NO: 2807182 - RNA, 22 nt, Listeria monocytogenes EGD-e
gcaucauuuuuuugauuaauaa

SEQ ID NO: 2807183 - RNA, 21 nt, Listeria monocytogenes EGD-e
gcauccaagcggguuuucuca

SEQ ID NO: 2807184 - RNA, 21 nt, Listeria monocytogenes EGD-e
gcauccucaaacgucauucgg

SEQ ID NO: 2807185 - RNA, 20 nt, Listeria monocytogenes EGD-e
gcauccucuuuuguaguaaa

SEQ ID NO: 2807186 - RNA, 15 nt, Listeria monocytogenes EGD-e
gcaucggucaaaucu

SEQ ID NO: 2807187 - RNA, 14 nt, Listeria monocytogenes EGD-e
gcaucuaguagcaa

SEQ ID NO: 2807188 - RNA, 22 nt, Listeria monocytogenes EGD-e
gcaucuucuaagaaaaaaaguu

SEQ ID NO: 2807189 - RNA, 21 nt, Listeria monocytogenes EGD-e
gcaucuuggcaugaugaaaag

SEQ ID NO: 2807190 - RNA, 16 nt, Listeria monocytogenes EGD-e
gcaucuuuuucuugcu

SEQ ID NO: 2807191 - RNA, 17 nt, Listeria monocytogenes EGD-e
gcaucuuuuucuugcuu

SEQ ID NO: 2807192 - RNA, 20 nt, Listeria monocytogenes EGD-e
gcaucuuuuucuugcuuucc

SEQ ID NO: 2807193 - RNA, 17 nt, Listeria monocytogenes EGD-e
gcauugcuuccccauag

SEQ ID NO: 2807194 - RNA, 11 nt, Listeria monocytogenes EGD-e
gcauuucacac

SEQ ID NO: 2807195 - RNA, 14 nt, Listeria monocytogenes EGD-e
gcauuuucaugaac

SEQ ID NO: 2807196 - RNA, 23 nt, Listeria monocytogenes EGD-e
gccaaccggaucaucacucccug

SEQ ID NO: 2807197 - RNA, 12 nt, Listeria monocytogenes EGD-e
gccacuaacaua

SEQ ID NO: 2807198 - RNA, 21 nt, Listeria monocytogenes EGD-e
gccacuaacauaaauugauuc

SEQ ID NO: 2807199 - RNA, 23 nt, Listeria monocytogenes EGD-e
gccagacuuuuuuuuauaagaaa

SEQ ID NO: 2807200 - RNA, 23 nt, Listeria monocytogenes EGD-e
gccagcuucuuccauuuguucuc

SEQ ID NO: 2807201 - RNA, 23 nt, Listeria monocytogenes EGD-e
gccaucaauaucggcauuugaau

SEQ ID NO: 2807202 - RNA, 15 nt, Listeria monocytogenes EGD-e
gccaucgcagcagaa

SEQ ID NO: 2807203 - RNA, 16 nt, Listeria monocytogenes EGD-e
gccaugaauauuagaa

SEQ ID NO: 2807204 - RNA, 17 nt, Listeria monocytogenes EGD-e
gccaugaauauuagaaa

SEQ ID NO: 2807205 - RNA, 13 nt, Listeria monocytogenes EGD-e
gccauucccgucc

SEQ ID NO: 2807206 - RNA, 22 nt, Listeria monocytogenes EGD-e
gccauuugccaucgcagcagaa

SEQ ID NO: 2807207 - RNA, 22 nt, Listeria monocytogenes EGD-e
gcccacaaaacggaucuuucuc

SEQ ID NO: 2807208 - RNA, 19 nt, Listeria monocytogenes EGD-e
gcccagcuuaauccaauuu

SEQ ID NO: 2807209 - RNA, 23 nt, Listeria monocytogenes EGD-e
gcccauuaaaaagcuuauuaaac

SEQ ID NO: 2807210 - RNA, 19 nt, Listeria monocytogenes EGD-e
gccgacaaguacuuugaau

SEQ ID NO: 2807211 - RNA, 14 nt, Listeria monocytogenes EGD-e
gccgacuaguucug

SEQ ID NO: 2807212 - RNA, 19 nt, Listeria monocytogenes EGD-e
gccgcucgucuaaauugag

SEQ ID NO: 2807213 - RNA, 16 nt, Listeria monocytogenes EGD-e
gccggguauggcuggg

SEQ ID NO: 2807214 - RNA, 19 nt, Listeria monocytogenes EGD-e
gccuaaguuaaaccauaaa

SEQ ID NO: 2807215 - RNA, 16 nt, Listeria monocytogenes EGD-e
gccuaauuguauaagu

SEQ ID NO: 2807216 - RNA, 21 nt, Listeria monocytogenes EGD-e
gccuacuuuuuuuauuuaccu

SEQ ID NO: 2807217 - RNA, 23 nt, Listeria monocytogenes EGD-e
gccuacuuuuuuuauuuaccuug

SEQ ID NO: 2807218 - RNA, 15 nt, Listeria monocytogenes EGD-e
gccuaggcucucuuc

SEQ ID NO: 2807219 - RNA, 15 nt, Listeria monocytogenes EGD-e
gccuggauuuucuag

SEQ ID NO: 2807220 - RNA, 17 nt, Listeria monocytogenes EGD-e
gccuuaaaauaaaaaaa

SEQ ID NO: 2807221 - RNA, 22 nt, Listeria monocytogenes EGD-e
gccuucgauaguuccuucuaau

SEQ ID NO: 2807222 - RNA, 13 nt, Listeria monocytogenes EGD-e
gccuuuauugaua

SEQ ID NO: 2807223 - RNA, 21 nt, Listeria monocytogenes EGD-e
gcgaaaaaugaaaagaaaaac

SEQ ID NO: 2807224 - RNA, 17 nt, Listeria monocytogenes EGD-e
gcgacauuaaauagccu

SEQ ID NO: 2807225 - RNA, 18 nt, Listeria monocytogenes EGD-e
gcgcaacauucaaaucac

SEQ ID NO: 2807226 - RNA, 22 nt, Listeria monocytogenes EGD-e
gcgcacaaguaauauuauaucc

SEQ ID NO: 2807227 - RNA, 16 nt, Listeria monocytogenes EGD-e
gcgcagaaugaagcca

SEQ ID NO: 2807228 - RNA, 18 nt, Listeria monocytogenes EGD-e
gcgcuuccaguggcugaa

SEQ ID NO: 2807229 - RNA, 14 nt, Listeria monocytogenes EGD-e
gcggaaauaaaaac

SEQ ID NO: 2807230 - RNA, 23 nt, Listeria monocytogenes EGD-e
gcggcauuucaaucgcagcagau

SEQ ID NO: 2807231 - RNA, 18 nt, Listeria monocytogenes EGD-e
gcggcucagauccuucaa

SEQ ID NO: 2807232 - RNA, 13 nt, Listeria monocytogenes EGD-e
gcguauccacaua

SEQ ID NO: 2807233 - RNA, 21 nt, Listeria monocytogenes EGD-e
gcguaugguucaaaaagauac

SEQ ID NO: 2807234 - RNA, 15 nt, Listeria monocytogenes EGD-e
gcguuaaucuuacau

SEQ ID NO: 2807235 - RNA, 21 nt, Listeria monocytogenes EGD-e
gcguuuaaagcguuuuucugc

SEQ ID NO: 2807236 - RNA, 14 nt, Listeria monocytogenes EGD-e
gcuaaaacuaaaac

SEQ ID NO: 2807237 - RNA, 23 nt, Listeria monocytogenes EGD-e
gcuaaauaaaaccauucaucuaa

SEQ ID NO: 2807238 - RNA, 15 nt, Listeria monocytogenes EGD-e
gcuaaauugugaaau

SEQ ID NO: 2807239 - RNA, 16 nt, Listeria monocytogenes EGD-e
gcuaagcauuauaaaa

SEQ ID NO: 2807240 - RNA, 18 nt, Listeria monocytogenes EGD-e
gcuaauaacauuaaaccu

SEQ ID NO: 2807241 - RNA, 15 nt, Listeria monocytogenes EGD-e
gcuaauacuauugaa

SEQ ID NO: 2807242 - RNA, 15 nt, Listeria monocytogenes EGD-e
gcuaauuauuucaag

SEQ ID NO: 2807243 - RNA, 19 nt, Listeria monocytogenes EGD-e
gcuagacuguaugaaacuu

SEQ ID NO: 2807244 - RNA, 17 nt, Listeria monocytogenes EGD-e
gcuagcgaagucaauuu

SEQ ID NO: 2807245 - RNA, 13 nt, Listeria monocytogenes EGD-e
gcuauuccagcua

SEQ ID NO: 2807246 - RNA, 23 nt, Listeria monocytogenes EGD-e
gcucaagugaacguacaacuaaa

SEQ ID NO: 2807247 - RNA, 14 nt, Listeria monocytogenes EGD-e
gcuccguauuuaua

SEQ ID NO: 2807248 - RNA, 18 nt, Listeria monocytogenes EGD-e
gcuccguauuuauauucu

SEQ ID NO: 2807249 - RNA, 13 nt, Listeria monocytogenes EGD-e
gcucgauuuuuuu

SEQ ID NO: 2807250 - RNA, 13 nt, Listeria monocytogenes EGD-e
gcucgucuaaauu

SEQ ID NO: 2807251 - RNA, 22 nt, Listeria monocytogenes EGD-e
gcucguucuuaguuaauucuuu

SEQ ID NO: 2807252 - RNA, 19 nt, Listeria monocytogenes EGD-e
gcucuguuucauuuuucca

SEQ ID NO: 2807253 - RNA, 15 nt, Listeria monocytogenes EGD-e
gcucuuccuuuuguu

SEQ ID NO: 2807254 - RNA, 17 nt, Listeria monocytogenes EGD-e
gcucuuccuuuuguuuu

SEQ ID NO: 2807255 - RNA, 18 nt, Listeria monocytogenes EGD-e
gcucuuccuuuuguuuua

SEQ ID NO: 2807256 - RNA, 14 nt, Listeria monocytogenes EGD-e
gcucuuugcuucaa

SEQ ID NO: 2807257 - RNA, 21 nt, Listeria monocytogenes EGD-e
gcugcuaaaggcaacaaagaa

SEQ ID NO: 2807258 - RNA, 18 nt, Listeria monocytogenes EGD-e
gcugcuacgauucgauuu

SEQ ID NO: 2807259 - RNA, 16 nt, Listeria monocytogenes EGD-e
gcuggauaaagaccua

SEQ ID NO: 2807260 - RNA, 18 nt, Listeria monocytogenes EGD-e
gcuggauaaagaccuaaa

SEQ ID NO: 2807261 - RNA, 13 nt, Listeria monocytogenes EGD-e
gcuguaaaugaau

SEQ ID NO: 2807262 - RNA, 17 nt, Listeria monocytogenes EGD-e
gcugucaaauucuucuc

SEQ ID NO: 2807263 - RNA, 14 nt, Listeria monocytogenes EGD-e
gcugucuuggaaga

SEQ ID NO: 2807264 - RNA, 22 nt, Listeria monocytogenes EGD-e
gcuguuacugugcucuuugcuu

SEQ ID NO: 2807265 - RNA, 22 nt, Listeria monocytogenes EGD-e
gcuucaccaagaagagcugcaa

SEQ ID NO: 2807266 - RNA, 22 nt, Listeria monocytogenes EGD-e
gcuucacgugcugcuuuccuug

SEQ ID NO: 2807267 - RNA, 19 nt, Listeria monocytogenes EGD-e
gcuucauaaaucgccacau

SEQ ID NO: 2807268 - RNA, 17 nt, Listeria monocytogenes EGD-e
gcuuccccauaguaaaa

SEQ ID NO: 2807269 - RNA, 19 nt, Listeria monocytogenes EGD-e
gcuuccccauaguaaaaaa

SEQ ID NO: 2807270 - RNA, 18 nt, Listeria monocytogenes EGD-e
gcuucgcuguccauucca

SEQ ID NO: 2807271 - RNA, 23 nt, Listeria monocytogenes EGD-e
gcuucguuucauuucaucuuuuu

SEQ ID NO: 2807272 - RNA, 15 nt, Listeria monocytogenes EGD-e
gcuucuaagucaaaa

SEQ ID NO: 2807273 - RNA, 17 nt, Listeria monocytogenes EGD-e
gcuucuaagucaaaacg

SEQ ID NO: 2807274 - RNA, 15 nt, Listeria monocytogenes EGD-e
gcuucuauuugucaa

SEQ ID NO: 2807275 - RNA, 15 nt, Listeria monocytogenes EGD-e
gcuucuggcuggcag

SEQ ID NO: 2807276 - RNA, 16 nt, Listeria monocytogenes EGD-e
gcuucuuccauuuguu

SEQ ID NO: 2807277 - RNA, 18 nt, Listeria monocytogenes EGD-e
gcuucuuccauuuguucu

SEQ ID NO: 2807278 - RNA, 17 nt, Listeria monocytogenes EGD-e
gcuucuuuuuucuucca

SEQ ID NO: 2807279 - RNA, 21 nt, Listeria monocytogenes EGD-e
gcuugcacuuggaacggcuuu

SEQ ID NO: 2807280 - RNA, 17 nt, Listeria monocytogenes EGD-e
gcuuguaagaagcuuuu

SEQ ID NO: 2807281 - RNA, 16 nt, Listeria monocytogenes EGD-e
gcuuguguaacauaaa

SEQ ID NO: 2807282 - RNA, 22 nt, Listeria monocytogenes EGD-e
gcuuguuuugaugcuaacuuaa

SEQ ID NO: 2807283 - RNA, 17 nt, Listeria monocytogenes EGD-e
gcuuuaauuuggaaaua

SEQ ID NO: 2807284 - RNA, 17 nt, Listeria monocytogenes EGD-e
gcuuuaucuuuuccuuc

SEQ ID NO: 2807285 - RNA, 13 nt, Listeria monocytogenes EGD-e
gcuuuccagcagg

SEQ ID NO: 2807286 - RNA, 12 nt, Listeria monocytogenes EGD-e
gcuuucuuuuuu

SEQ ID NO: 2807287 - RNA, 19 nt, Listeria monocytogenes EGD-e
gcuuugucuagguuuucuu

SEQ ID NO: 2807288 - RNA, 21 nt, Listeria monocytogenes EGD-e
gcuuugucuuaaaugacaaag

SEQ ID NO: 2807289 - RNA, 14 nt, Listeria monocytogenes EGD-e
gcuuuuaaauauac

SEQ ID NO: 2807290 - RNA, 21 nt, Listeria monocytogenes EGD-e
gcuuuuaacuuucuuguuuca

SEQ ID NO: 2807291 - RNA, 23 nt, Listeria monocytogenes EGD-e
gcuuuuguccaaccuaaaucuuu

SEQ ID NO: 2807292 - RNA, 17 nt, Listeria monocytogenes EGD-e
gcuuuuguuuuccuuug

SEQ ID NO: 2807293 - RNA, 20 nt, Listeria monocytogenes EGD-e
gcuuuuuaagucgaaagaau

SEQ ID NO: 2807294 - RNA, 17 nt, Listeria monocytogenes EGD-e
gcuuuuucaaaaucaag

SEQ ID NO: 2807295 - RNA, 17 nt, Listeria monocytogenes EGD-e
ggaaauaauucugcuaa

SEQ ID NO: 2807296 - RNA, 16 nt, Listeria monocytogenes EGD-e
ggaagaaccuucaagc

SEQ ID NO: 2807297 - RNA, 20 nt, Listeria monocytogenes EGD-e
ggacaacagguuuuguguua

SEQ ID NO: 2807298 - RNA, 13 nt, Listeria monocytogenes EGD-e
ggacaagcccagc

SEQ ID NO: 2807299 - RNA, 14 nt, Listeria monocytogenes EGD-e
ggacaagcccagca

SEQ ID NO: 2807300 - RNA, 19 nt, Listeria monocytogenes EGD-e
ggacauacuucaugugcuu

SEQ ID NO: 2807301 - RNA, 12 nt, Listeria monocytogenes EGD-e
ggagacagaaaa

SEQ ID NO: 2807302 - RNA, 17 nt, Listeria monocytogenes EGD-e
ggagcaagugugaaaau

SEQ ID NO: 2807303 - RNA, 16 nt, Listeria monocytogenes EGD-e
ggagugucaguguuuu

SEQ ID NO: 2807304 - RNA, 18 nt, Listeria monocytogenes EGD-e
ggauaaaaaaauaccuag

SEQ ID NO: 2807305 - RNA, 13 nt, Listeria monocytogenes EGD-e
ggauaaaaauugc

SEQ ID NO: 2807306 - RNA, 20 nt, Listeria monocytogenes EGD-e
ggauagcuucgcaaaaaguc

SEQ ID NO: 2807307 - RNA, 15 nt, Listeria monocytogenes EGD-e
ggauaguuccagcua

SEQ ID NO: 2807308 - RNA, 22 nt, Listeria monocytogenes EGD-e
ggaucuuccaucauaaucccag

SEQ ID NO: 2807309 - RNA, 20 nt, Listeria monocytogenes EGD-e
ggaugcacuuuuaauuuagu

SEQ ID NO: 2807310 - RNA, 23 nt, Listeria monocytogenes EGD-e
ggauuaaaaguugaccgcaaaua

SEQ ID NO: 2807311 - RNA, 19 nt, Listeria monocytogenes EGD-e
ggauucucuucuaacaauu

SEQ ID NO: 2807312 - RNA, 16 nt, Listeria monocytogenes EGD-e
ggauuuuucaaaucaa

SEQ ID NO: 2807313 - RNA, 22 nt, Listeria monocytogenes EGD-e
ggcaaauaacguugcauuaaaa

SEQ ID NO: 2807314 - RNA, 24 nt, Listeria monocytogenes EGD-e
ggcaucauuuuuuugauuaauaaa

SEQ ID NO: 2807315 - RNA, 12 nt, Listeria monocytogenes EGD-e
ggcgauucuuca

SEQ ID NO: 2807316 - RNA, 15 nt, Listeria monocytogenes EGD-e
ggcguaauaaauggu

SEQ ID NO: 2807317 - RNA, 15 nt, Listeria monocytogenes EGD-e
ggcguacuuaaauca

SEQ ID NO: 2807318 - RNA, 22 nt, Listeria monocytogenes EGD-e
ggcuaauaacauuaaaccucuu

SEQ ID NO: 2807319 - RNA, 21 nt, Listeria monocytogenes EGD-e
ggcuagcaacaaucgcaucca

SEQ ID NO: 2807320 - RNA, 15 nt, Listeria monocytogenes EGD-e
ggcucguugcagaaa

SEQ ID NO: 2807321 - RNA, 20 nt, Listeria monocytogenes EGD-e
ggcucuuccuuuuguuuuaa

SEQ ID NO: 2807322 - RNA, 14 nt, Listeria monocytogenes EGD-e
gggaauaaaucaag

SEQ ID NO: 2807323 - RNA, 14 nt, Listeria monocytogenes EGD-e
gggagaagccuugc

SEQ ID NO: 2807324 - RNA, 16 nt, Listeria monocytogenes EGD-e
gggcccgaaaaucgag

SEQ ID NO: 2807325 - RNA, 13 nt, Listeria monocytogenes EGD-e
ggggcaaaaagga

SEQ ID NO: 2807326 - RNA, 21 nt, Listeria monocytogenes EGD-e
gggguacugcggcauagaaag

SEQ ID NO: 2807327 - RNA, 12 nt, Listeria monocytogenes EGD-e
gggugagcuucu

SEQ ID NO: 2807328 - RNA, 19 nt, Listeria monocytogenes EGD-e
ggguguuuauucauauaaa

SEQ ID NO: 2807329 - RNA, 11 nt, Listeria monocytogenes EGD-e
gguaaauagcc

SEQ ID NO: 2807330 - RNA, 21 nt, Listeria monocytogenes EGD-e
gguaaauagccaagauuaaaa

SEQ ID NO: 2807331 - RNA, 17 nt, Listeria monocytogenes EGD-e
gguaacgucuacuuuug

SEQ ID NO: 2807332 - RNA, 22 nt, Listeria monocytogenes EGD-e
gguaaucgcagggcagaaaaca

SEQ ID NO: 2807333 - RNA, 19 nt, Listeria monocytogenes EGD-e
gguagcuucaaucaagccu

SEQ ID NO: 2807334 - RNA, 13 nt, Listeria monocytogenes EGD-e
gguaucaaauaac

SEQ ID NO: 2807335 - RNA, 23 nt, Listeria monocytogenes EGD-e
ggugaaaaugagcccaaaaauaa

SEQ ID NO: 2807336 - RNA, 22 nt, Listeria monocytogenes EGD-e
gguguaaucacuauugaauguc

SEQ ID NO: 2807337 - RNA, 23 nt, Listeria monocytogenes EGD-e
gguuagcagcuuuuguccaaccu

SEQ ID NO: 2807338 - RNA, 16 nt, Listeria monocytogenes EGD-e
gguucaaaaagauacu

SEQ ID NO: 2807339 - RNA, 18 nt, Listeria monocytogenes EGD-e
gguucaaaaagauacuuu

SEQ ID NO: 2807340 - RNA, 14 nt, Listeria monocytogenes EGD-e
gguugauaauaauc

SEQ ID NO: 2807341 - RNA, 23 nt, Listeria monocytogenes EGD-e
gguuuacucccuuuuuccacacu

SEQ ID NO: 2807342 - RNA, 13 nt, Listeria monocytogenes EGD-e
guaaaaaacuguu

SEQ ID NO: 2807343 - RNA, 13 nt, Listeria monocytogenes EGD-e
guaaaaaggaaag

SEQ ID NO: 2807344 - RNA, 19 nt, Listeria monocytogenes EGD-e
guaaaaucuuuuaauaacu

SEQ ID NO: 2807345 - RNA, 22 nt, Listeria monocytogenes EGD-e
guaaacauuucucccucauccu

SEQ ID NO: 2807346 - RNA, 22 nt, Listeria monocytogenes EGD-e
guaaauacucgucauagauacu

SEQ ID NO: 2807347 - RNA, 19 nt, Listeria monocytogenes EGD-e
guaaauaggauuaaaauaa

SEQ ID NO: 2807348 - RNA, 15 nt, Listeria monocytogenes EGD-e
guaacgucuacuuuu

SEQ ID NO: 2807349 - RNA, 19 nt, Listeria monocytogenes EGD-e
guaacuaaaaaucauuuaa

SEQ ID NO: 2807350 - RNA, 23 nt, Listeria monocytogenes EGD-e
guaacuaaaaaucauuuaaacac

SEQ ID NO: 2807351 - RNA, 14 nt, Listeria monocytogenes EGD-e
guaacuaaaauauu

SEQ ID NO: 2807352 - RNA, 13 nt, Listeria monocytogenes EGD-e
guaacucuuccaa

SEQ ID NO: 2807353 - RNA, 15 nt, Listeria monocytogenes EGD-e
guaacuguugaaaag

SEQ ID NO: 2807354 - RNA, 18 nt, Listeria monocytogenes EGD-e
guaaggcauguaucuuaa

SEQ ID NO: 2807355 - RNA, 20 nt, Listeria monocytogenes EGD-e
guaagguuuuuuuaugcaua

SEQ ID NO: 2807356 - RNA, 17 nt, Listeria monocytogenes EGD-e
guaaguagcauuuucga

SEQ ID NO: 2807357 - RNA, 14 nt, Listeria monocytogenes EGD-e
guaauaggauuuua

SEQ ID NO: 2807358 - RNA, 21 nt, Listeria monocytogenes EGD-e
guaauaggauuuuacugcggc

SEQ ID NO: 2807359 - RNA, 13 nt, Listeria monocytogenes EGD-e
guaauauaaauuu

SEQ ID NO: 2807360 - RNA, 19 nt, Listeria monocytogenes EGD-e
guaauauauucaaaauggu

SEQ ID NO: 2807361 - RNA, 19 nt, Listeria monocytogenes EGD-e
guaaucuguaaaaauaaau

SEQ ID NO: 2807362 - RNA, 16 nt, Listeria monocytogenes EGD-e
guaauucgaauaagaa

SEQ ID NO: 2807363 - RNA, 20 nt, Listeria monocytogenes EGD-e
guaauucuaaauaaauauuu

SEQ ID NO: 2807364 - RNA, 16 nt, Listeria monocytogenes EGD-e
guacaguuagaaccgu

SEQ ID NO: 2807365 - RNA, 17 nt, Listeria monocytogenes EGD-e
guagauuccgcuaaaac

SEQ ID NO: 2807366 - RNA, 21 nt, Listeria monocytogenes EGD-e
guagcagauguaucuaaaauc

SEQ ID NO: 2807367 - RNA, 23 nt, Listeria monocytogenes EGD-e
guagcguuuaaagcguuuuucug

SEQ ID NO: 2807368 - RNA, 16 nt, Listeria monocytogenes EGD-e
guagcuucaaucaagc

SEQ ID NO: 2807369 - RNA, 14 nt, Listeria monocytogenes EGD-e
guaggccuagcuaa

SEQ ID NO: 2807370 - RNA, 12 nt, Listeria monocytogenes EGD-e
guauacccuuuu

SEQ ID NO: 2807371 - RNA, 22 nt, Listeria monocytogenes EGD-e
guauagcuuaaagguuuuguuu

SEQ ID NO: 2807372 - RNA, 14 nt, Listeria monocytogenes EGD-e
guauaugcuacuau

SEQ ID NO: 2807373 - RNA, 16 nt, Listeria monocytogenes EGD-e
guauaugcuacuauca

SEQ ID NO: 2807374 - RNA, 18 nt, Listeria monocytogenes EGD-e
guauauguuuuauuuaua

SEQ ID NO: 2807375 - RNA, 16 nt, Listeria monocytogenes EGD-e
guauccagccgcaaau

SEQ ID NO: 2807376 - RNA, 22 nt, Listeria monocytogenes EGD-e
guauccagccgcaaauaguugu

SEQ ID NO: 2807377 - RNA, 21 nt, Listeria monocytogenes EGD-e
guaugaacacccgguccuuca

SEQ ID NO: 2807378 - RNA, 15 nt, Listeria monocytogenes EGD-e
guaugagaacaauca

SEQ ID NO: 2807379 - RNA, 22 nt, Listeria monocytogenes EGD-e
guauggugcgcggauaaauaua

SEQ ID NO: 2807380 - RNA, 18 nt, Listeria monocytogenes EGD-e
guauguuuuaauuucaaa

SEQ ID NO: 2807381 - RNA, 13 nt, Listeria monocytogenes EGD-e
guauguuuucccu

SEQ ID NO: 2807382 - RNA, 15 nt, Listeria monocytogenes EGD-e
guauuaccucgcuuu

SEQ ID NO: 2807383 - RNA, 17 nt, Listeria monocytogenes EGD-e
guauucaaauucaauuu

SEQ ID NO: 2807384 - RNA, 17 nt, Listeria monocytogenes EGD-e
gucaaaccauuauacaa

SEQ ID NO: 2807385 - RNA, 13 nt, Listeria monocytogenes EGD-e
gucaaucauuucu

SEQ ID NO: 2807386 - RNA, 20 nt, Listeria monocytogenes EGD-e
gucaauuauucgcucgucaa

SEQ ID NO: 2807387 - RNA, 19 nt, Listeria monocytogenes EGD-e
gucaauuugacgcaaggaa

SEQ ID NO: 2807388 - RNA, 14 nt, Listeria monocytogenes EGD-e
gucacaaacgcuuu

SEQ ID NO: 2807389 - RNA, 15 nt, Listeria monocytogenes EGD-e
gucaggauuaaaagu

SEQ ID NO: 2807390 - RNA, 13 nt, Listeria monocytogenes EGD-e
gucaguguuuuug

SEQ ID NO: 2807391 - RNA, 14 nt, Listeria monocytogenes EGD-e
gucaucauaaacau

SEQ ID NO: 2807392 - RNA, 15 nt, Listeria monocytogenes EGD-e
gucaucauaaacauu

SEQ ID NO: 2807393 - RNA, 19 nt, Listeria monocytogenes EGD-e
gucauuuuugcugauuuuu

SEQ ID NO: 2807394 - RNA, 19 nt, Listeria monocytogenes EGD-e
guccaaagagccauaaaau

SEQ ID NO: 2807395 - RNA, 22 nt, Listeria monocytogenes EGD-e
gucccauuacugucgcaaaaau

SEQ ID NO: 2807396 - RNA, 16 nt, Listeria monocytogenes EGD-e
guccgucaagcccagc

SEQ ID NO: 2807397 - RNA, 13 nt, Listeria monocytogenes EGD-e
gucgaaaaccuaa

SEQ ID NO: 2807398 - RNA, 14 nt, Listeria monocytogenes EGD-e
gucgcguucuuguc

SEQ ID NO: 2807399 - RNA, 18 nt, Listeria monocytogenes EGD-e
gucgcuauucuauuuauc

SEQ ID NO: 2807400 - RNA, 20 nt, Listeria monocytogenes EGD-e
gucgcugucaaauucuucuc

SEQ ID NO: 2807401 - RNA, 14 nt, Listeria monocytogenes EGD-e
gucggugcauuuuu

SEQ ID NO: 2807402 - RNA, 22 nt, Listeria monocytogenes EGD-e
gucguuauguaauucuaaauaa

SEQ ID NO: 2807403 - RNA, 22 nt, Listeria monocytogenes EGD-e
gucugugauuacuccaaaauaa

SEQ ID NO: 2807404 - RNA, 19 nt, Listeria monocytogenes EGD-e
gucuuaaaugacaaagcua

SEQ ID NO: 2807405 - RNA, 14 nt, Listeria monocytogenes EGD-e
gucuuuguuguuuu

SEQ ID NO: 2807406 - RNA, 17 nt, Listeria monocytogenes EGD-e
gucuuuuuguaaaggau

SEQ ID NO: 2807407 - RNA, 13 nt, Listeria monocytogenes EGD-e
gugaaaguuuuau

SEQ ID NO: 2807408 - RNA, 11 nt, Listeria monocytogenes EGD-e
gugaaauagaa

SEQ ID NO: 2807409 - RNA, 12 nt, Listeria monocytogenes EGD-e
gugaaauagaau

SEQ ID NO: 2807410 - RNA, 17 nt, Listeria monocytogenes EGD-e
gugagcuucuuuuucga

SEQ ID NO: 2807411 - RNA, 23 nt, Listeria monocytogenes EGD-e
gugaugaaaccaaauaugcuaua

SEQ ID NO: 2807412 - RNA, 19 nt, Listeria monocytogenes EGD-e
gugcucuuugcuucaaucc

SEQ ID NO: 2807413 - RNA, 20 nt, Listeria monocytogenes EGD-e
gugcuuuccccaccaggcaa

SEQ ID NO: 2807414 - RNA, 20 nt, Listeria monocytogenes EGD-e
gugguguuuuuuguuuguaa

SEQ ID NO: 2807415 - RNA, 22 nt, Listeria monocytogenes EGD-e
gugguuuacucccuuuuuccac

SEQ ID NO: 2807416 - RNA, 19 nt, Listeria monocytogenes EGD-e
guguaaucacuauugaaug

SEQ ID NO: 2807417 - RNA, 18 nt, Listeria monocytogenes EGD-e
guguaguuucgauaucuu

SEQ ID NO: 2807418 - RNA, 12 nt, Listeria monocytogenes EGD-e
guguccaaaaac

SEQ ID NO: 2807419 - RNA, 18 nt, Listeria monocytogenes EGD-e
gugugguguuuuuuguuu

SEQ ID NO: 2807420 - RNA, 13 nt, Listeria monocytogenes EGD-e
guguugaauaagu

SEQ ID NO: 2807421 - RNA, 23 nt, Listeria monocytogenes EGD-e
guguugauaaagauaauaaccgc

SEQ ID NO: 2807422 - RNA, 14 nt, Listeria monocytogenes EGD-e
guuaaacaaacaca

SEQ ID NO: 2807423 - RNA, 16 nt, Listeria monocytogenes EGD-e
guuaaaggagaaaaag

SEQ ID NO: 2807424 - RNA, 18 nt, Listeria monocytogenes EGD-e
guuaacuaacaaaaucca

SEQ ID NO: 2807425 - RNA, 13 nt, Listeria monocytogenes EGD-e
guuaauaaaauca

SEQ ID NO: 2807426 - RNA, 16 nt, Listeria monocytogenes EGD-e
guuaaucgaaaaauca

SEQ ID NO: 2807427 - RNA, 17 nt, Listeria monocytogenes EGD-e
guuaaucugauuaaaag

SEQ ID NO: 2807428 - RNA, 19 nt, Listeria monocytogenes EGD-e
guuaaucugauuaaaaguu

SEQ ID NO: 2807429 - RNA, 21 nt, Listeria monocytogenes EGD-e
guuacuuuaccuugaucaaaa

SEQ ID NO: 2807430 - RNA, 18 nt, Listeria monocytogenes EGD-e
guuagaaccguauuuaau

SEQ ID NO: 2807431 - RNA, 12 nt, Listeria monocytogenes EGD-e
guucaaaaagau

SEQ ID NO: 2807432 - RNA, 20 nt, Listeria monocytogenes EGD-e
guucaacuacuucaacuaaa

SEQ ID NO: 2807433 - RNA, 14 nt, Listeria monocytogenes EGD-e
guucaccaaaugcu

SEQ ID NO: 2807434 - RNA, 15 nt, Listeria monocytogenes EGD-e
guucaggguuuguuc

SEQ ID NO: 2807435 - RNA, 18 nt, Listeria monocytogenes EGD-e
guucauucgguaagacca

SEQ ID NO: 2807436 - RNA, 20 nt, Listeria monocytogenes EGD-e
guuccaaaaauagcuuuccc

SEQ ID NO: 2807437 - RNA, 21 nt, Listeria monocytogenes EGD-e
guuccaguuaaacaaacacaa

SEQ ID NO: 2807438 - RNA, 11 nt, Listeria monocytogenes EGD-e
guucuaaaaua

SEQ ID NO: 2807439 - RNA, 22 nt, Listeria monocytogenes EGD-e
guucuaaacguucuuccuuuuu

SEQ ID NO: 2807440 - RNA, 14 nt, Listeria monocytogenes EGD-e
guucucuauauuca

SEQ ID NO: 2807441 - RNA, 17 nt, Listeria monocytogenes EGD-e
guucugguaauaaguca

SEQ ID NO: 2807442 - RNA, 22 nt, Listeria monocytogenes EGD-e
guucuuccuuuuucauuauaag

SEQ ID NO: 2807443 - RNA, 13 nt, Listeria monocytogenes EGD-e
guucuugccaaaa

SEQ ID NO: 2807444 - RNA, 16 nt, Listeria monocytogenes EGD-e
guucuugccaaaaagg

SEQ ID NO: 2807445 - RNA, 19 nt, Listeria monocytogenes EGD-e
guucuuuacauauuccaaa

SEQ ID NO: 2807446 - RNA, 18 nt, Listeria monocytogenes EGD-e
guucuuuuuuaugaaaaa

SEQ ID NO: 2807447 - RNA, 17 nt, Listeria monocytogenes EGD-e
guugaaaaguaguguau

SEQ ID NO: 2807448 - RNA, 22 nt, Listeria monocytogenes EGD-e
guugaacgguuaacguuuuccc

SEQ ID NO: 2807449 - RNA, 14 nt, Listeria monocytogenes EGD-e
guugauaauaauca

SEQ ID NO: 2807450 - RNA, 23 nt, Listeria monocytogenes EGD-e
guugcauagugagaguuccaucu

SEQ ID NO: 2807451 - RNA, 16 nt, Listeria monocytogenes EGD-e
guugcggcaguaguuu

SEQ ID NO: 2807452 - RNA, 13 nt, Listeria monocytogenes EGD-e
guugcuuuuguuu

SEQ ID NO: 2807453 - RNA, 20 nt, Listeria monocytogenes EGD-e
guugcuuuuguuuuccuuug

SEQ ID NO: 2807454 - RNA, 19 nt, Listeria monocytogenes EGD-e
guugggcugcaacaacuaa

SEQ ID NO: 2807455 - RNA, 19 nt, Listeria monocytogenes EGD-e
guuguaaaccguaacuguu

SEQ ID NO: 2807456 - RNA, 12 nt, Listeria monocytogenes EGD-e
guugugcuuucc

SEQ ID NO: 2807457 - RNA, 14 nt, Listeria monocytogenes EGD-e
guuguucuaacauu

SEQ ID NO: 2807458 - RNA, 15 nt, Listeria monocytogenes EGD-e
guuguucuugccaaa

SEQ ID NO: 2807459 - RNA, 19 nt, Listeria monocytogenes EGD-e
guuguuuucccagaaaaaa

SEQ ID NO: 2807460 - RNA, 15 nt, Listeria monocytogenes EGD-e
guuuacgaacgauuu

SEQ ID NO: 2807461 - RNA, 16 nt, Listeria monocytogenes EGD-e
guuuauucauauaaag

SEQ ID NO: 2807462 - RNA, 10 nt, Listeria monocytogenes EGD-e
guuucaauuu

SEQ ID NO: 2807463 - RNA, 18 nt, Listeria monocytogenes EGD-e
guuucacuuuaucccaga

SEQ ID NO: 2807464 - RNA, 21 nt, Listeria monocytogenes EGD-e
guuucauauaauuuuuucauu

SEQ ID NO: 2807465 - RNA, 14 nt, Listeria monocytogenes EGD-e
guuucauuuuugau

SEQ ID NO: 2807466 - RNA, 20 nt, Listeria monocytogenes EGD-e
guuuccccgucuaagaaauc

SEQ ID NO: 2807467 - RNA, 20 nt, Listeria monocytogenes EGD-e
guuucgauaucuucaugucc

SEQ ID NO: 2807468 - RNA, 23 nt, Listeria monocytogenes EGD-e
guuucuaauccagcuugauuaaa

SEQ ID NO: 2807469 - RNA, 23 nt, Listeria monocytogenes EGD-e
guuucuuuaccauacacauaggu

SEQ ID NO: 2807470 - RNA, 17 nt, Listeria monocytogenes EGD-e
guuucuuuuauuuuucu

SEQ ID NO: 2807471 - RNA, 13 nt, Listeria monocytogenes EGD-e
guuucuuuuguuc

SEQ ID NO: 2807472 - RNA, 13 nt, Listeria monocytogenes EGD-e
guuucuuuuugau

SEQ ID NO: 2807473 - RNA, 18 nt, Listeria monocytogenes EGD-e
guuugauaaucuacaggu

SEQ ID NO: 2807474 - RNA, 17 nt, Listeria monocytogenes EGD-e
guuuggaaaacauagaa

SEQ ID NO: 2807475 - RNA, 16 nt, Listeria monocytogenes EGD-e
guuuggucaacaucau

SEQ ID NO: 2807476 - RNA, 23 nt, Listeria monocytogenes EGD-e
guuuguaacaacuaauuuuucga

SEQ ID NO: 2807477 - RNA, 12 nt, Listeria monocytogenes EGD-e
guuuguauaaga

SEQ ID NO: 2807478 - RNA, 14 nt, Listeria monocytogenes EGD-e
guuuguuccaccgc

SEQ ID NO: 2807479 - RNA, 17 nt, Listeria monocytogenes EGD-e
guuuuaaagcuugauuu

SEQ ID NO: 2807480 - RNA, 20 nt, Listeria monocytogenes EGD-e
guuuuaguggagcucuuucu

SEQ ID NO: 2807481 - RNA, 14 nt, Listeria monocytogenes EGD-e
guuuuauuacauua

SEQ ID NO: 2807482 - RNA, 22 nt, Listeria monocytogenes EGD-e
guuuucaacaaaacaaacuagu

SEQ ID NO: 2807483 - RNA, 20 nt, Listeria monocytogenes EGD-e
guuuucccagaaaaaaacaa

SEQ ID NO: 2807484 - RNA, 23 nt, Listeria monocytogenes EGD-e
guuuugucaaaccauuauacaau

SEQ ID NO: 2807485 - RNA, 14 nt, Listeria monocytogenes EGD-e
guuuuguccaaacc

SEQ ID NO: 2807486 - RNA, 18 nt, Listeria monocytogenes EGD-e
guuuuguuuuuuuuaguc

SEQ ID NO: 2807487 - RNA, 11 nt, Listeria monocytogenes EGD-e
guuuuuacuua

SEQ ID NO: 2807488 - RNA, 14 nt, Listeria monocytogenes EGD-e
guuuuuuguuugua

SEQ ID NO: 2807489 - RNA, 20 nt, Listeria monocytogenes EGD-e
guuuuuuuaugcauaaaaaa

SEQ ID NO: 2807490 - RNA, 16 nt, Listeria monocytogenes EGD-e
guuuuuuuaugcuaaa

SEQ ID NO: 2807491 - RNA, 12 nt, Listeria monocytogenes EGD-e
uaaaaaaauaca

SEQ ID NO: 2807492 - RNA, 21 nt, Listeria monocytogenes EGD-e
uaaaaaacagaaacgcuuugu

SEQ ID NO: 2807493 - RNA, 18 nt, Listeria monocytogenes EGD-e
uaaaaaagcacucgucua

SEQ ID NO: 2807494 - RNA, 15 nt, Listeria monocytogenes EGD-e
uaaaaaauauugaau

SEQ ID NO: 2807495 - RNA, 16 nt, Listeria monocytogenes EGD-e
uaaaaaauauugaaua

SEQ ID NO: 2807496 - RNA, 21 nt, Listeria monocytogenes EGD-e
uaaaaaauauugaauagaacu

SEQ ID NO: 2807497 - RNA, 18 nt, Listeria monocytogenes EGD-e
uaaaaacaguacuucuau

SEQ ID NO: 2807498 - RNA, 21 nt, Listeria monocytogenes EGD-e
uaaaaacaguuucuuuacaua

SEQ ID NO: 2807499 - RNA, 16 nt, Listeria monocytogenes EGD-e
uaaaaagcuuauuaaa

SEQ ID NO: 2807500 - RNA, 20 nt, Listeria monocytogenes EGD-e
uaaaaagcuuauuaaacaua

SEQ ID NO: 2807501 - RNA, 23 nt, Listeria monocytogenes EGD-e
uaaaaagguauccuuauuaauag

SEQ ID NO: 2807502 - RNA, 18 nt, Listeria monocytogenes EGD-e
uaaaaaucauuuaaacac

SEQ ID NO: 2807503 - RNA, 13 nt, Listeria monocytogenes EGD-e
uaaaaauuuuggu

SEQ ID NO: 2807504 - RNA, 17 nt, Listeria monocytogenes EGD-e
uaaaacaguauuccuca

SEQ ID NO: 2807505 - RNA, 19 nt, Listeria monocytogenes EGD-e
uaaaaccauucaucuaauu

SEQ ID NO: 2807506 - RNA, 18 nt, Listeria monocytogenes EGD-e
uaaaacgacagauaaaua

SEQ ID NO: 2807507 - RNA, 13 nt, Listeria monocytogenes EGD-e
uaaaagaggauuu

SEQ ID NO: 2807508 - RNA, 17 nt, Listeria monocytogenes EGD-e
uaaaagaggauuuucca

SEQ ID NO: 2807509 - RNA, 13 nt, Listeria monocytogenes EGD-e
uaaaagcaugaau

SEQ ID NO: 2807510 - RNA, 17 nt, Listeria monocytogenes EGD-e
uaaaagcuucuauuugu

SEQ ID NO: 2807511 - RNA, 15 nt, Listeria monocytogenes EGD-e
uaaaauaaaucugcu

SEQ ID NO: 2807512 - RNA, 21 nt, Listeria monocytogenes EGD-e
uaaaauaguuuuuuucauuaa

SEQ ID NO: 2807513 - RNA, 22 nt, Listeria monocytogenes EGD-e
uaaaauaucaucaauuaaauua

SEQ ID NO: 2807514 - RNA, 19 nt, Listeria monocytogenes EGD-e
uaaaaucauaauaggagac

SEQ ID NO: 2807515 - RNA, 18 nt, Listeria monocytogenes EGD-e
uaaaaucauuaaagcuau

SEQ ID NO: 2807516 - RNA, 19 nt, Listeria monocytogenes EGD-e
uaaaaucauuaaagcuaua

SEQ ID NO: 2807517 - RNA, 13 nt, Listeria monocytogenes EGD-e
uaaaaucauucca

SEQ ID NO: 2807518 - RNA, 15 nt, Listeria monocytogenes EGD-e
uaaaauccaauaaua

SEQ ID NO: 2807519 - RNA, 18 nt, Listeria monocytogenes EGD-e
uaaaauccaauaauauga

SEQ ID NO: 2807520 - RNA, 21 nt, Listeria monocytogenes EGD-e
uaaaaugcacaugauaaccag

SEQ ID NO: 2807521 - RNA, 13 nt, Listeria monocytogenes EGD-e
uaaaauucuauua

SEQ ID NO: 2807522 - RNA, 18 nt, Listeria monocytogenes EGD-e
uaaaauucuauuaauaau

SEQ ID NO: 2807523 - RNA, 19 nt, Listeria monocytogenes EGD-e
uaaacaacccauuugcauu

SEQ ID NO: 2807524 - RNA, 17 nt, Listeria monocytogenes EGD-e
uaaacaagcuuugugga

SEQ ID NO: 2807525 - RNA, 22 nt, Listeria monocytogenes EGD-e
uaaacauaauguacccaacaau

SEQ ID NO: 2807526 - RNA, 12 nt, Listeria monocytogenes EGD-e
uaaacauuugau

SEQ ID NO: 2807527 - RNA, 20 nt, Listeria monocytogenes EGD-e
uaaacauuugauacauauuu

SEQ ID NO: 2807528 - RNA, 19 nt, Listeria monocytogenes EGD-e
uaaaccgauaauuuucauu

SEQ ID NO: 2807529 - RNA, 23 nt, Listeria monocytogenes EGD-e
uaaacguuccaguuaaacaaaca

SEQ ID NO: 2807530 - RNA, 21 nt, Listeria monocytogenes EGD-e
uaaacguucuuccuuuuucau

SEQ ID NO: 2807531 - RNA, 17 nt, Listeria monocytogenes EGD-e
uaaacuaauuacuaaaa

SEQ ID NO: 2807532 - RNA, 19 nt, Listeria monocytogenes EGD-e
uaaagaacuagauuuaaua

SEQ ID NO: 2807533 - RNA, 21 nt, Listeria monocytogenes EGD-e
uaaagaacuagauuuaauaaa

SEQ ID NO: 2807534 - RNA, 14 nt, Listeria monocytogenes EGD-e
uaaagcgguauccc

SEQ ID NO: 2807535 - RNA, 12 nt, Listeria monocytogenes EGD-e
uaaaggagaaaa

SEQ ID NO: 2807536 - RNA, 13 nt, Listeria monocytogenes EGD-e
uaaaggagaaaaa

SEQ ID NO: 2807537 - RNA, 13 nt, Listeria monocytogenes EGD-e
uaaaggauaaaaa

SEQ ID NO: 2807538 - RNA, 15 nt, Listeria monocytogenes EGD-e
uaaaggauaaaaauu

SEQ ID NO: 2807539 - RNA, 16 nt, Listeria monocytogenes EGD-e
uaaaggcaacaaagaa

SEQ ID NO: 2807540 - RNA, 17 nt, Listeria monocytogenes EGD-e
uaaaggcaacaaagaag

SEQ ID NO: 2807541 - RNA, 17 nt, Listeria monocytogenes EGD-e
uaaaguuaacuucauua

SEQ ID NO: 2807542 - RNA, 16 nt, Listeria monocytogenes EGD-e
uaaaguuagauuaaaa

SEQ ID NO: 2807543 - RNA, 18 nt, Listeria monocytogenes EGD-e
uaaaguuagauuaaaaau

SEQ ID NO: 2807544 - RNA, 13 nt, Listeria monocytogenes EGD-e
uaaauaaacaaau

SEQ ID NO: 2807545 - RNA, 13 nt, Listeria monocytogenes EGD-e
uaaauaaauauuu

SEQ ID NO: 2807546 - RNA, 14 nt, Listeria monocytogenes EGD-e
uaaauacgaaaaac

SEQ ID NO: 2807547 - RNA, 16 nt, Listeria monocytogenes EGD-e
uaaauacgaaaaacau

SEQ ID NO: 2807548 - RNA, 18 nt, Listeria monocytogenes EGD-e
uaaauagcacagcuacca

SEQ ID NO: 2807549 - RNA, 16 nt, Listeria monocytogenes EGD-e
uaaauaggauuaaaau

SEQ ID NO: 2807550 - RNA, 20 nt, Listeria monocytogenes EGD-e
uaaauauaacuuuuuuucuu

SEQ ID NO: 2807551 - RNA, 13 nt, Listeria monocytogenes EGD-e
uaaauauagcuuc

SEQ ID NO: 2807552 - RNA, 14 nt, Listeria monocytogenes EGD-e
uaaauauagcuuca

SEQ ID NO: 2807553 - RNA, 14 nt, Listeria monocytogenes EGD-e
uaaauauuuaauuu

SEQ ID NO: 2807554 - RNA, 19 nt, Listeria monocytogenes EGD-e
uaaaucacuucuuaagaau

SEQ ID NO: 2807555 - RNA, 22 nt, Listeria monocytogenes EGD-e
uaaaucacuucuuaagaauucc

SEQ ID NO: 2807556 - RNA, 19 nt, Listeria monocytogenes EGD-e
uaaauccagcgucuaaaaa

SEQ ID NO: 2807557 - RNA, 16 nt, Listeria monocytogenes EGD-e
uaaauccauuucauuc

SEQ ID NO: 2807558 - RNA, 16 nt, Listeria monocytogenes EGD-e
uaaauccguugucuuc

SEQ ID NO: 2807559 - RNA, 14 nt, Listeria monocytogenes EGD-e
uaaaugaccaaugc

SEQ ID NO: 2807560 - RNA, 22 nt, Listeria monocytogenes EGD-e
uaaaugauuuuuaucuaaaucu

SEQ ID NO: 2807561 - RNA, 17 nt, Listeria monocytogenes EGD-e
uaaaugguugaauagau

SEQ ID NO: 2807562 - RNA, 13 nt, Listeria monocytogenes EGD-e
uaaauuauacauu

SEQ ID NO: 2807563 - RNA, 13 nt, Listeria monocytogenes EGD-e
uaaauuaucaucc

SEQ ID NO: 2807564 - RNA, 21 nt, Listeria monocytogenes EGD-e
uaaauuauccaguguaaucuu

SEQ ID NO: 2807565 - RNA, 16 nt, Listeria monocytogenes EGD-e
uaaauugauaccaaau

SEQ ID NO: 2807566 - RNA, 17 nt, Listeria monocytogenes EGD-e
uaaauugucuacugcuu

SEQ ID NO: 2807567 - RNA, 16 nt, Listeria monocytogenes EGD-e
uaaauuuuuuugaaaa

SEQ ID NO: 2807568 - RNA, 20 nt, Listeria monocytogenes EGD-e
uaaauuuuuuugaaaaaaca

SEQ ID NO: 2807569 - RNA, 23 nt, Listeria monocytogenes EGD-e
uaaauuuuuuugaaaaaacaucu

SEQ ID NO: 2807570 - RNA, 20 nt, Listeria monocytogenes EGD-e
uaacaacuaauuuuucgauu

SEQ ID NO: 2807571 - RNA, 23 nt, Listeria monocytogenes EGD-e
uaacaacuaauuuuucgauuggc

SEQ ID NO: 2807572 - RNA, 14 nt, Listeria monocytogenes EGD-e
uaacaagaauaaug

SEQ ID NO: 2807573 - RNA, 17 nt, Listeria monocytogenes EGD-e
uaacacgagagaaaugg

SEQ ID NO: 2807574 - RNA, 13 nt, Listeria monocytogenes EGD-e
uaacauaaauuga

SEQ ID NO: 2807575 - RNA, 13 nt, Listeria monocytogenes EGD-e
uaacaucagauua

SEQ ID NO: 2807576 - RNA, 12 nt, Listeria monocytogenes EGD-e
uaacaucugcua

SEQ ID NO: 2807577 - RNA, 21 nt, Listeria monocytogenes EGD-e
uaacaucugcuauuuuugaau

SEQ ID NO: 2807578 - RNA, 18 nt, Listeria monocytogenes EGD-e
uaacauuaaaccucuuuu

SEQ ID NO: 2807579 - RNA, 16 nt, Listeria monocytogenes EGD-e
uaacauuaauucauuu

SEQ ID NO: 2807580 - RNA, 13 nt, Listeria monocytogenes EGD-e
uaaccccaaaaug

SEQ ID NO: 2807581 - RNA, 19 nt, Listeria monocytogenes EGD-e
uaaccucgcaaaaaauaau

SEQ ID NO: 2807582 - RNA, 22 nt, Listeria monocytogenes EGD-e
uaaccucgcaaaaaauaauauc

SEQ ID NO: 2807583 - RNA, 15 nt, Listeria monocytogenes EGD-e
uaacgaauuuuucaa

SEQ ID NO: 2807584 - RNA, 20 nt, Listeria monocytogenes EGD-e
uaacgcaucugcuaauacua

SEQ ID NO: 2807585 - RNA, 20 nt, Listeria monocytogenes EGD-e
uaacgccgguugauaauaau

SEQ ID NO: 2807586 - RNA, 17 nt, Listeria monocytogenes EGD-e
uaacgcuuuuucagcaa

SEQ ID NO: 2807587 - RNA, 13 nt, Listeria monocytogenes EGD-e
uaacgguuuucau

SEQ ID NO: 2807588 - RNA, 16 nt, Listeria monocytogenes EGD-e
uaacgucucucauugu

SEQ ID NO: 2807589 - RNA, 15 nt, Listeria monocytogenes EGD-e
uaacuaaaaaucauu

SEQ ID NO: 2807590 - RNA, 13 nt, Listeria monocytogenes EGD-e
uaacuaauaaccc

SEQ ID NO: 2807591 - RNA, 17 nt, Listeria monocytogenes EGD-e
uaacuacuauuuaaaua

SEQ ID NO: 2807592 - RNA, 20 nt, Listeria monocytogenes EGD-e
uaacucaaaguaacuuuauc

SEQ ID NO: 2807593 - RNA, 14 nt, Listeria monocytogenes EGD-e
uaacugguuccauu

SEQ ID NO: 2807594 - RNA, 15 nt, Listeria monocytogenes EGD-e
uaacuguugaaaagu

SEQ ID NO: 2807595 - RNA, 19 nt, Listeria monocytogenes EGD-e
uaacuucauuagacaaaaa

SEQ ID NO: 2807596 - RNA, 14 nt, Listeria monocytogenes EGD-e
uaacuuuuuuucuu

SEQ ID NO: 2807597 - RNA, 13 nt, Listeria monocytogenes EGD-e
uaagaaaaaaagu

SEQ ID NO: 2807598 - RNA, 16 nt, Listeria monocytogenes EGD-e
uaagaagauauuuugc

SEQ ID NO: 2807599 - RNA, 17 nt, Listeria monocytogenes EGD-e
uaagaagauauuuugcu

SEQ ID NO: 2807600 - RNA, 18 nt, Listeria monocytogenes EGD-e
uaagaagcggaaggggua

SEQ ID NO: 2807601 - RNA, 16 nt, Listeria monocytogenes EGD-e
uaagaaguacaauaaa

SEQ ID NO: 2807602 - RNA, 17 nt, Listeria monocytogenes EGD-e
uaagaaguacaauaaag

SEQ ID NO: 2807603 - RNA, 22 nt, Listeria monocytogenes EGD-e
uaagaccaccaagaauaagcau

SEQ ID NO: 2807604 - RNA, 20 nt, Listeria monocytogenes EGD-e
uaagauuuuugcucaguagu

SEQ ID NO: 2807605 - RNA, 23 nt, Listeria monocytogenes EGD-e
uaagcaauuggaacaucuuugua

SEQ ID NO: 2807606 - RNA, 13 nt, Listeria monocytogenes EGD-e
uaagcacaaauua

SEQ ID NO: 2807607 - RNA, 14 nt, Listeria monocytogenes EGD-e
uaagcacaaauuau

SEQ ID NO: 2807608 - RNA, 13 nt, Listeria monocytogenes EGD-e
uaagcauuauaaa

SEQ ID NO: 2807609 - RNA, 18 nt, Listeria monocytogenes EGD-e
uaagcggguguccaaaaa

SEQ ID NO: 2807610 - RNA, 22 nt, Listeria monocytogenes EGD-e
uaagcggguguccaaaaaccaa

SEQ ID NO: 2807611 - RNA, 23 nt, Listeria monocytogenes EGD-e
uaagcugacaguugcuguuacug

SEQ ID NO: 2807612 - RNA, 13 nt, Listeria monocytogenes EGD-e
uaagcuucauaaa

SEQ ID NO: 2807613 - RNA, 18 nt, Listeria monocytogenes EGD-e
uaagcuucauaaaucgcc

SEQ ID NO: 2807614 - RNA, 16 nt, Listeria monocytogenes EGD-e
uaaggauuugucacuu

SEQ ID NO: 2807615 - RNA, 22 nt, Listeria monocytogenes EGD-e
uaagggugaagcuuccuuuauc

SEQ ID NO: 2807616 - RNA, 13 nt, Listeria monocytogenes EGD-e
uaaguacaauuuu

SEQ ID NO: 2807617 - RNA, 13 nt, Listeria monocytogenes EGD-e
uaaguauucaaau

SEQ ID NO: 2807618 - RNA, 20 nt, Listeria monocytogenes EGD-e
uaaguccaaagagccauaaa

SEQ ID NO: 2807619 - RNA, 23 nt, Listeria monocytogenes EGD-e
uaagucugcuuuuucaaguaaaa

SEQ ID NO: 2807620 - RNA, 13 nt, Listeria monocytogenes EGD-e
uaauaacauuaaa

SEQ ID NO: 2807621 - RNA, 19 nt, Listeria monocytogenes EGD-e
uaauaacauuaaaccucuu

SEQ ID NO: 2807622 - RNA, 20 nt, Listeria monocytogenes EGD-e
uaauaaugauuucuauaaaa

SEQ ID NO: 2807623 - RNA, 18 nt, Listeria monocytogenes EGD-e
uaauaccaggaucaaaau

SEQ ID NO: 2807624 - RNA, 19 nt, Listeria monocytogenes EGD-e
uaauaccaggaucaaaaug

SEQ ID NO: 2807625 - RNA, 15 nt, Listeria monocytogenes EGD-e
uaauaccgagaucuu

SEQ ID NO: 2807626 - RNA, 22 nt, Listeria monocytogenes EGD-e
uaauacgugaaaaucuuguugc

SEQ ID NO: 2807627 - RNA, 20 nt, Listeria monocytogenes EGD-e
uaauagaagccaauucacuu

SEQ ID NO: 2807628 - RNA, 20 nt, Listeria monocytogenes EGD-e
uaauagcagagcuccaauaa

SEQ ID NO: 2807629 - RNA, 22 nt, Listeria monocytogenes EGD-e
uaauagcagagcuccaauaaua

SEQ ID NO: 2807630 - RNA, 17 nt, Listeria monocytogenes EGD-e
uaauagcauaaaguauu

SEQ ID NO: 2807631 - RNA, 15 nt, Listeria monocytogenes EGD-e
uaauagguccgauaa

SEQ ID NO: 2807632 - RNA, 17 nt, Listeria monocytogenes EGD-e
uaauaguauacuuuuaa

SEQ ID NO: 2807633 - RNA, 13 nt, Listeria monocytogenes EGD-e
uaauauacuuuau

SEQ ID NO: 2807634 - RNA, 15 nt, Listeria monocytogenes EGD-e
uaauauacuuuauaa

SEQ ID NO: 2807635 - RNA, 15 nt, Listeria monocytogenes EGD-e
uaauauauucaaaau

SEQ ID NO: 2807636 - RNA, 12 nt, Listeria monocytogenes EGD-e
uaauauccauaa

SEQ ID NO: 2807637 - RNA, 14 nt, Listeria monocytogenes EGD-e
uaauauuauaucca

SEQ ID NO: 2807638 - RNA, 18 nt, Listeria monocytogenes EGD-e
uaaucaauaucuuuauuu

SEQ ID NO: 2807639 - RNA, 14 nt, Listeria monocytogenes EGD-e
uaaucacuauugaa

SEQ ID NO: 2807640 - RNA, 13 nt, Listeria monocytogenes EGD-e
uaauccagcuuga

SEQ ID NO: 2807641 - RNA, 16 nt, Listeria monocytogenes EGD-e
uaaucgaaaaaucauu

SEQ ID NO: 2807642 - RNA, 23 nt, Listeria monocytogenes EGD-e
uaaucgaaaaaucauuaaauuua

SEQ ID NO: 2807643 - RNA, 22 nt, Listeria monocytogenes EGD-e
uaaucuaagucaucggcuuuuu

SEQ ID NO: 2807644 - RNA, 15 nt, Listeria monocytogenes EGD-e
uaaucuacuguauau

SEQ ID NO: 2807645 - RNA, 17 nt, Listeria monocytogenes EGD-e
uaaucuccgcaaucauu

SEQ ID NO: 2807646 - RNA, 14 nt, Listeria monocytogenes EGD-e
uaaucuguaaaaau

SEQ ID NO: 2807647 - RNA, 20 nt, Listeria monocytogenes EGD-e
uaaugaauaagcaauuggaa

SEQ ID NO: 2807648 - RNA, 16 nt, Listeria monocytogenes EGD-e
uaaugauuucaauaau

SEQ ID NO: 2807649 - RNA, 18 nt, Listeria monocytogenes EGD-e
uaaugccaguauuuugau

SEQ ID NO: 2807650 - RNA, 13 nt, Listeria monocytogenes EGD-e
uaaugccgcuugg

SEQ ID NO: 2807651 - RNA, 19 nt, Listeria monocytogenes EGD-e
uaaugcgaaaaaugaaaag

SEQ ID NO: 2807652 - RNA, 17 nt, Listeria monocytogenes EGD-e
uaaugcucauuuuucuu

SEQ ID NO: 2807653 - RNA, 18 nt, Listeria monocytogenes EGD-e
uaaugugaccuuaaauua

SEQ ID NO: 2807654 - RNA, 14 nt, Listeria monocytogenes EGD-e
uaauuaauugugcu

SEQ ID NO: 2807655 - RNA, 20 nt, Listeria monocytogenes EGD-e
uaauuagcauaauauccaua

SEQ ID NO: 2807656 - RNA, 16 nt, Listeria monocytogenes EGD-e
uaauucgaauaagaac

SEQ ID NO: 2807657 - RNA, 14 nt, Listeria monocytogenes EGD-e
uaauucggcaaaca

SEQ ID NO: 2807658 - RNA, 22 nt, Listeria monocytogenes EGD-e
uaauucggcaaacagcuuuucu

SEQ ID NO: 2807659 - RNA, 13 nt, Listeria monocytogenes EGD-e
uaauucggcuuca

SEQ ID NO: 2807660 - RNA, 16 nt, Listeria monocytogenes EGD-e
uaauucggcuucaaaa

SEQ ID NO: 2807661 - RNA, 13 nt, Listeria monocytogenes EGD-e
uaauucuaaauaa

SEQ ID NO: 2807662 - RNA, 20 nt, Listeria monocytogenes EGD-e
uaauucugcgauuuuuucuu

SEQ ID NO: 2807663 - RNA, 13 nt, Listeria monocytogenes EGD-e
uaauucugcuaac

SEQ ID NO: 2807664 - RNA, 21 nt, Listeria monocytogenes EGD-e
uaauucugcuaacagcugagc

SEQ ID NO: 2807665 - RNA, 20 nt, Listeria monocytogenes EGD-e
uaauugcuagcgaagucaau

SEQ ID NO: 2807666 - RNA, 21 nt, Listeria monocytogenes EGD-e
uaauuguaauuccgugaaauu

SEQ ID NO: 2807667 - RNA, 17 nt, Listeria monocytogenes EGD-e
uaauugucauaaaacuu

SEQ ID NO: 2807668 - RNA, 21 nt, Listeria monocytogenes EGD-e
uaauugucgaaaaccuaaaua

SEQ ID NO: 2807669 - RNA, 10 nt, Listeria monocytogenes EGD-e
uaauuuaauu

SEQ ID NO: 2807670 - RNA, 11 nt, Listeria monocytogenes EGD-e
uaauuuaauug

SEQ ID NO: 2807671 - RNA, 15 nt, Listeria monocytogenes EGD-e
uaauuuaauugugcu

SEQ ID NO: 2807672 - RNA, 19 nt, Listeria monocytogenes EGD-e
uaauuuaggggcauaucuu

SEQ ID NO: 2807673 - RNA, 16 nt, Listeria monocytogenes EGD-e
uaauuuccauuucgau

SEQ ID NO: 2807674 - RNA, 23 nt, Listeria monocytogenes EGD-e
uaauuucuggguguuuauucaua

SEQ ID NO: 2807675 - RNA, 16 nt, Listeria monocytogenes EGD-e
uaauuucuuuugagaa

SEQ ID NO: 2807676 - RNA, 21 nt, Listeria monocytogenes EGD-e
uaauuuggaaauaauucugcu

SEQ ID NO: 2807677 - RNA, 21 nt, Listeria monocytogenes EGD-e
uaauuugguccaucaaauuau

SEQ ID NO: 2807678 - RNA, 22 nt, Listeria monocytogenes EGD-e
uaauuugguccaucaaauuauc

SEQ ID NO: 2807679 - RNA, 15 nt, Listeria monocytogenes EGD-e
uaauuuuacuucuac

SEQ ID NO: 2807680 - RNA, 20 nt, Listeria monocytogenes EGD-e
uaauuuuccgcagcuucaau

SEQ ID NO: 2807681 - RNA, 14 nt, Listeria monocytogenes EGD-e
uacaacaaaauaau

SEQ ID NO: 2807682 - RNA, 15 nt, Listeria monocytogenes EGD-e
uacaaguucuuucau

SEQ ID NO: 2807683 - RNA, 15 nt, Listeria monocytogenes EGD-e
uacaauuaauaauaa

SEQ ID NO: 2807684 - RNA, 15 nt, Listeria monocytogenes EGD-e
uacaauuuucauuua

SEQ ID NO: 2807685 - RNA, 22 nt, Listeria monocytogenes EGD-e
uacaccauuuuguucuaagaau

SEQ ID NO: 2807686 - RNA, 13 nt, Listeria monocytogenes EGD-e
uacagaagcauuu

SEQ ID NO: 2807687 - RNA, 13 nt, Listeria monocytogenes EGD-e
uacauaaaagcau

SEQ ID NO: 2807688 - RNA, 18 nt, Listeria monocytogenes EGD-e
uacauaauucauugacaa

SEQ ID NO: 2807689 - RNA, 19 nt, Listeria monocytogenes EGD-e
uacaugaauuacuucacca

SEQ ID NO: 2807690 - RNA, 17 nt, Listeria monocytogenes EGD-e
uacaugaccgccaauuu

SEQ ID NO: 2807691 - RNA, 16 nt, Listeria monocytogenes EGD-e
uacauuaaguuuacaa

SEQ ID NO: 2807692 - RNA, 17 nt, Listeria monocytogenes EGD-e
uacauucgggaauaaau

SEQ ID NO: 2807693 - RNA, 19 nt, Listeria monocytogenes EGD-e
uacauuuuagcuuauuaau

SEQ ID NO: 2807694 - RNA, 14 nt, Listeria monocytogenes EGD-e
uacauuuuugcuug

SEQ ID NO: 2807695 - RNA, 23 nt, Listeria monocytogenes EGD-e
uaccacaagaagggcuuuuuucc

SEQ ID NO: 2807696 - RNA, 17 nt, Listeria monocytogenes EGD-e
uaccaggaucaaaaugg

SEQ ID NO: 2807697 - RNA, 21 nt, Listeria monocytogenes EGD-e
uaccauaagcagccuccgcuu

SEQ ID NO: 2807698 - RNA, 18 nt, Listeria monocytogenes EGD-e
uaccaucauauaauucua

SEQ ID NO: 2807699 - RNA, 23 nt, Listeria monocytogenes EGD-e
uaccaucauauaauucuaauagc

SEQ ID NO: 2807700 - RNA, 11 nt, Listeria monocytogenes EGD-e
uaccaucuuuu

SEQ ID NO: 2807701 - RNA, 20 nt, Listeria monocytogenes EGD-e
uaccauguuuauuuaauaag

SEQ ID NO: 2807702 - RNA, 14 nt, Listeria monocytogenes EGD-e
uaccgaaugcaauc

SEQ ID NO: 2807703 - RNA, 16 nt, Listeria monocytogenes EGD-e
uaccgaaugcaaucca

SEQ ID NO: 2807704 - RNA, 17 nt, Listeria monocytogenes EGD-e
uaccgagaucuugcauu

SEQ ID NO: 2807705 - RNA, 22 nt, Listeria monocytogenes EGD-e
uaccgagaucuugcauuuuggc

SEQ ID NO: 2807706 - RNA, 23 nt, Listeria monocytogenes EGD-e
uaccgaguucgguauaaaacauc

SEQ ID NO: 2807707 - RNA, 14 nt, Listeria monocytogenes EGD-e
uaccgcauuuuucu

SEQ ID NO: 2807708 - RNA, 17 nt, Listeria monocytogenes EGD-e
uaccgcuugauguuuuu

SEQ ID NO: 2807709 - RNA, 16 nt, Listeria monocytogenes EGD-e
uaccugcaagcgaauu

SEQ ID NO: 2807710 - RNA, 21 nt, Listeria monocytogenes EGD-e
uaccuuauuuuauacgcaaug

SEQ ID NO: 2807711 - RNA, 12 nt, Listeria monocytogenes EGD-e
uaccuugaucaa

SEQ ID NO: 2807712 - RNA, 20 nt, Listeria monocytogenes EGD-e
uacgaaaucaaacuuauaau

SEQ ID NO: 2807713 - RNA, 20 nt, Listeria monocytogenes EGD-e
uacgacaauaccauguuuau

SEQ ID NO: 2807714 - RNA, 18 nt, Listeria monocytogenes EGD-e
uacgaucuacuucuaaau

SEQ ID NO: 2807715 - RNA, 15 nt, Listeria monocytogenes EGD-e
uacgauugcuucacc

SEQ ID NO: 2807716 - RNA, 17 nt, Listeria monocytogenes EGD-e
uacgauugcuucaccaa

SEQ ID NO: 2807717 - RNA, 23 nt, Listeria monocytogenes EGD-e
uacgauugggcggaaauaaaaac

SEQ ID NO: 2807718 - RNA, 12 nt, Listeria monocytogenes EGD-e
uacggcuucaau

SEQ ID NO: 2807719 - RNA, 20 nt, Listeria monocytogenes EGD-e
uacguaauaggauuuuacug

SEQ ID NO: 2807720 - RNA, 20 nt, Listeria monocytogenes EGD-e
uacguuguucuaacauuaau

SEQ ID NO: 2807721 - RNA, 17 nt, Listeria monocytogenes EGD-e
uacuaacgcuuuuucag

SEQ ID NO: 2807722 - RNA, 19 nt, Listeria monocytogenes EGD-e
uacuacauuuuguugaacu

SEQ ID NO: 2807723 - RNA, 20 nt, Listeria monocytogenes EGD-e
uacuacauuuuguugaacuu

SEQ ID NO: 2807724 - RNA, 22 nt, Listeria monocytogenes EGD-e
uacuacauuuuguugaacuucu

SEQ ID NO: 2807725 - RNA, 23 nt, Listeria monocytogenes EGD-e
uacuacuggauaaaauggcguuu

SEQ ID NO: 2807726 - RNA, 16 nt, Listeria monocytogenes EGD-e
uacuagcuuugucuag

SEQ ID NO: 2807727 - RNA, 14 nt, Listeria monocytogenes EGD-e
uacuagugaaauag

SEQ ID NO: 2807728 - RNA, 21 nt, Listeria monocytogenes EGD-e
uacuauugaauguucuaaaau

SEQ ID NO: 2807729 - RNA, 12 nt, Listeria monocytogenes EGD-e
uacuccaaaaua

SEQ ID NO: 2807730 - RNA, 15 nt, Listeria monocytogenes EGD-e
uacucgguucaauua

SEQ ID NO: 2807731 - RNA, 16 nt, Listeria monocytogenes EGD-e
uacugcaaucauuuau

SEQ ID NO: 2807732 - RNA, 16 nt, Listeria monocytogenes EGD-e
uacuguauauguuuua

SEQ ID NO: 2807733 - RNA, 18 nt, Listeria monocytogenes EGD-e
uacuguauauguuuuauu

SEQ ID NO: 2807734 - RNA, 21 nt, Listeria monocytogenes EGD-e
uacuguuguuuaauaugcauu

SEQ ID NO: 2807735 - RNA, 17 nt, Listeria monocytogenes EGD-e
uacuuaaaucacuucuu

SEQ ID NO: 2807736 - RNA, 12 nt, Listeria monocytogenes EGD-e
uacuuacaaaag

SEQ ID NO: 2807737 - RNA, 22 nt, Listeria monocytogenes EGD-e
uacuuauagcguacaugaugau

SEQ ID NO: 2807738 - RNA, 16 nt, Listeria monocytogenes EGD-e
uacuucggggcaaaaa

SEQ ID NO: 2807739 - RNA, 20 nt, Listeria monocytogenes EGD-e
uacuucggggcaaaaaggaa

SEQ ID NO: 2807740 - RNA, 15 nt, Listeria monocytogenes EGD-e
uacuugcaaaugcuu

SEQ ID NO: 2807741 - RNA, 18 nt, Listeria monocytogenes EGD-e
uacuugcuuuuuuuaaac

SEQ ID NO: 2807742 - RNA, 17 nt, Listeria monocytogenes EGD-e
uacuugugaaaguuuua

SEQ ID NO: 2807743 - RNA, 14 nt, Listeria monocytogenes EGD-e
uacuuuaauuucca

SEQ ID NO: 2807744 - RNA, 17 nt, Listeria monocytogenes EGD-e
uacuuuauuuauuuuua

SEQ ID NO: 2807745 - RNA, 13 nt, Listeria monocytogenes EGD-e
uacuuuuuaucug

SEQ ID NO: 2807746 - RNA, 20 nt, Listeria monocytogenes EGD-e
uacuuuuuucuauauucauc

SEQ ID NO: 2807747 - RNA, 20 nt, Listeria monocytogenes EGD-e
uagaaaccaucgcaaaagca

SEQ ID NO: 2807748 - RNA, 15 nt, Listeria monocytogenes EGD-e
uagaaagccuuuauu

SEQ ID NO: 2807749 - RNA, 13 nt, Listeria monocytogenes EGD-e
uagaaaguagauu

SEQ ID NO: 2807750 - RNA, 17 nt, Listeria monocytogenes EGD-e
uagaaccguauuuaaua

SEQ ID NO: 2807751 - RNA, 18 nt, Listeria monocytogenes EGD-e
uagaauguauacacuagu

SEQ ID NO: 2807752 - RNA, 12 nt, Listeria monocytogenes EGD-e
uagacuaaauug

SEQ ID NO: 2807753 - RNA, 22 nt, Listeria monocytogenes EGD-e
uagacuguaugaaacuuguuuu

SEQ ID NO: 2807754 - RNA, 17 nt, Listeria monocytogenes EGD-e
uagagcuuuuaaauaua

SEQ ID NO: 2807755 - RNA, 20 nt, Listeria monocytogenes EGD-e
uagauacucuuuaaauccau

SEQ ID NO: 2807756 - RNA, 23 nt, Listeria monocytogenes EGD-e
uagauggagauucauaaacaaaa

SEQ ID NO: 2807757 - RNA, 16 nt, Listeria monocytogenes EGD-e
uagauuccgcuaaaac

SEQ ID NO: 2807758 - RNA, 21 nt, Listeria monocytogenes EGD-e
uagauuccgcuaaaacuaaaa

SEQ ID NO: 2807759 - RNA, 17 nt, Listeria monocytogenes EGD-e
uagauuugcaaguagau

SEQ ID NO: 2807760 - RNA, 13 nt, Listeria monocytogenes EGD-e
uagauuuuaauuu

SEQ ID NO: 2807761 - RNA, 17 nt, Listeria monocytogenes EGD-e
uagauuuuaauuucuuu

SEQ ID NO: 2807762 - RNA, 15 nt, Listeria monocytogenes EGD-e
uagcaacuucacuaa

SEQ ID NO: 2807763 - RNA, 13 nt, Listeria monocytogenes EGD-e
uagcaauuucgga

SEQ ID NO: 2807764 - RNA, 12 nt, Listeria monocytogenes EGD-e
uagcacuccuug

SEQ ID NO: 2807765 - RNA, 20 nt, Listeria monocytogenes EGD-e
uagcacuccuugaucugccc

SEQ ID NO: 2807766 - RNA, 15 nt, Listeria monocytogenes EGD-e
uagccagacaucuuu

SEQ ID NO: 2807767 - RNA, 21 nt, Listeria monocytogenes EGD-e
uagccagacaucuuugccauc

SEQ ID NO: 2807768 - RNA, 12 nt, Listeria monocytogenes EGD-e
uagccuuuuauc

SEQ ID NO: 2807769 - RNA, 17 nt, Listeria monocytogenes EGD-e
uagcgcaucucuaacag

SEQ ID NO: 2807770 - RNA, 13 nt, Listeria monocytogenes EGD-e
uagcuacaauuaa

SEQ ID NO: 2807771 - RNA, 16 nt, Listeria monocytogenes EGD-e
uagcuacaauuaaaau

SEQ ID NO: 2807772 - RNA, 20 nt, Listeria monocytogenes EGD-e
uagcuagacuguaugaaacu

SEQ ID NO: 2807773 - RNA, 12 nt, Listeria monocytogenes EGD-e
uagcuauuuuuu

SEQ ID NO: 2807774 - RNA, 20 nt, Listeria monocytogenes EGD-e
uagcuauuuuuuugcuuuuu

SEQ ID NO: 2807775 - RNA, 16 nt, Listeria monocytogenes EGD-e
uagcuuaaagguuuug

SEQ ID NO: 2807776 - RNA, 17 nt, Listeria monocytogenes EGD-e
uagcuucaaucaagccu

SEQ ID NO: 2807777 - RNA, 21 nt, Listeria monocytogenes EGD-e
uagcuuuaucuuuuccuucua

SEQ ID NO: 2807778 - RNA, 19 nt, Listeria monocytogenes EGD-e
uaggaauuucgaaauuaaa

SEQ ID NO: 2807779 - RNA, 15 nt, Listeria monocytogenes EGD-e
uaggauuaaaauaaa

SEQ ID NO: 2807780 - RNA, 17 nt, Listeria monocytogenes EGD-e
uaggccacuaacauaaa

SEQ ID NO: 2807781 - RNA, 22 nt, Listeria monocytogenes EGD-e
uaggccacuaacauaaauugau

SEQ ID NO: 2807782 - RNA, 13 nt, Listeria monocytogenes EGD-e
uaggcccauuaaa

SEQ ID NO: 2807783 - RNA, 20 nt, Listeria monocytogenes EGD-e
uaggcgcgaguacaauuaua

SEQ ID NO: 2807784 - RNA, 21 nt, Listeria monocytogenes EGD-e
uaggcucuuccuuuuguuuua

SEQ ID NO: 2807785 - RNA, 22 nt, Listeria monocytogenes EGD-e
uaggucaggauuaaaaguugac

SEQ ID NO: 2807786 - RNA, 20 nt, Listeria monocytogenes EGD-e
uagguguauagaagguauug

SEQ ID NO: 2807787 - RNA, 21 nt, Listeria monocytogenes EGD-e
uaguaaagcacuggcaaauaa

SEQ ID NO: 2807788 - RNA, 12 nt, Listeria monocytogenes EGD-e
uaguaauuuaau

SEQ ID NO: 2807789 - RNA, 23 nt, Listeria monocytogenes EGD-e
uaguagagcuucuguuuuuucuu

SEQ ID NO: 2807790 - RNA, 13 nt, Listeria monocytogenes EGD-e
uaguagcaauuuu

SEQ ID NO: 2807791 - RNA, 17 nt, Listeria monocytogenes EGD-e
uaguagcaauuuuaaau

SEQ ID NO: 2807792 - RNA, 16 nt, Listeria monocytogenes EGD-e
uagucuacuuuuaaaa

SEQ ID NO: 2807793 - RNA, 14 nt, Listeria monocytogenes EGD-e
uagugcaucuucua

SEQ ID NO: 2807794 - RNA, 15 nt, Listeria monocytogenes EGD-e
uagugcaucuucuaa

SEQ ID NO: 2807795 - RNA, 22 nt, Listeria monocytogenes EGD-e
uagugcaucuucuaagaaaaaa

SEQ ID NO: 2807796 - RNA, 17 nt, Listeria monocytogenes EGD-e
uaguggagcuauauaga

SEQ ID NO: 2807797 - RNA, 13 nt, Listeria monocytogenes EGD-e
uaguggagcucuu

SEQ ID NO: 2807798 - RNA, 23 nt, Listeria monocytogenes EGD-e
uaguggagcucuuucuucuacua

SEQ ID NO: 2807799 - RNA, 17 nt, Listeria monocytogenes EGD-e
uaguuauuucuuuauaa

SEQ ID NO: 2807800 - RNA, 16 nt, Listeria monocytogenes EGD-e
uaguucacugugaacu

SEQ ID NO: 2807801 - RNA, 12 nt, Listeria monocytogenes EGD-e
uaguuccagcua

SEQ ID NO: 2807802 - RNA, 13 nt, Listeria monocytogenes EGD-e
uaguuccuucuaa

SEQ ID NO: 2807803 - RNA, 18 nt, Listeria monocytogenes EGD-e
uaguucguuuauuuugau

SEQ ID NO: 2807804 - RNA, 12 nt, Listeria monocytogenes EGD-e
uaguuguuccau

SEQ ID NO: 2807805 - RNA, 23 nt, Listeria monocytogenes EGD-e
uaguuugucccaagauucuucua

SEQ ID NO: 2807806 - RNA, 11 nt, Listeria monocytogenes EGD-e
uaguuuuaaau

SEQ ID NO: 2807807 - RNA, 21 nt, Listeria monocytogenes EGD-e
uaguuuuauuauauuuuagcu

SEQ ID NO: 2807808 - RNA, 13 nt, Listeria monocytogenes EGD-e
uauaaaaauacau

SEQ ID NO: 2807809 - RNA, 20 nt, Listeria monocytogenes EGD-e
uauaaagaacuagauuuaau

SEQ ID NO: 2807810 - RNA, 22 nt, Listeria monocytogenes EGD-e
uauaaagaacuagauuuaauaa

SEQ ID NO: 2807811 - RNA, 15 nt, Listeria monocytogenes EGD-e
uauaaagauccaucg

SEQ ID NO: 2807812 - RNA, 14 nt, Listeria monocytogenes EGD-e
uauaaccccaaaau

SEQ ID NO: 2807813 - RNA, 20 nt, Listeria monocytogenes EGD-e
uauaacucucauaagagaau

SEQ ID NO: 2807814 - RNA, 22 nt, Listeria monocytogenes EGD-e
uauaagcggguguccaaaaacc

SEQ ID NO: 2807815 - RNA, 23 nt, Listeria monocytogenes EGD-e
uauaagcggguguccaaaaacca

SEQ ID NO: 2807816 - RNA, 22 nt, Listeria monocytogenes EGD-e
uauaaguacuugaaaaauuuca

SEQ ID NO: 2807817 - RNA, 23 nt, Listeria monocytogenes EGD-e
uauaaucucgugcuaauucuguu

SEQ ID NO: 2807818 - RNA, 16 nt, Listeria monocytogenes EGD-e
uauaauuaacaaccau

SEQ ID NO: 2807819 - RNA, 16 nt, Listeria monocytogenes EGD-e
uauaauuuuuucauuu

SEQ ID NO: 2807820 - RNA, 17 nt, Listeria monocytogenes EGD-e
uauacaauuaauaauaa

SEQ ID NO: 2807821 - RNA, 16 nt, Listeria monocytogenes EGD-e
uauacaggaacuacau

SEQ ID NO: 2807822 - RNA, 22 nt, Listeria monocytogenes EGD-e
uauacaggaacuacauacuuau

SEQ ID NO: 2807823 - RNA, 20 nt, Listeria monocytogenes EGD-e
uauaccuuauuuuauacgca

SEQ ID NO: 2807824 - RNA, 12 nt, Listeria monocytogenes EGD-e
uauagcuucaaa

SEQ ID NO: 2807825 - RNA, 16 nt, Listeria monocytogenes EGD-e
uauagucuacuuuuaa

SEQ ID NO: 2807826 - RNA, 19 nt, Listeria monocytogenes EGD-e
uauaugaaaacuuaucucu

SEQ ID NO: 2807827 - RNA, 22 nt, Listeria monocytogenes EGD-e
uauaugaaaacuuaucucuuca

SEQ ID NO: 2807828 - RNA, 13 nt, Listeria monocytogenes EGD-e
uauaugcuacuau

SEQ ID NO: 2807829 - RNA, 18 nt, Listeria monocytogenes EGD-e
uauauucacaucacuaau

SEQ ID NO: 2807830 - RNA, 18 nt, Listeria monocytogenes EGD-e
uauauucauuauuaaacu

SEQ ID NO: 2807831 - RNA, 22 nt, Listeria monocytogenes EGD-e
uauauucuucugucacaucugu

SEQ ID NO: 2807832 - RNA, 14 nt, Listeria monocytogenes EGD-e
uauauuuuauucga

SEQ ID NO: 2807833 - RNA, 12 nt, Listeria monocytogenes EGD-e
uaucaaauaacc

SEQ ID NO: 2807834 - RNA, 19 nt, Listeria monocytogenes EGD-e
uaucaaauaaccauuauuu

SEQ ID NO: 2807835 - RNA, 23 nt, Listeria monocytogenes EGD-e
uaucaaugauaucaucaauaaua

SEQ ID NO: 2807836 - RNA, 18 nt, Listeria monocytogenes EGD-e
uaucaucaauaaaaugca

SEQ ID NO: 2807837 - RNA, 14 nt, Listeria monocytogenes EGD-e
uaucaucaauaaua

SEQ ID NO: 2807838 - RNA, 18 nt, Listeria monocytogenes EGD-e
uaucaugacuaaaaagca

SEQ ID NO: 2807839 - RNA, 21 nt, Listeria monocytogenes EGD-e
uaucauucauaauggaaaaau

SEQ ID NO: 2807840 - RNA, 16 nt, Listeria monocytogenes EGD-e
uaucccuuaugacaag

SEQ ID NO: 2807841 - RNA, 13 nt, Listeria monocytogenes EGD-e
uauccguuucauu

SEQ ID NO: 2807842 - RNA, 15 nt, Listeria monocytogenes EGD-e
uauccuuauuaauag

SEQ ID NO: 2807843 - RNA, 23 nt, Listeria monocytogenes EGD-e
uaucgccaaagccaguuuucauu

SEQ ID NO: 2807844 - RNA, 21 nt, Listeria monocytogenes EGD-e
uaucuacaggcuauuccagcu

SEQ ID NO: 2807845 - RNA, 17 nt, Listeria monocytogenes EGD-e
uaucuauucauucccac

SEQ ID NO: 2807846 - RNA, 18 nt, Listeria monocytogenes EGD-e
uaucucuucauuuuucua

SEQ ID NO: 2807847 - RNA, 17 nt, Listeria monocytogenes EGD-e
uaucugguacguuuuuu

SEQ ID NO: 2807848 - RNA, 20 nt, Listeria monocytogenes EGD-e
uaucugguacguuuuuuauu

SEQ ID NO: 2807849 - RNA, 23 nt, Listeria monocytogenes EGD-e
uaucuuuuccaaaauggccaacc

SEQ ID NO: 2807850 - RNA, 11 nt, Listeria monocytogenes EGD-e
uaugaaaaaaa

SEQ ID NO: 2807851 - RNA, 14 nt, Listeria monocytogenes EGD-e
uaugaaaaaaaaua

SEQ ID NO: 2807852 - RNA, 16 nt, Listeria monocytogenes EGD-e
uaugagaguuauaaag

SEQ ID NO: 2807853 - RNA, 17 nt, Listeria monocytogenes EGD-e
uaugauuuguuucuggu

SEQ ID NO: 2807854 - RNA, 19 nt, Listeria monocytogenes EGD-e
uaugcagguaaaacagcaa

SEQ ID NO: 2807855 - RNA, 20 nt, Listeria monocytogenes EGD-e
uaugcgguagccugcucgcu

SEQ ID NO: 2807856 - RNA, 17 nt, Listeria monocytogenes EGD-e
uaugguucaaaaagaua

SEQ ID NO: 2807857 - RNA, 13 nt, Listeria monocytogenes EGD-e
uauguaauucuaa

SEQ ID NO: 2807858 - RNA, 14 nt, Listeria monocytogenes EGD-e
uauguccagucacu

SEQ ID NO: 2807859 - RNA, 16 nt, Listeria monocytogenes EGD-e
uaugugcgaugccacu

SEQ ID NO: 2807860 - RNA, 16 nt, Listeria monocytogenes EGD-e
uauguuuaaucuaaau

SEQ ID NO: 2807861 - RNA, 16 nt, Listeria monocytogenes EGD-e
uauguuuuaauuucaa

SEQ ID NO: 2807862 - RNA, 12 nt, Listeria monocytogenes EGD-e
uauuaacuaaua

SEQ ID NO: 2807863 - RNA, 20 nt, Listeria monocytogenes EGD-e
uauuaauuauggcauaaaaa

SEQ ID NO: 2807864 - RNA, 12 nt, Listeria monocytogenes EGD-e
uauuacauuaag

SEQ ID NO: 2807865 - RNA, 15 nt, Listeria monocytogenes EGD-e
uauuagaauuccugc

SEQ ID NO: 2807866 - RNA, 18 nt, Listeria monocytogenes EGD-e
uauuauaguuuucuacua

SEQ ID NO: 2807867 - RNA, 14 nt, Listeria monocytogenes EGD-e
uauuaugauuuguu

SEQ ID NO: 2807868 - RNA, 21 nt, Listeria monocytogenes EGD-e
uauucaaccaagcaauaacau

SEQ ID NO: 2807869 - RNA, 17 nt, Listeria monocytogenes EGD-e
uauucauauaaaguuuu

SEQ ID NO: 2807870 - RNA, 14 nt, Listeria monocytogenes EGD-e
uauucauucccaca

SEQ ID NO: 2807871 - RNA, 19 nt, Listeria monocytogenes EGD-e
uauucauugaacgaacgau

SEQ ID NO: 2807872 - RNA, 15 nt, Listeria monocytogenes EGD-e
uauuccaaaaucgca

SEQ ID NO: 2807873 - RNA, 16 nt, Listeria monocytogenes EGD-e
uauuccuaucacaaac

SEQ ID NO: 2807874 - RNA, 17 nt, Listeria monocytogenes EGD-e
uauucgucuuuucaacu

SEQ ID NO: 2807875 - RNA, 21 nt, Listeria monocytogenes EGD-e
uauucuucugucacaucuguu

SEQ ID NO: 2807876 - RNA, 18 nt, Listeria monocytogenes EGD-e
uauuguuuuuugauuuuu

SEQ ID NO: 2807877 - RNA, 22 nt, Listeria monocytogenes EGD-e
uauuuaaauaguaguuauuucu

SEQ ID NO: 2807878 - RNA, 15 nt, Listeria monocytogenes EGD-e
uauuuaccuugcucc

SEQ ID NO: 2807879 - RNA, 16 nt, Listeria monocytogenes EGD-e
uauuuauauucuucug

SEQ ID NO: 2807880 - RNA, 21 nt, Listeria monocytogenes EGD-e
uauuuaucaaacaaaaaaguu

SEQ ID NO: 2807881 - RNA, 17 nt, Listeria monocytogenes EGD-e
uauuucaagguucaucc

SEQ ID NO: 2807882 - RNA, 20 nt, Listeria monocytogenes EGD-e
uauuucagcuaaucguuuua

SEQ ID NO: 2807883 - RNA, 17 nt, Listeria monocytogenes EGD-e
uauuucuuuaucuuucc

SEQ ID NO: 2807884 - RNA, 18 nt, Listeria monocytogenes EGD-e
uauuuggccaauuaaaau

SEQ ID NO: 2807885 - RNA, 17 nt, Listeria monocytogenes EGD-e
uauuugucaaucuaaau

SEQ ID NO: 2807886 - RNA, 19 nt, Listeria monocytogenes EGD-e
uauuugucaaucuaaauuu

SEQ ID NO: 2807887 - RNA, 20 nt, Listeria monocytogenes EGD-e
uauuugucaaucuaaauuuu

SEQ ID NO: 2807888 - RNA, 14 nt, Listeria monocytogenes EGD-e
uauuuuaacggcuu

SEQ ID NO: 2807889 - RNA, 21 nt, Listeria monocytogenes EGD-e
uauuuuauucgaauaaagaac

SEQ ID NO: 2807890 - RNA, 20 nt, Listeria monocytogenes EGD-e
uauuuugcggaaauaucacc

SEQ ID NO: 2807891 - RNA, 16 nt, Listeria monocytogenes EGD-e
uauuuugguuauuucu

SEQ ID NO: 2807892 - RNA, 17 nt, Listeria monocytogenes EGD-e
uauuuugguuauuucuu

SEQ ID NO: 2807893 - RNA, 16 nt, Listeria monocytogenes EGD-e
uauuuuuuuuacuguc

SEQ ID NO: 2807894 - RNA, 15 nt, Listeria monocytogenes EGD-e
ucaaaaagauacuuu

SEQ ID NO: 2807895 - RNA, 15 nt, Listeria monocytogenes EGD-e
ucaaaagcaaaaaag

SEQ ID NO: 2807896 - RNA, 18 nt, Listeria monocytogenes EGD-e
ucaaaagcaaaaaaguag

SEQ ID NO: 2807897 - RNA, 19 nt, Listeria monocytogenes EGD-e
ucaaaauuacuauuuggau

SEQ ID NO: 2807898 - RNA, 18 nt, Listeria monocytogenes EGD-e
ucaaaccauuauacaauu

SEQ ID NO: 2807899 - RNA, 20 nt, Listeria monocytogenes EGD-e
ucaaacgcagguucaccaaa

SEQ ID NO: 2807900 - RNA, 23 nt, Listeria monocytogenes EGD-e
ucaaacgucauucgguaaucuag

SEQ ID NO: 2807901 - RNA, 14 nt, Listeria monocytogenes EGD-e
ucaaacucuuucug

SEQ ID NO: 2807902 - RNA, 17 nt, Listeria monocytogenes EGD-e
ucaaagcuacuuuucga

SEQ ID NO: 2807903 - RNA, 15 nt, Listeria monocytogenes EGD-e
ucaaagguuuaauag

SEQ ID NO: 2807904 - RNA, 15 nt, Listeria monocytogenes EGD-e
ucaaaucaccacaaa

SEQ ID NO: 2807905 - RNA, 18 nt, Listeria monocytogenes EGD-e
ucaaaucuggauaaaaau

SEQ ID NO: 2807906 - RNA, 16 nt, Listeria monocytogenes EGD-e
ucaaauucaauuuaua

SEQ ID NO: 2807907 - RNA, 18 nt, Listeria monocytogenes EGD-e
ucaaauucaauuuauauu

SEQ ID NO: 2807908 - RNA, 19 nt, Listeria monocytogenes EGD-e
ucaaauucaauuuauauuu

SEQ ID NO: 2807909 - RNA, 15 nt, Listeria monocytogenes EGD-e
ucaacaaaacaaacu

SEQ ID NO: 2807910 - RNA, 16 nt, Listeria monocytogenes EGD-e
ucaacaaaacaaacua

SEQ ID NO: 2807911 - RNA, 11 nt, Listeria monocytogenes EGD-e
ucaacaaucug

SEQ ID NO: 2807912 - RNA, 20 nt, Listeria monocytogenes EGD-e
ucaaccaagcaauaacaucu

SEQ ID NO: 2807913 - RNA, 23 nt, Listeria monocytogenes EGD-e
ucaaccaagcaauaacaucuuua

SEQ ID NO: 2807914 - RNA, 18 nt, Listeria monocytogenes EGD-e
ucaacgggcgcuuucaca

SEQ ID NO: 2807915 - RNA, 22 nt, Listeria monocytogenes EGD-e
ucaacuccccagugaaaauaga

SEQ ID NO: 2807916 - RNA, 13 nt, Listeria monocytogenes EGD-e
ucaagaaauuaaa

SEQ ID NO: 2807917 - RNA, 16 nt, Listeria monocytogenes EGD-e
ucaagaccaagaacau

SEQ ID NO: 2807918 - RNA, 20 nt, Listeria monocytogenes EGD-e
ucaagcauauuaauuugauu

SEQ ID NO: 2807919 - RNA, 15 nt, Listeria monocytogenes EGD-e
ucaagcccagcuaaa

SEQ ID NO: 2807920 - RNA, 15 nt, Listeria monocytogenes EGD-e
ucaagcgaaaucuca

SEQ ID NO: 2807921 - RNA, 18 nt, Listeria monocytogenes EGD-e
ucaagcguaccauucacu

SEQ ID NO: 2807922 - RNA, 17 nt, Listeria monocytogenes EGD-e
ucaaguaaaaacaauaa

SEQ ID NO: 2807923 - RNA, 19 nt, Listeria monocytogenes EGD-e
ucaaguaaaaacaauaaca

SEQ ID NO: 2807924 - RNA, 22 nt, Listeria monocytogenes EGD-e
ucaaguaaaaacaauaacauuu

SEQ ID NO: 2807925 - RNA, 15 nt, Listeria monocytogenes EGD-e
ucaaguaauaagaag

SEQ ID NO: 2807926 - RNA, 20 nt, Listeria monocytogenes EGD-e
ucaaguaauaagaagauauu

SEQ ID NO: 2807927 - RNA, 17 nt, Listeria monocytogenes EGD-e
ucaagugcuucaucuuu

SEQ ID NO: 2807928 - RNA, 19 nt, Listeria monocytogenes EGD-e
ucaauaaaaugcacaugau

SEQ ID NO: 2807929 - RNA, 15 nt, Listeria monocytogenes EGD-e
ucaauaaugugguuc

SEQ ID NO: 2807930 - RNA, 23 nt, Listeria monocytogenes EGD-e
ucaauacuuuuuucuauauucau

SEQ ID NO: 2807931 - RNA, 23 nt, Listeria monocytogenes EGD-e
ucaauaucggcauuugaauaagc

SEQ ID NO: 2807932 - RNA, 14 nt, Listeria monocytogenes EGD-e
ucaauaucuuuauu

SEQ ID NO: 2807933 - RNA, 15 nt, Listeria monocytogenes EGD-e
ucaauaucuuuauuu

SEQ ID NO: 2807934 - RNA, 14 nt, Listeria monocytogenes EGD-e
ucaauccauuuuuc

SEQ ID NO: 2807935 - RNA, 18 nt, Listeria monocytogenes EGD-e
ucaaucccagcuuuuccu

SEQ ID NO: 2807936 - RNA, 18 nt, Listeria monocytogenes EGD-e
ucaaucgcagcagauuuu

SEQ ID NO: 2807937 - RNA, 16 nt, Listeria monocytogenes EGD-e
ucaaucggaacaccaa

SEQ ID NO: 2807938 - RNA, 16 nt, Listeria monocytogenes EGD-e
ucaaucuaaauuuuaa

SEQ ID NO: 2807939 - RNA, 18 nt, Listeria monocytogenes EGD-e
ucaaucuguuccaacaua

SEQ ID NO: 2807940 - RNA, 19 nt, Listeria monocytogenes EGD-e
ucaaugauaucaucaauaa

SEQ ID NO: 2807941 - RNA, 22 nt, Listeria monocytogenes EGD-e
ucaaugcccaguaaaacuaaau

SEQ ID NO: 2807942 - RNA, 20 nt, Listeria monocytogenes EGD-e
ucaauuuacguuguucuaac

SEQ ID NO: 2807943 - RNA, 16 nt, Listeria monocytogenes EGD-e
ucacaaguaacucuuc

SEQ ID NO: 2807944 - RNA, 18 nt, Listeria monocytogenes EGD-e
ucacaaguaacucuucca

SEQ ID NO: 2807945 - RNA, 13 nt, Listeria monocytogenes EGD-e
ucacaauuuaagu

SEQ ID NO: 2807946 - RNA, 23 nt, Listeria monocytogenes EGD-e
ucacaccacucuuuuauaaaaau

SEQ ID NO: 2807947 - RNA, 15 nt, Listeria monocytogenes EGD-e
ucacacgauaccaaa

SEQ ID NO: 2807948 - RNA, 23 nt, Listeria monocytogenes EGD-e
ucacaucacuaauuagcauaaua

SEQ ID NO: 2807949 - RNA, 14 nt, Listeria monocytogenes EGD-e
ucaccaaaugcuuc

SEQ ID NO: 2807950 - RNA, 20 nt, Listeria monocytogenes EGD-e
ucaccaacaauuacuuccau

SEQ ID NO: 2807951 - RNA, 16 nt, Listeria monocytogenes EGD-e
ucaccuucuuuuugcu

SEQ ID NO: 2807952 - RNA, 13 nt, Listeria monocytogenes EGD-e
ucaccuuuguuac

SEQ ID NO: 2807953 - RNA, 15 nt, Listeria monocytogenes EGD-e
ucacgagaaagccaa

SEQ ID NO: 2807954 - RNA, 13 nt, Listeria monocytogenes EGD-e
ucacgucccauug

SEQ ID NO: 2807955 - RNA, 19 nt, Listeria monocytogenes EGD-e
ucacuaauuagcauaauau

SEQ ID NO: 2807956 - RNA, 21 nt, Listeria monocytogenes EGD-e
ucacuucgaaaguaaaaucuu

SEQ ID NO: 2807957 - RNA, 16 nt, Listeria monocytogenes EGD-e
ucacuucuuaagaauu

SEQ ID NO: 2807958 - RNA, 18 nt, Listeria monocytogenes EGD-e
ucacuucuuaagaauucc

SEQ ID NO: 2807959 - RNA, 12 nt, Listeria monocytogenes EGD-e
ucacuuggaaaa

SEQ ID NO: 2807960 - RNA, 23 nt, Listeria monocytogenes EGD-e
ucagaagcgaugugggaaugaau

SEQ ID NO: 2807961 - RNA, 12 nt, Listeria monocytogenes EGD-e
ucagaaggaaua

SEQ ID NO: 2807962 - RNA, 17 nt, Listeria monocytogenes EGD-e
ucagaaggaauaaagcc

SEQ ID NO: 2807963 - RNA, 15 nt, Listeria monocytogenes EGD-e
ucagacgcaauuuca

SEQ ID NO: 2807964 - RNA, 16 nt, Listeria monocytogenes EGD-e
ucagacgcaauuucaa

SEQ ID NO: 2807965 - RNA, 13 nt, Listeria monocytogenes EGD-e
ucagauccuucaa

SEQ ID NO: 2807966 - RNA, 16 nt, Listeria monocytogenes EGD-e
ucagauuccauauaau

SEQ ID NO: 2807967 - RNA, 22 nt, Listeria monocytogenes EGD-e
ucagcaagauaacucaaaguaa

SEQ ID NO: 2807968 - RNA, 14 nt, Listeria monocytogenes EGD-e
ucagcaucuggauc

SEQ ID NO: 2807969 - RNA, 18 nt, Listeria monocytogenes EGD-e
ucagcuaaauauuuaauu

SEQ ID NO: 2807970 - RNA, 15 nt, Listeria monocytogenes EGD-e
ucagcucuauaauuu

SEQ ID NO: 2807971 - RNA, 19 nt, Listeria monocytogenes EGD-e
ucagcucuauaauuuauaa

SEQ ID NO: 2807972 - RNA, 22 nt, Listeria monocytogenes EGD-e
ucagcucuuuuuuuauuuucau

SEQ ID NO: 2807973 - RNA, 16 nt, Listeria monocytogenes EGD-e
ucagcuuccauacuuu

SEQ ID NO: 2807974 - RNA, 17 nt, Listeria monocytogenes EGD-e
ucagggaauaagaaauu

SEQ ID NO: 2807975 - RNA, 21 nt, Listeria monocytogenes EGD-e
ucagggaauaagaaauuaccu

SEQ ID NO: 2807976 - RNA, 20 nt, Listeria monocytogenes EGD-e
ucaggugaaaccacuacuaa

SEQ ID NO: 2807977 - RNA, 17 nt, Listeria monocytogenes EGD-e
ucaguuuauaaauaccu

SEQ ID NO: 2807978 - RNA, 17 nt, Listeria monocytogenes EGD-e
ucauaaaacuuucacaa

SEQ ID NO: 2807979 - RNA, 12 nt, Listeria monocytogenes EGD-e
ucauaaacauuu

SEQ ID NO: 2807980 - RNA, 14 nt, Listeria monocytogenes EGD-e
ucauaagcuucaua

SEQ ID NO: 2807981 - RNA, 10 nt, Listeria monocytogenes EGD-e
ucauaauagg

SEQ ID NO: 2807982 - RNA, 15 nt, Listeria monocytogenes EGD-e
ucauaauaggagaca

SEQ ID NO: 2807983 - RNA, 20 nt, Listeria monocytogenes EGD-e
ucauaaucaaauacaugacc

SEQ ID NO: 2807984 - RNA, 17 nt, Listeria monocytogenes EGD-e
ucauauaauuuuuucau

SEQ ID NO: 2807985 - RNA, 18 nt, Listeria monocytogenes EGD-e
ucauauucuucuaaaaua

SEQ ID NO: 2807986 - RNA, 19 nt, Listeria monocytogenes EGD-e
ucauauuuggccaauuaaa

SEQ ID NO: 2807987 - RNA, 21 nt, Listeria monocytogenes EGD-e
ucauauuuggccaauuaaaau

SEQ ID NO: 2807988 - RNA, 14 nt, Listeria monocytogenes EGD-e
ucaucauaaacauu

SEQ ID NO: 2807989 - RNA, 23 nt, Listeria monocytogenes EGD-e
ucaucggagacaguuuguauaag

SEQ ID NO: 2807990 - RNA, 22 nt, Listeria monocytogenes EGD-e
ucaucguuuucuacuguagaau

SEQ ID NO: 2807991 - RNA, 14 nt, Listeria monocytogenes EGD-e
ucaucuuaucaagu

SEQ ID NO: 2807992 - RNA, 15 nt, Listeria monocytogenes EGD-e
ucaugccuucaaaca

SEQ ID NO: 2807993 - RNA, 13 nt, Listeria monocytogenes EGD-e
ucauguucaaucu

SEQ ID NO: 2807994 - RNA, 17 nt, Listeria monocytogenes EGD-e
ucauguucaaucucauc

SEQ ID NO: 2807995 - RNA, 14 nt, Listeria monocytogenes EGD-e
ucauuaaacggcuu

SEQ ID NO: 2807996 - RNA, 15 nt, Listeria monocytogenes EGD-e
ucauuaaauauacac

SEQ ID NO: 2807997 - RNA, 15 nt, Listeria monocytogenes EGD-e
ucauuaaaucaguac

SEQ ID NO: 2807998 - RNA, 20 nt, Listeria monocytogenes EGD-e
ucauucgguaagaccaccaa

SEQ ID NO: 2807999 - RNA, 22 nt, Listeria monocytogenes EGD-e
ucauucgguaagaccaccaaga

SEQ ID NO: 2808000 - RNA, 18 nt, Listeria monocytogenes EGD-e
ucauugcuuuguguuaau

SEQ ID NO: 2808001 - RNA, 14 nt, Listeria monocytogenes EGD-e
ucauuguuguaaau

SEQ ID NO: 2808002 - RNA, 15 nt, Listeria monocytogenes EGD-e
ucauuuauuuucccu

SEQ ID NO: 2808003 - RNA, 15 nt, Listeria monocytogenes EGD-e
ucauuugaaaaaggg

SEQ ID NO: 2808004 - RNA, 18 nt, Listeria monocytogenes EGD-e
ucauuugaaaaagggcug

SEQ ID NO: 2808005 - RNA, 21 nt, Listeria monocytogenes EGD-e
ucauuuucacugcauaaaaaa

SEQ ID NO: 2808006 - RNA, 17 nt, Listeria monocytogenes EGD-e
ucauuuuucuagugcau

SEQ ID NO: 2808007 - RNA, 15 nt, Listeria monocytogenes EGD-e
uccaaaauaaaaugg

SEQ ID NO: 2808008 - RNA, 22 nt, Listeria monocytogenes EGD-e
uccaaaauaaaauggauaaaaa

SEQ ID NO: 2808009 - RNA, 13 nt, Listeria monocytogenes EGD-e
uccaaaaucgcau

SEQ ID NO: 2808010 - RNA, 18 nt, Listeria monocytogenes EGD-e
uccaaagagccauaaaau

SEQ ID NO: 2808011 - RNA, 20 nt, Listeria monocytogenes EGD-e
uccaaagagccauaaaauua

SEQ ID NO: 2808012 - RNA, 23 nt, Listeria monocytogenes EGD-e
uccaaauuauaauuuaauucgcg

SEQ ID NO: 2808013 - RNA, 14 nt, Listeria monocytogenes EGD-e
uccaacguuuuaau

SEQ ID NO: 2808014 - RNA, 16 nt, Listeria monocytogenes EGD-e
uccaacguuuuaauuu

SEQ ID NO: 2808015 - RNA, 16 nt, Listeria monocytogenes EGD-e
uccaagcggguuuucu

SEQ ID NO: 2808016 - RNA, 15 nt, Listeria monocytogenes EGD-e
uccaaguuuuuuaau

SEQ ID NO: 2808017 - RNA, 11 nt, Listeria monocytogenes EGD-e
uccaauaauag

SEQ ID NO: 2808018 - RNA, 21 nt, Listeria monocytogenes EGD-e
uccaaucagcaagauaacuca

SEQ ID NO: 2808019 - RNA, 16 nt, Listeria monocytogenes EGD-e
uccaauucuuucgcuu

SEQ ID NO: 2808020 - RNA, 21 nt, Listeria monocytogenes EGD-e
uccaauucuuucgcuucacug

SEQ ID NO: 2808021 - RNA, 16 nt, Listeria monocytogenes EGD-e
uccacacugguuuuuu

SEQ ID NO: 2808022 - RNA, 19 nt, Listeria monocytogenes EGD-e
uccacacugguuuuuuaau

SEQ ID NO: 2808023 - RNA, 24 nt, Listeria monocytogenes EGD-e
uccacacugguuuuuuaaugcgaa

SEQ ID NO: 2808024 - RNA, 19 nt, Listeria monocytogenes EGD-e
uccacacugguuuuuugau

SEQ ID NO: 2808025 - RNA, 16 nt, Listeria monocytogenes EGD-e
uccacauaacggaaau

SEQ ID NO: 2808026 - RNA, 18 nt, Listeria monocytogenes EGD-e
uccacaucgauguuacca

SEQ ID NO: 2808027 - RNA, 14 nt, Listeria monocytogenes EGD-e
uccaccaaaaacuu

SEQ ID NO: 2808028 - RNA, 20 nt, Listeria monocytogenes EGD-e
uccaccaccuuugguaaaaa

SEQ ID NO: 2808029 - RNA, 22 nt, Listeria monocytogenes EGD-e
uccacccuagcuauacauugaa

SEQ ID NO: 2808030 - RNA, 18 nt, Listeria monocytogenes EGD-e
uccacgauggaaccauuc

SEQ ID NO: 2808031 - RNA, 19 nt, Listeria monocytogenes EGD-e
uccacgauggaaccauuca

SEQ ID NO: 2808032 - RNA, 18 nt, Listeria monocytogenes EGD-e
uccacucguuccgacuac

SEQ ID NO: 2808033 - RNA, 19 nt, Listeria monocytogenes EGD-e
uccagcgucuaaaaaugca

SEQ ID NO: 2808034 - RNA, 19 nt, Listeria monocytogenes EGD-e
uccagcuaaguuuucuaaa

SEQ ID NO: 2808035 - RNA, 20 nt, Listeria monocytogenes EGD-e
uccagcugcuucuaaagcua

SEQ ID NO: 2808036 - RNA, 20 nt, Listeria monocytogenes EGD-e
uccagcuguaucaaugauau

SEQ ID NO: 2808037 - RNA, 14 nt, Listeria monocytogenes EGD-e
uccaguuaaacaaa

SEQ ID NO: 2808038 - RNA, 18 nt, Listeria monocytogenes EGD-e
uccauagaauguauacac

SEQ ID NO: 2808039 - RNA, 20 nt, Listeria monocytogenes EGD-e
uccauagaauguauacacua

SEQ ID NO: 2808040 - RNA, 14 nt, Listeria monocytogenes EGD-e
uccauaucaccaac

SEQ ID NO: 2808041 - RNA, 16 nt, Listeria monocytogenes EGD-e
uccauauuuucucuaa

SEQ ID NO: 2808042 - RNA, 16 nt, Listeria monocytogenes EGD-e
uccauuacuuuaauuu

SEQ ID NO: 2808043 - RNA, 18 nt, Listeria monocytogenes EGD-e
ucccaagauucuucuaau

SEQ ID NO: 2808044 - RNA, 14 nt, Listeria monocytogenes EGD-e
ucccaauuuaauuu

SEQ ID NO: 2808045 - RNA, 16 nt, Listeria monocytogenes EGD-e
ucccagaaaaaaacaa

SEQ ID NO: 2808046 - RNA, 17 nt, Listeria monocytogenes EGD-e
ucccagaaaaaaacaaa

SEQ ID NO: 2808047 - RNA, 18 nt, Listeria monocytogenes EGD-e
ucccagaaaaaaacaaau

SEQ ID NO: 2808048 - RNA, 19 nt, Listeria monocytogenes EGD-e
ucccauugcgaauaacaag

SEQ ID NO: 2808049 - RNA, 23 nt, Listeria monocytogenes EGD-e
uccccuagcucgauaacguguuu

SEQ ID NO: 2808050 - RNA, 21 nt, Listeria monocytogenes EGD-e
uccccuuuuuagaaugaagau

SEQ ID NO: 2808051 - RNA, 16 nt, Listeria monocytogenes EGD-e
ucccggucauuuucac

SEQ ID NO: 2808052 - RNA, 21 nt, Listeria monocytogenes EGD-e
ucccuuuacuugcaaaugcuu

SEQ ID NO: 2808053 - RNA, 20 nt, Listeria monocytogenes EGD-e
ucccuuuuuucauccuuuuu

SEQ ID NO: 2808054 - RNA, 22 nt, Listeria monocytogenes EGD-e
uccgaaccaagcacauccgcau

SEQ ID NO: 2808055 - RNA, 16 nt, Listeria monocytogenes EGD-e
uccgaauacuuucaau

SEQ ID NO: 2808056 - RNA, 22 nt, Listeria monocytogenes EGD-e
uccgaccuguucguacauuuuu

SEQ ID NO: 2808057 - RNA, 15 nt, Listeria monocytogenes EGD-e
uccgaccuuguucac

SEQ ID NO: 2808058 - RNA, 14 nt, Listeria monocytogenes EGD-e
uccgauacaacaaa

SEQ ID NO: 2808059 - RNA, 20 nt, Listeria monocytogenes EGD-e
uccgcgaauagcauaauaga

SEQ ID NO: 2808060 - RNA, 21 nt, Listeria monocytogenes EGD-e
uccgcuuugguuccuugcuua

SEQ ID NO: 2808061 - RNA, 19 nt, Listeria monocytogenes EGD-e
uccgguuuuugcuccauug

SEQ ID NO: 2808062 - RNA, 16 nt, Listeria monocytogenes EGD-e
uccguaagaagaaaau

SEQ ID NO: 2808063 - RNA, 13 nt, Listeria monocytogenes EGD-e
uccgucaagccca

SEQ ID NO: 2808064 - RNA, 19 nt, Listeria monocytogenes EGD-e
uccguuaaucugauuaaaa

SEQ ID NO: 2808065 - RNA, 14 nt, Listeria monocytogenes EGD-e
uccguuucauuuuu

SEQ ID NO: 2808066 - RNA, 22 nt, Listeria monocytogenes EGD-e
uccguuucauuuuugauagcau

SEQ ID NO: 2808067 - RNA, 13 nt, Listeria monocytogenes EGD-e
uccuaauuguuuu

SEQ ID NO: 2808068 - RNA, 17 nt, Listeria monocytogenes EGD-e
uccuaauuuuacuucua

SEQ ID NO: 2808069 - RNA, 18 nt, Listeria monocytogenes EGD-e
uccuagaacuaauucuaa

SEQ ID NO: 2808070 - RNA, 22 nt, Listeria monocytogenes EGD-e
uccuaggcgcucuuuaauaauu

SEQ ID NO: 2808071 - RNA, 22 nt, Listeria monocytogenes EGD-e
uccucauugaggaauacuguuu

SEQ ID NO: 2808072 - RNA, 16 nt, Listeria monocytogenes EGD-e
uccuccaauuuuacug

SEQ ID NO: 2808073 - RNA, 14 nt, Listeria monocytogenes EGD-e
uccugcuaaaacca

SEQ ID NO: 2808074 - RNA, 15 nt, Listeria monocytogenes EGD-e
uccugcugaaauagc

SEQ ID NO: 2808075 - RNA, 13 nt, Listeria monocytogenes EGD-e
uccuuaaauaaaa

SEQ ID NO: 2808076 - RNA, 18 nt, Listeria monocytogenes EGD-e
uccuuauuaauaguauaa

SEQ ID NO: 2808077 - RNA, 22 nt, Listeria monocytogenes EGD-e
uccuuauuaauaguauaaggau

SEQ ID NO: 2808078 - RNA, 16 nt, Listeria monocytogenes EGD-e
uccuucaagcauuuca

SEQ ID NO: 2808079 - RNA, 16 nt, Listeria monocytogenes EGD-e
uccuucauaauuauuu

SEQ ID NO: 2808080 - RNA, 17 nt, Listeria monocytogenes EGD-e
uccuucauaauuauuuu

SEQ ID NO: 2808081 - RNA, 12 nt, Listeria monocytogenes EGD-e
uccuucuaauac

SEQ ID NO: 2808082 - RNA, 17 nt, Listeria monocytogenes EGD-e
uccuucuacauuaccaa

SEQ ID NO: 2808083 - RNA, 23 nt, Listeria monocytogenes EGD-e
uccuugcugcucgcucaucauca

SEQ ID NO: 2808084 - RNA, 23 nt, Listeria monocytogenes EGD-e
uccuuguacuaauucugcgauuu

SEQ ID NO: 2808085 - RNA, 17 nt, Listeria monocytogenes EGD-e
uccuuguuguucuaaua

SEQ ID NO: 2808086 - RNA, 19 nt, Listeria monocytogenes EGD-e
uccuuguuguucuaauaau

SEQ ID NO: 2808087 - RNA, 20 nt, Listeria monocytogenes EGD-e
uccuuguuguucuaauaauu

SEQ ID NO: 2808088 - RNA, 13 nt, Listeria monocytogenes EGD-e
uccuuuuaguguc

SEQ ID NO: 2808089 - RNA, 12 nt, Listeria monocytogenes EGD-e
ucgaaagcaaau

SEQ ID NO: 2808090 - RNA, 18 nt, Listeria monocytogenes EGD-e
ucgaguauaugcuacuau

SEQ ID NO: 2808091 - RNA, 17 nt, Listeria monocytogenes EGD-e
ucgaguuuuuauucauu

SEQ ID NO: 2808092 - RNA, 23 nt, Listeria monocytogenes EGD-e
ucgauaguucacugugaacugau

SEQ ID NO: 2808093 - RNA, 12 nt, Listeria monocytogenes EGD-e
ucgauauuuuuu

SEQ ID NO: 2808094 - RNA, 12 nt, Listeria monocytogenes EGD-e
ucgauuggaauc

SEQ ID NO: 2808095 - RNA, 18 nt, Listeria monocytogenes EGD-e
ucgauuggcgauucuuca

SEQ ID NO: 2808096 - RNA, 13 nt, Listeria monocytogenes EGD-e
ucgauuguagcuu

SEQ ID NO: 2808097 - RNA, 16 nt, Listeria monocytogenes EGD-e
ucgauuguagcuucuc

SEQ ID NO: 2808098 - RNA, 15 nt, Listeria monocytogenes EGD-e
ucgauuuuuucaacg

SEQ ID NO: 2808099 - RNA, 14 nt, Listeria monocytogenes EGD-e
ucgcaaaaaauaau

SEQ ID NO: 2808100 - RNA, 14 nt, Listeria monocytogenes EGD-e
ucgcaaaaaucauc

SEQ ID NO: 2808101 - RNA, 14 nt, Listeria monocytogenes EGD-e
ucgcaaaagcaaac

SEQ ID NO: 2808102 - RNA, 16 nt, Listeria monocytogenes EGD-e
ucgcaaaaugguuucu

SEQ ID NO: 2808103 - RNA, 22 nt, Listeria monocytogenes EGD-e
ucgcagcagauuuugcgaaagc

SEQ ID NO: 2808104 - RNA, 15 nt, Listeria monocytogenes EGD-e
ucgcagggcagaaaa

SEQ ID NO: 2808105 - RNA, 20 nt, Listeria monocytogenes EGD-e
ucgcagggcagaaaacagaa

SEQ ID NO: 2808106 - RNA, 19 nt, Listeria monocytogenes EGD-e
ucgcauugauuuuugaaua

SEQ ID NO: 2808107 - RNA, 16 nt, Listeria monocytogenes EGD-e
ucgccaccuucaauuu

SEQ ID NO: 2808108 - RNA, 21 nt, Listeria monocytogenes EGD-e
ucgccaguugcugaauaucaa

SEQ ID NO: 2808109 - RNA, 14 nt, Listeria monocytogenes EGD-e
ucgccuacuucuaa

SEQ ID NO: 2808110 - RNA, 14 nt, Listeria monocytogenes EGD-e
ucgcucaucaucaa

SEQ ID NO: 2808111 - RNA, 23 nt, Listeria monocytogenes EGD-e
ucgcucuguuucauuuuuccaag

SEQ ID NO: 2808112 - RNA, 19 nt, Listeria monocytogenes EGD-e
ucgcugucaaauucuucuc

SEQ ID NO: 2808113 - RNA, 21 nt, Listeria monocytogenes EGD-e
ucggaccuuuugcuucuucca

SEQ ID NO: 2808114 - RNA, 14 nt, Listeria monocytogenes EGD-e
ucggagacagaaaa

SEQ ID NO: 2808115 - RNA, 17 nt, Listeria monocytogenes EGD-e
ucggggaaauaguuuug

SEQ ID NO: 2808116 - RNA, 13 nt, Listeria monocytogenes EGD-e
ucggucaaaucug

SEQ ID NO: 2808117 - RNA, 22 nt, Listeria monocytogenes EGD-e
ucgguucggagacagaaaaaga

SEQ ID NO: 2808118 - RNA, 12 nt, Listeria monocytogenes EGD-e
ucguacauuuuu

SEQ ID NO: 2808119 - RNA, 15 nt, Listeria monocytogenes EGD-e
ucguauguuuucccu

SEQ ID NO: 2808120 - RNA, 15 nt, Listeria monocytogenes EGD-e
ucgucuaaaaaauau

SEQ ID NO: 2808121 - RNA, 18 nt, Listeria monocytogenes EGD-e
ucgucuaaaaaauauuga

SEQ ID NO: 2808122 - RNA, 22 nt, Listeria monocytogenes EGD-e
ucgugcgcaacauucaaaucac

SEQ ID NO: 2808123 - RNA, 14 nt, Listeria monocytogenes EGD-e
ucguuauuuccuuc

SEQ ID NO: 2808124 - RNA, 22 nt, Listeria monocytogenes EGD-e
ucguuccgacuaccggcccaca

SEQ ID NO: 2808125 - RNA, 18 nt, Listeria monocytogenes EGD-e
ucguugcagaaacaauca

SEQ ID NO: 2808126 - RNA, 16 nt, Listeria monocytogenes EGD-e
ucguuuaacauauaau

SEQ ID NO: 2808127 - RNA, 14 nt, Listeria monocytogenes EGD-e
ucguuuauuuugau

SEQ ID NO: 2808128 - RNA, 16 nt, Listeria monocytogenes EGD-e
ucguuucaacuccgcu

SEQ ID NO: 2808129 - RNA, 12 nt, Listeria monocytogenes EGD-e
ucuaaaaaugca

SEQ ID NO: 2808130 - RNA, 17 nt, Listeria monocytogenes EGD-e
ucuaaaauaucaucaau

SEQ ID NO: 2808131 - RNA, 18 nt, Listeria monocytogenes EGD-e
ucuaaacguucuuccuuu

SEQ ID NO: 2808132 - RNA, 12 nt, Listeria monocytogenes EGD-e
ucuaaaguuaga

SEQ ID NO: 2808133 - RNA, 18 nt, Listeria monocytogenes EGD-e
ucuaaaguuagauuaaaa

SEQ ID NO: 2808134 - RNA, 20 nt, Listeria monocytogenes EGD-e
ucuaaaguuagauuaaaaau

SEQ ID NO: 2808135 - RNA, 16 nt, Listeria monocytogenes EGD-e
ucuaacauuaauucau

SEQ ID NO: 2808136 - RNA, 22 nt, Listeria monocytogenes EGD-e
ucuaagucugcuuuuucaagua

SEQ ID NO: 2808137 - RNA, 23 nt, Listeria monocytogenes EGD-e
ucuaauacgacaauaccauguuu

SEQ ID NO: 2808138 - RNA, 14 nt, Listeria monocytogenes EGD-e
ucuaaucaaaugca

SEQ ID NO: 2808139 - RNA, 16 nt, Listeria monocytogenes EGD-e
ucuacuucuaaauagu

SEQ ID NO: 2808140 - RNA, 15 nt, Listeria monocytogenes EGD-e
ucuacuuuuaaaauu

SEQ ID NO: 2808141 - RNA, 22 nt, Listeria monocytogenes EGD-e
ucuagccgcucgucuaaauuga

SEQ ID NO: 2808142 - RNA, 13 nt, Listeria monocytogenes EGD-e
ucuagguuuucuu

SEQ ID NO: 2808143 - RNA, 17 nt, Listeria monocytogenes EGD-e
ucuaguagcaauuuuaa

SEQ ID NO: 2808144 - RNA, 14 nt, Listeria monocytogenes EGD-e
ucuaguuuguccca

SEQ ID NO: 2808145 - RNA, 17 nt, Listeria monocytogenes EGD-e
ucuauaauuuauaaaag

SEQ ID NO: 2808146 - RNA, 14 nt, Listeria monocytogenes EGD-e
ucuauauuaauguc

SEQ ID NO: 2808147 - RNA, 14 nt, Listeria monocytogenes EGD-e
ucucacuaaacaua

SEQ ID NO: 2808148 - RNA, 12 nt, Listeria monocytogenes EGD-e
ucucaugaaacu

SEQ ID NO: 2808149 - RNA, 20 nt, Listeria monocytogenes EGD-e
ucuccaccaaguucuguugg

SEQ ID NO: 2808150 - RNA, 17 nt, Listeria monocytogenes EGD-e
ucucccucauccuuucu

SEQ ID NO: 2808151 - RNA, 17 nt, Listeria monocytogenes EGD-e
ucuccgcaaucauucca

SEQ ID NO: 2808152 - RNA, 16 nt, Listeria monocytogenes EGD-e
ucuccguaagaagaaa

SEQ ID NO: 2808153 - RNA, 17 nt, Listeria monocytogenes EGD-e
ucuccguaagaagaaaa

SEQ ID NO: 2808154 - RNA, 13 nt, Listeria monocytogenes EGD-e
ucucuauauucau

SEQ ID NO: 2808155 - RNA, 15 nt, Listeria monocytogenes EGD-e
ucucucauuguugua

SEQ ID NO: 2808156 - RNA, 22 nt, Listeria monocytogenes EGD-e
ucucuugcuuuaauuuggaaau

SEQ ID NO: 2808157 - RNA, 15 nt, Listeria monocytogenes EGD-e
ucugaaaauguugca

SEQ ID NO: 2808158 - RNA, 19 nt, Listeria monocytogenes EGD-e
ucugaacugacuagaaauu

SEQ ID NO: 2808159 - RNA, 13 nt, Listeria monocytogenes EGD-e
ucugagaagccag

SEQ ID NO: 2808160 - RNA, 22 nt, Listeria monocytogenes EGD-e
ucugagaagccagcauuuuuac

SEQ ID NO: 2808161 - RNA, 13 nt, Listeria monocytogenes EGD-e
ucugauuaaaagu

SEQ ID NO: 2808162 - RNA, 22 nt, Listeria monocytogenes EGD-e
ucugccgauuauccuguaauuc

SEQ ID NO: 2808163 - RNA, 19 nt, Listeria monocytogenes EGD-e
ucugccuaccaaaaccauu

SEQ ID NO: 2808164 - RNA, 15 nt, Listeria monocytogenes EGD-e
ucugcuauuuuugaa

SEQ ID NO: 2808165 - RNA, 23 nt, Listeria monocytogenes EGD-e
ucuggauuuacuacgcgacaaag

SEQ ID NO: 2808166 - RNA, 13 nt, Listeria monocytogenes EGD-e
ucuguacuccuug

SEQ ID NO: 2808167 - RNA, 14 nt, Listeria monocytogenes EGD-e
ucuguuucauuuuu

SEQ ID NO: 2808168 - RNA, 16 nt, Listeria monocytogenes EGD-e
ucuuaagaauuccguc

SEQ ID NO: 2808169 - RNA, 14 nt, Listeria monocytogenes EGD-e
ucuuacuauuuucu

SEQ ID NO: 2808170 - RNA, 15 nt, Listeria monocytogenes EGD-e
ucuuacuauuuucua

SEQ ID NO: 2808171 - RNA, 18 nt, Listeria monocytogenes EGD-e
ucuuauagcaucuuggca

SEQ ID NO: 2808172 - RNA, 23 nt, Listeria monocytogenes EGD-e
ucuucaauugcuucuuuuuucuu

SEQ ID NO: 2808173 - RNA, 14 nt, Listeria monocytogenes EGD-e
ucuucauuuuucua

SEQ ID NO: 2808174 - RNA, 15 nt, Listeria monocytogenes EGD-e
ucuuccauaucacca

SEQ ID NO: 2808175 - RNA, 14 nt, Listeria monocytogenes EGD-e
ucuuccauauuuuc

SEQ ID NO: 2808176 - RNA, 15 nt, Listeria monocytogenes EGD-e
ucuuccauauuuucu

SEQ ID NO: 2808177 - RNA, 13 nt, Listeria monocytogenes EGD-e
ucuuccuuuuguu

SEQ ID NO: 2808178 - RNA, 22 nt, Listeria monocytogenes EGD-e
ucuuccuuuuucauuauaagug

SEQ ID NO: 2808179 - RNA, 13 nt, Listeria monocytogenes EGD-e
ucuucgcuuguuu

SEQ ID NO: 2808180 - RNA, 17 nt, Listeria monocytogenes EGD-e
ucuucgcuuguuuugau

SEQ ID NO: 2808181 - RNA, 20 nt, Listeria monocytogenes EGD-e
ucuucgcuuguuuugaugcu

SEQ ID NO: 2808182 - RNA, 19 nt, Listeria monocytogenes EGD-e
ucuucggauucucuucuaa

SEQ ID NO: 2808183 - RNA, 16 nt, Listeria monocytogenes EGD-e
ucuucggauuuuucaa

SEQ ID NO: 2808184 - RNA, 22 nt, Listeria monocytogenes EGD-e
ucuucgugcgcaacauucaaau

SEQ ID NO: 2808185 - RNA, 19 nt, Listeria monocytogenes EGD-e
ucuucuaagaaaaaaaguu

SEQ ID NO: 2808186 - RNA, 22 nt, Listeria monocytogenes EGD-e
ucuucuaagaaaaaaaguuaua

SEQ ID NO: 2808187 - RNA, 15 nt, Listeria monocytogenes EGD-e
ucuucuaauacauuc

SEQ ID NO: 2808188 - RNA, 16 nt, Listeria monocytogenes EGD-e
ucuucuaauacauucg

SEQ ID NO: 2808189 - RNA, 16 nt, Listeria monocytogenes EGD-e
ucuucuguuaacauuu

SEQ ID NO: 2808190 - RNA, 13 nt, Listeria monocytogenes EGD-e
ucuucuugcuuca

SEQ ID NO: 2808191 - RNA, 12 nt, Listeria monocytogenes EGD-e
ucuucuuugauu

SEQ ID NO: 2808192 - RNA, 21 nt, Listeria monocytogenes EGD-e
ucuucuuuuugauuaaugauu

SEQ ID NO: 2808193 - RNA, 22 nt, Listeria monocytogenes EGD-e
ucuucuuuuugauuaaugauuu

SEQ ID NO: 2808194 - RNA, 21 nt, Listeria monocytogenes EGD-e
ucuugauccaaguuuuuuaau

SEQ ID NO: 2808195 - RNA, 13 nt, Listeria monocytogenes EGD-e
ucuugaugccauc

SEQ ID NO: 2808196 - RNA, 23 nt, Listeria monocytogenes EGD-e
ucuugcuucacgugcugcuuucc

SEQ ID NO: 2808197 - RNA, 14 nt, Listeria monocytogenes EGD-e
ucuugcuuuaauuu

SEQ ID NO: 2808198 - RNA, 16 nt, Listeria monocytogenes EGD-e
ucuugcuuuaauuugg

SEQ ID NO: 2808199 - RNA, 13 nt, Listeria monocytogenes EGD-e
ucuuguacacauu

SEQ ID NO: 2808200 - RNA, 17 nt, Listeria monocytogenes EGD-e
ucuuuacauauuccaaa

SEQ ID NO: 2808201 - RNA, 18 nt, Listeria monocytogenes EGD-e
ucuuuauaacucucauaa

SEQ ID NO: 2808202 - RNA, 18 nt, Listeria monocytogenes EGD-e
ucuuucacacgauaccaa

SEQ ID NO: 2808203 - RNA, 19 nt, Listeria monocytogenes EGD-e
ucuuucacacgauaccaaa

SEQ ID NO: 2808204 - RNA, 15 nt, Listeria monocytogenes EGD-e
ucuuucugaaaaugu

SEQ ID NO: 2808205 - RNA, 10 nt, Listeria monocytogenes EGD-e
ucuuugauuu

SEQ ID NO: 2808206 - RNA, 17 nt, Listeria monocytogenes EGD-e
ucuuugcuucaauccca

SEQ ID NO: 2808207 - RNA, 14 nt, Listeria monocytogenes EGD-e
ucuuuuaaagcuuu

SEQ ID NO: 2808208 - RNA, 18 nt, Listeria monocytogenes EGD-e
ucuuuuaaagcuuuuaaa

SEQ ID NO: 2808209 - RNA, 22 nt, Listeria monocytogenes EGD-e
ucuuuuacggcuucaaugagug

SEQ ID NO: 2808210 - RNA, 13 nt, Listeria monocytogenes EGD-e
ucuuuuaucuucc

SEQ ID NO: 2808211 - RNA, 14 nt, Listeria monocytogenes EGD-e
ucuuuuaucuuccc

SEQ ID NO: 2808212 - RNA, 13 nt, Listeria monocytogenes EGD-e
ucuuuuccaaaau

SEQ ID NO: 2808213 - RNA, 18 nt, Listeria monocytogenes EGD-e
ucuuuucgcaaucaauuu

SEQ ID NO: 2808214 - RNA, 13 nt, Listeria monocytogenes EGD-e
ucuuuuguaguaa

SEQ ID NO: 2808215 - RNA, 22 nt, Listeria monocytogenes EGD-e
ucuuuuguucgggcgaauaacc

SEQ ID NO: 2808216 - RNA, 13 nt, Listeria monocytogenes EGD-e
ucuuuuucuucuu

SEQ ID NO: 2808217 - RNA, 16 nt, Listeria monocytogenes EGD-e
ucuuuuuguaaaggau

SEQ ID NO: 2808218 - RNA, 16 nt, Listeria monocytogenes EGD-e
ucuuuuuucuuccaua

SEQ ID NO: 2808219 - RNA, 18 nt, Listeria monocytogenes EGD-e
ucuuuuuuucuuuaaaau

SEQ ID NO: 2808220 - RNA, 17 nt, Listeria monocytogenes EGD-e
ugaaaacugaacaaaga

SEQ ID NO: 2808221 - RNA, 18 nt, Listeria monocytogenes EGD-e
ugaaaacugaacaaagaa

SEQ ID NO: 2808222 - RNA, 22 nt, Listeria monocytogenes EGD-e
ugaaaacugaacaaagaagaag

SEQ ID NO: 2808223 - RNA, 12 nt, Listeria monocytogenes EGD-e
ugaaaaucgagg

SEQ ID NO: 2808224 - RNA, 18 nt, Listeria monocytogenes EGD-e
ugaaaaucuacaacuaga

SEQ ID NO: 2808225 - RNA, 20 nt, Listeria monocytogenes EGD-e
ugaaaaugagcccaaaaaua

SEQ ID NO: 2808226 - RNA, 22 nt, Listeria monocytogenes EGD-e
ugaaaaugagcccaaaaauaag

SEQ ID NO: 2808227 - RNA, 22 nt, Listeria monocytogenes EGD-e
ugaaaauuggauuauucaauuc

SEQ ID NO: 2808228 - RNA, 14 nt, Listeria monocytogenes EGD-e
ugaaaccacuacua

SEQ ID NO: 2808229 - RNA, 20 nt, Listeria monocytogenes EGD-e
ugaaacuuuaacaaaaguca

SEQ ID NO: 2808230 - RNA, 14 nt, Listeria monocytogenes EGD-e
ugaacaaagaagaa

SEQ ID NO: 2808231 - RNA, 15 nt, Listeria monocytogenes EGD-e
ugaacugauuuuuug

SEQ ID NO: 2808232 - RNA, 21 nt, Listeria monocytogenes EGD-e
ugaagauaaacuaauuacuaa

SEQ ID NO: 2808233 - RNA, 19 nt, Listeria monocytogenes EGD-e
ugaagaucccaaacucccu

SEQ ID NO: 2808234 - RNA, 14 nt, Listeria monocytogenes EGD-e
ugaagccauucccg

SEQ ID NO: 2808235 - RNA, 22 nt, Listeria monocytogenes EGD-e
ugaagcgaugauuuucauuaaa

SEQ ID NO: 2808236 - RNA, 16 nt, Listeria monocytogenes EGD-e
ugaauaacuuuccagc

SEQ ID NO: 2808237 - RNA, 21 nt, Listeria monocytogenes EGD-e
ugaauagauauucucuuauga

SEQ ID NO: 2808238 - RNA, 19 nt, Listeria monocytogenes EGD-e
ugaauagauugcgucacaa

SEQ ID NO: 2808239 - RNA, 14 nt, Listeria monocytogenes EGD-e
ugaauauccuaacu

SEQ ID NO: 2808240 - RNA, 12 nt, Listeria monocytogenes EGD-e
ugaauauuagaa

SEQ ID NO: 2808241 - RNA, 24 nt, Listeria monocytogenes EGD-e
ugaauauuagaaaaucauuucgau

SEQ ID NO: 2808242 - RNA, 16 nt, Listeria monocytogenes EGD-e
ugaaugccagccauuu

SEQ ID NO: 2808243 - RNA, 20 nt, Listeria monocytogenes EGD-e
ugaaugccagccauuuugga

SEQ ID NO: 2808244 - RNA, 22 nt, Listeria monocytogenes EGD-e
ugaauggcgagauguuuuuauu

SEQ ID NO: 2808245 - RNA, 14 nt, Listeria monocytogenes EGD-e
ugaauuaagaagua

SEQ ID NO: 2808246 - RNA, 14 nt, Listeria monocytogenes EGD-e
ugaauuuuuauaca

SEQ ID NO: 2808247 - RNA, 19 nt, Listeria monocytogenes EGD-e
ugacaaaaggacaagccca

SEQ ID NO: 2808248 - RNA, 13 nt, Listeria monocytogenes EGD-e
ugacaauuaaaaa

SEQ ID NO: 2808249 - RNA, 18 nt, Listeria monocytogenes EGD-e
ugacacccgcguuuucua

SEQ ID NO: 2808250 - RNA, 19 nt, Listeria monocytogenes EGD-e
ugacagcaucuuuuucuug

SEQ ID NO: 2808251 - RNA, 16 nt, Listeria monocytogenes EGD-e
ugaccaauuucuuuuu

SEQ ID NO: 2808252 - RNA, 22 nt, Listeria monocytogenes EGD-e
ugaccagugugguuuacucccu

SEQ ID NO: 2808253 - RNA, 18 nt, Listeria monocytogenes EGD-e
ugaccuaguuaaucuaag

SEQ ID NO: 2808254 - RNA, 14 nt, Listeria monocytogenes EGD-e
ugaccuuaaauuau

SEQ ID NO: 2808255 - RNA, 17 nt, Listeria monocytogenes EGD-e
ugaccuuaaauuauacu

SEQ ID NO: 2808256 - RNA, 17 nt, Listeria monocytogenes EGD-e
ugaccuuugaaaacuga

SEQ ID NO: 2808257 - RNA, 21 nt, Listeria monocytogenes EGD-e
ugacgagguugcgguuucuuu

SEQ ID NO: 2808258 - RNA, 18 nt, Listeria monocytogenes EGD-e
ugacgcguggaaagaaua

SEQ ID NO: 2808259 - RNA, 20 nt, Listeria monocytogenes EGD-e
ugacguaaggcauguaucuu

SEQ ID NO: 2808260 - RNA, 14 nt, Listeria monocytogenes EGD-e
ugacuagaaauuaa

SEQ ID NO: 2808261 - RNA, 21 nt, Listeria monocytogenes EGD-e
ugacuagaaauuaaugccagu

SEQ ID NO: 2808262 - RNA, 14 nt, Listeria monocytogenes EGD-e
ugacuguuguuuca

SEQ ID NO: 2808263 - RNA, 20 nt, Listeria monocytogenes EGD-e
ugagaaucauuaauauaaag

SEQ ID NO: 2808264 - RNA, 19 nt, Listeria monocytogenes EGD-e
ugagaguuauaaagaaaua

SEQ ID NO: 2808265 - RNA, 23 nt, Listeria monocytogenes EGD-e
ugagauaaucaagauuuuguaca

SEQ ID NO: 2808266 - RNA, 14 nt, Listeria monocytogenes EGD-e
ugagcccaaaaaua

SEQ ID NO: 2808267 - RNA, 16 nt, Listeria monocytogenes EGD-e
ugagcccaaaaauaag

SEQ ID NO: 2808268 - RNA, 20 nt, Listeria monocytogenes EGD-e
ugagcgguuuuguuuccaac

SEQ ID NO: 2808269 - RNA, 24 nt, Listeria monocytogenes EGD-e
ugagcuaauuuuuuuauaccuaaa

SEQ ID NO: 2808270 - RNA, 16 nt, Listeria monocytogenes EGD-e
ugagugaagauaaacu

SEQ ID NO: 2808271 - RNA, 17 nt, Listeria monocytogenes EGD-e
ugaguuagcuugaccag

SEQ ID NO: 2808272 - RNA, 17 nt, Listeria monocytogenes EGD-e
ugauaaagauaauaacc

SEQ ID NO: 2808273 - RNA, 22 nt, Listeria monocytogenes EGD-e
ugauaaauaacaagaauaauga

SEQ ID NO: 2808274 - RNA, 14 nt, Listeria monocytogenes EGD-e
ugauaauaaucaga

SEQ ID NO: 2808275 - RNA, 17 nt, Listeria monocytogenes EGD-e
ugauaauaaucagaucu

SEQ ID NO: 2808276 - RNA, 20 nt, Listeria monocytogenes EGD-e
ugauaaugugaccuuaaauu

SEQ ID NO: 2808277 - RNA, 21 nt, Listeria monocytogenes EGD-e
ugauaaugugaccuuaaauua

SEQ ID NO: 2808278 - RNA, 14 nt, Listeria monocytogenes EGD-e
ugauaccaaauugu

SEQ ID NO: 2808279 - RNA, 15 nt, Listeria monocytogenes EGD-e
ugauagcauccucuu

SEQ ID NO: 2808280 - RNA, 16 nt, Listeria monocytogenes EGD-e
ugauaucaucaauaau

SEQ ID NO: 2808281 - RNA, 17 nt, Listeria monocytogenes EGD-e
ugauauuaugauuuguu

SEQ ID NO: 2808282 - RNA, 20 nt, Listeria monocytogenes EGD-e
ugauauuaugauuuguuucu

SEQ ID NO: 2808283 - RNA, 14 nt, Listeria monocytogenes EGD-e
ugaucuuuucgcaa

SEQ ID NO: 2808284 - RNA, 21 nt, Listeria monocytogenes EGD-e
ugaugaaaagacaccaauuuc

SEQ ID NO: 2808285 - RNA, 20 nt, Listeria monocytogenes EGD-e
ugaugccgacuaguucugcu

SEQ ID NO: 2808286 - RNA, 21 nt, Listeria monocytogenes EGD-e
ugaugguauuguuuuuugauu

SEQ ID NO: 2808287 - RNA, 17 nt, Listeria monocytogenes EGD-e
ugauguguugcuuuuau

SEQ ID NO: 2808288 - RNA, 16 nt, Listeria monocytogenes EGD-e
ugauguuguaaauacu

SEQ ID NO: 2808289 - RNA, 19 nt, Listeria monocytogenes EGD-e
ugauuuaauuuaauuuucc

SEQ ID NO: 2808290 - RNA, 14 nt, Listeria monocytogenes EGD-e
ugauuuuauuuuua

SEQ ID NO: 2808291 - RNA, 13 nt, Listeria monocytogenes EGD-e
ugauuuuuauucc

SEQ ID NO: 2808292 - RNA, 23 nt, Listeria monocytogenes EGD-e
ugauuuuugagaacgauuuuggu

SEQ ID NO: 2808293 - RNA, 21 nt, Listeria monocytogenes EGD-e
ugcaaaagcaguagacuaaau

SEQ ID NO: 2808294 - RNA, 12 nt, Listeria monocytogenes EGD-e
ugcaaaugcuuu

SEQ ID NO: 2808295 - RNA, 18 nt, Listeria monocytogenes EGD-e
ugcaagccguauucuguu

SEQ ID NO: 2808296 - RNA, 22 nt, Listeria monocytogenes EGD-e
ugcaaggcuuuuaacuuucuug

SEQ ID NO: 2808297 - RNA, 23 nt, Listeria monocytogenes EGD-e
ugcaaucaucuuaucaaguaaua

SEQ ID NO: 2808298 - RNA, 16 nt, Listeria monocytogenes EGD-e
ugcaaucauuuauuuu

SEQ ID NO: 2808299 - RNA, 16 nt, Listeria monocytogenes EGD-e
ugcaaucccuauaaaa

SEQ ID NO: 2808300 - RNA, 23 nt, Listeria monocytogenes EGD-e
ugcacagcagaaacuuucuuuuc

SEQ ID NO: 2808301 - RNA, 18 nt, Listeria monocytogenes EGD-e
ugcaccugcauuucauuu

SEQ ID NO: 2808302 - RNA, 20 nt, Listeria monocytogenes EGD-e
ugcacuagaaaaaugaagag

SEQ ID NO: 2808303 - RNA, 19 nt, Listeria monocytogenes EGD-e
ugcacugcaccuaauagca

SEQ ID NO: 2808304 - RNA, 16 nt, Listeria monocytogenes EGD-e
ugcagaaaauuucgcg

SEQ ID NO: 2808305 - RNA, 14 nt, Listeria monocytogenes EGD-e
ugcagaaacaauca

SEQ ID NO: 2808306 - RNA, 15 nt, Listeria monocytogenes EGD-e
ugcagaaacaaucau

SEQ ID NO: 2808307 - RNA, 15 nt, Listeria monocytogenes EGD-e
ugcagcgacaauuau

SEQ ID NO: 2808308 - RNA, 14 nt, Listeria monocytogenes EGD-e
ugcauaaaaaacau

SEQ ID NO: 2808309 - RNA, 15 nt, Listeria monocytogenes EGD-e
ugcauagugagaguu

SEQ ID NO: 2808310 - RNA, 18 nt, Listeria monocytogenes EGD-e
ugcaucaagggaagcuuu

SEQ ID NO: 2808311 - RNA, 23 nt, Listeria monocytogenes EGD-e
ugcaucuucuaagaaaaaaaguu

SEQ ID NO: 2808312 - RNA, 20 nt, Listeria monocytogenes EGD-e
ugcaucuucuguuaacauuu

SEQ ID NO: 2808313 - RNA, 17 nt, Listeria monocytogenes EGD-e
ugcaugaccuagccaga

SEQ ID NO: 2808314 - RNA, 22 nt, Listeria monocytogenes EGD-e
ugcauuaaaaaggaauuuuucc

SEQ ID NO: 2808315 - RNA, 23 nt, Listeria monocytogenes EGD-e
ugcauuaaaaaggaauuuuucca

SEQ ID NO: 2808316 - RNA, 20 nt, Listeria monocytogenes EGD-e
ugcauucugugauggaagua

SEQ ID NO: 2808317 - RNA, 14 nt, Listeria monocytogenes EGD-e
ugcauuuucacaag

SEQ ID NO: 2808318 - RNA, 18 nt, Listeria monocytogenes EGD-e
ugcauuuuuucuuugccu

SEQ ID NO: 2808319 - RNA, 19 nt, Listeria monocytogenes EGD-e
ugccagccauuuuggaaaa

SEQ ID NO: 2808320 - RNA, 19 nt, Listeria monocytogenes EGD-e
ugccaucaggaguuucuuu

SEQ ID NO: 2808321 - RNA, 21 nt, Listeria monocytogenes EGD-e
ugccaucgccgccuauuauuu

SEQ ID NO: 2808322 - RNA, 16 nt, Listeria monocytogenes EGD-e
ugcccaccgauaauag

SEQ ID NO: 2808323 - RNA, 14 nt, Listeria monocytogenes EGD-e
ugcccaucuuuuuu

SEQ ID NO: 2808324 - RNA, 16 nt, Listeria monocytogenes EGD-e
ugccgacuaguucugc

SEQ ID NO: 2808325 - RNA, 19 nt, Listeria monocytogenes EGD-e
ugccgauuauccuguaauu

SEQ ID NO: 2808326 - RNA, 20 nt, Listeria monocytogenes EGD-e
ugccuucaaacacuucuaaa

SEQ ID NO: 2808327 - RNA, 15 nt, Listeria monocytogenes EGD-e
ugcgaauaacagauu

SEQ ID NO: 2808328 - RNA, 16 nt, Listeria monocytogenes EGD-e
ugcgcaacauucaaau

SEQ ID NO: 2808329 - RNA, 13 nt, Listeria monocytogenes EGD-e
ugcgcauguuuuu

SEQ ID NO: 2808330 - RNA, 16 nt, Listeria monocytogenes EGD-e
ugcgcggauaaauaua

SEQ ID NO: 2808331 - RNA, 14 nt, Listeria monocytogenes EGD-e
ugcgguuucuuuua

SEQ ID NO: 2808332 - RNA, 20 nt, Listeria monocytogenes EGD-e
ugcguaagauuuuugcucag

SEQ ID NO: 2808333 - RNA, 15 nt, Listeria monocytogenes EGD-e
ugcuaaaauaaaucu

SEQ ID NO: 2808334 - RNA, 23 nt, Listeria monocytogenes EGD-e
ugcuaaagaagucuuuuuguaaa

SEQ ID NO: 2808335 - RNA, 13 nt, Listeria monocytogenes EGD-e
ugcuaaauaaaac

SEQ ID NO: 2808336 - RNA, 21 nt, Listeria monocytogenes EGD-e
ugcucagcggguugaaaggaa

SEQ ID NO: 2808337 - RNA, 17 nt, Listeria monocytogenes EGD-e
ugcucaguaguucuuuu

SEQ ID NO: 2808338 - RNA, 16 nt, Listeria monocytogenes EGD-e
ugcucuuugcuucaau

SEQ ID NO: 2808339 - RNA, 17 nt, Listeria monocytogenes EGD-e
ugcugcauuuucacaag

SEQ ID NO: 2808340 - RNA, 15 nt, Listeria monocytogenes EGD-e
ugcugucuuggaaga

SEQ ID NO: 2808341 - RNA, 15 nt, Listeria monocytogenes EGD-e
ugcuguuacugugcu

SEQ ID NO: 2808342 - RNA, 13 nt, Listeria monocytogenes EGD-e
ugcuucaccaaga

SEQ ID NO: 2808343 - RNA, 19 nt, Listeria monocytogenes EGD-e
ugcuucaccaagaagagcu

SEQ ID NO: 2808344 - RNA, 13 nt, Listeria monocytogenes EGD-e
ugcuucacgugcu

SEQ ID NO: 2808345 - RNA, 17 nt, Listeria monocytogenes EGD-e
ugcuucaucuuuauaaa

SEQ ID NO: 2808346 - RNA, 20 nt, Listeria monocytogenes EGD-e
ugcuucgcuguccauuccaa

SEQ ID NO: 2808347 - RNA, 12 nt, Listeria monocytogenes EGD-e
ugcuucuuuuuu

SEQ ID NO: 2808348 - RNA, 21 nt, Listeria monocytogenes EGD-e
ugcuucuuuuuucuuccauau

SEQ ID NO: 2808349 - RNA, 21 nt, Listeria monocytogenes EGD-e
ugcuugcaaucccuauaaaaa

SEQ ID NO: 2808350 - RNA, 17 nt, Listeria monocytogenes EGD-e
ugcuuguguaacauaaa

SEQ ID NO: 2808351 - RNA, 19 nt, Listeria monocytogenes EGD-e
ugcuuuaauuuggaaauaa

SEQ ID NO: 2808352 - RNA, 16 nt, Listeria monocytogenes EGD-e
ugcuuuagcagcaagu

SEQ ID NO: 2808353 - RNA, 17 nt, Listeria monocytogenes EGD-e
ugcuuucguuucaaccc

SEQ ID NO: 2808354 - RNA, 22 nt, Listeria monocytogenes EGD-e
ugcuuugccgcgacuauuucgc

SEQ ID NO: 2808355 - RNA, 15 nt, Listeria monocytogenes EGD-e
ugcuuuuguuuuccu

SEQ ID NO: 2808356 - RNA, 14 nt, Listeria monocytogenes EGD-e
ugcuuuuuuuaaac

SEQ ID NO: 2808357 - RNA, 15 nt, Listeria monocytogenes EGD-e
uggaaaagagaaaaa

SEQ ID NO: 2808358 - RNA, 16 nt, Listeria monocytogenes EGD-e
uggaaaagagaaaaag

SEQ ID NO: 2808359 - RNA, 20 nt, Listeria monocytogenes EGD-e
uggaaauaaccauuccaucg

SEQ ID NO: 2808360 - RNA, 20 nt, Listeria monocytogenes EGD-e
uggaauagagcuuuuaaaua

SEQ ID NO: 2808361 - RNA, 21 nt, Listeria monocytogenes EGD-e
uggaaugcgguaacuaaaaua

SEQ ID NO: 2808362 - RNA, 23 nt, Listeria monocytogenes EGD-e
uggacaaugauccgaaccaagca

SEQ ID NO: 2808363 - RNA, 18 nt, Listeria monocytogenes EGD-e
uggaucaggauagcccgc

SEQ ID NO: 2808364 - RNA, 19 nt, Listeria monocytogenes EGD-e
uggaucauauucuucuaaa

SEQ ID NO: 2808365 - RNA, 19 nt, Listeria monocytogenes EGD-e
uggauuccuaaaucagcau

SEQ ID NO: 2808366 - RNA, 15 nt, Listeria monocytogenes EGD-e
uggauugauauuaua

SEQ ID NO: 2808367 - RNA, 15 nt, Listeria monocytogenes EGD-e
uggcaacuucuggau

SEQ ID NO: 2808368 - RNA, 19 nt, Listeria monocytogenes EGD-e
uggcacagcgcuuaaaaau

SEQ ID NO: 2808369 - RNA, 14 nt, Listeria monocytogenes EGD-e
uggcaucagauucc

SEQ ID NO: 2808370 - RNA, 15 nt, Listeria monocytogenes EGD-e
uggccaauuaaaaua

SEQ ID NO: 2808371 - RNA, 21 nt, Listeria monocytogenes EGD-e
uggccuucgauaguuccuucu

SEQ ID NO: 2808372 - RNA, 21 nt, Listeria monocytogenes EGD-e
uggcguauacauuuugaugua

SEQ ID NO: 2808373 - RNA, 14 nt, Listeria monocytogenes EGD-e
uggcuuauuuuaac

SEQ ID NO: 2808374 - RNA, 15 nt, Listeria monocytogenes EGD-e
uggcuuccacauugu

SEQ ID NO: 2808375 - RNA, 16 nt, Listeria monocytogenes EGD-e
ugggagcuuucuuuuu

SEQ ID NO: 2808376 - RNA, 20 nt, Listeria monocytogenes EGD-e
ugggcaaccuaguuuuauua

SEQ ID NO: 2808377 - RNA, 18 nt, Listeria monocytogenes EGD-e
ugggccguccaauucuuu

SEQ ID NO: 2808378 - RNA, 19 nt, Listeria monocytogenes EGD-e
ugggccguccaauucuuuc

SEQ ID NO: 2808379 - RNA, 14 nt, Listeria monocytogenes EGD-e
uggguaaguagcau

SEQ ID NO: 2808380 - RNA, 19 nt, Listeria monocytogenes EGD-e
uggguauacccuuuuuuua

SEQ ID NO: 2808381 - RNA, 22 nt, Listeria monocytogenes EGD-e
uggguauacccuuuuuuuacau

SEQ ID NO: 2808382 - RNA, 12 nt, Listeria monocytogenes EGD-e
ugguaaaaaacu

SEQ ID NO: 2808383 - RNA, 21 nt, Listeria monocytogenes EGD-e
ugguaaaaaacuguuguucuu

SEQ ID NO: 2808384 - RNA, 15 nt, Listeria monocytogenes EGD-e
ugguaagccauuucu

SEQ ID NO: 2808385 - RNA, 23 nt, Listeria monocytogenes EGD-e
ugguacuugugaaaguuuuauga

SEQ ID NO: 2808386 - RNA, 16 nt, Listeria monocytogenes EGD-e
ugguccaucaaauuau

SEQ ID NO: 2808387 - RNA, 19 nt, Listeria monocytogenes EGD-e
ugguccaucaaauuaucua

SEQ ID NO: 2808388 - RNA, 15 nt, Listeria monocytogenes EGD-e
ugguccugcugaaau

SEQ ID NO: 2808389 - RNA, 16 nt, Listeria monocytogenes EGD-e
ugguguaggaagugau

SEQ ID NO: 2808390 - RNA, 21 nt, Listeria monocytogenes EGD-e
ugguguggaaauaaccauucc

SEQ ID NO: 2808391 - RNA, 12 nt, Listeria monocytogenes EGD-e
ugguuauuucuu

SEQ ID NO: 2808392 - RNA, 13 nt, Listeria monocytogenes EGD-e
ugguucaaaaaga

SEQ ID NO: 2808393 - RNA, 14 nt, Listeria monocytogenes EGD-e
ugguuguucuuuua

SEQ ID NO: 2808394 - RNA, 19 nt, Listeria monocytogenes EGD-e
ugguuuacucccuuuuucc

SEQ ID NO: 2808395 - RNA, 21 nt, Listeria monocytogenes EGD-e
ugguuucuuguugaauaacau

SEQ ID NO: 2808396 - RNA, 23 nt, Listeria monocytogenes EGD-e
ugguuuuacaccauuuuguucua

SEQ ID NO: 2808397 - RNA, 20 nt, Listeria monocytogenes EGD-e
uguaaacgcaguauguuucg

SEQ ID NO: 2808398 - RNA, 17 nt, Listeria monocytogenes EGD-e
uguaaaggauaaaaauu

SEQ ID NO: 2808399 - RNA, 22 nt, Listeria monocytogenes EGD-e
uguaaaugaauaggcacuaauu

SEQ ID NO: 2808400 - RNA, 18 nt, Listeria monocytogenes EGD-e
uguaacaacuaauuuuuc

SEQ ID NO: 2808401 - RNA, 20 nt, Listeria monocytogenes EGD-e
uguaacugugcggaaaucuu

SEQ ID NO: 2808402 - RNA, 23 nt, Listeria monocytogenes EGD-e
uguaacugugcggaaaucuugau

SEQ ID NO: 2808403 - RNA, 22 nt, Listeria monocytogenes EGD-e
uguaagguuuuuuuaugcauaa

SEQ ID NO: 2808404 - RNA, 17 nt, Listeria monocytogenes EGD-e
uguaaucuguaaaaaua

SEQ ID NO: 2808405 - RNA, 18 nt, Listeria monocytogenes EGD-e
uguaaucuguaaaaauaa

SEQ ID NO: 2808406 - RNA, 12 nt, Listeria monocytogenes EGD-e
uguacauaaaag

SEQ ID NO: 2808407 - RNA, 22 nt, Listeria monocytogenes EGD-e
uguaccggucugugauuacucc

SEQ ID NO: 2808408 - RNA, 13 nt, Listeria monocytogenes EGD-e
uguaccuuauuaa

SEQ ID NO: 2808409 - RNA, 15 nt, Listeria monocytogenes EGD-e
uguaggaagugaugu

SEQ ID NO: 2808410 - RNA, 22 nt, Listeria monocytogenes EGD-e
uguaguuauagcggucaaucau

SEQ ID NO: 2808411 - RNA, 20 nt, Listeria monocytogenes EGD-e
uguaguuucaagauuagcca

SEQ ID NO: 2808412 - RNA, 17 nt, Listeria monocytogenes EGD-e
uguaguuucgauaucuu

SEQ ID NO: 2808413 - RNA, 19 nt, Listeria monocytogenes EGD-e
uguauauguuuuauuuaua

SEQ ID NO: 2808414 - RNA, 12 nt, Listeria monocytogenes EGD-e
uguaucaaugau

SEQ ID NO: 2808415 - RNA, 13 nt, Listeria monocytogenes EGD-e
uguaucuaaaauc

SEQ ID NO: 2808416 - RNA, 16 nt, Listeria monocytogenes EGD-e
uguauuaaugacuguu

SEQ ID NO: 2808417 - RNA, 15 nt, Listeria monocytogenes EGD-e
uguauugguuucuug

SEQ ID NO: 2808418 - RNA, 15 nt, Listeria monocytogenes EGD-e
ugucaaauucuucuc

SEQ ID NO: 2808419 - RNA, 21 nt, Listeria monocytogenes EGD-e
ugucacaucuguuccuuugcu

SEQ ID NO: 2808420 - RNA, 21 nt, Listeria monocytogenes EGD-e
ugucacuuggaaaagagaaaa

SEQ ID NO: 2808421 - RNA, 16 nt, Listeria monocytogenes EGD-e
ugucaucauaaacauu

SEQ ID NO: 2808422 - RNA, 16 nt, Listeria monocytogenes EGD-e
uguccaagcacagcaa

SEQ ID NO: 2808423 - RNA, 19 nt, Listeria monocytogenes EGD-e
ugucccaagauucuucuaa

SEQ ID NO: 2808424 - RNA, 17 nt, Listeria monocytogenes EGD-e
uguccuaggcgcucuuu

SEQ ID NO: 2808425 - RNA, 21 nt, Listeria monocytogenes EGD-e
uguccuucgauuguagcuucu

SEQ ID NO: 2808426 - RNA, 16 nt, Listeria monocytogenes EGD-e
ugucgcacguuuuagu

SEQ ID NO: 2808427 - RNA, 20 nt, Listeria monocytogenes EGD-e
ugucuagguuuucuuuuuuc

SEQ ID NO: 2808428 - RNA, 19 nt, Listeria monocytogenes EGD-e
ugucuuaaaugacaaagcu

SEQ ID NO: 2808429 - RNA, 14 nt, Listeria monocytogenes EGD-e
ugucuucggauuuu

SEQ ID NO: 2808430 - RNA, 23 nt, Listeria monocytogenes EGD-e
ugucuucggauuuuucaaaucaa

SEQ ID NO: 2808431 - RNA, 23 nt, Listeria monocytogenes EGD-e
ugucuucuggaucacuauauaag

SEQ ID NO: 2808432 - RNA, 14 nt, Listeria monocytogenes EGD-e
ugucuuggaagaac

SEQ ID NO: 2808433 - RNA, 16 nt, Listeria monocytogenes EGD-e
ugugcucuuugcuuca

SEQ ID NO: 2808434 - RNA, 20 nt, Listeria monocytogenes EGD-e
uguguucgcauugauuuuug

SEQ ID NO: 2808435 - RNA, 16 nt, Listeria monocytogenes EGD-e
uguuaauaaaaucauu

SEQ ID NO: 2808436 - RNA, 18 nt, Listeria monocytogenes EGD-e
uguucaggguuuguucca

SEQ ID NO: 2808437 - RNA, 15 nt, Listeria monocytogenes EGD-e
uguucauuacuucag

SEQ ID NO: 2808438 - RNA, 17 nt, Listeria monocytogenes EGD-e
uguucauuacuucagcc

SEQ ID NO: 2808439 - RNA, 17 nt, Listeria monocytogenes EGD-e
uguuccuuugcuaucaa

SEQ ID NO: 2808440 - RNA, 23 nt, Listeria monocytogenes EGD-e
uguucuaaaauaucaucaauuaa

SEQ ID NO: 2808441 - RNA, 17 nt, Listeria monocytogenes EGD-e
uguucuaauaauuuuaa

SEQ ID NO: 2808442 - RNA, 19 nt, Listeria monocytogenes EGD-e
uguucuaauaauuuuaauu

SEQ ID NO: 2808443 - RNA, 16 nt, Listeria monocytogenes EGD-e
uguugaacggaaaaug

SEQ ID NO: 2808444 - RNA, 18 nt, Listeria monocytogenes EGD-e
uguugcaccaaaaauacg

SEQ ID NO: 2808445 - RNA, 20 nt, Listeria monocytogenes EGD-e
uguugcagcccaaccuauuu

SEQ ID NO: 2808446 - RNA, 16 nt, Listeria monocytogenes EGD-e
uguugcgccacuucua

SEQ ID NO: 2808447 - RNA, 22 nt, Listeria monocytogenes EGD-e
uguugguguggaaauaaccauu

SEQ ID NO: 2808448 - RNA, 15 nt, Listeria monocytogenes EGD-e
uguuguaccauaagc

SEQ ID NO: 2808449 - RNA, 14 nt, Listeria monocytogenes EGD-e
uguugucaauguau

SEQ ID NO: 2808450 - RNA, 20 nt, Listeria monocytogenes EGD-e
uguugucaauguauacagga

SEQ ID NO: 2808451 - RNA, 13 nt, Listeria monocytogenes EGD-e
uguuguuuuagau

SEQ ID NO: 2808452 - RNA, 16 nt, Listeria monocytogenes EGD-e
uguuguuuugguacaa

SEQ ID NO: 2808453 - RNA, 18 nt, Listeria monocytogenes EGD-e
uguuuaaucuaaaucuag

SEQ ID NO: 2808454 - RNA, 22 nt, Listeria monocytogenes EGD-e
uguuuacgaacgauuuccgcaa

SEQ ID NO: 2808455 - RNA, 16 nt, Listeria monocytogenes EGD-e
uguuuagccuuuuauc

SEQ ID NO: 2808456 - RNA, 13 nt, Listeria monocytogenes EGD-e
uguuuagcugcua

SEQ ID NO: 2808457 - RNA, 18 nt, Listeria monocytogenes EGD-e
uguuuaggauauuuuuuu

SEQ ID NO: 2808458 - RNA, 19 nt, Listeria monocytogenes EGD-e
uguuuauccguuaaucuga

SEQ ID NO: 2808459 - RNA, 19 nt, Listeria monocytogenes EGD-e
uguuuauucauauaaaguu

SEQ ID NO: 2808460 - RNA, 12 nt, Listeria monocytogenes EGD-e
uguuuauuuaau

SEQ ID NO: 2808461 - RNA, 14 nt, Listeria monocytogenes EGD-e
uguuucauauaauu

SEQ ID NO: 2808462 - RNA, 15 nt, Listeria monocytogenes EGD-e
uguuucauuuuucca

SEQ ID NO: 2808463 - RNA, 11 nt, Listeria monocytogenes EGD-e
uguuucuuuug

SEQ ID NO: 2808464 - RNA, 13 nt, Listeria monocytogenes EGD-e
uguuucuuuuguu

SEQ ID NO: 2808465 - RNA, 18 nt, Listeria monocytogenes EGD-e
uguuuguaaaaauagcuu

SEQ ID NO: 2808466 - RNA, 15 nt, Listeria monocytogenes EGD-e
uguuuuauuuauaga

SEQ ID NO: 2808467 - RNA, 16 nt, Listeria monocytogenes EGD-e
uguuuuauuuauagau

SEQ ID NO: 2808468 - RNA, 22 nt, Listeria monocytogenes EGD-e
uguuuucccagaaaaaaacaaa

SEQ ID NO: 2808469 - RNA, 14 nt, Listeria monocytogenes EGD-e
uguuuucgauauuu

SEQ ID NO: 2808470 - RNA, 17 nt, Listeria monocytogenes EGD-e
uguuuucgauauuuuuu

SEQ ID NO: 2808471 - RNA, 13 nt, Listeria monocytogenes EGD-e
uguuuuuauuuau

SEQ ID NO: 2808472 - RNA, 13 nt, Listeria monocytogenes EGD-e
uguuuuugcuucu

SEQ ID NO: 2808473 - RNA, 18 nt, Listeria monocytogenes EGD-e
uguuuuuucuuugucuug

SEQ ID NO: 2808474 - RNA, 17 nt, Listeria monocytogenes EGD-e
uuaaaaacaguuucuuu

SEQ ID NO: 2808475 - RNA, 18 nt, Listeria monocytogenes EGD-e
uuaaaaggacacccauaa

SEQ ID NO: 2808476 - RNA, 20 nt, Listeria monocytogenes EGD-e
uuaaaaggacacccauaaua

SEQ ID NO: 2808477 - RNA, 20 nt, Listeria monocytogenes EGD-e
uuaaaaguugaccgcaaaua

SEQ ID NO: 2808478 - RNA, 16 nt, Listeria monocytogenes EGD-e
uuaaaauccaauaaua

SEQ ID NO: 2808479 - RNA, 13 nt, Listeria monocytogenes EGD-e
uuaaaauucuauu

SEQ ID NO: 2808480 - RNA, 18 nt, Listeria monocytogenes EGD-e
uuaaaccgauaauuuuca

SEQ ID NO: 2808481 - RNA, 21 nt, Listeria monocytogenes EGD-e
uuaaagcguuuuucugcaucc

SEQ ID NO: 2808482 - RNA, 16 nt, Listeria monocytogenes EGD-e
uuaaauacgaaaaaca

SEQ ID NO: 2808483 - RNA, 20 nt, Listeria monocytogenes EGD-e
uuaaauaguaguuauuucuu

SEQ ID NO: 2808484 - RNA, 22 nt, Listeria monocytogenes EGD-e
uuaaauaguaguuauuucuuua

SEQ ID NO: 2808485 - RNA, 22 nt, Listeria monocytogenes EGD-e
uuaaauauaacuuuuuuucuua

SEQ ID NO: 2808486 - RNA, 20 nt, Listeria monocytogenes EGD-e
uuaaauauacacaaaguaaa

SEQ ID NO: 2808487 - RNA, 18 nt, Listeria monocytogenes EGD-e
uuaaaugauuuuuaucua

SEQ ID NO: 2808488 - RNA, 19 nt, Listeria monocytogenes EGD-e
uuaaauuuuuuugaaaaaa

SEQ ID NO: 2808489 - RNA, 20 nt, Listeria monocytogenes EGD-e
uuaaauuuuuuugaaaaaac

SEQ ID NO: 2808490 - RNA, 21 nt, Listeria monocytogenes EGD-e
uuaaauuuuuuugaaaaaaca

SEQ ID NO: 2808491 - RNA, 14 nt, Listeria monocytogenes EGD-e
uuaacauaaaaagc

SEQ ID NO: 2808492 - RNA, 20 nt, Listeria monocytogenes EGD-e
uuaacaucagauuaaauaua

SEQ ID NO: 2808493 - RNA, 13 nt, Listeria monocytogenes EGD-e
uuaacccaauuuu

SEQ ID NO: 2808494 - RNA, 17 nt, Listeria monocytogenes EGD-e
uuaaccuacuuuaauuu

SEQ ID NO: 2808495 - RNA, 22 nt, Listeria monocytogenes EGD-e
uuaacguauuggguuugauaau

SEQ ID NO: 2808496 - RNA, 16 nt, Listeria monocytogenes EGD-e
uuaaguuuacaaugga

SEQ ID NO: 2808497 - RNA, 22 nt, Listeria monocytogenes EGD-e
uuaauaaugauuucuauaaaaa

SEQ ID NO: 2808498 - RNA, 15 nt, Listeria monocytogenes EGD-e
uuaauacggugaaug

SEQ ID NO: 2808499 - RNA, 12 nt, Listeria monocytogenes EGD-e
uuaauauaaaga

SEQ ID NO: 2808500 - RNA, 21 nt, Listeria monocytogenes EGD-e
uuaauauccacccuagcuaua

SEQ ID NO: 2808501 - RNA, 14 nt, Listeria monocytogenes EGD-e
uuaauaugcauuca

SEQ ID NO: 2808502 - RNA, 22 nt, Listeria monocytogenes EGD-e
uuaaucauuaaauauacacaaa

SEQ ID NO: 2808503 - RNA, 12 nt, Listeria monocytogenes EGD-e
uuaaucauugcu

SEQ ID NO: 2808504 - RNA, 15 nt, Listeria monocytogenes EGD-e
uuaaucuaaaucuag

SEQ ID NO: 2808505 - RNA, 11 nt, Listeria monocytogenes EGD-e
uuaaugccagu

SEQ ID NO: 2808506 - RNA, 18 nt, Listeria monocytogenes EGD-e
uuaaugccaguauuuuga

SEQ ID NO: 2808507 - RNA, 17 nt, Listeria monocytogenes EGD-e
uuaauuauggcauaaaa

SEQ ID NO: 2808508 - RNA, 19 nt, Listeria monocytogenes EGD-e
uuaauucgcggucaugagc

SEQ ID NO: 2808509 - RNA, 12 nt, Listeria monocytogenes EGD-e
uuaauuuaauuu

SEQ ID NO: 2808510 - RNA, 23 nt, Listeria monocytogenes EGD-e
uuaauuugguccaucaaauuauc

SEQ ID NO: 2808511 - RNA, 13 nt, Listeria monocytogenes EGD-e
uuaauuuuccgca

SEQ ID NO: 2808512 - RNA, 14 nt, Listeria monocytogenes EGD-e
uuacaccauuuugu

SEQ ID NO: 2808513 - RNA, 16 nt, Listeria monocytogenes EGD-e
uuaccuugaucaaaau

SEQ ID NO: 2808514 - RNA, 23 nt, Listeria monocytogenes EGD-e
uuaccuuucguuuuuacuuacaa

SEQ ID NO: 2808515 - RNA, 15 nt, Listeria monocytogenes EGD-e
uuacgcauaucauca

SEQ ID NO: 2808516 - RNA, 16 nt, Listeria monocytogenes EGD-e
uuacgcauaucaucaa

SEQ ID NO: 2808517 - RNA, 20 nt, Listeria monocytogenes EGD-e
uuacgcauaucaucaauaaa

SEQ ID NO: 2808518 - RNA, 20 nt, Listeria monocytogenes EGD-e
uuacguaauaggauuuuacu

SEQ ID NO: 2808519 - RNA, 19 nt, Listeria monocytogenes EGD-e
uuacuacauuuuguugaac

SEQ ID NO: 2808520 - RNA, 21 nt, Listeria monocytogenes EGD-e
uuacuacauuuuguugaacuu

SEQ ID NO: 2808521 - RNA, 14 nt, Listeria monocytogenes EGD-e
uuacuauuuggaua

SEQ ID NO: 2808522 - RNA, 13 nt, Listeria monocytogenes EGD-e
uuacuccaaaaua

SEQ ID NO: 2808523 - RNA, 11 nt, Listeria monocytogenes EGD-e
uuacucccuuu

SEQ ID NO: 2808524 - RNA, 21 nt, Listeria monocytogenes EGD-e
uuacugguuuuucuuuuccua

SEQ ID NO: 2808525 - RNA, 23 nt, Listeria monocytogenes EGD-e
uuacuuacaaaaguggaaauguu

SEQ ID NO: 2808526 - RNA, 15 nt, Listeria monocytogenes EGD-e
uuacuugcaaaugcu

SEQ ID NO: 2808527 - RNA, 22 nt, Listeria monocytogenes EGD-e
uuagaagaugcacuagaaaaau

SEQ ID NO: 2808528 - RNA, 13 nt, Listeria monocytogenes EGD-e
uuagaaugaagau

SEQ ID NO: 2808529 - RNA, 14 nt, Listeria monocytogenes EGD-e
uuagacaaaaagaa

SEQ ID NO: 2808530 - RNA, 15 nt, Listeria monocytogenes EGD-e
uuagacaaaaagaaa

SEQ ID NO: 2808531 - RNA, 17 nt, Listeria monocytogenes EGD-e
uuagaggcguacuaaaa

SEQ ID NO: 2808532 - RNA, 19 nt, Listeria monocytogenes EGD-e
uuagaggcguacuaaaaau

SEQ ID NO: 2808533 - RNA, 19 nt, Listeria monocytogenes EGD-e
uuagcuauuuuuuugcuuu

SEQ ID NO: 2808534 - RNA, 13 nt, Listeria monocytogenes EGD-e
uuaguaaacauuu

SEQ ID NO: 2808535 - RNA, 13 nt, Listeria monocytogenes EGD-e
uuaguauuucagc

SEQ ID NO: 2808536 - RNA, 14 nt, Listeria monocytogenes EGD-e
uuaguauuucccag

SEQ ID NO: 2808537 - RNA, 22 nt, Listeria monocytogenes EGD-e
uuaguggagcucuuucuucuac

SEQ ID NO: 2808538 - RNA, 23 nt, Listeria monocytogenes EGD-e
uuaguuacuccuccaaauuauaa

SEQ ID NO: 2808539 - RNA, 18 nt, Listeria monocytogenes EGD-e
uuaguucguuuauuuuga

SEQ ID NO: 2808540 - RNA, 21 nt, Listeria monocytogenes EGD-e
uuauaaaaaguggcuuccaca

SEQ ID NO: 2808541 - RNA, 15 nt, Listeria monocytogenes EGD-e
uuauaaaagcuucua

SEQ ID NO: 2808542 - RNA, 18 nt, Listeria monocytogenes EGD-e
uuauaaauaccuguuucu

SEQ ID NO: 2808543 - RNA, 16 nt, Listeria monocytogenes EGD-e
uuauaaccccaaaaug

SEQ ID NO: 2808544 - RNA, 15 nt, Listeria monocytogenes EGD-e
uuauaaugcagauua

SEQ ID NO: 2808545 - RNA, 23 nt, Listeria monocytogenes EGD-e
uuauaccuaaagcaucgaauacu

SEQ ID NO: 2808546 - RNA, 19 nt, Listeria monocytogenes EGD-e
uuauagcaucuuggcauga

SEQ ID NO: 2808547 - RNA, 13 nt, Listeria monocytogenes EGD-e
uuauagcggucaa

SEQ ID NO: 2808548 - RNA, 16 nt, Listeria monocytogenes EGD-e
uuauagguaacaucuu

SEQ ID NO: 2808549 - RNA, 14 nt, Listeria monocytogenes EGD-e
uuauaguuuucuac

SEQ ID NO: 2808550 - RNA, 23 nt, Listeria monocytogenes EGD-e
uuauaugaaaacuuaucucuuca

SEQ ID NO: 2808551 - RNA, 17 nt, Listeria monocytogenes EGD-e
uuauauucuucugucac

SEQ ID NO: 2808552 - RNA, 19 nt, Listeria monocytogenes EGD-e
uuaucaaacaaaaaaguuc

SEQ ID NO: 2808553 - RNA, 17 nt, Listeria monocytogenes EGD-e
uuaucaaguaauaagaa

SEQ ID NO: 2808554 - RNA, 13 nt, Listeria monocytogenes EGD-e
uuaucaauaauag

SEQ ID NO: 2808555 - RNA, 17 nt, Listeria monocytogenes EGD-e
uuaucgccaaagccagu

SEQ ID NO: 2808556 - RNA, 14 nt, Listeria monocytogenes EGD-e
uuaucuaaaucuuu

SEQ ID NO: 2808557 - RNA, 18 nt, Listeria monocytogenes EGD-e
uuaucucuucauuuuucu

SEQ ID NO: 2808558 - RNA, 12 nt, Listeria monocytogenes EGD-e
uuaucuggcagu

SEQ ID NO: 2808559 - RNA, 18 nt, Listeria monocytogenes EGD-e
uuaugaagugauguaucu

SEQ ID NO: 2808560 - RNA, 20 nt, Listeria monocytogenes EGD-e
uuaugagaguuauaaagaaa

SEQ ID NO: 2808561 - RNA, 23 nt, Listeria monocytogenes EGD-e
uuaugagaguuauaaagaaauaa

SEQ ID NO: 2808562 - RNA, 19 nt, Listeria monocytogenes EGD-e
uuaugauuuguuucugguu

SEQ ID NO: 2808563 - RNA, 12 nt, Listeria monocytogenes EGD-e
uuauuaaaagga

SEQ ID NO: 2808564 - RNA, 16 nt, Listeria monocytogenes EGD-e
uuauuaaacucauaac

SEQ ID NO: 2808565 - RNA, 13 nt, Listeria monocytogenes EGD-e
uuauuacuuuauu

SEQ ID NO: 2808566 - RNA, 12 nt, Listeria monocytogenes EGD-e
uuauuauaaaaa

SEQ ID NO: 2808567 - RNA, 13 nt, Listeria monocytogenes EGD-e
uuauucaauuccc

SEQ ID NO: 2808568 - RNA, 20 nt, Listeria monocytogenes EGD-e
uuauucacgguguugaauaa

SEQ ID NO: 2808569 - RNA, 15 nt, Listeria monocytogenes EGD-e
uuauuucaagguuca

SEQ ID NO: 2808570 - RNA, 13 nt, Listeria monocytogenes EGD-e
uuauuuuuuauuu

SEQ ID NO: 2808571 - RNA, 11 nt, Listeria monocytogenes EGD-e
uucaaaaagau

SEQ ID NO: 2808572 - RNA, 20 nt, Listeria monocytogenes EGD-e
uucaaaaagauuauggaaaa

SEQ ID NO: 2808573 - RNA, 22 nt, Listeria monocytogenes EGD-e
uucaaacgaucagccauuuuac

SEQ ID NO: 2808574 - RNA, 14 nt, Listeria monocytogenes EGD-e
uucaaagcuacuuu

SEQ ID NO: 2808575 - RNA, 12 nt, Listeria monocytogenes EGD-e
uucaaaucaauu

SEQ ID NO: 2808576 - RNA, 18 nt, Listeria monocytogenes EGD-e
uucaaaucaccacaaagg

SEQ ID NO: 2808577 - RNA, 19 nt, Listeria monocytogenes EGD-e
uucaaaucaccacaaagga

SEQ ID NO: 2808578 - RNA, 13 nt, Listeria monocytogenes EGD-e
uucaacaaaacaa

SEQ ID NO: 2808579 - RNA, 14 nt, Listeria monocytogenes EGD-e
uucaacaaucugaa

SEQ ID NO: 2808580 - RNA, 15 nt, Listeria monocytogenes EGD-e
uucaaccaagcaaua

SEQ ID NO: 2808581 - RNA, 13 nt, Listeria monocytogenes EGD-e
uucaaccaauucu

SEQ ID NO: 2808582 - RNA, 20 nt, Listeria monocytogenes EGD-e
uucaacuaaacgaccaucug

SEQ ID NO: 2808583 - RNA, 17 nt, Listeria monocytogenes EGD-e
uucaacuccccagugaa

SEQ ID NO: 2808584 - RNA, 15 nt, Listeria monocytogenes EGD-e
uucaagaccaagaac

SEQ ID NO: 2808585 - RNA, 15 nt, Listeria monocytogenes EGD-e
uucaagcauauuaau

SEQ ID NO: 2808586 - RNA, 17 nt, Listeria monocytogenes EGD-e
uucaagcauuucauaau

SEQ ID NO: 2808587 - RNA, 20 nt, Listeria monocytogenes EGD-e
uucaaguaaaaacaauaaca

SEQ ID NO: 2808588 - RNA, 18 nt, Listeria monocytogenes EGD-e
uucaagugauacaaugug

SEQ ID NO: 2808589 - RNA, 15 nt, Listeria monocytogenes EGD-e
uucaaucaagccuag

SEQ ID NO: 2808590 - RNA, 17 nt, Listeria monocytogenes EGD-e
uucaaucuguuccaaca

SEQ ID NO: 2808591 - RNA, 19 nt, Listeria monocytogenes EGD-e
uucaaucuguuccaacaua

SEQ ID NO: 2808592 - RNA, 14 nt, Listeria monocytogenes EGD-e
uucaauugcuucuu

SEQ ID NO: 2808593 - RNA, 13 nt, Listeria monocytogenes EGD-e
uucaauuuuauuu

SEQ ID NO: 2808594 - RNA, 16 nt, Listeria monocytogenes EGD-e
uucaauuuuauuuggu

SEQ ID NO: 2808595 - RNA, 20 nt, Listeria monocytogenes EGD-e
uucacaaguaacucuuccaa

SEQ ID NO: 2808596 - RNA, 21 nt, Listeria monocytogenes EGD-e
uucacaaguaacucuuccaaa

SEQ ID NO: 2808597 - RNA, 22 nt, Listeria monocytogenes EGD-e
uucacacgauaccaaaguuguc

SEQ ID NO: 2808598 - RNA, 13 nt, Listeria monocytogenes EGD-e
uucaccaaaugcu

SEQ ID NO: 2808599 - RNA, 20 nt, Listeria monocytogenes EGD-e
uucaccacuucuuccaccug

SEQ ID NO: 2808600 - RNA, 13 nt, Listeria monocytogenes EGD-e
uucacugcauaaa

SEQ ID NO: 2808601 - RNA, 16 nt, Listeria monocytogenes EGD-e
uucacugcauaaaaaa

SEQ ID NO: 2808602 - RNA, 17 nt, Listeria monocytogenes EGD-e
uucacuggagcugauuu

SEQ ID NO: 2808603 - RNA, 19 nt, Listeria monocytogenes EGD-e
uucacugugaacugauuuu

SEQ ID NO: 2808604 - RNA, 18 nt, Listeria monocytogenes EGD-e
uucacuucgaaaguaaaa

SEQ ID NO: 2808605 - RNA, 22 nt, Listeria monocytogenes EGD-e
uucagcaauguaggcauuguau

SEQ ID NO: 2808606 - RNA, 16 nt, Listeria monocytogenes EGD-e
uucagcuaaauauuua

SEQ ID NO: 2808607 - RNA, 13 nt, Listeria monocytogenes EGD-e
uucagcucuuuuu

SEQ ID NO: 2808608 - RNA, 19 nt, Listeria monocytogenes EGD-e
uucauaaacaaaagauuca

SEQ ID NO: 2808609 - RNA, 21 nt, Listeria monocytogenes EGD-e
uucauaauggaaaaauaauca

SEQ ID NO: 2808610 - RNA, 14 nt, Listeria monocytogenes EGD-e
uucauauaaguguu

SEQ ID NO: 2808611 - RNA, 14 nt, Listeria monocytogenes EGD-e
uucaucgcaaaaug

SEQ ID NO: 2808612 - RNA, 17 nt, Listeria monocytogenes EGD-e
uucaucguuuaacauau

SEQ ID NO: 2808613 - RNA, 22 nt, Listeria monocytogenes EGD-e
uucaugacgcgcaucuucguau

SEQ ID NO: 2808614 - RNA, 11 nt, Listeria monocytogenes EGD-e
uucaugcaagc

SEQ ID NO: 2808615 - RNA, 22 nt, Listeria monocytogenes EGD-e
uucaugcaagcgcagaaugaag

SEQ ID NO: 2808616 - RNA, 23 nt, Listeria monocytogenes EGD-e
uucauuagacaaaaagaaaaaac

SEQ ID NO: 2808617 - RNA, 20 nt, Listeria monocytogenes EGD-e
uucauucccacaucgcuucu

SEQ ID NO: 2808618 - RNA, 12 nt, Listeria monocytogenes EGD-e
uucauucuuuuu

SEQ ID NO: 2808619 - RNA, 14 nt, Listeria monocytogenes EGD-e
uucauuucaucuuu

SEQ ID NO: 2808620 - RNA, 18 nt, Listeria monocytogenes EGD-e
uucauuuucuauuccucc

SEQ ID NO: 2808621 - RNA, 13 nt, Listeria monocytogenes EGD-e
uucauuuuuccaa

SEQ ID NO: 2808622 - RNA, 16 nt, Listeria monocytogenes EGD-e
uuccaaaaauagcuuu

SEQ ID NO: 2808623 - RNA, 20 nt, Listeria monocytogenes EGD-e
uuccaaucggggaaauaguu

SEQ ID NO: 2808624 - RNA, 13 nt, Listeria monocytogenes EGD-e
uuccacaucgaug

SEQ ID NO: 2808625 - RNA, 19 nt, Listeria monocytogenes EGD-e
uuccacauuguagcgauuc

SEQ ID NO: 2808626 - RNA, 14 nt, Listeria monocytogenes EGD-e
uuccacuuuuaaag

SEQ ID NO: 2808627 - RNA, 23 nt, Listeria monocytogenes EGD-e
uuccagcuaaguuuucuaaacua

SEQ ID NO: 2808628 - RNA, 19 nt, Listeria monocytogenes EGD-e
uuccagcuguaucaaugau

SEQ ID NO: 2808629 - RNA, 16 nt, Listeria monocytogenes EGD-e
uuccaguggcugaaac

SEQ ID NO: 2808630 - RNA, 15 nt, Listeria monocytogenes EGD-e
uuccaucuucuaaug

SEQ ID NO: 2808631 - RNA, 15 nt, Listeria monocytogenes EGD-e
uuccaugacaucuuc

SEQ ID NO: 2808632 - RNA, 16 nt, Listeria monocytogenes EGD-e
uuccauuaaaucauaa

SEQ ID NO: 2808633 - RNA, 12 nt, Listeria monocytogenes EGD-e
uuccauuuaauu

SEQ ID NO: 2808634 - RNA, 17 nt, Listeria monocytogenes EGD-e
uucccacagaucaaaag

SEQ ID NO: 2808635 - RNA, 22 nt, Listeria monocytogenes EGD-e
uucccacagaucaaaagcaaaa

SEQ ID NO: 2808636 - RNA, 13 nt, Listeria monocytogenes EGD-e
uucccagaaaaaa

SEQ ID NO: 2808637 - RNA, 14 nt, Listeria monocytogenes EGD-e
uucccaucauaucu

SEQ ID NO: 2808638 - RNA, 16 nt, Listeria monocytogenes EGD-e
uuccccaccaagguaa

SEQ ID NO: 2808639 - RNA, 18 nt, Listeria monocytogenes EGD-e
uuccgauacaacaaaaua

SEQ ID NO: 2808640 - RNA, 18 nt, Listeria monocytogenes EGD-e
uuccgcucuuuuuuauga

SEQ ID NO: 2808641 - RNA, 22 nt, Listeria monocytogenes EGD-e
uuccgugaaauucuucgcuugu

SEQ ID NO: 2808642 - RNA, 13 nt, Listeria monocytogenes EGD-e
uuccguucauuug

SEQ ID NO: 2808643 - RNA, 20 nt, Listeria monocytogenes EGD-e
uuccucaaugaggaauacug

SEQ ID NO: 2808644 - RNA, 15 nt, Listeria monocytogenes EGD-e
uuccuccuaauuguu

SEQ ID NO: 2808645 - RNA, 14 nt, Listeria monocytogenes EGD-e
uuccucgacuucaa

SEQ ID NO: 2808646 - RNA, 15 nt, Listeria monocytogenes EGD-e
uuccuucaagcauuu

SEQ ID NO: 2808647 - RNA, 14 nt, Listeria monocytogenes EGD-e
uuccuucuaauacg

SEQ ID NO: 2808648 - RNA, 14 nt, Listeria monocytogenes EGD-e
uuccuuuacagaaa

SEQ ID NO: 2808649 - RNA, 15 nt, Listeria monocytogenes EGD-e
uuccuuuuguuuuaa

SEQ ID NO: 2808650 - RNA, 22 nt, Listeria monocytogenes EGD-e
uucgaaagcaaaugcauuucuc

SEQ ID NO: 2808651 - RNA, 17 nt, Listeria monocytogenes EGD-e
uucgaaaguuucuuuuu

SEQ ID NO: 2808652 - RNA, 15 nt, Listeria monocytogenes EGD-e
uucgacaguuucuuu

SEQ ID NO: 2808653 - RNA, 18 nt, Listeria monocytogenes EGD-e
uucgagcagcuccauuaa

SEQ ID NO: 2808654 - RNA, 17 nt, Listeria monocytogenes EGD-e
uucgaguuucuguucuu

SEQ ID NO: 2808655 - RNA, 14 nt, Listeria monocytogenes EGD-e
uucgauaucuucau

SEQ ID NO: 2808656 - RNA, 12 nt, Listeria monocytogenes EGD-e
uucgcaaucaau

SEQ ID NO: 2808657 - RNA, 15 nt, Listeria monocytogenes EGD-e
uucgccaauuugcga

SEQ ID NO: 2808658 - RNA, 14 nt, Listeria monocytogenes EGD-e
uucgccaccuucaa

SEQ ID NO: 2808659 - RNA, 16 nt, Listeria monocytogenes EGD-e
uucgccaccuucaauu

SEQ ID NO: 2808660 - RNA, 18 nt, Listeria monocytogenes EGD-e
uucgcuccguauuuauau

SEQ ID NO: 2808661 - RNA, 21 nt, Listeria monocytogenes EGD-e
uucgcucgucaaagcguucaa

SEQ ID NO: 2808662 - RNA, 17 nt, Listeria monocytogenes EGD-e
uucgcuguccauuccaa

SEQ ID NO: 2808663 - RNA, 20 nt, Listeria monocytogenes EGD-e
uucggaagauccgcgaauag

SEQ ID NO: 2808664 - RNA, 16 nt, Listeria monocytogenes EGD-e
uucggagacagaaaaa

SEQ ID NO: 2808665 - RNA, 18 nt, Listeria monocytogenes EGD-e
uucggauuuuucaaauca

SEQ ID NO: 2808666 - RNA, 12 nt, Listeria monocytogenes EGD-e
uucggcuucaaa

SEQ ID NO: 2808667 - RNA, 16 nt, Listeria monocytogenes EGD-e
uucgguauaaaacauc

SEQ ID NO: 2808668 - RNA, 21 nt, Listeria monocytogenes EGD-e
uucgguccuuguacuaauucu

SEQ ID NO: 2808669 - RNA, 14 nt, Listeria monocytogenes EGD-e
uucguacauuuuuu

SEQ ID NO: 2808670 - RNA, 19 nt, Listeria monocytogenes EGD-e
uucgugcgcaacauucaaa

SEQ ID NO: 2808671 - RNA, 13 nt, Listeria monocytogenes EGD-e
uucguuauuuccu

SEQ ID NO: 2808672 - RNA, 19 nt, Listeria monocytogenes EGD-e
uucguuucagcucuauaau

SEQ ID NO: 2808673 - RNA, 13 nt, Listeria monocytogenes EGD-e
uucguuuuuacuu

SEQ ID NO: 2808674 - RNA, 14 nt, Listeria monocytogenes EGD-e
uucuaagaaaaaaa

SEQ ID NO: 2808675 - RNA, 15 nt, Listeria monocytogenes EGD-e
uucuaguuuguccca

SEQ ID NO: 2808676 - RNA, 13 nt, Listeria monocytogenes EGD-e
uucuauuaauaau

SEQ ID NO: 2808677 - RNA, 14 nt, Listeria monocytogenes EGD-e
uucuauuccuccua

SEQ ID NO: 2808678 - RNA, 20 nt, Listeria monocytogenes EGD-e
uucuauuugucaaucuaaau

SEQ ID NO: 2808679 - RNA, 19 nt, Listeria monocytogenes EGD-e
uucucauaagcuucauaaa

SEQ ID NO: 2808680 - RNA, 17 nt, Listeria monocytogenes EGD-e
uucucccucauccuuuc

SEQ ID NO: 2808681 - RNA, 17 nt, Listeria monocytogenes EGD-e
uucucgaauaccagcag

SEQ ID NO: 2808682 - RNA, 16 nt, Listeria monocytogenes EGD-e
uucuguuaaaggagaa

SEQ ID NO: 2808683 - RNA, 12 nt, Listeria monocytogenes EGD-e
uucuguucuuua

SEQ ID NO: 2808684 - RNA, 14 nt, Listeria monocytogenes EGD-e
uucuguuuuuucuu

SEQ ID NO: 2808685 - RNA, 13 nt, Listeria monocytogenes EGD-e
uucuuaaauacga

SEQ ID NO: 2808686 - RNA, 14 nt, Listeria monocytogenes EGD-e
uucuuaagaauucc

SEQ ID NO: 2808687 - RNA, 22 nt, Listeria monocytogenes EGD-e
uucuuagaagaugcacuagaaa

SEQ ID NO: 2808688 - RNA, 20 nt, Listeria monocytogenes EGD-e
uucuuaguuaauucuuuuuc

SEQ ID NO: 2808689 - RNA, 16 nt, Listeria monocytogenes EGD-e
uucuucaacagcuuga

SEQ ID NO: 2808690 - RNA, 15 nt, Listeria monocytogenes EGD-e
uucuuccauuuguuc

SEQ ID NO: 2808691 - RNA, 23 nt, Listeria monocytogenes EGD-e
uucuuccauuuguucucuauauu

SEQ ID NO: 2808692 - RNA, 22 nt, Listeria monocytogenes EGD-e
uucuucgugcgcaacauucaaa

SEQ ID NO: 2808693 - RNA, 15 nt, Listeria monocytogenes EGD-e
uucuucuaaaauaac

SEQ ID NO: 2808694 - RNA, 16 nt, Listeria monocytogenes EGD-e
uucuucugucacaucu

SEQ ID NO: 2808695 - RNA, 20 nt, Listeria monocytogenes EGD-e
uucuugcuggucagaacgua

SEQ ID NO: 2808696 - RNA, 15 nt, Listeria monocytogenes EGD-e
uucuuuaaaauccaa

SEQ ID NO: 2808697 - RNA, 14 nt, Listeria monocytogenes EGD-e
uucuuuacauaauu

SEQ ID NO: 2808698 - RNA, 15 nt, Listeria monocytogenes EGD-e
uucuuuccccuuuuu

SEQ ID NO: 2808699 - RNA, 14 nt, Listeria monocytogenes EGD-e
uucuuucucguauu

SEQ ID NO: 2808700 - RNA, 14 nt, Listeria monocytogenes EGD-e
uucuuucuuuuguu

SEQ ID NO: 2808701 - RNA, 13 nt, Listeria monocytogenes EGD-e
uucuuuuaguucg

SEQ ID NO: 2808702 - RNA, 13 nt, Listeria monocytogenes EGD-e
uucuuuuccuaau

SEQ ID NO: 2808703 - RNA, 21 nt, Listeria monocytogenes EGD-e
uucuuuuguucgggcgaauaa

SEQ ID NO: 2808704 - RNA, 12 nt, Listeria monocytogenes EGD-e
uucuuuuguucu

SEQ ID NO: 2808705 - RNA, 13 nt, Listeria monocytogenes EGD-e
uucuuuuucuucu

SEQ ID NO: 2808706 - RNA, 17 nt, Listeria monocytogenes EGD-e
uucuuuuuuaauaauua

SEQ ID NO: 2808707 - RNA, 12 nt, Listeria monocytogenes EGD-e
uugaaaaaacau

SEQ ID NO: 2808708 - RNA, 12 nt, Listeria monocytogenes EGD-e
uugaaaacugaa

SEQ ID NO: 2808709 - RNA, 18 nt, Listeria monocytogenes EGD-e
uugaaaacugaacaaaga

SEQ ID NO: 2808710 - RNA, 13 nt, Listeria monocytogenes EGD-e
uugaacgaacgau

SEQ ID NO: 2808711 - RNA, 17 nt, Listeria monocytogenes EGD-e
uugaacggguuucccug

SEQ ID NO: 2808712 - RNA, 17 nt, Listeria monocytogenes EGD-e
uugaauaacuuuccagc

SEQ ID NO: 2808713 - RNA, 21 nt, Listeria monocytogenes EGD-e
uugaauaagcaacgguaaaca

SEQ ID NO: 2808714 - RNA, 23 nt, Listeria monocytogenes EGD-e
uugaauauccuaacuccugcauu

SEQ ID NO: 2808715 - RNA, 16 nt, Listeria monocytogenes EGD-e
uugaaugucacuucac

SEQ ID NO: 2808716 - RNA, 17 nt, Listeria monocytogenes EGD-e
uugaauguucuaaaaua

SEQ ID NO: 2808717 - RNA, 21 nt, Listeria monocytogenes EGD-e
uugacaaaaggacaagcccag

SEQ ID NO: 2808718 - RNA, 20 nt, Listeria monocytogenes EGD-e
uugaccagugugguuuacuc

SEQ ID NO: 2808719 - RNA, 18 nt, Listeria monocytogenes EGD-e
uugacgcaaggaaucuua

SEQ ID NO: 2808720 - RNA, 18 nt, Listeria monocytogenes EGD-e
uugacgcguggaaagaau

SEQ ID NO: 2808721 - RNA, 20 nt, Listeria monocytogenes EGD-e
uugagcgguuuuguuuccaa

SEQ ID NO: 2808722 - RNA, 13 nt, Listeria monocytogenes EGD-e
uugauaauaauca

SEQ ID NO: 2808723 - RNA, 20 nt, Listeria monocytogenes EGD-e
uugauaaucuacagguguau

SEQ ID NO: 2808724 - RNA, 15 nt, Listeria monocytogenes EGD-e
uugauacauauuuga

SEQ ID NO: 2808725 - RNA, 17 nt, Listeria monocytogenes EGD-e
uugauccaaguuuuuua

SEQ ID NO: 2808726 - RNA, 23 nt, Listeria monocytogenes EGD-e
uugauuaggcauuucuuugauua

SEQ ID NO: 2808727 - RNA, 12 nt, Listeria monocytogenes EGD-e
uugauuuaaaua

SEQ ID NO: 2808728 - RNA, 12 nt, Listeria monocytogenes EGD-e
uugauuuaauuu

SEQ ID NO: 2808729 - RNA, 17 nt, Listeria monocytogenes EGD-e
uugauuuguuuccagcg

SEQ ID NO: 2808730 - RNA, 21 nt, Listeria monocytogenes EGD-e
uugauuuguuuuauuacauua

SEQ ID NO: 2808731 - RNA, 23 nt, Listeria monocytogenes EGD-e
uugauuuguuuuauuacauuaag

SEQ ID NO: 2808732 - RNA, 17 nt, Listeria monocytogenes EGD-e
uugcaacaguuauuaaa

SEQ ID NO: 2808733 - RNA, 20 nt, Listeria monocytogenes EGD-e
uugcaacaguuauuaaaagg

SEQ ID NO: 2808734 - RNA, 21 nt, Listeria monocytogenes EGD-e
uugcaacaguuauuaaaagga

SEQ ID NO: 2808735 - RNA, 19 nt, Listeria monocytogenes EGD-e
uugcaagguaucgaacgcu

SEQ ID NO: 2808736 - RNA, 20 nt, Listeria monocytogenes EGD-e
uugcaaucccuauaaaaaca

SEQ ID NO: 2808737 - RNA, 21 nt, Listeria monocytogenes EGD-e
uugcaaucccuauaaaaacau

SEQ ID NO: 2808738 - RNA, 18 nt, Listeria monocytogenes EGD-e
uugcacaaaaugcaaaac

SEQ ID NO: 2808739 - RNA, 15 nt, Listeria monocytogenes EGD-e
uugcaccaaaaauac

SEQ ID NO: 2808740 - RNA, 23 nt, Listeria monocytogenes EGD-e
uugcacuauuugguugcuuguuu

SEQ ID NO: 2808741 - RNA, 21 nt, Listeria monocytogenes EGD-e
uugcauagugagaguuccauc

SEQ ID NO: 2808742 - RNA, 16 nt, Listeria monocytogenes EGD-e
uugcccaccgauaaua

SEQ ID NO: 2808743 - RNA, 19 nt, Listeria monocytogenes EGD-e
uugcggcaguaguuuacuu

SEQ ID NO: 2808744 - RNA, 13 nt, Listeria monocytogenes EGD-e
uugcggcuuguug

SEQ ID NO: 2808745 - RNA, 19 nt, Listeria monocytogenes EGD-e
uugcuacacccauaauauu

SEQ ID NO: 2808746 - RNA, 17 nt, Listeria monocytogenes EGD-e
uugcuaucaaccacuuu

SEQ ID NO: 2808747 - RNA, 19 nt, Listeria monocytogenes EGD-e
uugcuucaccaagaagagc

SEQ ID NO: 2808748 - RNA, 16 nt, Listeria monocytogenes EGD-e
uugcuuuaauuuggaa

SEQ ID NO: 2808749 - RNA, 22 nt, Listeria monocytogenes EGD-e
uugcuuuguguuaauaaaauca

SEQ ID NO: 2808750 - RNA, 16 nt, Listeria monocytogenes EGD-e
uuggacgagaaaugaa

SEQ ID NO: 2808751 - RNA, 17 nt, Listeria monocytogenes EGD-e
uuggacgagaaaugaau

SEQ ID NO: 2808752 - RNA, 17 nt, Listeria monocytogenes EGD-e
uuggacuaagaaugaac

SEQ ID NO: 2808753 - RNA, 21 nt, Listeria monocytogenes EGD-e
uuggagaaauggauugcaggu

SEQ ID NO: 2808754 - RNA, 20 nt, Listeria monocytogenes EGD-e
uuggcgcagaaauaucaaag

SEQ ID NO: 2808755 - RNA, 20 nt, Listeria monocytogenes EGD-e
uugggaauucguuauuuccu

SEQ ID NO: 2808756 - RNA, 21 nt, Listeria monocytogenes EGD-e
uugguacuugugaaaguuuua

SEQ ID NO: 2808757 - RNA, 16 nt, Listeria monocytogenes EGD-e
uugguaguuuuaaauu

SEQ ID NO: 2808758 - RNA, 15 nt, Listeria monocytogenes EGD-e
uugguccaucaaauu

SEQ ID NO: 2808759 - RNA, 21 nt, Listeria monocytogenes EGD-e
uugguguggaaauaaccauuc

SEQ ID NO: 2808760 - RNA, 14 nt, Listeria monocytogenes EGD-e
uugguuuuguccaa

SEQ ID NO: 2808761 - RNA, 18 nt, Listeria monocytogenes EGD-e
uuguaaaccguaacuguu

SEQ ID NO: 2808762 - RNA, 14 nt, Listeria monocytogenes EGD-e
uuguaauuucuuug

SEQ ID NO: 2808763 - RNA, 21 nt, Listeria monocytogenes EGD-e
uuguacauaaaagcaugaauu

SEQ ID NO: 2808764 - RNA, 20 nt, Listeria monocytogenes EGD-e
uuguaggguuuggaaaacau

SEQ ID NO: 2808765 - RNA, 15 nt, Listeria monocytogenes EGD-e
uuguauacuucaaaa

SEQ ID NO: 2808766 - RNA, 15 nt, Listeria monocytogenes EGD-e
uugucaaucuaaauu

SEQ ID NO: 2808767 - RNA, 16 nt, Listeria monocytogenes EGD-e
uugucaaucuaaauuu

SEQ ID NO: 2808768 - RNA, 14 nt, Listeria monocytogenes EGD-e
uugucacuuggaaa

SEQ ID NO: 2808769 - RNA, 22 nt, Listeria monocytogenes EGD-e
uugucauaaaacuuucacaagu

SEQ ID NO: 2808770 - RNA, 23 nt, Listeria monocytogenes EGD-e
uuguggcaacuucuggauuugcu

SEQ ID NO: 2808771 - RNA, 14 nt, Listeria monocytogenes EGD-e
uuguugucaaugua

SEQ ID NO: 2808772 - RNA, 14 nt, Listeria monocytogenes EGD-e
uuguuguucuaaua

SEQ ID NO: 2808773 - RNA, 15 nt, Listeria monocytogenes EGD-e
uuguuuaauaugcau

SEQ ID NO: 2808774 - RNA, 22 nt, Listeria monocytogenes EGD-e
uuguuucauauaauuuuuucau

SEQ ID NO: 2808775 - RNA, 11 nt, Listeria monocytogenes EGD-e
uuguuuuauuu

SEQ ID NO: 2808776 - RNA, 18 nt, Listeria monocytogenes EGD-e
uuguuuucccagaaaaaa

SEQ ID NO: 2808777 - RNA, 23 nt, Listeria monocytogenes EGD-e
uuguuuucccagaaaaaaacaaa

SEQ ID NO: 2808778 - RNA, 16 nt, Listeria monocytogenes EGD-e
uuuaaaauccaauaau

SEQ ID NO: 2808779 - RNA, 19 nt, Listeria monocytogenes EGD-e
uuuaaagcguuuuucugca

SEQ ID NO: 2808780 - RNA, 17 nt, Listeria monocytogenes EGD-e
uuuaaagcuuuuaaauu

SEQ ID NO: 2808781 - RNA, 12 nt, Listeria monocytogenes EGD-e
uuuaaauaaaca

SEQ ID NO: 2808782 - RNA, 18 nt, Listeria monocytogenes EGD-e
uuuaaauaguaguuauuu

SEQ ID NO: 2808783 - RNA, 21 nt, Listeria monocytogenes EGD-e
uuuaaauaguaguuauuucuu

SEQ ID NO: 2808784 - RNA, 17 nt, Listeria monocytogenes EGD-e
uuuaaauauaacuuuuu

SEQ ID NO: 2808785 - RNA, 20 nt, Listeria monocytogenes EGD-e
uuuaacauaaaaagcugcca

SEQ ID NO: 2808786 - RNA, 14 nt, Listeria monocytogenes EGD-e
uuuaauaaaucaua

SEQ ID NO: 2808787 - RNA, 21 nt, Listeria monocytogenes EGD-e
uuuaauaagcuugcacuugga

SEQ ID NO: 2808788 - RNA, 23 nt, Listeria monocytogenes EGD-e
uuuaauaggaaggagcagaaaaa

SEQ ID NO: 2808789 - RNA, 15 nt, Listeria monocytogenes EGD-e
uuuaaucuaaaucua

SEQ ID NO: 2808790 - RNA, 15 nt, Listeria monocytogenes EGD-e
uuuaauuaaaaguug

SEQ ID NO: 2808791 - RNA, 19 nt, Listeria monocytogenes EGD-e
uuuaauugucgaaaaccua

SEQ ID NO: 2808792 - RNA, 16 nt, Listeria monocytogenes EGD-e
uuuaauuuaauuuucc

SEQ ID NO: 2808793 - RNA, 20 nt, Listeria monocytogenes EGD-e
uuuacaauggaaugacaaaa

SEQ ID NO: 2808794 - RNA, 21 nt, Listeria monocytogenes EGD-e
uuuacaauggaaugacaaaau

SEQ ID NO: 2808795 - RNA, 12 nt, Listeria monocytogenes EGD-e
uuuacaccauuu

SEQ ID NO: 2808796 - RNA, 13 nt, Listeria monocytogenes EGD-e
uuuaccuugcucc

SEQ ID NO: 2808797 - RNA, 19 nt, Listeria monocytogenes EGD-e
uuuacgaacgauuuccgca

SEQ ID NO: 2808798 - RNA, 19 nt, Listeria monocytogenes EGD-e
uuuacgcauaucaucaaua

SEQ ID NO: 2808799 - RNA, 17 nt, Listeria monocytogenes EGD-e
uuuacucccuuuuucca

SEQ ID NO: 2808800 - RNA, 19 nt, Listeria monocytogenes EGD-e
uuuacuggcaacuucaaaa

SEQ ID NO: 2808801 - RNA, 22 nt, Listeria monocytogenes EGD-e
uuuagaaugaagaucccaaacu

SEQ ID NO: 2808802 - RNA, 18 nt, Listeria monocytogenes EGD-e
uuuagcaacuucacuaac

SEQ ID NO: 2808803 - RNA, 23 nt, Listeria monocytogenes EGD-e
uuuaguagagcuucuguuuuuuc

SEQ ID NO: 2808804 - RNA, 19 nt, Listeria monocytogenes EGD-e
uuuauaauuaacaaccauu

SEQ ID NO: 2808805 - RNA, 23 nt, Listeria monocytogenes EGD-e
uuuauaccuaaagcaucgaauac

SEQ ID NO: 2808806 - RNA, 22 nt, Listeria monocytogenes EGD-e
uuuauagagcgccgaguaucuu

SEQ ID NO: 2808807 - RNA, 23 nt, Listeria monocytogenes EGD-e
uuuauauagaaggaauuugccaa

SEQ ID NO: 2808808 - RNA, 21 nt, Listeria monocytogenes EGD-e
uuuaucaaacaaaaaaguucu

SEQ ID NO: 2808809 - RNA, 13 nt, Listeria monocytogenes EGD-e
uuuaucaauaaua

SEQ ID NO: 2808810 - RNA, 19 nt, Listeria monocytogenes EGD-e
uuuaucaggcuauaacaaa

SEQ ID NO: 2808811 - RNA, 22 nt, Listeria monocytogenes EGD-e
uuuauccguuaaucugauuaaa

SEQ ID NO: 2808812 - RNA, 12 nt, Listeria monocytogenes EGD-e
uuuaucuaaauc

SEQ ID NO: 2808813 - RNA, 18 nt, Listeria monocytogenes EGD-e
uuuaugacaauuaaaaac

SEQ ID NO: 2808814 - RNA, 18 nt, Listeria monocytogenes EGD-e
uuuaugcauaaaaaagca

SEQ ID NO: 2808815 - RNA, 13 nt, Listeria monocytogenes EGD-e
uuuauuauaagca

SEQ ID NO: 2808816 - RNA, 14 nt, Listeria monocytogenes EGD-e
uuuauuuaauaagc

SEQ ID NO: 2808817 - RNA, 13 nt, Listeria monocytogenes EGD-e
uuucaacaaaaca

SEQ ID NO: 2808818 - RNA, 18 nt, Listeria monocytogenes EGD-e
uuucaacaaaacaaacua

SEQ ID NO: 2808819 - RNA, 22 nt, Listeria monocytogenes EGD-e
uuucagcaauguaggcauugua

SEQ ID NO: 2808820 - RNA, 21 nt, Listeria monocytogenes EGD-e
uuucagcuaaucguuuuaaag

SEQ ID NO: 2808821 - RNA, 13 nt, Listeria monocytogenes EGD-e
uuucauaaucaaa

SEQ ID NO: 2808822 - RNA, 22 nt, Listeria monocytogenes EGD-e
uuucauagccggaccugaaaga

SEQ ID NO: 2808823 - RNA, 15 nt, Listeria monocytogenes EGD-e
uuucauauaaguguu

SEQ ID NO: 2808824 - RNA, 20 nt, Listeria monocytogenes EGD-e
uuucauauaauuuuuucauu

SEQ ID NO: 2808825 - RNA, 17 nt, Listeria monocytogenes EGD-e
uuucaucccuuuuuuca

SEQ ID NO: 2808826 - RNA, 16 nt, Listeria monocytogenes EGD-e
uuucauuucaucuuuu

SEQ ID NO: 2808827 - RNA, 15 nt, Listeria monocytogenes EGD-e
uuucauuuguuucuu

SEQ ID NO: 2808828 - RNA, 21 nt, Listeria monocytogenes EGD-e
uuucauuuucuauuccuccua

SEQ ID NO: 2808829 - RNA, 14 nt, Listeria monocytogenes EGD-e
uuucauuuuuccaa

SEQ ID NO: 2808830 - RNA, 16 nt, Listeria monocytogenes EGD-e
uuucccugcgucuucu

SEQ ID NO: 2808831 - RNA, 14 nt, Listeria monocytogenes EGD-e
uuuccgcaaguucg

SEQ ID NO: 2808832 - RNA, 22 nt, Listeria monocytogenes EGD-e
uuuccuucauaauuauuuuugu

SEQ ID NO: 2808833 - RNA, 18 nt, Listeria monocytogenes EGD-e
uuucgauauuuuuuuguu

SEQ ID NO: 2808834 - RNA, 23 nt, Listeria monocytogenes EGD-e
uuucgcuccguauuuauauucuu

SEQ ID NO: 2808835 - RNA, 16 nt, Listeria monocytogenes EGD-e
uuucuagugcaucuuc

SEQ ID NO: 2808836 - RNA, 18 nt, Listeria monocytogenes EGD-e
uuucuauauucauccuca

SEQ ID NO: 2808837 - RNA, 14 nt, Listeria monocytogenes EGD-e
uuucuauuccuccu

SEQ ID NO: 2808838 - RNA, 19 nt, Listeria monocytogenes EGD-e
uuucucaaggguuuuuguu

SEQ ID NO: 2808839 - RNA, 12 nt, Listeria monocytogenes EGD-e
uuucucuuguaa

SEQ ID NO: 2808840 - RNA, 19 nt, Listeria monocytogenes EGD-e
uuucugcaggguuucuugg

SEQ ID NO: 2808841 - RNA, 18 nt, Listeria monocytogenes EGD-e
uuucuguuuuguuuucag

SEQ ID NO: 2808842 - RNA, 23 nt, Listeria monocytogenes EGD-e
uuucuuccaccgcuuguuuugau

SEQ ID NO: 2808843 - RNA, 15 nt, Listeria monocytogenes EGD-e
uuucuuccauauuuu

SEQ ID NO: 2808844 - RNA, 22 nt, Listeria monocytogenes EGD-e
uuucuuccauauuuucucuaaa

SEQ ID NO: 2808845 - RNA, 18 nt, Listeria monocytogenes EGD-e
uuucuucgugcgcaacau

SEQ ID NO: 2808846 - RNA, 11 nt, Listeria monocytogenes EGD-e
uuucuuuaaaa

SEQ ID NO: 2808847 - RNA, 19 nt, Listeria monocytogenes EGD-e
uuucuuuaaaauccaauaa

SEQ ID NO: 2808848 - RNA, 21 nt, Listeria monocytogenes EGD-e
uuucuuuacauaauucauuga

SEQ ID NO: 2808849 - RNA, 13 nt, Listeria monocytogenes EGD-e
uuucuuucuuuug

SEQ ID NO: 2808850 - RNA, 14 nt, Listeria monocytogenes EGD-e
uuucuuuuauuuuu

SEQ ID NO: 2808851 - RNA, 12 nt, Listeria monocytogenes EGD-e
uuucuuuuccua

SEQ ID NO: 2808852 - RNA, 14 nt, Listeria monocytogenes EGD-e
uuugaaaaaacauc

SEQ ID NO: 2808853 - RNA, 21 nt, Listeria monocytogenes EGD-e
uuugaaaaagggcugcugcua

SEQ ID NO: 2808854 - RNA, 20 nt, Listeria monocytogenes EGD-e
uuugaauuaguauuuuguuc

SEQ ID NO: 2808855 - RNA, 14 nt, Listeria monocytogenes EGD-e
uuugauaaucuaca

SEQ ID NO: 2808856 - RNA, 20 nt, Listeria monocytogenes EGD-e
uuugauaggcucuuccuuuu

SEQ ID NO: 2808857 - RNA, 15 nt, Listeria monocytogenes EGD-e
uuugaucugugggaa

SEQ ID NO: 2808858 - RNA, 21 nt, Listeria monocytogenes EGD-e
uuugaugcgaaaaaugaaaag

SEQ ID NO: 2808859 - RNA, 21 nt, Listeria monocytogenes EGD-e
uuugauuaauaaaguuguaag

SEQ ID NO: 2808860 - RNA, 19 nt, Listeria monocytogenes EGD-e
uuugauugccugaaauaau

SEQ ID NO: 2808861 - RNA, 12 nt, Listeria monocytogenes EGD-e
uuugauuuaauu

SEQ ID NO: 2808862 - RNA, 13 nt, Listeria monocytogenes EGD-e
uuugcuuuaaaaa

SEQ ID NO: 2808863 - RNA, 21 nt, Listeria monocytogenes EGD-e
uuugguaaaaaacuguuguuc

SEQ ID NO: 2808864 - RNA, 14 nt, Listeria monocytogenes EGD-e
uuugguaauaaucc

SEQ ID NO: 2808865 - RNA, 17 nt, Listeria monocytogenes EGD-e
uuuguaggguuuggaaa

SEQ ID NO: 2808866 - RNA, 14 nt, Listeria monocytogenes EGD-e
uuugucaucauaaa

SEQ ID NO: 2808867 - RNA, 21 nt, Listeria monocytogenes EGD-e
uuugucaucauaaacauuuga

SEQ ID NO: 2808868 - RNA, 22 nt, Listeria monocytogenes EGD-e
uuugucuucggauuuuucaaau

SEQ ID NO: 2808869 - RNA, 22 nt, Listeria monocytogenes EGD-e
uuugucuuuacuacauuuuguu

SEQ ID NO: 2808870 - RNA, 23 nt, Listeria monocytogenes EGD-e
uuugucuuuacuacauuuuguug

SEQ ID NO: 2808871 - RNA, 23 nt, Listeria monocytogenes EGD-e
uuuguguuaauaaaaucauucca

SEQ ID NO: 2808872 - RNA, 14 nt, Listeria monocytogenes EGD-e
uuuguuaacuaaca

SEQ ID NO: 2808873 - RNA, 16 nt, Listeria monocytogenes EGD-e
uuuguuaacuaacaaa

SEQ ID NO: 2808874 - RNA, 23 nt, Listeria monocytogenes EGD-e
uuuguucucuauauucauuauua

SEQ ID NO: 2808875 - RNA, 18 nt, Listeria monocytogenes EGD-e
uuuguugucaauguauac

SEQ ID NO: 2808876 - RNA, 21 nt, Listeria monocytogenes EGD-e
uuuguuguuuucccagaaaaa

SEQ ID NO: 2808877 - RNA, 14 nt, Listeria monocytogenes EGD-e
uuuguuguuuuggu

SEQ ID NO: 2808878 - RNA, 15 nt, Listeria monocytogenes EGD-e
uuuguuuuccuuugu

SEQ ID NO: 2808879 - RNA, 20 nt, Listeria monocytogenes EGD-e
uuuuaaaauucuauuaauaa

SEQ ID NO: 2808880 - RNA, 20 nt, Listeria monocytogenes EGD-e
uuuuaaagcuugauuuaauu

SEQ ID NO: 2808881 - RNA, 12 nt, Listeria monocytogenes EGD-e
uuuuaaauauac

SEQ ID NO: 2808882 - RNA, 19 nt, Listeria monocytogenes EGD-e
uuuuaauaauuaagaccuu

SEQ ID NO: 2808883 - RNA, 18 nt, Listeria monocytogenes EGD-e
uuuuaaugcgaaaaauga

SEQ ID NO: 2808884 - RNA, 20 nt, Listeria monocytogenes EGD-e
uuuuaaugcgaaaaaugaaa

SEQ ID NO: 2808885 - RNA, 15 nt, Listeria monocytogenes EGD-e
uuuuaauuaaaaguu

SEQ ID NO: 2808886 - RNA, 16 nt, Listeria monocytogenes EGD-e
uuuuaauuaaaaguug

SEQ ID NO: 2808887 - RNA, 13 nt, Listeria monocytogenes EGD-e
uuuuaauuucuuu

SEQ ID NO: 2808888 - RNA, 12 nt, Listeria monocytogenes EGD-e
uuuuaauuuggu

SEQ ID NO: 2808889 - RNA, 21 nt, Listeria monocytogenes EGD-e
uuuuacgaucuacuucuaaau

SEQ ID NO: 2808890 - RNA, 14 nt, Listeria monocytogenes EGD-e
uuuuacgcauauca

SEQ ID NO: 2808891 - RNA, 17 nt, Listeria monocytogenes EGD-e
uuuuacggcuucaauga

SEQ ID NO: 2808892 - RNA, 14 nt, Listeria monocytogenes EGD-e
uuuuacuuacaaaa

SEQ ID NO: 2808893 - RNA, 13 nt, Listeria monocytogenes EGD-e
uuuuagaaugaag

SEQ ID NO: 2808894 - RNA, 15 nt, Listeria monocytogenes EGD-e
uuuuauaaaaauaca

SEQ ID NO: 2808895 - RNA, 22 nt, Listeria monocytogenes EGD-e
uuuuauaaaaauacauuuuagc

SEQ ID NO: 2808896 - RNA, 21 nt, Listeria monocytogenes EGD-e
uuuuauaauuaacaaccauuu

SEQ ID NO: 2808897 - RNA, 22 nt, Listeria monocytogenes EGD-e
uuuuauacgcaaugcugaaugu

SEQ ID NO: 2808898 - RNA, 18 nt, Listeria monocytogenes EGD-e
uuuuaugcacuuucaaau

SEQ ID NO: 2808899 - RNA, 17 nt, Listeria monocytogenes EGD-e
uuuuaugcuaaaugaau

SEQ ID NO: 2808900 - RNA, 13 nt, Listeria monocytogenes EGD-e
uuuuauuacuuua

SEQ ID NO: 2808901 - RNA, 19 nt, Listeria monocytogenes EGD-e
uuuuauuacuuuauuuauu

SEQ ID NO: 2808902 - RNA, 20 nt, Listeria monocytogenes EGD-e
uuuuauuacuuuauuuauuu

SEQ ID NO: 2808903 - RNA, 13 nt, Listeria monocytogenes EGD-e
uuuuauuauaaaa

SEQ ID NO: 2808904 - RNA, 23 nt, Listeria monocytogenes EGD-e
uuuuauuugguuuuguccaaacc

SEQ ID NO: 2808905 - RNA, 21 nt, Listeria monocytogenes EGD-e
uuuuauuuugguuauuucuuu

SEQ ID NO: 2808906 - RNA, 12 nt, Listeria monocytogenes EGD-e
uuuuauuuuuuu

SEQ ID NO: 2808907 - RNA, 15 nt, Listeria monocytogenes EGD-e
uuuucaacaaaacaa

SEQ ID NO: 2808908 - RNA, 18 nt, Listeria monocytogenes EGD-e
uuuucaacaaaacaaacu

SEQ ID NO: 2808909 - RNA, 22 nt, Listeria monocytogenes EGD-e
uuuucaacgauagauuuuaauu

SEQ ID NO: 2808910 - RNA, 13 nt, Listeria monocytogenes EGD-e
uuuucaaggcuuu

SEQ ID NO: 2808911 - RNA, 17 nt, Listeria monocytogenes EGD-e
uuuucacugcauaaaaa

SEQ ID NO: 2808912 - RNA, 20 nt, Listeria monocytogenes EGD-e
uuuucacugcauaaaaaaca

SEQ ID NO: 2808913 - RNA, 12 nt, Listeria monocytogenes EGD-e
uuuucagcaaug

SEQ ID NO: 2808914 - RNA, 20 nt, Listeria monocytogenes EGD-e
uuuucagcuaaauauuuaau

SEQ ID NO: 2808915 - RNA, 12 nt, Listeria monocytogenes EGD-e
uuuucaucccuu

SEQ ID NO: 2808916 - RNA, 13 nt, Listeria monocytogenes EGD-e
uuuucauugcacu

SEQ ID NO: 2808917 - RNA, 19 nt, Listeria monocytogenes EGD-e
uuuucauuuguuucuuuug

SEQ ID NO: 2808918 - RNA, 21 nt, Listeria monocytogenes EGD-e
uuuuccaaggaauaacuccac

SEQ ID NO: 2808919 - RNA, 15 nt, Listeria monocytogenes EGD-e
uuuucccagaaaaaa

SEQ ID NO: 2808920 - RNA, 18 nt, Listeria monocytogenes EGD-e
uuuucccagaaaaaaaca

SEQ ID NO: 2808921 - RNA, 14 nt, Listeria monocytogenes EGD-e
uuuuccuaauuuua

SEQ ID NO: 2808922 - RNA, 14 nt, Listeria monocytogenes EGD-e
uuuucgaaaguuuc

SEQ ID NO: 2808923 - RNA, 15 nt, Listeria monocytogenes EGD-e
uuuucgcgugauaaa

SEQ ID NO: 2808924 - RNA, 12 nt, Listeria monocytogenes EGD-e
uuuucuauuccu

SEQ ID NO: 2808925 - RNA, 16 nt, Listeria monocytogenes EGD-e
uuuucucaaaaauaug

SEQ ID NO: 2808926 - RNA, 13 nt, Listeria monocytogenes EGD-e
uuuucuuccauau

SEQ ID NO: 2808927 - RNA, 15 nt, Listeria monocytogenes EGD-e
uuuucuucuuguucc

SEQ ID NO: 2808928 - RNA, 14 nt, Listeria monocytogenes EGD-e
uuuucuuuuccuaa

SEQ ID NO: 2808929 - RNA, 21 nt, Listeria monocytogenes EGD-e
uuuucuuuuccuaauuuuacu

SEQ ID NO: 2808930 - RNA, 13 nt, Listeria monocytogenes EGD-e
uuuugaaaaaaca

SEQ ID NO: 2808931 - RNA, 17 nt, Listeria monocytogenes EGD-e
uuuugaugcgaaaaaug

SEQ ID NO: 2808932 - RNA, 15 nt, Listeria monocytogenes EGD-e
uuuugauuaggcauu

SEQ ID NO: 2808933 - RNA, 21 nt, Listeria monocytogenes EGD-e
uuuugcacaaaaugcaaaacc

SEQ ID NO: 2808934 - RNA, 14 nt, Listeria monocytogenes EGD-e
uuuugcucaaguga

SEQ ID NO: 2808935 - RNA, 15 nt, Listeria monocytogenes EGD-e
uuuugcucaguaguu

SEQ ID NO: 2808936 - RNA, 15 nt, Listeria monocytogenes EGD-e
uuuugcuggugcuuu

SEQ ID NO: 2808937 - RNA, 14 nt, Listeria monocytogenes EGD-e
uuuugcuucuucca

SEQ ID NO: 2808938 - RNA, 15 nt, Listeria monocytogenes EGD-e
uuuuggguauauuuu

SEQ ID NO: 2808939 - RNA, 15 nt, Listeria monocytogenes EGD-e
uuuuggugacgaauc

SEQ ID NO: 2808940 - RNA, 20 nt, Listeria monocytogenes EGD-e
uuuuguucuaagaauugauu

SEQ ID NO: 2808941 - RNA, 13 nt, Listeria monocytogenes EGD-e
uuuuguucuucua

SEQ ID NO: 2808942 - RNA, 14 nt, Listeria monocytogenes EGD-e
uuuuguuuguaaaa

SEQ ID NO: 2808943 - RNA, 15 nt, Listeria monocytogenes EGD-e
uuuuuaaacuauuuu

SEQ ID NO: 2808944 - RNA, 14 nt, Listeria monocytogenes EGD-e
uuuuuauacacgau

SEQ ID NO: 2808945 - RNA, 16 nt, Listeria monocytogenes EGD-e
uuuuucaaggcuuucu

SEQ ID NO: 2808946 - RNA, 12 nt, Listeria monocytogenes EGD-e
uuuuuccuucau

SEQ ID NO: 2808947 - RNA, 19 nt, Listeria monocytogenes EGD-e
uuuuucuauauucauccuc

SEQ ID NO: 2808948 - RNA, 13 nt, Listeria monocytogenes EGD-e
uuuuucucaggag

SEQ ID NO: 2808949 - RNA, 15 nt, Listeria monocytogenes EGD-e
uuuuucuuugccuua

SEQ ID NO: 2808950 - RNA, 13 nt, Listeria monocytogenes EGD-e
uuuuugaauaacu

SEQ ID NO: 2808951 - RNA, 14 nt, Listeria monocytogenes EGD-e
uuuuugcuuuugau

SEQ ID NO: 2808952 - RNA, 20 nt, Listeria monocytogenes EGD-e
uuuuuuaaugcgaaaaauga

SEQ ID NO: 2808953 - RNA, 14 nt, Listeria monocytogenes EGD-e
uuuuuuauuuaccu

SEQ ID NO: 2808954 - RNA, 13 nt, Listeria monocytogenes EGD-e
uuuuuuccuucau

SEQ ID NO: 2808955 - RNA, 12 nt, Listeria monocytogenes EGD-e
uuuuuuguucug

SEQ ID NO: 2808956 - RNA, 22 nt, Listeria monocytogenes EGD-e
uuuuuuuaugcauaaaaaagca

SEQ ID NO: 2808957 - RNA, 13 nt, Mycobacterium avium subsp. paratuberculosis
aaaccgucggccc

SEQ ID NO: 2808958 - RNA, 19 nt, Mycobacterium avium subsp. paratuberculosis
aaaccguugaccaccaggu

SEQ ID NO: 2808959 - RNA, 18 nt, Mycobacterium avium subsp. paratuberculosis
aaaccguuggccugcgcg

SEQ ID NO: 2808960 - RNA, 17 nt, Mycobacterium avium subsp. paratuberculosis
aaacgacgucgccacca

SEQ ID NO: 2808961 - RNA, 12 nt, Mycobacterium avium subsp. paratuberculosis
aaacgccugcgc

SEQ ID NO: 2808962 - RNA, 23 nt, Mycobacterium avium subsp. paratuberculosis
aaacgcuucuccgccuucgaguu

SEQ ID NO: 2808963 - RNA, 12 nt, Mycobacterium avium subsp. paratuberculosis
aaacggcggcgg

SEQ ID NO: 2808964 - RNA, 14 nt, Mycobacterium avium subsp. paratuberculosis
aaacuagcuucacg

SEQ ID NO: 2808965 - RNA, 23 nt, Mycobacterium avium subsp. paratuberculosis
aaacuaguuucacguucggcggg

SEQ ID NO: 2808966 - RNA, 18 nt, Mycobacterium avium subsp. paratuberculosis
aaacucguugccagccgg

SEQ ID NO: 2808967 - RNA, 23 nt, Mycobacterium avium subsp. paratuberculosis
aaagacauucggggccaccaggc

SEQ ID NO: 2808968 - RNA, 21 nt, Mycobacterium avium subsp. paratuberculosis
aaagacgcacuaaucaacgaa

SEQ ID NO: 2808969 - RNA, 22 nt, Mycobacterium avium subsp. paratuberculosis
aaagaucgucuugaccgcccgg

SEQ ID NO: 2808970 - RNA, 21 nt, Mycobacterium avium subsp. paratuberculosis
aaagcagcaacggcggcggca

SEQ ID NO: 2808971 - RNA, 13 nt, Mycobacterium avium subsp. paratuberculosis
aaagccacccgcg

SEQ ID NO: 2808972 - RNA, 20 nt, Mycobacterium avium subsp. paratuberculosis
aaagccgaggcgcaacaccg

SEQ ID NO: 2808973 - RNA, 21 nt, Mycobacterium avium subsp. paratuberculosis
aaagccguaccgcaacaccga

SEQ ID NO: 2808974 - RNA, 20 nt, Mycobacterium avium subsp. paratuberculosis
aaagccguagcgcaacaccg

SEQ ID NO: 2808975 - RNA, 21 nt, Mycobacterium avium subsp. paratuberculosis
aaagccguagcgcaacaccga

SEQ ID NO: 2808976 - RNA, 22 nt, Mycobacterium avium subsp. paratuberculosis
aaagccguagcgcaacaccgaa

SEQ ID NO: 2808977 - RNA, 22 nt, Mycobacterium avium subsp. paratuberculosis
aaagcgaccagcgcgccggcca

SEQ ID NO: 2808978 - RNA, 15 nt, Mycobacterium avium subsp. paratuberculosis
aaaggccgccgcugg

SEQ ID NO: 2808979 - RNA, 18 nt, Mycobacterium avium subsp. paratuberculosis
aaaguccuucucgggcaa

SEQ ID NO: 2808980 - RNA, 20 nt, Mycobacterium avium subsp. paratuberculosis
aaagugcuacugccgacgca

SEQ ID NO: 2808981 - RNA, 13 nt, Mycobacterium avium subsp. paratuberculosis
aaauaaccgcgcg

SEQ ID NO: 2808982 - RNA, 23 nt, Mycobacterium avium subsp. paratuberculosis
aaauagcggcgcaccuggcgcag

SEQ ID NO: 2808983 - RNA, 17 nt, Mycobacterium avium subsp. paratuberculosis
aaauccagaacagccag

SEQ ID NO: 2808984 - RNA, 18 nt, Mycobacterium avium subsp. paratuberculosis
aaauccgggaccggcguc

SEQ ID NO: 2808985 - RNA, 13 nt, Mycobacterium avium subsp. paratuberculosis
aaaucgucgggcc

SEQ ID NO: 2808986 - RNA, 18 nt, Mycobacterium avium subsp. paratuberculosis
aaaucguggcuuucggcg

SEQ ID NO: 2808987 - RNA, 12 nt, Mycobacterium avium subsp. paratuberculosis
aaaugccuuggc

SEQ ID NO: 2808988 - RNA, 16 nt, Mycobacterium avium subsp. paratuberculosis
aaauugcugaccauga

SEQ ID NO: 2808989 - RNA, 16 nt, Mycobacterium avium subsp. paratuberculosis
aacaacagggccgcgc

SEQ ID NO: 2808990 - RNA, 14 nt, Mycobacterium avium subsp. paratuberculosis
aacaacccggccgc

SEQ ID NO: 2808991 - RNA, 15 nt, Mycobacterium avium subsp. paratuberculosis
aacaacccggccgcg

SEQ ID NO: 2808992 - RNA, 12 nt, Mycobacterium avium subsp. paratuberculosis
aacaaccgcagc

SEQ ID NO: 2808993 - RNA, 19 nt, Mycobacterium avium subsp. paratuberculosis
aacaacgcgcacaacagcc

SEQ ID NO: 2808994 - RNA, 20 nt, Mycobacterium avium subsp. paratuberculosis
aacaacgcggugaccgcggc

SEQ ID NO: 2808995 - RNA, 20 nt, Mycobacterium avium subsp. paratuberculosis
aacaacuacgagcagcaaga

SEQ ID NO: 2808996 - RNA, 21 nt, Mycobacterium avium subsp. paratuberculosis
aacaaucgcugcgagcccggc

SEQ ID NO: 2808997 - RNA, 13 nt, Mycobacterium avium subsp. paratuberculosis
aacaauggccccg

SEQ ID NO: 2808998 - RNA, 15 nt, Mycobacterium avium subsp. paratuberculosis
aacaauggccccggc

SEQ ID NO: 2808999 - RNA, 17 nt, Mycobacterium avium subsp. paratuberculosis
aacaauguuuuucugcu

SEQ ID NO: 2809000 - RNA, 13 nt, Mycobacterium avium subsp. paratuberculosis
aacacaacgccuu

SEQ ID NO: 2809001 - RNA, 12 nt, Mycobacterium avium subsp. paratuberculosis
aacacagcagca

SEQ ID NO: 2809002 - RNA, 19 nt, Mycobacterium avium subsp. paratuberculosis
aacacagccaaucgccgau

SEQ ID NO: 2809003 - RNA, 16 nt, Mycobacterium avium subsp. paratuberculosis
aacaccaccaggccgu

SEQ ID NO: 2809004 - RNA, 21 nt, Mycobacterium avium subsp. paratuberculosis
aacaccaccggcaaccgccac

SEQ ID NO: 2809005 - RNA, 21 nt, Mycobacterium avium subsp. paratuberculosis
aacaccaccuugguggccgcg

SEQ ID NO: 2809006 - RNA, 23 nt, Mycobacterium avium subsp. paratuberculosis
aacaccaccuugguggccgcggc

SEQ ID NO: 2809007 - RNA, 23 nt, Mycobacterium avium subsp. paratuberculosis
aacaccacgguccccgcgcccgc

SEQ ID NO: 2809008 - RNA, 14 nt, Mycobacterium avium subsp. paratuberculosis
aacaccacgucguc

SEQ ID NO: 2809009 - RNA, 18 nt, Mycobacterium avium subsp. paratuberculosis
aacaccagcgcauacaac

SEQ ID NO: 2809010 - RNA, 21 nt, Mycobacterium avium subsp. paratuberculosis
aacaccagggugcgcagcgcg

SEQ ID NO: 2809011 - RNA, 21 nt, Mycobacterium avium subsp. paratuberculosis
aacacccagaugcccagcggc

SEQ ID NO: 2809012 - RNA, 22 nt, Mycobacterium avium subsp. paratuberculosis
aacacccagaugcccagcggca

SEQ ID NO: 2809013 - RNA, 14 nt, Mycobacterium avium subsp. paratuberculosis
aacacccagccgcu

SEQ ID NO: 2809014 - RNA, 22 nt, Mycobacterium avium subsp. paratuberculosis
aacacccagccgcugaacgcga

SEQ ID NO: 2809015 - RNA, 14 nt, Mycobacterium avium subsp. paratuberculosis
aacaccccgaccga

SEQ ID NO: 2809016 - RNA, 20 nt, Mycobacterium avium subsp. paratuberculosis
aacacccggcuucgcugcgc

SEQ ID NO: 2809017 - RNA, 14 nt, Mycobacterium avium subsp. paratuberculosis
aacacccucggucg

SEQ ID NO: 2809018 - RNA, 14 nt, Mycobacterium avium subsp. paratuberculosis
aacaccgaaagccg

SEQ ID NO: 2809019 - RNA, 21 nt, Mycobacterium avium subsp. paratuberculosis
aacaccgaaagccgacaccuc

SEQ ID NO: 2809020 - RNA, 23 nt, Mycobacterium avium subsp. paratuberculosis
aacaccgaaagccgacaccucac

SEQ ID NO: 2809021 - RNA, 17 nt, Mycobacterium avium subsp. paratuberculosis
aacaccgaacgccgagg

SEQ ID NO: 2809022 - RNA, 17 nt, Mycobacterium avium subsp. paratuberculosis
aacaccgagccggcggc

SEQ ID NO: 2809023 - RNA, 13 nt, Mycobacterium avium subsp. paratuberculosis
aacaccgccagca

SEQ ID NO: 2809024 - RNA, 18 nt, Mycobacterium avium subsp. paratuberculosis
aacaccgccagcaccgcc

SEQ ID NO: 2809025 - RNA, 21 nt, Mycobacterium avium subsp. paratuberculosis
aacaccgccuugcccggcucg

SEQ ID NO: 2809026 - RNA, 16 nt, Mycobacterium avium subsp. paratuberculosis
aacaccggcagcgcca

SEQ ID NO: 2809027 - RNA, 16 nt, Mycobacterium avium subsp. paratuberculosis
aacaccggcgcgacca

SEQ ID NO: 2809028 - RNA, 14 nt, Mycobacterium avium subsp. paratuberculosis
aacaccgugaacag

SEQ ID NO: 2809029 - RNA, 18 nt, Mycobacterium avium subsp. paratuberculosis
aacaccgugccgucacgc

SEQ ID NO: 2809030 - RNA, 13 nt, Mycobacterium avium subsp. paratuberculosis
aacaccuccucgg

SEQ ID NO: 2809031 - RNA, 21 nt, Mycobacterium avium subsp. paratuberculosis
aacaccuccucgguguacagc

SEQ ID NO: 2809032 - RNA, 20 nt, Mycobacterium avium subsp. paratuberculosis
aacaccucgccuccagcagg

SEQ ID NO: 2809033 - RNA, 15 nt, Mycobacterium avium subsp. paratuberculosis
aacaccucggugauc

SEQ ID NO: 2809034 - RNA, 20 nt, Mycobacterium avium subsp. paratuberculosis
aacacgagcagacccgccgc

SEQ ID NO: 2809035 - RNA, 17 nt, Mycobacterium avium subsp. paratuberculosis
aacacgcccagcgccgc

SEQ ID NO: 2809036 - RNA, 13 nt, Mycobacterium avium subsp. paratuberculosis
aacacgccccggc

SEQ ID NO: 2809037 - RNA, 16 nt, Mycobacterium avium subsp. paratuberculosis
aacacgccccggcggg

SEQ ID NO: 2809038 - RNA, 17 nt, Mycobacterium avium subsp. paratuberculosis
aacacgccccggcgggu

SEQ ID NO: 2809039 - RNA, 14 nt, Mycobacterium avium subsp. paratuberculosis
aacacgccggcggc

SEQ ID NO: 2809040 - RNA, 16 nt, Mycobacterium avium subsp. paratuberculosis
aacacgccggcggcca

SEQ ID NO: 2809041 - RNA, 23 nt, Mycobacterium avium subsp. paratuberculosis
aaccagcuccggcaacgaggcca

SEQ ID NO: 2809042 - RNA, 12 nt, Mycobacterium avium subsp. paratuberculosis
aaccaggccgcg

SEQ ID NO: 2809043 - RNA, 15 nt, Mycobacterium avium subsp. paratuberculosis
aaccaggcgccggcc

SEQ ID NO: 2809044 - RNA, 20 nt, Mycobacterium avium subsp. paratuberculosis
aaccaggcgccggccagcac

SEQ ID NO: 2809045 - RNA, 15 nt, Mycobacterium avium subsp. paratuberculosis
aaccaggucgcggcg

SEQ ID NO: 2809046 - RNA, 16 nt, Mycobacterium avium subsp. paratuberculosis
aaccaguucgccacca

SEQ ID NO: 2809047 - RNA, 19 nt, Mycobacterium avium subsp. paratuberculosis
aaccaugccagucaagcgc

SEQ ID NO: 2809048 - RNA, 23 nt, Mycobacterium avium subsp. paratuberculosis
aaccauucguggcugaacagcgc

SEQ ID NO: 2809049 - RNA, 18 nt, Mycobacterium avium subsp. paratuberculosis
aaccauuugcccagcagg

SEQ ID NO: 2809050 - RNA, 12 nt, Mycobacterium avium subsp. paratuberculosis
aacccaccccga

SEQ ID NO: 2809051 - RNA, 17 nt, Mycobacterium avium subsp. paratuberculosis
aacccagcaccaacagc

SEQ ID NO: 2809052 - RNA, 23 nt, Mycobacterium avium subsp. paratuberculosis
aacccagcaccaacagcggcccg

SEQ ID NO: 2809053 - RNA, 23 nt, Mycobacterium avium subsp. paratuberculosis
aacccagcgccucgagcaccacg

SEQ ID NO: 2809054 - RNA, 17 nt, Mycobacterium avium subsp. paratuberculosis
aaccccccuuggcggca

SEQ ID NO: 2809055 - RNA, 19 nt, Mycobacterium avium subsp. paratuberculosis
aaccccgcucccauccgga

SEQ ID NO: 2809056 - RNA, 15 nt, Mycobacterium avium subsp. paratuberculosis
aacccgaaaagcacc

SEQ ID NO: 2809057 - RNA, 15 nt, Mycobacterium avium subsp. paratuberculosis
aacccgaaagccccc

SEQ ID NO: 2809058 - RNA, 17 nt, Mycobacterium avium subsp. paratuberculosis
aacccgaacgcgucguc

SEQ ID NO: 2809059 - RNA, 15 nt, Mycobacterium avium subsp. paratuberculosis
aacccgagcaccccg

SEQ ID NO: 2809060 - RNA, 13 nt, Mycobacterium avium subsp. paratuberculosis
aacccgaucggcc

SEQ ID NO: 2809061 - RNA, 21 nt, Mycobacterium avium subsp. paratuberculosis
aacccgccgcggccgaaccgc

SEQ ID NO: 2809062 - RNA, 20 nt, Mycobacterium avium subsp. paratuberculosis
aacccgcucaggucggccgc

SEQ ID NO: 2809063 - RNA, 19 nt, Mycobacterium avium subsp. paratuberculosis
aacccgcugucaauccccg

SEQ ID NO: 2809064 - RNA, 14 nt, Mycobacterium avium subsp. paratuberculosis
aacccggaucggcc

SEQ ID NO: 2809065 - RNA, 15 nt, Mycobacterium avium subsp. paratuberculosis
aacccggcggacggu

SEQ ID NO: 2809066 - RNA, 21 nt, Mycobacterium avium subsp. paratuberculosis
aacccgggacccggaacccgc

SEQ ID NO: 2809067 - RNA, 12 nt, Mycobacterium avium subsp. paratuberculosis
aacccgggccgg

SEQ ID NO: 2809068 - RNA, 21 nt, Mycobacterium avium subsp. paratuberculosis
aacccgggcgcgcccacccgc

SEQ ID NO: 2809069 - RNA, 11 nt, Mycobacterium avium subsp. paratuberculosis
aacccugggcg

SEQ ID NO: 2809070 - RNA, 18 nt, Mycobacterium avium subsp. paratuberculosis
aaccgaagggaaaggcag

SEQ ID NO: 2809071 - RNA, 20 nt, Mycobacterium avium subsp. paratuberculosis
aaccgaagggaaaggcagca

SEQ ID NO: 2809072 - RNA, 22 nt, Mycobacterium avium subsp. paratuberculosis
aaccgaagggaaaggcagcagc

SEQ ID NO: 2809073 - RNA, 15 nt, Mycobacterium avium subsp. paratuberculosis
aaccgaaucggucga

SEQ ID NO: 2809074 - RNA, 20 nt, Mycobacterium avium subsp. paratuberculosis
aaccgacauaggucagguug

SEQ ID NO: 2809075 - RNA, 15 nt, Mycobacterium avium subsp. paratuberculosis
aaccgaccgccgcgg

SEQ ID NO: 2809076 - RNA, 16 nt, Mycobacterium avium subsp. paratuberculosis
aaccgaccgccgcggc

SEQ ID NO: 2809077 - RNA, 17 nt, Mycobacterium avium subsp. paratuberculosis
aaccgaucaccggcagc

SEQ ID NO: 2809078 - RNA, 19 nt, Mycobacterium avium subsp. paratuberculosis
aaccgauuucggccagccg

SEQ ID NO: 2809079 - RNA, 16 nt, Mycobacterium avium subsp. paratuberculosis
aaccgcauucggccgc

SEQ ID NO: 2809080 - RNA, 18 nt, Mycobacterium avium subsp. paratuberculosis
aaccgcauucggccgcca

SEQ ID NO: 2809081 - RNA, 13 nt, Mycobacterium avium subsp. paratuberculosis
aaccgccagcagc

SEQ ID NO: 2809082 - RNA, 14 nt, Mycobacterium avium subsp. paratuberculosis
aaccgccagcagcg

SEQ ID NO: 2809083 - RNA, 14 nt, Mycobacterium avium subsp. paratuberculosis
aaccgcccagcggc

SEQ ID NO: 2809084 - RNA, 17 nt, Mycobacterium avium subsp. paratuberculosis
aaccgcccggcgccgau

SEQ ID NO: 2809085 - RNA, 16 nt, Mycobacterium avium subsp. paratuberculosis
aaccgcccuuccagca

SEQ ID NO: 2809086 - RNA, 11 nt, Mycobacterium avium subsp. paratuberculosis
aaccgccgcgc

SEQ ID NO: 2809087 - RNA, 20 nt, Mycobacterium avium subsp. paratuberculosis
aaccgccgcgcucgcaccag

SEQ ID NO: 2809088 - RNA, 17 nt, Mycobacterium avium subsp. paratuberculosis
aaccgcgagcagacgcg

SEQ ID NO: 2809089 - RNA, 12 nt, Mycobacterium avium subsp. paratuberculosis
aaccgcgcggcg

SEQ ID NO: 2809090 - RNA, 20 nt, Mycobacterium avium subsp. paratuberculosis
aaccgcggacuggccaccgc

SEQ ID NO: 2809091 - RNA, 18 nt, Mycobacterium avium subsp. paratuberculosis
aaccgcggcggcagcagc

SEQ ID NO: 2809092 - RNA, 19 nt, Mycobacterium avium subsp. paratuberculosis
aaccgcggcggcagcagcc

SEQ ID NO: 2809093 - RNA, 21 nt, Mycobacterium avium subsp. paratuberculosis
aaccgcggcggcagcagcccg

SEQ ID NO: 2809094 - RNA, 18 nt, Mycobacterium avium subsp. paratuberculosis
aaccgcucgauggcgccg

SEQ ID NO: 2809095 - RNA, 13 nt, Mycobacterium avium subsp. paratuberculosis
aaccgcucggcgg

SEQ ID NO: 2809096 - RNA, 16 nt, Mycobacterium avium subsp. paratuberculosis
aaccgcucggcggcgc

SEQ ID NO: 2809097 - RNA, 17 nt, Mycobacterium avium subsp. paratuberculosis
aaccgcugcaugccguc

SEQ ID NO: 2809098 - RNA, 16 nt, Mycobacterium avium subsp. paratuberculosis
aaccgcugcugcucgg

SEQ ID NO: 2809099 - RNA, 18 nt, Mycobacterium avium subsp. paratuberculosis
aaccgcugcugcucggcc

SEQ ID NO: 2809100 - RNA, 23 nt, Mycobacterium avium subsp. paratuberculosis
aaccgcugcugcugcccgcccga

SEQ ID NO: 2809101 - RNA, 17 nt, Mycobacterium avium subsp. paratuberculosis
aaccggaauggcagcag

SEQ ID NO: 2809102 - RNA, 16 nt, Mycobacterium avium subsp. paratuberculosis
aaccggaccgccgcgg

SEQ ID NO: 2809103 - RNA, 14 nt, Mycobacterium avium subsp. paratuberculosis
aaccggaugaugcc

SEQ ID NO: 2809104 - RNA, 19 nt, Mycobacterium avium subsp. paratuberculosis
aaccggaugaugcccuugg

SEQ ID NO: 2809105 - RNA, 22 nt, Mycobacterium avium subsp. paratuberculosis
aaccggcaggacgggggccggu

SEQ ID NO: 2809106 - RNA, 14 nt, Mycobacterium avium subsp. paratuberculosis
aaccggcaggccgu

SEQ ID NO: 2809107 - RNA, 12 nt, Mycobacterium avium subsp. paratuberculosis
aaccggccacca

SEQ ID NO: 2809108 - RNA, 14 nt, Mycobacterium avium subsp. paratuberculosis
aaccggccagcagc

SEQ ID NO: 2809109 - RNA, 23 nt, Mycobacterium avium subsp. paratuberculosis
aaccggccagcagcagcccgccg

SEQ ID NO: 2809110 - RNA, 20 nt, Mycobacterium avium subsp. paratuberculosis
aaccggcccagcagcgucac

SEQ ID NO: 2809111 - RNA, 19 nt, Mycobacterium avium subsp. paratuberculosis
aaccggccccgagcgucac

SEQ ID NO: 2809112 - RNA, 19 nt, Mycobacterium avium subsp. paratuberculosis
aaccggccggcgcgcacgg

SEQ ID NO: 2809113 - RNA, 13 nt, Mycobacterium avium subsp. paratuberculosis
aaccggcgccgaa

SEQ ID NO: 2809114 - RNA, 19 nt, Mycobacterium avium subsp. paratuberculosis
aaccggcgccgaagcccgc

SEQ ID NO: 2809115 - RNA, 12 nt, Mycobacterium avium subsp. paratuberculosis
aaccggcggcgg

SEQ ID NO: 2809116 - RNA, 13 nt, Mycobacterium avium subsp. paratuberculosis
aaccggcggcggu

SEQ ID NO: 2809117 - RNA, 21 nt, Mycobacterium avium subsp. paratuberculosis
aaccggcggcggugagcgcgu

SEQ ID NO: 2809118 - RNA, 23 nt, Mycobacterium avium subsp. paratuberculosis
aaccggcguugcauuucggcguc

SEQ ID NO: 2809119 - RNA, 20 nt, Mycobacterium avium subsp. paratuberculosis
aaccggcuggacacccccga

SEQ ID NO: 2809120 - RNA, 15 nt, Mycobacterium avium subsp. paratuberculosis
aaccgggacagccgc

SEQ ID NO: 2809121 - RNA, 16 nt, Mycobacterium avium subsp. paratuberculosis
aaccgggacagccgcg

SEQ ID NO: 2809122 - RNA, 18 nt, Mycobacterium avium subsp. paratuberculosis
aaccgggacagccgcgcc

SEQ ID NO: 2809123 - RNA, 20 nt, Mycobacterium avium subsp. paratuberculosis
aaccgggacagccgcgccga

SEQ ID NO: 2809124 - RNA, 17 nt, Mycobacterium avium subsp. paratuberculosis
aaccgggauaccgcgac

SEQ ID NO: 2809125 - RNA, 22 nt, Mycobacterium avium subsp. paratuberculosis
aaccgggccaacgguucggccg

SEQ ID NO: 2809126 - RNA, 15 nt, Mycobacterium avium subsp. paratuberculosis
aacgccuuggugccg

SEQ ID NO: 2809127 - RNA, 23 nt, Mycobacterium avium subsp. paratuberculosis
aacgcgaccgucgggacggccag

SEQ ID NO: 2809128 - RNA, 18 nt, Mycobacterium avium subsp. paratuberculosis
aacgcgacgaucagcagc

SEQ ID NO: 2809129 - RNA, 21 nt, Mycobacterium avium subsp. paratuberculosis
aacgcgacgaucagcagccgg

SEQ ID NO: 2809130 - RNA, 19 nt, Mycobacterium avium subsp. paratuberculosis
aacgcgacgguggcggcga

SEQ ID NO: 2809131 - RNA, 16 nt, Mycobacterium avium subsp. paratuberculosis
aacgcgcacaucacgg

SEQ ID NO: 2809132 - RNA, 15 nt, Mycobacterium avium subsp. paratuberculosis
aacgcgcccggcggg

SEQ ID NO: 2809133 - RNA, 14 nt, Mycobacterium avium subsp. paratuberculosis
aacgcgccgccgag

SEQ ID NO: 2809134 - RNA, 16 nt, Mycobacterium avium subsp. paratuberculosis
aacgcgccgccgagca

SEQ ID NO: 2809135 - RNA, 12 nt, Mycobacterium avium subsp. paratuberculosis
aacgcgccggcg

SEQ ID NO: 2809136 - RNA, 14 nt, Mycobacterium avium subsp. paratuberculosis
aacgcgccggcgca

SEQ ID NO: 2809137 - RNA, 14 nt, Mycobacterium avium subsp. paratuberculosis
aacgcgccggcggu

SEQ ID NO: 2809138 - RNA, 18 nt, Mycobacterium avium subsp. paratuberculosis
aacgcgccggcggucgac

SEQ ID NO: 2809139 - RNA, 14 nt, Mycobacterium avium subsp. paratuberculosis
aacgcgccgggcaa

SEQ ID NO: 2809140 - RNA, 15 nt, Mycobacterium avium subsp. paratuberculosis
aacgcgccgggcaac

SEQ ID NO: 2809141 - RNA, 17 nt, Mycobacterium avium subsp. paratuberculosis
aacgcgcgcgacggcgc

SEQ ID NO: 2809142 - RNA, 22 nt, Mycobacterium avium subsp. paratuberculosis
aacgcgcggaugcccaggccgg

SEQ ID NO: 2809143 - RNA, 11 nt, Mycobacterium avium subsp. paratuberculosis
aacgcgcgucg

SEQ ID NO: 2809144 - RNA, 17 nt, Mycobacterium avium subsp. paratuberculosis
aacgcggcaugaccggc

SEQ ID NO: 2809145 - RNA, 16 nt, Mycobacterium avium subsp. paratuberculosis
aacgcggccgccagcg

SEQ ID NO: 2809146 - RNA, 17 nt, Mycobacterium avium subsp. paratuberculosis
aacgcggugaccgcggc

SEQ ID NO: 2809147 - RNA, 23 nt, Mycobacterium avium subsp. paratuberculosis
aacgcgguguuggcggcgucguc

SEQ ID NO: 2809148 - RNA, 22 nt, Mycobacterium avium subsp. paratuberculosis
aacgcgguuuugaugccgccgg

SEQ ID NO: 2809149 - RNA, 21 nt, Mycobacterium avium subsp. paratuberculosis
aacgcguacacggcccgcggc

SEQ ID NO: 2809150 - RNA, 23 nt, Mycobacterium avium subsp. paratuberculosis
aacgcguacacggcccgcggcac

SEQ ID NO: 2809151 - RNA, 15 nt, Mycobacterium avium subsp. paratuberculosis
aacgcguccgacggc

SEQ ID NO: 2809152 - RNA, 18 nt, Mycobacterium avium subsp. paratuberculosis
aacgcgucgaacagccgg

SEQ ID NO: 2809153 - RNA, 18 nt, Mycobacterium avium subsp. paratuberculosis
aacgcgucgaccgccgcg

SEQ ID NO: 2809154 - RNA, 19 nt, Mycobacterium avium subsp. paratuberculosis
aacgcgucgaccgccgcga

SEQ ID NO: 2809155 - RNA, 20 nt, Mycobacterium avium subsp. paratuberculosis
aacgcgucgcccacgccggu

SEQ ID NO: 2809156 - RNA, 23 nt, Mycobacterium avium subsp. paratuberculosis
aacgcgucguugucgucgccggc

SEQ ID NO: 2809157 - RNA, 24 nt, Mycobacterium avium subsp. paratuberculosis
aacgcguucgucggcgcgucguac

SEQ ID NO: 2809158 - RNA, 17 nt, Mycobacterium avium subsp. paratuberculosis
aacgcugaccgcaggaa

SEQ ID NO: 2809159 - RNA, 18 nt, Mycobacterium avium subsp. paratuberculosis
aacgcugaccgcaggaaa

SEQ ID NO: 2809160 - RNA, 14 nt, Mycobacterium avium subsp. paratuberculosis
aacgcugccaggcg

SEQ ID NO: 2809161 - RNA, 18 nt, Mycobacterium avium subsp. paratuberculosis
aacgcuggucgaacgcca

SEQ ID NO: 2809162 - RNA, 21 nt, Mycobacterium avium subsp. paratuberculosis
aacgcuggucgaacgccaccu

SEQ ID NO: 2809163 - RNA, 21 nt, Mycobacterium avium subsp. paratuberculosis
aacgcuuccagcaccacccgg

SEQ ID NO: 2809164 - RNA, 16 nt, Mycobacterium avium subsp. paratuberculosis
aacggaauucgggugc

SEQ ID NO: 2809165 - RNA, 20 nt, Mycobacterium avium subsp. paratuberculosis
aacggaucgagcgcaccgcc

SEQ ID NO: 2809166 - RNA, 17 nt, Mycobacterium avium subsp. paratuberculosis
aacggauucagcgucgc

SEQ ID NO: 2809167 - RNA, 20 nt, Mycobacterium avium subsp. paratuberculosis
aacggcaccccgcggucggc

SEQ ID NO: 2809168 - RNA, 15 nt, Mycobacterium avium subsp. paratuberculosis
aacggcacccgcagc

SEQ ID NO: 2809169 - RNA, 17 nt, Mycobacterium avium subsp. paratuberculosis
aacggccaaccgcccgg

SEQ ID NO: 2809170 - RNA, 18 nt, Mycobacterium avium subsp. paratuberculosis
aacggcccaucacgucgg

SEQ ID NO: 2809171 - RNA, 18 nt, Mycobacterium avium subsp. paratuberculosis
aacggcccgccgccggcg

SEQ ID NO: 2809172 - RNA, 21 nt, Mycobacterium avium subsp. paratuberculosis
aacggccgcgcagaucgccag

SEQ ID NO: 2809173 - RNA, 18 nt, Mycobacterium avium subsp. paratuberculosis
aacggccggcgccgccgg

SEQ ID NO: 2809174 - RNA, 22 nt, Mycobacterium avium subsp. paratuberculosis
aacggcgccaucguggccgcgu

SEQ ID NO: 2809175 - RNA, 18 nt, Mycobacterium avium subsp. paratuberculosis
aacggcgccuugaaccgg

SEQ ID NO: 2809176 - RNA, 22 nt, Mycobacterium avium subsp. paratuberculosis
aacggcgcgaaccgggccagga

SEQ ID NO: 2809177 - RNA, 19 nt, Mycobacterium avium subsp. paratuberculosis
aacggcggaccggcggccg

SEQ ID NO: 2809178 - RNA, 20 nt, Mycobacterium avium subsp. paratuberculosis
aacggcggaccggcggccgc

SEQ ID NO: 2809179 - RNA, 21 nt, Mycobacterium avium subsp. paratuberculosis
aacggcgggcccgucgccggc

SEQ ID NO: 2809180 - RNA, 22 nt, Mycobacterium avium subsp. paratuberculosis
aacggcgggcccgucgccggcg

SEQ ID NO: 2809181 - RNA, 21 nt, Mycobacterium avium subsp. paratuberculosis
aacggcggggccuccaccagc

SEQ ID NO: 2809182 - RNA, 19 nt, Mycobacterium avium subsp. paratuberculosis
aacggcggucgugcggcug

SEQ ID NO: 2809183 - RNA, 12 nt, Mycobacterium avium subsp. paratuberculosis
aacggcgucgac

SEQ ID NO: 2809184 - RNA, 16 nt, Mycobacterium avium subsp. paratuberculosis
aacggcgucuggccgg

SEQ ID NO: 2809185 - RNA, 16 nt, Mycobacterium avium subsp. paratuberculosis
aacggcucggucaagc

SEQ ID NO: 2809186 - RNA, 20 nt, Mycobacterium avium subsp. paratuberculosis
aacggcuugcgcucggccgg

SEQ ID NO: 2809187 - RNA, 22 nt, Mycobacterium avium subsp. paratuberculosis
aacgggaugaacucgugcggcg

SEQ ID NO: 2809188 - RNA, 17 nt, Mycobacterium avium subsp. paratuberculosis
aacgggccgcagccgcg

SEQ ID NO: 2809189 - RNA, 20 nt, Mycobacterium avium subsp. paratuberculosis
aacgggccgcagccgcgcgg

SEQ ID NO: 2809190 - RNA, 13 nt, Mycobacterium avium subsp. paratuberculosis
aacgggccgggca

SEQ ID NO: 2809191 - RNA, 20 nt, Mycobacterium avium subsp. paratuberculosis
aacggguccuugccggcggc

SEQ ID NO: 2809192 - RNA, 22 nt, Mycobacterium avium subsp. paratuberculosis
aacggguccuugccggcggcgg

SEQ ID NO: 2809193 - RNA, 18 nt, Mycobacterium avium subsp. paratuberculosis
aacgggucgaucucggcg

SEQ ID NO: 2809194 - RNA, 20 nt, Mycobacterium avium subsp. paratuberculosis
aacgggugaccggcggccag

SEQ ID NO: 2809195 - RNA, 18 nt, Mycobacterium avium subsp. paratuberculosis
aacgguacgugcgccggc

SEQ ID NO: 2809196 - RNA, 19 nt, Mycobacterium avium subsp. paratuberculosis
aacgguacgugcgccggcg

SEQ ID NO: 2809197 - RNA, 21 nt, Mycobacterium avium subsp. paratuberculosis
aacgguacgugcgccggcggu

SEQ ID NO: 2809198 - RNA, 14 nt, Mycobacterium avium subsp. paratuberculosis
aacgguucggccgc

SEQ ID NO: 2809199 - RNA, 19 nt, Mycobacterium avium subsp. paratuberculosis
aacgguucggccgcucggg

SEQ ID NO: 2809200 - RNA, 19 nt, Mycobacterium avium subsp. paratuberculosis
aacgguuuuucccagcggc

SEQ ID NO: 2809201 - RNA, 14 nt, Mycobacterium avium subsp. paratuberculosis
aacgucacggcgag

SEQ ID NO: 2809202 - RNA, 14 nt, Mycobacterium avium subsp. paratuberculosis
aacgucaggcccag

SEQ ID NO: 2809203 - RNA, 21 nt, Mycobacterium avium subsp. paratuberculosis
aacgucaggcccagcgaggcg

SEQ ID NO: 2809204 - RNA, 15 nt, Mycobacterium avium subsp. paratuberculosis
aacgucgauccccgc

SEQ ID NO: 2809205 - RNA, 14 nt, Mycobacterium avium subsp. paratuberculosis
aacgucucgcggga

SEQ ID NO: 2809206 - RNA, 22 nt, Mycobacterium avium subsp. paratuberculosis
aacgucugcgggaagcccaccg

SEQ ID NO: 2809207 - RNA, 13 nt, Mycobacterium avium subsp. paratuberculosis
aacgucuugggcg

SEQ ID NO: 2809208 - RNA, 16 nt, Mycobacterium avium subsp. paratuberculosis
aacgugauacgccgac

SEQ ID NO: 2809209 - RNA, 17 nt, Mycobacterium avium subsp. paratuberculosis
aacgugauagcggccgc

SEQ ID NO: 2809210 - RNA, 20 nt, Mycobacterium avium subsp. paratuberculosis
aacgugauagcggccgcgga

SEQ ID NO: 2809211 - RNA, 20 nt, Mycobacterium avium subsp. paratuberculosis
aacgugccacaggccgaaca

SEQ ID NO: 2809212 - RNA, 13 nt, Mycobacterium avium subsp. paratuberculosis
aacgugcccggcc

SEQ ID NO: 2809213 - RNA, 20 nt, Mycobacterium avium subsp. paratuberculosis
aacgugucgagcacgucgac

SEQ ID NO: 2809214 - RNA, 20 nt, Mycobacterium avium subsp. paratuberculosis
aacuacgagcagcaagagca

SEQ ID NO: 2809215 - RNA, 14 nt, Mycobacterium avium subsp. paratuberculosis
aacuacgcacccga

SEQ ID NO: 2809216 - RNA, 18 nt, Mycobacterium avium subsp. paratuberculosis
aacuacuucgucagcagc

SEQ ID NO: 2809217 - RNA, 19 nt, Mycobacterium avium subsp. paratuberculosis
aacuacuucgucagcagcg

SEQ ID NO: 2809218 - RNA, 19 nt, Mycobacterium avium subsp. paratuberculosis
aacuagcuucacgcucggc

SEQ ID NO: 2809219 - RNA, 14 nt, Mycobacterium avium subsp. paratuberculosis
aacuagcuucacgu

SEQ ID NO: 2809220 - RNA, 19 nt, Mycobacterium avium subsp. paratuberculosis
aacuagcuucacguucggc

SEQ ID NO: 2809221 - RNA, 18 nt, Mycobacterium avium subsp. paratuberculosis
aacuaucuggucugggcg

SEQ ID NO: 2809222 - RNA, 20 nt, Mycobacterium avium subsp. paratuberculosis
aacucaccgguggccgcguc

SEQ ID NO: 2809223 - RNA, 19 nt, Mycobacterium avium subsp. paratuberculosis
aacucaguccucgccgaga

SEQ ID NO: 2809224 - RNA, 12 nt, Mycobacterium avium subsp. paratuberculosis
aacucaugggcc

SEQ ID NO: 2809225 - RNA, 16 nt, Mycobacterium avium subsp. paratuberculosis
aacucaugggcccggc

SEQ ID NO: 2809226 - RNA, 13 nt, Mycobacterium avium subsp. paratuberculosis
aacuccagcagcu

SEQ ID NO: 2809227 - RNA, 15 nt, Mycobacterium avium subsp. paratuberculosis
aacuccgcgcgcggc

SEQ ID NO: 2809228 - RNA, 15 nt, Mycobacterium avium subsp. paratuberculosis
aacuccgcucgggcc

SEQ ID NO: 2809229 - RNA, 13 nt, Mycobacterium avium subsp. paratuberculosis
aacuccggcggca

SEQ ID NO: 2809230 - RNA, 21 nt, Mycobacterium avium subsp. paratuberculosis
aacuccggcggcagccaggcg

SEQ ID NO: 2809231 - RNA, 22 nt, Mycobacterium avium subsp. paratuberculosis
aacuccugcucgcgggccaccg

SEQ ID NO: 2809232 - RNA, 18 nt, Mycobacterium avium subsp. paratuberculosis
aacucgacccgcaccucg

SEQ ID NO: 2809233 - RNA, 22 nt, Mycobacterium avium subsp. paratuberculosis
aacucgaucugcagccggcgcg

SEQ ID NO: 2809234 - RNA, 23 nt, Mycobacterium avium subsp. paratuberculosis
aacucgccgaucgggaccgucac

SEQ ID NO: 2809235 - RNA, 20 nt, Mycobacterium avium subsp. paratuberculosis
aacucgcgaagaucggagcc

SEQ ID NO: 2809236 - RNA, 18 nt, Mycobacterium avium subsp. paratuberculosis
aacucgcgcucccggcgc

SEQ ID NO: 2809237 - RNA, 13 nt, Mycobacterium avium subsp. paratuberculosis
aacucggcggcgg

SEQ ID NO: 2809238 - RNA, 19 nt, Mycobacterium avium subsp. paratuberculosis
aacucggugaugccggcca

SEQ ID NO: 2809239 - RNA, 17 nt, Mycobacterium avium subsp. paratuberculosis
aacucgucgaugcacgc

SEQ ID NO: 2809240 - RNA, 18 nt, Mycobacterium avium subsp. paratuberculosis
aacucguugccagccggu

SEQ ID NO: 2809241 - RNA, 19 nt, Mycobacterium avium subsp. paratuberculosis
aacugaauuccuggccggu

SEQ ID NO: 2809242 - RNA, 13 nt, Mycobacterium avium subsp. paratuberculosis
aacugacaggcgg

SEQ ID NO: 2809243 - RNA, 22 nt, Mycobacterium avium subsp. paratuberculosis
aacugagcgcggcgagcggcaa

SEQ ID NO: 2809244 - RNA, 22 nt, Mycobacterium avium subsp. paratuberculosis
aacugauugcccuuggacaccu

SEQ ID NO: 2809245 - RNA, 12 nt, Mycobacterium avium subsp. paratuberculosis
aacugcaccagc

SEQ ID NO: 2809246 - RNA, 16 nt, Mycobacterium avium subsp. paratuberculosis
aacugcaccagcggcg

SEQ ID NO: 2809247 - RNA, 24 nt, Mycobacterium avium subsp. paratuberculosis
aacugcagauaggacccggcgagc

SEQ ID NO: 2809248 - RNA, 19 nt, Mycobacterium avium subsp. paratuberculosis
aacugcagcgacuggcccu

SEQ ID NO: 2809249 - RNA, 15 nt, Mycobacterium avium subsp. paratuberculosis
aacugcaucgccagc

SEQ ID NO: 2809250 - RNA, 17 nt, Mycobacterium avium subsp. paratuberculosis
aacugcaucgccagcac

SEQ ID NO: 2809251 - RNA, 12 nt, Mycobacterium avium subsp. paratuberculosis
aacugccgcggc

SEQ ID NO: 2809252 - RNA, 13 nt, Mycobacterium avium subsp. paratuberculosis
aacugccguagga

SEQ ID NO: 2809253 - RNA, 21 nt, Mycobacterium avium subsp. paratuberculosis
aacugcgcgucggagaucacc

SEQ ID NO: 2809254 - RNA, 13 nt, Mycobacterium avium subsp. paratuberculosis
aacugcucgacca

SEQ ID NO: 2809255 - RNA, 18 nt, Mycobacterium avium subsp. paratuberculosis
aacugcucgaccagcccc

SEQ ID NO: 2809256 - RNA, 17 nt, Mycobacterium avium subsp. paratuberculosis
aacugcucgaccagcgc

SEQ ID NO: 2809257 - RNA, 23 nt, Mycobacterium avium subsp. paratuberculosis
aacugcucgaccagcgccgaggu

SEQ ID NO: 2809258 - RNA, 18 nt, Mycobacterium avium subsp. paratuberculosis
aacugggugccccgccgu

SEQ ID NO: 2809259 - RNA, 21 nt, Mycobacterium avium subsp. paratuberculosis
aacugguccugcggcugguag

SEQ ID NO: 2809260 - RNA, 18 nt, Mycobacterium avium subsp. paratuberculosis
aacuggucgugcucgucg

SEQ ID NO: 2809261 - RNA, 20 nt, Mycobacterium avium subsp. paratuberculosis
aacuggucgugcucgucggc

SEQ ID NO: 2809262 - RNA, 13 nt, Mycobacterium avium subsp. paratuberculosis
aacugugcggugc

SEQ ID NO: 2809263 - RNA, 21 nt, Mycobacterium avium subsp. paratuberculosis
aacuguuaagacuucggcgaa

SEQ ID NO: 2809264 - RNA, 17 nt, Mycobacterium avium subsp. paratuberculosis
aacuguuuuuccgccgg

SEQ ID NO: 2809265 - RNA, 15 nt, Mycobacterium avium subsp. paratuberculosis
aacuuaacuucacgc

SEQ ID NO: 2809266 - RNA, 18 nt, Mycobacterium avium subsp. paratuberculosis
aacuucaccgucugcugg

SEQ ID NO: 2809267 - RNA, 20 nt, Mycobacterium avium subsp. paratuberculosis
aacuucaccgucugcuggcc

SEQ ID NO: 2809268 - RNA, 18 nt, Mycobacterium avium subsp. paratuberculosis
aacuucacgcucgcaggc

SEQ ID NO: 2809269 - RNA, 14 nt, Mycobacterium avium subsp. paratuberculosis
aacuucacgcucgg

SEQ ID NO: 2809270 - RNA, 15 nt, Mycobacterium avium subsp. paratuberculosis
aacuucacgcucggc

SEQ ID NO: 2809271 - RNA, 12 nt, Mycobacterium avium subsp. paratuberculosis
aacuucagcugc

SEQ ID NO: 2809272 - RNA, 16 nt, Mycobacterium avium subsp. paratuberculosis
aacuucaggcccucau

SEQ ID NO: 2809273 - RNA, 18 nt, Mycobacterium avium subsp. paratuberculosis
aacuuccgcccggcgagc

SEQ ID NO: 2809274 - RNA, 23 nt, Mycobacterium avium subsp. paratuberculosis
aacuucggggugacuucgagccg

SEQ ID NO: 2809275 - RNA, 19 nt, Mycobacterium avium subsp. paratuberculosis
aacuugaucagcucgcgga

SEQ ID NO: 2809276 - RNA, 18 nt, Mycobacterium avium subsp. paratuberculosis
aacuuguggaaggcgccg

SEQ ID NO: 2809277 - RNA, 21 nt, Mycobacterium avium subsp. paratuberculosis
aagaaccaacugagcgcggcg

SEQ ID NO: 2809278 - RNA, 16 nt, Mycobacterium avium subsp. paratuberculosis
aagaacgaaaagaugu

SEQ ID NO: 2809279 - RNA, 18 nt, Mycobacterium avium subsp. paratuberculosis
aagaacgaaaagauguau

SEQ ID NO: 2809280 - RNA, 23 nt, Mycobacterium avium subsp. paratuberculosis
aagaacgaaaagauguaucagga

SEQ ID NO: 2809281 - RNA, 16 nt, Mycobacterium avium subsp. paratuberculosis
aagaacgcgucccaca

SEQ ID NO: 2809282 - RNA, 13 nt, Mycobacterium avium subsp. paratuberculosis
aagaaguuucccc

SEQ ID NO: 2809283 - RNA, 14 nt, Mycobacterium avium subsp. paratuberculosis
aagaaguuucccca

SEQ ID NO: 2809284 - RNA, 17 nt, Mycobacterium avium subsp. paratuberculosis
aagaccggaagccuguu

SEQ ID NO: 2809285 - RNA, 14 nt, Mycobacterium avium subsp. paratuberculosis
aagaccguugacga

SEQ ID NO: 2809286 - RNA, 16 nt, Mycobacterium avium subsp. paratuberculosis
aagacggugggcccgc

SEQ ID NO: 2809287 - RNA, 17 nt, Mycobacterium avium subsp. paratuberculosis
aagacggugggcccgcc

SEQ ID NO: 2809288 - RNA, 19 nt, Mycobacterium avium subsp. paratuberculosis
aagacggugggcccgccgu

SEQ ID NO: 2809289 - RNA, 22 nt, Mycobacterium avium subsp. paratuberculosis
aagacguaggcggccagcagca

SEQ ID NO: 2809290 - RNA, 23 nt, Mycobacterium avium subsp. paratuberculosis
aagacguaggcggccagcagcac

SEQ ID NO: 2809291 - RNA, 17 nt, Mycobacterium avium subsp. paratuberculosis
aagacguccgcgucggc

SEQ ID NO: 2809292 - RNA, 21 nt, Mycobacterium avium subsp. paratuberculosis
aagacguccgcgucggcgccg

SEQ ID NO: 2809293 - RNA, 16 nt, Mycobacterium avium subsp. paratuberculosis
aagaucccgcuggcca

SEQ ID NO: 2809294 - RNA, 11 nt, Mycobacterium avium subsp. paratuberculosis
aagcuggccac

SEQ ID NO: 2809295 - RNA, 23 nt, Mycobacterium avium subsp. paratuberculosis
aagcuggccaccgcaucgccgag

SEQ ID NO: 2809296 - RNA, 23 nt, Mycobacterium avium subsp. paratuberculosis
aagcuggucgccaaacugcgcaa

SEQ ID NO: 2809297 - RNA, 18 nt, Mycobacterium avium subsp. paratuberculosis
aaggacuccaguugacgg

SEQ ID NO: 2809298 - RNA, 13 nt, Mycobacterium avium subsp. paratuberculosis
aaggacuggccca

SEQ ID NO: 2809299 - RNA, 12 nt, Mycobacterium avium subsp. paratuberculosis
aaggagcaaucg

SEQ ID NO: 2809300 - RNA, 18 nt, Mycobacterium avium subsp. paratuberculosis
aaggaugucgccgcagau

SEQ ID NO: 2809301 - RNA, 23 nt, Mycobacterium avium subsp. paratuberculosis
aaggcacccaggaaaaccagcga

SEQ ID NO: 2809302 - RNA, 12 nt, Mycobacterium avium subsp. paratuberculosis
aaggcaggcacu

SEQ ID NO: 2809303 - RNA, 23 nt, Mycobacterium avium subsp. paratuberculosis
aaggcaugggcgugccggcccgg

SEQ ID NO: 2809304 - RNA, 16 nt, Mycobacterium avium subsp. paratuberculosis
aaggccaaggccagca

SEQ ID NO: 2809305 - RNA, 12 nt, Mycobacterium avium subsp. paratuberculosis
aaggccagcaac

SEQ ID NO: 2809306 - RNA, 20 nt, Mycobacterium avium subsp. paratuberculosis
aaggccagcaaccgccgugg

SEQ ID NO: 2809307 - RNA, 16 nt, Mycobacterium avium subsp. paratuberculosis
aaggccagcacgcagg

SEQ ID NO: 2809308 - RNA, 13 nt, Mycobacterium avium subsp. paratuberculosis
aaggcccccggcu

SEQ ID NO: 2809309 - RNA, 21 nt, Mycobacterium avium subsp. paratuberculosis
aaggccgacagguagcaggcg

SEQ ID NO: 2809310 - RNA, 22 nt, Mycobacterium avium subsp. paratuberculosis
aaggccgacagguagcaggcgc

SEQ ID NO: 2809311 - RNA, 10 nt, Mycobacterium avium subsp. paratuberculosis
aaggccgccu

SEQ ID NO: 2809312 - RNA, 18 nt, Mycobacterium avium subsp. paratuberculosis
aaggccgcugcccggcgc

SEQ ID NO: 2809313 - RNA, 13 nt, Mycobacterium avium subsp. paratuberculosis
aaggccuggaaca

SEQ ID NO: 2809314 - RNA, 22 nt, Mycobacterium avium subsp. paratuberculosis
aaggccuuggugugagggcgug

SEQ ID NO: 2809315 - RNA, 23 nt, Mycobacterium avium subsp. paratuberculosis
aaggcgaauaaggggguagaugu

SEQ ID NO: 2809316 - RNA, 21 nt, Mycobacterium avium subsp. paratuberculosis
aaggcgcagaagcuaacgcca

SEQ ID NO: 2809317 - RNA, 17 nt, Mycobacterium avium subsp. paratuberculosis
aaggcgcgggcguccac

SEQ ID NO: 2809318 - RNA, 16 nt, Mycobacterium avium subsp. paratuberculosis
aaggcggccaccgcgg

SEQ ID NO: 2809319 - RNA, 19 nt, Mycobacterium avium subsp. paratuberculosis
aaggcggccaccgcggcca

SEQ ID NO: 2809320 - RNA, 14 nt, Mycobacterium avium subsp. paratuberculosis
aaggcggccgcgaa

SEQ ID NO: 2809321 - RNA, 15 nt, Mycobacterium avium subsp. paratuberculosis
aaggcggccgcgagc

SEQ ID NO: 2809322 - RNA, 21 nt, Mycobacterium avium subsp. paratuberculosis
aaggcggccgcgagcccggcg

SEQ ID NO: 2809323 - RNA, 12 nt, Mycobacterium avium subsp. paratuberculosis
aaggcggcgucg

SEQ ID NO: 2809324 - RNA, 19 nt, Mycobacterium avium subsp. paratuberculosis
aaggcggcgucgagcaccu

SEQ ID NO: 2809325 - RNA, 14 nt, Mycobacterium avium subsp. paratuberculosis
aaggcggcgucgau

SEQ ID NO: 2809326 - RNA, 18 nt, Mycobacterium avium subsp. paratuberculosis
aaggcguuggacuccacc

SEQ ID NO: 2809327 - RNA, 22 nt, Mycobacterium avium subsp. paratuberculosis
aaggcguuggacuccaccgcca

SEQ ID NO: 2809328 - RNA, 19 nt, Mycobacterium avium subsp. paratuberculosis
aaggcguuggagccgacca

SEQ ID NO: 2809329 - RNA, 22 nt, Mycobacterium avium subsp. paratuberculosis
aaggcguuggagccgaccagcg

SEQ ID NO: 2809330 - RNA, 18 nt, Mycobacterium avium subsp. paratuberculosis
aaggcguuguugaggaac

SEQ ID NO: 2809331 - RNA, 22 nt, Mycobacterium avium subsp. paratuberculosis
aaggcguuguugaggaacgcga

SEQ ID NO: 2809332 - RNA, 12 nt, Mycobacterium avium subsp. paratuberculosis
aaggcucgccac

SEQ ID NO: 2809333 - RNA, 18 nt, Mycobacterium avium subsp. paratuberculosis
aagggaaaggcagcagcc

SEQ ID NO: 2809334 - RNA, 15 nt, Mycobacterium avium subsp. paratuberculosis
aagggcgccagcacc

SEQ ID NO: 2809335 - RNA, 22 nt, Mycobacterium avium subsp. paratuberculosis
aagggcuccccggacagccacu

SEQ ID NO: 2809336 - RNA, 16 nt, Mycobacterium avium subsp. paratuberculosis
aagggcuuuagaaggc

SEQ ID NO: 2809337 - RNA, 18 nt, Mycobacterium avium subsp. paratuberculosis
aagggcuuuagaaggccg

SEQ ID NO: 2809338 - RNA, 14 nt, Mycobacterium avium subsp. paratuberculosis
aaggggccgggcua

SEQ ID NO: 2809339 - RNA, 9 nt, Mycobacterium avium subsp. paratuberculosis
aaggggucg

SEQ ID NO: 2809340 - RNA, 20 nt, Mycobacterium avium subsp. paratuberculosis
aaggggucguaccaccacca

SEQ ID NO: 2809341 - RNA, 19 nt, Mycobacterium avium subsp. paratuberculosis
aaggucugaaaugccgggc

SEQ ID NO: 2809342 - RNA, 13 nt, Mycobacterium avium subsp. paratuberculosis
aaggugacgucgc

SEQ ID NO: 2809343 - RNA, 16 nt, Mycobacterium avium subsp. paratuberculosis
aagguggacgagcagc

SEQ ID NO: 2809344 - RNA, 16 nt, Mycobacterium avium subsp. paratuberculosis
aaggugucgcacugcu

SEQ ID NO: 2809345 - RNA, 18 nt, Mycobacterium avium subsp. paratuberculosis
aaguacaccaccgcggcg

SEQ ID NO: 2809346 - RNA, 17 nt, Mycobacterium avium subsp. paratuberculosis
aaguacagcgucagcau

SEQ ID NO: 2809347 - RNA, 17 nt, Mycobacterium avium subsp. paratuberculosis
aaguacgccgucugguc

SEQ ID NO: 2809348 - RNA, 16 nt, Mycobacterium avium subsp. paratuberculosis
aaguagccggccagcg

SEQ ID NO: 2809349 - RNA, 12 nt, Mycobacterium avium subsp. paratuberculosis
aaguccgcgagg

SEQ ID NO: 2809350 - RNA, 12 nt, Mycobacterium avium subsp. paratuberculosis
aaguccggcggu

SEQ ID NO: 2809351 - RNA, 21 nt, Mycobacterium avium subsp. paratuberculosis
aaguccggcggucgcugcagc

SEQ ID NO: 2809352 - RNA, 21 nt, Mycobacterium avium subsp. paratuberculosis
aaguccggguccuaucaggac

SEQ ID NO: 2809353 - RNA, 22 nt, Mycobacterium avium subsp. paratuberculosis
aaguccggguccuaucaggacu

SEQ ID NO: 2809354 - RNA, 23 nt, Mycobacterium avium subsp. paratuberculosis
aaguccugcgccgcggugcgcca

SEQ ID NO: 2809355 - RNA, 15 nt, Mycobacterium avium subsp. paratuberculosis
aaguccuucucgggc

SEQ ID NO: 2809356 - RNA, 14 nt, Mycobacterium avium subsp. paratuberculosis
aagucgaccgcggc

SEQ ID NO: 2809357 - RNA, 16 nt, Mycobacterium avium subsp. paratuberculosis
aagucgacggcgguga

SEQ ID NO: 2809358 - RNA, 13 nt, Mycobacterium avium subsp. paratuberculosis
aagucgaugccgc

SEQ ID NO: 2809359 - RNA, 15 nt, Mycobacterium avium subsp. paratuberculosis
aagucgaugccgccc

SEQ ID NO: 2809360 - RNA, 16 nt, Mycobacterium avium subsp. paratuberculosis
aagucgauugccgcgg

SEQ ID NO: 2809361 - RNA, 17 nt, Mycobacterium avium subsp. paratuberculosis
aagucgccguccggggc

SEQ ID NO: 2809362 - RNA, 21 nt, Mycobacterium avium subsp. paratuberculosis
aagucgcugaggcugcgggug

SEQ ID NO: 2809363 - RNA, 16 nt, Mycobacterium avium subsp. paratuberculosis
aagucggugagcaccg

SEQ ID NO: 2809364 - RNA, 16 nt, Mycobacterium avium subsp. paratuberculosis
aagucguucagcugca

SEQ ID NO: 2809365 - RNA, 16 nt, Mycobacterium avium subsp. paratuberculosis
aagucguugcccgcca

SEQ ID NO: 2809366 - RNA, 18 nt, Mycobacterium avium subsp. paratuberculosis
aagugacgccgcucggcc

SEQ ID NO: 2809367 - RNA, 23 nt, Mycobacterium avium subsp. paratuberculosis
aagugacuggcguugaugcgggc

SEQ ID NO: 2809368 - RNA, 16 nt, Mycobacterium avium subsp. paratuberculosis
aagugcacgccgaggc

SEQ ID NO: 2809369 - RNA, 15 nt, Mycobacterium avium subsp. paratuberculosis
aagugcacucggcga

SEQ ID NO: 2809370 - RNA, 14 nt, Mycobacterium avium subsp. paratuberculosis
aagugcccgccuca

SEQ ID NO: 2809371 - RNA, 20 nt, Mycobacterium avium subsp. paratuberculosis
aagugccggacccccucggg

SEQ ID NO: 2809372 - RNA, 18 nt, Mycobacterium avium subsp. paratuberculosis
aaguggaccgcgugugcc

SEQ ID NO: 2809373 - RNA, 20 nt, Mycobacterium avium subsp. paratuberculosis
aaguggaccgcgugugcccg

SEQ ID NO: 2809374 - RNA, 23 nt, Mycobacterium avium subsp. paratuberculosis
aagugucguggggcucagccgaa

SEQ ID NO: 2809375 - RNA, 14 nt, Mycobacterium avium subsp. paratuberculosis
aaguguuguuugag

SEQ ID NO: 2809376 - RNA, 15 nt, Mycobacterium avium subsp. paratuberculosis
aaguuaacuucacgc

SEQ ID NO: 2809377 - RNA, 17 nt, Mycobacterium avium subsp. paratuberculosis
aaguucaccaccgcgcu

SEQ ID NO: 2809378 - RNA, 23 nt, Mycobacterium avium subsp. paratuberculosis
aaguucggcaucccggagaacau

SEQ ID NO: 2809379 - RNA, 13 nt, Mycobacterium avium subsp. paratuberculosis
acaacagcgccga

SEQ ID NO: 2809380 - RNA, 15 nt, Mycobacterium avium subsp. paratuberculosis
acaacauccgcgacg

SEQ ID NO: 2809381 - RNA, 20 nt, Mycobacterium avium subsp. paratuberculosis
acaacccggacagcgcgacg

SEQ ID NO: 2809382 - RNA, 19 nt, Mycobacterium avium subsp. paratuberculosis
acaaccgcugcugcugccc

SEQ ID NO: 2809383 - RNA, 20 nt, Mycobacterium avium subsp. paratuberculosis
acaacgccacaaacagcgcg

SEQ ID NO: 2809384 - RNA, 20 nt, Mycobacterium avium subsp. paratuberculosis
acaacgccagcgugagcuca

SEQ ID NO: 2809385 - RNA, 16 nt, Mycobacterium avium subsp. paratuberculosis
acaacgcgcacaacag

SEQ ID NO: 2809386 - RNA, 22 nt, Mycobacterium avium subsp. paratuberculosis
acaacgcguagaaccagugcgc

SEQ ID NO: 2809387 - RNA, 16 nt, Mycobacterium avium subsp. paratuberculosis
acaacggaucgagcgc

SEQ ID NO: 2809388 - RNA, 20 nt, Mycobacterium avium subsp. paratuberculosis
acaacggcggaccggcggcc

SEQ ID NO: 2809389 - RNA, 22 nt, Mycobacterium avium subsp. paratuberculosis
acaacggcggaccggcggccgc

SEQ ID NO: 2809390 - RNA, 14 nt, Mycobacterium avium subsp. paratuberculosis
acaacggugguggc

SEQ ID NO: 2809391 - RNA, 14 nt, Mycobacterium avium subsp. paratuberculosis
acaacucagaacag

SEQ ID NO: 2809392 - RNA, 20 nt, Mycobacterium avium subsp. paratuberculosis
acaacucgacgcucggcgau

SEQ ID NO: 2809393 - RNA, 20 nt, Mycobacterium avium subsp. paratuberculosis
acaacucgacguucggcggg

SEQ ID NO: 2809394 - RNA, 16 nt, Mycobacterium avium subsp. paratuberculosis
acaacucgccggagcg

SEQ ID NO: 2809395 - RNA, 14 nt, Mycobacterium avium subsp. paratuberculosis
acaacuggccggga

SEQ ID NO: 2809396 - RNA, 15 nt, Mycobacterium avium subsp. paratuberculosis
acaagccggcgucga

SEQ ID NO: 2809397 - RNA, 22 nt, Mycobacterium avium subsp. paratuberculosis
acaagggccgggcgcuggccgu

SEQ ID NO: 2809398 - RNA, 21 nt, Mycobacterium avium subsp. paratuberculosis
acaagggcggguaggcgccga

SEQ ID NO: 2809399 - RNA, 16 nt, Mycobacterium avium subsp. paratuberculosis
acaaggugauggcccg

SEQ ID NO: 2809400 - RNA, 17 nt, Mycobacterium avium subsp. paratuberculosis
acaaucgcugcgagccc

SEQ ID NO: 2809401 - RNA, 16 nt, Mycobacterium avium subsp. paratuberculosis
acaaucucgggcaccc

SEQ ID NO: 2809402 - RNA, 23 nt, Mycobacterium avium subsp. paratuberculosis
acacaaaagcacccaaaacaucg

SEQ ID NO: 2809403 - RNA, 16 nt, Mycobacterium avium subsp. paratuberculosis
acacaaaagcgcccga

SEQ ID NO: 2809404 - RNA, 20 nt, Mycobacterium avium subsp. paratuberculosis
acacaaggaaggaggugguc

SEQ ID NO: 2809405 - RNA, 21 nt, Mycobacterium avium subsp. paratuberculosis
acacaccagcggucggcgguu

SEQ ID NO: 2809406 - RNA, 17 nt, Mycobacterium avium subsp. paratuberculosis
acacagcaccggcgucg

SEQ ID NO: 2809407 - RNA, 19 nt, Mycobacterium avium subsp. paratuberculosis
acacagcaccggcgucgac

SEQ ID NO: 2809408 - RNA, 19 nt, Mycobacterium avium subsp. paratuberculosis
acacagcagcagcaccagg

SEQ ID NO: 2809409 - RNA, 21 nt, Mycobacterium avium subsp. paratuberculosis
acacagcagcagcaccaggcu

SEQ ID NO: 2809410 - RNA, 22 nt, Mycobacterium avium subsp. paratuberculosis
acacagccaaagccuacggcgc

SEQ ID NO: 2809411 - RNA, 18 nt, Mycobacterium avium subsp. paratuberculosis
acacagccaaucgccgau

SEQ ID NO: 2809412 - RNA, 20 nt, Mycobacterium avium subsp. paratuberculosis
acacagcccccacgcucggc

SEQ ID NO: 2809413 - RNA, 15 nt, Mycobacterium avium subsp. paratuberculosis
acacagccgcuuggc

SEQ ID NO: 2809414 - RNA, 16 nt, Mycobacterium avium subsp. paratuberculosis
acacaggaccagcacu

SEQ ID NO: 2809415 - RNA, 12 nt, Mycobacterium avium subsp. paratuberculosis
acaccaccaccg

SEQ ID NO: 2809416 - RNA, 20 nt, Mycobacterium avium subsp. paratuberculosis
acaccaccacgugccccucc

SEQ ID NO: 2809417 - RNA, 16 nt, Mycobacterium avium subsp. paratuberculosis
acaccaccaggccgua

SEQ ID NO: 2809418 - RNA, 14 nt, Mycobacterium avium subsp. paratuberculosis
acaccaccgccagg

SEQ ID NO: 2809419 - RNA, 13 nt, Mycobacterium avium subsp. paratuberculosis
acaccaccgcgcg

SEQ ID NO: 2809420 - RNA, 14 nt, Mycobacterium avium subsp. paratuberculosis
acaccaccgcggcg

SEQ ID NO: 2809421 - RNA, 14 nt, Mycobacterium avium subsp. paratuberculosis
acaccaccggcaac

SEQ ID NO: 2809422 - RNA, 13 nt, Mycobacterium avium subsp. paratuberculosis
acaccaccggccg

SEQ ID NO: 2809423 - RNA, 16 nt, Mycobacterium avium subsp. paratuberculosis
acaccacgaucagcgc

SEQ ID NO: 2809424 - RNA, 18 nt, Mycobacterium avium subsp. paratuberculosis
acaccacgccgagcaccu

SEQ ID NO: 2809425 - RNA, 13 nt, Mycobacterium avium subsp. paratuberculosis
acaccacggccgg

SEQ ID NO: 2809426 - RNA, 19 nt, Mycobacterium avium subsp. paratuberculosis
acaccacgguccccgcgcc

SEQ ID NO: 2809427 - RNA, 22 nt, Mycobacterium avium subsp. paratuberculosis
acaccacgguccccgcgcccgc

SEQ ID NO: 2809428 - RNA, 18 nt, Mycobacterium avium subsp. paratuberculosis
acaccacggucgccgcgc

SEQ ID NO: 2809429 - RNA, 21 nt, Mycobacterium avium subsp. paratuberculosis
acaccacgguguagcggcggc

SEQ ID NO: 2809430 - RNA, 22 nt, Mycobacterium avium subsp. paratuberculosis
acaccacgucggugccgcguuc

SEQ ID NO: 2809431 - RNA, 21 nt, Mycobacterium avium subsp. paratuberculosis
acaccagaugccgcucggcgc

SEQ ID NO: 2809432 - RNA, 22 nt, Mycobacterium avium subsp. paratuberculosis
acaccagaugccgcucggcgcu

SEQ ID NO: 2809433 - RNA, 17 nt, Mycobacterium avium subsp. paratuberculosis
acaccagcacccagcac

SEQ ID NO: 2809434 - RNA, 14 nt, Mycobacterium avium subsp. paratuberculosis
acaccagcacggcg

SEQ ID NO: 2809435 - RNA, 15 nt, Mycobacterium avium subsp. paratuberculosis
acaccagcccggccg

SEQ ID NO: 2809436 - RNA, 15 nt, Mycobacterium avium subsp. paratuberculosis
acaccagcgcgcacg

SEQ ID NO: 2809437 - RNA, 15 nt, Mycobacterium avium subsp. paratuberculosis
acaccagcggucggc

SEQ ID NO: 2809438 - RNA, 16 nt, Mycobacterium avium subsp. paratuberculosis
acaccagcggucggcg

SEQ ID NO: 2809439 - RNA, 18 nt, Mycobacterium avium subsp. paratuberculosis
acaccagcgucgcgauca

SEQ ID NO: 2809440 - RNA, 21 nt, Mycobacterium avium subsp. paratuberculosis
acaccagcguucgucgccggu

SEQ ID NO: 2809441 - RNA, 17 nt, Mycobacterium avium subsp. paratuberculosis
acaccagggugcgcagc

SEQ ID NO: 2809442 - RNA, 21 nt, Mycobacterium avium subsp. paratuberculosis
acaccagggugcgcagcgcgu

SEQ ID NO: 2809443 - RNA, 19 nt, Mycobacterium avium subsp. paratuberculosis
acaccagguaggcgguggc

SEQ ID NO: 2809444 - RNA, 22 nt, Mycobacterium avium subsp. paratuberculosis
acaccaggucgagguccucggc

SEQ ID NO: 2809445 - RNA, 16 nt, Mycobacterium avium subsp. paratuberculosis
acacccagccgcugaa

SEQ ID NO: 2809446 - RNA, 17 nt, Mycobacterium avium subsp. paratuberculosis
acacccagcgagccgau

SEQ ID NO: 2809447 - RNA, 14 nt, Mycobacterium avium subsp. paratuberculosis
acacccagcgccag

SEQ ID NO: 2809448 - RNA, 23 nt, Mycobacterium avium subsp. paratuberculosis
acacccaggucuuccggaugccg

SEQ ID NO: 2809449 - RNA, 17 nt, Mycobacterium avium subsp. paratuberculosis
acacccauucacgcagc

SEQ ID NO: 2809450 - RNA, 12 nt, Mycobacterium avium subsp. paratuberculosis
acaccccacacc

SEQ ID NO: 2809451 - RNA, 12 nt, Mycobacterium avium subsp. paratuberculosis
acacccccgcgc

SEQ ID NO: 2809452 - RNA, 13 nt, Mycobacterium avium subsp. paratuberculosis
acaccccgcgagu

SEQ ID NO: 2809453 - RNA, 21 nt, Mycobacterium avium subsp. paratuberculosis
acaccccgcgagucaccggcu

SEQ ID NO: 2809454 - RNA, 13 nt, Mycobacterium avium subsp. paratuberculosis
acaccccggccag

SEQ ID NO: 2809455 - RNA, 23 nt, Mycobacterium avium subsp. paratuberculosis
acacccgcggccgcugcgcccag

SEQ ID NO: 2809456 - RNA, 20 nt, Mycobacterium avium subsp. paratuberculosis
acacccggcuucgcugcgcc

SEQ ID NO: 2809457 - RNA, 17 nt, Mycobacterium avium subsp. paratuberculosis
acacccggugcgccggu

SEQ ID NO: 2809458 - RNA, 19 nt, Mycobacterium avium subsp. paratuberculosis
acacccgucgacucggcgg

SEQ ID NO: 2809459 - RNA, 16 nt, Mycobacterium avium subsp. paratuberculosis
acacccucaccccgcc

SEQ ID NO: 2809460 - RNA, 14 nt, Mycobacterium avium subsp. paratuberculosis
acacccucgacccg

SEQ ID NO: 2809461 - RNA, 14 nt, Mycobacterium avium subsp. paratuberculosis
acacccucggcccg

SEQ ID NO: 2809462 - RNA, 13 nt, Mycobacterium avium subsp. paratuberculosis
acacccucggggu

SEQ ID NO: 2809463 - RNA, 23 nt, Mycobacterium avium subsp. paratuberculosis
acacccucgggguagccggcccg

SEQ ID NO: 2809464 - RNA, 23 nt, Mycobacterium avium subsp. paratuberculosis
acacgaucucggucgccagcacc

SEQ ID NO: 2809465 - RNA, 12 nt, Mycobacterium avium subsp. paratuberculosis
acacgaucucgu

SEQ ID NO: 2809466 - RNA, 18 nt, Mycobacterium avium subsp. paratuberculosis
acacgauggcggcccaga

SEQ ID NO: 2809467 - RNA, 21 nt, Mycobacterium avium subsp. paratuberculosis
acacgauguugaugucgcgcg

SEQ ID NO: 2809468 - RNA, 17 nt, Mycobacterium avium subsp. paratuberculosis
acacgcaggugcgccgc

SEQ ID NO: 2809469 - RNA, 18 nt, Mycobacterium avium subsp. paratuberculosis
acacgcaggugcgccgcu

SEQ ID NO: 2809470 - RNA, 19 nt, Mycobacterium avium subsp. paratuberculosis
acacgcaggugcgccgcuc

SEQ ID NO: 2809471 - RNA, 23 nt, Mycobacterium avium subsp. paratuberculosis
acacgcaggugcgccgcucgucg

SEQ ID NO: 2809472 - RNA, 14 nt, Mycobacterium avium subsp. paratuberculosis
acacgcccagcgcc

SEQ ID NO: 2809473 - RNA, 22 nt, Mycobacterium avium subsp. paratuberculosis
acacgcccugguaggccuggaa

SEQ ID NO: 2809474 - RNA, 11 nt, Mycobacterium avium subsp. paratuberculosis
acacgccgacg

SEQ ID NO: 2809475 - RNA, 16 nt, Mycobacterium avium subsp. paratuberculosis
acacgccgaucgggau

SEQ ID NO: 2809476 - RNA, 14 nt, Mycobacterium avium subsp. paratuberculosis
acacgccggcggcc

SEQ ID NO: 2809477 - RNA, 12 nt, Mycobacterium avium subsp. paratuberculosis
acacgccuggac

SEQ ID NO: 2809478 - RNA, 16 nt, Mycobacterium avium subsp. paratuberculosis
acacgccuggacaggg

SEQ ID NO: 2809479 - RNA, 16 nt, Mycobacterium avium subsp. paratuberculosis
acacgcggacagggcg

SEQ ID NO: 2809480 - RNA, 23 nt, Mycobacterium avium subsp. paratuberculosis
acacgcgguccacuuccgcgcag

SEQ ID NO: 2809481 - RNA, 14 nt, Mycobacterium avium subsp. paratuberculosis
acacgcucggcgcg

SEQ ID NO: 2809482 - RNA, 15 nt, Mycobacterium avium subsp. paratuberculosis
acacggcaggcggcc

SEQ ID NO: 2809483 - RNA, 20 nt, Mycobacterium avium subsp. paratuberculosis
acacggcaggcggcccgcuc

SEQ ID NO: 2809484 - RNA, 22 nt, Mycobacterium avium subsp. paratuberculosis
acacggcccgcggcacgcugcg

SEQ ID NO: 2809485 - RNA, 15 nt, Mycobacterium avium subsp. paratuberculosis
acacggccgccucca

SEQ ID NO: 2809486 - RNA, 20 nt, Mycobacterium avium subsp. paratuberculosis
acacggccgccuccagcacg

SEQ ID NO: 2809487 - RNA, 16 nt, Mycobacterium avium subsp. paratuberculosis
acacggccucgcccag

SEQ ID NO: 2809488 - RNA, 19 nt, Mycobacterium avium subsp. paratuberculosis
acacggccucgcccagcgc

SEQ ID NO: 2809489 - RNA, 20 nt, Mycobacterium avium subsp. paratuberculosis
acacggccucgcccagcgcc

SEQ ID NO: 2809490 - RNA, 21 nt, Mycobacterium avium subsp. paratuberculosis
acacggccucgcccagcgccg

SEQ ID NO: 2809491 - RNA, 12 nt, Mycobacterium avium subsp. paratuberculosis
acacggcgccgu

SEQ ID NO: 2809492 - RNA, 17 nt, Mycobacterium avium subsp. paratuberculosis
acacggcgcugagcgac

SEQ ID NO: 2809493 - RNA, 19 nt, Mycobacterium avium subsp. paratuberculosis
acacggcggcgcgcacguc

SEQ ID NO: 2809494 - RNA, 19 nt, Mycobacterium avium subsp. paratuberculosis
acacggcggcgcgggcggc

SEQ ID NO: 2809495 - RNA, 19 nt, Mycobacterium avium subsp. paratuberculosis
acacggcucgggggccgcu

SEQ ID NO: 2809496 - RNA, 14 nt, Mycobacterium avium subsp. paratuberculosis
acacggcugcaccc

SEQ ID NO: 2809497 - RNA, 13 nt, Mycobacterium avium subsp. paratuberculosis
acacgggcccguc

SEQ ID NO: 2809498 - RNA, 16 nt, Mycobacterium avium subsp. paratuberculosis
acacgggccgcgccga

SEQ ID NO: 2809499 - RNA, 17 nt, Mycobacterium avium subsp. paratuberculosis
acacgggccgcgccgag

SEQ ID NO: 2809500 - RNA, 14 nt, Mycobacterium avium subsp. paratuberculosis
acacgggccgucca

SEQ ID NO: 2809501 - RNA, 23 nt, Mycobacterium avium subsp. paratuberculosis
acacgggcggcagggccagcacc

SEQ ID NO: 2809502 - RNA, 18 nt, Mycobacterium avium subsp. paratuberculosis
acacguacagcggcggcc

SEQ ID NO: 2809503 - RNA, 23 nt, Mycobacterium avium subsp. paratuberculosis
acacguagaaggcgccgucggug

SEQ ID NO: 2809504 - RNA, 18 nt, Mycobacterium avium subsp. paratuberculosis
acacguagcgguccagcg

SEQ ID NO: 2809505 - RNA, 19 nt, Mycobacterium avium subsp. paratuberculosis
acacguagcgguccagcgu

SEQ ID NO: 2809506 - RNA, 20 nt, Mycobacterium avium subsp. paratuberculosis
acacguccagcucucgagca

SEQ ID NO: 2809507 - RNA, 15 nt, Mycobacterium avium subsp. paratuberculosis
acacgugcaucugcg

SEQ ID NO: 2809508 - RNA, 17 nt, Mycobacterium avium subsp. paratuberculosis
acacgugcggauggccc

SEQ ID NO: 2809509 - RNA, 23 nt, Mycobacterium avium subsp. paratuberculosis
acacgugcggauggccccggcga

SEQ ID NO: 2809510 - RNA, 22 nt, Mycobacterium avium subsp. paratuberculosis
acacguggaccgagcgcgcgau

SEQ ID NO: 2809511 - RNA, 13 nt, Mycobacterium avium subsp. paratuberculosis
acacguggccgau

SEQ ID NO: 2809512 - RNA, 22 nt, Mycobacterium avium subsp. paratuberculosis
acacgugggcaaucugcccugc

SEQ ID NO: 2809513 - RNA, 16 nt, Mycobacterium avium subsp. paratuberculosis
acacguugagcccgga

SEQ ID NO: 2809514 - RNA, 20 nt, Mycobacterium avium subsp. paratuberculosis
acacguugagcccggaccgg

SEQ ID NO: 2809515 - RNA, 22 nt, Mycobacterium avium subsp. paratuberculosis
acacguugagcccggaccggcc

SEQ ID NO: 2809516 - RNA, 22 nt, Mycobacterium avium subsp. paratuberculosis
acacguugcgcaucagcgccac

SEQ ID NO: 2809517 - RNA, 19 nt, Mycobacterium avium subsp. paratuberculosis
acacguuggccagaugccc

SEQ ID NO: 2809518 - RNA, 22 nt, Mycobacterium avium subsp. paratuberculosis
acacguuucggcccuccagcac

SEQ ID NO: 2809519 - RNA, 14 nt, Mycobacterium avium subsp. paratuberculosis
acacucgagcgcgc

SEQ ID NO: 2809520 - RNA, 13 nt, Mycobacterium avium subsp. paratuberculosis
acacuggccaugc

SEQ ID NO: 2809521 - RNA, 18 nt, Mycobacterium avium subsp. paratuberculosis
acacuggcgugacgcucg

SEQ ID NO: 2809522 - RNA, 20 nt, Mycobacterium avium subsp. paratuberculosis
acacuggcgugacgcucggc

SEQ ID NO: 2809523 - RNA, 21 nt, Mycobacterium avium subsp. paratuberculosis
acacuucggguguggugccgg

SEQ ID NO: 2809524 - RNA, 12 nt, Mycobacterium avium subsp. paratuberculosis
acagacacagca

SEQ ID NO: 2809525 - RNA, 15 nt, Mycobacterium avium subsp. paratuberculosis
acagacaucgcugac

SEQ ID NO: 2809526 - RNA, 13 nt, Mycobacterium avium subsp. paratuberculosis
acagacucagccc

SEQ ID NO: 2809527 - RNA, 19 nt, Mycobacterium avium subsp. paratuberculosis
acagacucagcccggccca

SEQ ID NO: 2809528 - RNA, 19 nt, Mycobacterium avium subsp. paratuberculosis
acagagcgggaucccgcag

SEQ ID NO: 2809529 - RNA, 23 nt, Mycobacterium avium subsp. paratuberculosis
acagagucgaauugucuugcgug

SEQ ID NO: 2809530 - RNA, 16 nt, Mycobacterium avium subsp. paratuberculosis
acagaucgucucggcc

SEQ ID NO: 2809531 - RNA, 14 nt, Mycobacterium avium subsp. paratuberculosis
acagaugccugccc

SEQ ID NO: 2809532 - RNA, 23 nt, Mycobacterium avium subsp. paratuberculosis
acagaugccugcccagcggcacg

SEQ ID NO: 2809533 - RNA, 16 nt, Mycobacterium avium subsp. paratuberculosis
acagaugcggcaccag

SEQ ID NO: 2809534 - RNA, 23 nt, Mycobacterium avium subsp. paratuberculosis
acagauggugaaggugcccuccu

SEQ ID NO: 2809535 - RNA, 12 nt, Mycobacterium avium subsp. paratuberculosis
acagcaacgcca

SEQ ID NO: 2809536 - RNA, 13 nt, Mycobacterium avium subsp. paratuberculosis
acagcaccaccag

SEQ ID NO: 2809537 - RNA, 17 nt, Mycobacterium avium subsp. paratuberculosis
acagcaccagcaccacc

SEQ ID NO: 2809538 - RNA, 16 nt, Mycobacterium avium subsp. paratuberculosis
acagcacccaggugcu

SEQ ID NO: 2809539 - RNA, 19 nt, Mycobacterium avium subsp. paratuberculosis
acagcacccaggugcugcc

SEQ ID NO: 2809540 - RNA, 18 nt, Mycobacterium avium subsp. paratuberculosis
acagcacccccucggcgc

SEQ ID NO: 2809541 - RNA, 19 nt, Mycobacterium avium subsp. paratuberculosis
acagcacccccucggcgcc

SEQ ID NO: 2809542 - RNA, 13 nt, Mycobacterium avium subsp. paratuberculosis
acagcacccgcug

SEQ ID NO: 2809543 - RNA, 18 nt, Mycobacterium avium subsp. paratuberculosis
acagcacccgcugcagcc

SEQ ID NO: 2809544 - RNA, 22 nt, Mycobacterium avium subsp. paratuberculosis
acagcacccgcugcagccgguc

SEQ ID NO: 2809545 - RNA, 17 nt, Mycobacterium avium subsp. paratuberculosis
acagcaccgccacggcg

SEQ ID NO: 2809546 - RNA, 19 nt, Mycobacterium avium subsp. paratuberculosis
acagcaccgccacggcgac

SEQ ID NO: 2809547 - RNA, 14 nt, Mycobacterium avium subsp. paratuberculosis
acagcaccgccgcg

SEQ ID NO: 2809548 - RNA, 16 nt, Mycobacterium avium subsp. paratuberculosis
acagcgacuccagcgc

SEQ ID NO: 2809549 - RNA, 17 nt, Mycobacterium avium subsp. paratuberculosis
acagcgacuccagcgcg

SEQ ID NO: 2809550 - RNA, 19 nt, Mycobacterium avium subsp. paratuberculosis
acagcgacuccagcgcgau

SEQ ID NO: 2809551 - RNA, 21 nt, Mycobacterium avium subsp. paratuberculosis
acagcgacuccagcgcgauca

SEQ ID NO: 2809552 - RNA, 15 nt, Mycobacterium avium subsp. paratuberculosis
acagcgagaagucgc

SEQ ID NO: 2809553 - RNA, 15 nt, Mycobacterium avium subsp. paratuberculosis
acagcgagccgucga

SEQ ID NO: 2809554 - RNA, 16 nt, Mycobacterium avium subsp. paratuberculosis
acagcgagccgucgac

SEQ ID NO: 2809555 - RNA, 13 nt, Mycobacterium avium subsp. paratuberculosis
acagcgaggcgac

SEQ ID NO: 2809556 - RNA, 19 nt, Mycobacterium avium subsp. paratuberculosis
acagcgauuugagcauguu

SEQ ID NO: 2809557 - RNA, 12 nt, Mycobacterium avium subsp. paratuberculosis
acagcgccagca

SEQ ID NO: 2809558 - RNA, 13 nt, Mycobacterium avium subsp. paratuberculosis
acagcgccagcac

SEQ ID NO: 2809559 - RNA, 16 nt, Mycobacterium avium subsp. paratuberculosis
acagcgccagcacggc

SEQ ID NO: 2809560 - RNA, 13 nt, Mycobacterium avium subsp. paratuberculosis
acagcgccagcgg

SEQ ID NO: 2809561 - RNA, 15 nt, Mycobacterium avium subsp. paratuberculosis
acagcgccagggugc

SEQ ID NO: 2809562 - RNA, 21 nt, Mycobacterium avium subsp. paratuberculosis
acagcgcccggaugucgggcg

SEQ ID NO: 2809563 - RNA, 13 nt, Mycobacterium avium subsp. paratuberculosis
acagcgcccggcc

SEQ ID NO: 2809564 - RNA, 15 nt, Mycobacterium avium subsp. paratuberculosis
acagcgcccuugagc

SEQ ID NO: 2809565 - RNA, 11 nt, Mycobacterium avium subsp. paratuberculosis
acagcgccgac

SEQ ID NO: 2809566 - RNA, 23 nt, Mycobacterium avium subsp. paratuberculosis
acagcgccgacuuggugccaugc

SEQ ID NO: 2809567 - RNA, 17 nt, Mycobacterium avium subsp. paratuberculosis
acagcgccgcggccagc

SEQ ID NO: 2809568 - RNA, 20 nt, Mycobacterium avium subsp. paratuberculosis
acagcgccgcguugucggcg

SEQ ID NO: 2809569 - RNA, 14 nt, Mycobacterium avium subsp. paratuberculosis
acagcgccggaccg

SEQ ID NO: 2809570 - RNA, 15 nt, Mycobacterium avium subsp. paratuberculosis
acagcgccggaccga

SEQ ID NO: 2809571 - RNA, 15 nt, Mycobacterium avium subsp. paratuberculosis
acagcgccucgcggu

SEQ ID NO: 2809572 - RNA, 16 nt, Mycobacterium avium subsp. paratuberculosis
acagcgccucgcgguc

SEQ ID NO: 2809573 - RNA, 17 nt, Mycobacterium avium subsp. paratuberculosis
acagcgccucgucgagc

SEQ ID NO: 2809574 - RNA, 22 nt, Mycobacterium avium subsp. paratuberculosis
acagcgccucgucgagccgggc

SEQ ID NO: 2809575 - RNA, 10 nt, Mycobacterium avium subsp. paratuberculosis
acagcgcgac

SEQ ID NO: 2809576 - RNA, 12 nt, Mycobacterium avium subsp. paratuberculosis
acagcgcgacgc

SEQ ID NO: 2809577 - RNA, 21 nt, Mycobacterium avium subsp. paratuberculosis
acagcgcgacgcacgccggcg

SEQ ID NO: 2809578 - RNA, 23 nt, Mycobacterium avium subsp. paratuberculosis
acagcgcgacgcacgccggcggg

SEQ ID NO: 2809579 - RNA, 11 nt, Mycobacterium avium subsp. paratuberculosis
acagcgcgccc

SEQ ID NO: 2809580 - RNA, 13 nt, Mycobacterium avium subsp. paratuberculosis
acagcgcgcccga

SEQ ID NO: 2809581 - RNA, 14 nt, Mycobacterium avium subsp. paratuberculosis
acagcgcgcccgac

SEQ ID NO: 2809582 - RNA, 15 nt, Mycobacterium avium subsp. paratuberculosis
acagcgcgcccgacg

SEQ ID NO: 2809583 - RNA, 18 nt, Mycobacterium avium subsp. paratuberculosis
acagcgcgcccgacgguc

SEQ ID NO: 2809584 - RNA, 20 nt, Mycobacterium avium subsp. paratuberculosis
acagcgcgcccgacggucgc

SEQ ID NO: 2809585 - RNA, 13 nt, Mycobacterium avium subsp. paratuberculosis
acagcgcgccgaa

SEQ ID NO: 2809586 - RNA, 23 nt, Mycobacterium avium subsp. paratuberculosis
acagcgcgccgaacaccugcggc

SEQ ID NO: 2809587 - RNA, 15 nt, Mycobacterium avium subsp. paratuberculosis
acagcgcgccggccg

SEQ ID NO: 2809588 - RNA, 16 nt, Mycobacterium avium subsp. paratuberculosis
acagcgcgccggccgg

SEQ ID NO: 2809589 - RNA, 21 nt, Mycobacterium avium subsp. paratuberculosis
acagcgcgguggucagcggcg

SEQ ID NO: 2809590 - RNA, 16 nt, Mycobacterium avium subsp. paratuberculosis
acagcgcgucggccag

SEQ ID NO: 2809591 - RNA, 15 nt, Mycobacterium avium subsp. paratuberculosis
acagcgcgucggcga

SEQ ID NO: 2809592 - RNA, 12 nt, Mycobacterium avium subsp. paratuberculosis
acagcggcccga

SEQ ID NO: 2809593 - RNA, 20 nt, Mycobacterium avium subsp. paratuberculosis
acagcggcccgaucaccgcc

SEQ ID NO: 2809594 - RNA, 15 nt, Mycobacterium avium subsp. paratuberculosis
acagcggcgcgcgcc

SEQ ID NO: 2809595 - RNA, 14 nt, Mycobacterium avium subsp. paratuberculosis
acagcggcgcgguu

SEQ ID NO: 2809596 - RNA, 23 nt, Mycobacterium avium subsp. paratuberculosis
acagcggcggccauucaucgcgc

SEQ ID NO: 2809597 - RNA, 22 nt, Mycobacterium avium subsp. paratuberculosis
acagcgggaacaccacgucguc

SEQ ID NO: 2809598 - RNA, 19 nt, Mycobacterium avium subsp. paratuberculosis
acagcgggauguagccggu

SEQ ID NO: 2809599 - RNA, 18 nt, Mycobacterium avium subsp. paratuberculosis
acagcgggcagagcugcu

SEQ ID NO: 2809600 - RNA, 14 nt, Mycobacterium avium subsp. paratuberculosis
acagcgggccggcg

SEQ ID NO: 2809601 - RNA, 20 nt, Mycobacterium avium subsp. paratuberculosis
acagcgggccggcgucgucg

SEQ ID NO: 2809602 - RNA, 15 nt, Mycobacterium avium subsp. paratuberculosis
acagcggggugccca

SEQ ID NO: 2809603 - RNA, 21 nt, Mycobacterium avium subsp. paratuberculosis
acagcgggucguuggcggcgg

SEQ ID NO: 2809604 - RNA, 23 nt, Mycobacterium avium subsp. paratuberculosis
acagcggguuguucuccagcggc

SEQ ID NO: 2809605 - RNA, 22 nt, Mycobacterium avium subsp. paratuberculosis
acagcgguaucccguugggguc

SEQ ID NO: 2809606 - RNA, 16 nt, Mycobacterium avium subsp. paratuberculosis
acagcgguucggcgac

SEQ ID NO: 2809607 - RNA, 17 nt, Mycobacterium avium subsp. paratuberculosis
acagcgguucggcgacg

SEQ ID NO: 2809608 - RNA, 18 nt, Mycobacterium avium subsp. paratuberculosis
acagcgguucggcgacgc

SEQ ID NO: 2809609 - RNA, 22 nt, Mycobacterium avium subsp. paratuberculosis
acagcgucaccaaugcgccggc

SEQ ID NO: 2809610 - RNA, 23 nt, Mycobacterium avium subsp. paratuberculosis
acagcgucaccaaugcgccggcg

SEQ ID NO: 2809611 - RNA, 24 nt, Mycobacterium avium subsp. paratuberculosis
acagcgucaccaaugcgccggcgg

SEQ ID NO: 2809612 - RNA, 12 nt, Mycobacterium avium subsp. paratuberculosis
acagcgucagca

SEQ ID NO: 2809613 - RNA, 21 nt, Mycobacterium avium subsp. paratuberculosis
acagcgucagcaucgccgucg

SEQ ID NO: 2809614 - RNA, 13 nt, Mycobacterium avium subsp. paratuberculosis
acagcgucgccga

SEQ ID NO: 2809615 - RNA, 14 nt, Mycobacterium avium subsp. paratuberculosis
acagcgucgccgac

SEQ ID NO: 2809616 - RNA, 15 nt, Mycobacterium avium subsp. paratuberculosis
acagcgucgccgacg

SEQ ID NO: 2809617 - RNA, 16 nt, Mycobacterium avium subsp. paratuberculosis
acagcgucgccgacgg

SEQ ID NO: 2809618 - RNA, 17 nt, Mycobacterium avium subsp. paratuberculosis
acagcgucguccaugcc

SEQ ID NO: 2809619 - RNA, 20 nt, Mycobacterium avium subsp. paratuberculosis
acagcgucguccaugcccgc

SEQ ID NO: 2809620 - RNA, 18 nt, Mycobacterium avium subsp. paratuberculosis
acagcgucucgaccgcgg

SEQ ID NO: 2809621 - RNA, 20 nt, Mycobacterium avium subsp. paratuberculosis
acagcgucucgaccgcggug

SEQ ID NO: 2809622 - RNA, 20 nt, Mycobacterium avium subsp. paratuberculosis
acagcgucucgacggcgccg

SEQ ID NO: 2809623 - RNA, 21 nt, Mycobacterium avium subsp. paratuberculosis
acagcgucucgacggcgccga

SEQ ID NO: 2809624 - RNA, 18 nt, Mycobacterium avium subsp. paratuberculosis
acagcgucugcuggaugg

SEQ ID NO: 2809625 - RNA, 18 nt, Mycobacterium avium subsp. paratuberculosis
acagcguggucgcgcagc

SEQ ID NO: 2809626 - RNA, 19 nt, Mycobacterium avium subsp. paratuberculosis
acagcguggucgcgcagca

SEQ ID NO: 2809627 - RNA, 20 nt, Mycobacterium avium subsp. paratuberculosis
acagcguggucgcgcagcau

SEQ ID NO: 2809628 - RNA, 16 nt, Mycobacterium avium subsp. paratuberculosis
acagcuaggccagcag

SEQ ID NO: 2809629 - RNA, 17 nt, Mycobacterium avium subsp. paratuberculosis
acagcuaggccagcagc

SEQ ID NO: 2809630 - RNA, 18 nt, Mycobacterium avium subsp. paratuberculosis
acagcuaggccagcagcg

SEQ ID NO: 2809631 - RNA, 22 nt, Mycobacterium avium subsp. paratuberculosis
acagcuaggccagcagcgcggc

SEQ ID NO: 2809632 - RNA, 17 nt, Mycobacterium avium subsp. paratuberculosis
acagcuaggucguggcg

SEQ ID NO: 2809633 - RNA, 22 nt, Mycobacterium avium subsp. paratuberculosis
acagugcgcaggcggcgcgcag

SEQ ID NO: 2809634 - RNA, 16 nt, Mycobacterium avium subsp. paratuberculosis
acagugcgggcucgau

SEQ ID NO: 2809635 - RNA, 13 nt, Mycobacterium avium subsp. paratuberculosis
acaguucggcgcg

SEQ ID NO: 2809636 - RNA, 15 nt, Mycobacterium avium subsp. paratuberculosis
acaguucggcgcgca

SEQ ID NO: 2809637 - RNA, 17 nt, Mycobacterium avium subsp. paratuberculosis
acaguucggugcggguc

SEQ ID NO: 2809638 - RNA, 21 nt, Mycobacterium avium subsp. paratuberculosis
acauacaccgggaucggcggc

SEQ ID NO: 2809639 - RNA, 17 nt, Mycobacterium avium subsp. paratuberculosis
acauacgccucacccca

SEQ ID NO: 2809640 - RNA, 18 nt, Mycobacterium avium subsp. paratuberculosis
acauacgccucaccccag

SEQ ID NO: 2809641 - RNA, 22 nt, Mycobacterium avium subsp. paratuberculosis
acauacgccucaccccagcgcg

SEQ ID NO: 2809642 - RNA, 20 nt, Mycobacterium avium subsp. paratuberculosis
acauagugacguuccgaacg

SEQ ID NO: 2809643 - RNA, 19 nt, Mycobacterium avium subsp. paratuberculosis
acaucaccaaccgcucggc

SEQ ID NO: 2809644 - RNA, 16 nt, Mycobacterium avium subsp. paratuberculosis
acaucacccggcggca

SEQ ID NO: 2809645 - RNA, 19 nt, Mycobacterium avium subsp. paratuberculosis
acaucacccggcggcaccg

SEQ ID NO: 2809646 - RNA, 16 nt, Mycobacterium avium subsp. paratuberculosis
acaucacgguggccgc

SEQ ID NO: 2809647 - RNA, 15 nt, Mycobacterium avium subsp. paratuberculosis
acaucacgucccgcu

SEQ ID NO: 2809648 - RNA, 18 nt, Mycobacterium avium subsp. paratuberculosis
acaucacgucccgcucga

SEQ ID NO: 2809649 - RNA, 15 nt, Mycobacterium avium subsp. paratuberculosis
acaucagcucggcgg

SEQ ID NO: 2809650 - RNA, 20 nt, Mycobacterium avium subsp. paratuberculosis
acaucagcucggcggccucg

SEQ ID NO: 2809651 - RNA, 16 nt, Mycobacterium avium subsp. paratuberculosis
acauccaggaccgcgc

SEQ ID NO: 2809652 - RNA, 17 nt, Mycobacterium avium subsp. paratuberculosis
acauccaggaccgcgcg

SEQ ID NO: 2809653 - RNA, 23 nt, Mycobacterium avium subsp. paratuberculosis
acauccaggaccgcgcgccggcc

SEQ ID NO: 2809654 - RNA, 16 nt, Mycobacterium avium subsp. paratuberculosis
acauccauugggccgc

SEQ ID NO: 2809655 - RNA, 21 nt, Mycobacterium avium subsp. paratuberculosis
acauccauugggccgcggcgu

SEQ ID NO: 2809656 - RNA, 19 nt, Mycobacterium avium subsp. paratuberculosis
acaucccgaaugagacgac

SEQ ID NO: 2809657 - RNA, 14 nt, Mycobacterium avium subsp. paratuberculosis
acaucccgccgggc

SEQ ID NO: 2809658 - RNA, 21 nt, Mycobacterium avium subsp. paratuberculosis
acaucccggacaggucgggca

SEQ ID NO: 2809659 - RNA, 16 nt, Mycobacterium avium subsp. paratuberculosis
acaucgacgcgaccgg

SEQ ID NO: 2809660 - RNA, 18 nt, Mycobacterium avium subsp. paratuberculosis
acaucgacgcgaccggcc

SEQ ID NO: 2809661 - RNA, 23 nt, Mycobacterium avium subsp. paratuberculosis
acaucgacgugccguugacgaac

SEQ ID NO: 2809662 - RNA, 15 nt, Mycobacterium avium subsp. paratuberculosis
acaucgagcccaccg

SEQ ID NO: 2809663 - RNA, 16 nt, Mycobacterium avium subsp. paratuberculosis
acaucgagcccaccgc

SEQ ID NO: 2809664 - RNA, 12 nt, Mycobacterium avium subsp. paratuberculosis
acaucgccaccu

SEQ ID NO: 2809665 - RNA, 22 nt, Mycobacterium avium subsp. paratuberculosis
acaucgccaucagcagcgccuc

SEQ ID NO: 2809666 - RNA, 15 nt, Mycobacterium avium subsp. paratuberculosis
acaucgccgcggccg

SEQ ID NO: 2809667 - RNA, 22 nt, Mycobacterium avium subsp. paratuberculosis
acaucgccgcggccggagaaca

SEQ ID NO: 2809668 - RNA, 14 nt, Mycobacterium avium subsp. paratuberculosis
acaucgccggcgac

SEQ ID NO: 2809669 - RNA, 14 nt, Mycobacterium avium subsp. paratuberculosis
acaucgccucggcc

SEQ ID NO: 2809670 - RNA, 15 nt, Mycobacterium avium subsp. paratuberculosis
acaucgccucggccg

SEQ ID NO: 2809671 - RNA, 15 nt, Mycobacterium avium subsp. paratuberculosis
acaucgccucggcgu

SEQ ID NO: 2809672 - RNA, 22 nt, Mycobacterium avium subsp. paratuberculosis
acaucggagagcuugccgcgga

SEQ ID NO: 2809673 - RNA, 12 nt, Mycobacterium avium subsp. paratuberculosis
acaucggcacac

SEQ ID NO: 2809674 - RNA, 17 nt, Mycobacterium avium subsp. paratuberculosis
acaucggcacacgcgga

SEQ ID NO: 2809675 - RNA, 20 nt, Mycobacterium avium subsp. paratuberculosis
acaucggcagcagggugccg

SEQ ID NO: 2809676 - RNA, 12 nt, Mycobacterium avium subsp. paratuberculosis
acaucggccggg

SEQ ID NO: 2809677 - RNA, 18 nt, Mycobacterium avium subsp. paratuberculosis
acaucggcgccgacgggg

SEQ ID NO: 2809678 - RNA, 18 nt, Mycobacterium avium subsp. paratuberculosis
acaucggcgugucgggug

SEQ ID NO: 2809679 - RNA, 18 nt, Mycobacterium avium subsp. paratuberculosis
acaucgggauuggcggcc

SEQ ID NO: 2809680 - RNA, 20 nt, Mycobacterium avium subsp. paratuberculosis
acaucggugaccgucgccga

SEQ ID NO: 2809681 - RNA, 13 nt, Mycobacterium avium subsp. paratuberculosis
acaucggugauca

SEQ ID NO: 2809682 - RNA, 16 nt, Mycobacterium avium subsp. paratuberculosis
acaucgucgcgcccag

SEQ ID NO: 2809683 - RNA, 22 nt, Mycobacterium avium subsp. paratuberculosis
acaucguggcgacgacgccgau

SEQ ID NO: 2809684 - RNA, 22 nt, Mycobacterium avium subsp. paratuberculosis
acaucguucccugcgcggcgau

SEQ ID NO: 2809685 - RNA, 23 nt, Mycobacterium avium subsp. paratuberculosis
acaucguucccugcgcggcgaug

SEQ ID NO: 2809686 - RNA, 19 nt, Mycobacterium avium subsp. paratuberculosis
acaucuccagauugcggau

SEQ ID NO: 2809687 - RNA, 22 nt, Mycobacterium avium subsp. paratuberculosis
acaucuccuuggggcugaccuc

SEQ ID NO: 2809688 - RNA, 13 nt, Mycobacterium avium subsp. paratuberculosis
acaucucgacggu

SEQ ID NO: 2809689 - RNA, 23 nt, Mycobacterium avium subsp. paratuberculosis
acaucucgacggugaccggcucg

SEQ ID NO: 2809690 - RNA, 13 nt, Mycobacterium avium subsp. paratuberculosis
acaucucgguggu

SEQ ID NO: 2809691 - RNA, 14 nt, Mycobacterium avium subsp. paratuberculosis
acaucugccggucg

SEQ ID NO: 2809692 - RNA, 17 nt, Mycobacterium avium subsp. paratuberculosis
acaucugccggucgaug

SEQ ID NO: 2809693 - RNA, 21 nt, Mycobacterium avium subsp. paratuberculosis
acaucuugaucugggugccgc

SEQ ID NO: 2809694 - RNA, 20 nt, Mycobacterium avium subsp. paratuberculosis
acaucuuggucagccgcggc

SEQ ID NO: 2809695 - RNA, 14 nt, Mycobacterium avium subsp. paratuberculosis
acaugaagcccccg

SEQ ID NO: 2809696 - RNA, 16 nt, Mycobacterium avium subsp. paratuberculosis
acaugaccaccgcguc

SEQ ID NO: 2809697 - RNA, 13 nt, Mycobacterium avium subsp. paratuberculosis
acaugaucggcgc

SEQ ID NO: 2809698 - RNA, 14 nt, Mycobacterium avium subsp. paratuberculosis
acaugaucggcgcg

SEQ ID NO: 2809699 - RNA, 17 nt, Mycobacterium avium subsp. paratuberculosis
acaugauuccgccgggc

SEQ ID NO: 2809700 - RNA, 15 nt, Mycobacterium avium subsp. paratuberculosis
acaugauucguucgu

SEQ ID NO: 2809701 - RNA, 15 nt, Mycobacterium avium subsp. paratuberculosis
acaugcagccgccgc

SEQ ID NO: 2809702 - RNA, 18 nt, Mycobacterium avium subsp. paratuberculosis
acaugcagccgccgcgga

SEQ ID NO: 2809703 - RNA, 12 nt, Mycobacterium avium subsp. paratuberculosis
acaugcccggcg

SEQ ID NO: 2809704 - RNA, 14 nt, Mycobacterium avium subsp. paratuberculosis
acaugcccggcgac

SEQ ID NO: 2809705 - RNA, 23 nt, Mycobacterium avium subsp. paratuberculosis
acaugcccggcgacggcgccuga

SEQ ID NO: 2809706 - RNA, 16 nt, Mycobacterium avium subsp. paratuberculosis
acaugccgagcagcac

SEQ ID NO: 2809707 - RNA, 17 nt, Mycobacterium avium subsp. paratuberculosis
acaugccgagcagcacc

SEQ ID NO: 2809708 - RNA, 19 nt, Mycobacterium avium subsp. paratuberculosis
acaugccgagcagcaccgc

SEQ ID NO: 2809709 - RNA, 22 nt, Mycobacterium avium subsp. paratuberculosis
acaugccgagcagcaccgcgac

SEQ ID NO: 2809710 - RNA, 18 nt, Mycobacterium avium subsp. paratuberculosis
acaugccguugccaggcc

SEQ ID NO: 2809711 - RNA, 23 nt, Mycobacterium avium subsp. paratuberculosis
acaugccguugccaggccgcgag

SEQ ID NO: 2809712 - RNA, 13 nt, Mycobacterium avium subsp. paratuberculosis
acaugcugcacgg

SEQ ID NO: 2809713 - RNA, 14 nt, Mycobacterium avium subsp. paratuberculosis
acaugcugccgccg

SEQ ID NO: 2809714 - RNA, 15 nt, Mycobacterium avium subsp. paratuberculosis
acaugcugccgccgg

SEQ ID NO: 2809715 - RNA, 12 nt, Mycobacterium avium subsp. paratuberculosis
acaugcugggcu

SEQ ID NO: 2809716 - RNA, 14 nt, Mycobacterium avium subsp. paratuberculosis
acauggccagcacc

SEQ ID NO: 2809717 - RNA, 21 nt, Mycobacterium avium subsp. paratuberculosis
acauggccuugaacucggcca

SEQ ID NO: 2809718 - RNA, 17 nt, Mycobacterium avium subsp. paratuberculosis
accacccgcagcgcggc

SEQ ID NO: 2809719 - RNA, 14 nt, Mycobacterium avium subsp. paratuberculosis
accacccgcagcuc

SEQ ID NO: 2809720 - RNA, 18 nt, Mycobacterium avium subsp. paratuberculosis
accacccgcagcucgccg

SEQ ID NO: 2809721 - RNA, 16 nt, Mycobacterium avium subsp. paratuberculosis
accacccgcggccggc

SEQ ID NO: 2809722 - RNA, 12 nt, Mycobacterium avium subsp. paratuberculosis
accacccggcgg

SEQ ID NO: 2809723 - RNA, 12 nt, Mycobacterium avium subsp. paratuberculosis
accacccggucc

SEQ ID NO: 2809724 - RNA, 16 nt, Mycobacterium avium subsp. paratuberculosis
accacccggucgacga

SEQ ID NO: 2809725 - RNA, 20 nt, Mycobacterium avium subsp. paratuberculosis
accacccggucgaugugcgc

SEQ ID NO: 2809726 - RNA, 22 nt, Mycobacterium avium subsp. paratuberculosis
accacccggugggacugggcgc

SEQ ID NO: 2809727 - RNA, 19 nt, Mycobacterium avium subsp. paratuberculosis
accacccucggucaggauc

SEQ ID NO: 2809728 - RNA, 21 nt, Mycobacterium avium subsp. paratuberculosis
accacccucggucaggaucga

SEQ ID NO: 2809729 - RNA, 14 nt, Mycobacterium avium subsp. paratuberculosis
accaccgaccggcu

SEQ ID NO: 2809730 - RNA, 14 nt, Mycobacterium avium subsp. paratuberculosis
accaccgagccggc

SEQ ID NO: 2809731 - RNA, 23 nt, Mycobacterium avium subsp. paratuberculosis
accaccgagccgggcagcgcgac

SEQ ID NO: 2809732 - RNA, 14 nt, Mycobacterium avium subsp. paratuberculosis
accaccgagccggu

SEQ ID NO: 2809733 - RNA, 21 nt, Mycobacterium avium subsp. paratuberculosis
accaccgagguggcccagccg

SEQ ID NO: 2809734 - RNA, 16 nt, Mycobacterium avium subsp. paratuberculosis
accaccgccaccagcg

SEQ ID NO: 2809735 - RNA, 17 nt, Mycobacterium avium subsp. paratuberculosis
accaccgcccacagcaa

SEQ ID NO: 2809736 - RNA, 21 nt, Mycobacterium avium subsp. paratuberculosis
accaccgcccggaccggcucg

SEQ ID NO: 2809737 - RNA, 14 nt, Mycobacterium avium subsp. paratuberculosis
accaccgccggggu

SEQ ID NO: 2809738 - RNA, 13 nt, Mycobacterium avium subsp. paratuberculosis
accaccgccguca

SEQ ID NO: 2809739 - RNA, 13 nt, Mycobacterium avium subsp. paratuberculosis
accaccgccucga

SEQ ID NO: 2809740 - RNA, 14 nt, Mycobacterium avium subsp. paratuberculosis
accaccgccucgac

SEQ ID NO: 2809741 - RNA, 16 nt, Mycobacterium avium subsp. paratuberculosis
accaccgccucgacgg

SEQ ID NO: 2809742 - RNA, 12 nt, Mycobacterium avium subsp. paratuberculosis
accaccgcgagc

SEQ ID NO: 2809743 - RNA, 13 nt, Mycobacterium avium subsp. paratuberculosis
accaccgcgccca

SEQ ID NO: 2809744 - RNA, 12 nt, Mycobacterium avium subsp. paratuberculosis
accaccgcgccg

SEQ ID NO: 2809745 - RNA, 14 nt, Mycobacterium avium subsp. paratuberculosis
accaccgcgccguc

SEQ ID NO: 2809746 - RNA, 16 nt, Mycobacterium avium subsp. paratuberculosis
accaccgcgccgucgu

SEQ ID NO: 2809747 - RNA, 12 nt, Mycobacterium avium subsp. paratuberculosis
accaccgcgcug

SEQ ID NO: 2809748 - RNA, 15 nt, Mycobacterium avium subsp. paratuberculosis
accaccgcggcgccg

SEQ ID NO: 2809749 - RNA, 17 nt, Mycobacterium avium subsp. paratuberculosis
accaccgcggcgccguc

SEQ ID NO: 2809750 - RNA, 15 nt, Mycobacterium avium subsp. paratuberculosis
accaccgcggugagc

SEQ ID NO: 2809751 - RNA, 22 nt, Mycobacterium avium subsp. paratuberculosis
accaccgcggugagcggccgca

SEQ ID NO: 2809752 - RNA, 21 nt, Mycobacterium avium subsp. paratuberculosis
accaccgcuguggacaggucg

SEQ ID NO: 2809753 - RNA, 18 nt, Mycobacterium avium subsp. paratuberculosis
accaccggagcggcggua

SEQ ID NO: 2809754 - RNA, 16 nt, Mycobacterium avium subsp. paratuberculosis
accaccggcaaccgcc

SEQ ID NO: 2809755 - RNA, 21 nt, Mycobacterium avium subsp. paratuberculosis
accaccggcaaccgccacgac

SEQ ID NO: 2809756 - RNA, 12 nt, Mycobacterium avium subsp. paratuberculosis
accaccggcacc

SEQ ID NO: 2809757 - RNA, 14 nt, Mycobacterium avium subsp. paratuberculosis
accaccggccgccc

SEQ ID NO: 2809758 - RNA, 18 nt, Mycobacterium avium subsp. paratuberculosis
accaccggccgcccggcg

SEQ ID NO: 2809759 - RNA, 13 nt, Mycobacterium avium subsp. paratuberculosis
accaccggccgcg

SEQ ID NO: 2809760 - RNA, 14 nt, Mycobacterium avium subsp. paratuberculosis
accaccggccgcgc

SEQ ID NO: 2809761 - RNA, 15 nt, Mycobacterium avium subsp. paratuberculosis
accaccgggucgucg

SEQ ID NO: 2809762 - RNA, 14 nt, Mycobacterium avium subsp. paratuberculosis
accaccggugacga

SEQ ID NO: 2809763 - RNA, 21 nt, Mycobacterium avium subsp. paratuberculosis
accaccggugacgaccggcag

SEQ ID NO: 2809764 - RNA, 17 nt, Mycobacterium avium subsp. paratuberculosis
accaccgugccgucgcg

SEQ ID NO: 2809765 - RNA, 17 nt, Mycobacterium avium subsp. paratuberculosis
accaccgugcuggccac

SEQ ID NO: 2809766 - RNA, 18 nt, Mycobacterium avium subsp. paratuberculosis
accaccgugcuggccacc

SEQ ID NO: 2809767 - RNA, 19 nt, Mycobacterium avium subsp. paratuberculosis
accaccgugcuggccacca

SEQ ID NO: 2809768 - RNA, 19 nt, Mycobacterium avium subsp. paratuberculosis
accaccguggccccagcca

SEQ ID NO: 2809769 - RNA, 22 nt, Mycobacterium avium subsp. paratuberculosis
accaccguggccccagccaccg

SEQ ID NO: 2809770 - RNA, 15 nt, Mycobacterium avium subsp. paratuberculosis
accaccucaccugcg

SEQ ID NO: 2809771 - RNA, 14 nt, Mycobacterium avium subsp. paratuberculosis
accaccuccccgcg

SEQ ID NO: 2809772 - RNA, 14 nt, Mycobacterium avium subsp. paratuberculosis
accaccuccucgcg

SEQ ID NO: 2809773 - RNA, 19 nt, Mycobacterium avium subsp. paratuberculosis
accaccucgcgcggggcgg

SEQ ID NO: 2809774 - RNA, 23 nt, Mycobacterium avium subsp. paratuberculosis
accaccucgcgcggggcggccgc

SEQ ID NO: 2809775 - RNA, 16 nt, Mycobacterium avium subsp. paratuberculosis
accaccucgcgggcga

SEQ ID NO: 2809776 - RNA, 20 nt, Mycobacterium avium subsp. paratuberculosis
accaccucgcgggcgaccug

SEQ ID NO: 2809777 - RNA, 13 nt, Mycobacterium avium subsp. paratuberculosis
accaccucggcga

SEQ ID NO: 2809778 - RNA, 14 nt, Mycobacterium avium subsp. paratuberculosis
accaccucggcgac

SEQ ID NO: 2809779 - RNA, 15 nt, Mycobacterium avium subsp. paratuberculosis
accaccucggcgacg

SEQ ID NO: 2809780 - RNA, 22 nt, Mycobacterium avium subsp. paratuberculosis
accaccucggcgacgauggcca

SEQ ID NO: 2809781 - RNA, 14 nt, Mycobacterium avium subsp. paratuberculosis
accaccucggcgau

SEQ ID NO: 2809782 - RNA, 20 nt, Mycobacterium avium subsp. paratuberculosis
accaccucgguggacgccgc

SEQ ID NO: 2809783 - RNA, 15 nt, Mycobacterium avium subsp. paratuberculosis
accaccugaccgcgg

SEQ ID NO: 2809784 - RNA, 16 nt, Mycobacterium avium subsp. paratuberculosis
accaccugcaccugcg

SEQ ID NO: 2809785 - RNA, 23 nt, Mycobacterium avium subsp. paratuberculosis
accaccugcacggggacgucguc

SEQ ID NO: 2809786 - RNA, 15 nt, Mycobacterium avium subsp. paratuberculosis
accaccugccgcaac

SEQ ID NO: 2809787 - RNA, 22 nt, Mycobacterium avium subsp. paratuberculosis
accaccugccgcaacgggccgc

SEQ ID NO: 2809788 - RNA, 15 nt, Mycobacterium avium subsp. paratuberculosis
accaccuugcgcagc

SEQ ID NO: 2809789 - RNA, 21 nt, Mycobacterium avium subsp. paratuberculosis
accaccuugcgcagcagcagg

SEQ ID NO: 2809790 - RNA, 20 nt, Mycobacterium avium subsp. paratuberculosis
accaccuuggccggugcgcc

SEQ ID NO: 2809791 - RNA, 20 nt, Mycobacterium avium subsp. paratuberculosis
accaccuugguggccgcggc

SEQ ID NO: 2809792 - RNA, 23 nt, Mycobacterium avium subsp. paratuberculosis
accaccuugguggccgcggccgc

SEQ ID NO: 2809793 - RNA, 17 nt, Mycobacterium avium subsp. paratuberculosis
accacgaacaccggcgc

SEQ ID NO: 2809794 - RNA, 18 nt, Mycobacterium avium subsp. paratuberculosis
accacgaacaccggcgcg

SEQ ID NO: 2809795 - RNA, 19 nt, Mycobacterium avium subsp. paratuberculosis
accacgaacaccggcgcga

SEQ ID NO: 2809796 - RNA, 15 nt, Mycobacterium avium subsp. paratuberculosis
accacgaaccaggcg

SEQ ID NO: 2809797 - RNA, 17 nt, Mycobacterium avium subsp. paratuberculosis
accacgaaccaggcgcc

SEQ ID NO: 2809798 - RNA, 20 nt, Mycobacterium avium subsp. paratuberculosis
accacgaaccaggcgccggc

SEQ ID NO: 2809799 - RNA, 23 nt, Mycobacterium avium subsp. paratuberculosis
accacgaaccaggcgccggccag

SEQ ID NO: 2809800 - RNA, 16 nt, Mycobacterium avium subsp. paratuberculosis
accacgaacgcgccgc

SEQ ID NO: 2809801 - RNA, 16 nt, Mycobacterium avium subsp. paratuberculosis
accacgaacucccccg

SEQ ID NO: 2809802 - RNA, 14 nt, Mycobacterium avium subsp. paratuberculosis
accacgaagcgggc

SEQ ID NO: 2809803 - RNA, 18 nt, Mycobacterium avium subsp. paratuberculosis
accacgucggugccgcgu

SEQ ID NO: 2809804 - RNA, 17 nt, Mycobacterium avium subsp. paratuberculosis
accacgucgucggccug

SEQ ID NO: 2809805 - RNA, 19 nt, Mycobacterium avium subsp. paratuberculosis
accacgugccacuggcgcc

SEQ ID NO: 2809806 - RNA, 23 nt, Mycobacterium avium subsp. paratuberculosis
accacgugccccuccucggucag

SEQ ID NO: 2809807 - RNA, 15 nt, Mycobacterium avium subsp. paratuberculosis
accacgugcgcgaag

SEQ ID NO: 2809808 - RNA, 21 nt, Mycobacterium avium subsp. paratuberculosis
accacgugcgcgaagcugggg

SEQ ID NO: 2809809 - RNA, 18 nt, Mycobacterium avium subsp. paratuberculosis
accacguugcacggcagc

SEQ ID NO: 2809810 - RNA, 17 nt, Mycobacterium avium subsp. paratuberculosis
accacguugcgcccggc

SEQ ID NO: 2809811 - RNA, 16 nt, Mycobacterium avium subsp. paratuberculosis
accacguugcgcggcc

SEQ ID NO: 2809812 - RNA, 18 nt, Mycobacterium avium subsp. paratuberculosis
accacguugcgcggccgc

SEQ ID NO: 2809813 - RNA, 21 nt, Mycobacterium avium subsp. paratuberculosis
accacugauccgucaucucgu

SEQ ID NO: 2809814 - RNA, 14 nt, Mycobacterium avium subsp. paratuberculosis
accacugcgcgccc

SEQ ID NO: 2809815 - RNA, 15 nt, Mycobacterium avium subsp. paratuberculosis
accacugcgcgcccg

SEQ ID NO: 2809816 - RNA, 16 nt, Mycobacterium avium subsp. paratuberculosis
accacugcgcgcccga

SEQ ID NO: 2809817 - RNA, 19 nt, Mycobacterium avium subsp. paratuberculosis
accacugcgcgcccgagca

SEQ ID NO: 2809818 - RNA, 14 nt, Mycobacterium avium subsp. paratuberculosis
accacuuccagcac

SEQ ID NO: 2809819 - RNA, 15 nt, Mycobacterium avium subsp. paratuberculosis
accacuuccagcacc

SEQ ID NO: 2809820 - RNA, 16 nt, Mycobacterium avium subsp. paratuberculosis
accacuugaaggaggc

SEQ ID NO: 2809821 - RNA, 16 nt, Mycobacterium avium subsp. paratuberculosis
accagaacacguuucg

SEQ ID NO: 2809822 - RNA, 19 nt, Mycobacterium avium subsp. paratuberculosis
accagaaucuucgccuccg

SEQ ID NO: 2809823 - RNA, 16 nt, Mycobacterium avium subsp. paratuberculosis
accagaccggcgaagc

SEQ ID NO: 2809824 - RNA, 17 nt, Mycobacterium avium subsp. paratuberculosis
accagauaggccagcgc

SEQ ID NO: 2809825 - RNA, 18 nt, Mycobacterium avium subsp. paratuberculosis
accagauaggccagcgcg

SEQ ID NO: 2809826 - RNA, 13 nt, Mycobacterium avium subsp. paratuberculosis
accagaucgagcu

SEQ ID NO: 2809827 - RNA, 18 nt, Mycobacterium avium subsp. paratuberculosis
accagaucgucgggcacc

SEQ ID NO: 2809828 - RNA, 19 nt, Mycobacterium avium subsp. paratuberculosis
accagaucgucgggcaccu

SEQ ID NO: 2809829 - RNA, 23 nt, Mycobacterium avium subsp. paratuberculosis
accagaugccgcucggcgcucca

SEQ ID NO: 2809830 - RNA, 20 nt, Mycobacterium avium subsp. paratuberculosis
accagauucaccagcgccuc

SEQ ID NO: 2809831 - RNA, 15 nt, Mycobacterium avium subsp. paratuberculosis
accagauugcggcac

SEQ ID NO: 2809832 - RNA, 23 nt, Mycobacterium avium subsp. paratuberculosis
accagauugcggcaccagucgcg

SEQ ID NO: 2809833 - RNA, 19 nt, Mycobacterium avium subsp. paratuberculosis
accagcaacaccagggugc

SEQ ID NO: 2809834 - RNA, 22 nt, Mycobacterium avium subsp. paratuberculosis
accagcaacaccuuucggccgc

SEQ ID NO: 2809835 - RNA, 14 nt, Mycobacterium avium subsp. paratuberculosis
accagcaccaccgu

SEQ ID NO: 2809836 - RNA, 18 nt, Mycobacterium avium subsp. paratuberculosis
accagcacccagcacagc

SEQ ID NO: 2809837 - RNA, 21 nt, Mycobacterium avium subsp. paratuberculosis
accagcacccagcacagcgag

SEQ ID NO: 2809838 - RNA, 13 nt, Mycobacterium avium subsp. paratuberculosis
accagcaccccgc

SEQ ID NO: 2809839 - RNA, 14 nt, Mycobacterium avium subsp. paratuberculosis
accagcaccccgcc

SEQ ID NO: 2809840 - RNA, 16 nt, Mycobacterium avium subsp. paratuberculosis
accagcaccccgccgc

SEQ ID NO: 2809841 - RNA, 14 nt, Mycobacterium avium subsp. paratuberculosis
accagcacccgggc

SEQ ID NO: 2809842 - RNA, 15 nt, Mycobacterium avium subsp. paratuberculosis
accagcaccgccgcg

SEQ ID NO: 2809843 - RNA, 12 nt, Mycobacterium avium subsp. paratuberculosis
accagcaccgcg

SEQ ID NO: 2809844 - RNA, 13 nt, Mycobacterium avium subsp. paratuberculosis
accagcaccgcgg

SEQ ID NO: 2809845 - RNA, 14 nt, Mycobacterium avium subsp. paratuberculosis
accagcaccgcggc

SEQ ID NO: 2809846 - RNA, 14 nt, Mycobacterium avium subsp. paratuberculosis
accagcaccggcac

SEQ ID NO: 2809847 - RNA, 18 nt, Mycobacterium avium subsp. paratuberculosis
accagcaccggcaccgcc

SEQ ID NO: 2809848 - RNA, 23 nt, Mycobacterium avium subsp. paratuberculosis
accagcaccggcaccgccagcca

SEQ ID NO: 2809849 - RNA, 16 nt, Mycobacterium avium subsp. paratuberculosis
accagcacgacaccga

SEQ ID NO: 2809850 - RNA, 15 nt, Mycobacterium avium subsp. paratuberculosis
accagcacgccguug

SEQ ID NO: 2809851 - RNA, 14 nt, Mycobacterium avium subsp. paratuberculosis
accagcacggcgac

SEQ ID NO: 2809852 - RNA, 17 nt, Mycobacterium avium subsp. paratuberculosis
accagcacggcggcgcu

SEQ ID NO: 2809853 - RNA, 20 nt, Mycobacterium avium subsp. paratuberculosis
accagcacggcggcgcugau

SEQ ID NO: 2809854 - RNA, 17 nt, Mycobacterium avium subsp. paratuberculosis
accagcacguugugcuc

SEQ ID NO: 2809855 - RNA, 15 nt, Mycobacterium avium subsp. paratuberculosis
accagcagccgcagc

SEQ ID NO: 2809856 - RNA, 19 nt, Mycobacterium avium subsp. paratuberculosis
accagcagccgcagcgcgc

SEQ ID NO: 2809857 - RNA, 20 nt, Mycobacterium avium subsp. paratuberculosis
accagcagccgcagcgcgcg

SEQ ID NO: 2809858 - RNA, 13 nt, Mycobacterium avium subsp. paratuberculosis
accagcagccggu

SEQ ID NO: 2809859 - RNA, 18 nt, Mycobacterium avium subsp. paratuberculosis
accagcagcgagaccggc

SEQ ID NO: 2809860 - RNA, 22 nt, Mycobacterium avium subsp. paratuberculosis
accagcagcgagaccggcacgg

SEQ ID NO: 2809861 - RNA, 12 nt, Mycobacterium avium subsp. paratuberculosis
accagcagcgcc

SEQ ID NO: 2809862 - RNA, 13 nt, Mycobacterium avium subsp. paratuberculosis
accagcagcgcca

SEQ ID NO: 2809863 - RNA, 14 nt, Mycobacterium avium subsp. paratuberculosis
accagcagcgccac

SEQ ID NO: 2809864 - RNA, 17 nt, Mycobacterium avium subsp. paratuberculosis
accagcagcgcgacgcc

SEQ ID NO: 2809865 - RNA, 18 nt, Mycobacterium avium subsp. paratuberculosis
accagcagcgcgacgccg

SEQ ID NO: 2809866 - RNA, 19 nt, Mycobacterium avium subsp. paratuberculosis
accagcagcgcgacgccga

SEQ ID NO: 2809867 - RNA, 20 nt, Mycobacterium avium subsp. paratuberculosis
accagcagcgcgacgccgac

SEQ ID NO: 2809868 - RNA, 18 nt, Mycobacterium avium subsp. paratuberculosis
accagcaggacgcgcccg

SEQ ID NO: 2809869 - RNA, 22 nt, Mycobacterium avium subsp. paratuberculosis
accagcaggucgagcaugcguc

SEQ ID NO: 2809870 - RNA, 18 nt, Mycobacterium avium subsp. paratuberculosis
accagcauggcgaucacc

SEQ ID NO: 2809871 - RNA, 17 nt, Mycobacterium avium subsp. paratuberculosis
accagccacaccgccgc

SEQ ID NO: 2809872 - RNA, 18 nt, Mycobacterium avium subsp. paratuberculosis
accagccacaccgccgcg

SEQ ID NO: 2809873 - RNA, 19 nt, Mycobacterium avium subsp. paratuberculosis
accagccacaccgccgcgg

SEQ ID NO: 2809874 - RNA, 14 nt, Mycobacterium avium subsp. paratuberculosis
accagcccaggucg

SEQ ID NO: 2809875 - RNA, 16 nt, Mycobacterium avium subsp. paratuberculosis
accagcccccgcgggu

SEQ ID NO: 2809876 - RNA, 14 nt, Mycobacterium avium subsp. paratuberculosis
accagcccgccguc

SEQ ID NO: 2809877 - RNA, 15 nt, Mycobacterium avium subsp. paratuberculosis
accagcccggccagc

SEQ ID NO: 2809878 - RNA, 19 nt, Mycobacterium avium subsp. paratuberculosis
accagcccggccagcggca

SEQ ID NO: 2809879 - RNA, 13 nt, Mycobacterium avium subsp. paratuberculosis
accagcccggccc

SEQ ID NO: 2809880 - RNA, 14 nt, Mycobacterium avium subsp. paratuberculosis
accagcccggcccg

SEQ ID NO: 2809881 - RNA, 16 nt, Mycobacterium avium subsp. paratuberculosis
accagcccggccgagg

SEQ ID NO: 2809882 - RNA, 15 nt, Mycobacterium avium subsp. paratuberculosis
accagcccggccgcc

SEQ ID NO: 2809883 - RNA, 17 nt, Mycobacterium avium subsp. paratuberculosis
accagcccggccgccga

SEQ ID NO: 2809884 - RNA, 18 nt, Mycobacterium avium subsp. paratuberculosis
accagcccggccgccgag

SEQ ID NO: 2809885 - RNA, 12 nt, Mycobacterium avium subsp. paratuberculosis
accagcccgucg

SEQ ID NO: 2809886 - RNA, 14 nt, Mycobacterium avium subsp. paratuberculosis
accagcccgucggc

SEQ ID NO: 2809887 - RNA, 23 nt, Mycobacterium avium subsp. paratuberculosis
accagcccgucggccuccagccg

SEQ ID NO: 2809888 - RNA, 16 nt, Mycobacterium avium subsp. paratuberculosis
accaggaacacggcuc

SEQ ID NO: 2809889 - RNA, 16 nt, Mycobacterium avium subsp. paratuberculosis
accaggaagaugccga

SEQ ID NO: 2809890 - RNA, 18 nt, Mycobacterium avium subsp. paratuberculosis
accaggaaggucccgguc

SEQ ID NO: 2809891 - RNA, 20 nt, Mycobacterium avium subsp. paratuberculosis
accaggaaggucccggucag

SEQ ID NO: 2809892 - RNA, 16 nt, Mycobacterium avium subsp. paratuberculosis
accaggaccagguugg

SEQ ID NO: 2809893 - RNA, 17 nt, Mycobacterium avium subsp. paratuberculosis
accaggacgcgaccggc

SEQ ID NO: 2809894 - RNA, 19 nt, Mycobacterium avium subsp. paratuberculosis
accaggacgcgaccggcca

SEQ ID NO: 2809895 - RNA, 20 nt, Mycobacterium avium subsp. paratuberculosis
accaggacgcgaccggccau

SEQ ID NO: 2809896 - RNA, 15 nt, Mycobacterium avium subsp. paratuberculosis
accaggaugcccagg

SEQ ID NO: 2809897 - RNA, 19 nt, Mycobacterium avium subsp. paratuberculosis
accaggaugcccaggauga

SEQ ID NO: 2809898 - RNA, 20 nt, Mycobacterium avium subsp. paratuberculosis
accaggaugucuccgcgcag

SEQ ID NO: 2809899 - RNA, 23 nt, Mycobacterium avium subsp. paratuberculosis
accaggaugucuccgcgcagcca

SEQ ID NO: 2809900 - RNA, 18 nt, Mycobacterium avium subsp. paratuberculosis
accaggcauuagcgcgug

SEQ ID NO: 2809901 - RNA, 15 nt, Mycobacterium avium subsp. paratuberculosis
accaggcccaccacc

SEQ ID NO: 2809902 - RNA, 20 nt, Mycobacterium avium subsp. paratuberculosis
accaggcccaccaccacgag

SEQ ID NO: 2809903 - RNA, 13 nt, Mycobacterium avium subsp. paratuberculosis
accaggcccagcg

SEQ ID NO: 2809904 - RNA, 14 nt, Mycobacterium avium subsp. paratuberculosis
accaggcccagcgg

SEQ ID NO: 2809905 - RNA, 23 nt, Mycobacterium avium subsp. paratuberculosis
accaggcccaggccgacgccggc

SEQ ID NO: 2809906 - RNA, 13 nt, Mycobacterium avium subsp. paratuberculosis
accaggcccuccu

SEQ ID NO: 2809907 - RNA, 19 nt, Mycobacterium avium subsp. paratuberculosis
accaggcccuccuggguga

SEQ ID NO: 2809908 - RNA, 23 nt, Mycobacterium avium subsp. paratuberculosis
accaggcccucgccgcggucauc

SEQ ID NO: 2809909 - RNA, 16 nt, Mycobacterium avium subsp. paratuberculosis
accaggccgaagacga

SEQ ID NO: 2809910 - RNA, 17 nt, Mycobacterium avium subsp. paratuberculosis
accaggccgaagacgau

SEQ ID NO: 2809911 - RNA, 13 nt, Mycobacterium avium subsp. paratuberculosis
accaggccgacgc

SEQ ID NO: 2809912 - RNA, 15 nt, Mycobacterium avium subsp. paratuberculosis
accaggccgacgcug

SEQ ID NO: 2809913 - RNA, 17 nt, Mycobacterium avium subsp. paratuberculosis
accaggccgacgcuggc

SEQ ID NO: 2809914 - RNA, 18 nt, Mycobacterium avium subsp. paratuberculosis
accaggccgacgcuggcc

SEQ ID NO: 2809915 - RNA, 13 nt, Mycobacterium avium subsp. paratuberculosis
accaggccgcgcu

SEQ ID NO: 2809916 - RNA, 16 nt, Mycobacterium avium subsp. paratuberculosis
accaggccgcgcuggc

SEQ ID NO: 2809917 - RNA, 18 nt, Mycobacterium avium subsp. paratuberculosis
accaggccgcgcuggcgc

SEQ ID NO: 2809918 - RNA, 19 nt, Mycobacterium avium subsp. paratuberculosis
accaggccguccaccagau

SEQ ID NO: 2809919 - RNA, 12 nt, Mycobacterium avium subsp. paratuberculosis
accaggcgacgu

SEQ ID NO: 2809920 - RNA, 14 nt, Mycobacterium avium subsp. paratuberculosis
accaggcgacguuc

SEQ ID NO: 2809921 - RNA, 17 nt, Mycobacterium avium subsp. paratuberculosis
accaggcgcaccagcug

SEQ ID NO: 2809922 - RNA, 18 nt, Mycobacterium avium subsp. paratuberculosis
accaggcgccacagcagc

SEQ ID NO: 2809923 - RNA, 16 nt, Mycobacterium avium subsp. paratuberculosis
accaggcgccggccag

SEQ ID NO: 2809924 - RNA, 18 nt, Mycobacterium avium subsp. paratuberculosis
accaggcgccggccagca

SEQ ID NO: 2809925 - RNA, 12 nt, Mycobacterium avium subsp. paratuberculosis
accaggcgccgu

SEQ ID NO: 2809926 - RNA, 14 nt, Mycobacterium avium subsp. paratuberculosis
accaggcgccgucg

SEQ ID NO: 2809927 - RNA, 14 nt, Mycobacterium avium subsp. paratuberculosis
accaggcgcucguc

SEQ ID NO: 2809928 - RNA, 15 nt, Mycobacterium avium subsp. paratuberculosis
accaggcgcucgucg

SEQ ID NO: 2809929 - RNA, 16 nt, Mycobacterium avium subsp. paratuberculosis
accaggcgguccgaca

SEQ ID NO: 2809930 - RNA, 18 nt, Mycobacterium avium subsp. paratuberculosis
accaggcucacgcugcca

SEQ ID NO: 2809931 - RNA, 23 nt, Mycobacterium avium subsp. paratuberculosis
accaggcucgcucccgcgcgggc

SEQ ID NO: 2809932 - RNA, 18 nt, Mycobacterium avium subsp. paratuberculosis
accaggcugaacgucguc

SEQ ID NO: 2809933 - RNA, 22 nt, Mycobacterium avium subsp. paratuberculosis
accaggcugaacgucgucagca

SEQ ID NO: 2809934 - RNA, 15 nt, Mycobacterium avium subsp. paratuberculosis
accaggcugaccagc

SEQ ID NO: 2809935 - RNA, 18 nt, Mycobacterium avium subsp. paratuberculosis
accaggcugaccagcgcc

SEQ ID NO: 2809936 - RNA, 20 nt, Mycobacterium avium subsp. paratuberculosis
accaggcugaccagcgccuc

SEQ ID NO: 2809937 - RNA, 22 nt, Mycobacterium avium subsp. paratuberculosis
accaggcugaccagcgccucgc

SEQ ID NO: 2809938 - RNA, 19 nt, Mycobacterium avium subsp. paratuberculosis
accaggcugcucggcgggc

SEQ ID NO: 2809939 - RNA, 20 nt, Mycobacterium avium subsp. paratuberculosis
accaggcugcucggcgggcu

SEQ ID NO: 2809940 - RNA, 22 nt, Mycobacterium avium subsp. paratuberculosis
accaggcugcucggcgggcucg

SEQ ID NO: 2809941 - RNA, 13 nt, Mycobacterium avium subsp. paratuberculosis
accaggcuugccc

SEQ ID NO: 2809942 - RNA, 15 nt, Mycobacterium avium subsp. paratuberculosis
accaggcuuggcccg

SEQ ID NO: 2809943 - RNA, 19 nt, Mycobacterium avium subsp. paratuberculosis
accaggcuuggcccgccgc

SEQ ID NO: 2809944 - RNA, 13 nt, Mycobacterium avium subsp. paratuberculosis
accagggcagcca

SEQ ID NO: 2809945 - RNA, 20 nt, Mycobacterium avium subsp. paratuberculosis
accagggcagccagcccgcg

SEQ ID NO: 2809946 - RNA, 15 nt, Mycobacterium avium subsp. paratuberculosis
accagggcagcgccu

SEQ ID NO: 2809947 - RNA, 16 nt, Mycobacterium avium subsp. paratuberculosis
accagggcagcgccuc

SEQ ID NO: 2809948 - RNA, 17 nt, Mycobacterium avium subsp. paratuberculosis
accagggcagcgccucg

SEQ ID NO: 2809949 - RNA, 19 nt, Mycobacterium avium subsp. paratuberculosis
accagggcagcgccucggc

SEQ ID NO: 2809950 - RNA, 13 nt, Mycobacterium avium subsp. paratuberculosis
accagggccgcga

SEQ ID NO: 2809951 - RNA, 14 nt, Mycobacterium avium subsp. paratuberculosis
accagggccgcgag

SEQ ID NO: 2809952 - RNA, 18 nt, Mycobacterium avium subsp. paratuberculosis
accagggccucgucgucg

SEQ ID NO: 2809953 - RNA, 23 nt, Mycobacterium avium subsp. paratuberculosis
accagggcgaucaccgcggccac

SEQ ID NO: 2809954 - RNA, 15 nt, Mycobacterium avium subsp. paratuberculosis
accagggcgguggcg

SEQ ID NO: 2809955 - RNA, 20 nt, Mycobacterium avium subsp. paratuberculosis
accagggcgucgagcgcguc

SEQ ID NO: 2809956 - RNA, 14 nt, Mycobacterium avium subsp. paratuberculosis
accagggcguguug

SEQ ID NO: 2809957 - RNA, 18 nt, Mycobacterium avium subsp. paratuberculosis
accagggucucgcgcagc

SEQ ID NO: 2809958 - RNA, 19 nt, Mycobacterium avium subsp. paratuberculosis
accagggucucgcgcagca

SEQ ID NO: 2809959 - RNA, 21 nt, Mycobacterium avium subsp. paratuberculosis
accagggucuucagcccgcgc

SEQ ID NO: 2809960 - RNA, 23 nt, Mycobacterium avium subsp. paratuberculosis
accagggucuucagcccgcgcau

SEQ ID NO: 2809961 - RNA, 14 nt, Mycobacterium avium subsp. paratuberculosis
accagggugccgcc

SEQ ID NO: 2809962 - RNA, 19 nt, Mycobacterium avium subsp. paratuberculosis
accagggugccgccgggca

SEQ ID NO: 2809963 - RNA, 21 nt, Mycobacterium avium subsp. paratuberculosis
accagggugccgccgggcacc

SEQ ID NO: 2809964 - RNA, 16 nt, Mycobacterium avium subsp. paratuberculosis
accagggugcgcacga

SEQ ID NO: 2809965 - RNA, 17 nt, Mycobacterium avium subsp. paratuberculosis
accagggugcgcacgau

SEQ ID NO: 2809966 - RNA, 23 nt, Mycobacterium avium subsp. paratuberculosis
accagggugcgcacgaucugcag

SEQ ID NO: 2809967 - RNA, 18 nt, Mycobacterium avium subsp. paratuberculosis
accagggugcgcagcgcg

SEQ ID NO: 2809968 - RNA, 19 nt, Mycobacterium avium subsp. paratuberculosis
accagggugcgcagcgcgu

SEQ ID NO: 2809969 - RNA, 19 nt, Mycobacterium avium subsp. paratuberculosis
accaggguggccccagccc

SEQ ID NO: 2809970 - RNA, 21 nt, Mycobacterium avium subsp. paratuberculosis
accaggguggccccagcccgg

SEQ ID NO: 2809971 - RNA, 14 nt, Mycobacterium avium subsp. paratuberculosis
accaggguggccgc

SEQ ID NO: 2809972 - RNA, 14 nt, Mycobacterium avium subsp. paratuberculosis
accaggguggucag

SEQ ID NO: 2809973 - RNA, 13 nt, Mycobacterium avium subsp. paratuberculosis
accaugucgacgc

SEQ ID NO: 2809974 - RNA, 17 nt, Mycobacterium avium subsp. paratuberculosis
accaugucgacgcugag

SEQ ID NO: 2809975 - RNA, 21 nt, Mycobacterium avium subsp. paratuberculosis
accaugucgacgcugagccgc

SEQ ID NO: 2809976 - RNA, 23 nt, Mycobacterium avium subsp. paratuberculosis
accaugucgacgcugagccgcuc

SEQ ID NO: 2809977 - RNA, 15 nt, Mycobacterium avium subsp. paratuberculosis
accaugucggcgacc

SEQ ID NO: 2809978 - RNA, 20 nt, Mycobacterium avium subsp. paratuberculosis
accaugucggcgucgccgag

SEQ ID NO: 2809979 - RNA, 16 nt, Mycobacterium avium subsp. paratuberculosis
accaugucguugacgc

SEQ ID NO: 2809980 - RNA, 19 nt, Mycobacterium avium subsp. paratuberculosis
accauguuccagaaccggc

SEQ ID NO: 2809981 - RNA, 13 nt, Mycobacterium avium subsp. paratuberculosis
accauugcgccgg

SEQ ID NO: 2809982 - RNA, 15 nt, Mycobacterium avium subsp. paratuberculosis
accauuugcccagca

SEQ ID NO: 2809983 - RNA, 17 nt, Mycobacterium avium subsp. paratuberculosis
accauuugcccagcagg

SEQ ID NO: 2809984 - RNA, 18 nt, Mycobacterium avium subsp. paratuberculosis
acccaacucaugggcccg

SEQ ID NO: 2809985 - RNA, 20 nt, Mycobacterium avium subsp. paratuberculosis
acccaacucaugggcccggc

SEQ ID NO: 2809986 - RNA, 21 nt, Mycobacterium avium subsp. paratuberculosis
acccacacguugagcccggac

SEQ ID NO: 2809987 - RNA, 16 nt, Mycobacterium avium subsp. paratuberculosis
acccacagcugccggc

SEQ ID NO: 2809988 - RNA, 13 nt, Mycobacterium avium subsp. paratuberculosis
acccaccagcgcc

SEQ ID NO: 2809989 - RNA, 15 nt, Mycobacterium avium subsp. paratuberculosis
acccaccggcccagc

SEQ ID NO: 2809990 - RNA, 15 nt, Mycobacterium avium subsp. paratuberculosis
acccaccggcgcagc

SEQ ID NO: 2809991 - RNA, 19 nt, Mycobacterium avium subsp. paratuberculosis
acccaccggcgcagcgcgu

SEQ ID NO: 2809992 - RNA, 12 nt, Mycobacterium avium subsp. paratuberculosis
acccacgccagc

SEQ ID NO: 2809993 - RNA, 17 nt, Mycobacterium avium subsp. paratuberculosis
acccacgccagccgggu

SEQ ID NO: 2809994 - RNA, 13 nt, Mycobacterium avium subsp. paratuberculosis
acccacggccaca

SEQ ID NO: 2809995 - RNA, 14 nt, Mycobacterium avium subsp. paratuberculosis
acccacgugcggcg

SEQ ID NO: 2809996 - RNA, 14 nt, Mycobacterium avium subsp. paratuberculosis
acccacucccagcc

SEQ ID NO: 2809997 - RNA, 17 nt, Mycobacterium avium subsp. paratuberculosis
acccacucccagccgcc

SEQ ID NO: 2809998 - RNA, 16 nt, Mycobacterium avium subsp. paratuberculosis
acccacuggcggccgg

SEQ ID NO: 2809999 - RNA, 18 nt, Mycobacterium avium subsp. paratuberculosis
acccacuggcggccggcc

SEQ ID NO: 2810000 - RNA, 21 nt, Mycobacterium avium subsp. paratuberculosis
acccacuggcggccggccgcg

SEQ ID NO: 2810001 - RNA, 23 nt, Mycobacterium avium subsp. paratuberculosis
acccacuggcggccggccgcgcc

SEQ ID NO: 2810002 - RNA, 17 nt, Mycobacterium avium subsp. paratuberculosis
acccagaucgcccgggc

SEQ ID NO: 2810003 - RNA, 20 nt, Mycobacterium avium subsp. paratuberculosis
acccagaucgcccgggcggc

SEQ ID NO: 2810004 - RNA, 21 nt, Mycobacterium avium subsp. paratuberculosis
acccagaucgcccgggcggcg

SEQ ID NO: 2810005 - RNA, 17 nt, Mycobacterium avium subsp. paratuberculosis
acccagaugcccagcgg

SEQ ID NO: 2810006 - RNA, 19 nt, Mycobacterium avium subsp. paratuberculosis
acccagcaccaacagcggc

SEQ ID NO: 2810007 - RNA, 20 nt, Mycobacterium avium subsp. paratuberculosis
acccagcaccaacagcggcc

SEQ ID NO: 2810008 - RNA, 22 nt, Mycobacterium avium subsp. paratuberculosis
acccagcaccaacagcggcccg

SEQ ID NO: 2810009 - RNA, 13 nt, Mycobacterium avium subsp. paratuberculosis
acccagcaccacc

SEQ ID NO: 2810010 - RNA, 14 nt, Mycobacterium avium subsp. paratuberculosis
acccagcaccacca

SEQ ID NO: 2810011 - RNA, 22 nt, Mycobacterium avium subsp. paratuberculosis
acccagcaccaccacgcuggcc

SEQ ID NO: 2810012 - RNA, 11 nt, Mycobacterium avium subsp. paratuberculosis
acccagcaccc

SEQ ID NO: 2810013 - RNA, 12 nt, Mycobacterium avium subsp. paratuberculosis
acccagcagcgg

SEQ ID NO: 2810014 - RNA, 13 nt, Mycobacterium avium subsp. paratuberculosis
acccagcagcggc

SEQ ID NO: 2810015 - RNA, 20 nt, Mycobacterium avium subsp. paratuberculosis
acccagcagcggccggcgca

SEQ ID NO: 2810016 - RNA, 21 nt, Mycobacterium avium subsp. paratuberculosis
acccagcagcggccggcgcag

SEQ ID NO: 2810017 - RNA, 22 nt, Mycobacterium avium subsp. paratuberculosis
acccagcagcggccggcgcagc

SEQ ID NO: 2810018 - RNA, 15 nt, Mycobacterium avium subsp. paratuberculosis
acccagcaucgccgc

SEQ ID NO: 2810019 - RNA, 16 nt, Mycobacterium avium subsp. paratuberculosis
acccagcaucgccgcg

SEQ ID NO: 2810020 - RNA, 18 nt, Mycobacterium avium subsp. paratuberculosis
acccagcaucgccgcggu

SEQ ID NO: 2810021 - RNA, 22 nt, Mycobacterium avium subsp. paratuberculosis
acccagcaucgccgcggugcgc

SEQ ID NO: 2810022 - RNA, 21 nt, Mycobacterium avium subsp. paratuberculosis
acccagccgcauucggugagc

SEQ ID NO: 2810023 - RNA, 11 nt, Mycobacterium avium subsp. paratuberculosis
acccagccgcu

SEQ ID NO: 2810024 - RNA, 14 nt, Mycobacterium avium subsp. paratuberculosis
acccagccgcugaa

SEQ ID NO: 2810025 - RNA, 17 nt, Mycobacterium avium subsp. paratuberculosis
acccagcgccucgagca

SEQ ID NO: 2810026 - RNA, 20 nt, Mycobacterium avium subsp. paratuberculosis
acccagcggaaccgggggcc

SEQ ID NO: 2810027 - RNA, 11 nt, Mycobacterium avium subsp. paratuberculosis
acccagcggcg

SEQ ID NO: 2810028 - RNA, 15 nt, Mycobacterium avium subsp. paratuberculosis
acccagcggcgcggc

SEQ ID NO: 2810029 - RNA, 16 nt, Mycobacterium avium subsp. paratuberculosis
acccagcggcgcggcc

SEQ ID NO: 2810030 - RNA, 19 nt, Mycobacterium avium subsp. paratuberculosis
acccagcggcgcggccgau

SEQ ID NO: 2810031 - RNA, 14 nt, Mycobacterium avium subsp. paratuberculosis
acccagcgggcgac

SEQ ID NO: 2810032 - RNA, 15 nt, Mycobacterium avium subsp. paratuberculosis
acccagcuccucggc

SEQ ID NO: 2810033 - RNA, 19 nt, Mycobacterium avium subsp. paratuberculosis
acccagcuccucggccagc

SEQ ID NO: 2810034 - RNA, 22 nt, Mycobacterium avium subsp. paratuberculosis
acccagcuccucggccagcacc

SEQ ID NO: 2810035 - RNA, 17 nt, Mycobacterium avium subsp. paratuberculosis
acccagcuugaccaccc

SEQ ID NO: 2810036 - RNA, 19 nt, Mycobacterium avium subsp. paratuberculosis
acccagcuugaccacccgg

SEQ ID NO: 2810037 - RNA, 19 nt, Mycobacterium avium subsp. paratuberculosis
acccaggaaaaccagcgac

SEQ ID NO: 2810038 - RNA, 20 nt, Mycobacterium avium subsp. paratuberculosis
acccaggaaaaccagcgacg

SEQ ID NO: 2810039 - RNA, 14 nt, Mycobacterium avium subsp. paratuberculosis
acccaggccacccg

SEQ ID NO: 2810040 - RNA, 14 nt, Mycobacterium avium subsp. paratuberculosis
acccaggccgccgc

SEQ ID NO: 2810041 - RNA, 23 nt, Mycobacterium avium subsp. paratuberculosis
acccagggcaacgaacgcggcgc

SEQ ID NO: 2810042 - RNA, 18 nt, Mycobacterium avium subsp. paratuberculosis
acccaggucaugguggcg

SEQ ID NO: 2810043 - RNA, 21 nt, Mycobacterium avium subsp. paratuberculosis
acccaggucaugguggcggcg

SEQ ID NO: 2810044 - RNA, 19 nt, Mycobacterium avium subsp. paratuberculosis
acccaucaggaugcccggg

SEQ ID NO: 2810045 - RNA, 22 nt, Mycobacterium avium subsp. paratuberculosis
acccaugauggugggcaccgcg

SEQ ID NO: 2810046 - RNA, 17 nt, Mycobacterium avium subsp. paratuberculosis
acccauucacgcagcug

SEQ ID NO: 2810047 - RNA, 19 nt, Mycobacterium avium subsp. paratuberculosis
acccauucacgcagcuggc

SEQ ID NO: 2810048 - RNA, 15 nt, Mycobacterium avium subsp. paratuberculosis
acccauucgucggcg

SEQ ID NO: 2810049 - RNA, 15 nt, Mycobacterium avium subsp. paratuberculosis
acccauugucgccgu

SEQ ID NO: 2810050 - RNA, 21 nt, Mycobacterium avium subsp. paratuberculosis
acccauugucgccgugcggcg

SEQ ID NO: 2810051 - RNA, 18 nt, Mycobacterium avium subsp. paratuberculosis
accccacaccguccgacc

SEQ ID NO: 2810052 - RNA, 23 nt, Mycobacterium avium subsp. paratuberculosis
accccacaccuucgcggucggca

SEQ ID NO: 2810053 - RNA, 15 nt, Mycobacterium avium subsp. paratuberculosis
accccacagcgcgcc

SEQ ID NO: 2810054 - RNA, 18 nt, Mycobacterium avium subsp. paratuberculosis
accccacagcgcgcccca

SEQ ID NO: 2810055 - RNA, 16 nt, Mycobacterium avium subsp. paratuberculosis
accccacccgcgcgac

SEQ ID NO: 2810056 - RNA, 17 nt, Mycobacterium avium subsp. paratuberculosis
accccacccgcgcgaca

SEQ ID NO: 2810057 - RNA, 17 nt, Mycobacterium avium subsp. paratuberculosis
accccaccgagcagcug

SEQ ID NO: 2810058 - RNA, 20 nt, Mycobacterium avium subsp. paratuberculosis
accccggccagggugccgac

SEQ ID NO: 2810059 - RNA, 21 nt, Mycobacterium avium subsp. paratuberculosis
accccggccaguccgcgugac

SEQ ID NO: 2810060 - RNA, 11 nt, Mycobacterium avium subsp. paratuberculosis
accccggcccc

SEQ ID NO: 2810061 - RNA, 16 nt, Mycobacterium avium subsp. paratuberculosis
accccggccccggccg

SEQ ID NO: 2810062 - RNA, 18 nt, Mycobacterium avium subsp. paratuberculosis
accccggccccggccggc

SEQ ID NO: 2810063 - RNA, 19 nt, Mycobacterium avium subsp. paratuberculosis
accccggccccggccggcg

SEQ ID NO: 2810064 - RNA, 13 nt, Mycobacterium avium subsp. paratuberculosis
accccggcgacgg

SEQ ID NO: 2810065 - RNA, 20 nt, Mycobacterium avium subsp. paratuberculosis
accccggcgacggcgguggg

SEQ ID NO: 2810066 - RNA, 18 nt, Mycobacterium avium subsp. paratuberculosis
accccggcgagcgcgugc

SEQ ID NO: 2810067 - RNA, 13 nt, Mycobacterium avium subsp. paratuberculosis
accccggcgauga

SEQ ID NO: 2810068 - RNA, 15 nt, Mycobacterium avium subsp. paratuberculosis
accccggcgaugacc

SEQ ID NO: 2810069 - RNA, 16 nt, Mycobacterium avium subsp. paratuberculosis
accccggcgcggaacg

SEQ ID NO: 2810070 - RNA, 14 nt, Mycobacterium avium subsp. paratuberculosis
accccggcggccgc

SEQ ID NO: 2810071 - RNA, 15 nt, Mycobacterium avium subsp. paratuberculosis
accccggcggccgcg

SEQ ID NO: 2810072 - RNA, 17 nt, Mycobacterium avium subsp. paratuberculosis
accccggcggccgcguc

SEQ ID NO: 2810073 - RNA, 20 nt, Mycobacterium avium subsp. paratuberculosis
accccggcggccgcgucggc

SEQ ID NO: 2810074 - RNA, 18 nt, Mycobacterium avium subsp. paratuberculosis
accccggcguccaguagc

SEQ ID NO: 2810075 - RNA, 13 nt, Mycobacterium avium subsp. paratuberculosis
accccgggcggcu

SEQ ID NO: 2810076 - RNA, 20 nt, Mycobacterium avium subsp. paratuberculosis
accccggucaccgguccggu

SEQ ID NO: 2810077 - RNA, 15 nt, Mycobacterium avium subsp. paratuberculosis
accccgguccaggcg

SEQ ID NO: 2810078 - RNA, 16 nt, Mycobacterium avium subsp. paratuberculosis
accccggugccgcagu

SEQ ID NO: 2810079 - RNA, 19 nt, Mycobacterium avium subsp. paratuberculosis
accccggugccgcagugcc

SEQ ID NO: 2810080 - RNA, 15 nt, Mycobacterium avium subsp. paratuberculosis
accccguaccagcgc

SEQ ID NO: 2810081 - RNA, 19 nt, Mycobacterium avium subsp. paratuberculosis
accccguaccagcgcucga

SEQ ID NO: 2810082 - RNA, 15 nt, Mycobacterium avium subsp. paratuberculosis
accccguaggugcac

SEQ ID NO: 2810083 - RNA, 20 nt, Mycobacterium avium subsp. paratuberculosis
accccguccaggaugagcug

SEQ ID NO: 2810084 - RNA, 16 nt, Mycobacterium avium subsp. paratuberculosis
accccgucgagcagcc

SEQ ID NO: 2810085 - RNA, 17 nt, Mycobacterium avium subsp. paratuberculosis
accccgucgagcagccg

SEQ ID NO: 2810086 - RNA, 13 nt, Mycobacterium avium subsp. paratuberculosis
accccgucgaggu

SEQ ID NO: 2810087 - RNA, 14 nt, Mycobacterium avium subsp. paratuberculosis
accccgucgcggac

SEQ ID NO: 2810088 - RNA, 20 nt, Mycobacterium avium subsp. paratuberculosis
accccgucgcggacccuggc

SEQ ID NO: 2810089 - RNA, 23 nt, Mycobacterium avium subsp. paratuberculosis
accccgucgcggacccuggccag

SEQ ID NO: 2810090 - RNA, 16 nt, Mycobacterium avium subsp. paratuberculosis
accccgugguagacgc

SEQ ID NO: 2810091 - RNA, 21 nt, Mycobacterium avium subsp. paratuberculosis
accccgugguagacgccggac

SEQ ID NO: 2810092 - RNA, 15 nt, Mycobacterium avium subsp. paratuberculosis
accccguucgccgac

SEQ ID NO: 2810093 - RNA, 21 nt, Mycobacterium avium subsp. paratuberculosis
accccguucgccgacagcagc

SEQ ID NO: 2810094 - RNA, 17 nt, Mycobacterium avium subsp. paratuberculosis
accccguugagcagcgg

SEQ ID NO: 2810095 - RNA, 17 nt, Mycobacterium avium subsp. paratuberculosis
accccguugccgccggc

SEQ ID NO: 2810096 - RNA, 21 nt, Mycobacterium avium subsp. paratuberculosis
accccuacgggcgcaccgcgc

SEQ ID NO: 2810097 - RNA, 23 nt, Mycobacterium avium subsp. paratuberculosis
accccuacgggcgcaccgcgcgc

SEQ ID NO: 2810098 - RNA, 17 nt, Mycobacterium avium subsp. paratuberculosis
accccucagccggaacc

SEQ ID NO: 2810099 - RNA, 15 nt, Mycobacterium avium subsp. paratuberculosis
accccugccgccacc

SEQ ID NO: 2810100 - RNA, 23 nt, Mycobacterium avium subsp. paratuberculosis
accccuggcggguacagccgcag

SEQ ID NO: 2810101 - RNA, 18 nt, Mycobacterium avium subsp. paratuberculosis
accccuuggcguccaugu

SEQ ID NO: 2810102 - RNA, 19 nt, Mycobacterium avium subsp. paratuberculosis
acccgaaaagcaccaggcu

SEQ ID NO: 2810103 - RNA, 20 nt, Mycobacterium avium subsp. paratuberculosis
acccgaaaagcaccaggcuc

SEQ ID NO: 2810104 - RNA, 22 nt, Mycobacterium avium subsp. paratuberculosis
acccgaaaagcaccaggcucgc

SEQ ID NO: 2810105 - RNA, 19 nt, Mycobacterium avium subsp. paratuberculosis
acccgaaagcccccagcuc

SEQ ID NO: 2810106 - RNA, 16 nt, Mycobacterium avium subsp. paratuberculosis
acccgaacccagcgcc

SEQ ID NO: 2810107 - RNA, 18 nt, Mycobacterium avium subsp. paratuberculosis
acccgaacccagcgccuc

SEQ ID NO: 2810108 - RNA, 18 nt, Mycobacterium avium subsp. paratuberculosis
acccgaacggaccgggcg

SEQ ID NO: 2810109 - RNA, 22 nt, Mycobacterium avium subsp. paratuberculosis
acccgaacggaccgggcgggcu

SEQ ID NO: 2810110 - RNA, 16 nt, Mycobacterium avium subsp. paratuberculosis
acccgaaggugguggc

SEQ ID NO: 2810111 - RNA, 18 nt, Mycobacterium avium subsp. paratuberculosis
acccgaaguaggcggggu

SEQ ID NO: 2810112 - RNA, 15 nt, Mycobacterium avium subsp. paratuberculosis
acccgaagucgacgc

SEQ ID NO: 2810113 - RNA, 17 nt, Mycobacterium avium subsp. paratuberculosis
acccgaauuccgcuggg

SEQ ID NO: 2810114 - RNA, 13 nt, Mycobacterium avium subsp. paratuberculosis
acccgacacgccg

SEQ ID NO: 2810115 - RNA, 12 nt, Mycobacterium avium subsp. paratuberculosis
acccgaccagca

SEQ ID NO: 2810116 - RNA, 14 nt, Mycobacterium avium subsp. paratuberculosis
acccgaccagcacc

SEQ ID NO: 2810117 - RNA, 15 nt, Mycobacterium avium subsp. paratuberculosis
acccgaccagcaccg

SEQ ID NO: 2810118 - RNA, 17 nt, Mycobacterium avium subsp. paratuberculosis
acccgaccagcaccgcg

SEQ ID NO: 2810119 - RNA, 21 nt, Mycobacterium avium subsp. paratuberculosis
acccgaccagcaccgcggcgu

SEQ ID NO: 2810120 - RNA, 12 nt, Mycobacterium avium subsp. paratuberculosis
acccgaccgcga

SEQ ID NO: 2810121 - RNA, 13 nt, Mycobacterium avium subsp. paratuberculosis
acccgaccgcgau

SEQ ID NO: 2810122 - RNA, 15 nt, Mycobacterium avium subsp. paratuberculosis
acccgaccgcgaugc

SEQ ID NO: 2810123 - RNA, 17 nt, Mycobacterium avium subsp. paratuberculosis
acccgaccgcgaugcag

SEQ ID NO: 2810124 - RNA, 16 nt, Mycobacterium avium subsp. paratuberculosis
acccgaccucgucgac

SEQ ID NO: 2810125 - RNA, 18 nt, Mycobacterium avium subsp. paratuberculosis
acccgaccucgucgacgg

SEQ ID NO: 2810126 - RNA, 21 nt, Mycobacterium avium subsp. paratuberculosis
acccgaccucgucgacggcgg

SEQ ID NO: 2810127 - RNA, 22 nt, Mycobacterium avium subsp. paratuberculosis
acccgaccucgucgacggcggc

SEQ ID NO: 2810128 - RNA, 23 nt, Mycobacterium avium subsp. paratuberculosis
acccgaccucgucgacggcggcg

SEQ ID NO: 2810129 - RNA, 21 nt, Mycobacterium avium subsp. paratuberculosis
acccgaccuuuugcccggcga

SEQ ID NO: 2810130 - RNA, 21 nt, Mycobacterium avium subsp. paratuberculosis
acccgacgggaacucggccag

SEQ ID NO: 2810131 - RNA, 22 nt, Mycobacterium avium subsp. paratuberculosis
acccgacgggaacucggccagc

SEQ ID NO: 2810132 - RNA, 16 nt, Mycobacterium avium subsp. paratuberculosis
acccgacggucgggcc

SEQ ID NO: 2810133 - RNA, 22 nt, Mycobacterium avium subsp. paratuberculosis
acccgacgucgacgcgggcgac

SEQ ID NO: 2810134 - RNA, 12 nt, Mycobacterium avium subsp. paratuberculosis
acccgacuucgg

SEQ ID NO: 2810135 - RNA, 15 nt, Mycobacterium avium subsp. paratuberculosis
acccgacuucggcuc

SEQ ID NO: 2810136 - RNA, 17 nt, Mycobacterium avium subsp. paratuberculosis
acccgacuucggcucgg

SEQ ID NO: 2810137 - RNA, 18 nt, Mycobacterium avium subsp. paratuberculosis
acccgacuucggcucggc

SEQ ID NO: 2810138 - RNA, 21 nt, Mycobacterium avium subsp. paratuberculosis
acccgacuucggcucggcgac

SEQ ID NO: 2810139 - RNA, 14 nt, Mycobacterium avium subsp. paratuberculosis
acccgagagcugcu

SEQ ID NO: 2810140 - RNA, 15 nt, Mycobacterium avium subsp. paratuberculosis
acccgagagcugcug

SEQ ID NO: 2810141 - RNA, 18 nt, Mycobacterium avium subsp. paratuberculosis
acccgagcaccccggcgg

SEQ ID NO: 2810142 - RNA, 20 nt, Mycobacterium avium subsp. paratuberculosis
acccgagcaccccggcggcc

SEQ ID NO: 2810143 - RNA, 17 nt, Mycobacterium avium subsp. paratuberculosis
acccgcgcggcgucggc

SEQ ID NO: 2810144 - RNA, 21 nt, Mycobacterium avium subsp. paratuberculosis
acccgcgcggcgucggccugc

SEQ ID NO: 2810145 - RNA, 20 nt, Mycobacterium avium subsp. paratuberculosis
acccgcgcggugcccggaac

SEQ ID NO: 2810146 - RNA, 20 nt, Mycobacterium avium subsp. paratuberculosis
acccgcgcgucgcgcagcga

SEQ ID NO: 2810147 - RNA, 13 nt, Mycobacterium avium subsp. paratuberculosis
acccgcggccgcu

SEQ ID NO: 2810148 - RNA, 14 nt, Mycobacterium avium subsp. paratuberculosis
acccgcggccgcug

SEQ ID NO: 2810149 - RNA, 16 nt, Mycobacterium avium subsp. paratuberculosis
acccgcggccgcugcg

SEQ ID NO: 2810150 - RNA, 22 nt, Mycobacterium avium subsp. paratuberculosis
acccgcggccgcugcgcccagc

SEQ ID NO: 2810151 - RNA, 13 nt, Mycobacterium avium subsp. paratuberculosis
acccgcggccggc

SEQ ID NO: 2810152 - RNA, 13 nt, Mycobacterium avium subsp. paratuberculosis
acccgcggccucc

SEQ ID NO: 2810153 - RNA, 14 nt, Mycobacterium avium subsp. paratuberculosis
acccgcggccuccg

SEQ ID NO: 2810154 - RNA, 11 nt, Mycobacterium avium subsp. paratuberculosis
acccgcggcgc

SEQ ID NO: 2810155 - RNA, 13 nt, Mycobacterium avium subsp. paratuberculosis
acccgcggcgccg

SEQ ID NO: 2810156 - RNA, 23 nt, Mycobacterium avium subsp. paratuberculosis
acccgcgggucgucgggcggcag

SEQ ID NO: 2810157 - RNA, 18 nt, Mycobacterium avium subsp. paratuberculosis
acccgcgucaucgggccc

SEQ ID NO: 2810158 - RNA, 21 nt, Mycobacterium avium subsp. paratuberculosis
acccgcucaggucggccgcgg

SEQ ID NO: 2810159 - RNA, 22 nt, Mycobacterium avium subsp. paratuberculosis
acccgcucaggucggccgcggc

SEQ ID NO: 2810160 - RNA, 23 nt, Mycobacterium avium subsp. paratuberculosis
acccgcucaggucggccgcggcc

SEQ ID NO: 2810161 - RNA, 15 nt, Mycobacterium avium subsp. paratuberculosis
acccgcuccccgauc

SEQ ID NO: 2810162 - RNA, 18 nt, Mycobacterium avium subsp. paratuberculosis
acccgcuccgacgcggug

SEQ ID NO: 2810163 - RNA, 20 nt, Mycobacterium avium subsp. paratuberculosis
acccgcuccgacgcgguggc

SEQ ID NO: 2810164 - RNA, 17 nt, Mycobacterium avium subsp. paratuberculosis
acccgcucgacgcgcac

SEQ ID NO: 2810165 - RNA, 20 nt, Mycobacterium avium subsp. paratuberculosis
acccgcucgacgcgcacccg

SEQ ID NO: 2810166 - RNA, 23 nt, Mycobacterium avium subsp. paratuberculosis
acccgcucgccgaugacguugcg

SEQ ID NO: 2810167 - RNA, 16 nt, Mycobacterium avium subsp. paratuberculosis
acccgcucgcgggccc

SEQ ID NO: 2810168 - RNA, 18 nt, Mycobacterium avium subsp. paratuberculosis
acccgcucgcgggcccgc

SEQ ID NO: 2810169 - RNA, 21 nt, Mycobacterium avium subsp. paratuberculosis
acccgcucgcgggcccgcgcc

SEQ ID NO: 2810170 - RNA, 23 nt, Mycobacterium avium subsp. paratuberculosis
acccgcucgcgggcccgcgccgc

SEQ ID NO: 2810171 - RNA, 15 nt, Mycobacterium avium subsp. paratuberculosis
acccgcucgggcgcc

SEQ ID NO: 2810172 - RNA, 22 nt, Mycobacterium avium subsp. paratuberculosis
acccgcucgggcgccucgaaca

SEQ ID NO: 2810173 - RNA, 19 nt, Mycobacterium avium subsp. paratuberculosis
acccgcugauccagcagcg

SEQ ID NO: 2810174 - RNA, 18 nt, Mycobacterium avium subsp. paratuberculosis
acccgcugcaccagcccg

SEQ ID NO: 2810175 - RNA, 20 nt, Mycobacterium avium subsp. paratuberculosis
acccgcugcagccgguccgg

SEQ ID NO: 2810176 - RNA, 21 nt, Mycobacterium avium subsp. paratuberculosis
acccgcugcagccgguccggc

SEQ ID NO: 2810177 - RNA, 15 nt, Mycobacterium avium subsp. paratuberculosis
acccgcugcucgacc

SEQ ID NO: 2810178 - RNA, 20 nt, Mycobacterium avium subsp. paratuberculosis
acccgcugcucgaccucggc

SEQ ID NO: 2810179 - RNA, 23 nt, Mycobacterium avium subsp. paratuberculosis
acccgcugcucgaccucggcgac

SEQ ID NO: 2810180 - RNA, 19 nt, Mycobacterium avium subsp. paratuberculosis
acccgcuggaacagcgggc

SEQ ID NO: 2810181 - RNA, 20 nt, Mycobacterium avium subsp. paratuberculosis
acccgcuggaacagcgggcc

SEQ ID NO: 2810182 - RNA, 23 nt, Mycobacterium avium subsp. paratuberculosis
acccgcuggaacagcgggccggc

SEQ ID NO: 2810183 - RNA, 20 nt, Mycobacterium avium subsp. paratuberculosis
acccgcuggucaaugcccuc

SEQ ID NO: 2810184 - RNA, 22 nt, Mycobacterium avium subsp. paratuberculosis
acccgcuggucaaugcccucgu

SEQ ID NO: 2810185 - RNA, 21 nt, Mycobacterium avium subsp. paratuberculosis
acccgcugucaauccccgcgg

SEQ ID NO: 2810186 - RNA, 15 nt, Mycobacterium avium subsp. paratuberculosis
acccgcuucgcccgg

SEQ ID NO: 2810187 - RNA, 16 nt, Mycobacterium avium subsp. paratuberculosis
acccgcuucgcccggc

SEQ ID NO: 2810188 - RNA, 17 nt, Mycobacterium avium subsp. paratuberculosis
acccgcuucgcccggcu

SEQ ID NO: 2810189 - RNA, 22 nt, Mycobacterium avium subsp. paratuberculosis
acccgcuucgcccggcugcgcc

SEQ ID NO: 2810190 - RNA, 14 nt, Mycobacterium avium subsp. paratuberculosis
acccggacagcgcg

SEQ ID NO: 2810191 - RNA, 15 nt, Mycobacterium avium subsp. paratuberculosis
acccggacagcgcga

SEQ ID NO: 2810192 - RNA, 16 nt, Mycobacterium avium subsp. paratuberculosis
acccggacagcgcgac

SEQ ID NO: 2810193 - RNA, 22 nt, Mycobacterium avium subsp. paratuberculosis
acccggaccgggugaccggcgc

SEQ ID NO: 2810194 - RNA, 23 nt, Mycobacterium avium subsp. paratuberculosis
acccggaccgggugaccggcgcg

SEQ ID NO: 2810195 - RNA, 20 nt, Mycobacterium avium subsp. paratuberculosis
acccggacgugaucgcggug

SEQ ID NO: 2810196 - RNA, 23 nt, Mycobacterium avium subsp. paratuberculosis
acccggacgugaucgcgguggcc

SEQ ID NO: 2810197 - RNA, 14 nt, Mycobacterium avium subsp. paratuberculosis
acccggaggcggcg

SEQ ID NO: 2810198 - RNA, 15 nt, Mycobacterium avium subsp. paratuberculosis
acccggaggcggcgg

SEQ ID NO: 2810199 - RNA, 17 nt, Mycobacterium avium subsp. paratuberculosis
acccggaggcggcgggg

SEQ ID NO: 2810200 - RNA, 23 nt, Mycobacterium avium subsp. paratuberculosis
acccggaggcggcgggggcgggc

SEQ ID NO: 2810201 - RNA, 22 nt, Mycobacterium avium subsp. paratuberculosis
acccggauacacgguggugacc

SEQ ID NO: 2810202 - RNA, 16 nt, Mycobacterium avium subsp. paratuberculosis
acccggaucggccaug

SEQ ID NO: 2810203 - RNA, 23 nt, Mycobacterium avium subsp. paratuberculosis
acccggaucggccauggugccgc

SEQ ID NO: 2810204 - RNA, 22 nt, Mycobacterium avium subsp. paratuberculosis
acccggauggucugcagcgacg

SEQ ID NO: 2810205 - RNA, 18 nt, Mycobacterium avium subsp. paratuberculosis
acccggaugucgugcggu

SEQ ID NO: 2810206 - RNA, 20 nt, Mycobacterium avium subsp. paratuberculosis
acccggcaucccacccgggu

SEQ ID NO: 2810207 - RNA, 13 nt, Mycobacterium avium subsp. paratuberculosis
acccggccaccgc

SEQ ID NO: 2810208 - RNA, 18 nt, Mycobacterium avium subsp. paratuberculosis
acccggccaccgccgcca

SEQ ID NO: 2810209 - RNA, 13 nt, Mycobacterium avium subsp. paratuberculosis
acccggccacgcc

SEQ ID NO: 2810210 - RNA, 14 nt, Mycobacterium avium subsp. paratuberculosis
acccggccacgccg

SEQ ID NO: 2810211 - RNA, 21 nt, Mycobacterium avium subsp. paratuberculosis
acccggccacgccggguuugu

SEQ ID NO: 2810212 - RNA, 12 nt, Mycobacterium avium subsp. paratuberculosis
acccggccagcg

SEQ ID NO: 2810213 - RNA, 15 nt, Mycobacterium avium subsp. paratuberculosis
acccggccagcggca

SEQ ID NO: 2810214 - RNA, 17 nt, Mycobacterium avium subsp. paratuberculosis
acccggccagcggcagc

SEQ ID NO: 2810215 - RNA, 21 nt, Mycobacterium avium subsp. paratuberculosis
acccggcccaccaccgccucg

SEQ ID NO: 2810216 - RNA, 14 nt, Mycobacterium avium subsp. paratuberculosis
acccggcccacgcc

SEQ ID NO: 2810217 - RNA, 17 nt, Mycobacterium avium subsp. paratuberculosis
acccggcccacgccguc

SEQ ID NO: 2810218 - RNA, 18 nt, Mycobacterium avium subsp. paratuberculosis
acccggcccacgccgucg

SEQ ID NO: 2810219 - RNA, 22 nt, Mycobacterium avium subsp. paratuberculosis
acccggcccacgccgucgucgu

SEQ ID NO: 2810220 - RNA, 12 nt, Mycobacterium avium subsp. paratuberculosis
acccggcccauc

SEQ ID NO: 2810221 - RNA, 13 nt, Mycobacterium avium subsp. paratuberculosis
acccggcccauca

SEQ ID NO: 2810222 - RNA, 23 nt, Mycobacterium avium subsp. paratuberculosis
acccggcccaucaccggaccggc

SEQ ID NO: 2810223 - RNA, 20 nt, Mycobacterium avium subsp. paratuberculosis
acccggcccccgagcuucgg

SEQ ID NO: 2810224 - RNA, 16 nt, Mycobacterium avium subsp. paratuberculosis
acccggcccccugagg

SEQ ID NO: 2810225 - RNA, 23 nt, Mycobacterium avium subsp. paratuberculosis
acccggcccccugaggagacgau

SEQ ID NO: 2810226 - RNA, 22 nt, Mycobacterium avium subsp. paratuberculosis
acccggcccggaacgcgucgcc

SEQ ID NO: 2810227 - RNA, 16 nt, Mycobacterium avium subsp. paratuberculosis
acccgguggcccgguc

SEQ ID NO: 2810228 - RNA, 22 nt, Mycobacterium avium subsp. paratuberculosis
acccggugggacugggcgccgc

SEQ ID NO: 2810229 - RNA, 19 nt, Mycobacterium avium subsp. paratuberculosis
acccgguuccaccgggccg

SEQ ID NO: 2810230 - RNA, 21 nt, Mycobacterium avium subsp. paratuberculosis
acccgguuccaccgggccgcc

SEQ ID NO: 2810231 - RNA, 22 nt, Mycobacterium avium subsp. paratuberculosis
acccgguuccaccgggccgcca

SEQ ID NO: 2810232 - RNA, 16 nt, Mycobacterium avium subsp. paratuberculosis
acccgguucugggcgg

SEQ ID NO: 2810233 - RNA, 19 nt, Mycobacterium avium subsp. paratuberculosis
acccgguucugggcgggcu

SEQ ID NO: 2810234 - RNA, 14 nt, Mycobacterium avium subsp. paratuberculosis
acccgguugagcac

SEQ ID NO: 2810235 - RNA, 16 nt, Mycobacterium avium subsp. paratuberculosis
acccgguugauccgga

SEQ ID NO: 2810236 - RNA, 21 nt, Mycobacterium avium subsp. paratuberculosis
acccguaacacgaucaccccg

SEQ ID NO: 2810237 - RNA, 23 nt, Mycobacterium avium subsp. paratuberculosis
acccguaacacgaucaccccgac

SEQ ID NO: 2810238 - RNA, 16 nt, Mycobacterium avium subsp. paratuberculosis
acccguaauugaucgu

SEQ ID NO: 2810239 - RNA, 15 nt, Mycobacterium avium subsp. paratuberculosis
acccguccagcgcga

SEQ ID NO: 2810240 - RNA, 16 nt, Mycobacterium avium subsp. paratuberculosis
acccguccagcgcgag

SEQ ID NO: 2810241 - RNA, 23 nt, Mycobacterium avium subsp. paratuberculosis
acccguccagcgugugcguggug

SEQ ID NO: 2810242 - RNA, 17 nt, Mycobacterium avium subsp. paratuberculosis
acccgucgacucggcgg

SEQ ID NO: 2810243 - RNA, 19 nt, Mycobacterium avium subsp. paratuberculosis
acccgucgacucggcggug

SEQ ID NO: 2810244 - RNA, 17 nt, Mycobacterium avium subsp. paratuberculosis
acccgucgcgggucagc

SEQ ID NO: 2810245 - RNA, 23 nt, Mycobacterium avium subsp. paratuberculosis
acccgucggugaaguuggcggcg

SEQ ID NO: 2810246 - RNA, 16 nt, Mycobacterium avium subsp. paratuberculosis
acccguggauggacgc

SEQ ID NO: 2810247 - RNA, 18 nt, Mycobacterium avium subsp. paratuberculosis
acccgugggccgaccggc

SEQ ID NO: 2810248 - RNA, 21 nt, Mycobacterium avium subsp. paratuberculosis
acccgugggccgaccggccgg

SEQ ID NO: 2810249 - RNA, 22 nt, Mycobacterium avium subsp. paratuberculosis
acccgugggccgaccggccggu

SEQ ID NO: 2810250 - RNA, 15 nt, Mycobacterium avium subsp. paratuberculosis
acccguuccccggcc

SEQ ID NO: 2810251 - RNA, 16 nt, Mycobacterium avium subsp. paratuberculosis
acccguuccccggccg

SEQ ID NO: 2810252 - RNA, 20 nt, Mycobacterium avium subsp. paratuberculosis
acccguuccccggccgacgu

SEQ ID NO: 2810253 - RNA, 15 nt, Mycobacterium avium subsp. paratuberculosis
acccguucggcgucg

SEQ ID NO: 2810254 - RNA, 16 nt, Mycobacterium avium subsp. paratuberculosis
acccguucggcgucga

SEQ ID NO: 2810255 - RNA, 14 nt, Mycobacterium avium subsp. paratuberculosis
acccguugcagcac

SEQ ID NO: 2810256 - RNA, 14 nt, Mycobacterium avium subsp. paratuberculosis
acccguugcgcccc

SEQ ID NO: 2810257 - RNA, 15 nt, Mycobacterium avium subsp. paratuberculosis
acccguuggcaggcc

SEQ ID NO: 2810258 - RNA, 16 nt, Mycobacterium avium subsp. paratuberculosis
acccguuugaggcgag

SEQ ID NO: 2810259 - RNA, 17 nt, Mycobacterium avium subsp. paratuberculosis
acccguuugaggcgagc

SEQ ID NO: 2810260 - RNA, 22 nt, Mycobacterium avium subsp. paratuberculosis
acccguuugaggcgagcaauua

SEQ ID NO: 2810261 - RNA, 16 nt, Mycobacterium avium subsp. paratuberculosis
acccucagaccauggc

SEQ ID NO: 2810262 - RNA, 22 nt, Mycobacterium avium subsp. paratuberculosis
acccucagaccauggcgcggcg

SEQ ID NO: 2810263 - RNA, 23 nt, Mycobacterium avium subsp. paratuberculosis
acccucagaccauggcgcggcgg

SEQ ID NO: 2810264 - RNA, 12 nt, Mycobacterium avium subsp. paratuberculosis
acccucagcagg

SEQ ID NO: 2810265 - RNA, 14 nt, Mycobacterium avium subsp. paratuberculosis
acccucagcagggc

SEQ ID NO: 2810266 - RNA, 20 nt, Mycobacterium avium subsp. paratuberculosis
acccucagcagggcggcacc

SEQ ID NO: 2810267 - RNA, 21 nt, Mycobacterium avium subsp. paratuberculosis
acccucagcagggcggcaccg

SEQ ID NO: 2810268 - RNA, 16 nt, Mycobacterium avium subsp. paratuberculosis
acccucagggagcugc

SEQ ID NO: 2810269 - RNA, 20 nt, Mycobacterium avium subsp. paratuberculosis
acccucagggagcugcccgc

SEQ ID NO: 2810270 - RNA, 13 nt, Mycobacterium avium subsp. paratuberculosis
acccuccggcgcc

SEQ ID NO: 2810271 - RNA, 16 nt, Mycobacterium avium subsp. paratuberculosis
acccuccucgcggcgg

SEQ ID NO: 2810272 - RNA, 13 nt, Mycobacterium avium subsp. paratuberculosis
acccucgacgccg

SEQ ID NO: 2810273 - RNA, 15 nt, Mycobacterium avium subsp. paratuberculosis
acccucgacgccggg

SEQ ID NO: 2810274 - RNA, 17 nt, Mycobacterium avium subsp. paratuberculosis
acccucgaggccgacgu

SEQ ID NO: 2810275 - RNA, 20 nt, Mycobacterium avium subsp. paratuberculosis
acccucgggguagccggccc

SEQ ID NO: 2810276 - RNA, 21 nt, Mycobacterium avium subsp. paratuberculosis
acccucgggguagccggcccg

SEQ ID NO: 2810277 - RNA, 14 nt, Mycobacterium avium subsp. paratuberculosis
acccucggucgggc

SEQ ID NO: 2810278 - RNA, 17 nt, Mycobacterium avium subsp. paratuberculosis
acccucggucgggcgau

SEQ ID NO: 2810279 - RNA, 22 nt, Mycobacterium avium subsp. paratuberculosis
acccucguucgaauuguggcgg

SEQ ID NO: 2810280 - RNA, 13 nt, Mycobacterium avium subsp. paratuberculosis
acccugccgaccu

SEQ ID NO: 2810281 - RNA, 19 nt, Mycobacterium avium subsp. paratuberculosis
acccugccgaccugcgcga

SEQ ID NO: 2810282 - RNA, 19 nt, Mycobacterium avium subsp. paratuberculosis
acccugcguccggcccggc

SEQ ID NO: 2810283 - RNA, 22 nt, Mycobacterium avium subsp. paratuberculosis
acccugcguccggcccggcguc

SEQ ID NO: 2810284 - RNA, 17 nt, Mycobacterium avium subsp. paratuberculosis
acccuggcgaaccgcgg

SEQ ID NO: 2810285 - RNA, 18 nt, Mycobacterium avium subsp. paratuberculosis
acccuggcgaaccgcggc

SEQ ID NO: 2810286 - RNA, 23 nt, Mycobacterium avium subsp. paratuberculosis
acccugggcggcgacacgccgac

SEQ ID NO: 2810287 - RNA, 16 nt, Mycobacterium avium subsp. paratuberculosis
acccuucaucagcacc

SEQ ID NO: 2810288 - RNA, 15 nt, Mycobacterium avium subsp. paratuberculosis
acccuucggccggca

SEQ ID NO: 2810289 - RNA, 17 nt, Mycobacterium avium subsp. paratuberculosis
acccuugacuaccgcgc

SEQ ID NO: 2810290 - RNA, 18 nt, Mycobacterium avium subsp. paratuberculosis
acccuugacuaccgcgcc

SEQ ID NO: 2810291 - RNA, 15 nt, Mycobacterium avium subsp. paratuberculosis
acccuugucggugac

SEQ ID NO: 2810292 - RNA, 17 nt, Mycobacterium avium subsp. paratuberculosis
acccuuuugccgaucgu

SEQ ID NO: 2810293 - RNA, 22 nt, Mycobacterium avium subsp. paratuberculosis
accgaaaccuugaucggccccu

SEQ ID NO: 2810294 - RNA, 20 nt, Mycobacterium avium subsp. paratuberculosis
accgaaagccguagcgcaac

SEQ ID NO: 2810295 - RNA, 19 nt, Mycobacterium avium subsp. paratuberculosis
accgaacccggaucggcca

SEQ ID NO: 2810296 - RNA, 13 nt, Mycobacterium avium subsp. paratuberculosis
accgaacccgggc

SEQ ID NO: 2810297 - RNA, 15 nt, Mycobacterium avium subsp. paratuberculosis
accgaacccgggcgc

SEQ ID NO: 2810298 - RNA, 19 nt, Mycobacterium avium subsp. paratuberculosis
accgaaccgccccgcgcga

SEQ ID NO: 2810299 - RNA, 16 nt, Mycobacterium avium subsp. paratuberculosis
accgaacgccagcagc

SEQ ID NO: 2810300 - RNA, 18 nt, Mycobacterium avium subsp. paratuberculosis
accgaagaucaccgcgac

SEQ ID NO: 2810301 - RNA, 16 nt, Mycobacterium avium subsp. paratuberculosis
accgaagccgacgucg

SEQ ID NO: 2810302 - RNA, 19 nt, Mycobacterium avium subsp. paratuberculosis
accgaagccgacgucgacc

SEQ ID NO: 2810303 - RNA, 14 nt, Mycobacterium avium subsp. paratuberculosis
accgaagcggcccg

SEQ ID NO: 2810304 - RNA, 15 nt, Mycobacterium avium subsp. paratuberculosis
accgaagcggcccga

SEQ ID NO: 2810305 - RNA, 23 nt, Mycobacterium avium subsp. paratuberculosis
accgaagggaaaggcagcagcca

SEQ ID NO: 2810306 - RNA, 19 nt, Mycobacterium avium subsp. paratuberculosis
accgaaucacccacggcca

SEQ ID NO: 2810307 - RNA, 20 nt, Mycobacterium avium subsp. paratuberculosis
accgaaucacccacggccac

SEQ ID NO: 2810308 - RNA, 14 nt, Mycobacterium avium subsp. paratuberculosis
accgaaucgccgag

SEQ ID NO: 2810309 - RNA, 16 nt, Mycobacterium avium subsp. paratuberculosis
accgaaucggucgacc

SEQ ID NO: 2810310 - RNA, 18 nt, Mycobacterium avium subsp. paratuberculosis
accgaaucggucgaccag

SEQ ID NO: 2810311 - RNA, 18 nt, Mycobacterium avium subsp. paratuberculosis
accgaggugacgucgcgc

SEQ ID NO: 2810312 - RNA, 19 nt, Mycobacterium avium subsp. paratuberculosis
accgaggugacgucgcgcc

SEQ ID NO: 2810313 - RNA, 20 nt, Mycobacterium avium subsp. paratuberculosis
accgaggugacgucgcgccg

SEQ ID NO: 2810314 - RNA, 21 nt, Mycobacterium avium subsp. paratuberculosis
accgaggugacgucgcgccgc

SEQ ID NO: 2810315 - RNA, 16 nt, Mycobacterium avium subsp. paratuberculosis
accgaggugccgcggg

SEQ ID NO: 2810316 - RNA, 13 nt, Mycobacterium avium subsp. paratuberculosis
accgagguggccc

SEQ ID NO: 2810317 - RNA, 16 nt, Mycobacterium avium subsp. paratuberculosis
accgagguggcccagc

SEQ ID NO: 2810318 - RNA, 20 nt, Mycobacterium avium subsp. paratuberculosis
accgagguggcccagccgcu

SEQ ID NO: 2810319 - RNA, 12 nt, Mycobacterium avium subsp. paratuberculosis
accgagucgcgc

SEQ ID NO: 2810320 - RNA, 14 nt, Mycobacterium avium subsp. paratuberculosis
accgagucgcgcga

SEQ ID NO: 2810321 - RNA, 14 nt, Mycobacterium avium subsp. paratuberculosis
accgagucgcugca

SEQ ID NO: 2810322 - RNA, 15 nt, Mycobacterium avium subsp. paratuberculosis
accgagucggugacc

SEQ ID NO: 2810323 - RNA, 20 nt, Mycobacterium avium subsp. paratuberculosis
accgagucggugaccaccug

SEQ ID NO: 2810324 - RNA, 23 nt, Mycobacterium avium subsp. paratuberculosis
accgagucggugaccaccugcac

SEQ ID NO: 2810325 - RNA, 12 nt, Mycobacterium avium subsp. paratuberculosis
accgagucgucg

SEQ ID NO: 2810326 - RNA, 15 nt, Mycobacterium avium subsp. paratuberculosis
accgagugcggcgcg

SEQ ID NO: 2810327 - RNA, 21 nt, Mycobacterium avium subsp. paratuberculosis
accgagugcggcgcggugcgc

SEQ ID NO: 2810328 - RNA, 22 nt, Mycobacterium avium subsp. paratuberculosis
accgagugcggcgcggugcgcc

SEQ ID NO: 2810329 - RNA, 12 nt, Mycobacterium avium subsp. paratuberculosis
accgaucaccgg

SEQ ID NO: 2810330 - RNA, 15 nt, Mycobacterium avium subsp. paratuberculosis
accgaucaccggcag

SEQ ID NO: 2810331 - RNA, 16 nt, Mycobacterium avium subsp. paratuberculosis
accgaucaccggcagc

SEQ ID NO: 2810332 - RNA, 20 nt, Mycobacterium avium subsp. paratuberculosis
accgaucaccggcagcagcg

SEQ ID NO: 2810333 - RNA, 18 nt, Mycobacterium avium subsp. paratuberculosis
accgaucagcaugccggu

SEQ ID NO: 2810334 - RNA, 20 nt, Mycobacterium avium subsp. paratuberculosis
accgauccgagcgcugcccg

SEQ ID NO: 2810335 - RNA, 12 nt, Mycobacterium avium subsp. paratuberculosis
accgauccgccg

SEQ ID NO: 2810336 - RNA, 13 nt, Mycobacterium avium subsp. paratuberculosis
accgauccgccgg

SEQ ID NO: 2810337 - RNA, 16 nt, Mycobacterium avium subsp. paratuberculosis
accgauccggcgcccg

SEQ ID NO: 2810338 - RNA, 20 nt, Mycobacterium avium subsp. paratuberculosis
accgaucgcgagggccguug

SEQ ID NO: 2810339 - RNA, 19 nt, Mycobacterium avium subsp. paratuberculosis
accgaucucgauggacgcg

SEQ ID NO: 2810340 - RNA, 23 nt, Mycobacterium avium subsp. paratuberculosis
accgaucucgauggacgcggugg

SEQ ID NO: 2810341 - RNA, 20 nt, Mycobacterium avium subsp. paratuberculosis
accgaugcccgacaccgccc

SEQ ID NO: 2810342 - RNA, 13 nt, Mycobacterium avium subsp. paratuberculosis
accgaugccgcug

SEQ ID NO: 2810343 - RNA, 14 nt, Mycobacterium avium subsp. paratuberculosis
accgaugcgggcca

SEQ ID NO: 2810344 - RNA, 23 nt, Mycobacterium avium subsp. paratuberculosis
accgaugcgggccaggaugucgg

SEQ ID NO: 2810345 - RNA, 15 nt, Mycobacterium avium subsp. paratuberculosis
accgauggccgcccg

SEQ ID NO: 2810346 - RNA, 19 nt, Mycobacterium avium subsp. paratuberculosis
accgauggccgcccgcagg

SEQ ID NO: 2810347 - RNA, 20 nt, Mycobacterium avium subsp. paratuberculosis
accgauggccgcccgcaggu

SEQ ID NO: 2810348 - RNA, 16 nt, Mycobacterium avium subsp. paratuberculosis
accgauggcggcggcc

SEQ ID NO: 2810349 - RNA, 22 nt, Mycobacterium avium subsp. paratuberculosis
accgauggcggcggcccgccgc

SEQ ID NO: 2810350 - RNA, 14 nt, Mycobacterium avium subsp. paratuberculosis
accgauguggacga

SEQ ID NO: 2810351 - RNA, 18 nt, Mycobacterium avium subsp. paratuberculosis
accgauuucggccagccg

SEQ ID NO: 2810352 - RNA, 17 nt, Mycobacterium avium subsp. paratuberculosis
accgcaaagcaccgcga

SEQ ID NO: 2810353 - RNA, 19 nt, Mycobacterium avium subsp. paratuberculosis
accgcaacaccagcacggu

SEQ ID NO: 2810354 - RNA, 20 nt, Mycobacterium avium subsp. paratuberculosis
accgcaacaccagcacggug

SEQ ID NO: 2810355 - RNA, 13 nt, Mycobacterium avium subsp. paratuberculosis
accgcaacaccga

SEQ ID NO: 2810356 - RNA, 20 nt, Mycobacterium avium subsp. paratuberculosis
accgcaagugcggucagcuc

SEQ ID NO: 2810357 - RNA, 23 nt, Mycobacterium avium subsp. paratuberculosis
accgcacaugccgaggcacagca

SEQ ID NO: 2810358 - RNA, 11 nt, Mycobacterium avium subsp. paratuberculosis
accgcaccacc

SEQ ID NO: 2810359 - RNA, 16 nt, Mycobacterium avium subsp. paratuberculosis
accgcacccccagcuc

SEQ ID NO: 2810360 - RNA, 19 nt, Mycobacterium avium subsp. paratuberculosis
accgcacccccagcucgac

SEQ ID NO: 2810361 - RNA, 20 nt, Mycobacterium avium subsp. paratuberculosis
accgcacccccagcucgacg

SEQ ID NO: 2810362 - RNA, 13 nt, Mycobacterium avium subsp. paratuberculosis
accgcaccccguc

SEQ ID NO: 2810363 - RNA, 16 nt, Mycobacterium avium subsp. paratuberculosis
accgcaccccgucgcg

SEQ ID NO: 2810364 - RNA, 14 nt, Mycobacterium avium subsp. paratuberculosis
accgcaccgacgaa

SEQ ID NO: 2810365 - RNA, 18 nt, Mycobacterium avium subsp. paratuberculosis
accgcaccuugcgcccgu

SEQ ID NO: 2810366 - RNA, 21 nt, Mycobacterium avium subsp. paratuberculosis
accgcacgaucagggugucga

SEQ ID NO: 2810367 - RNA, 13 nt, Mycobacterium avium subsp. paratuberculosis
accgcacggccca

SEQ ID NO: 2810368 - RNA, 15 nt, Mycobacterium avium subsp. paratuberculosis
accgcacggcccauc

SEQ ID NO: 2810369 - RNA, 16 nt, Mycobacterium avium subsp. paratuberculosis
accgcacggcccauca

SEQ ID NO: 2810370 - RNA, 21 nt, Mycobacterium avium subsp. paratuberculosis
accgcacgucuuacggauauc

SEQ ID NO: 2810371 - RNA, 16 nt, Mycobacterium avium subsp. paratuberculosis
accgcagcaggcggac

SEQ ID NO: 2810372 - RNA, 17 nt, Mycobacterium avium subsp. paratuberculosis
accgcagcaggcggacg

SEQ ID NO: 2810373 - RNA, 18 nt, Mycobacterium avium subsp. paratuberculosis
accgcagcaggcggacgg

SEQ ID NO: 2810374 - RNA, 13 nt, Mycobacterium avium subsp. paratuberculosis
accgcagccggau

SEQ ID NO: 2810375 - RNA, 14 nt, Mycobacterium avium subsp. paratuberculosis
accgcagccgggug

SEQ ID NO: 2810376 - RNA, 23 nt, Mycobacterium avium subsp. paratuberculosis
accgcagccgggugcgggccagc

SEQ ID NO: 2810377 - RNA, 19 nt, Mycobacterium avium subsp. paratuberculosis
accgcagccuucuucgccg

SEQ ID NO: 2810378 - RNA, 22 nt, Mycobacterium avium subsp. paratuberculosis
accgcagccuucuucgccgggg

SEQ ID NO: 2810379 - RNA, 14 nt, Mycobacterium avium subsp. paratuberculosis
accgcaggucgaug

SEQ ID NO: 2810380 - RNA, 19 nt, Mycobacterium avium subsp. paratuberculosis
accgcagucguucggccag

SEQ ID NO: 2810381 - RNA, 21 nt, Mycobacterium avium subsp. paratuberculosis
accgcagucguucggccagca

SEQ ID NO: 2810382 - RNA, 20 nt, Mycobacterium avium subsp. paratuberculosis
accgcauagcgggagccggc

SEQ ID NO: 2810383 - RNA, 23 nt, Mycobacterium avium subsp. paratuberculosis
accgcauauaggugcugagcgug

SEQ ID NO: 2810384 - RNA, 15 nt, Mycobacterium avium subsp. paratuberculosis
accgcaucgaaccgc

SEQ ID NO: 2810385 - RNA, 16 nt, Mycobacterium avium subsp. paratuberculosis
accgcaucgaaccgcc

SEQ ID NO: 2810386 - RNA, 18 nt, Mycobacterium avium subsp. paratuberculosis
accgcaucgaaccgccgc

SEQ ID NO: 2810387 - RNA, 19 nt, Mycobacterium avium subsp. paratuberculosis
accgcaucgaaccgccgcg

SEQ ID NO: 2810388 - RNA, 21 nt, Mycobacterium avium subsp. paratuberculosis
accgcaucgaaccgccgcgcu

SEQ ID NO: 2810389 - RNA, 22 nt, Mycobacterium avium subsp. paratuberculosis
accgcaucgaaccgccgcgcuc

SEQ ID NO: 2810390 - RNA, 19 nt, Mycobacterium avium subsp. paratuberculosis
accgcaucgccgagggcga

SEQ ID NO: 2810391 - RNA, 14 nt, Mycobacterium avium subsp. paratuberculosis
accgcauggccggc

SEQ ID NO: 2810392 - RNA, 15 nt, Mycobacterium avium subsp. paratuberculosis
accgcauggccggcg

SEQ ID NO: 2810393 - RNA, 16 nt, Mycobacterium avium subsp. paratuberculosis
accgcauggccggcga

SEQ ID NO: 2810394 - RNA, 16 nt, Mycobacterium avium subsp. paratuberculosis
accgcauucggccgcc

SEQ ID NO: 2810395 - RNA, 17 nt, Mycobacterium avium subsp. paratuberculosis
accgcauucggccgcca

SEQ ID NO: 2810396 - RNA, 17 nt, Mycobacterium avium subsp. paratuberculosis
accgcccuuccagcacc

SEQ ID NO: 2810397 - RNA, 21 nt, Mycobacterium avium subsp. paratuberculosis
accgcccuuccagcaccccgu

SEQ ID NO: 2810398 - RNA, 20 nt, Mycobacterium avium subsp. paratuberculosis
accgccgacaccaccgcgcg

SEQ ID NO: 2810399 - RNA, 22 nt, Mycobacterium avium subsp. paratuberculosis
accgccgacaccaccgcgcgca

SEQ ID NO: 2810400 - RNA, 19 nt, Mycobacterium avium subsp. paratuberculosis
accgccgacaucgcccggu

SEQ ID NO: 2810401 - RNA, 15 nt, Mycobacterium avium subsp. paratuberculosis
accgccgagccgcuc

SEQ ID NO: 2810402 - RNA, 14 nt, Mycobacterium avium subsp. paratuberculosis
accgccgagccguc

SEQ ID NO: 2810403 - RNA, 14 nt, Mycobacterium avium subsp. paratuberculosis
accgccgagcgggc

SEQ ID NO: 2810404 - RNA, 15 nt, Mycobacterium avium subsp. paratuberculosis
accgccgagggcccg

SEQ ID NO: 2810405 - RNA, 17 nt, Mycobacterium avium subsp. paratuberculosis
accgccgaucgugacgc

SEQ ID NO: 2810406 - RNA, 24 nt, Mycobacterium avium subsp. paratuberculosis
accgccgaucgugacgccguccga

SEQ ID NO: 2810407 - RNA, 13 nt, Mycobacterium avium subsp. paratuberculosis
accgccgcaccca

SEQ ID NO: 2810408 - RNA, 20 nt, Mycobacterium avium subsp. paratuberculosis
accgccgcaccgucgugcca

SEQ ID NO: 2810409 - RNA, 21 nt, Mycobacterium avium subsp. paratuberculosis
accgccgccauccgcgccgaa

SEQ ID NO: 2810410 - RNA, 13 nt, Mycobacterium avium subsp. paratuberculosis
accgccgccgacu

SEQ ID NO: 2810411 - RNA, 20 nt, Mycobacterium avium subsp. paratuberculosis
accgccgccgacuccccgcc

SEQ ID NO: 2810412 - RNA, 15 nt, Mycobacterium avium subsp. paratuberculosis
accgccgcgcggccg

SEQ ID NO: 2810413 - RNA, 20 nt, Mycobacterium avium subsp. paratuberculosis
accgccgcgcggccgggcuc

SEQ ID NO: 2810414 - RNA, 22 nt, Mycobacterium avium subsp. paratuberculosis
accgccgcgcggccgggcuccc

SEQ ID NO: 2810415 - RNA, 18 nt, Mycobacterium avium subsp. paratuberculosis
accgccgcgcucgcacca

SEQ ID NO: 2810416 - RNA, 14 nt, Mycobacterium avium subsp. paratuberculosis
accgccgcgcucgg

SEQ ID NO: 2810417 - RNA, 11 nt, Mycobacterium avium subsp. paratuberculosis
accgccgcggc

SEQ ID NO: 2810418 - RNA, 13 nt, Mycobacterium avium subsp. paratuberculosis
accgccgcggccg

SEQ ID NO: 2810419 - RNA, 14 nt, Mycobacterium avium subsp. paratuberculosis
accgccgcggccgc

SEQ ID NO: 2810420 - RNA, 13 nt, Mycobacterium avium subsp. paratuberculosis
accgccgcggcga

SEQ ID NO: 2810421 - RNA, 14 nt, Mycobacterium avium subsp. paratuberculosis
accgccgcggcgac

SEQ ID NO: 2810422 - RNA, 13 nt, Mycobacterium avium subsp. paratuberculosis
accgccgcggcgc

SEQ ID NO: 2810423 - RNA, 14 nt, Mycobacterium avium subsp. paratuberculosis
accgccgcggcgcc

SEQ ID NO: 2810424 - RNA, 15 nt, Mycobacterium avium subsp. paratuberculosis
accgccgcggcgccc

SEQ ID NO: 2810425 - RNA, 16 nt, Mycobacterium avium subsp. paratuberculosis
accgccgcggcgcccg

SEQ ID NO: 2810426 - RNA, 21 nt, Mycobacterium avium subsp. paratuberculosis
accgccgcggcgcccggcgcc

SEQ ID NO: 2810427 - RNA, 17 nt, Mycobacterium avium subsp. paratuberculosis
accgccgcggcggccug

SEQ ID NO: 2810428 - RNA, 20 nt, Mycobacterium avium subsp. paratuberculosis
accgccgcggcgguggccug

SEQ ID NO: 2810429 - RNA, 22 nt, Mycobacterium avium subsp. paratuberculosis
accgccgcggcgguggccugcc

SEQ ID NO: 2810430 - RNA, 23 nt, Mycobacterium avium subsp. paratuberculosis
accgccgcggcgguggccugccc

SEQ ID NO: 2810431 - RNA, 13 nt, Mycobacterium avium subsp. paratuberculosis
accgccgcgggcu

SEQ ID NO: 2810432 - RNA, 16 nt, Mycobacterium avium subsp. paratuberculosis
accgccgcgggcuccc

SEQ ID NO: 2810433 - RNA, 13 nt, Mycobacterium avium subsp. paratuberculosis
accgccgcugcgc

SEQ ID NO: 2810434 - RNA, 20 nt, Mycobacterium avium subsp. paratuberculosis
accgccggacaccaccgcgg

SEQ ID NO: 2810435 - RNA, 23 nt, Mycobacterium avium subsp. paratuberculosis
accgccggacaccaccgcggugg

SEQ ID NO: 2810436 - RNA, 17 nt, Mycobacterium avium subsp. paratuberculosis
accgccggcagcggcug

SEQ ID NO: 2810437 - RNA, 14 nt, Mycobacterium avium subsp. paratuberculosis
accgccggccacgu

SEQ ID NO: 2810438 - RNA, 17 nt, Mycobacterium avium subsp. paratuberculosis
accgccggccaggcgac

SEQ ID NO: 2810439 - RNA, 13 nt, Mycobacterium avium subsp. paratuberculosis
accgccggcccag

SEQ ID NO: 2810440 - RNA, 14 nt, Mycobacterium avium subsp. paratuberculosis
accgccggcccagg

SEQ ID NO: 2810441 - RNA, 14 nt, Mycobacterium avium subsp. paratuberculosis
accgccggcccggc

SEQ ID NO: 2810442 - RNA, 16 nt, Mycobacterium avium subsp. paratuberculosis
accgccggcccggcgu

SEQ ID NO: 2810443 - RNA, 14 nt, Mycobacterium avium subsp. paratuberculosis
accgccggccgcgc

SEQ ID NO: 2810444 - RNA, 14 nt, Mycobacterium avium subsp. paratuberculosis
accgccggcggccu

SEQ ID NO: 2810445 - RNA, 15 nt, Mycobacterium avium subsp. paratuberculosis
accgccggcggccuc

SEQ ID NO: 2810446 - RNA, 20 nt, Mycobacterium avium subsp. paratuberculosis
accgccgggcauccgggccg

SEQ ID NO: 2810447 - RNA, 21 nt, Mycobacterium avium subsp. paratuberculosis
accgccgggcauccgggccgc

SEQ ID NO: 2810448 - RNA, 15 nt, Mycobacterium avium subsp. paratuberculosis
accgccgggcgggcc

SEQ ID NO: 2810449 - RNA, 19 nt, Mycobacterium avium subsp. paratuberculosis
accgccgggcgggccgcag

SEQ ID NO: 2810450 - RNA, 21 nt, Mycobacterium avium subsp. paratuberculosis
accgccgggcgggccgcagca

SEQ ID NO: 2810451 - RNA, 23 nt, Mycobacterium avium subsp. paratuberculosis
accgccgggcgggccgcagcacc

SEQ ID NO: 2810452 - RNA, 22 nt, Mycobacterium avium subsp. paratuberculosis
accgccggggugugcagcggga

SEQ ID NO: 2810453 - RNA, 24 nt, Mycobacterium avium subsp. paratuberculosis
accgccggggugugcagcgggaug

SEQ ID NO: 2810454 - RNA, 21 nt, Mycobacterium avium subsp. paratuberculosis
accgccggugcgcagcuugcu

SEQ ID NO: 2810455 - RNA, 20 nt, Mycobacterium avium subsp. paratuberculosis
accgccgucccgucacggcu

SEQ ID NO: 2810456 - RNA, 17 nt, Mycobacterium avium subsp. paratuberculosis
accgccgucccguccga

SEQ ID NO: 2810457 - RNA, 23 nt, Mycobacterium avium subsp. paratuberculosis
accgccguccgggcacccgacgu

SEQ ID NO: 2810458 - RNA, 13 nt, Mycobacterium avium subsp. paratuberculosis
accgccgucgggg

SEQ ID NO: 2810459 - RNA, 20 nt, Mycobacterium avium subsp. paratuberculosis
accgccgucggggcgucggc

SEQ ID NO: 2810460 - RNA, 12 nt, Mycobacterium avium subsp. paratuberculosis
accgccguggca

SEQ ID NO: 2810461 - RNA, 13 nt, Mycobacterium avium subsp. paratuberculosis
accgccguggcag

SEQ ID NO: 2810462 - RNA, 17 nt, Mycobacterium avium subsp. paratuberculosis
accgccguggcagggcc

SEQ ID NO: 2810463 - RNA, 21 nt, Mycobacterium avium subsp. paratuberculosis
accgccguggcagggccagca

SEQ ID NO: 2810464 - RNA, 24 nt, Mycobacterium avium subsp. paratuberculosis
accgccguggcagggccagcagcc

SEQ ID NO: 2810465 - RNA, 21 nt, Mycobacterium avium subsp. paratuberculosis
accgccguggcguuacacccg

SEQ ID NO: 2810466 - RNA, 22 nt, Mycobacterium avium subsp. paratuberculosis
accgccguggcguuacacccgc

SEQ ID NO: 2810467 - RNA, 18 nt, Mycobacterium avium subsp. paratuberculosis
accgccguuccgaugaag

SEQ ID NO: 2810468 - RNA, 20 nt, Mycobacterium avium subsp. paratuberculosis
accgccguuccgaugaagaa

SEQ ID NO: 2810469 - RNA, 14 nt, Mycobacterium avium subsp. paratuberculosis
accgccucaugcca

SEQ ID NO: 2810470 - RNA, 17 nt, Mycobacterium avium subsp. paratuberculosis
accgccucgauggcccg

SEQ ID NO: 2810471 - RNA, 18 nt, Mycobacterium avium subsp. paratuberculosis
accgccucgauggcccgc

SEQ ID NO: 2810472 - RNA, 20 nt, Mycobacterium avium subsp. paratuberculosis
accgccucgauggcccgcuc

SEQ ID NO: 2810473 - RNA, 15 nt, Mycobacterium avium subsp. paratuberculosis
accgccucgccagcc

SEQ ID NO: 2810474 - RNA, 16 nt, Mycobacterium avium subsp. paratuberculosis
accgccucgccagccc

SEQ ID NO: 2810475 - RNA, 17 nt, Mycobacterium avium subsp. paratuberculosis
accgccucgccagcccc

SEQ ID NO: 2810476 - RNA, 21 nt, Mycobacterium avium subsp. paratuberculosis
accgccucgccagccccaccg

SEQ ID NO: 2810477 - RNA, 13 nt, Mycobacterium avium subsp. paratuberculosis
accgccucggcca

SEQ ID NO: 2810478 - RNA, 21 nt, Mycobacterium avium subsp. paratuberculosis
accgccucggccaccuugcgc

SEQ ID NO: 2810479 - RNA, 14 nt, Mycobacterium avium subsp. paratuberculosis
accgccugcgcgau

SEQ ID NO: 2810480 - RNA, 18 nt, Mycobacterium avium subsp. paratuberculosis
accgccugcgcgaucgcc

SEQ ID NO: 2810481 - RNA, 19 nt, Mycobacterium avium subsp. paratuberculosis
accgcgaugguggcgucac

SEQ ID NO: 2810482 - RNA, 16 nt, Mycobacterium avium subsp. paratuberculosis
accgcgcaaccgggcc

SEQ ID NO: 2810483 - RNA, 17 nt, Mycobacterium avium subsp. paratuberculosis
accgcgcaaccgggccg

SEQ ID NO: 2810484 - RNA, 19 nt, Mycobacterium avium subsp. paratuberculosis
accgcgcaaccgggccgca

SEQ ID NO: 2810485 - RNA, 20 nt, Mycobacterium avium subsp. paratuberculosis
accgcgcaaccgggccgcac

SEQ ID NO: 2810486 - RNA, 15 nt, Mycobacterium avium subsp. paratuberculosis
accgcgcaccggcgc

SEQ ID NO: 2810487 - RNA, 16 nt, Mycobacterium avium subsp. paratuberculosis
accgcgcaccggcgcu

SEQ ID NO: 2810488 - RNA, 21 nt, Mycobacterium avium subsp. paratuberculosis
accgcgcacucgaacggcccg

SEQ ID NO: 2810489 - RNA, 16 nt, Mycobacterium avium subsp. paratuberculosis
accgcgcagaaccgca

SEQ ID NO: 2810490 - RNA, 17 nt, Mycobacterium avium subsp. paratuberculosis
accgcgcagaaccgcac

SEQ ID NO: 2810491 - RNA, 18 nt, Mycobacterium avium subsp. paratuberculosis
accgcgcagaaccgcacc

SEQ ID NO: 2810492 - RNA, 17 nt, Mycobacterium avium subsp. paratuberculosis
accgcgcaggcggcgac

SEQ ID NO: 2810493 - RNA, 19 nt, Mycobacterium avium subsp. paratuberculosis
accgcgcaggcggcgacgg

SEQ ID NO: 2810494 - RNA, 19 nt, Mycobacterium avium subsp. paratuberculosis
accgcgcccagccccagca

SEQ ID NO: 2810495 - RNA, 22 nt, Mycobacterium avium subsp. paratuberculosis
accgcgcccaggggagcggcgg

SEQ ID NO: 2810496 - RNA, 17 nt, Mycobacterium avium subsp. paratuberculosis
accgcgccccggcgcag

SEQ ID NO: 2810497 - RNA, 23 nt, Mycobacterium avium subsp. paratuberculosis
accgcgccccggcgcagcgccgc

SEQ ID NO: 2810498 - RNA, 11 nt, Mycobacterium avium subsp. paratuberculosis
accgcgccgaa

SEQ ID NO: 2810499 - RNA, 13 nt, Mycobacterium avium subsp. paratuberculosis
accgcgccgcggg

SEQ ID NO: 2810500 - RNA, 19 nt, Mycobacterium avium subsp. paratuberculosis
accgcgccgcgggugacga

SEQ ID NO: 2810501 - RNA, 13 nt, Mycobacterium avium subsp. paratuberculosis
accgcgccggcgg

SEQ ID NO: 2810502 - RNA, 14 nt, Mycobacterium avium subsp. paratuberculosis
accgcgccggcggc

SEQ ID NO: 2810503 - RNA, 12 nt, Mycobacterium avium subsp. paratuberculosis
accgcgccgggc

SEQ ID NO: 2810504 - RNA, 15 nt, Mycobacterium avium subsp. paratuberculosis
accgcgccgggcacc

SEQ ID NO: 2810505 - RNA, 17 nt, Mycobacterium avium subsp. paratuberculosis
accgcgccgggcaccac

SEQ ID NO: 2810506 - RNA, 19 nt, Mycobacterium avium subsp. paratuberculosis
accgcgccgggcaccacca

SEQ ID NO: 2810507 - RNA, 19 nt, Mycobacterium avium subsp. paratuberculosis
accgcgccgguccggcccu

SEQ ID NO: 2810508 - RNA, 20 nt, Mycobacterium avium subsp. paratuberculosis
accgcgccgguguucggcgc

SEQ ID NO: 2810509 - RNA, 12 nt, Mycobacterium avium subsp. paratuberculosis
accgcgccgucg

SEQ ID NO: 2810510 - RNA, 15 nt, Mycobacterium avium subsp. paratuberculosis
accgcgccgucgucg

SEQ ID NO: 2810511 - RNA, 20 nt, Mycobacterium avium subsp. paratuberculosis
accgcgccgucgucgagcac

SEQ ID NO: 2810512 - RNA, 20 nt, Mycobacterium avium subsp. paratuberculosis
accgcgccgucuuccgggcc

SEQ ID NO: 2810513 - RNA, 21 nt, Mycobacterium avium subsp. paratuberculosis
accgcgccgucuuccgggcca

SEQ ID NO: 2810514 - RNA, 12 nt, Mycobacterium avium subsp. paratuberculosis
accgcgccguga

SEQ ID NO: 2810515 - RNA, 17 nt, Mycobacterium avium subsp. paratuberculosis
accgcgccuucgacccg

SEQ ID NO: 2810516 - RNA, 20 nt, Mycobacterium avium subsp. paratuberculosis
accgcgcgcaacgaggcggu

SEQ ID NO: 2810517 - RNA, 14 nt, Mycobacterium avium subsp. paratuberculosis
accgcgcgcaccac

SEQ ID NO: 2810518 - RNA, 21 nt, Mycobacterium avium subsp. paratuberculosis
accgcgcgcaggccccggcgc

SEQ ID NO: 2810519 - RNA, 22 nt, Mycobacterium avium subsp. paratuberculosis
accgcgcgcaggccccggcgcg

SEQ ID NO: 2810520 - RNA, 15 nt, Mycobacterium avium subsp. paratuberculosis
accgcgcgccagguc

SEQ ID NO: 2810521 - RNA, 16 nt, Mycobacterium avium subsp. paratuberculosis
accgcgcgccggccag

SEQ ID NO: 2810522 - RNA, 18 nt, Mycobacterium avium subsp. paratuberculosis
accgcgcgccggccagca

SEQ ID NO: 2810523 - RNA, 13 nt, Mycobacterium avium subsp. paratuberculosis
accgcgcgcggcg

SEQ ID NO: 2810524 - RNA, 19 nt, Mycobacterium avium subsp. paratuberculosis
accgcgcgcggcgccgcgu

SEQ ID NO: 2810525 - RNA, 12 nt, Mycobacterium avium subsp. paratuberculosis
accgcgcgcggg

SEQ ID NO: 2810526 - RNA, 19 nt, Mycobacterium avium subsp. paratuberculosis
accgcgcgcggguagacgu

SEQ ID NO: 2810527 - RNA, 16 nt, Mycobacterium avium subsp. paratuberculosis
accgcgcgcugccgcg

SEQ ID NO: 2810528 - RNA, 19 nt, Mycobacterium avium subsp. paratuberculosis
accgcgcgcugccgcgccc

SEQ ID NO: 2810529 - RNA, 22 nt, Mycobacterium avium subsp. paratuberculosis
accgcgcggccagcggcgccga

SEQ ID NO: 2810530 - RNA, 11 nt, Mycobacterium avium subsp. paratuberculosis
accgcgcggcg

SEQ ID NO: 2810531 - RNA, 15 nt, Mycobacterium avium subsp. paratuberculosis
accgcgcggcgcagu

SEQ ID NO: 2810532 - RNA, 16 nt, Mycobacterium avium subsp. paratuberculosis
accgcgcggcgcaguu

SEQ ID NO: 2810533 - RNA, 13 nt, Mycobacterium avium subsp. paratuberculosis
accgcgcggcgcc

SEQ ID NO: 2810534 - RNA, 14 nt, Mycobacterium avium subsp. paratuberculosis
accgcgcggcgccc

SEQ ID NO: 2810535 - RNA, 14 nt, Mycobacterium avium subsp. paratuberculosis
accgcgcggcggug

SEQ ID NO: 2810536 - RNA, 13 nt, Mycobacterium avium subsp. paratuberculosis
accgcgcgggcca

SEQ ID NO: 2810537 - RNA, 14 nt, Mycobacterium avium subsp. paratuberculosis
accgcgcgggccag

SEQ ID NO: 2810538 - RNA, 17 nt, Mycobacterium avium subsp. paratuberculosis
accgcgcgggccagcgc

SEQ ID NO: 2810539 - RNA, 18 nt, Mycobacterium avium subsp. paratuberculosis
accgcgcgggccagcgcc

SEQ ID NO: 2810540 - RNA, 21 nt, Mycobacterium avium subsp. paratuberculosis
accgcgcgggccagcgccuuc

SEQ ID NO: 2810541 - RNA, 19 nt, Mycobacterium avium subsp. paratuberculosis
accgcgcguucgaguucgu

SEQ ID NO: 2810542 - RNA, 23 nt, Mycobacterium avium subsp. paratuberculosis
accgcgcguucgaguucgucgac

SEQ ID NO: 2810543 - RNA, 18 nt, Mycobacterium avium subsp. paratuberculosis
accgcgcucaccgcgggg

SEQ ID NO: 2810544 - RNA, 16 nt, Mycobacterium avium subsp. paratuberculosis
accgcgcuccugccag

SEQ ID NO: 2810545 - RNA, 23 nt, Mycobacterium avium subsp. paratuberculosis
accgcgcuccugccagcggcgca

SEQ ID NO: 2810546 - RNA, 12 nt, Mycobacterium avium subsp. paratuberculosis
accgcgcucggc

SEQ ID NO: 2810547 - RNA, 16 nt, Mycobacterium avium subsp. paratuberculosis
accgcgcucggcgacg

SEQ ID NO: 2810548 - RNA, 18 nt, Mycobacterium avium subsp. paratuberculosis
accgcgcugcgcgcguug

SEQ ID NO: 2810549 - RNA, 16 nt, Mycobacterium avium subsp. paratuberculosis
accgcgcuugccgcga

SEQ ID NO: 2810550 - RNA, 17 nt, Mycobacterium avium subsp. paratuberculosis
accgcgcuugccgcgac

SEQ ID NO: 2810551 - RNA, 18 nt, Mycobacterium avium subsp. paratuberculosis
accgcgcuugccgcgacc

SEQ ID NO: 2810552 - RNA, 22 nt, Mycobacterium avium subsp. paratuberculosis
accgcgcuuuggaccagggcgg

SEQ ID NO: 2810553 - RNA, 18 nt, Mycobacterium avium subsp. paratuberculosis
accgcggaccaccgcgug

SEQ ID NO: 2810554 - RNA, 19 nt, Mycobacterium avium subsp. paratuberculosis
accgcggaccaccgcgugc

SEQ ID NO: 2810555 - RNA, 16 nt, Mycobacterium avium subsp. paratuberculosis
accgcggacuggccac

SEQ ID NO: 2810556 - RNA, 21 nt, Mycobacterium avium subsp. paratuberculosis
accgcggacuggccaccgcga

SEQ ID NO: 2810557 - RNA, 15 nt, Mycobacterium avium subsp. paratuberculosis
accgcggagcgcaac

SEQ ID NO: 2810558 - RNA, 18 nt, Mycobacterium avium subsp. paratuberculosis
accgcggagcgcaacgug

SEQ ID NO: 2810559 - RNA, 21 nt, Mycobacterium avium subsp. paratuberculosis
accgcggaggaauucgccgac

SEQ ID NO: 2810560 - RNA, 14 nt, Mycobacterium avium subsp. paratuberculosis
accgcggaugacgg

SEQ ID NO: 2810561 - RNA, 20 nt, Mycobacterium avium subsp. paratuberculosis
accgcggauuccagcgcgua

SEQ ID NO: 2810562 - RNA, 21 nt, Mycobacterium avium subsp. paratuberculosis
accgcggccaacccgggcgcc

SEQ ID NO: 2810563 - RNA, 23 nt, Mycobacterium avium subsp. paratuberculosis
accgcggccaacccgggcgccau

SEQ ID NO: 2810564 - RNA, 14 nt, Mycobacterium avium subsp. paratuberculosis
accgcggccaccac

SEQ ID NO: 2810565 - RNA, 18 nt, Mycobacterium avium subsp. paratuberculosis
accgcggccaccaccgcc

SEQ ID NO: 2810566 - RNA, 21 nt, Mycobacterium avium subsp. paratuberculosis
accgcguccuucuccgccggg

SEQ ID NO: 2810567 - RNA, 23 nt, Mycobacterium avium subsp. paratuberculosis
accgcguccuucuccgccgggcu

SEQ ID NO: 2810568 - RNA, 12 nt, Mycobacterium avium subsp. paratuberculosis
accgcgucgacc

SEQ ID NO: 2810569 - RNA, 13 nt, Mycobacterium avium subsp. paratuberculosis
accgcgucgacca

SEQ ID NO: 2810570 - RNA, 17 nt, Mycobacterium avium subsp. paratuberculosis
accgcgucgaccaccgc

SEQ ID NO: 2810571 - RNA, 20 nt, Mycobacterium avium subsp. paratuberculosis
accgcgucgaccaccgccgg

SEQ ID NO: 2810572 - RNA, 23 nt, Mycobacterium avium subsp. paratuberculosis
accgcgucgaccaccgccggccc

SEQ ID NO: 2810573 - RNA, 13 nt, Mycobacterium avium subsp. paratuberculosis
accgcgucgacgg

SEQ ID NO: 2810574 - RNA, 19 nt, Mycobacterium avium subsp. paratuberculosis
accgcgucgaugucgucgu

SEQ ID NO: 2810575 - RNA, 15 nt, Mycobacterium avium subsp. paratuberculosis
accgcgucggcccag

SEQ ID NO: 2810576 - RNA, 13 nt, Mycobacterium avium subsp. paratuberculosis
accgcgucggcgc

SEQ ID NO: 2810577 - RNA, 15 nt, Mycobacterium avium subsp. paratuberculosis
accgcgucggcgccg

SEQ ID NO: 2810578 - RNA, 16 nt, Mycobacterium avium subsp. paratuberculosis
accgcgucggcgccgu

SEQ ID NO: 2810579 - RNA, 17 nt, Mycobacterium avium subsp. paratuberculosis
accgcgucggcgccgua

SEQ ID NO: 2810580 - RNA, 15 nt, Mycobacterium avium subsp. paratuberculosis
accgcgucggcgcug

SEQ ID NO: 2810581 - RNA, 17 nt, Mycobacterium avium subsp. paratuberculosis
accgcgucggcgcuggc

SEQ ID NO: 2810582 - RNA, 23 nt, Mycobacterium avium subsp. paratuberculosis
accgcgucuuggacgcccgcgac

SEQ ID NO: 2810583 - RNA, 19 nt, Mycobacterium avium subsp. paratuberculosis
accgcgugcgagccgagca

SEQ ID NO: 2810584 - RNA, 14 nt, Mycobacterium avium subsp. paratuberculosis
accgcgugugcccg

SEQ ID NO: 2810585 - RNA, 14 nt, Mycobacterium avium subsp. paratuberculosis
accgcguucucggc

SEQ ID NO: 2810586 - RNA, 17 nt, Mycobacterium avium subsp. paratuberculosis
accgcguucucggcgga

SEQ ID NO: 2810587 - RNA, 22 nt, Mycobacterium avium subsp. paratuberculosis
accgcguucucggcggacaucg

SEQ ID NO: 2810588 - RNA, 19 nt, Mycobacterium avium subsp. paratuberculosis
accgcguugaucagcgcca

SEQ ID NO: 2810589 - RNA, 16 nt, Mycobacterium avium subsp. paratuberculosis
accgcguuggccgcca

SEQ ID NO: 2810590 - RNA, 19 nt, Mycobacterium avium subsp. paratuberculosis
accgcguuggccgccacga

SEQ ID NO: 2810591 - RNA, 20 nt, Mycobacterium avium subsp. paratuberculosis
accgcguuggccgccacgau

SEQ ID NO: 2810592 - RNA, 13 nt, Mycobacterium avium subsp. paratuberculosis
accgcguuggcgc

SEQ ID NO: 2810593 - RNA, 17 nt, Mycobacterium avium subsp. paratuberculosis
accgcguuggcgccgac

SEQ ID NO: 2810594 - RNA, 18 nt, Mycobacterium avium subsp. paratuberculosis
accgcguuggcgccgacg

SEQ ID NO: 2810595 - RNA, 19 nt, Mycobacterium avium subsp. paratuberculosis
accgcguuggcgccgacgu

SEQ ID NO: 2810596 - RNA, 17 nt, Mycobacterium avium subsp. paratuberculosis
accgcguugucggcgac

SEQ ID NO: 2810597 - RNA, 20 nt, Mycobacterium avium subsp. paratuberculosis
accgcguugucggcgacggc

SEQ ID NO: 2810598 - RNA, 16 nt, Mycobacterium avium subsp. paratuberculosis
accgcuccccgagcac

SEQ ID NO: 2810599 - RNA, 18 nt, Mycobacterium avium subsp. paratuberculosis
accgcucgaacacccggc

SEQ ID NO: 2810600 - RNA, 14 nt, Mycobacterium avium subsp. paratuberculosis
accgcucgauggcg

SEQ ID NO: 2810601 - RNA, 17 nt, Mycobacterium avium subsp. paratuberculosis
accgcucgauggcgccg

SEQ ID NO: 2810602 - RNA, 12 nt, Mycobacterium avium subsp. paratuberculosis
accgcucggcga

SEQ ID NO: 2810603 - RNA, 16 nt, Mycobacterium avium subsp. paratuberculosis
accgcucggcggcgcc

SEQ ID NO: 2810604 - RNA, 18 nt, Mycobacterium avium subsp. paratuberculosis
accgcucggcggcgccgu

SEQ ID NO: 2810605 - RNA, 19 nt, Mycobacterium avium subsp. paratuberculosis
accgcucggcggcgccguc

SEQ ID NO: 2810606 - RNA, 20 nt, Mycobacterium avium subsp. paratuberculosis
accgcucggcggcgccgucg

SEQ ID NO: 2810607 - RNA, 21 nt, Mycobacterium avium subsp. paratuberculosis
accgcucggcggcgccgucgu

SEQ ID NO: 2810608 - RNA, 14 nt, Mycobacterium avium subsp. paratuberculosis
accgcucgucggga

SEQ ID NO: 2810609 - RNA, 16 nt, Mycobacterium avium subsp. paratuberculosis
accgcucgucgggaac

SEQ ID NO: 2810610 - RNA, 22 nt, Mycobacterium avium subsp. paratuberculosis
accgcucgucgggaacgccgau

SEQ ID NO: 2810611 - RNA, 21 nt, Mycobacterium avium subsp. paratuberculosis
accgcucgucgggcucgucgu

SEQ ID NO: 2810612 - RNA, 23 nt, Mycobacterium avium subsp. paratuberculosis
accgcugagguagucccgcgccu

SEQ ID NO: 2810613 - RNA, 16 nt, Mycobacterium avium subsp. paratuberculosis
accgcugaugccgccg

SEQ ID NO: 2810614 - RNA, 20 nt, Mycobacterium avium subsp. paratuberculosis
accgcugcaaccgguagcgg

SEQ ID NO: 2810615 - RNA, 14 nt, Mycobacterium avium subsp. paratuberculosis
accgcugcaugccg

SEQ ID NO: 2810616 - RNA, 15 nt, Mycobacterium avium subsp. paratuberculosis
accgcugcaugccgu

SEQ ID NO: 2810617 - RNA, 18 nt, Mycobacterium avium subsp. paratuberculosis
accgcugcaugccgucga

SEQ ID NO: 2810618 - RNA, 21 nt, Mycobacterium avium subsp. paratuberculosis
accgcugccacgguuucgccg

SEQ ID NO: 2810619 - RNA, 13 nt, Mycobacterium avium subsp. paratuberculosis
accgcugccggcc

SEQ ID NO: 2810620 - RNA, 15 nt, Mycobacterium avium subsp. paratuberculosis
accgcugccggccga

SEQ ID NO: 2810621 - RNA, 18 nt, Mycobacterium avium subsp. paratuberculosis
accgcugcuccggguccg

SEQ ID NO: 2810622 - RNA, 23 nt, Mycobacterium avium subsp. paratuberculosis
accgcugcuccggguccgcggug

SEQ ID NO: 2810623 - RNA, 14 nt, Mycobacterium avium subsp. paratuberculosis
accgcugcugcucg

SEQ ID NO: 2810624 - RNA, 20 nt, Mycobacterium avium subsp. paratuberculosis
accgcugcugcucggccgca

SEQ ID NO: 2810625 - RNA, 22 nt, Mycobacterium avium subsp. paratuberculosis
accgcugcugcucggccgcauc

SEQ ID NO: 2810626 - RNA, 18 nt, Mycobacterium avium subsp. paratuberculosis
accgcugcugcugcccgc

SEQ ID NO: 2810627 - RNA, 23 nt, Mycobacterium avium subsp. paratuberculosis
accgcuggaaccgaaucggucga

SEQ ID NO: 2810628 - RNA, 15 nt, Mycobacterium avium subsp. paratuberculosis
accgcuggccgaggc

SEQ ID NO: 2810629 - RNA, 19 nt, Mycobacterium avium subsp. paratuberculosis
accgcuggccgaggccucc

SEQ ID NO: 2810630 - RNA, 14 nt, Mycobacterium avium subsp. paratuberculosis
accgcugggcggcg

SEQ ID NO: 2810631 - RNA, 22 nt, Mycobacterium avium subsp. paratuberculosis
accgcugucggugugagcggug

SEQ ID NO: 2810632 - RNA, 19 nt, Mycobacterium avium subsp. paratuberculosis
accgcuugacgccgccgaa

SEQ ID NO: 2810633 - RNA, 14 nt, Mycobacterium avium subsp. paratuberculosis
accgcuugcgacug

SEQ ID NO: 2810634 - RNA, 14 nt, Mycobacterium avium subsp. paratuberculosis
accgcuugcggcuc

SEQ ID NO: 2810635 - RNA, 17 nt, Mycobacterium avium subsp. paratuberculosis
accgcuuggcccaccga

SEQ ID NO: 2810636 - RNA, 21 nt, Mycobacterium avium subsp. paratuberculosis
accgcuuugaauugagcgccg

SEQ ID NO: 2810637 - RNA, 23 nt, Mycobacterium avium subsp. paratuberculosis
accgcuuugaauugagcgccggg

SEQ ID NO: 2810638 - RNA, 21 nt, Mycobacterium avium subsp. paratuberculosis
accgcuuugugaggcgcgccg

SEQ ID NO: 2810639 - RNA, 22 nt, Mycobacterium avium subsp. paratuberculosis
accgcuuugugaggcgcgccgg

SEQ ID NO: 2810640 - RNA, 23 nt, Mycobacterium avium subsp. paratuberculosis
accgcuuugugaggcgcgccggu

SEQ ID NO: 2810641 - RNA, 18 nt, Mycobacterium avium subsp. paratuberculosis
accggaagaucagcaggc

SEQ ID NO: 2810642 - RNA, 20 nt, Mycobacterium avium subsp. paratuberculosis
accggaagaucagcaggcug

SEQ ID NO: 2810643 - RNA, 19 nt, Mycobacterium avium subsp. paratuberculosis
accggaagcgcgcaucgcg

SEQ ID NO: 2810644 - RNA, 21 nt, Mycobacterium avium subsp. paratuberculosis
accggaaggccagguugccac

SEQ ID NO: 2810645 - RNA, 14 nt, Mycobacterium avium subsp. paratuberculosis
accggaauggcagc

SEQ ID NO: 2810646 - RNA, 17 nt, Mycobacterium avium subsp. paratuberculosis
accggaauggcagcagc

SEQ ID NO: 2810647 - RNA, 18 nt, Mycobacterium avium subsp. paratuberculosis
accggaauggcagcagcc

SEQ ID NO: 2810648 - RNA, 20 nt, Mycobacterium avium subsp. paratuberculosis
accggaauggcagcagccgg

SEQ ID NO: 2810649 - RNA, 12 nt, Mycobacterium avium subsp. paratuberculosis
accggacagcug

SEQ ID NO: 2810650 - RNA, 19 nt, Mycobacterium avium subsp. paratuberculosis
accggcccagccggcggug

SEQ ID NO: 2810651 - RNA, 13 nt, Mycobacterium avium subsp. paratuberculosis
accggcccagcgc

SEQ ID NO: 2810652 - RNA, 13 nt, Mycobacterium avium subsp. paratuberculosis
accggcccggccg

SEQ ID NO: 2810653 - RNA, 15 nt, Mycobacterium avium subsp. paratuberculosis
accggcccggccggc

SEQ ID NO: 2810654 - RNA, 18 nt, Mycobacterium avium subsp. paratuberculosis
accggcccggccggcgcg

SEQ ID NO: 2810655 - RNA, 17 nt, Mycobacterium avium subsp. paratuberculosis
accggcccggcggccgg

SEQ ID NO: 2810656 - RNA, 23 nt, Mycobacterium avium subsp. paratuberculosis
accggcccggcggccggccgcgc

SEQ ID NO: 2810657 - RNA, 14 nt, Mycobacterium avium subsp. paratuberculosis
accggcccggcggg

SEQ ID NO: 2810658 - RNA, 21 nt, Mycobacterium avium subsp. paratuberculosis
accggccgaccggucucgacc

SEQ ID NO: 2810659 - RNA, 21 nt, Mycobacterium avium subsp. paratuberculosis
accggccgagccgaugcccag

SEQ ID NO: 2810660 - RNA, 22 nt, Mycobacterium avium subsp. paratuberculosis
accggccgagccgaugcccagc

SEQ ID NO: 2810661 - RNA, 23 nt, Mycobacterium avium subsp. paratuberculosis
accggccgagccgaugcccagca

SEQ ID NO: 2810662 - RNA, 18 nt, Mycobacterium avium subsp. paratuberculosis
accggccgauggcccagg

SEQ ID NO: 2810663 - RNA, 14 nt, Mycobacterium avium subsp. paratuberculosis
accggccgcccggc

SEQ ID NO: 2810664 - RNA, 17 nt, Mycobacterium avium subsp. paratuberculosis
accggccgcccggcgag

SEQ ID NO: 2810665 - RNA, 17 nt, Mycobacterium avium subsp. paratuberculosis
accggccggccccgggg

SEQ ID NO: 2810666 - RNA, 14 nt, Mycobacterium avium subsp. paratuberculosis
accggccggccgcc

SEQ ID NO: 2810667 - RNA, 19 nt, Mycobacterium avium subsp. paratuberculosis
accggccggccgccuggac

SEQ ID NO: 2810668 - RNA, 20 nt, Mycobacterium avium subsp. paratuberculosis
accggccggcgcgcacggca

SEQ ID NO: 2810669 - RNA, 22 nt, Mycobacterium avium subsp. paratuberculosis
accggccggcgcgcacggcagc

SEQ ID NO: 2810670 - RNA, 14 nt, Mycobacterium avium subsp. paratuberculosis
accggccggcgcgg

SEQ ID NO: 2810671 - RNA, 15 nt, Mycobacterium avium subsp. paratuberculosis
accggccggggcgcc

SEQ ID NO: 2810672 - RNA, 20 nt, Mycobacterium avium subsp. paratuberculosis
accggccgguuguugcgguc

SEQ ID NO: 2810673 - RNA, 21 nt, Mycobacterium avium subsp. paratuberculosis
accggccugagacgacgccac

SEQ ID NO: 2810674 - RNA, 16 nt, Mycobacterium avium subsp. paratuberculosis
accggccugcagcgcg

SEQ ID NO: 2810675 - RNA, 17 nt, Mycobacterium avium subsp. paratuberculosis
accggccugcagcgcgg

SEQ ID NO: 2810676 - RNA, 18 nt, Mycobacterium avium subsp. paratuberculosis
accggccugcagcgcggu

SEQ ID NO: 2810677 - RNA, 22 nt, Mycobacterium avium subsp. paratuberculosis
accggccugcagcgcggucauc

SEQ ID NO: 2810678 - RNA, 23 nt, Mycobacterium avium subsp. paratuberculosis
accggccugcagcgcggucaucg

SEQ ID NO: 2810679 - RNA, 20 nt, Mycobacterium avium subsp. paratuberculosis
accggcgaggugaaccgcga

SEQ ID NO: 2810680 - RNA, 21 nt, Mycobacterium avium subsp. paratuberculosis
accggcgaggugaaccgcgac

SEQ ID NO: 2810681 - RNA, 16 nt, Mycobacterium avium subsp. paratuberculosis
accggcgaggugcgcc

SEQ ID NO: 2810682 - RNA, 16 nt, Mycobacterium avium subsp. paratuberculosis
accggcgaugcagauc

SEQ ID NO: 2810683 - RNA, 21 nt, Mycobacterium avium subsp. paratuberculosis
accggcgaugcagaucaccac

SEQ ID NO: 2810684 - RNA, 15 nt, Mycobacterium avium subsp. paratuberculosis
accggcgaugccagc

SEQ ID NO: 2810685 - RNA, 22 nt, Mycobacterium avium subsp. paratuberculosis
accggcgaugccagcgcaccgg

SEQ ID NO: 2810686 - RNA, 14 nt, Mycobacterium avium subsp. paratuberculosis
accggcgcagcgcg

SEQ ID NO: 2810687 - RNA, 20 nt, Mycobacterium avium subsp. paratuberculosis
accggcgcagcgcgucgcgc

SEQ ID NO: 2810688 - RNA, 23 nt, Mycobacterium avium subsp. paratuberculosis
accggcgcagcgcgucgcgcccg

SEQ ID NO: 2810689 - RNA, 11 nt, Mycobacterium avium subsp. paratuberculosis
accggcgccag

SEQ ID NO: 2810690 - RNA, 22 nt, Mycobacterium avium subsp. paratuberculosis
accggcgccaggccggcgacgc

SEQ ID NO: 2810691 - RNA, 19 nt, Mycobacterium avium subsp. paratuberculosis
accggcgccgaagcccgca

SEQ ID NO: 2810692 - RNA, 21 nt, Mycobacterium avium subsp. paratuberculosis
accggcgccgaagcccgcagc

SEQ ID NO: 2810693 - RNA, 14 nt, Mycobacterium avium subsp. paratuberculosis
accggcgccgccac

SEQ ID NO: 2810694 - RNA, 14 nt, Mycobacterium avium subsp. paratuberculosis
accggcgccggccg

SEQ ID NO: 2810695 - RNA, 12 nt, Mycobacterium avium subsp. paratuberculosis
accggcgccggg

SEQ ID NO: 2810696 - RNA, 23 nt, Mycobacterium avium subsp. paratuberculosis
accggcgccgggcagcccggguc

SEQ ID NO: 2810697 - RNA, 13 nt, Mycobacterium avium subsp. paratuberculosis
accggcgccgggu

SEQ ID NO: 2810698 - RNA, 13 nt, Mycobacterium avium subsp. paratuberculosis
accggcgccucga

SEQ ID NO: 2810699 - RNA, 23 nt, Mycobacterium avium subsp. paratuberculosis
accggcgcgaccacauaccggga

SEQ ID NO: 2810700 - RNA, 14 nt, Mycobacterium avium subsp. paratuberculosis
accggcgcgacggc

SEQ ID NO: 2810701 - RNA, 16 nt, Mycobacterium avium subsp. paratuberculosis
accggcgcgcagcauc

SEQ ID NO: 2810702 - RNA, 13 nt, Mycobacterium avium subsp. paratuberculosis
accggcgcgcccg

SEQ ID NO: 2810703 - RNA, 22 nt, Mycobacterium avium subsp. paratuberculosis
accggcgcgcccgagucacccg

SEQ ID NO: 2810704 - RNA, 14 nt, Mycobacterium avium subsp. paratuberculosis
accggcgcgccgcg

SEQ ID NO: 2810705 - RNA, 15 nt, Mycobacterium avium subsp. paratuberculosis
accggcgcgccgucc

SEQ ID NO: 2810706 - RNA, 15 nt, Mycobacterium avium subsp. paratuberculosis
accggcgcguuggcc

SEQ ID NO: 2810707 - RNA, 14 nt, Mycobacterium avium subsp. paratuberculosis
accggcgcugcccg

SEQ ID NO: 2810708 - RNA, 17 nt, Mycobacterium avium subsp. paratuberculosis
accggcgcugcccgcga

SEQ ID NO: 2810709 - RNA, 14 nt, Mycobacterium avium subsp. paratuberculosis
accggcggauucuc

SEQ ID NO: 2810710 - RNA, 12 nt, Mycobacterium avium subsp. paratuberculosis
accggcggcagc

SEQ ID NO: 2810711 - RNA, 15 nt, Mycobacterium avium subsp. paratuberculosis
accggcggcagcgac

SEQ ID NO: 2810712 - RNA, 18 nt, Mycobacterium avium subsp. paratuberculosis
accggcggccagcgagga

SEQ ID NO: 2810713 - RNA, 12 nt, Mycobacterium avium subsp. paratuberculosis
accggcggccgc

SEQ ID NO: 2810714 - RNA, 14 nt, Mycobacterium avium subsp. paratuberculosis
accggcggccgcca

SEQ ID NO: 2810715 - RNA, 16 nt, Mycobacterium avium subsp. paratuberculosis
accggcggccgccauc

SEQ ID NO: 2810716 - RNA, 18 nt, Mycobacterium avium subsp. paratuberculosis
accggcggcgacggcacc

SEQ ID NO: 2810717 - RNA, 15 nt, Mycobacterium avium subsp. paratuberculosis
accggcggcgaucgg

SEQ ID NO: 2810718 - RNA, 21 nt, Mycobacterium avium subsp. paratuberculosis
accggcggcgaucggcgcggc

SEQ ID NO: 2810719 - RNA, 16 nt, Mycobacterium avium subsp. paratuberculosis
accggcggcggccuuc

SEQ ID NO: 2810720 - RNA, 16 nt, Mycobacterium avium subsp. paratuberculosis
accggcggcggugagc

SEQ ID NO: 2810721 - RNA, 18 nt, Mycobacterium avium subsp. paratuberculosis
accggcggcggugagcgc

SEQ ID NO: 2810722 - RNA, 23 nt, Mycobacterium avium subsp. paratuberculosis
accggcggcggugagcgcgucga

SEQ ID NO: 2810723 - RNA, 22 nt, Mycobacterium avium subsp. paratuberculosis
accggcggcugggcagccgcgc

SEQ ID NO: 2810724 - RNA, 23 nt, Mycobacterium avium subsp. paratuberculosis
accggcggcugggcagccgcgcg

SEQ ID NO: 2810725 - RNA, 22 nt, Mycobacterium avium subsp. paratuberculosis
accggcgggaacucgaugcggc

SEQ ID NO: 2810726 - RNA, 16 nt, Mycobacterium avium subsp. paratuberculosis
accggcgggcggcggc

SEQ ID NO: 2810727 - RNA, 17 nt, Mycobacterium avium subsp. paratuberculosis
accggcgggcggcggcg

SEQ ID NO: 2810728 - RNA, 18 nt, Mycobacterium avium subsp. paratuberculosis
accggcggucaccaaggc

SEQ ID NO: 2810729 - RNA, 22 nt, Mycobacterium avium subsp. paratuberculosis
accggcggugccggccagaucg

SEQ ID NO: 2810730 - RNA, 18 nt, Mycobacterium avium subsp. paratuberculosis
accggcggugcggacccg

SEQ ID NO: 2810731 - RNA, 23 nt, Mycobacterium avium subsp. paratuberculosis
accggcggugucggugccgagca

SEQ ID NO: 2810732 - RNA, 15 nt, Mycobacterium avium subsp. paratuberculosis
accggcguacgacau

SEQ ID NO: 2810733 - RNA, 23 nt, Mycobacterium avium subsp. paratuberculosis
accggcgucacauacgccucacc

SEQ ID NO: 2810734 - RNA, 20 nt, Mycobacterium avium subsp. paratuberculosis
accgggccgccaucaccgcg

SEQ ID NO: 2810735 - RNA, 17 nt, Mycobacterium avium subsp. paratuberculosis
accgggccgcuggccgc

SEQ ID NO: 2810736 - RNA, 14 nt, Mycobacterium avium subsp. paratuberculosis
accgggccugcgcg

SEQ ID NO: 2810737 - RNA, 15 nt, Mycobacterium avium subsp. paratuberculosis
accgggccugcgcgc

SEQ ID NO: 2810738 - RNA, 21 nt, Mycobacterium avium subsp. paratuberculosis
accgggcgacaccccgcgagu

SEQ ID NO: 2810739 - RNA, 13 nt, Mycobacterium avium subsp. paratuberculosis
accgggcgcgcag

SEQ ID NO: 2810740 - RNA, 14 nt, Mycobacterium avium subsp. paratuberculosis
accgggcgcgcaga

SEQ ID NO: 2810741 - RNA, 22 nt, Mycobacterium avium subsp. paratuberculosis
accgggcgcgcagaucgucgac

SEQ ID NO: 2810742 - RNA, 12 nt, Mycobacterium avium subsp. paratuberculosis
accgggcggccg

SEQ ID NO: 2810743 - RNA, 13 nt, Mycobacterium avium subsp. paratuberculosis
accgggcgucggc

SEQ ID NO: 2810744 - RNA, 15 nt, Mycobacterium avium subsp. paratuberculosis
accgggcuccagcgg

SEQ ID NO: 2810745 - RNA, 17 nt, Mycobacterium avium subsp. paratuberculosis
accgggcuccagcgggu

SEQ ID NO: 2810746 - RNA, 15 nt, Mycobacterium avium subsp. paratuberculosis
accgggcucggucac

SEQ ID NO: 2810747 - RNA, 21 nt, Mycobacterium avium subsp. paratuberculosis
accgggcucggucaccccgga

SEQ ID NO: 2810748 - RNA, 15 nt, Mycobacterium avium subsp. paratuberculosis
accggggaucaccuc

SEQ ID NO: 2810749 - RNA, 17 nt, Mycobacterium avium subsp. paratuberculosis
accggggccagcacgcc

SEQ ID NO: 2810750 - RNA, 12 nt, Mycobacterium avium subsp. paratuberculosis
accggggccgca

SEQ ID NO: 2810751 - RNA, 17 nt, Mycobacterium avium subsp. paratuberculosis
accggggccgcaccuga

SEQ ID NO: 2810752 - RNA, 12 nt, Mycobacterium avium subsp. paratuberculosis
accggggccggc

SEQ ID NO: 2810753 - RNA, 21 nt, Mycobacterium avium subsp. paratuberculosis
accggggcgccccgcugguag

SEQ ID NO: 2810754 - RNA, 13 nt, Mycobacterium avium subsp. paratuberculosis
accgggggccguc

SEQ ID NO: 2810755 - RNA, 14 nt, Mycobacterium avium subsp. paratuberculosis
accgggggccguca

SEQ ID NO: 2810756 - RNA, 21 nt, Mycobacterium avium subsp. paratuberculosis
accggggucaccuuggccgga

SEQ ID NO: 2810757 - RNA, 14 nt, Mycobacterium avium subsp. paratuberculosis
accggggucggcgc

SEQ ID NO: 2810758 - RNA, 21 nt, Mycobacterium avium subsp. paratuberculosis
accggggucggcgcccucggc

SEQ ID NO: 2810759 - RNA, 13 nt, Mycobacterium avium subsp. paratuberculosis
accggggugccgc

SEQ ID NO: 2810760 - RNA, 18 nt, Mycobacterium avium subsp. paratuberculosis
accggggugccgcccaac

SEQ ID NO: 2810761 - RNA, 15 nt, Mycobacterium avium subsp. paratuberculosis
accgggucagcacca

SEQ ID NO: 2810762 - RNA, 21 nt, Mycobacterium avium subsp. paratuberculosis
accgggucagcaccaccaaca

SEQ ID NO: 2810763 - RNA, 23 nt, Mycobacterium avium subsp. paratuberculosis
accgggucagcaccaccaacagc

SEQ ID NO: 2810764 - RNA, 18 nt, Mycobacterium avium subsp. paratuberculosis
accgggucccccgccgac

SEQ ID NO: 2810765 - RNA, 19 nt, Mycobacterium avium subsp. paratuberculosis
accgggucccccgccgacc

SEQ ID NO: 2810766 - RNA, 20 nt, Mycobacterium avium subsp. paratuberculosis
accgggucccccgccgaccg

SEQ ID NO: 2810767 - RNA, 13 nt, Mycobacterium avium subsp. paratuberculosis
accgggucgccga

SEQ ID NO: 2810768 - RNA, 19 nt, Mycobacterium avium subsp. paratuberculosis
accgggucguccgcgacgc

SEQ ID NO: 2810769 - RNA, 21 nt, Mycobacterium avium subsp. paratuberculosis
accgggucguccgcgacgcug

SEQ ID NO: 2810770 - RNA, 19 nt, Mycobacterium avium subsp. paratuberculosis
accgggucucgcgccacca

SEQ ID NO: 2810771 - RNA, 19 nt, Mycobacterium avium subsp. paratuberculosis
accgggugaacgaggccgc

SEQ ID NO: 2810772 - RNA, 23 nt, Mycobacterium avium subsp. paratuberculosis
accgggugaacgaggccgcgccg

SEQ ID NO: 2810773 - RNA, 17 nt, Mycobacterium avium subsp. paratuberculosis
accgggugaccggcgcg

SEQ ID NO: 2810774 - RNA, 14 nt, Mycobacterium avium subsp. paratuberculosis
accgggugacgacc

SEQ ID NO: 2810775 - RNA, 20 nt, Mycobacterium avium subsp. paratuberculosis
accgggugauaccggcccag

SEQ ID NO: 2810776 - RNA, 21 nt, Mycobacterium avium subsp. paratuberculosis
accgggugauaccggcccagc

SEQ ID NO: 2810777 - RNA, 19 nt, Mycobacterium avium subsp. paratuberculosis
accgggugaugucgccgac

SEQ ID NO: 2810778 - RNA, 22 nt, Mycobacterium avium subsp. paratuberculosis
accgggugaugucgccgaccag

SEQ ID NO: 2810779 - RNA, 21 nt, Mycobacterium avium subsp. paratuberculosis
accgggugcguccagaccggc

SEQ ID NO: 2810780 - RNA, 15 nt, Mycobacterium avium subsp. paratuberculosis
accggguggccagca

SEQ ID NO: 2810781 - RNA, 23 nt, Mycobacterium avium subsp. paratuberculosis
accggguggccagcaccagcccg

SEQ ID NO: 2810782 - RNA, 17 nt, Mycobacterium avium subsp. paratuberculosis
accgggugggccgaccu

SEQ ID NO: 2810783 - RNA, 23 nt, Mycobacterium avium subsp. paratuberculosis
accgggugggccgaccugcacgc

SEQ ID NO: 2810784 - RNA, 16 nt, Mycobacterium avium subsp. paratuberculosis
accggguggugggcga

SEQ ID NO: 2810785 - RNA, 15 nt, Mycobacterium avium subsp. paratuberculosis
accggguuggcgcgc

SEQ ID NO: 2810786 - RNA, 17 nt, Mycobacterium avium subsp. paratuberculosis
accgguacagcgacucc

SEQ ID NO: 2810787 - RNA, 20 nt, Mycobacterium avium subsp. paratuberculosis
accgguacagcgacuccagc

SEQ ID NO: 2810788 - RNA, 23 nt, Mycobacterium avium subsp. paratuberculosis
accgguacagcgacuccagcgcg

SEQ ID NO: 2810789 - RNA, 17 nt, Mycobacterium avium subsp. paratuberculosis
accgguagaagaugcgc

SEQ ID NO: 2810790 - RNA, 21 nt, Mycobacterium avium subsp. paratuberculosis
accgguagaagaugcgccggg

SEQ ID NO: 2810791 - RNA, 19 nt, Mycobacterium avium subsp. paratuberculosis
accgguagcgguccucgaa

SEQ ID NO: 2810792 - RNA, 21 nt, Mycobacterium avium subsp. paratuberculosis
accgguagcgguccucgaacc

SEQ ID NO: 2810793 - RNA, 23 nt, Mycobacterium avium subsp. paratuberculosis
accgguagcgguccucgaaccgc

SEQ ID NO: 2810794 - RNA, 13 nt, Mycobacterium avium subsp. paratuberculosis
accgguaggcgca

SEQ ID NO: 2810795 - RNA, 14 nt, Mycobacterium avium subsp. paratuberculosis
accgguaggcgcac

SEQ ID NO: 2810796 - RNA, 20 nt, Mycobacterium avium subsp. paratuberculosis
accgguaggcgcaccgccgg

SEQ ID NO: 2810797 - RNA, 21 nt, Mycobacterium avium subsp. paratuberculosis
accgguaggcgcaccgccggg

SEQ ID NO: 2810798 - RNA, 19 nt, Mycobacterium avium subsp. paratuberculosis
accgguccaguccggccgu

SEQ ID NO: 2810799 - RNA, 13 nt, Mycobacterium avium subsp. paratuberculosis
accgguccgccgc

SEQ ID NO: 2810800 - RNA, 18 nt, Mycobacterium avium subsp. paratuberculosis
accgguccgccgccggcg

SEQ ID NO: 2810801 - RNA, 14 nt, Mycobacterium avium subsp. paratuberculosis
accgguccgccguc

SEQ ID NO: 2810802 - RNA, 14 nt, Mycobacterium avium subsp. paratuberculosis
accgguccgcgguu

SEQ ID NO: 2810803 - RNA, 16 nt, Mycobacterium avium subsp. paratuberculosis
accgguccggucacgc

SEQ ID NO: 2810804 - RNA, 14 nt, Mycobacterium avium subsp. paratuberculosis
accgguccgugcca

SEQ ID NO: 2810805 - RNA, 21 nt, Mycobacterium avium subsp. paratuberculosis
accgguccgugccacggccgc

SEQ ID NO: 2810806 - RNA, 24 nt, Mycobacterium avium subsp. paratuberculosis
accgguccgugccacggccgcggc

SEQ ID NO: 2810807 - RNA, 19 nt, Mycobacterium avium subsp. paratuberculosis
accgguccuccccgcuggc

SEQ ID NO: 2810808 - RNA, 23 nt, Mycobacterium avium subsp. paratuberculosis
accggucgcguugaaagccgcga

SEQ ID NO: 2810809 - RNA, 16 nt, Mycobacterium avium subsp. paratuberculosis
accggucguuggccuc

SEQ ID NO: 2810810 - RNA, 18 nt, Mycobacterium avium subsp. paratuberculosis
accggucucgaccgcggc

SEQ ID NO: 2810811 - RNA, 17 nt, Mycobacterium avium subsp. paratuberculosis
accggugaacgggucaa

SEQ ID NO: 2810812 - RNA, 22 nt, Mycobacterium avium subsp. paratuberculosis
accggugacaugauggacuucg

SEQ ID NO: 2810813 - RNA, 18 nt, Mycobacterium avium subsp. paratuberculosis
accggugacgaccggcag

SEQ ID NO: 2810814 - RNA, 19 nt, Mycobacterium avium subsp. paratuberculosis
accggugacgaccggcagc

SEQ ID NO: 2810815 - RNA, 14 nt, Mycobacterium avium subsp. paratuberculosis
accggugcaccgcg

SEQ ID NO: 2810816 - RNA, 16 nt, Mycobacterium avium subsp. paratuberculosis
accggugcaccgcgcg

SEQ ID NO: 2810817 - RNA, 17 nt, Mycobacterium avium subsp. paratuberculosis
accggugcaccgcgcgc

SEQ ID NO: 2810818 - RNA, 15 nt, Mycobacterium avium subsp. paratuberculosis
accgucuucggggcc

SEQ ID NO: 2810819 - RNA, 21 nt, Mycobacterium avium subsp. paratuberculosis
accgucuucggggccgccguc

SEQ ID NO: 2810820 - RNA, 22 nt, Mycobacterium avium subsp. paratuberculosis
accgucuucggggccgccgucg

SEQ ID NO: 2810821 - RNA, 20 nt, Mycobacterium avium subsp. paratuberculosis
accgucuuggucucgccgau

SEQ ID NO: 2810822 - RNA, 20 nt, Mycobacterium avium subsp. paratuberculosis
accgugacggcaucggcgcc

SEQ ID NO: 2810823 - RNA, 23 nt, Mycobacterium avium subsp. paratuberculosis
accgugacggcaucggcgcccuc

SEQ ID NO: 2810824 - RNA, 14 nt, Mycobacterium avium subsp. paratuberculosis
accgugacugggug

SEQ ID NO: 2810825 - RNA, 23 nt, Mycobacterium avium subsp. paratuberculosis
accgugaggcccggcgugggccg

SEQ ID NO: 2810826 - RNA, 17 nt, Mycobacterium avium subsp. paratuberculosis
accgugaucgccaccac

SEQ ID NO: 2810827 - RNA, 19 nt, Mycobacterium avium subsp. paratuberculosis
accgugaucgccaccacca

SEQ ID NO: 2810828 - RNA, 20 nt, Mycobacterium avium subsp. paratuberculosis
accgugcccaccagccggcc

SEQ ID NO: 2810829 - RNA, 22 nt, Mycobacterium avium subsp. paratuberculosis
accgugcccaccagccggccgg

SEQ ID NO: 2810830 - RNA, 15 nt, Mycobacterium avium subsp. paratuberculosis
accgugccgcgcggc

SEQ ID NO: 2810831 - RNA, 19 nt, Mycobacterium avium subsp. paratuberculosis
accgugccgcgcggcggug

SEQ ID NO: 2810832 - RNA, 22 nt, Mycobacterium avium subsp. paratuberculosis
accgugccgcgcggcggugacc

SEQ ID NO: 2810833 - RNA, 20 nt, Mycobacterium avium subsp. paratuberculosis
accgugccgucggcgucgac

SEQ ID NO: 2810834 - RNA, 13 nt, Mycobacterium avium subsp. paratuberculosis
accgugccucgcc

SEQ ID NO: 2810835 - RNA, 21 nt, Mycobacterium avium subsp. paratuberculosis
accgugccuuacgccgggguc

SEQ ID NO: 2810836 - RNA, 13 nt, Mycobacterium avium subsp. paratuberculosis
accgugcgcgcgc

SEQ ID NO: 2810837 - RNA, 15 nt, Mycobacterium avium subsp. paratuberculosis
accgugcgcgcgcac

SEQ ID NO: 2810838 - RNA, 16 nt, Mycobacterium avium subsp. paratuberculosis
accgugcgggucgcgc

SEQ ID NO: 2810839 - RNA, 18 nt, Mycobacterium avium subsp. paratuberculosis
accgugcgggucgcgcug

SEQ ID NO: 2810840 - RNA, 17 nt, Mycobacterium avium subsp. paratuberculosis
accgugcugauccacgc

SEQ ID NO: 2810841 - RNA, 17 nt, Mycobacterium avium subsp. paratuberculosis
accgugcuggccaccac

SEQ ID NO: 2810842 - RNA, 23 nt, Mycobacterium avium subsp. paratuberculosis
accgugcuguacgacaacagugc

SEQ ID NO: 2810843 - RNA, 23 nt, Mycobacterium avium subsp. paratuberculosis
accgugcuuggcggcgcacucca

SEQ ID NO: 2810844 - RNA, 19 nt, Mycobacterium avium subsp. paratuberculosis
accguggaagucgccgucc

SEQ ID NO: 2810845 - RNA, 21 nt, Mycobacterium avium subsp. paratuberculosis
accguggaggacgaggcccgc

SEQ ID NO: 2810846 - RNA, 23 nt, Mycobacterium avium subsp. paratuberculosis
accguggaggacgaggcccgcaa

SEQ ID NO: 2810847 - RNA, 18 nt, Mycobacterium avium subsp. paratuberculosis
accguggccccacgggcc

SEQ ID NO: 2810848 - RNA, 18 nt, Mycobacterium avium subsp. paratuberculosis
accguggccccagccacc

SEQ ID NO: 2810849 - RNA, 17 nt, Mycobacterium avium subsp. paratuberculosis
accguggcgggggagcc

SEQ ID NO: 2810850 - RNA, 21 nt, Mycobacterium avium subsp. paratuberculosis
accguggcgggggagccgugc

SEQ ID NO: 2810851 - RNA, 14 nt, Mycobacterium avium subsp. paratuberculosis
accgugggcggcgc

SEQ ID NO: 2810852 - RNA, 16 nt, Mycobacterium avium subsp. paratuberculosis
accgugggcggcgcga

SEQ ID NO: 2810853 - RNA, 20 nt, Mycobacterium avium subsp. paratuberculosis
accgugggcggcgcgaucgu

SEQ ID NO: 2810854 - RNA, 15 nt, Mycobacterium avium subsp. paratuberculosis
accguggucggcagc

SEQ ID NO: 2810855 - RNA, 18 nt, Mycobacterium avium subsp. paratuberculosis
accguggucggcagcacc

SEQ ID NO: 2810856 - RNA, 20 nt, Mycobacterium avium subsp. paratuberculosis
accguggucggcagcaccgg

SEQ ID NO: 2810857 - RNA, 21 nt, Mycobacterium avium subsp. paratuberculosis
accguggucggcagcaccggc

SEQ ID NO: 2810858 - RNA, 22 nt, Mycobacterium avium subsp. paratuberculosis
accgugguggacaacuccugga

SEQ ID NO: 2810859 - RNA, 16 nt, Mycobacterium avium subsp. paratuberculosis
accguggugucggaga

SEQ ID NO: 2810860 - RNA, 22 nt, Mycobacterium avium subsp. paratuberculosis
accguggugucggagaucggcg

SEQ ID NO: 2810861 - RNA, 17 nt, Mycobacterium avium subsp. paratuberculosis
accguggugugcccgcg

SEQ ID NO: 2810862 - RNA, 20 nt, Mycobacterium avium subsp. paratuberculosis
accguggugugcccgcgggc

SEQ ID NO: 2810863 - RNA, 16 nt, Mycobacterium avium subsp. paratuberculosis
accguguagccgaccg

SEQ ID NO: 2810864 - RNA, 17 nt, Mycobacterium avium subsp. paratuberculosis
accgugucgucgcugac

SEQ ID NO: 2810865 - RNA, 19 nt, Mycobacterium avium subsp. paratuberculosis
accgugugacgaugcugag

SEQ ID NO: 2810866 - RNA, 19 nt, Mycobacterium avium subsp. paratuberculosis
accguguugaucucgucga

SEQ ID NO: 2810867 - RNA, 20 nt, Mycobacterium avium subsp. paratuberculosis
accguucaacggccaaccgc

SEQ ID NO: 2810868 - RNA, 20 nt, Mycobacterium avium subsp. paratuberculosis
accguucgucgucgcgcagg

SEQ ID NO: 2810869 - RNA, 15 nt, Mycobacterium avium subsp. paratuberculosis
accguugaccaccag

SEQ ID NO: 2810870 - RNA, 15 nt, Mycobacterium avium subsp. paratuberculosis
accguugaccgacgc

SEQ ID NO: 2810871 - RNA, 21 nt, Mycobacterium avium subsp. paratuberculosis
accguugacgaccuugucgcg

SEQ ID NO: 2810872 - RNA, 14 nt, Mycobacterium avium subsp. paratuberculosis
accguugaggcgag

SEQ ID NO: 2810873 - RNA, 12 nt, Mycobacterium avium subsp. paratuberculosis
accguugcgccc

SEQ ID NO: 2810874 - RNA, 19 nt, Mycobacterium avium subsp. paratuberculosis
accguugcgccccagacgu

SEQ ID NO: 2810875 - RNA, 22 nt, Mycobacterium avium subsp. paratuberculosis
accguugggcaacgcggcauga

SEQ ID NO: 2810876 - RNA, 17 nt, Mycobacterium avium subsp. paratuberculosis
accguuggugcgguguc

SEQ ID NO: 2810877 - RNA, 21 nt, Mycobacterium avium subsp. paratuberculosis
accguugucucggcgccgucg

SEQ ID NO: 2810878 - RNA, 17 nt, Mycobacterium avium subsp. paratuberculosis
accguugugacccgcuc

SEQ ID NO: 2810879 - RNA, 20 nt, Mycobacterium avium subsp. paratuberculosis
accguugugacccgcucggg

SEQ ID NO: 2810880 - RNA, 15 nt, Mycobacterium avium subsp. paratuberculosis
accguuuucggcgcg

SEQ ID NO: 2810881 - RNA, 20 nt, Mycobacterium avium subsp. paratuberculosis
accguuuucggcgcgcagcu

SEQ ID NO: 2810882 - RNA, 21 nt, Mycobacterium avium subsp. paratuberculosis
accuaggcgucgucggcccag

SEQ ID NO: 2810883 - RNA, 14 nt, Mycobacterium avium subsp. paratuberculosis
accucacacugaaa

SEQ ID NO: 2810884 - RNA, 16 nt, Mycobacterium avium subsp. paratuberculosis
accucaccacgugcca

SEQ ID NO: 2810885 - RNA, 17 nt, Mycobacterium avium subsp. paratuberculosis
accucaccugcguugcg

SEQ ID NO: 2810886 - RNA, 20 nt, Mycobacterium avium subsp. paratuberculosis
accucacggucggcguccag

SEQ ID NO: 2810887 - RNA, 17 nt, Mycobacterium avium subsp. paratuberculosis
accucaucgcccagccg

SEQ ID NO: 2810888 - RNA, 19 nt, Mycobacterium avium subsp. paratuberculosis
accucaucgcccagccggc

SEQ ID NO: 2810889 - RNA, 17 nt, Mycobacterium avium subsp. paratuberculosis
accuccaaugcgcccug

SEQ ID NO: 2810890 - RNA, 21 nt, Mycobacterium avium subsp. paratuberculosis
accuccaguugcgaccccgcc

SEQ ID NO: 2810891 - RNA, 15 nt, Mycobacterium avium subsp. paratuberculosis
accucccccgacgcc

SEQ ID NO: 2810892 - RNA, 14 nt, Mycobacterium avium subsp. paratuberculosis
accuccccgcggug

SEQ ID NO: 2810893 - RNA, 19 nt, Mycobacterium avium subsp. paratuberculosis
accuccccgcggugccgca

SEQ ID NO: 2810894 - RNA, 21 nt, Mycobacterium avium subsp. paratuberculosis
accuccccgcggugccgcagc

SEQ ID NO: 2810895 - RNA, 22 nt, Mycobacterium avium subsp. paratuberculosis
accuccccgcggugccgcagcu

SEQ ID NO: 2810896 - RNA, 13 nt, Mycobacterium avium subsp. paratuberculosis
accucccggcgcc

SEQ ID NO: 2810897 - RNA, 13 nt, Mycobacterium avium subsp. paratuberculosis
accuccggagauc

SEQ ID NO: 2810898 - RNA, 19 nt, Mycobacterium avium subsp. paratuberculosis
accuccggagaucgccccg

SEQ ID NO: 2810899 - RNA, 20 nt, Mycobacterium avium subsp. paratuberculosis
accuccggagaucgccccgg

SEQ ID NO: 2810900 - RNA, 14 nt, Mycobacterium avium subsp. paratuberculosis
accuccggcagcga

SEQ ID NO: 2810901 - RNA, 19 nt, Mycobacterium avium subsp. paratuberculosis
accuccgugccgauggcca

SEQ ID NO: 2810902 - RNA, 14 nt, Mycobacterium avium subsp. paratuberculosis
accucggccaggua

SEQ ID NO: 2810903 - RNA, 14 nt, Mycobacterium avium subsp. paratuberculosis
accucggccuugcc

SEQ ID NO: 2810904 - RNA, 16 nt, Mycobacterium avium subsp. paratuberculosis
accucggcgaccagcg

SEQ ID NO: 2810905 - RNA, 17 nt, Mycobacterium avium subsp. paratuberculosis
accucggcgaccagcga

SEQ ID NO: 2810906 - RNA, 12 nt, Mycobacterium avium subsp. paratuberculosis
accucggcgacg

SEQ ID NO: 2810907 - RNA, 13 nt, Mycobacterium avium subsp. paratuberculosis
accucggcgacga

SEQ ID NO: 2810908 - RNA, 22 nt, Mycobacterium avium subsp. paratuberculosis
accucggcgacgauggccaggc

SEQ ID NO: 2810909 - RNA, 15 nt, Mycobacterium avium subsp. paratuberculosis
accucggcgacgucc

SEQ ID NO: 2810910 - RNA, 19 nt, Mycobacterium avium subsp. paratuberculosis
accucggcggcaccgcccg

SEQ ID NO: 2810911 - RNA, 22 nt, Mycobacterium avium subsp. paratuberculosis
accucggcggcaccgcccgggu

SEQ ID NO: 2810912 - RNA, 13 nt, Mycobacterium avium subsp. paratuberculosis
accucggcggcca

SEQ ID NO: 2810913 - RNA, 14 nt, Mycobacterium avium subsp. paratuberculosis
accucggcggccag

SEQ ID NO: 2810914 - RNA, 22 nt, Mycobacterium avium subsp. paratuberculosis
accucggcggccagcgcgacgc

SEQ ID NO: 2810915 - RNA, 14 nt, Mycobacterium avium subsp. paratuberculosis
accucggcggcggc

SEQ ID NO: 2810916 - RNA, 20 nt, Mycobacterium avium subsp. paratuberculosis
accucggcggcggcgcgccg

SEQ ID NO: 2810917 - RNA, 21 nt, Mycobacterium avium subsp. paratuberculosis
accucggcggcggcgcgccgg

SEQ ID NO: 2810918 - RNA, 22 nt, Mycobacterium avium subsp. paratuberculosis
accucggcggcggcgcgccggc

SEQ ID NO: 2810919 - RNA, 19 nt, Mycobacterium avium subsp. paratuberculosis
accucgggauccaggaacg

SEQ ID NO: 2810920 - RNA, 19 nt, Mycobacterium avium subsp. paratuberculosis
accucgggaugggcauugc

SEQ ID NO: 2810921 - RNA, 21 nt, Mycobacterium avium subsp. paratuberculosis
accucgggcacguccagcccg

SEQ ID NO: 2810922 - RNA, 17 nt, Mycobacterium avium subsp. paratuberculosis
accucgggcauuggcag

SEQ ID NO: 2810923 - RNA, 14 nt, Mycobacterium avium subsp. paratuberculosis
accucgggccgggc

SEQ ID NO: 2810924 - RNA, 16 nt, Mycobacterium avium subsp. paratuberculosis
accucgggccgggcgg

SEQ ID NO: 2810925 - RNA, 19 nt, Mycobacterium avium subsp. paratuberculosis
accucgggccgggcgggca

SEQ ID NO: 2810926 - RNA, 21 nt, Mycobacterium avium subsp. paratuberculosis
accucgggccgggcgggcacc

SEQ ID NO: 2810927 - RNA, 22 nt, Mycobacterium avium subsp. paratuberculosis
accucgggccgggcgggcaccc

SEQ ID NO: 2810928 - RNA, 17 nt, Mycobacterium avium subsp. paratuberculosis
accucggggcguggcgg

SEQ ID NO: 2810929 - RNA, 22 nt, Mycobacterium avium subsp. paratuberculosis
accucggggucggccggaucga

SEQ ID NO: 2810930 - RNA, 12 nt, Mycobacterium avium subsp. paratuberculosis
accucgggugua

SEQ ID NO: 2810931 - RNA, 22 nt, Mycobacterium avium subsp. paratuberculosis
accucggugaucucaccggcgg

SEQ ID NO: 2810932 - RNA, 23 nt, Mycobacterium avium subsp. paratuberculosis
accucggugaucucaccggcggc

SEQ ID NO: 2810933 - RNA, 14 nt, Mycobacterium avium subsp. paratuberculosis
accucgguggacgc

SEQ ID NO: 2810934 - RNA, 16 nt, Mycobacterium avium subsp. paratuberculosis
accucggugucgaggu

SEQ ID NO: 2810935 - RNA, 16 nt, Mycobacterium avium subsp. paratuberculosis
accucgucccagcgca

SEQ ID NO: 2810936 - RNA, 20 nt, Mycobacterium avium subsp. paratuberculosis
accucgucgacggcggcguc

SEQ ID NO: 2810937 - RNA, 15 nt, Mycobacterium avium subsp. paratuberculosis
accucgucgcccggc

SEQ ID NO: 2810938 - RNA, 14 nt, Mycobacterium avium subsp. paratuberculosis
accucgucgccguc

SEQ ID NO: 2810939 - RNA, 20 nt, Mycobacterium avium subsp. paratuberculosis
accucgucgccgucgggguc

SEQ ID NO: 2810940 - RNA, 16 nt, Mycobacterium avium subsp. paratuberculosis
accucgucggcggcga

SEQ ID NO: 2810941 - RNA, 15 nt, Mycobacterium avium subsp. paratuberculosis
accucgucggcgguc

SEQ ID NO: 2810942 - RNA, 19 nt, Mycobacterium avium subsp. paratuberculosis
accucgucggcggugccga

SEQ ID NO: 2810943 - RNA, 17 nt, Mycobacterium avium subsp. paratuberculosis
accucgucgggcgccag

SEQ ID NO: 2810944 - RNA, 21 nt, Mycobacterium avium subsp. paratuberculosis
accucgucgggcgccagcccg

SEQ ID NO: 2810945 - RNA, 24 nt, Mycobacterium avium subsp. paratuberculosis
accucgucgggcgccagcccgccc

SEQ ID NO: 2810946 - RNA, 20 nt, Mycobacterium avium subsp. paratuberculosis
accucgucgucgaugaacag

SEQ ID NO: 2810947 - RNA, 13 nt, Mycobacterium avium subsp. paratuberculosis
accucgugcacau

SEQ ID NO: 2810948 - RNA, 20 nt, Mycobacterium avium subsp. paratuberculosis
accucgugcacaugcccguc

SEQ ID NO: 2810949 - RNA, 22 nt, Mycobacterium avium subsp. paratuberculosis
accucugcgcgagcagcucgac

SEQ ID NO: 2810950 - RNA, 19 nt, Mycobacterium avium subsp. paratuberculosis
accucuucgaaagccaccc

SEQ ID NO: 2810951 - RNA, 15 nt, Mycobacterium avium subsp. paratuberculosis
accucuucgacccgc

SEQ ID NO: 2810952 - RNA, 13 nt, Mycobacterium avium subsp. paratuberculosis
accucuucgcggu

SEQ ID NO: 2810953 - RNA, 22 nt, Mycobacterium avium subsp. paratuberculosis
accucuucggcgccggcaucca

SEQ ID NO: 2810954 - RNA, 23 nt, Mycobacterium avium subsp. paratuberculosis
accucuugcggcgcaaccucuuc

SEQ ID NO: 2810955 - RNA, 15 nt, Mycobacterium avium subsp. paratuberculosis
accucuugggcgcug

SEQ ID NO: 2810956 - RNA, 14 nt, Mycobacterium avium subsp. paratuberculosis
accugaaccgcgca

SEQ ID NO: 2810957 - RNA, 23 nt, Mycobacterium avium subsp. paratuberculosis
accugaccagcggcgcgccgggc

SEQ ID NO: 2810958 - RNA, 16 nt, Mycobacterium avium subsp. paratuberculosis
accugaccgaacagcu

SEQ ID NO: 2810959 - RNA, 15 nt, Mycobacterium avium subsp. paratuberculosis
accugaccgcgggcc

SEQ ID NO: 2810960 - RNA, 17 nt, Mycobacterium avium subsp. paratuberculosis
accugaccgcgggcccg

SEQ ID NO: 2810961 - RNA, 19 nt, Mycobacterium avium subsp. paratuberculosis
accugaccgcgggcccgcc

SEQ ID NO: 2810962 - RNA, 20 nt, Mycobacterium avium subsp. paratuberculosis
accugaccgcgggcccgccg

SEQ ID NO: 2810963 - RNA, 15 nt, Mycobacterium avium subsp. paratuberculosis
accugaccgucggcc

SEQ ID NO: 2810964 - RNA, 16 nt, Mycobacterium avium subsp. paratuberculosis
accugaccgucggcca

SEQ ID NO: 2810965 - RNA, 17 nt, Mycobacterium avium subsp. paratuberculosis
accugacgcaucaccac

SEQ ID NO: 2810966 - RNA, 14 nt, Mycobacterium avium subsp. paratuberculosis
accugacgcucggu

SEQ ID NO: 2810967 - RNA, 23 nt, Mycobacterium avium subsp. paratuberculosis
accugaucgaguuccgcgucggc

SEQ ID NO: 2810968 - RNA, 14 nt, Mycobacterium avium subsp. paratuberculosis
accugaucgcggcg

SEQ ID NO: 2810969 - RNA, 22 nt, Mycobacterium avium subsp. paratuberculosis
accugauuucaucgcggcgacc

SEQ ID NO: 2810970 - RNA, 22 nt, Mycobacterium avium subsp. paratuberculosis
accugcaccugcggcaggucgg

SEQ ID NO: 2810971 - RNA, 19 nt, Mycobacterium avium subsp. paratuberculosis
accugcaccugggugaucu

SEQ ID NO: 2810972 - RNA, 23 nt, Mycobacterium avium subsp. paratuberculosis
accugcacgcugaagcacaccgu

SEQ ID NO: 2810973 - RNA, 14 nt, Mycobacterium avium subsp. paratuberculosis
accugcagccgguc

SEQ ID NO: 2810974 - RNA, 16 nt, Mycobacterium avium subsp. paratuberculosis
accugcagccggucgg

SEQ ID NO: 2810975 - RNA, 17 nt, Mycobacterium avium subsp. paratuberculosis
accugcagccggucgga

SEQ ID NO: 2810976 - RNA, 20 nt, Mycobacterium avium subsp. paratuberculosis
accugcaguucgaucaccga

SEQ ID NO: 2810977 - RNA, 17 nt, Mycobacterium avium subsp. paratuberculosis
accugcaucucgacccg

SEQ ID NO: 2810978 - RNA, 22 nt, Mycobacterium avium subsp. paratuberculosis
accugccgcaacgggccgcagc

SEQ ID NO: 2810979 - RNA, 22 nt, Mycobacterium avium subsp. paratuberculosis
accugcgcgacgcugauggcga

SEQ ID NO: 2810980 - RNA, 18 nt, Mycobacterium avium subsp. paratuberculosis
accugcgcgacggcgcug

SEQ ID NO: 2810981 - RNA, 21 nt, Mycobacterium avium subsp. paratuberculosis
accugcggcaggucggccagc

SEQ ID NO: 2810982 - RNA, 12 nt, Mycobacterium avium subsp. paratuberculosis
accugcggcccc

SEQ ID NO: 2810983 - RNA, 15 nt, Mycobacterium avium subsp. paratuberculosis
accugcggcccgucg

SEQ ID NO: 2810984 - RNA, 17 nt, Mycobacterium avium subsp. paratuberculosis
accugcggcccgucgcc

SEQ ID NO: 2810985 - RNA, 24 nt, Mycobacterium avium subsp. paratuberculosis
accugcggcggcagucgcagcagc

SEQ ID NO: 2810986 - RNA, 21 nt, Mycobacterium avium subsp. paratuberculosis
accuugaucucgucgcggcug

SEQ ID NO: 2810987 - RNA, 15 nt, Mycobacterium avium subsp. paratuberculosis
accuugcccgucgcg

SEQ ID NO: 2810988 - RNA, 14 nt, Mycobacterium avium subsp. paratuberculosis
accuugcccugcgu

SEQ ID NO: 2810989 - RNA, 18 nt, Mycobacterium avium subsp. paratuberculosis
accuugccguuggucugu

SEQ ID NO: 2810990 - RNA, 16 nt, Mycobacterium avium subsp. paratuberculosis
accuugcgcagcagca

SEQ ID NO: 2810991 - RNA, 15 nt, Mycobacterium avium subsp. paratuberculosis
accuugcgcccguag

SEQ ID NO: 2810992 - RNA, 15 nt, Mycobacterium avium subsp. paratuberculosis
accuugcggccggcg

SEQ ID NO: 2810993 - RNA, 13 nt, Mycobacterium avium subsp. paratuberculosis
accuugcggcgcg

SEQ ID NO: 2810994 - RNA, 20 nt, Mycobacterium avium subsp. paratuberculosis
accuuggccggugcgccgac

SEQ ID NO: 2810995 - RNA, 12 nt, Mycobacterium avium subsp. paratuberculosis
accuuggcggcc

SEQ ID NO: 2810996 - RNA, 19 nt, Mycobacterium avium subsp. paratuberculosis
accuugggcauccgcucgc

SEQ ID NO: 2810997 - RNA, 16 nt, Mycobacterium avium subsp. paratuberculosis
accuuggucagcuccc

SEQ ID NO: 2810998 - RNA, 19 nt, Mycobacterium avium subsp. paratuberculosis
accuuggugagcaccgcga

SEQ ID NO: 2810999 - RNA, 16 nt, Mycobacterium avium subsp. paratuberculosis
accuugguggccgcgg

SEQ ID NO: 2811000 - RNA, 17 nt, Mycobacterium avium subsp. paratuberculosis
accuuggugucggcgag

SEQ ID NO: 2811001 - RNA, 23 nt, Mycobacterium avium subsp. paratuberculosis
accuugucgaaggugaucuuguu

SEQ ID NO: 2811002 - RNA, 15 nt, Mycobacterium avium subsp. paratuberculosis
accuugucgcgcacc

SEQ ID NO: 2811003 - RNA, 22 nt, Mycobacterium avium subsp. paratuberculosis
accuugucgcgcacccgcacgu

SEQ ID NO: 2811004 - RNA, 15 nt, Mycobacterium avium subsp. paratuberculosis
accuugucgggccgc

SEQ ID NO: 2811005 - RNA, 13 nt, Mycobacterium avium subsp. paratuberculosis
accuuucggccgc

SEQ ID NO: 2811006 - RNA, 15 nt, Mycobacterium avium subsp. paratuberculosis
accuuucggccgcgg

SEQ ID NO: 2811007 - RNA, 16 nt, Mycobacterium avium subsp. paratuberculosis
acgaaaccgcguggcg

SEQ ID NO: 2811008 - RNA, 22 nt, Mycobacterium avium subsp. paratuberculosis
acgaaauugggcugggucacca

SEQ ID NO: 2811009 - RNA, 23 nt, Mycobacterium avium subsp. paratuberculosis
acgaaauugggcugggucaccac

SEQ ID NO: 2811010 - RNA, 16 nt, Mycobacterium avium subsp. paratuberculosis
acgaacaccaccggca

SEQ ID NO: 2811011 - RNA, 13 nt, Mycobacterium avium subsp. paratuberculosis
acgaacaccggcg

SEQ ID NO: 2811012 - RNA, 16 nt, Mycobacterium avium subsp. paratuberculosis
acgaacaccggcgcga

SEQ ID NO: 2811013 - RNA, 14 nt, Mycobacterium avium subsp. paratuberculosis
acgaaccaggcgcc

SEQ ID NO: 2811014 - RNA, 16 nt, Mycobacterium avium subsp. paratuberculosis
acgaaccgguugcggg

SEQ ID NO: 2811015 - RNA, 22 nt, Mycobacterium avium subsp. paratuberculosis
acgaaccgguugcgggccgaac

SEQ ID NO: 2811016 - RNA, 13 nt, Mycobacterium avium subsp. paratuberculosis
acgaaccuggcug

SEQ ID NO: 2811017 - RNA, 14 nt, Mycobacterium avium subsp. paratuberculosis
acgaaccuggcugc

SEQ ID NO: 2811018 - RNA, 21 nt, Mycobacterium avium subsp. paratuberculosis
acgaacgccaccacggcgucg

SEQ ID NO: 2811019 - RNA, 23 nt, Mycobacterium avium subsp. paratuberculosis
acgaacgccaccacggcgucgcu

SEQ ID NO: 2811020 - RNA, 12 nt, Mycobacterium avium subsp. paratuberculosis
acgaacgccggc

SEQ ID NO: 2811021 - RNA, 12 nt, Mycobacterium avium subsp. paratuberculosis
acgaacgcggcc

SEQ ID NO: 2811022 - RNA, 17 nt, Mycobacterium avium subsp. paratuberculosis
acgaacgcggccagcgg

SEQ ID NO: 2811023 - RNA, 13 nt, Mycobacterium avium subsp. paratuberculosis
acgaacgcggccg

SEQ ID NO: 2811024 - RNA, 15 nt, Mycobacterium avium subsp. paratuberculosis
acgaacgcggcgaac

SEQ ID NO: 2811025 - RNA, 21 nt, Mycobacterium avium subsp. paratuberculosis
acgaacgcguucgucggcgcg

SEQ ID NO: 2811026 - RNA, 22 nt, Mycobacterium avium subsp. paratuberculosis
acgaacgcguucgucggcgcgu

SEQ ID NO: 2811027 - RNA, 13 nt, Mycobacterium avium subsp. paratuberculosis
acgaacggcacgu

SEQ ID NO: 2811028 - RNA, 13 nt, Mycobacterium avium subsp. paratuberculosis
acgaacggcgcga

SEQ ID NO: 2811029 - RNA, 22 nt, Mycobacterium avium subsp. paratuberculosis
acgaacgggccaagcaccggga

SEQ ID NO: 2811030 - RNA, 21 nt, Mycobacterium avium subsp. paratuberculosis
acgaacggguccuugccggcg

SEQ ID NO: 2811031 - RNA, 20 nt, Mycobacterium avium subsp. paratuberculosis
acgaacuccgagccggugga

SEQ ID NO: 2811032 - RNA, 17 nt, Mycobacterium avium subsp. paratuberculosis
acgaacucguuggcgug

SEQ ID NO: 2811033 - RNA, 21 nt, Mycobacterium avium subsp. paratuberculosis
acgaagaacuugucgucgucg

SEQ ID NO: 2811034 - RNA, 20 nt, Mycobacterium avium subsp. paratuberculosis
acgaagaaggacgccucgcg

SEQ ID NO: 2811035 - RNA, 14 nt, Mycobacterium avium subsp. paratuberculosis
acgaagaccggguc

SEQ ID NO: 2811036 - RNA, 20 nt, Mycobacterium avium subsp. paratuberculosis
acgaagacguacggaugccc

SEQ ID NO: 2811037 - RNA, 18 nt, Mycobacterium avium subsp. paratuberculosis
acgaagaugaucagcgcg

SEQ ID NO: 2811038 - RNA, 19 nt, Mycobacterium avium subsp. paratuberculosis
acgaagaugaucagcgcgc

SEQ ID NO: 2811039 - RNA, 22 nt, Mycobacterium avium subsp. paratuberculosis
acgaagaugaucagcgcgccca

SEQ ID NO: 2811040 - RNA, 17 nt, Mycobacterium avium subsp. paratuberculosis
acgaagaugcgcccggu

SEQ ID NO: 2811041 - RNA, 14 nt, Mycobacterium avium subsp. paratuberculosis
acgaagcggccggg

SEQ ID NO: 2811042 - RNA, 15 nt, Mycobacterium avium subsp. paratuberculosis
acgaagcggccgggg

SEQ ID NO: 2811043 - RNA, 19 nt, Mycobacterium avium subsp. paratuberculosis
acgaagcuggcgaacagca

SEQ ID NO: 2811044 - RNA, 16 nt, Mycobacterium avium subsp. paratuberculosis
acgaaggccgccgggu

SEQ ID NO: 2811045 - RNA, 13 nt, Mycobacterium avium subsp. paratuberculosis
acgaaguacagcg

SEQ ID NO: 2811046 - RNA, 20 nt, Mycobacterium avium subsp. paratuberculosis
acgaaguagaagaucagcgc

SEQ ID NO: 2811047 - RNA, 12 nt, Mycobacterium avium subsp. paratuberculosis
acgaagucgacc

SEQ ID NO: 2811048 - RNA, 17 nt, Mycobacterium avium subsp. paratuberculosis
acgaagucgaccgcggc

SEQ ID NO: 2811049 - RNA, 13 nt, Mycobacterium avium subsp. paratuberculosis
acgaagucgacgg

SEQ ID NO: 2811050 - RNA, 15 nt, Mycobacterium avium subsp. paratuberculosis
acgaagucgacggcg

SEQ ID NO: 2811051 - RNA, 22 nt, Mycobacterium avium subsp. paratuberculosis
acgaauacccuccgggcggcac

SEQ ID NO: 2811052 - RNA, 20 nt, Mycobacterium avium subsp. paratuberculosis
acgaauccggugaccgccuc

SEQ ID NO: 2811053 - RNA, 23 nt, Mycobacterium avium subsp. paratuberculosis
acgaaucgucgccguccaacagg

SEQ ID NO: 2811054 - RNA, 14 nt, Mycobacterium avium subsp. paratuberculosis
acgaauuccgcacc

SEQ ID NO: 2811055 - RNA, 17 nt, Mycobacterium avium subsp. paratuberculosis
acgaauugccgguggug

SEQ ID NO: 2811056 - RNA, 19 nt, Mycobacterium avium subsp. paratuberculosis
acgacaccaccgugcuggc

SEQ ID NO: 2811057 - RNA, 15 nt, Mycobacterium avium subsp. paratuberculosis
acgacaccacggucg

SEQ ID NO: 2811058 - RNA, 22 nt, Mycobacterium avium subsp. paratuberculosis
acgacaccacggucgccgcgcc

SEQ ID NO: 2811059 - RNA, 15 nt, Mycobacterium avium subsp. paratuberculosis
acgacaccagcgucg

SEQ ID NO: 2811060 - RNA, 14 nt, Mycobacterium avium subsp. paratuberculosis
acgacaccgacgac

SEQ ID NO: 2811061 - RNA, 21 nt, Mycobacterium avium subsp. paratuberculosis
acgacacguggaccgagcgcg

SEQ ID NO: 2811062 - RNA, 16 nt, Mycobacterium avium subsp. paratuberculosis
acgacaggucgagcac

SEQ ID NO: 2811063 - RNA, 18 nt, Mycobacterium avium subsp. paratuberculosis
acgacaggucgagcacca

SEQ ID NO: 2811064 - RNA, 20 nt, Mycobacterium avium subsp. paratuberculosis
acgacauccagaugcccagc

SEQ ID NO: 2811065 - RNA, 13 nt, Mycobacterium avium subsp. paratuberculosis
acgacauccccgc

SEQ ID NO: 2811066 - RNA, 20 nt, Mycobacterium avium subsp. paratuberculosis
acgacauccuggguugacgc

SEQ ID NO: 2811067 - RNA, 17 nt, Mycobacterium avium subsp. paratuberculosis
acgacaucucgacggug

SEQ ID NO: 2811068 - RNA, 20 nt, Mycobacterium avium subsp. paratuberculosis
acgacaucucgacggugacc

SEQ ID NO: 2811069 - RNA, 19 nt, Mycobacterium avium subsp. paratuberculosis
acgaccaccaggagcaccu

SEQ ID NO: 2811070 - RNA, 20 nt, Mycobacterium avium subsp. paratuberculosis
acgaccaccaggagcaccug

SEQ ID NO: 2811071 - RNA, 19 nt, Mycobacterium avium subsp. paratuberculosis
acgacggcgccgcgucgga

SEQ ID NO: 2811072 - RNA, 13 nt, Mycobacterium avium subsp. paratuberculosis
acgacggcgcugg

SEQ ID NO: 2811073 - RNA, 20 nt, Mycobacterium avium subsp. paratuberculosis
acgacggcgcuggccgcggc

SEQ ID NO: 2811074 - RNA, 23 nt, Mycobacterium avium subsp. paratuberculosis
acgacggggaacucggugaugcc

SEQ ID NO: 2811075 - RNA, 16 nt, Mycobacterium avium subsp. paratuberculosis
acgacggucaccggca

SEQ ID NO: 2811076 - RNA, 17 nt, Mycobacterium avium subsp. paratuberculosis
acgacggucaccggcag

SEQ ID NO: 2811077 - RNA, 19 nt, Mycobacterium avium subsp. paratuberculosis
acgacggucaccggcaggc

SEQ ID NO: 2811078 - RNA, 18 nt, Mycobacterium avium subsp. paratuberculosis
acgacggucacggccgcc

SEQ ID NO: 2811079 - RNA, 20 nt, Mycobacterium avium subsp. paratuberculosis
acgacggucacggccgccag

SEQ ID NO: 2811080 - RNA, 17 nt, Mycobacterium avium subsp. paratuberculosis
acgacggucuucccgcc

SEQ ID NO: 2811081 - RNA, 19 nt, Mycobacterium avium subsp. paratuberculosis
acgacggucuucccgccgc

SEQ ID NO: 2811082 - RNA, 14 nt, Mycobacterium avium subsp. paratuberculosis
acgacggugcgccc

SEQ ID NO: 2811083 - RNA, 16 nt, Mycobacterium avium subsp. paratuberculosis
acgacggugcgcccgu

SEQ ID NO: 2811084 - RNA, 17 nt, Mycobacterium avium subsp. paratuberculosis
acgacguacccccgcac

SEQ ID NO: 2811085 - RNA, 17 nt, Mycobacterium avium subsp. paratuberculosis
acgacguccgggccgcc

SEQ ID NO: 2811086 - RNA, 19 nt, Mycobacterium avium subsp. paratuberculosis
acgacguccgggccgccuc

SEQ ID NO: 2811087 - RNA, 16 nt, Mycobacterium avium subsp. paratuberculosis
acgacguccucgacga

SEQ ID NO: 2811088 - RNA, 12 nt, Mycobacterium avium subsp. paratuberculosis
acgacgucgacc

SEQ ID NO: 2811089 - RNA, 15 nt, Mycobacterium avium subsp. paratuberculosis
acgacgucgacgacc

SEQ ID NO: 2811090 - RNA, 18 nt, Mycobacterium avium subsp. paratuberculosis
acgacgucgaugugcucg

SEQ ID NO: 2811091 - RNA, 13 nt, Mycobacterium avium subsp. paratuberculosis
acgacgucgccac

SEQ ID NO: 2811092 - RNA, 15 nt, Mycobacterium avium subsp. paratuberculosis
acgacgucugggccg

SEQ ID NO: 2811093 - RNA, 15 nt, Mycobacterium avium subsp. paratuberculosis
acgacgugacgaccu

SEQ ID NO: 2811094 - RNA, 21 nt, Mycobacterium avium subsp. paratuberculosis
acgacguugcgggccaggucg

SEQ ID NO: 2811095 - RNA, 15 nt, Mycobacterium avium subsp. paratuberculosis
acgacguuggccagc

SEQ ID NO: 2811096 - RNA, 21 nt, Mycobacterium avium subsp. paratuberculosis
acgacguuggccagcaccgcg

SEQ ID NO: 2811097 - RNA, 13 nt, Mycobacterium avium subsp. paratuberculosis
acgacuccuggcc

SEQ ID NO: 2811098 - RNA, 19 nt, Mycobacterium avium subsp. paratuberculosis
acgacucggccuccgcgcg

SEQ ID NO: 2811099 - RNA, 23 nt, Mycobacterium avium subsp. paratuberculosis
acgacucggccuccgcgcgcggc

SEQ ID NO: 2811100 - RNA, 20 nt, Mycobacterium avium subsp. paratuberculosis
acgacucguucgacgccggu

SEQ ID NO: 2811101 - RNA, 21 nt, Mycobacterium avium subsp. paratuberculosis
acgacucguucgacgccggug

SEQ ID NO: 2811102 - RNA, 22 nt, Mycobacterium avium subsp. paratuberculosis
acgacucguucgacgccgguga

SEQ ID NO: 2811103 - RNA, 13 nt, Mycobacterium avium subsp. paratuberculosis
acgacucuuccag

SEQ ID NO: 2811104 - RNA, 17 nt, Mycobacterium avium subsp. paratuberculosis
acgacugcgcggccggc

SEQ ID NO: 2811105 - RNA, 13 nt, Mycobacterium avium subsp. paratuberculosis
acgacuggcggcg

SEQ ID NO: 2811106 - RNA, 14 nt, Mycobacterium avium subsp. paratuberculosis
acgacuggcggcgg

SEQ ID NO: 2811107 - RNA, 20 nt, Mycobacterium avium subsp. paratuberculosis
acgacuucacaggccgccuc

SEQ ID NO: 2811108 - RNA, 13 nt, Mycobacterium avium subsp. paratuberculosis
acgagaaggcggc

SEQ ID NO: 2811109 - RNA, 14 nt, Mycobacterium avium subsp. paratuberculosis
acgagaaggcggcg

SEQ ID NO: 2811110 - RNA, 19 nt, Mycobacterium avium subsp. paratuberculosis
acgagagcggaucggcggc

SEQ ID NO: 2811111 - RNA, 20 nt, Mycobacterium avium subsp. paratuberculosis
acgagagcggaucggcggcg

SEQ ID NO: 2811112 - RNA, 23 nt, Mycobacterium avium subsp. paratuberculosis
acgagaucgguuggcucgcagau

SEQ ID NO: 2811113 - RNA, 17 nt, Mycobacterium avium subsp. paratuberculosis
acgagaugccccaggcg

SEQ ID NO: 2811114 - RNA, 14 nt, Mycobacterium avium subsp. paratuberculosis
acgagcacccagaa

SEQ ID NO: 2811115 - RNA, 23 nt, Mycobacterium avium subsp. paratuberculosis
acgagcacccagaaacaccaucg

SEQ ID NO: 2811116 - RNA, 17 nt, Mycobacterium avium subsp. paratuberculosis
acgagcagacccgccgc

SEQ ID NO: 2811117 - RNA, 23 nt, Mycobacterium avium subsp. paratuberculosis
acgagcaggcugaucucggcggu

SEQ ID NO: 2811118 - RNA, 13 nt, Mycobacterium avium subsp. paratuberculosis
acgagcccagccg

SEQ ID NO: 2811119 - RNA, 16 nt, Mycobacterium avium subsp. paratuberculosis
acgagcccagccgucg

SEQ ID NO: 2811120 - RNA, 14 nt, Mycobacterium avium subsp. paratuberculosis
acgagcccgccggc

SEQ ID NO: 2811121 - RNA, 15 nt, Mycobacterium avium subsp. paratuberculosis
acgagcccgccggcg

SEQ ID NO: 2811122 - RNA, 17 nt, Mycobacterium avium subsp. paratuberculosis
acgagcccgccggcggg

SEQ ID NO: 2811123 - RNA, 18 nt, Mycobacterium avium subsp. paratuberculosis
acgagcccgccggcgggu

SEQ ID NO: 2811124 - RNA, 14 nt, Mycobacterium avium subsp. paratuberculosis
acgagcccgcgccc

SEQ ID NO: 2811125 - RNA, 11 nt, Mycobacterium avium subsp. paratuberculosis
acgagccggac

SEQ ID NO: 2811126 - RNA, 19 nt, Mycobacterium avium subsp. paratuberculosis
acgagcgaacacgugcagc

SEQ ID NO: 2811127 - RNA, 14 nt, Mycobacterium avium subsp. paratuberculosis
acgagcgcgccgag

SEQ ID NO: 2811128 - RNA, 14 nt, Mycobacterium avium subsp. paratuberculosis
acgagcucaccgcc

SEQ ID NO: 2811129 - RNA, 16 nt, Mycobacterium avium subsp. paratuberculosis
acgaggcacggcccgc

SEQ ID NO: 2811130 - RNA, 21 nt, Mycobacterium avium subsp. paratuberculosis
acgaggcacggcccgcucggg

SEQ ID NO: 2811131 - RNA, 19 nt, Mycobacterium avium subsp. paratuberculosis
acgaggccagggcccgcag

SEQ ID NO: 2811132 - RNA, 13 nt, Mycobacterium avium subsp. paratuberculosis
acgaggccgggcu

SEQ ID NO: 2811133 - RNA, 14 nt, Mycobacterium avium subsp. paratuberculosis
acgaggccgggcug

SEQ ID NO: 2811134 - RNA, 19 nt, Mycobacterium avium subsp. paratuberculosis
acgaggcgaguaaggccga

SEQ ID NO: 2811135 - RNA, 22 nt, Mycobacterium avium subsp. paratuberculosis
acgaggcgaguaaggccgaggc

SEQ ID NO: 2811136 - RNA, 22 nt, Mycobacterium avium subsp. paratuberculosis
acgaggcgggugaggacgcccg

SEQ ID NO: 2811137 - RNA, 14 nt, Mycobacterium avium subsp. paratuberculosis
acgaggcgugcagc

SEQ ID NO: 2811138 - RNA, 20 nt, Mycobacterium avium subsp. paratuberculosis
acgaggcgugcagcccgcau

SEQ ID NO: 2811139 - RNA, 18 nt, Mycobacterium avium subsp. paratuberculosis
acgaggggcagcagcgcc

SEQ ID NO: 2811140 - RNA, 17 nt, Mycobacterium avium subsp. paratuberculosis
acgaggugaacgccgca

SEQ ID NO: 2811141 - RNA, 13 nt, Mycobacterium avium subsp. paratuberculosis
acgaggugaccgg

SEQ ID NO: 2811142 - RNA, 19 nt, Mycobacterium avium subsp. paratuberculosis
acgaggugaugccguccag

SEQ ID NO: 2811143 - RNA, 21 nt, Mycobacterium avium subsp. paratuberculosis
acgaggugaugccguccagca

SEQ ID NO: 2811144 - RNA, 18 nt, Mycobacterium avium subsp. paratuberculosis
acgagucccaugggcugc

SEQ ID NO: 2811145 - RNA, 22 nt, Mycobacterium avium subsp. paratuberculosis
acgaguuucccgucgucgaugc

SEQ ID NO: 2811146 - RNA, 20 nt, Mycobacterium avium subsp. paratuberculosis
acgauaucggccgcggggcc

SEQ ID NO: 2811147 - RNA, 13 nt, Mycobacterium avium subsp. paratuberculosis
acgaucaccacca

SEQ ID NO: 2811148 - RNA, 16 nt, Mycobacterium avium subsp. paratuberculosis
acgaucaccaccaccg

SEQ ID NO: 2811149 - RNA, 13 nt, Mycobacterium avium subsp. paratuberculosis
acgaucaccagac

SEQ ID NO: 2811150 - RNA, 14 nt, Mycobacterium avium subsp. paratuberculosis
acgaucaccccgac

SEQ ID NO: 2811151 - RNA, 21 nt, Mycobacterium avium subsp. paratuberculosis
acgaucaccuuguugcgggcg

SEQ ID NO: 2811152 - RNA, 22 nt, Mycobacterium avium subsp. paratuberculosis
acgaucagcacgucgcggcccu

SEQ ID NO: 2811153 - RNA, 17 nt, Mycobacterium avium subsp. paratuberculosis
acgaucagcagaugcgu

SEQ ID NO: 2811154 - RNA, 13 nt, Mycobacterium avium subsp. paratuberculosis
acgaucagcagcc

SEQ ID NO: 2811155 - RNA, 16 nt, Mycobacterium avium subsp. paratuberculosis
acgaucagcgcgucga

SEQ ID NO: 2811156 - RNA, 20 nt, Mycobacterium avium subsp. paratuberculosis
acgcacgaaaccgcguggcg

SEQ ID NO: 2811157 - RNA, 12 nt, Mycobacterium avium subsp. paratuberculosis
acgcacgccggc

SEQ ID NO: 2811158 - RNA, 14 nt, Mycobacterium avium subsp. paratuberculosis
acgcacgccggcgg

SEQ ID NO: 2811159 - RNA, 23 nt, Mycobacterium avium subsp. paratuberculosis
acgcacgggcggcgggggcgaga

SEQ ID NO: 2811160 - RNA, 19 nt, Mycobacterium avium subsp. paratuberculosis
acgcagaacucgucgccac

SEQ ID NO: 2811161 - RNA, 16 nt, Mycobacterium avium subsp. paratuberculosis
acgcagaucuugugcc

SEQ ID NO: 2811162 - RNA, 20 nt, Mycobacterium avium subsp. paratuberculosis
acgcagaucuugugccagcc

SEQ ID NO: 2811163 - RNA, 21 nt, Mycobacterium avium subsp. paratuberculosis
acgcagaucuugugccagccg

SEQ ID NO: 2811164 - RNA, 13 nt, Mycobacterium avium subsp. paratuberculosis
acgcagccgcgcc

SEQ ID NO: 2811165 - RNA, 18 nt, Mycobacterium avium subsp. paratuberculosis
acgcagcgaucggcggcu

SEQ ID NO: 2811166 - RNA, 19 nt, Mycobacterium avium subsp. paratuberculosis
acgcagcgcauccgacacc

SEQ ID NO: 2811167 - RNA, 15 nt, Mycobacterium avium subsp. paratuberculosis
acgcagcggcgucac

SEQ ID NO: 2811168 - RNA, 16 nt, Mycobacterium avium subsp. paratuberculosis
acgcagcggcgucacg

SEQ ID NO: 2811169 - RNA, 19 nt, Mycobacterium avium subsp. paratuberculosis
acgcagcggugcagccccg

SEQ ID NO: 2811170 - RNA, 12 nt, Mycobacterium avium subsp. paratuberculosis
acgcagcuggcc

SEQ ID NO: 2811171 - RNA, 18 nt, Mycobacterium avium subsp. paratuberculosis
acgcaggcguccagggcc

SEQ ID NO: 2811172 - RNA, 20 nt, Mycobacterium avium subsp. paratuberculosis
acgcaggcguccagggccac

SEQ ID NO: 2811173 - RNA, 17 nt, Mycobacterium avium subsp. paratuberculosis
acgcaggcguggcccag

SEQ ID NO: 2811174 - RNA, 22 nt, Mycobacterium avium subsp. paratuberculosis
acgcaggcguggcccagccggu

SEQ ID NO: 2811175 - RNA, 14 nt, Mycobacterium avium subsp. paratuberculosis
acgcagguccagga

SEQ ID NO: 2811176 - RNA, 15 nt, Mycobacterium avium subsp. paratuberculosis
acgcaggugcgccgc

SEQ ID NO: 2811177 - RNA, 16 nt, Mycobacterium avium subsp. paratuberculosis
acgcaggugcgccgcu

SEQ ID NO: 2811178 - RNA, 17 nt, Mycobacterium avium subsp. paratuberculosis
acgcaggugcgccgcuc

SEQ ID NO: 2811179 - RNA, 17 nt, Mycobacterium avium subsp. paratuberculosis
acgcagguuucucgacc

SEQ ID NO: 2811180 - RNA, 16 nt, Mycobacterium avium subsp. paratuberculosis
acgcagugccgcacca

SEQ ID NO: 2811181 - RNA, 19 nt, Mycobacterium avium subsp. paratuberculosis
acgcagugccgcaccagca

SEQ ID NO: 2811182 - RNA, 21 nt, Mycobacterium avium subsp. paratuberculosis
acgcagugccgcaccagcacc

SEQ ID NO: 2811183 - RNA, 20 nt, Mycobacterium avium subsp. paratuberculosis
acgcaucagggccagccgau

SEQ ID NO: 2811184 - RNA, 14 nt, Mycobacterium avium subsp. paratuberculosis
acgcaucgccgaga

SEQ ID NO: 2811185 - RNA, 12 nt, Mycobacterium avium subsp. paratuberculosis
acgcaucggcgc

SEQ ID NO: 2811186 - RNA, 15 nt, Mycobacterium avium subsp. paratuberculosis
acgcauguccgccgu

SEQ ID NO: 2811187 - RNA, 16 nt, Mycobacterium avium subsp. paratuberculosis
acgcauguccgccguc

SEQ ID NO: 2811188 - RNA, 20 nt, Mycobacterium avium subsp. paratuberculosis
acgcauguccgccgucaucg

SEQ ID NO: 2811189 - RNA, 16 nt, Mycobacterium avium subsp. paratuberculosis
acgccaacugguccug

SEQ ID NO: 2811190 - RNA, 22 nt, Mycobacterium avium subsp. paratuberculosis
acgccaacugguccugcggcug

SEQ ID NO: 2811191 - RNA, 23 nt, Mycobacterium avium subsp. paratuberculosis
acgccacaaacagcgcggccgga

SEQ ID NO: 2811192 - RNA, 12 nt, Mycobacterium avium subsp. paratuberculosis
acgccaccacgg

SEQ ID NO: 2811193 - RNA, 17 nt, Mycobacterium avium subsp. paratuberculosis
acgccaccacggcgucg

SEQ ID NO: 2811194 - RNA, 22 nt, Mycobacterium avium subsp. paratuberculosis
acgccaccaucgaguaggccca

SEQ ID NO: 2811195 - RNA, 12 nt, Mycobacterium avium subsp. paratuberculosis
acgccacgcguc

SEQ ID NO: 2811196 - RNA, 20 nt, Mycobacterium avium subsp. paratuberculosis
acgccacgcgucaggcgucg

SEQ ID NO: 2811197 - RNA, 22 nt, Mycobacterium avium subsp. paratuberculosis
acgccacgcgucaggcgucgua

SEQ ID NO: 2811198 - RNA, 12 nt, Mycobacterium avium subsp. paratuberculosis
acgccacggcga

SEQ ID NO: 2811199 - RNA, 14 nt, Mycobacterium avium subsp. paratuberculosis
acgccacggcgaac

SEQ ID NO: 2811200 - RNA, 22 nt, Mycobacterium avium subsp. paratuberculosis
acgccacggggcugcgggccag

SEQ ID NO: 2811201 - RNA, 15 nt, Mycobacterium avium subsp. paratuberculosis
acgccacucgucgac

SEQ ID NO: 2811202 - RNA, 17 nt, Mycobacterium avium subsp. paratuberculosis
acgccacucgucgacgu

SEQ ID NO: 2811203 - RNA, 18 nt, Mycobacterium avium subsp. paratuberculosis
acgccagaugcgccgcgg

SEQ ID NO: 2811204 - RNA, 13 nt, Mycobacterium avium subsp. paratuberculosis
acgccagcacgug

SEQ ID NO: 2811205 - RNA, 20 nt, Mycobacterium avium subsp. paratuberculosis
acgccagcacguggccgggc

SEQ ID NO: 2811206 - RNA, 21 nt, Mycobacterium avium subsp. paratuberculosis
acgccagcacguggccgggcu

SEQ ID NO: 2811207 - RNA, 15 nt, Mycobacterium avium subsp. paratuberculosis
acgccagcagcugcg

SEQ ID NO: 2811208 - RNA, 16 nt, Mycobacterium avium subsp. paratuberculosis
acgccagcaucgagau

SEQ ID NO: 2811209 - RNA, 22 nt, Mycobacterium avium subsp. paratuberculosis
acgccagcaugaucaccgccag

SEQ ID NO: 2811210 - RNA, 11 nt, Mycobacterium avium subsp. paratuberculosis
acgccagccag

SEQ ID NO: 2811211 - RNA, 15 nt, Mycobacterium avium subsp. paratuberculosis
acgccagccaggcga

SEQ ID NO: 2811212 - RNA, 16 nt, Mycobacterium avium subsp. paratuberculosis
acgccagccaggcgau

SEQ ID NO: 2811213 - RNA, 17 nt, Mycobacterium avium subsp. paratuberculosis
acgccagccggguggcc

SEQ ID NO: 2811214 - RNA, 19 nt, Mycobacterium avium subsp. paratuberculosis
acgccagccggguggcccg

SEQ ID NO: 2811215 - RNA, 14 nt, Mycobacterium avium subsp. paratuberculosis
acgccagcgccgca

SEQ ID NO: 2811216 - RNA, 21 nt, Mycobacterium avium subsp. paratuberculosis
acgccagcgccgcaacggcuc

SEQ ID NO: 2811217 - RNA, 14 nt, Mycobacterium avium subsp. paratuberculosis
acgccagcgcgacc

SEQ ID NO: 2811218 - RNA, 22 nt, Mycobacterium avium subsp. paratuberculosis
acgccagcgcgacccgcucgac

SEQ ID NO: 2811219 - RNA, 12 nt, Mycobacterium avium subsp. paratuberculosis
acgccagcggca

SEQ ID NO: 2811220 - RNA, 14 nt, Mycobacterium avium subsp. paratuberculosis
acgccagcggcagc

SEQ ID NO: 2811221 - RNA, 17 nt, Mycobacterium avium subsp. paratuberculosis
acgccagcggcagcgcc

SEQ ID NO: 2811222 - RNA, 18 nt, Mycobacterium avium subsp. paratuberculosis
acgccagcggcagcgcca

SEQ ID NO: 2811223 - RNA, 21 nt, Mycobacterium avium subsp. paratuberculosis
acgccagcggcagcgccagcg

SEQ ID NO: 2811224 - RNA, 13 nt, Mycobacterium avium subsp. paratuberculosis
acgccagcgggcc

SEQ ID NO: 2811225 - RNA, 23 nt, Mycobacterium avium subsp. paratuberculosis
acgccagcgggccgugccgccau

SEQ ID NO: 2811226 - RNA, 14 nt, Mycobacterium avium subsp. paratuberculosis
acgccagcgugacg

SEQ ID NO: 2811227 - RNA, 15 nt, Mycobacterium avium subsp. paratuberculosis
acgccagcgugacgc

SEQ ID NO: 2811228 - RNA, 22 nt, Mycobacterium avium subsp. paratuberculosis
acgccagcgugacgcccggcgc

SEQ ID NO: 2811229 - RNA, 23 nt, Mycobacterium avium subsp. paratuberculosis
acgccagcgugacgcccggcgcc

SEQ ID NO: 2811230 - RNA, 20 nt, Mycobacterium avium subsp. paratuberculosis
acgccagcgugacgccgggc

SEQ ID NO: 2811231 - RNA, 17 nt, Mycobacterium avium subsp. paratuberculosis
acgccagcgugacgcuc

SEQ ID NO: 2811232 - RNA, 17 nt, Mycobacterium avium subsp. paratuberculosis
acgccagcugccgcgac

SEQ ID NO: 2811233 - RNA, 16 nt, Mycobacterium avium subsp. paratuberculosis
acgccagcugcggauc

SEQ ID NO: 2811234 - RNA, 16 nt, Mycobacterium avium subsp. paratuberculosis
acgccagcugggcagc

SEQ ID NO: 2811235 - RNA, 21 nt, Mycobacterium avium subsp. paratuberculosis
acgccaguggcugcacgucac

SEQ ID NO: 2811236 - RNA, 18 nt, Mycobacterium avium subsp. paratuberculosis
acgccaguguggccgcgg

SEQ ID NO: 2811237 - RNA, 20 nt, Mycobacterium avium subsp. paratuberculosis
acgccaguguggccgcggcg

SEQ ID NO: 2811238 - RNA, 22 nt, Mycobacterium avium subsp. paratuberculosis
acgccaguguggccgcggcggc

SEQ ID NO: 2811239 - RNA, 18 nt, Mycobacterium avium subsp. paratuberculosis
acgccaguucgucggccg

SEQ ID NO: 2811240 - RNA, 20 nt, Mycobacterium avium subsp. paratuberculosis
acgccaguucgucggccguc

SEQ ID NO: 2811241 - RNA, 23 nt, Mycobacterium avium subsp. paratuberculosis
acgccgacguaggacagcaccac

SEQ ID NO: 2811242 - RNA, 17 nt, Mycobacterium avium subsp. paratuberculosis
acgccgacuagcgcggc

SEQ ID NO: 2811243 - RNA, 13 nt, Mycobacterium avium subsp. paratuberculosis
acgccgagcagca

SEQ ID NO: 2811244 - RNA, 14 nt, Mycobacterium avium subsp. paratuberculosis
acgccgagcagcac

SEQ ID NO: 2811245 - RNA, 18 nt, Mycobacterium avium subsp. paratuberculosis
acgccgagcagcaccggc

SEQ ID NO: 2811246 - RNA, 20 nt, Mycobacterium avium subsp. paratuberculosis
acgccgagcagcaccggcau

SEQ ID NO: 2811247 - RNA, 21 nt, Mycobacterium avium subsp. paratuberculosis
acgccgagcagcaccggcaug

SEQ ID NO: 2811248 - RNA, 17 nt, Mycobacterium avium subsp. paratuberculosis
acgccgagcagcucagc

SEQ ID NO: 2811249 - RNA, 19 nt, Mycobacterium avium subsp. paratuberculosis
acgccgaggaggccgcggc

SEQ ID NO: 2811250 - RNA, 13 nt, Mycobacterium avium subsp. paratuberculosis
acgccgaggcgca

SEQ ID NO: 2811251 - RNA, 16 nt, Mycobacterium avium subsp. paratuberculosis
acgccgaggcgugccg

SEQ ID NO: 2811252 - RNA, 18 nt, Mycobacterium avium subsp. paratuberculosis
acgccgagggcggcggcu

SEQ ID NO: 2811253 - RNA, 20 nt, Mycobacterium avium subsp. paratuberculosis
acgccgagggugccggccac

SEQ ID NO: 2811254 - RNA, 21 nt, Mycobacterium avium subsp. paratuberculosis
acgccgagggugccggccacc

SEQ ID NO: 2811255 - RNA, 18 nt, Mycobacterium avium subsp. paratuberculosis
acgccgaucaccggcacg

SEQ ID NO: 2811256 - RNA, 20 nt, Mycobacterium avium subsp. paratuberculosis
acgccgaucaccggcacgug

SEQ ID NO: 2811257 - RNA, 17 nt, Mycobacterium avium subsp. paratuberculosis
acgccgauccgcugcgg

SEQ ID NO: 2811258 - RNA, 18 nt, Mycobacterium avium subsp. paratuberculosis
acgccgaucgggaugugc

SEQ ID NO: 2811259 - RNA, 14 nt, Mycobacterium avium subsp. paratuberculosis
acgccgaugaucug

SEQ ID NO: 2811260 - RNA, 23 nt, Mycobacterium avium subsp. paratuberculosis
acgccgaugcgguugaucaacgg

SEQ ID NO: 2811261 - RNA, 21 nt, Mycobacterium avium subsp. paratuberculosis
acgccgauggccugguggccc

SEQ ID NO: 2811262 - RNA, 17 nt, Mycobacterium avium subsp. paratuberculosis
acgccgauggugaccuc

SEQ ID NO: 2811263 - RNA, 19 nt, Mycobacterium avium subsp. paratuberculosis
acgccgauggugaccucgg

SEQ ID NO: 2811264 - RNA, 21 nt, Mycobacterium avium subsp. paratuberculosis
acgccgauggugaccucgguc

SEQ ID NO: 2811265 - RNA, 20 nt, Mycobacterium avium subsp. paratuberculosis
acgccgaugugcucggucaa

SEQ ID NO: 2811266 - RNA, 21 nt, Mycobacterium avium subsp. paratuberculosis
acgccgaugugcucggucaac

SEQ ID NO: 2811267 - RNA, 20 nt, Mycobacterium avium subsp. paratuberculosis
acgccgauguuuugggugcu

SEQ ID NO: 2811268 - RNA, 22 nt, Mycobacterium avium subsp. paratuberculosis
acgccgauguuuugggugcuuu

SEQ ID NO: 2811269 - RNA, 13 nt, Mycobacterium avium subsp. paratuberculosis
acgccgcaccgca

SEQ ID NO: 2811270 - RNA, 21 nt, Mycobacterium avium subsp. paratuberculosis
acgccgcacgaauugccggug

SEQ ID NO: 2811271 - RNA, 13 nt, Mycobacterium avium subsp. paratuberculosis
acgccgcacgcga

SEQ ID NO: 2811272 - RNA, 14 nt, Mycobacterium avium subsp. paratuberculosis
acgccgcacgcgac

SEQ ID NO: 2811273 - RNA, 22 nt, Mycobacterium avium subsp. paratuberculosis
acgccgcacgcgaccgcgucga

SEQ ID NO: 2811274 - RNA, 13 nt, Mycobacterium avium subsp. paratuberculosis
acgccgcccaggc

SEQ ID NO: 2811275 - RNA, 19 nt, Mycobacterium avium subsp. paratuberculosis
acgccgcccaggccccggc

SEQ ID NO: 2811276 - RNA, 24 nt, Mycobacterium avium subsp. paratuberculosis
acgccgcccaggccccggccgagc

SEQ ID NO: 2811277 - RNA, 14 nt, Mycobacterium avium subsp. paratuberculosis
acgccgcccccgcc

SEQ ID NO: 2811278 - RNA, 18 nt, Mycobacterium avium subsp. paratuberculosis
acgccgccgaaccccagc

SEQ ID NO: 2811279 - RNA, 11 nt, Mycobacterium avium subsp. paratuberculosis
acgccgccgac

SEQ ID NO: 2811280 - RNA, 17 nt, Mycobacterium avium subsp. paratuberculosis
acgccgccgacagcacc

SEQ ID NO: 2811281 - RNA, 13 nt, Mycobacterium avium subsp. paratuberculosis
acgccgccgccga

SEQ ID NO: 2811282 - RNA, 14 nt, Mycobacterium avium subsp. paratuberculosis
acgccgccgccgag

SEQ ID NO: 2811283 - RNA, 20 nt, Mycobacterium avium subsp. paratuberculosis
acgccgccgccgagcucggc

SEQ ID NO: 2811284 - RNA, 21 nt, Mycobacterium avium subsp. paratuberculosis
acgccgccgccgagcucggcc

SEQ ID NO: 2811285 - RNA, 22 nt, Mycobacterium avium subsp. paratuberculosis
acgccgccgccgagcucggcca

SEQ ID NO: 2811286 - RNA, 13 nt, Mycobacterium avium subsp. paratuberculosis
acgccgccgcgaa

SEQ ID NO: 2811287 - RNA, 14 nt, Mycobacterium avium subsp. paratuberculosis
acgccgccgcgaac

SEQ ID NO: 2811288 - RNA, 20 nt, Mycobacterium avium subsp. paratuberculosis
acgccgccgcgucgucaucg

SEQ ID NO: 2811289 - RNA, 20 nt, Mycobacterium avium subsp. paratuberculosis
acgccgccggcuagacgcgc

SEQ ID NO: 2811290 - RNA, 22 nt, Mycobacterium avium subsp. paratuberculosis
acgccgccggcuagacgcgcag

SEQ ID NO: 2811291 - RNA, 14 nt, Mycobacterium avium subsp. paratuberculosis
acgccgccggggcg

SEQ ID NO: 2811292 - RNA, 20 nt, Mycobacterium avium subsp. paratuberculosis
acgccgccgguggagauggc

SEQ ID NO: 2811293 - RNA, 22 nt, Mycobacterium avium subsp. paratuberculosis
acgccgccgucguagccgcggg

SEQ ID NO: 2811294 - RNA, 13 nt, Mycobacterium avium subsp. paratuberculosis
acgccgccgugga

SEQ ID NO: 2811295 - RNA, 21 nt, Mycobacterium avium subsp. paratuberculosis
acgccgccguguaggccgcgc

SEQ ID NO: 2811296 - RNA, 22 nt, Mycobacterium avium subsp. paratuberculosis
acgccgccguguaggccgcgcu

SEQ ID NO: 2811297 - RNA, 21 nt, Mycobacterium avium subsp. paratuberculosis
acgccgccuccgacagccgca

SEQ ID NO: 2811298 - RNA, 13 nt, Mycobacterium avium subsp. paratuberculosis
acgccgccuugac

SEQ ID NO: 2811299 - RNA, 20 nt, Mycobacterium avium subsp. paratuberculosis
acgccgccuugacgccgggc

SEQ ID NO: 2811300 - RNA, 12 nt, Mycobacterium avium subsp. paratuberculosis
acgccgcgcacg

SEQ ID NO: 2811301 - RNA, 14 nt, Mycobacterium avium subsp. paratuberculosis
acgccgcgcacgac

SEQ ID NO: 2811302 - RNA, 19 nt, Mycobacterium avium subsp. paratuberculosis
acgccgcgcacgacgugga

SEQ ID NO: 2811303 - RNA, 12 nt, Mycobacterium avium subsp. paratuberculosis
acgccgcgcagc

SEQ ID NO: 2811304 - RNA, 12 nt, Mycobacterium avium subsp. paratuberculosis
acgccgcgcauc

SEQ ID NO: 2811305 - RNA, 13 nt, Mycobacterium avium subsp. paratuberculosis
acgccgcgcccgu

SEQ ID NO: 2811306 - RNA, 15 nt, Mycobacterium avium subsp. paratuberculosis
acgccgcgcccgucg

SEQ ID NO: 2811307 - RNA, 19 nt, Mycobacterium avium subsp. paratuberculosis
acgccgcgcccgucgagcg

SEQ ID NO: 2811308 - RNA, 20 nt, Mycobacterium avium subsp. paratuberculosis
acgccgcgcccgucgagcgu

SEQ ID NO: 2811309 - RNA, 22 nt, Mycobacterium avium subsp. paratuberculosis
acgccgcgcccgucgagcguca

SEQ ID NO: 2811310 - RNA, 12 nt, Mycobacterium avium subsp. paratuberculosis
acgccgcgccgc

SEQ ID NO: 2811311 - RNA, 17 nt, Mycobacterium avium subsp. paratuberculosis
acgccgcgccgcccggc

SEQ ID NO: 2811312 - RNA, 19 nt, Mycobacterium avium subsp. paratuberculosis
acgccgcgcgcagcacaaa

SEQ ID NO: 2811313 - RNA, 22 nt, Mycobacterium avium subsp. paratuberculosis
acgccgcgcucgugcugcugcu

SEQ ID NO: 2811314 - RNA, 12 nt, Mycobacterium avium subsp. paratuberculosis
acgccgcgcugg

SEQ ID NO: 2811315 - RNA, 17 nt, Mycobacterium avium subsp. paratuberculosis
acgccgcgcuugacggc

SEQ ID NO: 2811316 - RNA, 21 nt, Mycobacterium avium subsp. paratuberculosis
acgccgcgcuugacggccggg

SEQ ID NO: 2811317 - RNA, 21 nt, Mycobacterium avium subsp. paratuberculosis
acgccgcggaagccccaggcc

SEQ ID NO: 2811318 - RNA, 13 nt, Mycobacterium avium subsp. paratuberculosis
acgccgcgggagg

SEQ ID NO: 2811319 - RNA, 19 nt, Mycobacterium avium subsp. paratuberculosis
acgccgcgggaggcccagu

SEQ ID NO: 2811320 - RNA, 22 nt, Mycobacterium avium subsp. paratuberculosis
acgccgcggucgcugacccgcc

SEQ ID NO: 2811321 - RNA, 15 nt, Mycobacterium avium subsp. paratuberculosis
acgccgcggugcagc

SEQ ID NO: 2811322 - RNA, 20 nt, Mycobacterium avium subsp. paratuberculosis
acgccgcgguuggucaccag

SEQ ID NO: 2811323 - RNA, 18 nt, Mycobacterium avium subsp. paratuberculosis
acgccgcguccucgucga

SEQ ID NO: 2811324 - RNA, 20 nt, Mycobacterium avium subsp. paratuberculosis
acgccgcguccucgucgaug

SEQ ID NO: 2811325 - RNA, 24 nt, Mycobacterium avium subsp. paratuberculosis
acgcgcaccagggccgcgagcgcu

SEQ ID NO: 2811326 - RNA, 12 nt, Mycobacterium avium subsp. paratuberculosis
acgcgcacccgg

SEQ ID NO: 2811327 - RNA, 14 nt, Mycobacterium avium subsp. paratuberculosis
acgcgcaccgccac

SEQ ID NO: 2811328 - RNA, 16 nt, Mycobacterium avium subsp. paratuberculosis
acgcgcaccgccaccg

SEQ ID NO: 2811329 - RNA, 14 nt, Mycobacterium avium subsp. paratuberculosis
acgcgcagccagga

SEQ ID NO: 2811330 - RNA, 21 nt, Mycobacterium avium subsp. paratuberculosis
acgcgcagggcgaacggcgga

SEQ ID NO: 2811331 - RNA, 24 nt, Mycobacterium avium subsp. paratuberculosis
acgcgcaucaugcguuugccgucg

SEQ ID NO: 2811332 - RNA, 15 nt, Mycobacterium avium subsp. paratuberculosis
acgcgcaugcccugg

SEQ ID NO: 2811333 - RNA, 17 nt, Mycobacterium avium subsp. paratuberculosis
acgcgccaaugguuuuc

SEQ ID NO: 2811334 - RNA, 19 nt, Mycobacterium avium subsp. paratuberculosis
acgcgccacgccccggcgc

SEQ ID NO: 2811335 - RNA, 20 nt, Mycobacterium avium subsp. paratuberculosis
acgcgccacgccccggcgcc

SEQ ID NO: 2811336 - RNA, 16 nt, Mycobacterium avium subsp. paratuberculosis
acgcgccccgccggga

SEQ ID NO: 2811337 - RNA, 13 nt, Mycobacterium avium subsp. paratuberculosis
acgcgcccggcga

SEQ ID NO: 2811338 - RNA, 16 nt, Mycobacterium avium subsp. paratuberculosis
acgcgcccggcgacgc

SEQ ID NO: 2811339 - RNA, 19 nt, Mycobacterium avium subsp. paratuberculosis
acgcgcccggcgacgcggc

SEQ ID NO: 2811340 - RNA, 12 nt, Mycobacterium avium subsp. paratuberculosis
acgcgccgaucg

SEQ ID NO: 2811341 - RNA, 19 nt, Mycobacterium avium subsp. paratuberculosis
acgcgccgaucgagacgau

SEQ ID NO: 2811342 - RNA, 15 nt, Mycobacterium avium subsp. paratuberculosis
acgcgccgcacugca

SEQ ID NO: 2811343 - RNA, 16 nt, Mycobacterium avium subsp. paratuberculosis
acgcgccgcacugcac

SEQ ID NO: 2811344 - RNA, 15 nt, Mycobacterium avium subsp. paratuberculosis
acgcgccgccgagca

SEQ ID NO: 2811345 - RNA, 23 nt, Mycobacterium avium subsp. paratuberculosis
acgcgccgccgagcaacagcccg

SEQ ID NO: 2811346 - RNA, 13 nt, Mycobacterium avium subsp. paratuberculosis
acgcgccggccag

SEQ ID NO: 2811347 - RNA, 14 nt, Mycobacterium avium subsp. paratuberculosis
acgcgccggccagc

SEQ ID NO: 2811348 - RNA, 16 nt, Mycobacterium avium subsp. paratuberculosis
acgcgccggccagccg

SEQ ID NO: 2811349 - RNA, 12 nt, Mycobacterium avium subsp. paratuberculosis
acgcgccggccu

SEQ ID NO: 2811350 - RNA, 13 nt, Mycobacterium avium subsp. paratuberculosis
acgcgccggcgca

SEQ ID NO: 2811351 - RNA, 22 nt, Mycobacterium avium subsp. paratuberculosis
acgcgccggcgcacaucguggc

SEQ ID NO: 2811352 - RNA, 16 nt, Mycobacterium avium subsp. paratuberculosis
acgcgccggcgcgggc

SEQ ID NO: 2811353 - RNA, 17 nt, Mycobacterium avium subsp. paratuberculosis
acgcgccggcgcgggca

SEQ ID NO: 2811354 - RNA, 15 nt, Mycobacterium avium subsp. paratuberculosis
acgcgccggcggucg

SEQ ID NO: 2811355 - RNA, 19 nt, Mycobacterium avium subsp. paratuberculosis
acgcgccggcggucgacac

SEQ ID NO: 2811356 - RNA, 13 nt, Mycobacterium avium subsp. paratuberculosis
acgcgccgggcaa

SEQ ID NO: 2811357 - RNA, 23 nt, Mycobacterium avium subsp. paratuberculosis
acgcgccgggcaacagcgcgccg

SEQ ID NO: 2811358 - RNA, 16 nt, Mycobacterium avium subsp. paratuberculosis
acgcgccggugacccc

SEQ ID NO: 2811359 - RNA, 17 nt, Mycobacterium avium subsp. paratuberculosis
acgcgccggugaccccg

SEQ ID NO: 2811360 - RNA, 22 nt, Mycobacterium avium subsp. paratuberculosis
acgcgccggugaccccgucgaa

SEQ ID NO: 2811361 - RNA, 17 nt, Mycobacterium avium subsp. paratuberculosis
acgcgccgucggcccac

SEQ ID NO: 2811362 - RNA, 12 nt, Mycobacterium avium subsp. paratuberculosis
acgcgccgucgu

SEQ ID NO: 2811363 - RNA, 14 nt, Mycobacterium avium subsp. paratuberculosis
acgcgccgucgucg

SEQ ID NO: 2811364 - RNA, 23 nt, Mycobacterium avium subsp. paratuberculosis
acgcgccgucgucggacaccagc

SEQ ID NO: 2811365 - RNA, 18 nt, Mycobacterium avium subsp. paratuberculosis
acgcgccgucgucgucgc

SEQ ID NO: 2811366 - RNA, 13 nt, Mycobacterium avium subsp. paratuberculosis
acgcgcgaucggu

SEQ ID NO: 2811367 - RNA, 22 nt, Mycobacterium avium subsp. paratuberculosis
acgcgcgccccggucccgccgg

SEQ ID NO: 2811368 - RNA, 16 nt, Mycobacterium avium subsp. paratuberculosis
acgcgcgcccggcacc

SEQ ID NO: 2811369 - RNA, 21 nt, Mycobacterium avium subsp. paratuberculosis
acgcgcgcccggcaccgcggc

SEQ ID NO: 2811370 - RNA, 14 nt, Mycobacterium avium subsp. paratuberculosis
acgcgcgcgacggc

SEQ ID NO: 2811371 - RNA, 13 nt, Mycobacterium avium subsp. paratuberculosis
acgcgcgcgccgu

SEQ ID NO: 2811372 - RNA, 14 nt, Mycobacterium avium subsp. paratuberculosis
acgcgcgcgccguc

SEQ ID NO: 2811373 - RNA, 15 nt, Mycobacterium avium subsp. paratuberculosis
acgcgcgcgccgucu

SEQ ID NO: 2811374 - RNA, 21 nt, Mycobacterium avium subsp. paratuberculosis
acgcgcgcggcgucaggggug

SEQ ID NO: 2811375 - RNA, 16 nt, Mycobacterium avium subsp. paratuberculosis
acgcgcggaugcccag

SEQ ID NO: 2811376 - RNA, 24 nt, Mycobacterium avium subsp. paratuberculosis
acgcgcggaugcccaggccggcga

SEQ ID NO: 2811377 - RNA, 17 nt, Mycobacterium avium subsp. paratuberculosis
acgcgcgggucgucggc

SEQ ID NO: 2811378 - RNA, 24 nt, Mycobacterium avium subsp. paratuberculosis
acgcgcgggucgucggccuguccg

SEQ ID NO: 2811379 - RNA, 15 nt, Mycobacterium avium subsp. paratuberculosis
acgcgcggucgucgc

SEQ ID NO: 2811380 - RNA, 21 nt, Mycobacterium avium subsp. paratuberculosis
acgcgcggucgucgcccgucu

SEQ ID NO: 2811381 - RNA, 17 nt, Mycobacterium avium subsp. paratuberculosis
acgcgcgugacggcggg

SEQ ID NO: 2811382 - RNA, 19 nt, Mycobacterium avium subsp. paratuberculosis
acgcgcgugacggcggggc

SEQ ID NO: 2811383 - RNA, 20 nt, Mycobacterium avium subsp. paratuberculosis
acgcgcgugacggcggggcg

SEQ ID NO: 2811384 - RNA, 21 nt, Mycobacterium avium subsp. paratuberculosis
acgcgcgugacggcggggcgg

SEQ ID NO: 2811385 - RNA, 17 nt, Mycobacterium avium subsp. paratuberculosis
acgcgcucagccccagc

SEQ ID NO: 2811386 - RNA, 15 nt, Mycobacterium avium subsp. paratuberculosis
acgcgcucagcgcgg

SEQ ID NO: 2811387 - RNA, 16 nt, Mycobacterium avium subsp. paratuberculosis
acgcgcucagcgcggc

SEQ ID NO: 2811388 - RNA, 20 nt, Mycobacterium avium subsp. paratuberculosis
acgcgcucagcgcggccaca

SEQ ID NO: 2811389 - RNA, 13 nt, Mycobacterium avium subsp. paratuberculosis
acgcgcucggcga

SEQ ID NO: 2811390 - RNA, 14 nt, Mycobacterium avium subsp. paratuberculosis
acgcgcucggcgac

SEQ ID NO: 2811391 - RNA, 15 nt, Mycobacterium avium subsp. paratuberculosis
acgcgcucggcgacc

SEQ ID NO: 2811392 - RNA, 17 nt, Mycobacterium avium subsp. paratuberculosis
acgcgcucggcgaccgc

SEQ ID NO: 2811393 - RNA, 14 nt, Mycobacterium avium subsp. paratuberculosis
acgcgcugccgacg

SEQ ID NO: 2811394 - RNA, 15 nt, Mycobacterium avium subsp. paratuberculosis
acgcgcugccgacga

SEQ ID NO: 2811395 - RNA, 16 nt, Mycobacterium avium subsp. paratuberculosis
acgcgcugccgacgau

SEQ ID NO: 2811396 - RNA, 16 nt, Mycobacterium avium subsp. paratuberculosis
acgcgcugcgcgccgc

SEQ ID NO: 2811397 - RNA, 16 nt, Mycobacterium avium subsp. paratuberculosis
acgcgcugcuugaccc

SEQ ID NO: 2811398 - RNA, 20 nt, Mycobacterium avium subsp. paratuberculosis
acgcgcugcuugacccgcuc

SEQ ID NO: 2811399 - RNA, 22 nt, Mycobacterium avium subsp. paratuberculosis
acgcgcugucgcccucgaucgc

SEQ ID NO: 2811400 - RNA, 21 nt, Mycobacterium avium subsp. paratuberculosis
acgcgcuuguacaggucgacc

SEQ ID NO: 2811401 - RNA, 15 nt, Mycobacterium avium subsp. paratuberculosis
acgcggacacggccg

SEQ ID NO: 2811402 - RNA, 17 nt, Mycobacterium avium subsp. paratuberculosis
acgcggacacggccggg

SEQ ID NO: 2811403 - RNA, 18 nt, Mycobacterium avium subsp. paratuberculosis
acgcggacacggccggga

SEQ ID NO: 2811404 - RNA, 19 nt, Mycobacterium avium subsp. paratuberculosis
acgcggacagcucgccggc

SEQ ID NO: 2811405 - RNA, 21 nt, Mycobacterium avium subsp. paratuberculosis
acgcggacagcucgccggccg

SEQ ID NO: 2811406 - RNA, 17 nt, Mycobacterium avium subsp. paratuberculosis
acgcggacagggcggcg

SEQ ID NO: 2811407 - RNA, 18 nt, Mycobacterium avium subsp. paratuberculosis
acgcggacagggcggcga

SEQ ID NO: 2811408 - RNA, 19 nt, Mycobacterium avium subsp. paratuberculosis
acgcggacagggcggcgac

SEQ ID NO: 2811409 - RNA, 21 nt, Mycobacterium avium subsp. paratuberculosis
acgcggacagggcggcgaccu

SEQ ID NO: 2811410 - RNA, 14 nt, Mycobacterium avium subsp. paratuberculosis
acgcguacacggcc

SEQ ID NO: 2811411 - RNA, 16 nt, Mycobacterium avium subsp. paratuberculosis
acgcguacacggcccg

SEQ ID NO: 2811412 - RNA, 17 nt, Mycobacterium avium subsp. paratuberculosis
acgcguacacggcccgc

SEQ ID NO: 2811413 - RNA, 14 nt, Mycobacterium avium subsp. paratuberculosis
acgcguacagcgcc

SEQ ID NO: 2811414 - RNA, 12 nt, Mycobacterium avium subsp. paratuberculosis
acgcguagaacc

SEQ ID NO: 2811415 - RNA, 12 nt, Mycobacterium avium subsp. paratuberculosis
acgcgucaccgg

SEQ ID NO: 2811416 - RNA, 13 nt, Mycobacterium avium subsp. paratuberculosis
acgcgucaccgga

SEQ ID NO: 2811417 - RNA, 16 nt, Mycobacterium avium subsp. paratuberculosis
acgcgucaggcgucgu

SEQ ID NO: 2811418 - RNA, 20 nt, Mycobacterium avium subsp. paratuberculosis
acgcguccguagugcucggc

SEQ ID NO: 2811419 - RNA, 19 nt, Mycobacterium avium subsp. paratuberculosis
acgcgucgaacagccgggc

SEQ ID NO: 2811420 - RNA, 21 nt, Mycobacterium avium subsp. paratuberculosis
acgcgucgaacagccgggccg

SEQ ID NO: 2811421 - RNA, 23 nt, Mycobacterium avium subsp. paratuberculosis
acgcgucgacaguuaggucuugu

SEQ ID NO: 2811422 - RNA, 15 nt, Mycobacterium avium subsp. paratuberculosis
acgcgucgaccgccg

SEQ ID NO: 2811423 - RNA, 17 nt, Mycobacterium avium subsp. paratuberculosis
acgcgucgcccacgccg

SEQ ID NO: 2811424 - RNA, 22 nt, Mycobacterium avium subsp. paratuberculosis
acgcgucgccgugccggaccgc

SEQ ID NO: 2811425 - RNA, 23 nt, Mycobacterium avium subsp. paratuberculosis
acgcgucgcgccagcgguccagc

SEQ ID NO: 2811426 - RNA, 13 nt, Mycobacterium avium subsp. paratuberculosis
acgcgucgcggcg

SEQ ID NO: 2811427 - RNA, 18 nt, Mycobacterium avium subsp. paratuberculosis
acgcgucggcgccggauc

SEQ ID NO: 2811428 - RNA, 19 nt, Mycobacterium avium subsp. paratuberculosis
acgcgucggcgccggaucg

SEQ ID NO: 2811429 - RNA, 21 nt, Mycobacterium avium subsp. paratuberculosis
acgcgucguugucgucgccgg

SEQ ID NO: 2811430 - RNA, 22 nt, Mycobacterium avium subsp. paratuberculosis
acgcgucguugucgucgccggc

SEQ ID NO: 2811431 - RNA, 21 nt, Mycobacterium avium subsp. paratuberculosis
acgcgugcgucaucgcgcugg

SEQ ID NO: 2811432 - RNA, 20 nt, Mycobacterium avium subsp. paratuberculosis
acgcguucggacaccucggc

SEQ ID NO: 2811433 - RNA, 23 nt, Mycobacterium avium subsp. paratuberculosis
acgcguucggacaccucggccag

SEQ ID NO: 2811434 - RNA, 15 nt, Mycobacterium avium subsp. paratuberculosis
acgcguucgucggcg

SEQ ID NO: 2811435 - RNA, 18 nt, Mycobacterium avium subsp. paratuberculosis
acgcguucgucggcgcgu

SEQ ID NO: 2811436 - RNA, 19 nt, Mycobacterium avium subsp. paratuberculosis
acgcguucuccucgaacac

SEQ ID NO: 2811437 - RNA, 23 nt, Mycobacterium avium subsp. paratuberculosis
acgcguucuccucgaacaccgca

SEQ ID NO: 2811438 - RNA, 20 nt, Mycobacterium avium subsp. paratuberculosis
acgcguugcagcgccgcggc

SEQ ID NO: 2811439 - RNA, 18 nt, Mycobacterium avium subsp. paratuberculosis
acgcguuguugcucggcg

SEQ ID NO: 2811440 - RNA, 19 nt, Mycobacterium avium subsp. paratuberculosis
acgcguuguugcucggcgg

SEQ ID NO: 2811441 - RNA, 20 nt, Mycobacterium avium subsp. paratuberculosis
acgcguuguugcucggcggc

SEQ ID NO: 2811442 - RNA, 23 nt, Mycobacterium avium subsp. paratuberculosis
acgcguuguugcucggcggcccg

SEQ ID NO: 2811443 - RNA, 18 nt, Mycobacterium avium subsp. paratuberculosis
acgcuagcgugacagucg

SEQ ID NO: 2811444 - RNA, 19 nt, Mycobacterium avium subsp. paratuberculosis
acgcuagcgugacgcucgc

SEQ ID NO: 2811445 - RNA, 21 nt, Mycobacterium avium subsp. paratuberculosis
acgcuagcgugacgcucgcgu

SEQ ID NO: 2811446 - RNA, 20 nt, Mycobacterium avium subsp. paratuberculosis
acgcuauuggccgagccggg

SEQ ID NO: 2811447 - RNA, 21 nt, Mycobacterium avium subsp. paratuberculosis
acgcuauuggccgagccgggc

SEQ ID NO: 2811448 - RNA, 14 nt, Mycobacterium avium subsp. paratuberculosis
acgcucacccggcc

SEQ ID NO: 2811449 - RNA, 15 nt, Mycobacterium avium subsp. paratuberculosis
acgcucacccggccc

SEQ ID NO: 2811450 - RNA, 16 nt, Mycobacterium avium subsp. paratuberculosis
acgcucacccggccca

SEQ ID NO: 2811451 - RNA, 22 nt, Mycobacterium avium subsp. paratuberculosis
acgcucacccggcccaccggcc

SEQ ID NO: 2811452 - RNA, 14 nt, Mycobacterium avium subsp. paratuberculosis
acgcucaugcccgc

SEQ ID NO: 2811453 - RNA, 23 nt, Mycobacterium avium subsp. paratuberculosis
acgcucaugcccgccacggccag

SEQ ID NO: 2811454 - RNA, 17 nt, Mycobacterium avium subsp. paratuberculosis
acgcuccagaugcggug

SEQ ID NO: 2811455 - RNA, 20 nt, Mycobacterium avium subsp. paratuberculosis
acgcuccagaugcgguggug

SEQ ID NO: 2811456 - RNA, 19 nt, Mycobacterium avium subsp. paratuberculosis
acgcucccgguagagcggc

SEQ ID NO: 2811457 - RNA, 15 nt, Mycobacterium avium subsp. paratuberculosis
acgcucgacggccgg

SEQ ID NO: 2811458 - RNA, 16 nt, Mycobacterium avium subsp. paratuberculosis
acgcucgacggccggc

SEQ ID NO: 2811459 - RNA, 17 nt, Mycobacterium avium subsp. paratuberculosis
acgcucgacggccggcg

SEQ ID NO: 2811460 - RNA, 16 nt, Mycobacterium avium subsp. paratuberculosis
acgcucgaggccccgc

SEQ ID NO: 2811461 - RNA, 14 nt, Mycobacterium avium subsp. paratuberculosis
acgcucgcaggcga

SEQ ID NO: 2811462 - RNA, 15 nt, Mycobacterium avium subsp. paratuberculosis
acgcucgcaggcgag

SEQ ID NO: 2811463 - RNA, 17 nt, Mycobacterium avium subsp. paratuberculosis
acgcucgcaggcgagcc

SEQ ID NO: 2811464 - RNA, 20 nt, Mycobacterium avium subsp. paratuberculosis
acgcucgcaggcgagccgac

SEQ ID NO: 2811465 - RNA, 23 nt, Mycobacterium avium subsp. paratuberculosis
acgcucgcaggcgagccgacagu

SEQ ID NO: 2811466 - RNA, 21 nt, Mycobacterium avium subsp. paratuberculosis
acgcucgccaccccgcgccac

SEQ ID NO: 2811467 - RNA, 22 nt, Mycobacterium avium subsp. paratuberculosis
acgcucgccaccccgcgccacg

SEQ ID NO: 2811468 - RNA, 14 nt, Mycobacterium avium subsp. paratuberculosis
acgcucgccggcgg

SEQ ID NO: 2811469 - RNA, 15 nt, Mycobacterium avium subsp. paratuberculosis
acgcucgccggcggc

SEQ ID NO: 2811470 - RNA, 19 nt, Mycobacterium avium subsp. paratuberculosis
acgcucgccggcggccgcc

SEQ ID NO: 2811471 - RNA, 12 nt, Mycobacterium avium subsp. paratuberculosis
acgcucgcggug

SEQ ID NO: 2811472 - RNA, 22 nt, Mycobacterium avium subsp. paratuberculosis
acgcucgcgguugggccgccgg

SEQ ID NO: 2811473 - RNA, 23 nt, Mycobacterium avium subsp. paratuberculosis
acgcucgcgguugggccgccggc

SEQ ID NO: 2811474 - RNA, 23 nt, Mycobacterium avium subsp. paratuberculosis
acgcucgcguggccugggcgacc

SEQ ID NO: 2811475 - RNA, 18 nt, Mycobacterium avium subsp. paratuberculosis
acgcucggcaggcgggga

SEQ ID NO: 2811476 - RNA, 18 nt, Mycobacterium avium subsp. paratuberculosis
acgcucggccagggugac

SEQ ID NO: 2811477 - RNA, 19 nt, Mycobacterium avium subsp. paratuberculosis
acgcucggccguggccguc

SEQ ID NO: 2811478 - RNA, 16 nt, Mycobacterium avium subsp. paratuberculosis
acgcucggccucaggc

SEQ ID NO: 2811479 - RNA, 22 nt, Mycobacterium avium subsp. paratuberculosis
acgcucggcgagcaaggcgagc

SEQ ID NO: 2811480 - RNA, 14 nt, Mycobacterium avium subsp. paratuberculosis
acgcucggcgagug

SEQ ID NO: 2811481 - RNA, 13 nt, Mycobacterium avium subsp. paratuberculosis
acgcucggcgccg

SEQ ID NO: 2811482 - RNA, 15 nt, Mycobacterium avium subsp. paratuberculosis
acgcucggcgccgag

SEQ ID NO: 2811483 - RNA, 18 nt, Mycobacterium avium subsp. paratuberculosis
acgcucggcgccgagcgu

SEQ ID NO: 2811484 - RNA, 22 nt, Mycobacterium avium subsp. paratuberculosis
acgcucggcgccgagcgugaac

SEQ ID NO: 2811485 - RNA, 14 nt, Mycobacterium avium subsp. paratuberculosis
acgcucggcgccgc

SEQ ID NO: 2811486 - RNA, 17 nt, Mycobacterium avium subsp. paratuberculosis
acgcucggcgccgcggg

SEQ ID NO: 2811487 - RNA, 17 nt, Mycobacterium avium subsp. paratuberculosis
acgcucggcgccggccg

SEQ ID NO: 2811488 - RNA, 19 nt, Mycobacterium avium subsp. paratuberculosis
acgcucggcgccggccguc

SEQ ID NO: 2811489 - RNA, 16 nt, Mycobacterium avium subsp. paratuberculosis
acgcucggcgcgacgu

SEQ ID NO: 2811490 - RNA, 15 nt, Mycobacterium avium subsp. paratuberculosis
acgcucggcgcgcgg

SEQ ID NO: 2811491 - RNA, 23 nt, Mycobacterium avium subsp. paratuberculosis
acgcucggcgcgcggggccggcg

SEQ ID NO: 2811492 - RNA, 13 nt, Mycobacterium avium subsp. paratuberculosis
acgcucggcgcgu

SEQ ID NO: 2811493 - RNA, 16 nt, Mycobacterium avium subsp. paratuberculosis
acgcucggcgcgucgu

SEQ ID NO: 2811494 - RNA, 23 nt, Mycobacterium avium subsp. paratuberculosis
acggaaaccgcugcggcacacca

SEQ ID NO: 2811495 - RNA, 11 nt, Mycobacterium avium subsp. paratuberculosis
acggaaaucgc

SEQ ID NO: 2811496 - RNA, 14 nt, Mycobacterium avium subsp. paratuberculosis
acggaagccgagcg

SEQ ID NO: 2811497 - RNA, 21 nt, Mycobacterium avium subsp. paratuberculosis
acggaauucagugaggccagc

SEQ ID NO: 2811498 - RNA, 15 nt, Mycobacterium avium subsp. paratuberculosis
acggacacccgcgcg

SEQ ID NO: 2811499 - RNA, 16 nt, Mycobacterium avium subsp. paratuberculosis
acggacacccgcgcgg

SEQ ID NO: 2811500 - RNA, 14 nt, Mycobacterium avium subsp. paratuberculosis
acggacagcucacc

SEQ ID NO: 2811501 - RNA, 17 nt, Mycobacterium avium subsp. paratuberculosis
acggacaggugugggcg

SEQ ID NO: 2811502 - RNA, 13 nt, Mycobacterium avium subsp. paratuberculosis
acggaccgggcgg

SEQ ID NO: 2811503 - RNA, 21 nt, Mycobacterium avium subsp. paratuberculosis
acggacgcauccacggccggu

SEQ ID NO: 2811504 - RNA, 15 nt, Mycobacterium avium subsp. paratuberculosis
acggagacgaccagg

SEQ ID NO: 2811505 - RNA, 12 nt, Mycobacterium avium subsp. paratuberculosis
acggagccgagc

SEQ ID NO: 2811506 - RNA, 20 nt, Mycobacterium avium subsp. paratuberculosis
acggagcgcccggccagccg

SEQ ID NO: 2811507 - RNA, 22 nt, Mycobacterium avium subsp. paratuberculosis
acggagcgcccggccagccggc

SEQ ID NO: 2811508 - RNA, 18 nt, Mycobacterium avium subsp. paratuberculosis
acggagucgucggcgcgg

SEQ ID NO: 2811509 - RNA, 20 nt, Mycobacterium avium subsp. paratuberculosis
acggagucgucggcgcgguu

SEQ ID NO: 2811510 - RNA, 22 nt, Mycobacterium avium subsp. paratuberculosis
acggaguuggaucgccgcaacu

SEQ ID NO: 2811511 - RNA, 17 nt, Mycobacterium avium subsp. paratuberculosis
acggauacccgcggccu

SEQ ID NO: 2811512 - RNA, 18 nt, Mycobacterium avium subsp. paratuberculosis
acggauaucccgcggguc

SEQ ID NO: 2811513 - RNA, 20 nt, Mycobacterium avium subsp. paratuberculosis
acggaucgagucccgcgcgg

SEQ ID NO: 2811514 - RNA, 21 nt, Mycobacterium avium subsp. paratuberculosis
acggaucgagucccgcgcggc

SEQ ID NO: 2811515 - RNA, 15 nt, Mycobacterium avium subsp. paratuberculosis
acggaucgcccaccc

SEQ ID NO: 2811516 - RNA, 22 nt, Mycobacterium avium subsp. paratuberculosis
acggaucgcccacccgcacgcc

SEQ ID NO: 2811517 - RNA, 23 nt, Mycobacterium avium subsp. paratuberculosis
acggaucgccggacagcgggccg

SEQ ID NO: 2811518 - RNA, 19 nt, Mycobacterium avium subsp. paratuberculosis
acggauucagcgucgccau

SEQ ID NO: 2811519 - RNA, 14 nt, Mycobacterium avium subsp. paratuberculosis
acggauugcggacg

SEQ ID NO: 2811520 - RNA, 14 nt, Mycobacterium avium subsp. paratuberculosis
acggcaaccugggc

SEQ ID NO: 2811521 - RNA, 18 nt, Mycobacterium avium subsp. paratuberculosis
acggcaaccugggcggcg

SEQ ID NO: 2811522 - RNA, 21 nt, Mycobacterium avium subsp. paratuberculosis
acggcaaccugggcggcggcg

SEQ ID NO: 2811523 - RNA, 17 nt, Mycobacterium avium subsp. paratuberculosis
acggcaauccggccccg

SEQ ID NO: 2811524 - RNA, 18 nt, Mycobacterium avium subsp. paratuberculosis
acggcaauccggccccgc

SEQ ID NO: 2811525 - RNA, 20 nt, Mycobacterium avium subsp. paratuberculosis
acggcaauccggccccgcug

SEQ ID NO: 2811526 - RNA, 15 nt, Mycobacterium avium subsp. paratuberculosis
acggcaaugguugcg

SEQ ID NO: 2811527 - RNA, 21 nt, Mycobacterium avium subsp. paratuberculosis
acggcaaugguugcggcgggc

SEQ ID NO: 2811528 - RNA, 13 nt, Mycobacterium avium subsp. paratuberculosis
acggcaccaccac

SEQ ID NO: 2811529 - RNA, 16 nt, Mycobacterium avium subsp. paratuberculosis
acggcaccaccacggu

SEQ ID NO: 2811530 - RNA, 20 nt, Mycobacterium avium subsp. paratuberculosis
acggcaccaccacgguggcg

SEQ ID NO: 2811531 - RNA, 22 nt, Mycobacterium avium subsp. paratuberculosis
acggcaccaccacgguggcgcc

SEQ ID NO: 2811532 - RNA, 23 nt, Mycobacterium avium subsp. paratuberculosis
acggcaccccgcggucggcggcg

SEQ ID NO: 2811533 - RNA, 16 nt, Mycobacterium avium subsp. paratuberculosis
acggcacccgcagcuc

SEQ ID NO: 2811534 - RNA, 21 nt, Mycobacterium avium subsp. paratuberculosis
acggcacccgcagcuccagcg

SEQ ID NO: 2811535 - RNA, 14 nt, Mycobacterium avium subsp. paratuberculosis
acggcacccggccc

SEQ ID NO: 2811536 - RNA, 15 nt, Mycobacterium avium subsp. paratuberculosis
acggcacccggcccu

SEQ ID NO: 2811537 - RNA, 13 nt, Mycobacterium avium subsp. paratuberculosis
acggcaccgacgg

SEQ ID NO: 2811538 - RNA, 14 nt, Mycobacterium avium subsp. paratuberculosis
acggcaccgacgga

SEQ ID NO: 2811539 - RNA, 17 nt, Mycobacterium avium subsp. paratuberculosis
acggcaccgccgcgcgg

SEQ ID NO: 2811540 - RNA, 20 nt, Mycobacterium avium subsp. paratuberculosis
acggcaccgccgcgcggccg

SEQ ID NO: 2811541 - RNA, 22 nt, Mycobacterium avium subsp. paratuberculosis
acggcaccgccgcgcggccggg

SEQ ID NO: 2811542 - RNA, 13 nt, Mycobacterium avium subsp. paratuberculosis
acggcaccgccgg

SEQ ID NO: 2811543 - RNA, 14 nt, Mycobacterium avium subsp. paratuberculosis
acggcaccgccggc

SEQ ID NO: 2811544 - RNA, 16 nt, Mycobacterium avium subsp. paratuberculosis
acggcaccgccggcgg

SEQ ID NO: 2811545 - RNA, 19 nt, Mycobacterium avium subsp. paratuberculosis
acggcaccgccggcggccu

SEQ ID NO: 2811546 - RNA, 16 nt, Mycobacterium avium subsp. paratuberculosis
acggcaccgcgagcac

SEQ ID NO: 2811547 - RNA, 16 nt, Mycobacterium avium subsp. paratuberculosis
acggcacgcccguucg

SEQ ID NO: 2811548 - RNA, 20 nt, Mycobacterium avium subsp. paratuberculosis
acggcacguugcccaggaag

SEQ ID NO: 2811549 - RNA, 24 nt, Mycobacterium avium subsp. paratuberculosis
acggcagaggcguuuucggugugc

SEQ ID NO: 2811550 - RNA, 14 nt, Mycobacterium avium subsp. paratuberculosis
acggcagcaacuga

SEQ ID NO: 2811551 - RNA, 13 nt, Mycobacterium avium subsp. paratuberculosis
acggcagcaccgc

SEQ ID NO: 2811552 - RNA, 17 nt, Mycobacterium avium subsp. paratuberculosis
acggcagcaccgccgac

SEQ ID NO: 2811553 - RNA, 19 nt, Mycobacterium avium subsp. paratuberculosis
acggcagcaccgccgacau

SEQ ID NO: 2811554 - RNA, 20 nt, Mycobacterium avium subsp. paratuberculosis
acggcagcaccucgcgcagc

SEQ ID NO: 2811555 - RNA, 21 nt, Mycobacterium avium subsp. paratuberculosis
acggcagcaccucgcgcagca

SEQ ID NO: 2811556 - RNA, 13 nt, Mycobacterium avium subsp. paratuberculosis
acggcagcccgac

SEQ ID NO: 2811557 - RNA, 22 nt, Mycobacterium avium subsp. paratuberculosis
acggcagcgcuaaccgcgggca

SEQ ID NO: 2811558 - RNA, 14 nt, Mycobacterium avium subsp. paratuberculosis
acggcagcggcacc

SEQ ID NO: 2811559 - RNA, 16 nt, Mycobacterium avium subsp. paratuberculosis
acggcagcucgucgac

SEQ ID NO: 2811560 - RNA, 18 nt, Mycobacterium avium subsp. paratuberculosis
acggcagcucgucgacgu

SEQ ID NO: 2811561 - RNA, 23 nt, Mycobacterium avium subsp. paratuberculosis
acggcagcucgucgacguccucg

SEQ ID NO: 2811562 - RNA, 16 nt, Mycobacterium avium subsp. paratuberculosis
acggcaggcggcccgc

SEQ ID NO: 2811563 - RNA, 18 nt, Mycobacterium avium subsp. paratuberculosis
acggcaggcggcccgcuc

SEQ ID NO: 2811564 - RNA, 21 nt, Mycobacterium avium subsp. paratuberculosis
acggcaggcggcccgcucgau

SEQ ID NO: 2811565 - RNA, 21 nt, Mycobacterium avium subsp. paratuberculosis
acggcaggucggugcgcgggg

SEQ ID NO: 2811566 - RNA, 23 nt, Mycobacterium avium subsp. paratuberculosis
acggcaguaucuuguucgccgac

SEQ ID NO: 2811567 - RNA, 21 nt, Mycobacterium avium subsp. paratuberculosis
acggcagugagggaacgccga

SEQ ID NO: 2811568 - RNA, 16 nt, Mycobacterium avium subsp. paratuberculosis
acggcaucggcgcccu

SEQ ID NO: 2811569 - RNA, 17 nt, Mycobacterium avium subsp. paratuberculosis
acggcaucggcgcccuc

SEQ ID NO: 2811570 - RNA, 12 nt, Mycobacterium avium subsp. paratuberculosis
acggcaugccgg

SEQ ID NO: 2811571 - RNA, 22 nt, Mycobacterium avium subsp. paratuberculosis
acggcaugccgggccagccggc

SEQ ID NO: 2811572 - RNA, 15 nt, Mycobacterium avium subsp. paratuberculosis
acggcauggacacgc

SEQ ID NO: 2811573 - RNA, 22 nt, Mycobacterium avium subsp. paratuberculosis
acggcauggcgaacacgucggc

SEQ ID NO: 2811574 - RNA, 19 nt, Mycobacterium avium subsp. paratuberculosis
acggcauggugaugauccc

SEQ ID NO: 2811575 - RNA, 12 nt, Mycobacterium avium subsp. paratuberculosis
acggcaugucgg

SEQ ID NO: 2811576 - RNA, 14 nt, Mycobacterium avium subsp. paratuberculosis
acggcauugcagcg

SEQ ID NO: 2811577 - RNA, 14 nt, Mycobacterium avium subsp. paratuberculosis
acggccaaccgccc

SEQ ID NO: 2811578 - RNA, 12 nt, Mycobacterium avium subsp. paratuberculosis
acggccggcagc

SEQ ID NO: 2811579 - RNA, 19 nt, Mycobacterium avium subsp. paratuberculosis
acggccggcccugcacgca

SEQ ID NO: 2811580 - RNA, 15 nt, Mycobacterium avium subsp. paratuberculosis
acggccggccggccg

SEQ ID NO: 2811581 - RNA, 17 nt, Mycobacterium avium subsp. paratuberculosis
acggccggcgccgccgg

SEQ ID NO: 2811582 - RNA, 22 nt, Mycobacterium avium subsp. paratuberculosis
acggccgggauuucccgggcga

SEQ ID NO: 2811583 - RNA, 20 nt, Mycobacterium avium subsp. paratuberculosis
acggccggggccagcaccca

SEQ ID NO: 2811584 - RNA, 13 nt, Mycobacterium avium subsp. paratuberculosis
acggccgggucag

SEQ ID NO: 2811585 - RNA, 14 nt, Mycobacterium avium subsp. paratuberculosis
acggccggugacuc

SEQ ID NO: 2811586 - RNA, 21 nt, Mycobacterium avium subsp. paratuberculosis
acggccgguuccacgauuccu

SEQ ID NO: 2811587 - RNA, 17 nt, Mycobacterium avium subsp. paratuberculosis
acggccguccaggcgcc

SEQ ID NO: 2811588 - RNA, 19 nt, Mycobacterium avium subsp. paratuberculosis
acggccguccaggcgccau

SEQ ID NO: 2811589 - RNA, 17 nt, Mycobacterium avium subsp. paratuberculosis
acggccgugaugccggg

SEQ ID NO: 2811590 - RNA, 18 nt, Mycobacterium avium subsp. paratuberculosis
acggccguucucgggaaa

SEQ ID NO: 2811591 - RNA, 19 nt, Mycobacterium avium subsp. paratuberculosis
acggccucgaucaucacca

SEQ ID NO: 2811592 - RNA, 21 nt, Mycobacterium avium subsp. paratuberculosis
acggccucgaucaucaccacc

SEQ ID NO: 2811593 - RNA, 18 nt, Mycobacterium avium subsp. paratuberculosis
acggccucgcccagcgcc

SEQ ID NO: 2811594 - RNA, 19 nt, Mycobacterium avium subsp. paratuberculosis
acggccucgcccagcgccg

SEQ ID NO: 2811595 - RNA, 22 nt, Mycobacterium avium subsp. paratuberculosis
acggccucgcccagcgccgcgg

SEQ ID NO: 2811596 - RNA, 22 nt, Mycobacterium avium subsp. paratuberculosis
acggccucgccgucgcgaucgc

SEQ ID NO: 2811597 - RNA, 13 nt, Mycobacterium avium subsp. paratuberculosis
acggccugcacca

SEQ ID NO: 2811598 - RNA, 20 nt, Mycobacterium avium subsp. paratuberculosis
acggccugcaccaccacacc

SEQ ID NO: 2811599 - RNA, 22 nt, Mycobacterium avium subsp. paratuberculosis
acggccugcaccaccacaccca

SEQ ID NO: 2811600 - RNA, 20 nt, Mycobacterium avium subsp. paratuberculosis
acggccugguacagcaccgc

SEQ ID NO: 2811601 - RNA, 21 nt, Mycobacterium avium subsp. paratuberculosis
acggccugguacagcaccgcc

SEQ ID NO: 2811602 - RNA, 16 nt, Mycobacterium avium subsp. paratuberculosis
acggccuugccgauca

SEQ ID NO: 2811603 - RNA, 16 nt, Mycobacterium avium subsp. paratuberculosis
acggcgaacggccgcg

SEQ ID NO: 2811604 - RNA, 14 nt, Mycobacterium avium subsp. paratuberculosis
acggcgaacgucga

SEQ ID NO: 2811605 - RNA, 15 nt, Mycobacterium avium subsp. paratuberculosis
acggcgaacgucgau

SEQ ID NO: 2811606 - RNA, 18 nt, Mycobacterium avium subsp. paratuberculosis
acggcgaacuuggccgac

SEQ ID NO: 2811607 - RNA, 19 nt, Mycobacterium avium subsp. paratuberculosis
acggcgaacuuggccgaca

SEQ ID NO: 2811608 - RNA, 16 nt, Mycobacterium avium subsp. paratuberculosis
acggcgaagccggcgu

SEQ ID NO: 2811609 - RNA, 18 nt, Mycobacterium avium subsp. paratuberculosis
acggcgaauauuucgccg

SEQ ID NO: 2811610 - RNA, 20 nt, Mycobacterium avium subsp. paratuberculosis
acggcgaauauuucgccgau

SEQ ID NO: 2811611 - RNA, 15 nt, Mycobacterium avium subsp. paratuberculosis
acggcgaccacaccg

SEQ ID NO: 2811612 - RNA, 16 nt, Mycobacterium avium subsp. paratuberculosis
acggcgaccacaccgu

SEQ ID NO: 2811613 - RNA, 19 nt, Mycobacterium avium subsp. paratuberculosis
acggcgaccacaccgucga

SEQ ID NO: 2811614 - RNA, 20 nt, Mycobacterium avium subsp. paratuberculosis
acggcgaccacaccgucgac

SEQ ID NO: 2811615 - RNA, 14 nt, Mycobacterium avium subsp. paratuberculosis
acggcgaccagcga

SEQ ID NO: 2811616 - RNA, 21 nt, Mycobacterium avium subsp. paratuberculosis
acggcgaccagcgagcccagc

SEQ ID NO: 2811617 - RNA, 15 nt, Mycobacterium avium subsp. paratuberculosis
acggcgacgaccacc

SEQ ID NO: 2811618 - RNA, 18 nt, Mycobacterium avium subsp. paratuberculosis
acggcgacgaccaccagg

SEQ ID NO: 2811619 - RNA, 22 nt, Mycobacterium avium subsp. paratuberculosis
acggcgacgaccaccaggagca

SEQ ID NO: 2811620 - RNA, 18 nt, Mycobacterium avium subsp. paratuberculosis
acggcgacgaccgucauc

SEQ ID NO: 2811621 - RNA, 14 nt, Mycobacterium avium subsp. paratuberculosis
acggcgacggcagc

SEQ ID NO: 2811622 - RNA, 13 nt, Mycobacterium avium subsp. paratuberculosis
acggcgacggcca

SEQ ID NO: 2811623 - RNA, 14 nt, Mycobacterium avium subsp. paratuberculosis
acggcgacggccag

SEQ ID NO: 2811624 - RNA, 20 nt, Mycobacterium avium subsp. paratuberculosis
acggcgacggcguccgggcg

SEQ ID NO: 2811625 - RNA, 20 nt, Mycobacterium avium subsp. paratuberculosis
acggcgagccgggccggguc

SEQ ID NO: 2811626 - RNA, 15 nt, Mycobacterium avium subsp. paratuberculosis
acggcgagcggcccu

SEQ ID NO: 2811627 - RNA, 17 nt, Mycobacterium avium subsp. paratuberculosis
acggcgagcggcccugc

SEQ ID NO: 2811628 - RNA, 19 nt, Mycobacterium avium subsp. paratuberculosis
acggcgaggauggcgauca

SEQ ID NO: 2811629 - RNA, 17 nt, Mycobacterium avium subsp. paratuberculosis
acggcgauguaggacgc

SEQ ID NO: 2811630 - RNA, 23 nt, Mycobacterium avium subsp. paratuberculosis
acggcgauguaggacgccgcacc

SEQ ID NO: 2811631 - RNA, 14 nt, Mycobacterium avium subsp. paratuberculosis
acggcgccaccagc

SEQ ID NO: 2811632 - RNA, 23 nt, Mycobacterium avium subsp. paratuberculosis
acggcgccaccagccacaccgcc

SEQ ID NO: 2811633 - RNA, 15 nt, Mycobacterium avium subsp. paratuberculosis
acggcgccaugcgcc

SEQ ID NO: 2811634 - RNA, 23 nt, Mycobacterium avium subsp. paratuberculosis
acggcgcccagguccaccaggug

SEQ ID NO: 2811635 - RNA, 15 nt, Mycobacterium avium subsp. paratuberculosis
acggcgcccgccccg

SEQ ID NO: 2811636 - RNA, 17 nt, Mycobacterium avium subsp. paratuberculosis
acggcgcccgccccgac

SEQ ID NO: 2811637 - RNA, 20 nt, Mycobacterium avium subsp. paratuberculosis
acggcgcccgccccgacgug

SEQ ID NO: 2811638 - RNA, 20 nt, Mycobacterium avium subsp. paratuberculosis
acggcgccgcccgggcccgg

SEQ ID NO: 2811639 - RNA, 13 nt, Mycobacterium avium subsp. paratuberculosis
acggcgccgcggc

SEQ ID NO: 2811640 - RNA, 15 nt, Mycobacterium avium subsp. paratuberculosis
acggcgccgcggccg

SEQ ID NO: 2811641 - RNA, 12 nt, Mycobacterium avium subsp. paratuberculosis
acggcgccgcgu

SEQ ID NO: 2811642 - RNA, 14 nt, Mycobacterium avium subsp. paratuberculosis
acggcgccgcgucg

SEQ ID NO: 2811643 - RNA, 17 nt, Mycobacterium avium subsp. paratuberculosis
acggcgccgcgucggac

SEQ ID NO: 2811644 - RNA, 20 nt, Mycobacterium avium subsp. paratuberculosis
acggcgccgcgucggacccc

SEQ ID NO: 2811645 - RNA, 17 nt, Mycobacterium avium subsp. paratuberculosis
acggcgccggugcccac

SEQ ID NO: 2811646 - RNA, 19 nt, Mycobacterium avium subsp. paratuberculosis
acggcgccgugccgcgcgg

SEQ ID NO: 2811647 - RNA, 21 nt, Mycobacterium avium subsp. paratuberculosis
acggcgccgugccgcgcggcg

SEQ ID NO: 2811648 - RNA, 22 nt, Mycobacterium avium subsp. paratuberculosis
acggcgccgugccgcgcggcga

SEQ ID NO: 2811649 - RNA, 21 nt, Mycobacterium avium subsp. paratuberculosis
acggcgccugauccgcgguca

SEQ ID NO: 2811650 - RNA, 15 nt, Mycobacterium avium subsp. paratuberculosis
acggcgcgaaccggg

SEQ ID NO: 2811651 - RNA, 21 nt, Mycobacterium avium subsp. paratuberculosis
acggcgcgaaccgggccagga

SEQ ID NO: 2811652 - RNA, 16 nt, Mycobacterium avium subsp. paratuberculosis
acggcgcgaggacgau

SEQ ID NO: 2811653 - RNA, 16 nt, Mycobacterium avium subsp. paratuberculosis
acggcgcgcaccgcgg

SEQ ID NO: 2811654 - RNA, 15 nt, Mycobacterium avium subsp. paratuberculosis
acggcgcgcccgacg

SEQ ID NO: 2811655 - RNA, 18 nt, Mycobacterium avium subsp. paratuberculosis
acggcgcgguggcgugca

SEQ ID NO: 2811656 - RNA, 23 nt, Mycobacterium avium subsp. paratuberculosis
acggcgcgguggcgugcagcgcg

SEQ ID NO: 2811657 - RNA, 13 nt, Mycobacterium avium subsp. paratuberculosis
acggcgcgucgua

SEQ ID NO: 2811658 - RNA, 12 nt, Mycobacterium avium subsp. paratuberculosis
acggcgcgugcu

SEQ ID NO: 2811659 - RNA, 18 nt, Mycobacterium avium subsp. paratuberculosis
acggcgcgugcuguugca

SEQ ID NO: 2811660 - RNA, 21 nt, Mycobacterium avium subsp. paratuberculosis
acggcgcucaccggcguggug

SEQ ID NO: 2811661 - RNA, 16 nt, Mycobacterium avium subsp. paratuberculosis
acggcgcuggccgcgg

SEQ ID NO: 2811662 - RNA, 20 nt, Mycobacterium avium subsp. paratuberculosis
acggcucggucaagccggcc

SEQ ID NO: 2811663 - RNA, 21 nt, Mycobacterium avium subsp. paratuberculosis
acggcucggucaagccggcca

SEQ ID NO: 2811664 - RNA, 22 nt, Mycobacterium avium subsp. paratuberculosis
acggcucggucaagccggccag

SEQ ID NO: 2811665 - RNA, 23 nt, Mycobacterium avium subsp. paratuberculosis
acggcucggucaagccggccagc

SEQ ID NO: 2811666 - RNA, 15 nt, Mycobacterium avium subsp. paratuberculosis
acggcucgugggugg

SEQ ID NO: 2811667 - RNA, 22 nt, Mycobacterium avium subsp. paratuberculosis
acggcucguggguggucugcug

SEQ ID NO: 2811668 - RNA, 19 nt, Mycobacterium avium subsp. paratuberculosis
acggcucuucgcggcgggg

SEQ ID NO: 2811669 - RNA, 15 nt, Mycobacterium avium subsp. paratuberculosis
acggcucuucggcgc

SEQ ID NO: 2811670 - RNA, 16 nt, Mycobacterium avium subsp. paratuberculosis
acggcucuucggcgcc

SEQ ID NO: 2811671 - RNA, 18 nt, Mycobacterium avium subsp. paratuberculosis
acggcucuucggcgccga

SEQ ID NO: 2811672 - RNA, 20 nt, Mycobacterium avium subsp. paratuberculosis
acggcucuucggcgccgagc

SEQ ID NO: 2811673 - RNA, 13 nt, Mycobacterium avium subsp. paratuberculosis
acggcugcccggc

SEQ ID NO: 2811674 - RNA, 15 nt, Mycobacterium avium subsp. paratuberculosis
acggcugcccggccc

SEQ ID NO: 2811675 - RNA, 16 nt, Mycobacterium avium subsp. paratuberculosis
acggcugcccggcccg

SEQ ID NO: 2811676 - RNA, 19 nt, Mycobacterium avium subsp. paratuberculosis
acggcugcccggcccgccg

SEQ ID NO: 2811677 - RNA, 20 nt, Mycobacterium avium subsp. paratuberculosis
acggcugcccggcccgccgc

SEQ ID NO: 2811678 - RNA, 14 nt, Mycobacterium avium subsp. paratuberculosis
acggcugccgaccu

SEQ ID NO: 2811679 - RNA, 22 nt, Mycobacterium avium subsp. paratuberculosis
acggcugccgaccucgauggcg

SEQ ID NO: 2811680 - RNA, 23 nt, Mycobacterium avium subsp. paratuberculosis
acggcugccgaccucgauggcga

SEQ ID NO: 2811681 - RNA, 19 nt, Mycobacterium avium subsp. paratuberculosis
acggcugcgguuggccggc

SEQ ID NO: 2811682 - RNA, 16 nt, Mycobacterium avium subsp. paratuberculosis
acggcugcucccgaaa

SEQ ID NO: 2811683 - RNA, 15 nt, Mycobacterium avium subsp. paratuberculosis
acggcugcugcgcgg

SEQ ID NO: 2811684 - RNA, 17 nt, Mycobacterium avium subsp. paratuberculosis
acggcugcugcgcggca

SEQ ID NO: 2811685 - RNA, 20 nt, Mycobacterium avium subsp. paratuberculosis
acggcugcugcgcggcacgg

SEQ ID NO: 2811686 - RNA, 20 nt, Mycobacterium avium subsp. paratuberculosis
acggcuggaaucccgccucg

SEQ ID NO: 2811687 - RNA, 22 nt, Mycobacterium avium subsp. paratuberculosis
acggcuggaaucccgccucggc

SEQ ID NO: 2811688 - RNA, 16 nt, Mycobacterium avium subsp. paratuberculosis
acggcuggcgcaggug

SEQ ID NO: 2811689 - RNA, 14 nt, Mycobacterium avium subsp. paratuberculosis
acggcuuccgcgga

SEQ ID NO: 2811690 - RNA, 16 nt, Mycobacterium avium subsp. paratuberculosis
acggcuugcgcucggc

SEQ ID NO: 2811691 - RNA, 20 nt, Mycobacterium avium subsp. paratuberculosis
acggcuugcgcucggccggg

SEQ ID NO: 2811692 - RNA, 21 nt, Mycobacterium avium subsp. paratuberculosis
acggcuugcgcucggccgggu

SEQ ID NO: 2811693 - RNA, 21 nt, Mycobacterium avium subsp. paratuberculosis
acggcuuuggugacgccgacg

SEQ ID NO: 2811694 - RNA, 19 nt, Mycobacterium avium subsp. paratuberculosis
acgggaacucggccagcug

SEQ ID NO: 2811695 - RNA, 17 nt, Mycobacterium avium subsp. paratuberculosis
acgggaccacccgcagc

SEQ ID NO: 2811696 - RNA, 16 nt, Mycobacterium avium subsp. paratuberculosis
acgggaccgcacgccg

SEQ ID NO: 2811697 - RNA, 18 nt, Mycobacterium avium subsp. paratuberculosis
acgggacguuggcggacu

SEQ ID NO: 2811698 - RNA, 14 nt, Mycobacterium avium subsp. paratuberculosis
acgggagucgggcc

SEQ ID NO: 2811699 - RNA, 17 nt, Mycobacterium avium subsp. paratuberculosis
acgggagucgggcccgc

SEQ ID NO: 2811700 - RNA, 18 nt, Mycobacterium avium subsp. paratuberculosis
acgggaucggcgcgucgg

SEQ ID NO: 2811701 - RNA, 20 nt, Mycobacterium avium subsp. paratuberculosis
acgggaucggcgcgucggcg

SEQ ID NO: 2811702 - RNA, 23 nt, Mycobacterium avium subsp. paratuberculosis
acgggaugaacucgugcggcgcc

SEQ ID NO: 2811703 - RNA, 18 nt, Mycobacterium avium subsp. paratuberculosis
acgggaugaucggcgccu

SEQ ID NO: 2811704 - RNA, 14 nt, Mycobacterium avium subsp. paratuberculosis
acgggaugcggcac

SEQ ID NO: 2811705 - RNA, 18 nt, Mycobacterium avium subsp. paratuberculosis
acgggaugcggucgauca

SEQ ID NO: 2811706 - RNA, 16 nt, Mycobacterium avium subsp. paratuberculosis
acgggauggcucagcg

SEQ ID NO: 2811707 - RNA, 23 nt, Mycobacterium avium subsp. paratuberculosis
acgggauggcucagcgcaccgcc

SEQ ID NO: 2811708 - RNA, 13 nt, Mycobacterium avium subsp. paratuberculosis
acgggcacaccgu

SEQ ID NO: 2811709 - RNA, 12 nt, Mycobacterium avium subsp. paratuberculosis
acgggcaccagu

SEQ ID NO: 2811710 - RNA, 17 nt, Mycobacterium avium subsp. paratuberculosis
acgggcacccgcgcguc

SEQ ID NO: 2811711 - RNA, 18 nt, Mycobacterium avium subsp. paratuberculosis
acgggcacccgcgcgucg

SEQ ID NO: 2811712 - RNA, 22 nt, Mycobacterium avium subsp. paratuberculosis
acgggcacccgcgcgucgcgca

SEQ ID NO: 2811713 - RNA, 14 nt, Mycobacterium avium subsp. paratuberculosis
acgggcagccacgc

SEQ ID NO: 2811714 - RNA, 15 nt, Mycobacterium avium subsp. paratuberculosis
acgggcagccacgcg

SEQ ID NO: 2811715 - RNA, 16 nt, Mycobacterium avium subsp. paratuberculosis
acgggcagccacgcgc

SEQ ID NO: 2811716 - RNA, 17 nt, Mycobacterium avium subsp. paratuberculosis
acgggcagggugaccga

SEQ ID NO: 2811717 - RNA, 17 nt, Mycobacterium avium subsp. paratuberculosis
acgggcauccggcucag

SEQ ID NO: 2811718 - RNA, 15 nt, Mycobacterium avium subsp. paratuberculosis
acgggcaugccgucg

SEQ ID NO: 2811719 - RNA, 16 nt, Mycobacterium avium subsp. paratuberculosis
acgggcaugccgucgg

SEQ ID NO: 2811720 - RNA, 15 nt, Mycobacterium avium subsp. paratuberculosis
acgggccaccagcgc

SEQ ID NO: 2811721 - RNA, 23 nt, Mycobacterium avium subsp. paratuberculosis
acgggccauguccccgaccauca

SEQ ID NO: 2811722 - RNA, 21 nt, Mycobacterium avium subsp. paratuberculosis
acgggcccagcgcgacgucga

SEQ ID NO: 2811723 - RNA, 14 nt, Mycobacterium avium subsp. paratuberculosis
acgggcccgcgccu

SEQ ID NO: 2811724 - RNA, 19 nt, Mycobacterium avium subsp. paratuberculosis
acgggcccgcgccuucuug

SEQ ID NO: 2811725 - RNA, 13 nt, Mycobacterium avium subsp. paratuberculosis
acgggcccguccg

SEQ ID NO: 2811726 - RNA, 12 nt, Mycobacterium avium subsp. paratuberculosis
acgggccgauca

SEQ ID NO: 2811727 - RNA, 12 nt, Mycobacterium avium subsp. paratuberculosis
acgggccgcacu

SEQ ID NO: 2811728 - RNA, 19 nt, Mycobacterium avium subsp. paratuberculosis
acgggccgcauccgcgagc

SEQ ID NO: 2811729 - RNA, 15 nt, Mycobacterium avium subsp. paratuberculosis
acgggccgcgccgag

SEQ ID NO: 2811730 - RNA, 12 nt, Mycobacterium avium subsp. paratuberculosis
acgggccgcggc

SEQ ID NO: 2811731 - RNA, 17 nt, Mycobacterium avium subsp. paratuberculosis
acgggccgcggccagcu

SEQ ID NO: 2811732 - RNA, 14 nt, Mycobacterium avium subsp. paratuberculosis
acgggccgggcacc

SEQ ID NO: 2811733 - RNA, 22 nt, Mycobacterium avium subsp. paratuberculosis
acgggccgggcaccgcgcccgc

SEQ ID NO: 2811734 - RNA, 17 nt, Mycobacterium avium subsp. paratuberculosis
acgggccgggcacgucg

SEQ ID NO: 2811735 - RNA, 19 nt, Mycobacterium avium subsp. paratuberculosis
acgggccgggcacgucgac

SEQ ID NO: 2811736 - RNA, 17 nt, Mycobacterium avium subsp. paratuberculosis
acgggccguccaucccg

SEQ ID NO: 2811737 - RNA, 16 nt, Mycobacterium avium subsp. paratuberculosis
acgggcgcaccgcgcg

SEQ ID NO: 2811738 - RNA, 22 nt, Mycobacterium avium subsp. paratuberculosis
acgggcgcaccgcgcgccaggu

SEQ ID NO: 2811739 - RNA, 15 nt, Mycobacterium avium subsp. paratuberculosis
acgggcgcagcgccg

SEQ ID NO: 2811740 - RNA, 20 nt, Mycobacterium avium subsp. paratuberculosis
acgggcgcagcgccgucucg

SEQ ID NO: 2811741 - RNA, 17 nt, Mycobacterium avium subsp. paratuberculosis
acgggcggcagggccag

SEQ ID NO: 2811742 - RNA, 21 nt, Mycobacterium avium subsp. paratuberculosis
acgggcggcagggccagcacc

SEQ ID NO: 2811743 - RNA, 17 nt, Mycobacterium avium subsp. paratuberculosis
acgggcggcggaucagc

SEQ ID NO: 2811744 - RNA, 19 nt, Mycobacterium avium subsp. paratuberculosis
acgggcggcggaucagcac

SEQ ID NO: 2811745 - RNA, 23 nt, Mycobacterium avium subsp. paratuberculosis
acgggcggcggaucagcaccgac

SEQ ID NO: 2811746 - RNA, 16 nt, Mycobacterium avium subsp. paratuberculosis
acggucaggguguugu

SEQ ID NO: 2811747 - RNA, 16 nt, Mycobacterium avium subsp. paratuberculosis
acggucaguccggguu

SEQ ID NO: 2811748 - RNA, 19 nt, Mycobacterium avium subsp. paratuberculosis
acggucaugccgagccgcu

SEQ ID NO: 2811749 - RNA, 17 nt, Mycobacterium avium subsp. paratuberculosis
acggucccacucgggaa

SEQ ID NO: 2811750 - RNA, 14 nt, Mycobacterium avium subsp. paratuberculosis
acgguccccgcgcc

SEQ ID NO: 2811751 - RNA, 16 nt, Mycobacterium avium subsp. paratuberculosis
acgguccccgcgcccg

SEQ ID NO: 2811752 - RNA, 17 nt, Mycobacterium avium subsp. paratuberculosis
acgguccccgcgcccgc

SEQ ID NO: 2811753 - RNA, 18 nt, Mycobacterium avium subsp. paratuberculosis
acggucgaccucgagcgu

SEQ ID NO: 2811754 - RNA, 17 nt, Mycobacterium avium subsp. paratuberculosis
acggucgcaccgcggcg

SEQ ID NO: 2811755 - RNA, 11 nt, Mycobacterium avium subsp. paratuberculosis
acggucgccga

SEQ ID NO: 2811756 - RNA, 22 nt, Mycobacterium avium subsp. paratuberculosis
acggucgccggcuuaccgaccu

SEQ ID NO: 2811757 - RNA, 19 nt, Mycobacterium avium subsp. paratuberculosis
acggucgcggugucggcgu

SEQ ID NO: 2811758 - RNA, 21 nt, Mycobacterium avium subsp. paratuberculosis
acggucgcggugucggcgucg

SEQ ID NO: 2811759 - RNA, 22 nt, Mycobacterium avium subsp. paratuberculosis
acggucgcggugucggcgucga

SEQ ID NO: 2811760 - RNA, 11 nt, Mycobacterium avium subsp. paratuberculosis
acggucggagc

SEQ ID NO: 2811761 - RNA, 15 nt, Mycobacterium avium subsp. paratuberculosis
acggucggagcccag

SEQ ID NO: 2811762 - RNA, 14 nt, Mycobacterium avium subsp. paratuberculosis
acggucggccccgc

SEQ ID NO: 2811763 - RNA, 17 nt, Mycobacterium avium subsp. paratuberculosis
acggucggccccgcgca

SEQ ID NO: 2811764 - RNA, 19 nt, Mycobacterium avium subsp. paratuberculosis
acggucggcguccagcgcg

SEQ ID NO: 2811765 - RNA, 13 nt, Mycobacterium avium subsp. paratuberculosis
acggucggggcgg

SEQ ID NO: 2811766 - RNA, 23 nt, Mycobacterium avium subsp. paratuberculosis
acggucggggcggcgggcgaagu

SEQ ID NO: 2811767 - RNA, 22 nt, Mycobacterium avium subsp. paratuberculosis
acggucugcaccgggaugacaa

SEQ ID NO: 2811768 - RNA, 17 nt, Mycobacterium avium subsp. paratuberculosis
acggucugccgggacag

SEQ ID NO: 2811769 - RNA, 14 nt, Mycobacterium avium subsp. paratuberculosis
acggucuggcuggu

SEQ ID NO: 2811770 - RNA, 14 nt, Mycobacterium avium subsp. paratuberculosis
acggugaacgggcc

SEQ ID NO: 2811771 - RNA, 17 nt, Mycobacterium avium subsp. paratuberculosis
acggugaacgucgaucc

SEQ ID NO: 2811772 - RNA, 22 nt, Mycobacterium avium subsp. paratuberculosis
acggugaccucgucgggcgcca

SEQ ID NO: 2811773 - RNA, 24 nt, Mycobacterium avium subsp. paratuberculosis
acggugaccucgucgggcgccagc

SEQ ID NO: 2811774 - RNA, 15 nt, Mycobacterium avium subsp. paratuberculosis
acggugacgccggau

SEQ ID NO: 2811775 - RNA, 20 nt, Mycobacterium avium subsp. paratuberculosis
acggugacgccggauacccc

SEQ ID NO: 2811776 - RNA, 18 nt, Mycobacterium avium subsp. paratuberculosis
acggugagcaacaccggc

SEQ ID NO: 2811777 - RNA, 17 nt, Mycobacterium avium subsp. paratuberculosis
acggugagcaccgccgu

SEQ ID NO: 2811778 - RNA, 20 nt, Mycobacterium avium subsp. paratuberculosis
acggugaucagggucccggu

SEQ ID NO: 2811779 - RNA, 14 nt, Mycobacterium avium subsp. paratuberculosis
acggugaucgacau

SEQ ID NO: 2811780 - RNA, 15 nt, Mycobacterium avium subsp. paratuberculosis
acggugaucucgccg

SEQ ID NO: 2811781 - RNA, 15 nt, Mycobacterium avium subsp. paratuberculosis
acggugaugucgccg

SEQ ID NO: 2811782 - RNA, 17 nt, Mycobacterium avium subsp. paratuberculosis
acggugauuccggcacc

SEQ ID NO: 2811783 - RNA, 23 nt, Mycobacterium avium subsp. paratuberculosis
acggugauuccggcacccgccag

SEQ ID NO: 2811784 - RNA, 12 nt, Mycobacterium avium subsp. paratuberculosis
acggugcagcag

SEQ ID NO: 2811785 - RNA, 16 nt, Mycobacterium avium subsp. paratuberculosis
acggugcaugcgcugg

SEQ ID NO: 2811786 - RNA, 17 nt, Mycobacterium avium subsp. paratuberculosis
acggugcaugcgcuggc

SEQ ID NO: 2811787 - RNA, 21 nt, Mycobacterium avium subsp. paratuberculosis
acggugcccgccgaucgauca

SEQ ID NO: 2811788 - RNA, 16 nt, Mycobacterium avium subsp. paratuberculosis
acggugcccgccgcga

SEQ ID NO: 2811789 - RNA, 21 nt, Mycobacterium avium subsp. paratuberculosis
acggugcccgucggcaacgcc

SEQ ID NO: 2811790 - RNA, 12 nt, Mycobacterium avium subsp. paratuberculosis
acggugccgagu

SEQ ID NO: 2811791 - RNA, 14 nt, Mycobacterium avium subsp. paratuberculosis
acggugccgccguc

SEQ ID NO: 2811792 - RNA, 23 nt, Mycobacterium avium subsp. paratuberculosis
acggugccgccgugcgcggcgac

SEQ ID NO: 2811793 - RNA, 13 nt, Mycobacterium avium subsp. paratuberculosis
acggugccgucac

SEQ ID NO: 2811794 - RNA, 15 nt, Mycobacterium avium subsp. paratuberculosis
acggugcgcccgucg

SEQ ID NO: 2811795 - RNA, 23 nt, Mycobacterium avium subsp. paratuberculosis
acggugcgcccgucgucgccgau

SEQ ID NO: 2811796 - RNA, 12 nt, Mycobacterium avium subsp. paratuberculosis
acggugcgccgg

SEQ ID NO: 2811797 - RNA, 13 nt, Mycobacterium avium subsp. paratuberculosis
acggugcgccggc

SEQ ID NO: 2811798 - RNA, 20 nt, Mycobacterium avium subsp. paratuberculosis
acggugcgccggcagcggcc

SEQ ID NO: 2811799 - RNA, 13 nt, Mycobacterium avium subsp. paratuberculosis
acggugcggccuc

SEQ ID NO: 2811800 - RNA, 15 nt, Mycobacterium avium subsp. paratuberculosis
acggugcggccucga

SEQ ID NO: 2811801 - RNA, 18 nt, Mycobacterium avium subsp. paratuberculosis
acggugcgggugccgaac

SEQ ID NO: 2811802 - RNA, 19 nt, Mycobacterium avium subsp. paratuberculosis
acggugcgugccagcagcu

SEQ ID NO: 2811803 - RNA, 19 nt, Mycobacterium avium subsp. paratuberculosis
acggugcugccguugggca

SEQ ID NO: 2811804 - RNA, 16 nt, Mycobacterium avium subsp. paratuberculosis
acggugcuggcgaugu

SEQ ID NO: 2811805 - RNA, 17 nt, Mycobacterium avium subsp. paratuberculosis
acggugcuggcgaugug

SEQ ID NO: 2811806 - RNA, 15 nt, Mycobacterium avium subsp. paratuberculosis
acgguggacccgacc

SEQ ID NO: 2811807 - RNA, 16 nt, Mycobacterium avium subsp. paratuberculosis
acgguggagcggccca

SEQ ID NO: 2811808 - RNA, 12 nt, Mycobacterium avium subsp. paratuberculosis
acgguggccgcc

SEQ ID NO: 2811809 - RNA, 16 nt, Mycobacterium avium subsp. paratuberculosis
acgguggccgccacca

SEQ ID NO: 2811810 - RNA, 19 nt, Mycobacterium avium subsp. paratuberculosis
acgguggccgccaccaaca

SEQ ID NO: 2811811 - RNA, 20 nt, Mycobacterium avium subsp. paratuberculosis
acgguggccgccaccaacau

SEQ ID NO: 2811812 - RNA, 21 nt, Mycobacterium avium subsp. paratuberculosis
acgguggccgccaccaacauc

SEQ ID NO: 2811813 - RNA, 15 nt, Mycobacterium avium subsp. paratuberculosis
acgguggccgucucg

SEQ ID NO: 2811814 - RNA, 16 nt, Mycobacterium avium subsp. paratuberculosis
acgguggccucggcgc

SEQ ID NO: 2811815 - RNA, 18 nt, Mycobacterium avium subsp. paratuberculosis
acgguggccucggcgcug

SEQ ID NO: 2811816 - RNA, 14 nt, Mycobacterium avium subsp. paratuberculosis
acgguggcgcccag

SEQ ID NO: 2811817 - RNA, 15 nt, Mycobacterium avium subsp. paratuberculosis
acgguggcgccgaau

SEQ ID NO: 2811818 - RNA, 13 nt, Mycobacterium avium subsp. paratuberculosis
acgguggcgccgc

SEQ ID NO: 2811819 - RNA, 14 nt, Mycobacterium avium subsp. paratuberculosis
acgguggcgccggc

SEQ ID NO: 2811820 - RNA, 22 nt, Mycobacterium avium subsp. paratuberculosis
acgguggcgccggcaucgaccg

SEQ ID NO: 2811821 - RNA, 17 nt, Mycobacterium avium subsp. paratuberculosis
acggugggacggcgggu

SEQ ID NO: 2811822 - RNA, 16 nt, Mycobacterium avium subsp. paratuberculosis
acggugggcccgccgu

SEQ ID NO: 2811823 - RNA, 19 nt, Mycobacterium avium subsp. paratuberculosis
acggugggcccgccgucga

SEQ ID NO: 2811824 - RNA, 22 nt, Mycobacterium avium subsp. paratuberculosis
acggugggcccgccgucgacca

SEQ ID NO: 2811825 - RNA, 15 nt, Mycobacterium avium subsp. paratuberculosis
acggugggcgccggg

SEQ ID NO: 2811826 - RNA, 16 nt, Mycobacterium avium subsp. paratuberculosis
acggugggcgccgggu

SEQ ID NO: 2811827 - RNA, 17 nt, Mycobacterium avium subsp. paratuberculosis
acggugggcgccggguc

SEQ ID NO: 2811828 - RNA, 15 nt, Mycobacterium avium subsp. paratuberculosis
acgguggugucgucg

SEQ ID NO: 2811829 - RNA, 16 nt, Mycobacterium avium subsp. paratuberculosis
acgguguagcggcggc

SEQ ID NO: 2811830 - RNA, 17 nt, Mycobacterium avium subsp. paratuberculosis
acgguguaggacgccgu

SEQ ID NO: 2811831 - RNA, 11 nt, Mycobacterium avium subsp. paratuberculosis
acguccaggcc

SEQ ID NO: 2811832 - RNA, 17 nt, Mycobacterium avium subsp. paratuberculosis
acguccaggccggcgcc

SEQ ID NO: 2811833 - RNA, 21 nt, Mycobacterium avium subsp. paratuberculosis
acguccaggccggcgccgcgg

SEQ ID NO: 2811834 - RNA, 22 nt, Mycobacterium avium subsp. paratuberculosis
acguccaggccggcgccgcggg

SEQ ID NO: 2811835 - RNA, 23 nt, Mycobacterium avium subsp. paratuberculosis
acguccaggccggcgccgcgggu

SEQ ID NO: 2811836 - RNA, 15 nt, Mycobacterium avium subsp. paratuberculosis
acguccaucauggcg

SEQ ID NO: 2811837 - RNA, 19 nt, Mycobacterium avium subsp. paratuberculosis
acguccaucgggaccgcgg

SEQ ID NO: 2811838 - RNA, 15 nt, Mycobacterium avium subsp. paratuberculosis
acguccccgggcacc

SEQ ID NO: 2811839 - RNA, 16 nt, Mycobacterium avium subsp. paratuberculosis
acguccccgggcaccc

SEQ ID NO: 2811840 - RNA, 15 nt, Mycobacterium avium subsp. paratuberculosis
acguccccgggcgug

SEQ ID NO: 2811841 - RNA, 17 nt, Mycobacterium avium subsp. paratuberculosis
acguccccgugcagccg

SEQ ID NO: 2811842 - RNA, 19 nt, Mycobacterium avium subsp. paratuberculosis
acguccccgugcagccggg

SEQ ID NO: 2811843 - RNA, 13 nt, Mycobacterium avium subsp. paratuberculosis
acgucccgcccgg

SEQ ID NO: 2811844 - RNA, 14 nt, Mycobacterium avium subsp. paratuberculosis
acgucccgcccggc

SEQ ID NO: 2811845 - RNA, 16 nt, Mycobacterium avium subsp. paratuberculosis
acgucccgcccggcgc

SEQ ID NO: 2811846 - RNA, 17 nt, Mycobacterium avium subsp. paratuberculosis
acgucccgcccggcgcc

SEQ ID NO: 2811847 - RNA, 12 nt, Mycobacterium avium subsp. paratuberculosis
acguccgagguc

SEQ ID NO: 2811848 - RNA, 16 nt, Mycobacterium avium subsp. paratuberculosis
acguccgaggucuugg

SEQ ID NO: 2811849 - RNA, 18 nt, Mycobacterium avium subsp. paratuberculosis
acguccgccuccgaccag

SEQ ID NO: 2811850 - RNA, 21 nt, Mycobacterium avium subsp. paratuberculosis
acguccgccuccgaccagccg

SEQ ID NO: 2811851 - RNA, 21 nt, Mycobacterium avium subsp. paratuberculosis
acguccgcggugagcaccgga

SEQ ID NO: 2811852 - RNA, 13 nt, Mycobacterium avium subsp. paratuberculosis
acguccgcgucgg

SEQ ID NO: 2811853 - RNA, 16 nt, Mycobacterium avium subsp. paratuberculosis
acguccgcgucggcgc

SEQ ID NO: 2811854 - RNA, 22 nt, Mycobacterium avium subsp. paratuberculosis
acguccgcgucggcgccggcca

SEQ ID NO: 2811855 - RNA, 23 nt, Mycobacterium avium subsp. paratuberculosis
acguccgcgucggcgccggccaa

SEQ ID NO: 2811856 - RNA, 17 nt, Mycobacterium avium subsp. paratuberculosis
acguccggaugcggcgc

SEQ ID NO: 2811857 - RNA, 18 nt, Mycobacterium avium subsp. paratuberculosis
acguccggaugcggcgcc

SEQ ID NO: 2811858 - RNA, 20 nt, Mycobacterium avium subsp. paratuberculosis
acguccggaugcggcgccca

SEQ ID NO: 2811859 - RNA, 13 nt, Mycobacterium avium subsp. paratuberculosis
acguccgggccgc

SEQ ID NO: 2811860 - RNA, 16 nt, Mycobacterium avium subsp. paratuberculosis
acguccgggccgccuc

SEQ ID NO: 2811861 - RNA, 18 nt, Mycobacterium avium subsp. paratuberculosis
acguccgggccgccucga

SEQ ID NO: 2811862 - RNA, 22 nt, Mycobacterium avium subsp. paratuberculosis
acguccugccaguugucgaucu

SEQ ID NO: 2811863 - RNA, 12 nt, Mycobacterium avium subsp. paratuberculosis
acguccuggcgc

SEQ ID NO: 2811864 - RNA, 15 nt, Mycobacterium avium subsp. paratuberculosis
acguccuggcgccag

SEQ ID NO: 2811865 - RNA, 19 nt, Mycobacterium avium subsp. paratuberculosis
acguccuugacccggccgc

SEQ ID NO: 2811866 - RNA, 21 nt, Mycobacterium avium subsp. paratuberculosis
acguccuugacccggccgcac

SEQ ID NO: 2811867 - RNA, 22 nt, Mycobacterium avium subsp. paratuberculosis
acguccuugaucagcaugucgc

SEQ ID NO: 2811868 - RNA, 15 nt, Mycobacterium avium subsp. paratuberculosis
acguccuuggugacg

SEQ ID NO: 2811869 - RNA, 19 nt, Mycobacterium avium subsp. paratuberculosis
acguccuuggugacggccu

SEQ ID NO: 2811870 - RNA, 23 nt, Mycobacterium avium subsp. paratuberculosis
acgucgaacccgaaaagcaccag

SEQ ID NO: 2811871 - RNA, 14 nt, Mycobacterium avium subsp. paratuberculosis
acgucgaacccgac

SEQ ID NO: 2811872 - RNA, 16 nt, Mycobacterium avium subsp. paratuberculosis
acgucgaacccgaccc

SEQ ID NO: 2811873 - RNA, 15 nt, Mycobacterium avium subsp. paratuberculosis
acgucgaagcccggg

SEQ ID NO: 2811874 - RNA, 16 nt, Mycobacterium avium subsp. paratuberculosis
acgucgaagcccgggu

SEQ ID NO: 2811875 - RNA, 21 nt, Mycobacterium avium subsp. paratuberculosis
acgucgaagggucggucgagc

SEQ ID NO: 2811876 - RNA, 18 nt, Mycobacterium avium subsp. paratuberculosis
acgucgacacgccggccg

SEQ ID NO: 2811877 - RNA, 19 nt, Mycobacterium avium subsp. paratuberculosis
acgucgacacgccggccgu

SEQ ID NO: 2811878 - RNA, 16 nt, Mycobacterium avium subsp. paratuberculosis
acgucgaccgcgacga

SEQ ID NO: 2811879 - RNA, 17 nt, Mycobacterium avium subsp. paratuberculosis
acgucgaccgcgacgac

SEQ ID NO: 2811880 - RNA, 16 nt, Mycobacterium avium subsp. paratuberculosis
acgucgaccgcgccgg

SEQ ID NO: 2811881 - RNA, 17 nt, Mycobacterium avium subsp. paratuberculosis
acgucgaccgcgccggg

SEQ ID NO: 2811882 - RNA, 18 nt, Mycobacterium avium subsp. paratuberculosis
acgucgaccuugcagccc

SEQ ID NO: 2811883 - RNA, 23 nt, Mycobacterium avium subsp. paratuberculosis
acgucgaccuugcagcccgcguc

SEQ ID NO: 2811884 - RNA, 11 nt, Mycobacterium avium subsp. paratuberculosis
acgucgacgac

SEQ ID NO: 2811885 - RNA, 15 nt, Mycobacterium avium subsp. paratuberculosis
acgucgacgcccugc

SEQ ID NO: 2811886 - RNA, 21 nt, Mycobacterium avium subsp. paratuberculosis
acgucgacgcccugccacagc

SEQ ID NO: 2811887 - RNA, 18 nt, Mycobacterium avium subsp. paratuberculosis
acgucgacgccggucucg

SEQ ID NO: 2811888 - RNA, 17 nt, Mycobacterium avium subsp. paratuberculosis
acgucgacggcagcgcu

SEQ ID NO: 2811889 - RNA, 14 nt, Mycobacterium avium subsp. paratuberculosis
acgucgacggccgc

SEQ ID NO: 2811890 - RNA, 15 nt, Mycobacterium avium subsp. paratuberculosis
acgucgacggccgcc

SEQ ID NO: 2811891 - RNA, 15 nt, Mycobacterium avium subsp. paratuberculosis
acgucgagcaguugc

SEQ ID NO: 2811892 - RNA, 13 nt, Mycobacterium avium subsp. paratuberculosis
acgucgagccagc

SEQ ID NO: 2811893 - RNA, 23 nt, Mycobacterium avium subsp. paratuberculosis
acgucgagccagcgggccgagcg

SEQ ID NO: 2811894 - RNA, 14 nt, Mycobacterium avium subsp. paratuberculosis
acgucgagcgcggc

SEQ ID NO: 2811895 - RNA, 15 nt, Mycobacterium avium subsp. paratuberculosis
acgucgagcgcggcc

SEQ ID NO: 2811896 - RNA, 18 nt, Mycobacterium avium subsp. paratuberculosis
acgucgagcgcggcccgc

SEQ ID NO: 2811897 - RNA, 20 nt, Mycobacterium avium subsp. paratuberculosis
acgucgagcgcggcccgccg

SEQ ID NO: 2811898 - RNA, 14 nt, Mycobacterium avium subsp. paratuberculosis
acgucgagcggccc

SEQ ID NO: 2811899 - RNA, 15 nt, Mycobacterium avium subsp. paratuberculosis
acgucgagcggcccg

SEQ ID NO: 2811900 - RNA, 16 nt, Mycobacterium avium subsp. paratuberculosis
acgucgagcggcccgu

SEQ ID NO: 2811901 - RNA, 18 nt, Mycobacterium avium subsp. paratuberculosis
acgucgagcggcccgucg

SEQ ID NO: 2811902 - RNA, 22 nt, Mycobacterium avium subsp. paratuberculosis
acgucgagcggcccgucgccga

SEQ ID NO: 2811903 - RNA, 23 nt, Mycobacterium avium subsp. paratuberculosis
acgucgagcggcccgucgccgau

SEQ ID NO: 2811904 - RNA, 15 nt, Mycobacterium avium subsp. paratuberculosis
acgucgagcggcgcc

SEQ ID NO: 2811905 - RNA, 18 nt, Mycobacterium avium subsp. paratuberculosis
acgucgagcggcgccugg

SEQ ID NO: 2811906 - RNA, 15 nt, Mycobacterium avium subsp. paratuberculosis
acgucgagcuccucg

SEQ ID NO: 2811907 - RNA, 20 nt, Mycobacterium avium subsp. paratuberculosis
acgucgagcuccucggccag

SEQ ID NO: 2811908 - RNA, 21 nt, Mycobacterium avium subsp. paratuberculosis
acgucgagcuccucggccagc

SEQ ID NO: 2811909 - RNA, 22 nt, Mycobacterium avium subsp. paratuberculosis
acgucgagcuccucggccagcg

SEQ ID NO: 2811910 - RNA, 15 nt, Mycobacterium avium subsp. paratuberculosis
acgucgagggugaug

SEQ ID NO: 2811911 - RNA, 18 nt, Mycobacterium avium subsp. paratuberculosis
acgucgaggucggacgcc

SEQ ID NO: 2811912 - RNA, 15 nt, Mycobacterium avium subsp. paratuberculosis
acgucgagguguugu

SEQ ID NO: 2811913 - RNA, 13 nt, Mycobacterium avium subsp. paratuberculosis
acgucgaucacgc

SEQ ID NO: 2811914 - RNA, 21 nt, Mycobacterium avium subsp. paratuberculosis
acgucgaucacgccgccgggg

SEQ ID NO: 2811915 - RNA, 22 nt, Mycobacterium avium subsp. paratuberculosis
acgucgaucacgccgccggggc

SEQ ID NO: 2811916 - RNA, 17 nt, Mycobacterium avium subsp. paratuberculosis
acgucguucaugaucgg

SEQ ID NO: 2811917 - RNA, 20 nt, Mycobacterium avium subsp. paratuberculosis
acgucguucaugaucggcag

SEQ ID NO: 2811918 - RNA, 20 nt, Mycobacterium avium subsp. paratuberculosis
acgucguugaccgaggcgau

SEQ ID NO: 2811919 - RNA, 22 nt, Mycobacterium avium subsp. paratuberculosis
acgucguuuuccagccggcgca

SEQ ID NO: 2811920 - RNA, 18 nt, Mycobacterium avium subsp. paratuberculosis
acgucucauaccagugcc

SEQ ID NO: 2811921 - RNA, 18 nt, Mycobacterium avium subsp. paratuberculosis
acgucucgcgggaguggc

SEQ ID NO: 2811922 - RNA, 23 nt, Mycobacterium avium subsp. paratuberculosis
acgucucgcgggaguggccggcg

SEQ ID NO: 2811923 - RNA, 23 nt, Mycobacterium avium subsp. paratuberculosis
acgucucggguuugccgacggug

SEQ ID NO: 2811924 - RNA, 18 nt, Mycobacterium avium subsp. paratuberculosis
acgucucugucgucgacc

SEQ ID NO: 2811925 - RNA, 19 nt, Mycobacterium avium subsp. paratuberculosis
acgucucugucgucgacca

SEQ ID NO: 2811926 - RNA, 18 nt, Mycobacterium avium subsp. paratuberculosis
acgucugcggcucggcgc

SEQ ID NO: 2811927 - RNA, 12 nt, Mycobacterium avium subsp. paratuberculosis
acgucugcucgg

SEQ ID NO: 2811928 - RNA, 16 nt, Mycobacterium avium subsp. paratuberculosis
acgucugcucggcggg

SEQ ID NO: 2811929 - RNA, 15 nt, Mycobacterium avium subsp. paratuberculosis
acgucuggccaccga

SEQ ID NO: 2811930 - RNA, 14 nt, Mycobacterium avium subsp. paratuberculosis
acgucugggccgcc

SEQ ID NO: 2811931 - RNA, 16 nt, Mycobacterium avium subsp. paratuberculosis
acgucugggccgccga

SEQ ID NO: 2811932 - RNA, 15 nt, Mycobacterium avium subsp. paratuberculosis
acgucugguuggccg

SEQ ID NO: 2811933 - RNA, 19 nt, Mycobacterium avium subsp. paratuberculosis
acgucugguuggccggcgg

SEQ ID NO: 2811934 - RNA, 20 nt, Mycobacterium avium subsp. paratuberculosis
acgucugguuggccggcggg

SEQ ID NO: 2811935 - RNA, 21 nt, Mycobacterium avium subsp. paratuberculosis
acgucugguuggccggcgggu

SEQ ID NO: 2811936 - RNA, 22 nt, Mycobacterium avium subsp. paratuberculosis
acgucugguuggccggcggguu

SEQ ID NO: 2811937 - RNA, 15 nt, Mycobacterium avium subsp. paratuberculosis
acgucuugucgggga

SEQ ID NO: 2811938 - RNA, 19 nt, Mycobacterium avium subsp. paratuberculosis
acgugaaacuagcuucacg

SEQ ID NO: 2811939 - RNA, 19 nt, Mycobacterium avium subsp. paratuberculosis
acgugaagcuaguuucacg

SEQ ID NO: 2811940 - RNA, 14 nt, Mycobacterium avium subsp. paratuberculosis
acgugauccaggua

SEQ ID NO: 2811941 - RNA, 16 nt, Mycobacterium avium subsp. paratuberculosis
acgugaucgcgguggc

SEQ ID NO: 2811942 - RNA, 18 nt, Mycobacterium avium subsp. paratuberculosis
acgugaucgcgguggccg

SEQ ID NO: 2811943 - RNA, 17 nt, Mycobacterium avium subsp. paratuberculosis
acgugaucggcggccug

SEQ ID NO: 2811944 - RNA, 21 nt, Mycobacterium avium subsp. paratuberculosis
acgugaucggcggccugcggc

SEQ ID NO: 2811945 - RNA, 18 nt, Mycobacterium avium subsp. paratuberculosis
acgugaucuggucggcca

SEQ ID NO: 2811946 - RNA, 19 nt, Mycobacterium avium subsp. paratuberculosis
acgugaucuggucggccag

SEQ ID NO: 2811947 - RNA, 20 nt, Mycobacterium avium subsp. paratuberculosis
acgugaucuggucggccagc

SEQ ID NO: 2811948 - RNA, 23 nt, Mycobacterium avium subsp. paratuberculosis
acgugaucuggucggccagcgcg

SEQ ID NO: 2811949 - RNA, 21 nt, Mycobacterium avium subsp. paratuberculosis
acgugaugagcgaggacgucg

SEQ ID NO: 2811950 - RNA, 22 nt, Mycobacterium avium subsp. paratuberculosis
acgugaugagcgaggacgucga

SEQ ID NO: 2811951 - RNA, 21 nt, Mycobacterium avium subsp. paratuberculosis
acgugauggcgaaguucggca

SEQ ID NO: 2811952 - RNA, 12 nt, Mycobacterium avium subsp. paratuberculosis
acgugcaccacc

SEQ ID NO: 2811953 - RNA, 13 nt, Mycobacterium avium subsp. paratuberculosis
acgugcacccacg

SEQ ID NO: 2811954 - RNA, 21 nt, Mycobacterium avium subsp. paratuberculosis
acgugcaccgcggccaacccg

SEQ ID NO: 2811955 - RNA, 17 nt, Mycobacterium avium subsp. paratuberculosis
acgugcacgugcaggug

SEQ ID NO: 2811956 - RNA, 17 nt, Mycobacterium avium subsp. paratuberculosis
acgugcacucagggcga

SEQ ID NO: 2811957 - RNA, 15 nt, Mycobacterium avium subsp. paratuberculosis
acgugcagcgccagc

SEQ ID NO: 2811958 - RNA, 15 nt, Mycobacterium avium subsp. paratuberculosis
acgugcaggugcggc

SEQ ID NO: 2811959 - RNA, 18 nt, Mycobacterium avium subsp. paratuberculosis
acgugccacuggcgccac

SEQ ID NO: 2811960 - RNA, 21 nt, Mycobacterium avium subsp. paratuberculosis
acgugccacuggcgccaccuc

SEQ ID NO: 2811961 - RNA, 23 nt, Mycobacterium avium subsp. paratuberculosis
acgugccccucgacccgaagcca

SEQ ID NO: 2811962 - RNA, 16 nt, Mycobacterium avium subsp. paratuberculosis
acgugcccgaucucgu

SEQ ID NO: 2811963 - RNA, 15 nt, Mycobacterium avium subsp. paratuberculosis
acgugcccuuccccg

SEQ ID NO: 2811964 - RNA, 19 nt, Mycobacterium avium subsp. paratuberculosis
acgugcccuuccccggcgg

SEQ ID NO: 2811965 - RNA, 20 nt, Mycobacterium avium subsp. paratuberculosis
acgugcccuuccccggcggc

SEQ ID NO: 2811966 - RNA, 22 nt, Mycobacterium avium subsp. paratuberculosis
acgugcccuuccccggcggccg

SEQ ID NO: 2811967 - RNA, 12 nt, Mycobacterium avium subsp. paratuberculosis
acgugccggcga

SEQ ID NO: 2811968 - RNA, 16 nt, Mycobacterium avium subsp. paratuberculosis
acgugccguugacgaa

SEQ ID NO: 2811969 - RNA, 16 nt, Mycobacterium avium subsp. paratuberculosis
acgugcgacaccggcg

SEQ ID NO: 2811970 - RNA, 17 nt, Mycobacterium avium subsp. paratuberculosis
acgugcgccggcggugc

SEQ ID NO: 2811971 - RNA, 21 nt, Mycobacterium avium subsp. paratuberculosis
acgugcgccggcggugcggcg

SEQ ID NO: 2811972 - RNA, 16 nt, Mycobacterium avium subsp. paratuberculosis
acgugcgcgccgaccg

SEQ ID NO: 2811973 - RNA, 17 nt, Mycobacterium avium subsp. paratuberculosis
acgugcgcgccgaccgc

SEQ ID NO: 2811974 - RNA, 19 nt, Mycobacterium avium subsp. paratuberculosis
acgugcgcgccgaccgcga

SEQ ID NO: 2811975 - RNA, 22 nt, Mycobacterium avium subsp. paratuberculosis
acgugcgcgccgaccgcgagca

SEQ ID NO: 2811976 - RNA, 17 nt, Mycobacterium avium subsp. paratuberculosis
acgugcgcggcgcgcga

SEQ ID NO: 2811977 - RNA, 23 nt, Mycobacterium avium subsp. paratuberculosis
acgugcgcggcguucuccagcac

SEQ ID NO: 2811978 - RNA, 15 nt, Mycobacterium avium subsp. paratuberculosis
acgugcgcgggaacg

SEQ ID NO: 2811979 - RNA, 19 nt, Mycobacterium avium subsp. paratuberculosis
acgugcggauggccccggc

SEQ ID NO: 2811980 - RNA, 22 nt, Mycobacterium avium subsp. paratuberculosis
acgugcggauggccccggcgag

SEQ ID NO: 2811981 - RNA, 14 nt, Mycobacterium avium subsp. paratuberculosis
acgugcggcgcccu

SEQ ID NO: 2811982 - RNA, 21 nt, Mycobacterium avium subsp. paratuberculosis
acgugcggcugcgcguucggc

SEQ ID NO: 2811983 - RNA, 15 nt, Mycobacterium avium subsp. paratuberculosis
acgugcucggcggcc

SEQ ID NO: 2811984 - RNA, 16 nt, Mycobacterium avium subsp. paratuberculosis
acgugcucggcggccg

SEQ ID NO: 2811985 - RNA, 22 nt, Mycobacterium avium subsp. paratuberculosis
acgugcucggcggccgccagcg

SEQ ID NO: 2811986 - RNA, 23 nt, Mycobacterium avium subsp. paratuberculosis
acgugcucugccuacuugcggcc

SEQ ID NO: 2811987 - RNA, 17 nt, Mycobacterium avium subsp. paratuberculosis
acgugcugugcgggcgg

SEQ ID NO: 2811988 - RNA, 15 nt, Mycobacterium avium subsp. paratuberculosis
acgugcuuggccagc

SEQ ID NO: 2811989 - RNA, 15 nt, Mycobacterium avium subsp. paratuberculosis
acguggaaauugcug

SEQ ID NO: 2811990 - RNA, 14 nt, Mycobacterium avium subsp. paratuberculosis
acguggaccgagcg

SEQ ID NO: 2811991 - RNA, 19 nt, Mycobacterium avium subsp. paratuberculosis
acguggaccgagcgcgcga

SEQ ID NO: 2811992 - RNA, 16 nt, Mycobacterium avium subsp. paratuberculosis
acguggacgcgcgcgg

SEQ ID NO: 2811993 - RNA, 23 nt, Mycobacterium avium subsp. paratuberculosis
acguggagcugaaguucaccacc

SEQ ID NO: 2811994 - RNA, 20 nt, Mycobacterium avium subsp. paratuberculosis
acguggagucgaagcggugc

SEQ ID NO: 2811995 - RNA, 15 nt, Mycobacterium avium subsp. paratuberculosis
acguggcaacgugcc

SEQ ID NO: 2811996 - RNA, 17 nt, Mycobacterium avium subsp. paratuberculosis
acguggcaacgugccac

SEQ ID NO: 2811997 - RNA, 23 nt, Mycobacterium avium subsp. paratuberculosis
acguggccgaucagcugcucggc

SEQ ID NO: 2811998 - RNA, 13 nt, Mycobacterium avium subsp. paratuberculosis
acguggccgggcu

SEQ ID NO: 2811999 - RNA, 15 nt, Mycobacterium avium subsp. paratuberculosis
acguggcggccgucg

SEQ ID NO: 2812000 - RNA, 18 nt, Mycobacterium avium subsp. paratuberculosis
acuccagcgcgaucaacg

SEQ ID NO: 2812001 - RNA, 15 nt, Mycobacterium avium subsp. paratuberculosis
acuccagcggcggcc

SEQ ID NO: 2812002 - RNA, 16 nt, Mycobacterium avium subsp. paratuberculosis
acuccagcggcggccc

SEQ ID NO: 2812003 - RNA, 20 nt, Mycobacterium avium subsp. paratuberculosis
acuccaggguucucgcggcg

SEQ ID NO: 2812004 - RNA, 13 nt, Mycobacterium avium subsp. paratuberculosis
acuccaguugacg

SEQ ID NO: 2812005 - RNA, 17 nt, Mycobacterium avium subsp. paratuberculosis
acuccaguugacggcgc

SEQ ID NO: 2812006 - RNA, 17 nt, Mycobacterium avium subsp. paratuberculosis
acuccaucacgaccucg

SEQ ID NO: 2812007 - RNA, 15 nt, Mycobacterium avium subsp. paratuberculosis
acuccaucccgugcg

SEQ ID NO: 2812008 - RNA, 17 nt, Mycobacterium avium subsp. paratuberculosis
acuccauccgccgucga

SEQ ID NO: 2812009 - RNA, 18 nt, Mycobacterium avium subsp. paratuberculosis
acucccagccgccggcca

SEQ ID NO: 2812010 - RNA, 22 nt, Mycobacterium avium subsp. paratuberculosis
acucccagccgccggccaccag

SEQ ID NO: 2812011 - RNA, 19 nt, Mycobacterium avium subsp. paratuberculosis
acucccgcgccgcggccag

SEQ ID NO: 2812012 - RNA, 15 nt, Mycobacterium avium subsp. paratuberculosis
acuccgacuccagca

SEQ ID NO: 2812013 - RNA, 16 nt, Mycobacterium avium subsp. paratuberculosis
acuccgacuccagcag

SEQ ID NO: 2812014 - RNA, 18 nt, Mycobacterium avium subsp. paratuberculosis
acuccgacuccagcagcg

SEQ ID NO: 2812015 - RNA, 19 nt, Mycobacterium avium subsp. paratuberculosis
acuccgacuccagcagcgc

SEQ ID NO: 2812016 - RNA, 21 nt, Mycobacterium avium subsp. paratuberculosis
acuccgacuccagcagcgccu

SEQ ID NO: 2812017 - RNA, 17 nt, Mycobacterium avium subsp. paratuberculosis
acuccgagccgguggag

SEQ ID NO: 2812018 - RNA, 18 nt, Mycobacterium avium subsp. paratuberculosis
acuccgaggucagcgcgu

SEQ ID NO: 2812019 - RNA, 19 nt, Mycobacterium avium subsp. paratuberculosis
acuccgccgaaccgaucac

SEQ ID NO: 2812020 - RNA, 14 nt, Mycobacterium avium subsp. paratuberculosis
acuccgcgauggcc

SEQ ID NO: 2812021 - RNA, 14 nt, Mycobacterium avium subsp. paratuberculosis
acuccgcgcgcggc

SEQ ID NO: 2812022 - RNA, 22 nt, Mycobacterium avium subsp. paratuberculosis
acuccgcucgggcccgcgcacc

SEQ ID NO: 2812023 - RNA, 23 nt, Mycobacterium avium subsp. paratuberculosis
acuccgcucgggcccgcgcaccg

SEQ ID NO: 2812024 - RNA, 23 nt, Mycobacterium avium subsp. paratuberculosis
acuccggcgacacguccagcucu

SEQ ID NO: 2812025 - RNA, 13 nt, Mycobacterium avium subsp. paratuberculosis
acuccggcgccgg

SEQ ID NO: 2812026 - RNA, 14 nt, Mycobacterium avium subsp. paratuberculosis
acuccggcgccggu

SEQ ID NO: 2812027 - RNA, 18 nt, Mycobacterium avium subsp. paratuberculosis
acuccggcgccggucagc

SEQ ID NO: 2812028 - RNA, 19 nt, Mycobacterium avium subsp. paratuberculosis
acuccgguaccacgccguc

SEQ ID NO: 2812029 - RNA, 20 nt, Mycobacterium avium subsp. paratuberculosis
acuccgguaccacgccgucg

SEQ ID NO: 2812030 - RNA, 21 nt, Mycobacterium avium subsp. paratuberculosis
acuccgguaccacgccgucga

SEQ ID NO: 2812031 - RNA, 15 nt, Mycobacterium avium subsp. paratuberculosis
acuccucacaccucg

SEQ ID NO: 2812032 - RNA, 14 nt, Mycobacterium avium subsp. paratuberculosis
acuccuccggcccg

SEQ ID NO: 2812033 - RNA, 22 nt, Mycobacterium avium subsp. paratuberculosis
acuccucggugacgaacggcga

SEQ ID NO: 2812034 - RNA, 18 nt, Mycobacterium avium subsp. paratuberculosis
acuccucgguggccucgc

SEQ ID NO: 2812035 - RNA, 13 nt, Mycobacterium avium subsp. paratuberculosis
acuccugcgcgaa

SEQ ID NO: 2812036 - RNA, 21 nt, Mycobacterium avium subsp. paratuberculosis
acuccugcgcgaaaggcccac

SEQ ID NO: 2812037 - RNA, 22 nt, Mycobacterium avium subsp. paratuberculosis
acuccuggguaagccaggucac

SEQ ID NO: 2812038 - RNA, 23 nt, Mycobacterium avium subsp. paratuberculosis
acuccuugaacccuuugagcauu

SEQ ID NO: 2812039 - RNA, 16 nt, Mycobacterium avium subsp. paratuberculosis
acucgaacggcccgga

SEQ ID NO: 2812040 - RNA, 15 nt, Mycobacterium avium subsp. paratuberculosis
acucgaagaaccgca

SEQ ID NO: 2812041 - RNA, 20 nt, Mycobacterium avium subsp. paratuberculosis
acucgaagaucgccugcagg

SEQ ID NO: 2812042 - RNA, 13 nt, Mycobacterium avium subsp. paratuberculosis
acucgacccgcac

SEQ ID NO: 2812043 - RNA, 18 nt, Mycobacterium avium subsp. paratuberculosis
acucgaccugcccgggcc

SEQ ID NO: 2812044 - RNA, 22 nt, Mycobacterium avium subsp. paratuberculosis
acucgaccugcccgggcccgau

SEQ ID NO: 2812045 - RNA, 19 nt, Mycobacterium avium subsp. paratuberculosis
acucgaccuucgagccgcc

SEQ ID NO: 2812046 - RNA, 14 nt, Mycobacterium avium subsp. paratuberculosis
acucgacgcucggc

SEQ ID NO: 2812047 - RNA, 20 nt, Mycobacterium avium subsp. paratuberculosis
acucgacggagugcguguca

SEQ ID NO: 2812048 - RNA, 15 nt, Mycobacterium avium subsp. paratuberculosis
acucgacgucgacgu

SEQ ID NO: 2812049 - RNA, 14 nt, Mycobacterium avium subsp. paratuberculosis
acucgacguucggc

SEQ ID NO: 2812050 - RNA, 18 nt, Mycobacterium avium subsp. paratuberculosis
acucgacguucggcgggc

SEQ ID NO: 2812051 - RNA, 20 nt, Mycobacterium avium subsp. paratuberculosis
acucgacguucggcgggcag

SEQ ID NO: 2812052 - RNA, 16 nt, Mycobacterium avium subsp. paratuberculosis
acucgagcgugcccgc

SEQ ID NO: 2812053 - RNA, 22 nt, Mycobacterium avium subsp. paratuberculosis
acucgagcgugcccgcgcccac

SEQ ID NO: 2812054 - RNA, 17 nt, Mycobacterium avium subsp. paratuberculosis
acucgaucagcaccgcc

SEQ ID NO: 2812055 - RNA, 23 nt, Mycobacterium avium subsp. paratuberculosis
acucgaucagcaccgccacgccg

SEQ ID NO: 2812056 - RNA, 15 nt, Mycobacterium avium subsp. paratuberculosis
acucgaucgccaccg

SEQ ID NO: 2812057 - RNA, 17 nt, Mycobacterium avium subsp. paratuberculosis
acucgaugcgcgugacg

SEQ ID NO: 2812058 - RNA, 18 nt, Mycobacterium avium subsp. paratuberculosis
acucgaugcgcgugacgc

SEQ ID NO: 2812059 - RNA, 20 nt, Mycobacterium avium subsp. paratuberculosis
acucgaugggggugccgcag

SEQ ID NO: 2812060 - RNA, 17 nt, Mycobacterium avium subsp. paratuberculosis
acucgauguagccgggc

SEQ ID NO: 2812061 - RNA, 19 nt, Mycobacterium avium subsp. paratuberculosis
acucgauguagccgggcuc

SEQ ID NO: 2812062 - RNA, 12 nt, Mycobacterium avium subsp. paratuberculosis
acucgcccaaug

SEQ ID NO: 2812063 - RNA, 16 nt, Mycobacterium avium subsp. paratuberculosis
acucgccggagcgccc

SEQ ID NO: 2812064 - RNA, 13 nt, Mycobacterium avium subsp. paratuberculosis
acucgccggcggc

SEQ ID NO: 2812065 - RNA, 14 nt, Mycobacterium avium subsp. paratuberculosis
acucgccggcggcg

SEQ ID NO: 2812066 - RNA, 18 nt, Mycobacterium avium subsp. paratuberculosis
acucgccguggaauucga

SEQ ID NO: 2812067 - RNA, 16 nt, Mycobacterium avium subsp. paratuberculosis
acucgcgaggccgcca

SEQ ID NO: 2812068 - RNA, 15 nt, Mycobacterium avium subsp. paratuberculosis
acucgcgcaggguca

SEQ ID NO: 2812069 - RNA, 21 nt, Mycobacterium avium subsp. paratuberculosis
acucgcgcucccggcgccgcc

SEQ ID NO: 2812070 - RNA, 23 nt, Mycobacterium avium subsp. paratuberculosis
acucgcgcucccggcgccgccgu

SEQ ID NO: 2812071 - RNA, 15 nt, Mycobacterium avium subsp. paratuberculosis
acucgcggcggguca

SEQ ID NO: 2812072 - RNA, 22 nt, Mycobacterium avium subsp. paratuberculosis
acucgcggcgggucagcacccg

SEQ ID NO: 2812073 - RNA, 17 nt, Mycobacterium avium subsp. paratuberculosis
acucgcgggcgagcagc

SEQ ID NO: 2812074 - RNA, 19 nt, Mycobacterium avium subsp. paratuberculosis
acucgcgggcgagcagcgc

SEQ ID NO: 2812075 - RNA, 21 nt, Mycobacterium avium subsp. paratuberculosis
acucgcgggcgagcagcgccc

SEQ ID NO: 2812076 - RNA, 20 nt, Mycobacterium avium subsp. paratuberculosis
acucgcguccccgcgccggg

SEQ ID NO: 2812077 - RNA, 23 nt, Mycobacterium avium subsp. paratuberculosis
acucggacagguggccgaucagc

SEQ ID NO: 2812078 - RNA, 14 nt, Mycobacterium avium subsp. paratuberculosis
acucggacgccggc

SEQ ID NO: 2812079 - RNA, 17 nt, Mycobacterium avium subsp. paratuberculosis
acucggacgccggcagc

SEQ ID NO: 2812080 - RNA, 15 nt, Mycobacterium avium subsp. paratuberculosis
acucggccggcaccu

SEQ ID NO: 2812081 - RNA, 16 nt, Mycobacterium avium subsp. paratuberculosis
acucggccuccgcgcg

SEQ ID NO: 2812082 - RNA, 17 nt, Mycobacterium avium subsp. paratuberculosis
acucggccuccgcgcgc

SEQ ID NO: 2812083 - RNA, 18 nt, Mycobacterium avium subsp. paratuberculosis
acucggcgaugcgccguc

SEQ ID NO: 2812084 - RNA, 18 nt, Mycobacterium avium subsp. paratuberculosis
acugcugccguccaacac

SEQ ID NO: 2812085 - RNA, 18 nt, Mycobacterium avium subsp. paratuberculosis
acugcugcgcagacccgg

SEQ ID NO: 2812086 - RNA, 13 nt, Mycobacterium avium subsp. paratuberculosis
acugcugcgggug

SEQ ID NO: 2812087 - RNA, 19 nt, Mycobacterium avium subsp. paratuberculosis
acugcugcgggugcggcca

SEQ ID NO: 2812088 - RNA, 19 nt, Mycobacterium avium subsp. paratuberculosis
acugcuucgggucgccggu

SEQ ID NO: 2812089 - RNA, 14 nt, Mycobacterium avium subsp. paratuberculosis
acugcuugccgccg

SEQ ID NO: 2812090 - RNA, 15 nt, Mycobacterium avium subsp. paratuberculosis
acugcuugccgccgg

SEQ ID NO: 2812091 - RNA, 17 nt, Mycobacterium avium subsp. paratuberculosis
acugcuugccgccgggc

SEQ ID NO: 2812092 - RNA, 14 nt, Mycobacterium avium subsp. paratuberculosis
acugcuugccgucg

SEQ ID NO: 2812093 - RNA, 16 nt, Mycobacterium avium subsp. paratuberculosis
acugcuugccgucgac

SEQ ID NO: 2812094 - RNA, 18 nt, Mycobacterium avium subsp. paratuberculosis
acugcuugccgucgacgc

SEQ ID NO: 2812095 - RNA, 22 nt, Mycobacterium avium subsp. paratuberculosis
acugcuugggcgccucgccgac

SEQ ID NO: 2812096 - RNA, 23 nt, Mycobacterium avium subsp. paratuberculosis
acugcuugggcgccucgccgacc

SEQ ID NO: 2812097 - RNA, 18 nt, Mycobacterium avium subsp. paratuberculosis
acuggaccgugccggaau

SEQ ID NO: 2812098 - RNA, 18 nt, Mycobacterium avium subsp. paratuberculosis
acuggacgccguggaucg

SEQ ID NO: 2812099 - RNA, 14 nt, Mycobacterium avium subsp. paratuberculosis
acuggagugcugca

SEQ ID NO: 2812100 - RNA, 17 nt, Mycobacterium avium subsp. paratuberculosis
acuggagugcugcagac

SEQ ID NO: 2812101 - RNA, 17 nt, Mycobacterium avium subsp. paratuberculosis
acuggcccacgcagccg

SEQ ID NO: 2812102 - RNA, 19 nt, Mycobacterium avium subsp. paratuberculosis
acuggcccacgcagccguc

SEQ ID NO: 2812103 - RNA, 21 nt, Mycobacterium avium subsp. paratuberculosis
acuggcccacgcagccgucga

SEQ ID NO: 2812104 - RNA, 15 nt, Mycobacterium avium subsp. paratuberculosis
acuggcgccaccucc

SEQ ID NO: 2812105 - RNA, 12 nt, Mycobacterium avium subsp. paratuberculosis
acuggcgccggu

SEQ ID NO: 2812106 - RNA, 14 nt, Mycobacterium avium subsp. paratuberculosis
acuggcgcugcgcu

SEQ ID NO: 2812107 - RNA, 15 nt, Mycobacterium avium subsp. paratuberculosis
acuggcggccggccg

SEQ ID NO: 2812108 - RNA, 18 nt, Mycobacterium avium subsp. paratuberculosis
acuggcugagcaccgggg

SEQ ID NO: 2812109 - RNA, 20 nt, Mycobacterium avium subsp. paratuberculosis
acuggcugagcaccgggguc

SEQ ID NO: 2812110 - RNA, 12 nt, Mycobacterium avium subsp. paratuberculosis
acugggccaggu

SEQ ID NO: 2812111 - RNA, 13 nt, Mycobacterium avium subsp. paratuberculosis
acugggccgccgu

SEQ ID NO: 2812112 - RNA, 14 nt, Mycobacterium avium subsp. paratuberculosis
acugggccgccguc

SEQ ID NO: 2812113 - RNA, 15 nt, Mycobacterium avium subsp. paratuberculosis
acugggccgccgucg

SEQ ID NO: 2812114 - RNA, 16 nt, Mycobacterium avium subsp. paratuberculosis
acugggccgccgucgc

SEQ ID NO: 2812115 - RNA, 15 nt, Mycobacterium avium subsp. paratuberculosis
acugggcggccugca

SEQ ID NO: 2812116 - RNA, 13 nt, Mycobacterium avium subsp. paratuberculosis
acugggcgucggc

SEQ ID NO: 2812117 - RNA, 18 nt, Mycobacterium avium subsp. paratuberculosis
acuggggugucagcgcga

SEQ ID NO: 2812118 - RNA, 20 nt, Mycobacterium avium subsp. paratuberculosis
acuggggugucagcgcgacc

SEQ ID NO: 2812119 - RNA, 13 nt, Mycobacterium avium subsp. paratuberculosis
acugggugccccg

SEQ ID NO: 2812120 - RNA, 23 nt, Mycobacterium avium subsp. paratuberculosis
acugggugccccgccguuucagc

SEQ ID NO: 2812121 - RNA, 23 nt, Mycobacterium avium subsp. paratuberculosis
acugggugcgcgggcgcccguag

SEQ ID NO: 2812122 - RNA, 16 nt, Mycobacterium avium subsp. paratuberculosis
acugguccuccaacgg

SEQ ID NO: 2812123 - RNA, 18 nt, Mycobacterium avium subsp. paratuberculosis
acugguccugcggcuggu

SEQ ID NO: 2812124 - RNA, 21 nt, Mycobacterium avium subsp. paratuberculosis
acuggucgaacagcgcgcccg

SEQ ID NO: 2812125 - RNA, 17 nt, Mycobacterium avium subsp. paratuberculosis
acuggucgucgagcuga

SEQ ID NO: 2812126 - RNA, 20 nt, Mycobacterium avium subsp. paratuberculosis
acuggucgugcagcaccgcc

SEQ ID NO: 2812127 - RNA, 22 nt, Mycobacterium avium subsp. paratuberculosis
acuggucgugcagcaccgccag

SEQ ID NO: 2812128 - RNA, 23 nt, Mycobacterium avium subsp. paratuberculosis
acuggucgugcagcaccgccagc

SEQ ID NO: 2812129 - RNA, 12 nt, Mycobacterium avium subsp. paratuberculosis
acuggucgugcu

SEQ ID NO: 2812130 - RNA, 21 nt, Mycobacterium avium subsp. paratuberculosis
acuggucgugcucgucggcgg

SEQ ID NO: 2812131 - RNA, 14 nt, Mycobacterium avium subsp. paratuberculosis
acuggucgugcugg

SEQ ID NO: 2812132 - RNA, 16 nt, Mycobacterium avium subsp. paratuberculosis
acuggucgugcuggag

SEQ ID NO: 2812133 - RNA, 16 nt, Mycobacterium avium subsp. paratuberculosis
acuggucguugcacac

SEQ ID NO: 2812134 - RNA, 15 nt, Mycobacterium avium subsp. paratuberculosis
acuggugggcgucgu

SEQ ID NO: 2812135 - RNA, 19 nt, Mycobacterium avium subsp. paratuberculosis
acuggugggcgucgugguc

SEQ ID NO: 2812136 - RNA, 20 nt, Mycobacterium avium subsp. paratuberculosis
acugguuccacaccaccaug

SEQ ID NO: 2812137 - RNA, 17 nt, Mycobacterium avium subsp. paratuberculosis
acuguauuugaguucuc

SEQ ID NO: 2812138 - RNA, 20 nt, Mycobacterium avium subsp. paratuberculosis
acuguccaggccgaggcuga

SEQ ID NO: 2812139 - RNA, 15 nt, Mycobacterium avium subsp. paratuberculosis
acugucggcgccccg

SEQ ID NO: 2812140 - RNA, 16 nt, Mycobacterium avium subsp. paratuberculosis
acugucggcgcggacg

SEQ ID NO: 2812141 - RNA, 18 nt, Mycobacterium avium subsp. paratuberculosis
acugucggcucgcccgcg

SEQ ID NO: 2812142 - RNA, 20 nt, Mycobacterium avium subsp. paratuberculosis
acugucggcucgcccgcgac

SEQ ID NO: 2812143 - RNA, 16 nt, Mycobacterium avium subsp. paratuberculosis
acuguuacgcccgauc

SEQ ID NO: 2812144 - RNA, 13 nt, Mycobacterium avium subsp. paratuberculosis
acuguucgcggcu

SEQ ID NO: 2812145 - RNA, 15 nt, Mycobacterium avium subsp. paratuberculosis
acuguucgcggcugg

SEQ ID NO: 2812146 - RNA, 23 nt, Mycobacterium avium subsp. paratuberculosis
acuguucgcggcuggccgcggcg

SEQ ID NO: 2812147 - RNA, 15 nt, Mycobacterium avium subsp. paratuberculosis
acuguugucagccac

SEQ ID NO: 2812148 - RNA, 13 nt, Mycobacterium avium subsp. paratuberculosis
acuguuugaugcc

SEQ ID NO: 2812149 - RNA, 18 nt, Mycobacterium avium subsp. paratuberculosis
acuucaccgucugcuggc

SEQ ID NO: 2812150 - RNA, 20 nt, Mycobacterium avium subsp. paratuberculosis
acuucaccgucugcuggccc

SEQ ID NO: 2812151 - RNA, 18 nt, Mycobacterium avium subsp. paratuberculosis
acuucacgcucgcgugcg

SEQ ID NO: 2812152 - RNA, 13 nt, Mycobacterium avium subsp. paratuberculosis
acuucacgcucgg

SEQ ID NO: 2812153 - RNA, 17 nt, Mycobacterium avium subsp. paratuberculosis
acuucaggcccucaucg

SEQ ID NO: 2812154 - RNA, 18 nt, Mycobacterium avium subsp. paratuberculosis
acuucaggcccucaucgu

SEQ ID NO: 2812155 - RNA, 17 nt, Mycobacterium avium subsp. paratuberculosis
acuucauguaccggucg

SEQ ID NO: 2812156 - RNA, 15 nt, Mycobacterium avium subsp. paratuberculosis
acuuccgcgcaggga

SEQ ID NO: 2812157 - RNA, 18 nt, Mycobacterium avium subsp. paratuberculosis
acuucgacggcagcggca

SEQ ID NO: 2812158 - RNA, 15 nt, Mycobacterium avium subsp. paratuberculosis
acuucgacggugaug

SEQ ID NO: 2812159 - RNA, 14 nt, Mycobacterium avium subsp. paratuberculosis
acuucgagccgggc

SEQ ID NO: 2812160 - RNA, 15 nt, Mycobacterium avium subsp. paratuberculosis
acuucgccagcgggc

SEQ ID NO: 2812161 - RNA, 15 nt, Mycobacterium avium subsp. paratuberculosis
acuucgcguuccgcc

SEQ ID NO: 2812162 - RNA, 17 nt, Mycobacterium avium subsp. paratuberculosis
acuucgcguuccgccac

SEQ ID NO: 2812163 - RNA, 20 nt, Mycobacterium avium subsp. paratuberculosis
acuucgcuguaguagccggg

SEQ ID NO: 2812164 - RNA, 21 nt, Mycobacterium avium subsp. paratuberculosis
acuucgcuguaguagccgggg

SEQ ID NO: 2812165 - RNA, 16 nt, Mycobacterium avium subsp. paratuberculosis
acuucggguguggugc

SEQ ID NO: 2812166 - RNA, 15 nt, Mycobacterium avium subsp. paratuberculosis
acuucgucagcagcg

SEQ ID NO: 2812167 - RNA, 16 nt, Mycobacterium avium subsp. paratuberculosis
acuucgucagcagcga

SEQ ID NO: 2812168 - RNA, 13 nt, Mycobacterium avium subsp. paratuberculosis
acuucguccaucg

SEQ ID NO: 2812169 - RNA, 21 nt, Mycobacterium avium subsp. paratuberculosis
agaccccggcguccaguagcc

SEQ ID NO: 2812170 - RNA, 20 nt, Mycobacterium avium subsp. paratuberculosis
agacccgcccggagaacucc

SEQ ID NO: 2812171 - RNA, 18 nt, Mycobacterium avium subsp. paratuberculosis
agacccggggguccaggg

SEQ ID NO: 2812172 - RNA, 20 nt, Mycobacterium avium subsp. paratuberculosis
agaccgcacaauccggucag

SEQ ID NO: 2812173 - RNA, 21 nt, Mycobacterium avium subsp. paratuberculosis
agaccgcacaauccggucagc

SEQ ID NO: 2812174 - RNA, 20 nt, Mycobacterium avium subsp. paratuberculosis
agaccgccggugcgcagcuu

SEQ ID NO: 2812175 - RNA, 19 nt, Mycobacterium avium subsp. paratuberculosis
agaccgcgaucagccccag

SEQ ID NO: 2812176 - RNA, 12 nt, Mycobacterium avium subsp. paratuberculosis
agaccgcgguca

SEQ ID NO: 2812177 - RNA, 20 nt, Mycobacterium avium subsp. paratuberculosis
agaccggacagcugggcgua

SEQ ID NO: 2812178 - RNA, 15 nt, Mycobacterium avium subsp. paratuberculosis
agaccggccggggcg

SEQ ID NO: 2812179 - RNA, 13 nt, Mycobacterium avium subsp. paratuberculosis
agaccggcggcga

SEQ ID NO: 2812180 - RNA, 14 nt, Mycobacterium avium subsp. paratuberculosis
agaccggcggcgau

SEQ ID NO: 2812181 - RNA, 20 nt, Mycobacterium avium subsp. paratuberculosis
agaccggcggcgaucggcgc

SEQ ID NO: 2812182 - RNA, 12 nt, Mycobacterium avium subsp. paratuberculosis
agaccgggccga

SEQ ID NO: 2812183 - RNA, 13 nt, Mycobacterium avium subsp. paratuberculosis
agaccgggucgua

SEQ ID NO: 2812184 - RNA, 21 nt, Mycobacterium avium subsp. paratuberculosis
agaccgggucguagccgaagc

SEQ ID NO: 2812185 - RNA, 18 nt, Mycobacterium avium subsp. paratuberculosis
agaccggugagcaccggg

SEQ ID NO: 2812186 - RNA, 20 nt, Mycobacterium avium subsp. paratuberculosis
agaccguccgguucggcggc

SEQ ID NO: 2812187 - RNA, 15 nt, Mycobacterium avium subsp. paratuberculosis
agaccgugugccagc

SEQ ID NO: 2812188 - RNA, 18 nt, Mycobacterium avium subsp. paratuberculosis
agaccgugugccagcccg

SEQ ID NO: 2812189 - RNA, 20 nt, Mycobacterium avium subsp. paratuberculosis
agaccucacggucggcgucc

SEQ ID NO: 2812190 - RNA, 23 nt, Mycobacterium avium subsp. paratuberculosis
agaccucccggcgccacgccgcg

SEQ ID NO: 2812191 - RNA, 14 nt, Mycobacterium avium subsp. paratuberculosis
agaccugguugccg

SEQ ID NO: 2812192 - RNA, 20 nt, Mycobacterium avium subsp. paratuberculosis
agaccugguugccgcccucg

SEQ ID NO: 2812193 - RNA, 16 nt, Mycobacterium avium subsp. paratuberculosis
agaccuugaccaccga

SEQ ID NO: 2812194 - RNA, 15 nt, Mycobacterium avium subsp. paratuberculosis
agacgacccgagagc

SEQ ID NO: 2812195 - RNA, 21 nt, Mycobacterium avium subsp. paratuberculosis
agacgacgacgaacgcgguga

SEQ ID NO: 2812196 - RNA, 14 nt, Mycobacterium avium subsp. paratuberculosis
agacgacgccacca

SEQ ID NO: 2812197 - RNA, 12 nt, Mycobacterium avium subsp. paratuberculosis
agacgacgucga

SEQ ID NO: 2812198 - RNA, 19 nt, Mycobacterium avium subsp. paratuberculosis
agacgacucuuccaggaca

SEQ ID NO: 2812199 - RNA, 14 nt, Mycobacterium avium subsp. paratuberculosis
agacgagccgccgc

SEQ ID NO: 2812200 - RNA, 17 nt, Mycobacterium avium subsp. paratuberculosis
agacgagccgccgcggg

SEQ ID NO: 2812201 - RNA, 15 nt, Mycobacterium avium subsp. paratuberculosis
agacgagcucaccgc

SEQ ID NO: 2812202 - RNA, 21 nt, Mycobacterium avium subsp. paratuberculosis
agacgaucaccggcuugccga

SEQ ID NO: 2812203 - RNA, 16 nt, Mycobacterium avium subsp. paratuberculosis
agacgaucucgccguc

SEQ ID NO: 2812204 - RNA, 18 nt, Mycobacterium avium subsp. paratuberculosis
agacgaucucgccguccu

SEQ ID NO: 2812205 - RNA, 15 nt, Mycobacterium avium subsp. paratuberculosis
agacgaugcccagcc

SEQ ID NO: 2812206 - RNA, 14 nt, Mycobacterium avium subsp. paratuberculosis
agacgaugucgucg

SEQ ID NO: 2812207 - RNA, 15 nt, Mycobacterium avium subsp. paratuberculosis
agacgaugucgucgc

SEQ ID NO: 2812208 - RNA, 23 nt, Mycobacterium avium subsp. paratuberculosis
agacgaugucgucgccgguggcc

SEQ ID NO: 2812209 - RNA, 20 nt, Mycobacterium avium subsp. paratuberculosis
agacgcaaaagccccgcgac

SEQ ID NO: 2812210 - RNA, 14 nt, Mycobacterium avium subsp. paratuberculosis
agacgccccaguug

SEQ ID NO: 2812211 - RNA, 16 nt, Mycobacterium avium subsp. paratuberculosis
agacgcgaaagcaccc

SEQ ID NO: 2812212 - RNA, 17 nt, Mycobacterium avium subsp. paratuberculosis
agacgcgaaagcagcgu

SEQ ID NO: 2812213 - RNA, 19 nt, Mycobacterium avium subsp. paratuberculosis
agacgcgaaagucccccaa

SEQ ID NO: 2812214 - RNA, 16 nt, Mycobacterium avium subsp. paratuberculosis
agacgcgcaccagggc

SEQ ID NO: 2812215 - RNA, 22 nt, Mycobacterium avium subsp. paratuberculosis
agacgcgcaccagggccgcgag

SEQ ID NO: 2812216 - RNA, 21 nt, Mycobacterium avium subsp. paratuberculosis
agacgcgcaccgccaccgccc

SEQ ID NO: 2812217 - RNA, 13 nt, Mycobacterium avium subsp. paratuberculosis
agacgcgggcgcc

SEQ ID NO: 2812218 - RNA, 13 nt, Mycobacterium avium subsp. paratuberculosis
agacgcugccgcu

SEQ ID NO: 2812219 - RNA, 15 nt, Mycobacterium avium subsp. paratuberculosis
agacgcuggccacga

SEQ ID NO: 2812220 - RNA, 13 nt, Mycobacterium avium subsp. paratuberculosis
agacggacacccg

SEQ ID NO: 2812221 - RNA, 17 nt, Mycobacterium avium subsp. paratuberculosis
agacggacacccgcgcg

SEQ ID NO: 2812222 - RNA, 20 nt, Mycobacterium avium subsp. paratuberculosis
agacggacacccgcgcggug

SEQ ID NO: 2812223 - RNA, 22 nt, Mycobacterium avium subsp. paratuberculosis
agacggcaugccgggccagccg

SEQ ID NO: 2812224 - RNA, 16 nt, Mycobacterium avium subsp. paratuberculosis
agacggucuuggcguu

SEQ ID NO: 2812225 - RNA, 16 nt, Mycobacterium avium subsp. paratuberculosis
agacggugcuggcgau

SEQ ID NO: 2812226 - RNA, 23 nt, Mycobacterium avium subsp. paratuberculosis
agacggugggcccgccgucgacc

SEQ ID NO: 2812227 - RNA, 14 nt, Mycobacterium avium subsp. paratuberculosis
agacgguggggcug

SEQ ID NO: 2812228 - RNA, 18 nt, Mycobacterium avium subsp. paratuberculosis
agacgguggggcuggccg

SEQ ID NO: 2812229 - RNA, 22 nt, Mycobacterium avium subsp. paratuberculosis
agacguaagccauggcggcccg

SEQ ID NO: 2812230 - RNA, 18 nt, Mycobacterium avium subsp. paratuberculosis
agacguacggaugccccu

SEQ ID NO: 2812231 - RNA, 16 nt, Mycobacterium avium subsp. paratuberculosis
agacguaggcggccag

SEQ ID NO: 2812232 - RNA, 21 nt, Mycobacterium avium subsp. paratuberculosis
agacguaggcggccagcagca

SEQ ID NO: 2812233 - RNA, 14 nt, Mycobacterium avium subsp. paratuberculosis
agacguccagcgcc

SEQ ID NO: 2812234 - RNA, 17 nt, Mycobacterium avium subsp. paratuberculosis
agacguccagcgccgcc

SEQ ID NO: 2812235 - RNA, 14 nt, Mycobacterium avium subsp. paratuberculosis
agacguccgagguc

SEQ ID NO: 2812236 - RNA, 20 nt, Mycobacterium avium subsp. paratuberculosis
agacguccgcgucggcgccg

SEQ ID NO: 2812237 - RNA, 23 nt, Mycobacterium avium subsp. paratuberculosis
agacguccgcgucggcgccggcc

SEQ ID NO: 2812238 - RNA, 14 nt, Mycobacterium avium subsp. paratuberculosis
agacguccucgguc

SEQ ID NO: 2812239 - RNA, 22 nt, Mycobacterium avium subsp. paratuberculosis
agacguccucggucucguccag

SEQ ID NO: 2812240 - RNA, 11 nt, Mycobacterium avium subsp. paratuberculosis
agacgucgacc

SEQ ID NO: 2812241 - RNA, 16 nt, Mycobacterium avium subsp. paratuberculosis
agacgucggcgcgguc

SEQ ID NO: 2812242 - RNA, 18 nt, Mycobacterium avium subsp. paratuberculosis
agacgugacgugccccuc

SEQ ID NO: 2812243 - RNA, 19 nt, Mycobacterium avium subsp. paratuberculosis
agacgugcacgugcaggug

SEQ ID NO: 2812244 - RNA, 22 nt, Mycobacterium avium subsp. paratuberculosis
agacguggucgggcaugccggc

SEQ ID NO: 2812245 - RNA, 23 nt, Mycobacterium avium subsp. paratuberculosis
agacguggucgggcaugccggcc

SEQ ID NO: 2812246 - RNA, 19 nt, Mycobacterium avium subsp. paratuberculosis
agacguguggcacccgggu

SEQ ID NO: 2812247 - RNA, 18 nt, Mycobacterium avium subsp. paratuberculosis
agacguucuccccgccgg

SEQ ID NO: 2812248 - RNA, 20 nt, Mycobacterium avium subsp. paratuberculosis
agacguugccgaucccggcc

SEQ ID NO: 2812249 - RNA, 22 nt, Mycobacterium avium subsp. paratuberculosis
agacguugccgcacaccgcgca

SEQ ID NO: 2812250 - RNA, 20 nt, Mycobacterium avium subsp. paratuberculosis
agacucacggcggcagcgcg

SEQ ID NO: 2812251 - RNA, 15 nt, Mycobacterium avium subsp. paratuberculosis
agacucagcccggcc

SEQ ID NO: 2812252 - RNA, 20 nt, Mycobacterium avium subsp. paratuberculosis
agacucagcccggcccagcc

SEQ ID NO: 2812253 - RNA, 19 nt, Mycobacterium avium subsp. paratuberculosis
agaucgcggcccgccgcuc

SEQ ID NO: 2812254 - RNA, 16 nt, Mycobacterium avium subsp. paratuberculosis
agaucgcugaugcgca

SEQ ID NO: 2812255 - RNA, 16 nt, Mycobacterium avium subsp. paratuberculosis
agaucggccagccacg

SEQ ID NO: 2812256 - RNA, 15 nt, Mycobacterium avium subsp. paratuberculosis
agaucggccagcgcg

SEQ ID NO: 2812257 - RNA, 19 nt, Mycobacterium avium subsp. paratuberculosis
agaucggccagcgcggccg

SEQ ID NO: 2812258 - RNA, 21 nt, Mycobacterium avium subsp. paratuberculosis
agaucguagggcucggcgucg

SEQ ID NO: 2812259 - RNA, 13 nt, Mycobacterium avium subsp. paratuberculosis
agaucgucgggca

SEQ ID NO: 2812260 - RNA, 16 nt, Mycobacterium avium subsp. paratuberculosis
agaucgucgggcaccu

SEQ ID NO: 2812261 - RNA, 14 nt, Mycobacterium avium subsp. paratuberculosis
agaucgucgucccg

SEQ ID NO: 2812262 - RNA, 18 nt, Mycobacterium avium subsp. paratuberculosis
agaucgucuugaccgccc

SEQ ID NO: 2812263 - RNA, 19 nt, Mycobacterium avium subsp. paratuberculosis
agaucgucuugaccgcccg

SEQ ID NO: 2812264 - RNA, 19 nt, Mycobacterium avium subsp. paratuberculosis
agaucguguccgcgccggc

SEQ ID NO: 2812265 - RNA, 19 nt, Mycobacterium avium subsp. paratuberculosis
agaucuccgccuucgacga

SEQ ID NO: 2812266 - RNA, 19 nt, Mycobacterium avium subsp. paratuberculosis
agaucuccgggaacgcggc

SEQ ID NO: 2812267 - RNA, 20 nt, Mycobacterium avium subsp. paratuberculosis
agaucuccgggaacgcggcg

SEQ ID NO: 2812268 - RNA, 17 nt, Mycobacterium avium subsp. paratuberculosis
agaucuccucggacccg

SEQ ID NO: 2812269 - RNA, 22 nt, Mycobacterium avium subsp. paratuberculosis
agaucucgcgccgcgcauuguu

SEQ ID NO: 2812270 - RNA, 12 nt, Mycobacterium avium subsp. paratuberculosis
agaucucggcgu

SEQ ID NO: 2812271 - RNA, 21 nt, Mycobacterium avium subsp. paratuberculosis
agaucuguauuaagcuggcag

SEQ ID NO: 2812272 - RNA, 16 nt, Mycobacterium avium subsp. paratuberculosis
agaugaagacccggcc

SEQ ID NO: 2812273 - RNA, 20 nt, Mycobacterium avium subsp. paratuberculosis
agaugagauccuuugcggcc

SEQ ID NO: 2812274 - RNA, 13 nt, Mycobacterium avium subsp. paratuberculosis
agaugagccgcag

SEQ ID NO: 2812275 - RNA, 15 nt, Mycobacterium avium subsp. paratuberculosis
agaugaucagccgcc

SEQ ID NO: 2812276 - RNA, 16 nt, Mycobacterium avium subsp. paratuberculosis
agaugaucagccgccc

SEQ ID NO: 2812277 - RNA, 17 nt, Mycobacterium avium subsp. paratuberculosis
agaugaucagcgcgccc

SEQ ID NO: 2812278 - RNA, 21 nt, Mycobacterium avium subsp. paratuberculosis
agaugaucagcgcgcccaggc

SEQ ID NO: 2812279 - RNA, 15 nt, Mycobacterium avium subsp. paratuberculosis
agaugaucucgccga

SEQ ID NO: 2812280 - RNA, 17 nt, Mycobacterium avium subsp. paratuberculosis
agaugaucucgccgagc

SEQ ID NO: 2812281 - RNA, 15 nt, Mycobacterium avium subsp. paratuberculosis
agaugauggccgcgc

SEQ ID NO: 2812282 - RNA, 19 nt, Mycobacterium avium subsp. paratuberculosis
agaugauggccgcgccgcc

SEQ ID NO: 2812283 - RNA, 19 nt, Mycobacterium avium subsp. paratuberculosis
agaugauugcgugcccggc

SEQ ID NO: 2812284 - RNA, 20 nt, Mycobacterium avium subsp. paratuberculosis
agaugauugcgugcccggcc

SEQ ID NO: 2812285 - RNA, 16 nt, Mycobacterium avium subsp. paratuberculosis
agaugcccacccgcuc

SEQ ID NO: 2812286 - RNA, 21 nt, Mycobacterium avium subsp. paratuberculosis
agaugcccacccgcucggcga

SEQ ID NO: 2812287 - RNA, 15 nt, Mycobacterium avium subsp. paratuberculosis
agaugcccagcggca

SEQ ID NO: 2812288 - RNA, 15 nt, Mycobacterium avium subsp. paratuberculosis
agaugcccgccccgc

SEQ ID NO: 2812289 - RNA, 21 nt, Mycobacterium avium subsp. paratuberculosis
agaugcccgccccgcccggcg

SEQ ID NO: 2812290 - RNA, 18 nt, Mycobacterium avium subsp. paratuberculosis
agaugccgccgccagcgc

SEQ ID NO: 2812291 - RNA, 20 nt, Mycobacterium avium subsp. paratuberculosis
agaugccgcucggcgcucca

SEQ ID NO: 2812292 - RNA, 22 nt, Mycobacterium avium subsp. paratuberculosis
agaugccgggcuccgcguucga

SEQ ID NO: 2812293 - RNA, 14 nt, Mycobacterium avium subsp. paratuberculosis
agaugcgccgcgga

SEQ ID NO: 2812294 - RNA, 23 nt, Mycobacterium avium subsp. paratuberculosis
agaugcgccgcggauguggaggc

SEQ ID NO: 2812295 - RNA, 17 nt, Mycobacterium avium subsp. paratuberculosis
agaugcgcgucgcggcg

SEQ ID NO: 2812296 - RNA, 18 nt, Mycobacterium avium subsp. paratuberculosis
agaugcgcgucgcggcgc

SEQ ID NO: 2812297 - RNA, 16 nt, Mycobacterium avium subsp. paratuberculosis
agaugcggcaccagcc

SEQ ID NO: 2812298 - RNA, 22 nt, Mycobacterium avium subsp. paratuberculosis
agaugcggcaccagcccgccgu

SEQ ID NO: 2812299 - RNA, 12 nt, Mycobacterium avium subsp. paratuberculosis
agaugcggccca

SEQ ID NO: 2812300 - RNA, 17 nt, Mycobacterium avium subsp. paratuberculosis
agaugcggcccagcccg

SEQ ID NO: 2812301 - RNA, 20 nt, Mycobacterium avium subsp. paratuberculosis
agaugcggcccagcccggcc

SEQ ID NO: 2812302 - RNA, 16 nt, Mycobacterium avium subsp. paratuberculosis
agaugcgucaacccgu

SEQ ID NO: 2812303 - RNA, 17 nt, Mycobacterium avium subsp. paratuberculosis
agaugcuucagcccucg

SEQ ID NO: 2812304 - RNA, 16 nt, Mycobacterium avium subsp. paratuberculosis
agauggcaacacguuu

SEQ ID NO: 2812305 - RNA, 22 nt, Mycobacterium avium subsp. paratuberculosis
agauggccaccaucaggccggc

SEQ ID NO: 2812306 - RNA, 23 nt, Mycobacterium avium subsp. paratuberculosis
agauggccaccaucaggccggcc

SEQ ID NO: 2812307 - RNA, 15 nt, Mycobacterium avium subsp. paratuberculosis
agauggccagcacca

SEQ ID NO: 2812308 - RNA, 16 nt, Mycobacterium avium subsp. paratuberculosis
agauggccagcaccac

SEQ ID NO: 2812309 - RNA, 18 nt, Mycobacterium avium subsp. paratuberculosis
agauggccagcaccaccg

SEQ ID NO: 2812310 - RNA, 20 nt, Mycobacterium avium subsp. paratuberculosis
agauggccagcaccaccgcg

SEQ ID NO: 2812311 - RNA, 21 nt, Mycobacterium avium subsp. paratuberculosis
agauggccagcaccaccgcga

SEQ ID NO: 2812312 - RNA, 14 nt, Mycobacterium avium subsp. paratuberculosis
agauggccagcgcg

SEQ ID NO: 2812313 - RNA, 12 nt, Mycobacterium avium subsp. paratuberculosis
agauggccagga

SEQ ID NO: 2812314 - RNA, 13 nt, Mycobacterium avium subsp. paratuberculosis
agauggccaggaa

SEQ ID NO: 2812315 - RNA, 15 nt, Mycobacterium avium subsp. paratuberculosis
agauggccaggaacg

SEQ ID NO: 2812316 - RNA, 23 nt, Mycobacterium avium subsp. paratuberculosis
agauggccagguaguggugggcg

SEQ ID NO: 2812317 - RNA, 21 nt, Mycobacterium avium subsp. paratuberculosis
agauggucgggacgucggcgc

SEQ ID NO: 2812318 - RNA, 23 nt, Mycobacterium avium subsp. paratuberculosis
agauggugaaggugcccuccucg

SEQ ID NO: 2812319 - RNA, 15 nt, Mycobacterium avium subsp. paratuberculosis
agauggugaaguugc

SEQ ID NO: 2812320 - RNA, 19 nt, Mycobacterium avium subsp. paratuberculosis
agaugguggccgucggccu

SEQ ID NO: 2812321 - RNA, 19 nt, Mycobacterium avium subsp. paratuberculosis
agaugguggucaccaccac

SEQ ID NO: 2812322 - RNA, 13 nt, Mycobacterium avium subsp. paratuberculosis
agauguugcggcc

SEQ ID NO: 2812323 - RNA, 17 nt, Mycobacterium avium subsp. paratuberculosis
agauguugcggccggcc

SEQ ID NO: 2812324 - RNA, 16 nt, Mycobacterium avium subsp. paratuberculosis
agauguugcggcggcc

SEQ ID NO: 2812325 - RNA, 21 nt, Mycobacterium avium subsp. paratuberculosis
agauucaccagcgccucggcc

SEQ ID NO: 2812326 - RNA, 20 nt, Mycobacterium avium subsp. paratuberculosis
agauucgaggucaucgagcc

SEQ ID NO: 2812327 - RNA, 13 nt, Mycobacterium avium subsp. paratuberculosis
agauugcggcccu

SEQ ID NO: 2812328 - RNA, 21 nt, Mycobacterium avium subsp. paratuberculosis
agauugcggcccuugcggccg

SEQ ID NO: 2812329 - RNA, 12 nt, Mycobacterium avium subsp. paratuberculosis
agauugguucgg

SEQ ID NO: 2812330 - RNA, 14 nt, Mycobacterium avium subsp. paratuberculosis
agcaaaaccccgcc

SEQ ID NO: 2812331 - RNA, 13 nt, Mycobacterium avium subsp. paratuberculosis
agcaaacccagca

SEQ ID NO: 2812332 - RNA, 14 nt, Mycobacterium avium subsp. paratuberculosis
agcaaacccagcac

SEQ ID NO: 2812333 - RNA, 15 nt, Mycobacterium avium subsp. paratuberculosis
agcaaacccagcacc

SEQ ID NO: 2812334 - RNA, 18 nt, Mycobacterium avium subsp. paratuberculosis
agcaaacccagcaccaac

SEQ ID NO: 2812335 - RNA, 18 nt, Mycobacterium avium subsp. paratuberculosis
agcaaaccgaccgccgcg

SEQ ID NO: 2812336 - RNA, 23 nt, Mycobacterium avium subsp. paratuberculosis
agcaaauccggcagcgcucgucg

SEQ ID NO: 2812337 - RNA, 15 nt, Mycobacterium avium subsp. paratuberculosis
agcaacaccagcugg

SEQ ID NO: 2812338 - RNA, 13 nt, Mycobacterium avium subsp. paratuberculosis
agcaccccgaucg

SEQ ID NO: 2812339 - RNA, 15 nt, Mycobacterium avium subsp. paratuberculosis
agcaccccgccgcag

SEQ ID NO: 2812340 - RNA, 14 nt, Mycobacterium avium subsp. paratuberculosis
agcaccccggcggc

SEQ ID NO: 2812341 - RNA, 15 nt, Mycobacterium avium subsp. paratuberculosis
agcaccccggcggcc

SEQ ID NO: 2812342 - RNA, 18 nt, Mycobacterium avium subsp. paratuberculosis
agcaccccggcggccgcg

SEQ ID NO: 2812343 - RNA, 22 nt, Mycobacterium avium subsp. paratuberculosis
agcaccccgucgagcagccgca

SEQ ID NO: 2812344 - RNA, 16 nt, Mycobacterium avium subsp. paratuberculosis
agcaccccgucgaggu

SEQ ID NO: 2812345 - RNA, 19 nt, Mycobacterium avium subsp. paratuberculosis
agcacccgcagccgcgagu

SEQ ID NO: 2812346 - RNA, 16 nt, Mycobacterium avium subsp. paratuberculosis
agcacccgcaucaacu

SEQ ID NO: 2812347 - RNA, 22 nt, Mycobacterium avium subsp. paratuberculosis
agcacccgcaucaacugcacca

SEQ ID NO: 2812348 - RNA, 14 nt, Mycobacterium avium subsp. paratuberculosis
agcacccgcccgga

SEQ ID NO: 2812349 - RNA, 23 nt, Mycobacterium avium subsp. paratuberculosis
agcacccgcucgcgggcccgcgc

SEQ ID NO: 2812350 - RNA, 14 nt, Mycobacterium avium subsp. paratuberculosis
agcacccgcugcag

SEQ ID NO: 2812351 - RNA, 18 nt, Mycobacterium avium subsp. paratuberculosis
agcacccggaugucguag

SEQ ID NO: 2812352 - RNA, 13 nt, Mycobacterium avium subsp. paratuberculosis
agcacccggccca

SEQ ID NO: 2812353 - RNA, 18 nt, Mycobacterium avium subsp. paratuberculosis
agcacccggcccacgccg

SEQ ID NO: 2812354 - RNA, 17 nt, Mycobacterium avium subsp. paratuberculosis
agcacccggucgccggu

SEQ ID NO: 2812355 - RNA, 21 nt, Mycobacterium avium subsp. paratuberculosis
agcacccgguuccaccgggcc

SEQ ID NO: 2812356 - RNA, 19 nt, Mycobacterium avium subsp. paratuberculosis
agcaccgaaccggcggggu

SEQ ID NO: 2812357 - RNA, 19 nt, Mycobacterium avium subsp. paratuberculosis
agcaccgaaucgccgagcu

SEQ ID NO: 2812358 - RNA, 22 nt, Mycobacterium avium subsp. paratuberculosis
agcaccgacagucccaccagua

SEQ ID NO: 2812359 - RNA, 14 nt, Mycobacterium avium subsp. paratuberculosis
agcaccgacgcgcc

SEQ ID NO: 2812360 - RNA, 15 nt, Mycobacterium avium subsp. paratuberculosis
agcaccgacgcggcg

SEQ ID NO: 2812361 - RNA, 19 nt, Mycobacterium avium subsp. paratuberculosis
agcaccgacuccuccggcc

SEQ ID NO: 2812362 - RNA, 18 nt, Mycobacterium avium subsp. paratuberculosis
agcaccgagaacagaugc

SEQ ID NO: 2812363 - RNA, 21 nt, Mycobacterium avium subsp. paratuberculosis
agcaccgagaacagaugccgg

SEQ ID NO: 2812364 - RNA, 15 nt, Mycobacterium avium subsp. paratuberculosis
agcaccgaugccaga

SEQ ID NO: 2812365 - RNA, 14 nt, Mycobacterium avium subsp. paratuberculosis
agcaccgccaccgg

SEQ ID NO: 2812366 - RNA, 21 nt, Mycobacterium avium subsp. paratuberculosis
agcaccgccaccggcccggcc

SEQ ID NO: 2812367 - RNA, 16 nt, Mycobacterium avium subsp. paratuberculosis
agcaccgccacggcga

SEQ ID NO: 2812368 - RNA, 18 nt, Mycobacterium avium subsp. paratuberculosis
agcaccgccagcgccggc

SEQ ID NO: 2812369 - RNA, 19 nt, Mycobacterium avium subsp. paratuberculosis
agcaccgccagcgccggca

SEQ ID NO: 2812370 - RNA, 21 nt, Mycobacterium avium subsp. paratuberculosis
agcaccgccccggucaccccg

SEQ ID NO: 2812371 - RNA, 17 nt, Mycobacterium avium subsp. paratuberculosis
agcaccgccgacaucgc

SEQ ID NO: 2812372 - RNA, 16 nt, Mycobacterium avium subsp. paratuberculosis
agcaccgccgagccgu

SEQ ID NO: 2812373 - RNA, 17 nt, Mycobacterium avium subsp. paratuberculosis
agcaccgccgagccguc

SEQ ID NO: 2812374 - RNA, 14 nt, Mycobacterium avium subsp. paratuberculosis
agcaccgccgcggc

SEQ ID NO: 2812375 - RNA, 15 nt, Mycobacterium avium subsp. paratuberculosis
agcaccgccgcggcc

SEQ ID NO: 2812376 - RNA, 18 nt, Mycobacterium avium subsp. paratuberculosis
agcaccgccgcggccgcg

SEQ ID NO: 2812377 - RNA, 21 nt, Mycobacterium avium subsp. paratuberculosis
agcaccgccgcggccgcgaug

SEQ ID NO: 2812378 - RNA, 17 nt, Mycobacterium avium subsp. paratuberculosis
agcaccgccggcgccgu

SEQ ID NO: 2812379 - RNA, 22 nt, Mycobacterium avium subsp. paratuberculosis
agcaccgccgucccgucacggc

SEQ ID NO: 2812380 - RNA, 17 nt, Mycobacterium avium subsp. paratuberculosis
agcaccgccucggccac

SEQ ID NO: 2812381 - RNA, 15 nt, Mycobacterium avium subsp. paratuberculosis
agcaccgcgaagaac

SEQ ID NO: 2812382 - RNA, 17 nt, Mycobacterium avium subsp. paratuberculosis
agcaccgcgaccacgcc

SEQ ID NO: 2812383 - RNA, 22 nt, Mycobacterium avium subsp. paratuberculosis
agcaccgcgaccacgccgcggu

SEQ ID NO: 2812384 - RNA, 22 nt, Mycobacterium avium subsp. paratuberculosis
agcaccgcgacccaggccgccg

SEQ ID NO: 2812385 - RNA, 18 nt, Mycobacterium avium subsp. paratuberculosis
agcaccgcgaucgccgac

SEQ ID NO: 2812386 - RNA, 11 nt, Mycobacterium avium subsp. paratuberculosis
agcaccgcgcg

SEQ ID NO: 2812387 - RNA, 17 nt, Mycobacterium avium subsp. paratuberculosis
agcaccgcgcggcggug

SEQ ID NO: 2812388 - RNA, 22 nt, Mycobacterium avium subsp. paratuberculosis
agcaccgcgcggcggugcucgc

SEQ ID NO: 2812389 - RNA, 18 nt, Mycobacterium avium subsp. paratuberculosis
agcaccgcgcucaccgcg

SEQ ID NO: 2812390 - RNA, 20 nt, Mycobacterium avium subsp. paratuberculosis
agcaccgcggccgucgcggc

SEQ ID NO: 2812391 - RNA, 23 nt, Mycobacterium avium subsp. paratuberculosis
agcaccgcggccgucgcggcgau

SEQ ID NO: 2812392 - RNA, 15 nt, Mycobacterium avium subsp. paratuberculosis
agcaccgcggcgauc

SEQ ID NO: 2812393 - RNA, 14 nt, Mycobacterium avium subsp. paratuberculosis
agcaccgcgucgau

SEQ ID NO: 2812394 - RNA, 21 nt, Mycobacterium avium subsp. paratuberculosis
agcaccgcgucgaugucgucg

SEQ ID NO: 2812395 - RNA, 22 nt, Mycobacterium avium subsp. paratuberculosis
agcaccgcgucggcgcuggcca

SEQ ID NO: 2812396 - RNA, 15 nt, Mycobacterium avium subsp. paratuberculosis
agcaccggcaccgcc

SEQ ID NO: 2812397 - RNA, 17 nt, Mycobacterium avium subsp. paratuberculosis
agcaccggcaccgccag

SEQ ID NO: 2812398 - RNA, 20 nt, Mycobacterium avium subsp. paratuberculosis
agcaccggcaccgccagcca

SEQ ID NO: 2812399 - RNA, 16 nt, Mycobacterium avium subsp. paratuberculosis
agcaccggcagccgca

SEQ ID NO: 2812400 - RNA, 20 nt, Mycobacterium avium subsp. paratuberculosis
agcaccggcagccgcagcga

SEQ ID NO: 2812401 - RNA, 21 nt, Mycobacterium avium subsp. paratuberculosis
agcaccggcaugugccacagg

SEQ ID NO: 2812402 - RNA, 21 nt, Mycobacterium avium subsp. paratuberculosis
agcaccggcgccaugaacucc

SEQ ID NO: 2812403 - RNA, 15 nt, Mycobacterium avium subsp. paratuberculosis
agcaccggcgccccg

SEQ ID NO: 2812404 - RNA, 13 nt, Mycobacterium avium subsp. paratuberculosis
agcaccggcgccu

SEQ ID NO: 2812405 - RNA, 12 nt, Mycobacterium avium subsp. paratuberculosis
agcaccggcguc

SEQ ID NO: 2812406 - RNA, 15 nt, Mycobacterium avium subsp. paratuberculosis
agcaccggcgucgac

SEQ ID NO: 2812407 - RNA, 16 nt, Mycobacterium avium subsp. paratuberculosis
agcaccggcgucgaca

SEQ ID NO: 2812408 - RNA, 19 nt, Mycobacterium avium subsp. paratuberculosis
agcaccggcgucgacagcc

SEQ ID NO: 2812409 - RNA, 21 nt, Mycobacterium avium subsp. paratuberculosis
agcaccggcgucgacagccgg

SEQ ID NO: 2812410 - RNA, 13 nt, Mycobacterium avium subsp. paratuberculosis
agcaccggcuggc

SEQ ID NO: 2812411 - RNA, 15 nt, Mycobacterium avium subsp. paratuberculosis
agcaccggcuggccg

SEQ ID NO: 2812412 - RNA, 16 nt, Mycobacterium avium subsp. paratuberculosis
agcaccggcuggccga

SEQ ID NO: 2812413 - RNA, 13 nt, Mycobacterium avium subsp. paratuberculosis
agcaccggcuggu

SEQ ID NO: 2812414 - RNA, 17 nt, Mycobacterium avium subsp. paratuberculosis
agcaccggcuggugcag

SEQ ID NO: 2812415 - RNA, 23 nt, Mycobacterium avium subsp. paratuberculosis
agcaccggcuggugcagcagcug

SEQ ID NO: 2812416 - RNA, 18 nt, Mycobacterium avium subsp. paratuberculosis
agcaccgggaacagccag

SEQ ID NO: 2812417 - RNA, 20 nt, Mycobacterium avium subsp. paratuberculosis
agcaccgggaacagccaggc

SEQ ID NO: 2812418 - RNA, 22 nt, Mycobacterium avium subsp. paratuberculosis
agcaccgggaacagccaggcga

SEQ ID NO: 2812419 - RNA, 16 nt, Mycobacterium avium subsp. paratuberculosis
agcaccgggcccagcu

SEQ ID NO: 2812420 - RNA, 17 nt, Mycobacterium avium subsp. paratuberculosis
agcaccgggcccagcuc

SEQ ID NO: 2812421 - RNA, 15 nt, Mycobacterium avium subsp. paratuberculosis
agcaccgggcugucg

SEQ ID NO: 2812422 - RNA, 17 nt, Mycobacterium avium subsp. paratuberculosis
agcaccggggccaacuc

SEQ ID NO: 2812423 - RNA, 14 nt, Mycobacterium avium subsp. paratuberculosis
agcacggcggcgcu

SEQ ID NO: 2812424 - RNA, 13 nt, Mycobacterium avium subsp. paratuberculosis
agcacggcggcgu

SEQ ID NO: 2812425 - RNA, 22 nt, Mycobacterium avium subsp. paratuberculosis
agcacggcucguccaucagcag

SEQ ID NO: 2812426 - RNA, 18 nt, Mycobacterium avium subsp. paratuberculosis
agcacggucagcggccag

SEQ ID NO: 2812427 - RNA, 18 nt, Mycobacterium avium subsp. paratuberculosis
agcacggugaucagcagc

SEQ ID NO: 2812428 - RNA, 19 nt, Mycobacterium avium subsp. paratuberculosis
agcacggugggcgccgggu

SEQ ID NO: 2812429 - RNA, 22 nt, Mycobacterium avium subsp. paratuberculosis
agcacgguguugcgcacccgcg

SEQ ID NO: 2812430 - RNA, 16 nt, Mycobacterium avium subsp. paratuberculosis
agcacgucaccgcuga

SEQ ID NO: 2812431 - RNA, 18 nt, Mycobacterium avium subsp. paratuberculosis
agcacguccccgggcacc

SEQ ID NO: 2812432 - RNA, 16 nt, Mycobacterium avium subsp. paratuberculosis
agcacgucgcggcccu

SEQ ID NO: 2812433 - RNA, 16 nt, Mycobacterium avium subsp. paratuberculosis
agcacgucgggguggc

SEQ ID NO: 2812434 - RNA, 20 nt, Mycobacterium avium subsp. paratuberculosis
agcacgucgggguggccggc

SEQ ID NO: 2812435 - RNA, 19 nt, Mycobacterium avium subsp. paratuberculosis
agcacgucguaggccaucc

SEQ ID NO: 2812436 - RNA, 14 nt, Mycobacterium avium subsp. paratuberculosis
agcacgugaugcag

SEQ ID NO: 2812437 - RNA, 16 nt, Mycobacterium avium subsp. paratuberculosis
agcacgugaugcagcu

SEQ ID NO: 2812438 - RNA, 17 nt, Mycobacterium avium subsp. paratuberculosis
agcacgugaugcagcug

SEQ ID NO: 2812439 - RNA, 14 nt, Mycobacterium avium subsp. paratuberculosis
agcacgugcccagc

SEQ ID NO: 2812440 - RNA, 21 nt, Mycobacterium avium subsp. paratuberculosis
agcacgugcccagcccgcgcg

SEQ ID NO: 2812441 - RNA, 23 nt, Mycobacterium avium subsp. paratuberculosis
agcacgugcccagcccgcgcgag

SEQ ID NO: 2812442 - RNA, 16 nt, Mycobacterium avium subsp. paratuberculosis
agcacgugcccgccgu

SEQ ID NO: 2812443 - RNA, 17 nt, Mycobacterium avium subsp. paratuberculosis
agcacgugcccgccgug

SEQ ID NO: 2812444 - RNA, 21 nt, Mycobacterium avium subsp. paratuberculosis
agcacgugcccgccgugcgcc

SEQ ID NO: 2812445 - RNA, 19 nt, Mycobacterium avium subsp. paratuberculosis
agcacgugcgcgggaacga

SEQ ID NO: 2812446 - RNA, 13 nt, Mycobacterium avium subsp. paratuberculosis
agcacguguucgg

SEQ ID NO: 2812447 - RNA, 18 nt, Mycobacterium avium subsp. paratuberculosis
agcacguugugcucgucg

SEQ ID NO: 2812448 - RNA, 22 nt, Mycobacterium avium subsp. paratuberculosis
agcacguugugggcgggcgcgu

SEQ ID NO: 2812449 - RNA, 18 nt, Mycobacterium avium subsp. paratuberculosis
agcacuccccgugugugg

SEQ ID NO: 2812450 - RNA, 19 nt, Mycobacterium avium subsp. paratuberculosis
agcacucgauggcggcgau

SEQ ID NO: 2812451 - RNA, 22 nt, Mycobacterium avium subsp. paratuberculosis
agcacucgcgggacggcggcga

SEQ ID NO: 2812452 - RNA, 15 nt, Mycobacterium avium subsp. paratuberculosis
agcacugagcggcag

SEQ ID NO: 2812453 - RNA, 18 nt, Mycobacterium avium subsp. paratuberculosis
agcacuucauggucgucg

SEQ ID NO: 2812454 - RNA, 15 nt, Mycobacterium avium subsp. paratuberculosis
agcagaacgccauca

SEQ ID NO: 2812455 - RNA, 21 nt, Mycobacterium avium subsp. paratuberculosis
agcagaacgccaucaccagcg

SEQ ID NO: 2812456 - RNA, 15 nt, Mycobacterium avium subsp. paratuberculosis
agcagacccgccgcg

SEQ ID NO: 2812457 - RNA, 13 nt, Mycobacterium avium subsp. paratuberculosis
agcagaccgaacc

SEQ ID NO: 2812458 - RNA, 20 nt, Mycobacterium avium subsp. paratuberculosis
agcagaccgaacccgggcgc

SEQ ID NO: 2812459 - RNA, 14 nt, Mycobacterium avium subsp. paratuberculosis
agcagaccgccggu

SEQ ID NO: 2812460 - RNA, 21 nt, Mycobacterium avium subsp. paratuberculosis
agcagaccgcgaucagcccca

SEQ ID NO: 2812461 - RNA, 19 nt, Mycobacterium avium subsp. paratuberculosis
agcagacggacacccgcgc

SEQ ID NO: 2812462 - RNA, 23 nt, Mycobacterium avium subsp. paratuberculosis
agcagacgguaugcccgccgcgu

SEQ ID NO: 2812463 - RNA, 18 nt, Mycobacterium avium subsp. paratuberculosis
agcagaucuuccaucacg

SEQ ID NO: 2812464 - RNA, 16 nt, Mycobacterium avium subsp. paratuberculosis
agcagaugccgcccag

SEQ ID NO: 2812465 - RNA, 17 nt, Mycobacterium avium subsp. paratuberculosis
agcagaugccgcccagg

SEQ ID NO: 2812466 - RNA, 20 nt, Mycobacterium avium subsp. paratuberculosis
agcagaugccgcccaggugc

SEQ ID NO: 2812467 - RNA, 15 nt, Mycobacterium avium subsp. paratuberculosis
agcagaugcgccucg

SEQ ID NO: 2812468 - RNA, 20 nt, Mycobacterium avium subsp. paratuberculosis
agcagaugcgcgucgcggcg

SEQ ID NO: 2812469 - RNA, 15 nt, Mycobacterium avium subsp. paratuberculosis
agcagcaacgcggug

SEQ ID NO: 2812470 - RNA, 15 nt, Mycobacterium avium subsp. paratuberculosis
agcagcaacggcggc

SEQ ID NO: 2812471 - RNA, 17 nt, Mycobacterium avium subsp. paratuberculosis
agcagcaacggcggcgg

SEQ ID NO: 2812472 - RNA, 22 nt, Mycobacterium avium subsp. paratuberculosis
agcagcacauccgguugcaccg

SEQ ID NO: 2812473 - RNA, 17 nt, Mycobacterium avium subsp. paratuberculosis
agcagcaccacccgcac

SEQ ID NO: 2812474 - RNA, 23 nt, Mycobacterium avium subsp. paratuberculosis
agcagcaccagaugcaccucgcc

SEQ ID NO: 2812475 - RNA, 13 nt, Mycobacterium avium subsp. paratuberculosis
agcagcaccagcg

SEQ ID NO: 2812476 - RNA, 17 nt, Mycobacterium avium subsp. paratuberculosis
agcagcaccagcgccgc

SEQ ID NO: 2812477 - RNA, 18 nt, Mycobacterium avium subsp. paratuberculosis
agcagcaccagcgccgcg

SEQ ID NO: 2812478 - RNA, 15 nt, Mycobacterium avium subsp. paratuberculosis
agcagcaccagcgcg

SEQ ID NO: 2812479 - RNA, 13 nt, Mycobacterium avium subsp. paratuberculosis
agcagcaccaggc

SEQ ID NO: 2812480 - RNA, 15 nt, Mycobacterium avium subsp. paratuberculosis
agcagcaccaggcug

SEQ ID NO: 2812481 - RNA, 14 nt, Mycobacterium avium subsp. paratuberculosis
agcagcaccagggc

SEQ ID NO: 2812482 - RNA, 22 nt, Mycobacterium avium subsp. paratuberculosis
agcagcaccccgaucgcgauca

SEQ ID NO: 2812483 - RNA, 22 nt, Mycobacterium avium subsp. paratuberculosis
agcagcacccgacuucggcucg

SEQ ID NO: 2812484 - RNA, 12 nt, Mycobacterium avium subsp. paratuberculosis
agcagcacccgg

SEQ ID NO: 2812485 - RNA, 14 nt, Mycobacterium avium subsp. paratuberculosis
agcagcacccgggc

SEQ ID NO: 2812486 - RNA, 21 nt, Mycobacterium avium subsp. paratuberculosis
agcagcacccgggccugcggc

SEQ ID NO: 2812487 - RNA, 15 nt, Mycobacterium avium subsp. paratuberculosis
agcagcacccgggug

SEQ ID NO: 2812488 - RNA, 16 nt, Mycobacterium avium subsp. paratuberculosis
agcagcacccggguga

SEQ ID NO: 2812489 - RNA, 19 nt, Mycobacterium avium subsp. paratuberculosis
agcagcacccgggugauca

SEQ ID NO: 2812490 - RNA, 14 nt, Mycobacterium avium subsp. paratuberculosis
agcagcaccgcaug

SEQ ID NO: 2812491 - RNA, 12 nt, Mycobacterium avium subsp. paratuberculosis
agcagcaccgcg

SEQ ID NO: 2812492 - RNA, 13 nt, Mycobacterium avium subsp. paratuberculosis
agcagcaccgcga

SEQ ID NO: 2812493 - RNA, 13 nt, Mycobacterium avium subsp. paratuberculosis
agcagcaccggca

SEQ ID NO: 2812494 - RNA, 14 nt, Mycobacterium avium subsp. paratuberculosis
agcagcaccggcac

SEQ ID NO: 2812495 - RNA, 20 nt, Mycobacterium avium subsp. paratuberculosis
agcagcaccggcaccgcggc

SEQ ID NO: 2812496 - RNA, 18 nt, Mycobacterium avium subsp. paratuberculosis
agcagcaccggcgccucg

SEQ ID NO: 2812497 - RNA, 16 nt, Mycobacterium avium subsp. paratuberculosis
agcagcacgcccagcc

SEQ ID NO: 2812498 - RNA, 20 nt, Mycobacterium avium subsp. paratuberculosis
agcagcacgcccagcccgcg

SEQ ID NO: 2812499 - RNA, 21 nt, Mycobacterium avium subsp. paratuberculosis
agcagcacgcccagcccgcgg

SEQ ID NO: 2812500 - RNA, 23 nt, Mycobacterium avium subsp. paratuberculosis
agcagcacgcccagcccgcgggc

SEQ ID NO: 2812501 - RNA, 13 nt, Mycobacterium avium subsp. paratuberculosis
agcagcacggcaa

SEQ ID NO: 2812502 - RNA, 17 nt, Mycobacterium avium subsp. paratuberculosis
agcagcacggcaauggu

SEQ ID NO: 2812503 - RNA, 17 nt, Mycobacterium avium subsp. paratuberculosis
agcagcagaaccagcac

SEQ ID NO: 2812504 - RNA, 20 nt, Mycobacterium avium subsp. paratuberculosis
agcagcagaaccagcaccgc

SEQ ID NO: 2812505 - RNA, 21 nt, Mycobacterium avium subsp. paratuberculosis
agcagcagaaccagcaccgcc

SEQ ID NO: 2812506 - RNA, 14 nt, Mycobacterium avium subsp. paratuberculosis
agcagcagaccgcg

SEQ ID NO: 2812507 - RNA, 16 nt, Mycobacterium avium subsp. paratuberculosis
agcagcagcccgaaca

SEQ ID NO: 2812508 - RNA, 23 nt, Mycobacterium avium subsp. paratuberculosis
agcagcgcgcgcuugcgcucggu

SEQ ID NO: 2812509 - RNA, 13 nt, Mycobacterium avium subsp. paratuberculosis
agcagcgcgcggu

SEQ ID NO: 2812510 - RNA, 21 nt, Mycobacterium avium subsp. paratuberculosis
agcagcgcggcauggcuggcg

SEQ ID NO: 2812511 - RNA, 13 nt, Mycobacterium avium subsp. paratuberculosis
agcagcgcggcuu

SEQ ID NO: 2812512 - RNA, 21 nt, Mycobacterium avium subsp. paratuberculosis
agcagcgcggcuuggccacca

SEQ ID NO: 2812513 - RNA, 22 nt, Mycobacterium avium subsp. paratuberculosis
agcagcgcggucaacaccggga

SEQ ID NO: 2812514 - RNA, 20 nt, Mycobacterium avium subsp. paratuberculosis
agcagcgcguaggugcgguc

SEQ ID NO: 2812515 - RNA, 21 nt, Mycobacterium avium subsp. paratuberculosis
agcagcggcacccgguccggc

SEQ ID NO: 2812516 - RNA, 12 nt, Mycobacterium avium subsp. paratuberculosis
agcagcggcagc

SEQ ID NO: 2812517 - RNA, 18 nt, Mycobacterium avium subsp. paratuberculosis
agcagcggcaugcccccg

SEQ ID NO: 2812518 - RNA, 16 nt, Mycobacterium avium subsp. paratuberculosis
agcagcggccggcgca

SEQ ID NO: 2812519 - RNA, 18 nt, Mycobacterium avium subsp. paratuberculosis
agcagcggccggcgcagc

SEQ ID NO: 2812520 - RNA, 16 nt, Mycobacterium avium subsp. paratuberculosis
agcagcggcucggccu

SEQ ID NO: 2812521 - RNA, 17 nt, Mycobacterium avium subsp. paratuberculosis
agcagcggcucggccuu

SEQ ID NO: 2812522 - RNA, 20 nt, Mycobacterium avium subsp. paratuberculosis
agcagcggcuugagcgccag

SEQ ID NO: 2812523 - RNA, 21 nt, Mycobacterium avium subsp. paratuberculosis
agcagcggcuugagcgccagc

SEQ ID NO: 2812524 - RNA, 21 nt, Mycobacterium avium subsp. paratuberculosis
agcagcgggcccgggcugccc

SEQ ID NO: 2812525 - RNA, 12 nt, Mycobacterium avium subsp. paratuberculosis
agcagcggggug

SEQ ID NO: 2812526 - RNA, 23 nt, Mycobacterium avium subsp. paratuberculosis
agcagcggggugagcaccgcgac

SEQ ID NO: 2812527 - RNA, 23 nt, Mycobacterium avium subsp. paratuberculosis
agcagcggggugugcucggcggc

SEQ ID NO: 2812528 - RNA, 21 nt, Mycobacterium avium subsp. paratuberculosis
agcagcgggucgucgggccgg

SEQ ID NO: 2812529 - RNA, 17 nt, Mycobacterium avium subsp. paratuberculosis
agcagcgucacgucgac

SEQ ID NO: 2812530 - RNA, 13 nt, Mycobacterium avium subsp. paratuberculosis
agcagcgucguca

SEQ ID NO: 2812531 - RNA, 18 nt, Mycobacterium avium subsp. paratuberculosis
agcagcgucgucaggccg

SEQ ID NO: 2812532 - RNA, 16 nt, Mycobacterium avium subsp. paratuberculosis
agcagcgucugcgcca

SEQ ID NO: 2812533 - RNA, 17 nt, Mycobacterium avium subsp. paratuberculosis
agcagcgucugcgccag

SEQ ID NO: 2812534 - RNA, 21 nt, Mycobacterium avium subsp. paratuberculosis
agcagcgugcugacgucgucg

SEQ ID NO: 2812535 - RNA, 17 nt, Mycobacterium avium subsp. paratuberculosis
agcagcguuccgucggc

SEQ ID NO: 2812536 - RNA, 15 nt, Mycobacterium avium subsp. paratuberculosis
agcagcuagcccaga

SEQ ID NO: 2812537 - RNA, 15 nt, Mycobacterium avium subsp. paratuberculosis
agcagcucagccgcc

SEQ ID NO: 2812538 - RNA, 16 nt, Mycobacterium avium subsp. paratuberculosis
agcagcucauacagcg

SEQ ID NO: 2812539 - RNA, 20 nt, Mycobacterium avium subsp. paratuberculosis
agcagcucauacagcggcgc

SEQ ID NO: 2812540 - RNA, 15 nt, Mycobacterium avium subsp. paratuberculosis
agcagcucgcguagc

SEQ ID NO: 2812541 - RNA, 23 nt, Mycobacterium avium subsp. paratuberculosis
agcagcucgcguagcgaggugug

SEQ ID NO: 2812542 - RNA, 24 nt, Mycobacterium avium subsp. paratuberculosis
agcagcucgcguagcgagguguga

SEQ ID NO: 2812543 - RNA, 14 nt, Mycobacterium avium subsp. paratuberculosis
agcagcucggcggc

SEQ ID NO: 2812544 - RNA, 16 nt, Mycobacterium avium subsp. paratuberculosis
agcagcucggcggccu

SEQ ID NO: 2812545 - RNA, 17 nt, Mycobacterium avium subsp. paratuberculosis
agcagcucggcggccug

SEQ ID NO: 2812546 - RNA, 14 nt, Mycobacterium avium subsp. paratuberculosis
agcagcucgguggc

SEQ ID NO: 2812547 - RNA, 15 nt, Mycobacterium avium subsp. paratuberculosis
agcagcucgguggcg

SEQ ID NO: 2812548 - RNA, 20 nt, Mycobacterium avium subsp. paratuberculosis
agcagcucgguggcgucggc

SEQ ID NO: 2812549 - RNA, 23 nt, Mycobacterium avium subsp. paratuberculosis
agcagcucgguggcgucggcggc

SEQ ID NO: 2812550 - RNA, 23 nt, Mycobacterium avium subsp. paratuberculosis
agcagcucgucguacucggguga

SEQ ID NO: 2812551 - RNA, 19 nt, Mycobacterium avium subsp. paratuberculosis
agcagcugcacccgcucca

SEQ ID NO: 2812552 - RNA, 13 nt, Mycobacterium avium subsp. paratuberculosis
agcagcugcagcg

SEQ ID NO: 2812553 - RNA, 18 nt, Mycobacterium avium subsp. paratuberculosis
agcagcugcccgagcggc

SEQ ID NO: 2812554 - RNA, 23 nt, Mycobacterium avium subsp. paratuberculosis
agcagcugcgcgucgaagaaguc

SEQ ID NO: 2812555 - RNA, 22 nt, Mycobacterium avium subsp. paratuberculosis
agcagcugcgucggcaccagcg

SEQ ID NO: 2812556 - RNA, 16 nt, Mycobacterium avium subsp. paratuberculosis
agcagcugcuggcgug

SEQ ID NO: 2812557 - RNA, 22 nt, Mycobacterium avium subsp. paratuberculosis
agcagcuggaaauaggccgggc

SEQ ID NO: 2812558 - RNA, 20 nt, Mycobacterium avium subsp. paratuberculosis
agcagcuggaacaccacggc

SEQ ID NO: 2812559 - RNA, 20 nt, Mycobacterium avium subsp. paratuberculosis
agcagcuguugcggcgucag

SEQ ID NO: 2812560 - RNA, 21 nt, Mycobacterium avium subsp. paratuberculosis
agcagcuugacgucggucagc

SEQ ID NO: 2812561 - RNA, 19 nt, Mycobacterium avium subsp. paratuberculosis
agcaggacgcgcccggcga

SEQ ID NO: 2812562 - RNA, 17 nt, Mycobacterium avium subsp. paratuberculosis
agcaggaugaugaccga

SEQ ID NO: 2812563 - RNA, 12 nt, Mycobacterium avium subsp. paratuberculosis
agcaggcccagg

SEQ ID NO: 2812564 - RNA, 14 nt, Mycobacterium avium subsp. paratuberculosis
agcaggcccaggcc

SEQ ID NO: 2812565 - RNA, 17 nt, Mycobacterium avium subsp. paratuberculosis
agcaggcccaggccgau

SEQ ID NO: 2812566 - RNA, 14 nt, Mycobacterium avium subsp. paratuberculosis
agcaggcccucggc

SEQ ID NO: 2812567 - RNA, 17 nt, Mycobacterium avium subsp. paratuberculosis
agcaggcccucggccag

SEQ ID NO: 2812568 - RNA, 16 nt, Mycobacterium avium subsp. paratuberculosis
agcaggcgccgcagca

SEQ ID NO: 2812569 - RNA, 13 nt, Mycobacterium avium subsp. paratuberculosis
agcaggcgccggu

SEQ ID NO: 2812570 - RNA, 13 nt, Mycobacterium avium subsp. paratuberculosis
agcaggcgcgcag

SEQ ID NO: 2812571 - RNA, 15 nt, Mycobacterium avium subsp. paratuberculosis
agcaggcgcgccgag

SEQ ID NO: 2812572 - RNA, 15 nt, Mycobacterium avium subsp. paratuberculosis
agcaggcggacggcg

SEQ ID NO: 2812573 - RNA, 18 nt, Mycobacterium avium subsp. paratuberculosis
agcaggcggaucggcccg

SEQ ID NO: 2812574 - RNA, 15 nt, Mycobacterium avium subsp. paratuberculosis
agcaggcgguggugg

SEQ ID NO: 2812575 - RNA, 16 nt, Mycobacterium avium subsp. paratuberculosis
agcaggcggugguggg

SEQ ID NO: 2812576 - RNA, 19 nt, Mycobacterium avium subsp. paratuberculosis
agcaggcgguggugggguc

SEQ ID NO: 2812577 - RNA, 15 nt, Mycobacterium avium subsp. paratuberculosis
agcaggcuggcggcg

SEQ ID NO: 2812578 - RNA, 16 nt, Mycobacterium avium subsp. paratuberculosis
agcaggcuggcggcga

SEQ ID NO: 2812579 - RNA, 19 nt, Mycobacterium avium subsp. paratuberculosis
agcaggcuggcggcgauca

SEQ ID NO: 2812580 - RNA, 20 nt, Mycobacterium avium subsp. paratuberculosis
agcagggacauccgugaggg

SEQ ID NO: 2812581 - RNA, 20 nt, Mycobacterium avium subsp. paratuberculosis
agcagggcaccgacggccgc

SEQ ID NO: 2812582 - RNA, 22 nt, Mycobacterium avium subsp. paratuberculosis
agcagggcaccgacggccgcac

SEQ ID NO: 2812583 - RNA, 21 nt, Mycobacterium avium subsp. paratuberculosis
agcagggcaucucccgcgcgc

SEQ ID NO: 2812584 - RNA, 16 nt, Mycobacterium avium subsp. paratuberculosis
agcagggccagcggca

SEQ ID NO: 2812585 - RNA, 13 nt, Mycobacterium avium subsp. paratuberculosis
agcagggccucgc

SEQ ID NO: 2812586 - RNA, 16 nt, Mycobacterium avium subsp. paratuberculosis
agcagggccucgccgu

SEQ ID NO: 2812587 - RNA, 13 nt, Mycobacterium avium subsp. paratuberculosis
agcagggcgccga

SEQ ID NO: 2812588 - RNA, 15 nt, Mycobacterium avium subsp. paratuberculosis
agcagggcgcgcauc

SEQ ID NO: 2812589 - RNA, 23 nt, Mycobacterium avium subsp. paratuberculosis
agcagggcgcgcaucugcucggc

SEQ ID NO: 2812590 - RNA, 17 nt, Mycobacterium avium subsp. paratuberculosis
agcagggcggcaccgau

SEQ ID NO: 2812591 - RNA, 21 nt, Mycobacterium avium subsp. paratuberculosis
agcagggcggcaccgaucggc

SEQ ID NO: 2812592 - RNA, 22 nt, Mycobacterium avium subsp. paratuberculosis
agcauggcgaucaccccggcga

SEQ ID NO: 2812593 - RNA, 21 nt, Mycobacterium avium subsp. paratuberculosis
agcauggcgaugacgucgucg

SEQ ID NO: 2812594 - RNA, 14 nt, Mycobacterium avium subsp. paratuberculosis
agcauguugaacgc

SEQ ID NO: 2812595 - RNA, 18 nt, Mycobacterium avium subsp. paratuberculosis
agcauguugaacgccgcg

SEQ ID NO: 2812596 - RNA, 19 nt, Mycobacterium avium subsp. paratuberculosis
agcauguugaacgccgcgu

SEQ ID NO: 2812597 - RNA, 14 nt, Mycobacterium avium subsp. paratuberculosis
agcauuggcgaugg

SEQ ID NO: 2812598 - RNA, 19 nt, Mycobacterium avium subsp. paratuberculosis
agccaaaccgugucccgga

SEQ ID NO: 2812599 - RNA, 22 nt, Mycobacterium avium subsp. paratuberculosis
agccaaagccuacggcgccggu

SEQ ID NO: 2812600 - RNA, 22 nt, Mycobacterium avium subsp. paratuberculosis
agccaaccgccggggaagaucu

SEQ ID NO: 2812601 - RNA, 20 nt, Mycobacterium avium subsp. paratuberculosis
agccaaugccggaucgggac

SEQ ID NO: 2812602 - RNA, 16 nt, Mycobacterium avium subsp. paratuberculosis
agccacaccgccgcgg

SEQ ID NO: 2812603 - RNA, 13 nt, Mycobacterium avium subsp. paratuberculosis
agccacagccgca

SEQ ID NO: 2812604 - RNA, 13 nt, Mycobacterium avium subsp. paratuberculosis
agccacagcucgg

SEQ ID NO: 2812605 - RNA, 16 nt, Mycobacterium avium subsp. paratuberculosis
agccacaucugguugc

SEQ ID NO: 2812606 - RNA, 22 nt, Mycobacterium avium subsp. paratuberculosis
agccacccgcgccuccauucgg

SEQ ID NO: 2812607 - RNA, 23 nt, Mycobacterium avium subsp. paratuberculosis
agccaccucgaucagcggcaucg

SEQ ID NO: 2812608 - RNA, 16 nt, Mycobacterium avium subsp. paratuberculosis
agccacgagcccagcc

SEQ ID NO: 2812609 - RNA, 19 nt, Mycobacterium avium subsp. paratuberculosis
agccacgccaacugguccu

SEQ ID NO: 2812610 - RNA, 15 nt, Mycobacterium avium subsp. paratuberculosis
agccacgccgacacc

SEQ ID NO: 2812611 - RNA, 19 nt, Mycobacterium avium subsp. paratuberculosis
agccacgccgacaccgucg

SEQ ID NO: 2812612 - RNA, 12 nt, Mycobacterium avium subsp. paratuberculosis
agccacgccggc

SEQ ID NO: 2812613 - RNA, 18 nt, Mycobacterium avium subsp. paratuberculosis
agccacgccggcacaccg

SEQ ID NO: 2812614 - RNA, 16 nt, Mycobacterium avium subsp. paratuberculosis
agccacggcagcugca

SEQ ID NO: 2812615 - RNA, 21 nt, Mycobacterium avium subsp. paratuberculosis
agccacggcagcugcagcgga

SEQ ID NO: 2812616 - RNA, 19 nt, Mycobacterium avium subsp. paratuberculosis
agccacucgccgugagaag

SEQ ID NO: 2812617 - RNA, 22 nt, Mycobacterium avium subsp. paratuberculosis
agccagaacacgccccggcggg

SEQ ID NO: 2812618 - RNA, 16 nt, Mycobacterium avium subsp. paratuberculosis
agccagaccucgccga

SEQ ID NO: 2812619 - RNA, 19 nt, Mycobacterium avium subsp. paratuberculosis
agccagaccucgccgacgg

SEQ ID NO: 2812620 - RNA, 20 nt, Mycobacterium avium subsp. paratuberculosis
agccagaucgaggccagcgc

SEQ ID NO: 2812621 - RNA, 21 nt, Mycobacterium avium subsp. paratuberculosis
agccagaucgaggccagcgcg

SEQ ID NO: 2812622 - RNA, 23 nt, Mycobacterium avium subsp. paratuberculosis
agccagaucgaggccagcgcgau

SEQ ID NO: 2812623 - RNA, 20 nt, Mycobacterium avium subsp. paratuberculosis
agccagaugucgcguucccg

SEQ ID NO: 2812624 - RNA, 19 nt, Mycobacterium avium subsp. paratuberculosis
agccagcaccgccccgguc

SEQ ID NO: 2812625 - RNA, 13 nt, Mycobacterium avium subsp. paratuberculosis
agccagcccagcc

SEQ ID NO: 2812626 - RNA, 16 nt, Mycobacterium avium subsp. paratuberculosis
agccagcccguggcca

SEQ ID NO: 2812627 - RNA, 17 nt, Mycobacterium avium subsp. paratuberculosis
agccagcccguggccag

SEQ ID NO: 2812628 - RNA, 22 nt, Mycobacterium avium subsp. paratuberculosis
agccagcccguggccagcgcca

SEQ ID NO: 2812629 - RNA, 13 nt, Mycobacterium avium subsp. paratuberculosis
agccagccgcgcc

SEQ ID NO: 2812630 - RNA, 21 nt, Mycobacterium avium subsp. paratuberculosis
agccagccggugcggucggcg

SEQ ID NO: 2812631 - RNA, 19 nt, Mycobacterium avium subsp. paratuberculosis
agccagccgguggcggcca

SEQ ID NO: 2812632 - RNA, 20 nt, Mycobacterium avium subsp. paratuberculosis
agccagccgguggcggccac

SEQ ID NO: 2812633 - RNA, 21 nt, Mycobacterium avium subsp. paratuberculosis
agccagccgguggcggccacg

SEQ ID NO: 2812634 - RNA, 20 nt, Mycobacterium avium subsp. paratuberculosis
agccagccgucccgccgucu

SEQ ID NO: 2812635 - RNA, 17 nt, Mycobacterium avium subsp. paratuberculosis
agccagccuggcggcga

SEQ ID NO: 2812636 - RNA, 16 nt, Mycobacterium avium subsp. paratuberculosis
agccagcgcccggcga

SEQ ID NO: 2812637 - RNA, 14 nt, Mycobacterium avium subsp. paratuberculosis
agccagcgggccga

SEQ ID NO: 2812638 - RNA, 15 nt, Mycobacterium avium subsp. paratuberculosis
agccagcucggcgua

SEQ ID NO: 2812639 - RNA, 15 nt, Mycobacterium avium subsp. paratuberculosis
agccagcugcgcguc

SEQ ID NO: 2812640 - RNA, 21 nt, Mycobacterium avium subsp. paratuberculosis
agccagcuggugaagcugccg

SEQ ID NO: 2812641 - RNA, 22 nt, Mycobacterium avium subsp. paratuberculosis
agccagcuggugaagcugccga

SEQ ID NO: 2812642 - RNA, 13 nt, Mycobacterium avium subsp. paratuberculosis
agccaggccgucg

SEQ ID NO: 2812643 - RNA, 14 nt, Mycobacterium avium subsp. paratuberculosis
agccaggccgucgg

SEQ ID NO: 2812644 - RNA, 16 nt, Mycobacterium avium subsp. paratuberculosis
agccaggccgucggcg

SEQ ID NO: 2812645 - RNA, 17 nt, Mycobacterium avium subsp. paratuberculosis
agccagguccgggcacu

SEQ ID NO: 2812646 - RNA, 16 nt, Mycobacterium avium subsp. paratuberculosis
agccaguccgccgccg

SEQ ID NO: 2812647 - RNA, 13 nt, Mycobacterium avium subsp. paratuberculosis
agccagucgccgg

SEQ ID NO: 2812648 - RNA, 14 nt, Mycobacterium avium subsp. paratuberculosis
agccagucgccggc

SEQ ID NO: 2812649 - RNA, 20 nt, Mycobacterium avium subsp. paratuberculosis
agccagucgccggccaggcc

SEQ ID NO: 2812650 - RNA, 18 nt, Mycobacterium avium subsp. paratuberculosis
agccagucggucaacgug

SEQ ID NO: 2812651 - RNA, 21 nt, Mycobacterium avium subsp. paratuberculosis
agccaguucgccagcaugcga

SEQ ID NO: 2812652 - RNA, 18 nt, Mycobacterium avium subsp. paratuberculosis
agccaguugaucagcccg

SEQ ID NO: 2812653 - RNA, 19 nt, Mycobacterium avium subsp. paratuberculosis
agccauaaaccggccggcg

SEQ ID NO: 2812654 - RNA, 21 nt, Mycobacterium avium subsp. paratuberculosis
agccaucagaacgcccgcaac

SEQ ID NO: 2812655 - RNA, 14 nt, Mycobacterium avium subsp. paratuberculosis
agccauggcggccc

SEQ ID NO: 2812656 - RNA, 18 nt, Mycobacterium avium subsp. paratuberculosis
agccaugggucucggcga

SEQ ID NO: 2812657 - RNA, 19 nt, Mycobacterium avium subsp. paratuberculosis
agccaugggucucggcgag

SEQ ID NO: 2812658 - RNA, 16 nt, Mycobacterium avium subsp. paratuberculosis
agcccaagugcccgcg

SEQ ID NO: 2812659 - RNA, 13 nt, Mycobacterium avium subsp. paratuberculosis
agcccaccgcgcc

SEQ ID NO: 2812660 - RNA, 14 nt, Mycobacterium avium subsp. paratuberculosis
agcccaccgcgccc

SEQ ID NO: 2812661 - RNA, 14 nt, Mycobacterium avium subsp. paratuberculosis
agcccaccgcggug

SEQ ID NO: 2812662 - RNA, 19 nt, Mycobacterium avium subsp. paratuberculosis
agcccaccgcggugaccgc

SEQ ID NO: 2812663 - RNA, 16 nt, Mycobacterium avium subsp. paratuberculosis
agcccagccagccggu

SEQ ID NO: 2812664 - RNA, 16 nt, Mycobacterium avium subsp. paratuberculosis
agcccagccaguccgc

SEQ ID NO: 2812665 - RNA, 14 nt, Mycobacterium avium subsp. paratuberculosis
agcccagccgucgc

SEQ ID NO: 2812666 - RNA, 23 nt, Mycobacterium avium subsp. paratuberculosis
agcccagcgcccguagccgcggu

SEQ ID NO: 2812667 - RNA, 12 nt, Mycobacterium avium subsp. paratuberculosis
agcccagcgcgu

SEQ ID NO: 2812668 - RNA, 14 nt, Mycobacterium avium subsp. paratuberculosis
agcccagcgcguug

SEQ ID NO: 2812669 - RNA, 22 nt, Mycobacterium avium subsp. paratuberculosis
agcccagcgcguugaagcugac

SEQ ID NO: 2812670 - RNA, 21 nt, Mycobacterium avium subsp. paratuberculosis
agcccagcgcguugcggccgu

SEQ ID NO: 2812671 - RNA, 12 nt, Mycobacterium avium subsp. paratuberculosis
agcccagcguga

SEQ ID NO: 2812672 - RNA, 13 nt, Mycobacterium avium subsp. paratuberculosis
agcccagcguggu

SEQ ID NO: 2812673 - RNA, 12 nt, Mycobacterium avium subsp. paratuberculosis
agcccagcugcg

SEQ ID NO: 2812674 - RNA, 17 nt, Mycobacterium avium subsp. paratuberculosis
agcccagcugcgcggag

SEQ ID NO: 2812675 - RNA, 20 nt, Mycobacterium avium subsp. paratuberculosis
agcccagcuuggcgcccuug

SEQ ID NO: 2812676 - RNA, 14 nt, Mycobacterium avium subsp. paratuberculosis
agcccaggcccagc

SEQ ID NO: 2812677 - RNA, 17 nt, Mycobacterium avium subsp. paratuberculosis
agcccggaaaaccccac

SEQ ID NO: 2812678 - RNA, 19 nt, Mycobacterium avium subsp. paratuberculosis
agcccggaaaaccccaccc

SEQ ID NO: 2812679 - RNA, 17 nt, Mycobacterium avium subsp. paratuberculosis
agcccggaaucgucggc

SEQ ID NO: 2812680 - RNA, 18 nt, Mycobacterium avium subsp. paratuberculosis
agcccggaccggccgugc

SEQ ID NO: 2812681 - RNA, 21 nt, Mycobacterium avium subsp. paratuberculosis
agcccggccagcacccgcucg

SEQ ID NO: 2812682 - RNA, 21 nt, Mycobacterium avium subsp. paratuberculosis
agcccggccagccgggcggcc

SEQ ID NO: 2812683 - RNA, 20 nt, Mycobacterium avium subsp. paratuberculosis
agcccggccaguccggcagc

SEQ ID NO: 2812684 - RNA, 14 nt, Mycobacterium avium subsp. paratuberculosis
agcccggcccagcc

SEQ ID NO: 2812685 - RNA, 16 nt, Mycobacterium avium subsp. paratuberculosis
agcccggccccaccgc

SEQ ID NO: 2812686 - RNA, 19 nt, Mycobacterium avium subsp. paratuberculosis
agcccggccccaccgccgc

SEQ ID NO: 2812687 - RNA, 15 nt, Mycobacterium avium subsp. paratuberculosis
agcccggcccgcauc

SEQ ID NO: 2812688 - RNA, 12 nt, Mycobacterium avium subsp. paratuberculosis
agcccggcccgu

SEQ ID NO: 2812689 - RNA, 13 nt, Mycobacterium avium subsp. paratuberculosis
agcccggcccguc

SEQ ID NO: 2812690 - RNA, 15 nt, Mycobacterium avium subsp. paratuberculosis
agcccggcccgucga

SEQ ID NO: 2812691 - RNA, 17 nt, Mycobacterium avium subsp. paratuberculosis
agcccggcccgucgagc

SEQ ID NO: 2812692 - RNA, 22 nt, Mycobacterium avium subsp. paratuberculosis
agcccggccgaggucaccaccg

SEQ ID NO: 2812693 - RNA, 13 nt, Mycobacterium avium subsp. paratuberculosis
agcccggccgccg

SEQ ID NO: 2812694 - RNA, 14 nt, Mycobacterium avium subsp. paratuberculosis
agcccggccgccga

SEQ ID NO: 2812695 - RNA, 13 nt, Mycobacterium avium subsp. paratuberculosis
agcccggccgcgg

SEQ ID NO: 2812696 - RNA, 20 nt, Mycobacterium avium subsp. paratuberculosis
agcccggcgaacaccacggu

SEQ ID NO: 2812697 - RNA, 12 nt, Mycobacterium avium subsp. paratuberculosis
agcccggcgacg

SEQ ID NO: 2812698 - RNA, 16 nt, Mycobacterium avium subsp. paratuberculosis
agcccggcgacgaagc

SEQ ID NO: 2812699 - RNA, 17 nt, Mycobacterium avium subsp. paratuberculosis
agcccggcgacgaagca

SEQ ID NO: 2812700 - RNA, 20 nt, Mycobacterium avium subsp. paratuberculosis
agcccggcgacgaagcagcu

SEQ ID NO: 2812701 - RNA, 22 nt, Mycobacterium avium subsp. paratuberculosis
agcccggcgacgaagcagcucg

SEQ ID NO: 2812702 - RNA, 17 nt, Mycobacterium avium subsp. paratuberculosis
agcccggcgacgucguc

SEQ ID NO: 2812703 - RNA, 18 nt, Mycobacterium avium subsp. paratuberculosis
agcccggcgacgucgucg

SEQ ID NO: 2812704 - RNA, 17 nt, Mycobacterium avium subsp. paratuberculosis
agcccggcgcucaccgc

SEQ ID NO: 2812705 - RNA, 19 nt, Mycobacterium avium subsp. paratuberculosis
agcccggcgcucaccgcga

SEQ ID NO: 2812706 - RNA, 14 nt, Mycobacterium avium subsp. paratuberculosis
agcccggcgcugcg

SEQ ID NO: 2812707 - RNA, 20 nt, Mycobacterium avium subsp. paratuberculosis
agcccggcgcugcgcccggu

SEQ ID NO: 2812708 - RNA, 21 nt, Mycobacterium avium subsp. paratuberculosis
agcccggcuaauucgggccgc

SEQ ID NO: 2812709 - RNA, 19 nt, Mycobacterium avium subsp. paratuberculosis
agcccggcugcgcagcgca

SEQ ID NO: 2812710 - RNA, 13 nt, Mycobacterium avium subsp. paratuberculosis
agcccgggcaggc

SEQ ID NO: 2812711 - RNA, 16 nt, Mycobacterium avium subsp. paratuberculosis
agcccgggcugcagca

SEQ ID NO: 2812712 - RNA, 18 nt, Mycobacterium avium subsp. paratuberculosis
agcccgggcugcagcagc

SEQ ID NO: 2812713 - RNA, 20 nt, Mycobacterium avium subsp. paratuberculosis
agcccgggcugcagcagcga

SEQ ID NO: 2812714 - RNA, 20 nt, Mycobacterium avium subsp. paratuberculosis
agcccggguauuucgagcac

SEQ ID NO: 2812715 - RNA, 21 nt, Mycobacterium avium subsp. paratuberculosis
agcccggguauuucgagcaca

SEQ ID NO: 2812716 - RNA, 13 nt, Mycobacterium avium subsp. paratuberculosis
agcccgggugcga

SEQ ID NO: 2812717 - RNA, 21 nt, Mycobacterium avium subsp. paratuberculosis
agcccggguugagcaggucag

SEQ ID NO: 2812718 - RNA, 22 nt, Mycobacterium avium subsp. paratuberculosis
agcccggguugagcaggucagc

SEQ ID NO: 2812719 - RNA, 21 nt, Mycobacterium avium subsp. paratuberculosis
agcccggucaccaucagcacc

SEQ ID NO: 2812720 - RNA, 22 nt, Mycobacterium avium subsp. paratuberculosis
agcccggucaccaucagcaccg

SEQ ID NO: 2812721 - RNA, 22 nt, Mycobacterium avium subsp. paratuberculosis
agcccgguuuccaguccggcgc

SEQ ID NO: 2812722 - RNA, 18 nt, Mycobacterium avium subsp. paratuberculosis
agcccguacuugcuggcg

SEQ ID NO: 2812723 - RNA, 15 nt, Mycobacterium avium subsp. paratuberculosis
agcccgucccggccc

SEQ ID NO: 2812724 - RNA, 13 nt, Mycobacterium avium subsp. paratuberculosis
agcccgucgacgg

SEQ ID NO: 2812725 - RNA, 15 nt, Mycobacterium avium subsp. paratuberculosis
agcccgucgacgucg

SEQ ID NO: 2812726 - RNA, 20 nt, Mycobacterium avium subsp. paratuberculosis
agcccgucggccuccagccg

SEQ ID NO: 2812727 - RNA, 23 nt, Mycobacterium avium subsp. paratuberculosis
agcccgucgggugugauugccag

SEQ ID NO: 2812728 - RNA, 19 nt, Mycobacterium avium subsp. paratuberculosis
agcccgugccgaugccggc

SEQ ID NO: 2812729 - RNA, 21 nt, Mycobacterium avium subsp. paratuberculosis
agcccgugccgaugccggccu

SEQ ID NO: 2812730 - RNA, 22 nt, Mycobacterium avium subsp. paratuberculosis
agcccgugccgaugccggccug

SEQ ID NO: 2812731 - RNA, 24 nt, Mycobacterium avium subsp. paratuberculosis
agcccgugccgaugccggccuggc

SEQ ID NO: 2812732 - RNA, 19 nt, Mycobacterium avium subsp. paratuberculosis
agcccgugcgacggcucuu

SEQ ID NO: 2812733 - RNA, 21 nt, Mycobacterium avium subsp. paratuberculosis
agcccgugcggcggggccucg

SEQ ID NO: 2812734 - RNA, 14 nt, Mycobacterium avium subsp. paratuberculosis
agcccguggccagc

SEQ ID NO: 2812735 - RNA, 17 nt, Mycobacterium avium subsp. paratuberculosis
agcccguggccagcgcc

SEQ ID NO: 2812736 - RNA, 19 nt, Mycobacterium avium subsp. paratuberculosis
agcccguucagugaccagu

SEQ ID NO: 2812737 - RNA, 22 nt, Mycobacterium avium subsp. paratuberculosis
agcccguugcugcguucggcga

SEQ ID NO: 2812738 - RNA, 17 nt, Mycobacterium avium subsp. paratuberculosis
agcccguugucgagcac

SEQ ID NO: 2812739 - RNA, 21 nt, Mycobacterium avium subsp. paratuberculosis
agcccguugucgagcaccgcg

SEQ ID NO: 2812740 - RNA, 22 nt, Mycobacterium avium subsp. paratuberculosis
agcccguugucgagcaccgcga

SEQ ID NO: 2812741 - RNA, 17 nt, Mycobacterium avium subsp. paratuberculosis
agcccguuguggcggcc

SEQ ID NO: 2812742 - RNA, 18 nt, Mycobacterium avium subsp. paratuberculosis
agcccguuguggcggcca

SEQ ID NO: 2812743 - RNA, 19 nt, Mycobacterium avium subsp. paratuberculosis
agcccguuguggcggccag

SEQ ID NO: 2812744 - RNA, 20 nt, Mycobacterium avium subsp. paratuberculosis
agcccguuguggcggccagc

SEQ ID NO: 2812745 - RNA, 16 nt, Mycobacterium avium subsp. paratuberculosis
agcccuacccguccag

SEQ ID NO: 2812746 - RNA, 20 nt, Mycobacterium avium subsp. paratuberculosis
agcccuaccggcucggcccg

SEQ ID NO: 2812747 - RNA, 12 nt, Mycobacterium avium subsp. paratuberculosis
agcccuccagcu

SEQ ID NO: 2812748 - RNA, 24 nt, Mycobacterium avium subsp. paratuberculosis
agcccucgagccauaaaccggccg

SEQ ID NO: 2812749 - RNA, 19 nt, Mycobacterium avium subsp. paratuberculosis
agcccucuucgaucaggcg

SEQ ID NO: 2812750 - RNA, 19 nt, Mycobacterium avium subsp. paratuberculosis
agcccugcagguagguggc

SEQ ID NO: 2812751 - RNA, 20 nt, Mycobacterium avium subsp. paratuberculosis
agcccugcgccagcagcagc

SEQ ID NO: 2812752 - RNA, 12 nt, Mycobacterium avium subsp. paratuberculosis
agcccugcucgg

SEQ ID NO: 2812753 - RNA, 14 nt, Mycobacterium avium subsp. paratuberculosis
agcccugcucggug

SEQ ID NO: 2812754 - RNA, 19 nt, Mycobacterium avium subsp. paratuberculosis
agcccugcucggugaugcc

SEQ ID NO: 2812755 - RNA, 16 nt, Mycobacterium avium subsp. paratuberculosis
agcccuucaccucggc

SEQ ID NO: 2812756 - RNA, 18 nt, Mycobacterium avium subsp. paratuberculosis
agcccuucaccucggccu

SEQ ID NO: 2812757 - RNA, 14 nt, Mycobacterium avium subsp. paratuberculosis
agcccuucgcggug

SEQ ID NO: 2812758 - RNA, 24 nt, Mycobacterium avium subsp. paratuberculosis
agcccuucgcggugugcggcagcu

SEQ ID NO: 2812759 - RNA, 15 nt, Mycobacterium avium subsp. paratuberculosis
agcccuugcagcaca

SEQ ID NO: 2812760 - RNA, 18 nt, Mycobacterium avium subsp. paratuberculosis
agcccuugcagcacaccg

SEQ ID NO: 2812761 - RNA, 13 nt, Mycobacterium avium subsp. paratuberculosis
agccgcaccaggu

SEQ ID NO: 2812762 - RNA, 13 nt, Mycobacterium avium subsp. paratuberculosis
agccgcaccgcga

SEQ ID NO: 2812763 - RNA, 16 nt, Mycobacterium avium subsp. paratuberculosis
agccgcaccggcgccg

SEQ ID NO: 2812764 - RNA, 15 nt, Mycobacterium avium subsp. paratuberculosis
agccgcacgaaccgc

SEQ ID NO: 2812765 - RNA, 17 nt, Mycobacterium avium subsp. paratuberculosis
agccgcacgaaccgcuc

SEQ ID NO: 2812766 - RNA, 16 nt, Mycobacterium avium subsp. paratuberculosis
agccgcacuuggccuc

SEQ ID NO: 2812767 - RNA, 13 nt, Mycobacterium avium subsp. paratuberculosis
agccgcagcagcc

SEQ ID NO: 2812768 - RNA, 13 nt, Mycobacterium avium subsp. paratuberculosis
agccgcagcaggu

SEQ ID NO: 2812769 - RNA, 14 nt, Mycobacterium avium subsp. paratuberculosis
agccgcagccgggu

SEQ ID NO: 2812770 - RNA, 20 nt, Mycobacterium avium subsp. paratuberculosis
agccgcaggugcucgccggc

SEQ ID NO: 2812771 - RNA, 21 nt, Mycobacterium avium subsp. paratuberculosis
agccgcaggugcucgccggcg

SEQ ID NO: 2812772 - RNA, 15 nt, Mycobacterium avium subsp. paratuberculosis
agccgcagucgauca

SEQ ID NO: 2812773 - RNA, 17 nt, Mycobacterium avium subsp. paratuberculosis
agccgcagucgaucacc

SEQ ID NO: 2812774 - RNA, 18 nt, Mycobacterium avium subsp. paratuberculosis
agccgcauggugcgggug

SEQ ID NO: 2812775 - RNA, 19 nt, Mycobacterium avium subsp. paratuberculosis
agccgcauguugugcccga

SEQ ID NO: 2812776 - RNA, 21 nt, Mycobacterium avium subsp. paratuberculosis
agccgcauguugugcccgacg

SEQ ID NO: 2812777 - RNA, 18 nt, Mycobacterium avium subsp. paratuberculosis
agccgcauucggugagcc

SEQ ID NO: 2812778 - RNA, 22 nt, Mycobacterium avium subsp. paratuberculosis
agccgccacggggcccgcgacc

SEQ ID NO: 2812779 - RNA, 14 nt, Mycobacterium avium subsp. paratuberculosis
agccgccagccggu

SEQ ID NO: 2812780 - RNA, 20 nt, Mycobacterium avium subsp. paratuberculosis
agccgcccagcaucgccgcg

SEQ ID NO: 2812781 - RNA, 12 nt, Mycobacterium avium subsp. paratuberculosis
agccgccccgau

SEQ ID NO: 2812782 - RNA, 13 nt, Mycobacterium avium subsp. paratuberculosis
agccgcccgauca

SEQ ID NO: 2812783 - RNA, 23 nt, Mycobacterium avium subsp. paratuberculosis
agccgcccgaucaucucaccgac

SEQ ID NO: 2812784 - RNA, 18 nt, Mycobacterium avium subsp. paratuberculosis
agccgcccggcgccccgc

SEQ ID NO: 2812785 - RNA, 17 nt, Mycobacterium avium subsp. paratuberculosis
agccgcccugcccgucg

SEQ ID NO: 2812786 - RNA, 16 nt, Mycobacterium avium subsp. paratuberculosis
agccgccgacgguggc

SEQ ID NO: 2812787 - RNA, 15 nt, Mycobacterium avium subsp. paratuberculosis
agccgccgagccggc

SEQ ID NO: 2812788 - RNA, 12 nt, Mycobacterium avium subsp. paratuberculosis
agccgccgagcg

SEQ ID NO: 2812789 - RNA, 13 nt, Mycobacterium avium subsp. paratuberculosis
agccgccgagcgu

SEQ ID NO: 2812790 - RNA, 16 nt, Mycobacterium avium subsp. paratuberculosis
agccgccgaucuucuc

SEQ ID NO: 2812791 - RNA, 15 nt, Mycobacterium avium subsp. paratuberculosis
agccgccgccgacca

SEQ ID NO: 2812792 - RNA, 21 nt, Mycobacterium avium subsp. paratuberculosis
agccgccgccgaccacaugcc

SEQ ID NO: 2812793 - RNA, 13 nt, Mycobacterium avium subsp. paratuberculosis
agccgccgccggc

SEQ ID NO: 2812794 - RNA, 19 nt, Mycobacterium avium subsp. paratuberculosis
agccgccgccggcgucgcc

SEQ ID NO: 2812795 - RNA, 18 nt, Mycobacterium avium subsp. paratuberculosis
agccgccgcgccaccgag

SEQ ID NO: 2812796 - RNA, 14 nt, Mycobacterium avium subsp. paratuberculosis
agccgccgcggguc

SEQ ID NO: 2812797 - RNA, 19 nt, Mycobacterium avium subsp. paratuberculosis
agccgccgcgggucggcga

SEQ ID NO: 2812798 - RNA, 22 nt, Mycobacterium avium subsp. paratuberculosis
agccgccgcgggucggcgacgg

SEQ ID NO: 2812799 - RNA, 15 nt, Mycobacterium avium subsp. paratuberculosis
agccgccgcguggcc

SEQ ID NO: 2812800 - RNA, 17 nt, Mycobacterium avium subsp. paratuberculosis
agccgccggaucggcag

SEQ ID NO: 2812801 - RNA, 22 nt, Mycobacterium avium subsp. paratuberculosis
agccgccggaucggcagcgcgu

SEQ ID NO: 2812802 - RNA, 13 nt, Mycobacterium avium subsp. paratuberculosis
agccgccggccac

SEQ ID NO: 2812803 - RNA, 14 nt, Mycobacterium avium subsp. paratuberculosis
agccgccggccacc

SEQ ID NO: 2812804 - RNA, 18 nt, Mycobacterium avium subsp. paratuberculosis
agccgccggcucagcggc

SEQ ID NO: 2812805 - RNA, 18 nt, Mycobacterium avium subsp. paratuberculosis
agccgccgggccacgccg

SEQ ID NO: 2812806 - RNA, 13 nt, Mycobacterium avium subsp. paratuberculosis
agccgccggggcg

SEQ ID NO: 2812807 - RNA, 17 nt, Mycobacterium avium subsp. paratuberculosis
agccgccggggcgccgc

SEQ ID NO: 2812808 - RNA, 19 nt, Mycobacterium avium subsp. paratuberculosis
agccgccggggcgccgccg

SEQ ID NO: 2812809 - RNA, 14 nt, Mycobacterium avium subsp. paratuberculosis
agccgccgguccag

SEQ ID NO: 2812810 - RNA, 21 nt, Mycobacterium avium subsp. paratuberculosis
agccgccgguccagugccggc

SEQ ID NO: 2812811 - RNA, 23 nt, Mycobacterium avium subsp. paratuberculosis
agccgccgguccagugccggcga

SEQ ID NO: 2812812 - RNA, 13 nt, Mycobacterium avium subsp. paratuberculosis
agccgccgguggc

SEQ ID NO: 2812813 - RNA, 14 nt, Mycobacterium avium subsp. paratuberculosis
agccgccgguggcg

SEQ ID NO: 2812814 - RNA, 15 nt, Mycobacterium avium subsp. paratuberculosis
agccgccgguggcgu

SEQ ID NO: 2812815 - RNA, 19 nt, Mycobacterium avium subsp. paratuberculosis
agccgccguagccggcggu

SEQ ID NO: 2812816 - RNA, 20 nt, Mycobacterium avium subsp. paratuberculosis
agccgccguagccggcggug

SEQ ID NO: 2812817 - RNA, 22 nt, Mycobacterium avium subsp. paratuberculosis
agccgccguagccggcgguggc

SEQ ID NO: 2812818 - RNA, 16 nt, Mycobacterium avium subsp. paratuberculosis
agccgccguccccgcg

SEQ ID NO: 2812819 - RNA, 12 nt, Mycobacterium avium subsp. paratuberculosis
agccgccgucgc

SEQ ID NO: 2812820 - RNA, 17 nt, Mycobacterium avium subsp. paratuberculosis
agccgccguucucgcgc

SEQ ID NO: 2812821 - RNA, 16 nt, Mycobacterium avium subsp. paratuberculosis
agccgcgaacgccucg

SEQ ID NO: 2812822 - RNA, 18 nt, Mycobacterium avium subsp. paratuberculosis
agccgcgaacgccucggc

SEQ ID NO: 2812823 - RNA, 19 nt, Mycobacterium avium subsp. paratuberculosis
agccgcgacacgugcaucu

SEQ ID NO: 2812824 - RNA, 17 nt, Mycobacterium avium subsp. paratuberculosis
agccgcgauagccauca

SEQ ID NO: 2812825 - RNA, 13 nt, Mycobacterium avium subsp. paratuberculosis
agccgcgaucggc

SEQ ID NO: 2812826 - RNA, 16 nt, Mycobacterium avium subsp. paratuberculosis
agccgcgcaccacggu

SEQ ID NO: 2812827 - RNA, 19 nt, Mycobacterium avium subsp. paratuberculosis
agccgcgcaccacgguggc

SEQ ID NO: 2812828 - RNA, 14 nt, Mycobacterium avium subsp. paratuberculosis
agccgcgccaccgc

SEQ ID NO: 2812829 - RNA, 21 nt, Mycobacterium avium subsp. paratuberculosis
agccgcgccaccgcggggcug

SEQ ID NO: 2812830 - RNA, 13 nt, Mycobacterium avium subsp. paratuberculosis
agccgcgccacgc

SEQ ID NO: 2812831 - RNA, 22 nt, Mycobacterium avium subsp. paratuberculosis
agccgcgccacgcgcagggcga

SEQ ID NO: 2812832 - RNA, 19 nt, Mycobacterium avium subsp. paratuberculosis
agccgcgcccacccgcgca

SEQ ID NO: 2812833 - RNA, 23 nt, Mycobacterium avium subsp. paratuberculosis
agccgcgccgacagaugcggcac

SEQ ID NO: 2812834 - RNA, 19 nt, Mycobacterium avium subsp. paratuberculosis
agccgcgccgacgcccaca

SEQ ID NO: 2812835 - RNA, 11 nt, Mycobacterium avium subsp. paratuberculosis
agccgcgccgc

SEQ ID NO: 2812836 - RNA, 14 nt, Mycobacterium avium subsp. paratuberculosis
agccgcgccgccgc

SEQ ID NO: 2812837 - RNA, 16 nt, Mycobacterium avium subsp. paratuberculosis
agccgcgccgccgcgu

SEQ ID NO: 2812838 - RNA, 12 nt, Mycobacterium avium subsp. paratuberculosis
agccgcgccgcg

SEQ ID NO: 2812839 - RNA, 14 nt, Mycobacterium avium subsp. paratuberculosis
agccgcgccgcgcc

SEQ ID NO: 2812840 - RNA, 18 nt, Mycobacterium avium subsp. paratuberculosis
agccgcgcgacgccguag

SEQ ID NO: 2812841 - RNA, 18 nt, Mycobacterium avium subsp. paratuberculosis
agccgcgcgagcaucacc

SEQ ID NO: 2812842 - RNA, 13 nt, Mycobacterium avium subsp. paratuberculosis
agccgcgcgccga

SEQ ID NO: 2812843 - RNA, 15 nt, Mycobacterium avium subsp. paratuberculosis
agccgcgcgccgaga

SEQ ID NO: 2812844 - RNA, 14 nt, Mycobacterium avium subsp. paratuberculosis
agccgcgcggccgc

SEQ ID NO: 2812845 - RNA, 16 nt, Mycobacterium avium subsp. paratuberculosis
agccgcgcggccgccu

SEQ ID NO: 2812846 - RNA, 15 nt, Mycobacterium avium subsp. paratuberculosis
agccggccccgcccg

SEQ ID NO: 2812847 - RNA, 16 nt, Mycobacterium avium subsp. paratuberculosis
agccggcccgcagcca

SEQ ID NO: 2812848 - RNA, 14 nt, Mycobacterium avium subsp. paratuberculosis
agccggcccgcauc

SEQ ID NO: 2812849 - RNA, 22 nt, Mycobacterium avium subsp. paratuberculosis
agccggcccggggugugcccga

SEQ ID NO: 2812850 - RNA, 20 nt, Mycobacterium avium subsp. paratuberculosis
agccggccgaagaccgccga

SEQ ID NO: 2812851 - RNA, 23 nt, Mycobacterium avium subsp. paratuberculosis
agccggccgaagcguuccgccgu

SEQ ID NO: 2812852 - RNA, 18 nt, Mycobacterium avium subsp. paratuberculosis
agccggccgaccgccucg

SEQ ID NO: 2812853 - RNA, 19 nt, Mycobacterium avium subsp. paratuberculosis
agccggccgacgcggccuc

SEQ ID NO: 2812854 - RNA, 14 nt, Mycobacterium avium subsp. paratuberculosis
agccggccgccgaa

SEQ ID NO: 2812855 - RNA, 12 nt, Mycobacterium avium subsp. paratuberculosis
agccggccgcgu

SEQ ID NO: 2812856 - RNA, 16 nt, Mycobacterium avium subsp. paratuberculosis
agccggccgcgucgcc

SEQ ID NO: 2812857 - RNA, 18 nt, Mycobacterium avium subsp. paratuberculosis
agccggccgcgucgccga

SEQ ID NO: 2812858 - RNA, 19 nt, Mycobacterium avium subsp. paratuberculosis
agccggccgcgucgccgac

SEQ ID NO: 2812859 - RNA, 14 nt, Mycobacterium avium subsp. paratuberculosis
agccggccgcugag

SEQ ID NO: 2812860 - RNA, 23 nt, Mycobacterium avium subsp. paratuberculosis
agccggccgcugaggaugguggu

SEQ ID NO: 2812861 - RNA, 15 nt, Mycobacterium avium subsp. paratuberculosis
agccggccggacacc

SEQ ID NO: 2812862 - RNA, 17 nt, Mycobacterium avium subsp. paratuberculosis
agccggccggacaccga

SEQ ID NO: 2812863 - RNA, 13 nt, Mycobacterium avium subsp. paratuberculosis
agccggccggcag

SEQ ID NO: 2812864 - RNA, 13 nt, Mycobacterium avium subsp. paratuberculosis
agccggccggccg

SEQ ID NO: 2812865 - RNA, 23 nt, Mycobacterium avium subsp. paratuberculosis
agccggccggcggacgcggccag

SEQ ID NO: 2812866 - RNA, 17 nt, Mycobacterium avium subsp. paratuberculosis
agccggccguccacggc

SEQ ID NO: 2812867 - RNA, 16 nt, Mycobacterium avium subsp. paratuberculosis
agccggccucgccggc

SEQ ID NO: 2812868 - RNA, 20 nt, Mycobacterium avium subsp. paratuberculosis
agccggccucgccggcgccg

SEQ ID NO: 2812869 - RNA, 21 nt, Mycobacterium avium subsp. paratuberculosis
agccggccugcuuuucggccg

SEQ ID NO: 2812870 - RNA, 22 nt, Mycobacterium avium subsp. paratuberculosis
agccggccugcuuuucggccga

SEQ ID NO: 2812871 - RNA, 19 nt, Mycobacterium avium subsp. paratuberculosis
agccggcgaacuccacccu

SEQ ID NO: 2812872 - RNA, 17 nt, Mycobacterium avium subsp. paratuberculosis
agccggcgacgaccgca

SEQ ID NO: 2812873 - RNA, 22 nt, Mycobacterium avium subsp. paratuberculosis
agccggcgacgaccgcaccgac

SEQ ID NO: 2812874 - RNA, 14 nt, Mycobacterium avium subsp. paratuberculosis
agccggcgagcgcg

SEQ ID NO: 2812875 - RNA, 15 nt, Mycobacterium avium subsp. paratuberculosis
agccggcgaucgucg

SEQ ID NO: 2812876 - RNA, 17 nt, Mycobacterium avium subsp. paratuberculosis
agccggcgaucgucgcc

SEQ ID NO: 2812877 - RNA, 13 nt, Mycobacterium avium subsp. paratuberculosis
agccggcgcacca

SEQ ID NO: 2812878 - RNA, 20 nt, Mycobacterium avium subsp. paratuberculosis
agccggcgcaccaggguguc

SEQ ID NO: 2812879 - RNA, 22 nt, Mycobacterium avium subsp. paratuberculosis
agccggcgcaccagggugucgu

SEQ ID NO: 2812880 - RNA, 20 nt, Mycobacterium avium subsp. paratuberculosis
agccggcgcacucccgcgua

SEQ ID NO: 2812881 - RNA, 14 nt, Mycobacterium avium subsp. paratuberculosis
agccggcgcaggug

SEQ ID NO: 2812882 - RNA, 14 nt, Mycobacterium avium subsp. paratuberculosis
agccggcgcgcggu

SEQ ID NO: 2812883 - RNA, 12 nt, Mycobacterium avium subsp. paratuberculosis
agccggcggcgc

SEQ ID NO: 2812884 - RNA, 23 nt, Mycobacterium avium subsp. paratuberculosis
agccggcggcgccuugccggucu

SEQ ID NO: 2812885 - RNA, 16 nt, Mycobacterium avium subsp. paratuberculosis
agccggcggcggcggu

SEQ ID NO: 2812886 - RNA, 20 nt, Mycobacterium avium subsp. paratuberculosis
agccggcggcggcggucggc

SEQ ID NO: 2812887 - RNA, 14 nt, Mycobacterium avium subsp. paratuberculosis
agccggcggcggug

SEQ ID NO: 2812888 - RNA, 16 nt, Mycobacterium avium subsp. paratuberculosis
agccggcggcggugcg

SEQ ID NO: 2812889 - RNA, 12 nt, Mycobacterium avium subsp. paratuberculosis
agccggcggcgu

SEQ ID NO: 2812890 - RNA, 21 nt, Mycobacterium avium subsp. paratuberculosis
agccggcggcugugaucgcug

SEQ ID NO: 2812891 - RNA, 14 nt, Mycobacterium avium subsp. paratuberculosis
agccggcgggcgcu

SEQ ID NO: 2812892 - RNA, 17 nt, Mycobacterium avium subsp. paratuberculosis
agccggcgggcgcucga

SEQ ID NO: 2812893 - RNA, 18 nt, Mycobacterium avium subsp. paratuberculosis
agccggcgggcgcucgau

SEQ ID NO: 2812894 - RNA, 14 nt, Mycobacterium avium subsp. paratuberculosis
agccggcgguggcc

SEQ ID NO: 2812895 - RNA, 16 nt, Mycobacterium avium subsp. paratuberculosis
agccggcgguggccau

SEQ ID NO: 2812896 - RNA, 23 nt, Mycobacterium avium subsp. paratuberculosis
agccggcgguggccaugcgcgag

SEQ ID NO: 2812897 - RNA, 18 nt, Mycobacterium avium subsp. paratuberculosis
agccggcgguucggcggg

SEQ ID NO: 2812898 - RNA, 23 nt, Mycobacterium avium subsp. paratuberculosis
agccggcgguucggcgggccuuc

SEQ ID NO: 2812899 - RNA, 22 nt, Mycobacterium avium subsp. paratuberculosis
agccggcguacucgcacagccg

SEQ ID NO: 2812900 - RNA, 15 nt, Mycobacterium avium subsp. paratuberculosis
agccggcgucgauga

SEQ ID NO: 2812901 - RNA, 16 nt, Mycobacterium avium subsp. paratuberculosis
agccggcgucgccgcu

SEQ ID NO: 2812902 - RNA, 22 nt, Mycobacterium avium subsp. paratuberculosis
agccggcucagggugcgcuggc

SEQ ID NO: 2812903 - RNA, 16 nt, Mycobacterium avium subsp. paratuberculosis
agccgggcagcgcgac

SEQ ID NO: 2812904 - RNA, 20 nt, Mycobacterium avium subsp. paratuberculosis
agccgggccaauuacgcugc

SEQ ID NO: 2812905 - RNA, 23 nt, Mycobacterium avium subsp. paratuberculosis
agccgggccaauuacgcugcggc

SEQ ID NO: 2812906 - RNA, 21 nt, Mycobacterium avium subsp. paratuberculosis
agccgggccagcaacagcagc

SEQ ID NO: 2812907 - RNA, 23 nt, Mycobacterium avium subsp. paratuberculosis
agccgggccagcaacagcagcgg

SEQ ID NO: 2812908 - RNA, 14 nt, Mycobacterium avium subsp. paratuberculosis
agccgggccagcag

SEQ ID NO: 2812909 - RNA, 16 nt, Mycobacterium avium subsp. paratuberculosis
agccgggccagcagcu

SEQ ID NO: 2812910 - RNA, 20 nt, Mycobacterium avium subsp. paratuberculosis
agccgggccagcccgggaaa

SEQ ID NO: 2812911 - RNA, 13 nt, Mycobacterium avium subsp. paratuberculosis
agccgggccaggu

SEQ ID NO: 2812912 - RNA, 18 nt, Mycobacterium avium subsp. paratuberculosis
agccgggccaggucccag

SEQ ID NO: 2812913 - RNA, 20 nt, Mycobacterium avium subsp. paratuberculosis
agccgggccaggucccaggc

SEQ ID NO: 2812914 - RNA, 21 nt, Mycobacterium avium subsp. paratuberculosis
agccgggccaggucccaggcg

SEQ ID NO: 2812915 - RNA, 22 nt, Mycobacterium avium subsp. paratuberculosis
agccgggccaggucccaggcgu

SEQ ID NO: 2812916 - RNA, 14 nt, Mycobacterium avium subsp. paratuberculosis
agccgggccgagcg

SEQ ID NO: 2812917 - RNA, 22 nt, Mycobacterium avium subsp. paratuberculosis
agccgggccgagcgcgccgccg

SEQ ID NO: 2812918 - RNA, 18 nt, Mycobacterium avium subsp. paratuberculosis
agccgggccgcccgcgcg

SEQ ID NO: 2812919 - RNA, 21 nt, Mycobacterium avium subsp. paratuberculosis
agccgggccggguccacgccg

SEQ ID NO: 2812920 - RNA, 23 nt, Mycobacterium avium subsp. paratuberculosis
agccgggccggguccacgccgag

SEQ ID NO: 2812921 - RNA, 15 nt, Mycobacterium avium subsp. paratuberculosis
agccgggccugcagc

SEQ ID NO: 2812922 - RNA, 16 nt, Mycobacterium avium subsp. paratuberculosis
agccgggccugcggcg

SEQ ID NO: 2812923 - RNA, 18 nt, Mycobacterium avium subsp. paratuberculosis
agccgggccugcggcgcg

SEQ ID NO: 2812924 - RNA, 18 nt, Mycobacterium avium subsp. paratuberculosis
agccgggcgcgggcgccg

SEQ ID NO: 2812925 - RNA, 21 nt, Mycobacterium avium subsp. paratuberculosis
agccgggcgcgggcgccgucg

SEQ ID NO: 2812926 - RNA, 15 nt, Mycobacterium avium subsp. paratuberculosis
agccgggcggcagca

SEQ ID NO: 2812927 - RNA, 20 nt, Mycobacterium avium subsp. paratuberculosis
agccgggcggcagcagcugc

SEQ ID NO: 2812928 - RNA, 13 nt, Mycobacterium avium subsp. paratuberculosis
agccgggcggcca

SEQ ID NO: 2812929 - RNA, 15 nt, Mycobacterium avium subsp. paratuberculosis
agccgggcggccagc

SEQ ID NO: 2812930 - RNA, 19 nt, Mycobacterium avium subsp. paratuberculosis
agccgguggcggccacgau

SEQ ID NO: 2812931 - RNA, 23 nt, Mycobacterium avium subsp. paratuberculosis
agccgguggcggccacgaucgcg

SEQ ID NO: 2812932 - RNA, 21 nt, Mycobacterium avium subsp. paratuberculosis
agccggugguuuugcggcccu

SEQ ID NO: 2812933 - RNA, 14 nt, Mycobacterium avium subsp. paratuberculosis
agccgguucguccc

SEQ ID NO: 2812934 - RNA, 17 nt, Mycobacterium avium subsp. paratuberculosis
agccguacacggcggcg

SEQ ID NO: 2812935 - RNA, 19 nt, Mycobacterium avium subsp. paratuberculosis
agccguacacggcggcgaa

SEQ ID NO: 2812936 - RNA, 23 nt, Mycobacterium avium subsp. paratuberculosis
agccguaggacccuucgaacgcg

SEQ ID NO: 2812937 - RNA, 13 nt, Mycobacterium avium subsp. paratuberculosis
agccguaggccag

SEQ ID NO: 2812938 - RNA, 21 nt, Mycobacterium avium subsp. paratuberculosis
agccgucccgccgucucgacc

SEQ ID NO: 2812939 - RNA, 12 nt, Mycobacterium avium subsp. paratuberculosis
agccgucccugu

SEQ ID NO: 2812940 - RNA, 18 nt, Mycobacterium avium subsp. paratuberculosis
agccguccggguucgacg

SEQ ID NO: 2812941 - RNA, 22 nt, Mycobacterium avium subsp. paratuberculosis
agccgucgaaacggcugcugcg

SEQ ID NO: 2812942 - RNA, 23 nt, Mycobacterium avium subsp. paratuberculosis
agccgucgaagaugaccugaucg

SEQ ID NO: 2812943 - RNA, 16 nt, Mycobacterium avium subsp. paratuberculosis
agccgucgaccccgcc

SEQ ID NO: 2812944 - RNA, 19 nt, Mycobacterium avium subsp. paratuberculosis
agccgucgaccccgccggc

SEQ ID NO: 2812945 - RNA, 21 nt, Mycobacterium avium subsp. paratuberculosis
agccgucgaccccgccggccc

SEQ ID NO: 2812946 - RNA, 16 nt, Mycobacterium avium subsp. paratuberculosis
agccgucgaccggguc

SEQ ID NO: 2812947 - RNA, 12 nt, Mycobacterium avium subsp. paratuberculosis
agccgucgaucu

SEQ ID NO: 2812948 - RNA, 17 nt, Mycobacterium avium subsp. paratuberculosis
agccgucgaugccggcg

SEQ ID NO: 2812949 - RNA, 14 nt, Mycobacterium avium subsp. paratuberculosis
agccgucgcaccgc

SEQ ID NO: 2812950 - RNA, 17 nt, Mycobacterium avium subsp. paratuberculosis
agccgucgcaucagcuc

SEQ ID NO: 2812951 - RNA, 18 nt, Mycobacterium avium subsp. paratuberculosis
agccgucgcaucagcucg

SEQ ID NO: 2812952 - RNA, 20 nt, Mycobacterium avium subsp. paratuberculosis
agccgucgcaucagcucggc

SEQ ID NO: 2812953 - RNA, 22 nt, Mycobacterium avium subsp. paratuberculosis
agccgucgcaucagcucggcag

SEQ ID NO: 2812954 - RNA, 14 nt, Mycobacterium avium subsp. paratuberculosis
agccgucgccgcgc

SEQ ID NO: 2812955 - RNA, 16 nt, Mycobacterium avium subsp. paratuberculosis
agccgucgccgcgccc

SEQ ID NO: 2812956 - RNA, 19 nt, Mycobacterium avium subsp. paratuberculosis
agccgucgccgcgcccgcc

SEQ ID NO: 2812957 - RNA, 22 nt, Mycobacterium avium subsp. paratuberculosis
agccgucgccgcgcccgccggc

SEQ ID NO: 2812958 - RNA, 12 nt, Mycobacterium avium subsp. paratuberculosis
agccgucggcgg

SEQ ID NO: 2812959 - RNA, 14 nt, Mycobacterium avium subsp. paratuberculosis
agccgucggcggag

SEQ ID NO: 2812960 - RNA, 14 nt, Mycobacterium avium subsp. paratuberculosis
agccgucggcggcc

SEQ ID NO: 2812961 - RNA, 15 nt, Mycobacterium avium subsp. paratuberculosis
agccgucggcggccu

SEQ ID NO: 2812962 - RNA, 16 nt, Mycobacterium avium subsp. paratuberculosis
agccgucggcggccuu

SEQ ID NO: 2812963 - RNA, 20 nt, Mycobacterium avium subsp. paratuberculosis
agccgucggcuuccuccucg

SEQ ID NO: 2812964 - RNA, 20 nt, Mycobacterium avium subsp. paratuberculosis
agccgucgguguccaggucg

SEQ ID NO: 2812965 - RNA, 17 nt, Mycobacterium avium subsp. paratuberculosis
agccgucgucgcugcag

SEQ ID NO: 2812966 - RNA, 20 nt, Mycobacterium avium subsp. paratuberculosis
agccgucguugcgggcggcg

SEQ ID NO: 2812967 - RNA, 21 nt, Mycobacterium avium subsp. paratuberculosis
agccgucguugcgggcggcgc

SEQ ID NO: 2812968 - RNA, 23 nt, Mycobacterium avium subsp. paratuberculosis
agccgucguugcgggcggcgcgg

SEQ ID NO: 2812969 - RNA, 13 nt, Mycobacterium avium subsp. paratuberculosis
agccgugacccgc

SEQ ID NO: 2812970 - RNA, 14 nt, Mycobacterium avium subsp. paratuberculosis
agccgugacccgcc

SEQ ID NO: 2812971 - RNA, 17 nt, Mycobacterium avium subsp. paratuberculosis
agccgugacccgccgug

SEQ ID NO: 2812972 - RNA, 12 nt, Mycobacterium avium subsp. paratuberculosis
agccgugcacgc

SEQ ID NO: 2812973 - RNA, 14 nt, Mycobacterium avium subsp. paratuberculosis
agccgugcacgccg

SEQ ID NO: 2812974 - RNA, 18 nt, Mycobacterium avium subsp. paratuberculosis
agccgugcacgccgucgu

SEQ ID NO: 2812975 - RNA, 14 nt, Mycobacterium avium subsp. paratuberculosis
agccgugcagcgcc

SEQ ID NO: 2812976 - RNA, 19 nt, Mycobacterium avium subsp. paratuberculosis
agccgugcagcgcccagcc

SEQ ID NO: 2812977 - RNA, 18 nt, Mycobacterium avium subsp. paratuberculosis
agccgugcaucgggcgcu

SEQ ID NO: 2812978 - RNA, 21 nt, Mycobacterium avium subsp. paratuberculosis
agccgugcaucgggcgcucgg

SEQ ID NO: 2812979 - RNA, 22 nt, Mycobacterium avium subsp. paratuberculosis
agccgugcaucgggcgcucggc

SEQ ID NO: 2812980 - RNA, 13 nt, Mycobacterium avium subsp. paratuberculosis
agccgugccccag

SEQ ID NO: 2812981 - RNA, 22 nt, Mycobacterium avium subsp. paratuberculosis
agccgugccccaggucggggug

SEQ ID NO: 2812982 - RNA, 12 nt, Mycobacterium avium subsp. paratuberculosis
agccgugcccga

SEQ ID NO: 2812983 - RNA, 14 nt, Mycobacterium avium subsp. paratuberculosis
agccgugcccgcgg

SEQ ID NO: 2812984 - RNA, 16 nt, Mycobacterium avium subsp. paratuberculosis
agccgugcggcggcgg

SEQ ID NO: 2812985 - RNA, 20 nt, Mycobacterium avium subsp. paratuberculosis
agccgugcggcggcggcggu

SEQ ID NO: 2812986 - RNA, 21 nt, Mycobacterium avium subsp. paratuberculosis
agccgugcggcuugcccguuc

SEQ ID NO: 2812987 - RNA, 12 nt, Mycobacterium avium subsp. paratuberculosis
agccgugcuggg

SEQ ID NO: 2812988 - RNA, 14 nt, Mycobacterium avium subsp. paratuberculosis
agccguggcaggca

SEQ ID NO: 2812989 - RNA, 14 nt, Mycobacterium avium subsp. paratuberculosis
agccgugggugccg

SEQ ID NO: 2812990 - RNA, 18 nt, Mycobacterium avium subsp. paratuberculosis
agccgugggugccgacga

SEQ ID NO: 2812991 - RNA, 18 nt, Mycobacterium avium subsp. paratuberculosis
agccgugggugucggcga

SEQ ID NO: 2812992 - RNA, 21 nt, Mycobacterium avium subsp. paratuberculosis
agccguuccaucgggcccagc

SEQ ID NO: 2812993 - RNA, 17 nt, Mycobacterium avium subsp. paratuberculosis
agccguucgcgcacggc

SEQ ID NO: 2812994 - RNA, 20 nt, Mycobacterium avium subsp. paratuberculosis
agccguucgcgcacggcgcg

SEQ ID NO: 2812995 - RNA, 17 nt, Mycobacterium avium subsp. paratuberculosis
agccguucgcugcccuc

SEQ ID NO: 2812996 - RNA, 20 nt, Mycobacterium avium subsp. paratuberculosis
agccguucgcugcccucggu

SEQ ID NO: 2812997 - RNA, 21 nt, Mycobacterium avium subsp. paratuberculosis
agccguucgcugcccucgguc

SEQ ID NO: 2812998 - RNA, 19 nt, Mycobacterium avium subsp. paratuberculosis
agccguugacgguguucuu

SEQ ID NO: 2812999 - RNA, 22 nt, Mycobacterium avium subsp. paratuberculosis
agccguugaugcgcaccgcggc

SEQ ID NO: 2813000 - RNA, 23 nt, Mycobacterium avium subsp. paratuberculosis
agccguugaugcgcaccgcggcg

SEQ ID NO: 2813001 - RNA, 13 nt, Mycobacterium avium subsp. paratuberculosis
agccguugccgcc

SEQ ID NO: 2813002 - RNA, 14 nt, Mycobacterium avium subsp. paratuberculosis
agccguugccgccg

SEQ ID NO: 2813003 - RNA, 15 nt, Mycobacterium avium subsp. paratuberculosis
agccguugccgccgc

SEQ ID NO: 2813004 - RNA, 16 nt, Mycobacterium avium subsp. paratuberculosis
agccguugccgccgcg

SEQ ID NO: 2813005 - RNA, 21 nt, Mycobacterium avium subsp. paratuberculosis
agccguugccgccgcgcgcgg

SEQ ID NO: 2813006 - RNA, 17 nt, Mycobacterium avium subsp. paratuberculosis
agccguugggcagcucg

SEQ ID NO: 2813007 - RNA, 17 nt, Mycobacterium avium subsp. paratuberculosis
agccguuuggcgccgcc

SEQ ID NO: 2813008 - RNA, 19 nt, Mycobacterium avium subsp. paratuberculosis
agccguuuggcgccgccca

SEQ ID NO: 2813009 - RNA, 22 nt, Mycobacterium avium subsp. paratuberculosis
agccguuuggcgccgcccacca

SEQ ID NO: 2813010 - RNA, 17 nt, Mycobacterium avium subsp. paratuberculosis
agccucagggcgcgcug

SEQ ID NO: 2813011 - RNA, 18 nt, Mycobacterium avium subsp. paratuberculosis
agccucagggcgcgcugu

SEQ ID NO: 2813012 - RNA, 14 nt, Mycobacterium avium subsp. paratuberculosis
agccuccgcgauca

SEQ ID NO: 2813013 - RNA, 20 nt, Mycobacterium avium subsp. paratuberculosis
agccugccccccuugagccg

SEQ ID NO: 2813014 - RNA, 23 nt, Mycobacterium avium subsp. paratuberculosis
agcgagaucccgguucccggcac

SEQ ID NO: 2813015 - RNA, 16 nt, Mycobacterium avium subsp. paratuberculosis
agcgagcccagcugcg

SEQ ID NO: 2813016 - RNA, 12 nt, Mycobacterium avium subsp. paratuberculosis
agcgagccgaga

SEQ ID NO: 2813017 - RNA, 21 nt, Mycobacterium avium subsp. paratuberculosis
agcgagccggcacgcgcgccg

SEQ ID NO: 2813018 - RNA, 14 nt, Mycobacterium avium subsp. paratuberculosis
agcgagccgucgac

SEQ ID NO: 2813019 - RNA, 15 nt, Mycobacterium avium subsp. paratuberculosis
agcgagccgucgacc

SEQ ID NO: 2813020 - RNA, 14 nt, Mycobacterium avium subsp. paratuberculosis
agcgagcgcuggcc

SEQ ID NO: 2813021 - RNA, 19 nt, Mycobacterium avium subsp. paratuberculosis
agcgagcgggcacgccgcc

SEQ ID NO: 2813022 - RNA, 20 nt, Mycobacterium avium subsp. paratuberculosis
agcgagcgggcacgccgccg

SEQ ID NO: 2813023 - RNA, 22 nt, Mycobacterium avium subsp. paratuberculosis
agcgagcgggcacgccgccgcg

SEQ ID NO: 2813024 - RNA, 21 nt, Mycobacterium avium subsp. paratuberculosis
agcgagcgguuggcgacgcug

SEQ ID NO: 2813025 - RNA, 17 nt, Mycobacterium avium subsp. paratuberculosis
agcgagcucaggccggc

SEQ ID NO: 2813026 - RNA, 19 nt, Mycobacterium avium subsp. paratuberculosis
agcgagcucaggccggccu

SEQ ID NO: 2813027 - RNA, 14 nt, Mycobacterium avium subsp. paratuberculosis
agcgagcugccggc

SEQ ID NO: 2813028 - RNA, 16 nt, Mycobacterium avium subsp. paratuberculosis
agcgagcugccggcgg

SEQ ID NO: 2813029 - RNA, 18 nt, Mycobacterium avium subsp. paratuberculosis
agcgagcugccggcggcc

SEQ ID NO: 2813030 - RNA, 19 nt, Mycobacterium avium subsp. paratuberculosis
agcgagcugccggcggccg

SEQ ID NO: 2813031 - RNA, 20 nt, Mycobacterium avium subsp. paratuberculosis
agcgaggacgucgagcggcg

SEQ ID NO: 2813032 - RNA, 15 nt, Mycobacterium avium subsp. paratuberculosis
agcgaggcggccagc

SEQ ID NO: 2813033 - RNA, 18 nt, Mycobacterium avium subsp. paratuberculosis
agcgaggggguggguccg

SEQ ID NO: 2813034 - RNA, 19 nt, Mycobacterium avium subsp. paratuberculosis
agcgaggugugaggagucg

SEQ ID NO: 2813035 - RNA, 20 nt, Mycobacterium avium subsp. paratuberculosis
agcgaggugugaggagucgg

SEQ ID NO: 2813036 - RNA, 15 nt, Mycobacterium avium subsp. paratuberculosis
agcgaguccagccag

SEQ ID NO: 2813037 - RNA, 19 nt, Mycobacterium avium subsp. paratuberculosis
agcgaguccagccagccgc

SEQ ID NO: 2813038 - RNA, 22 nt, Mycobacterium avium subsp. paratuberculosis
agcgaguccagccagccgcgcc

SEQ ID NO: 2813039 - RNA, 21 nt, Mycobacterium avium subsp. paratuberculosis
agcgagucgaagccguggcag

SEQ ID NO: 2813040 - RNA, 21 nt, Mycobacterium avium subsp. paratuberculosis
agcgagucgaaggcgcgggcg

SEQ ID NO: 2813041 - RNA, 22 nt, Mycobacterium avium subsp. paratuberculosis
agcgagucggcgaaggcgcgca

SEQ ID NO: 2813042 - RNA, 14 nt, Mycobacterium avium subsp. paratuberculosis
agcgagugccggcc

SEQ ID NO: 2813043 - RNA, 19 nt, Mycobacterium avium subsp. paratuberculosis
agcgaguuggccaucguca

SEQ ID NO: 2813044 - RNA, 22 nt, Mycobacterium avium subsp. paratuberculosis
agcgauacccguugcgccccac

SEQ ID NO: 2813045 - RNA, 14 nt, Mycobacterium avium subsp. paratuberculosis
agcgauccggcgcg

SEQ ID NO: 2813046 - RNA, 14 nt, Mycobacterium avium subsp. paratuberculosis
agcgaucggcggcu

SEQ ID NO: 2813047 - RNA, 16 nt, Mycobacterium avium subsp. paratuberculosis
agcgaucggcggcucg

SEQ ID NO: 2813048 - RNA, 17 nt, Mycobacterium avium subsp. paratuberculosis
agcgaugggcgcgauca

SEQ ID NO: 2813049 - RNA, 13 nt, Mycobacterium avium subsp. paratuberculosis
agcgauucccgcc

SEQ ID NO: 2813050 - RNA, 22 nt, Mycobacterium avium subsp. paratuberculosis
agcgauugcggccgccggccag

SEQ ID NO: 2813051 - RNA, 24 nt, Mycobacterium avium subsp. paratuberculosis
agcgauugcggccgccggccagcu

SEQ ID NO: 2813052 - RNA, 23 nt, Mycobacterium avium subsp. paratuberculosis
agcgauuggauuuaucucggcga

SEQ ID NO: 2813053 - RNA, 14 nt, Mycobacterium avium subsp. paratuberculosis
agcgcaacaccgaa

SEQ ID NO: 2813054 - RNA, 17 nt, Mycobacterium avium subsp. paratuberculosis
agcgcaacggcgucgac

SEQ ID NO: 2813055 - RNA, 18 nt, Mycobacterium avium subsp. paratuberculosis
agcgcaacggcgucgaca

SEQ ID NO: 2813056 - RNA, 21 nt, Mycobacterium avium subsp. paratuberculosis
agcgcaacguguacucggcgu

SEQ ID NO: 2813057 - RNA, 15 nt, Mycobacterium avium subsp. paratuberculosis
agcgcaagggccgac

SEQ ID NO: 2813058 - RNA, 21 nt, Mycobacterium avium subsp. paratuberculosis
agcgcaagggccgacaucguc

SEQ ID NO: 2813059 - RNA, 23 nt, Mycobacterium avium subsp. paratuberculosis
agcgcaagggccgacaucgucgg

SEQ ID NO: 2813060 - RNA, 20 nt, Mycobacterium avium subsp. paratuberculosis
agcgcacacagcagcagcac

SEQ ID NO: 2813061 - RNA, 15 nt, Mycobacterium avium subsp. paratuberculosis
agcgcaccgccgucg

SEQ ID NO: 2813062 - RNA, 16 nt, Mycobacterium avium subsp. paratuberculosis
agcgcaccgccgucgg

SEQ ID NO: 2813063 - RNA, 23 nt, Mycobacterium avium subsp. paratuberculosis
agcgcaccgccgucggggcgucg

SEQ ID NO: 2813064 - RNA, 14 nt, Mycobacterium avium subsp. paratuberculosis
agcgcaccgcggag

SEQ ID NO: 2813065 - RNA, 15 nt, Mycobacterium avium subsp. paratuberculosis
agcgcaccgcggagc

SEQ ID NO: 2813066 - RNA, 20 nt, Mycobacterium avium subsp. paratuberculosis
agcgcaccgcggagcgcaac

SEQ ID NO: 2813067 - RNA, 15 nt, Mycobacterium avium subsp. paratuberculosis
agcgcacgucgccgc

SEQ ID NO: 2813068 - RNA, 13 nt, Mycobacterium avium subsp. paratuberculosis
agcgcagcaccag

SEQ ID NO: 2813069 - RNA, 16 nt, Mycobacterium avium subsp. paratuberculosis
agcgcagcaccaggcc

SEQ ID NO: 2813070 - RNA, 17 nt, Mycobacterium avium subsp. paratuberculosis
agcgcagcaccaggccc

SEQ ID NO: 2813071 - RNA, 12 nt, Mycobacterium avium subsp. paratuberculosis
agcgcagcagcu

SEQ ID NO: 2813072 - RNA, 13 nt, Mycobacterium avium subsp. paratuberculosis
agcgcagcaggua

SEQ ID NO: 2813073 - RNA, 11 nt, Mycobacterium avium subsp. paratuberculosis
agcgcagcauc

SEQ ID NO: 2813074 - RNA, 21 nt, Mycobacterium avium subsp. paratuberculosis
agcgcagcaucacgucggcga

SEQ ID NO: 2813075 - RNA, 14 nt, Mycobacterium avium subsp. paratuberculosis
agcgcagcaucggc

SEQ ID NO: 2813076 - RNA, 16 nt, Mycobacterium avium subsp. paratuberculosis
agcgcagcaucggcag

SEQ ID NO: 2813077 - RNA, 13 nt, Mycobacterium avium subsp. paratuberculosis
agcgcagcccggu

SEQ ID NO: 2813078 - RNA, 23 nt, Mycobacterium avium subsp. paratuberculosis
agcgcagcccgguuuccaguccg

SEQ ID NO: 2813079 - RNA, 18 nt, Mycobacterium avium subsp. paratuberculosis
agcgcagcgccaggcaga

SEQ ID NO: 2813080 - RNA, 12 nt, Mycobacterium avium subsp. paratuberculosis
agcgcagcgccu

SEQ ID NO: 2813081 - RNA, 14 nt, Mycobacterium avium subsp. paratuberculosis
agcgcagcgccucg

SEQ ID NO: 2813082 - RNA, 21 nt, Mycobacterium avium subsp. paratuberculosis
agcgcagcgccucggcggccc

SEQ ID NO: 2813083 - RNA, 21 nt, Mycobacterium avium subsp. paratuberculosis
agcgcagcggggaggcccagc

SEQ ID NO: 2813084 - RNA, 17 nt, Mycobacterium avium subsp. paratuberculosis
agcgcagcgucggcgug

SEQ ID NO: 2813085 - RNA, 16 nt, Mycobacterium avium subsp. paratuberculosis
agcgcagcuccagguc

SEQ ID NO: 2813086 - RNA, 21 nt, Mycobacterium avium subsp. paratuberculosis
agcgcaggccguuguggccac

SEQ ID NO: 2813087 - RNA, 17 nt, Mycobacterium avium subsp. paratuberculosis
agcgcagugcggacgcc

SEQ ID NO: 2813088 - RNA, 21 nt, Mycobacterium avium subsp. paratuberculosis
agcgcagugcggacgccacaa

SEQ ID NO: 2813089 - RNA, 16 nt, Mycobacterium avium subsp. paratuberculosis
agcgcauaggccgcga

SEQ ID NO: 2813090 - RNA, 17 nt, Mycobacterium avium subsp. paratuberculosis
agcgcauaggccgcgag

SEQ ID NO: 2813091 - RNA, 21 nt, Mycobacterium avium subsp. paratuberculosis
agcgcauccaccagggcggug

SEQ ID NO: 2813092 - RNA, 12 nt, Mycobacterium avium subsp. paratuberculosis
agcgcauccgac

SEQ ID NO: 2813093 - RNA, 17 nt, Mycobacterium avium subsp. paratuberculosis
agcgcauccgacaccgc

SEQ ID NO: 2813094 - RNA, 18 nt, Mycobacterium avium subsp. paratuberculosis
agcgcauccgacaccgcc

SEQ ID NO: 2813095 - RNA, 20 nt, Mycobacterium avium subsp. paratuberculosis
agcgcauccucauagccggc

SEQ ID NO: 2813096 - RNA, 18 nt, Mycobacterium avium subsp. paratuberculosis
agcgcaucgccggcgaug

SEQ ID NO: 2813097 - RNA, 20 nt, Mycobacterium avium subsp. paratuberculosis
agcgcaucgccggcgcgcug

SEQ ID NO: 2813098 - RNA, 17 nt, Mycobacterium avium subsp. paratuberculosis
agcgccgccaccggccg

SEQ ID NO: 2813099 - RNA, 19 nt, Mycobacterium avium subsp. paratuberculosis
agcgccgccaccggccggu

SEQ ID NO: 2813100 - RNA, 20 nt, Mycobacterium avium subsp. paratuberculosis
agcgccgccacggccaccgc

SEQ ID NO: 2813101 - RNA, 13 nt, Mycobacterium avium subsp. paratuberculosis
agcgccgcccgca

SEQ ID NO: 2813102 - RNA, 14 nt, Mycobacterium avium subsp. paratuberculosis
agcgccgcccgcac

SEQ ID NO: 2813103 - RNA, 19 nt, Mycobacterium avium subsp. paratuberculosis
agcgccgcccgcaccugcg

SEQ ID NO: 2813104 - RNA, 21 nt, Mycobacterium avium subsp. paratuberculosis
agcgccgcccgggcggcccgg

SEQ ID NO: 2813105 - RNA, 20 nt, Mycobacterium avium subsp. paratuberculosis
agcgccgcccguccagcgca

SEQ ID NO: 2813106 - RNA, 19 nt, Mycobacterium avium subsp. paratuberculosis
agcgccgcgacgaacugcc

SEQ ID NO: 2813107 - RNA, 20 nt, Mycobacterium avium subsp. paratuberculosis
agcgccgcgacgaacugccg

SEQ ID NO: 2813108 - RNA, 14 nt, Mycobacterium avium subsp. paratuberculosis
agcgccgcgccgac

SEQ ID NO: 2813109 - RNA, 16 nt, Mycobacterium avium subsp. paratuberculosis
agcgccgcgccgaccu

SEQ ID NO: 2813110 - RNA, 18 nt, Mycobacterium avium subsp. paratuberculosis
agcgccgcgcgcgcggcc

SEQ ID NO: 2813111 - RNA, 19 nt, Mycobacterium avium subsp. paratuberculosis
agcgccgcgcgcgcggccu

SEQ ID NO: 2813112 - RNA, 22 nt, Mycobacterium avium subsp. paratuberculosis
agcgccgcgcgcgcggccucca

SEQ ID NO: 2813113 - RNA, 17 nt, Mycobacterium avium subsp. paratuberculosis
agcgccgcggccaccgg

SEQ ID NO: 2813114 - RNA, 19 nt, Mycobacterium avium subsp. paratuberculosis
agcgccgcggccagccggu

SEQ ID NO: 2813115 - RNA, 15 nt, Mycobacterium avium subsp. paratuberculosis
agcgccgcggccggu

SEQ ID NO: 2813116 - RNA, 13 nt, Mycobacterium avium subsp. paratuberculosis
agcgccgcggcga

SEQ ID NO: 2813117 - RNA, 24 nt, Mycobacterium avium subsp. paratuberculosis
agcgccgcggcgaaaacgccugcg

SEQ ID NO: 2813118 - RNA, 13 nt, Mycobacterium avium subsp. paratuberculosis
agcgccgcggcgc

SEQ ID NO: 2813119 - RNA, 14 nt, Mycobacterium avium subsp. paratuberculosis
agcgccgcggcgcc

SEQ ID NO: 2813120 - RNA, 16 nt, Mycobacterium avium subsp. paratuberculosis
agcgccgcggcgcccu

SEQ ID NO: 2813121 - RNA, 18 nt, Mycobacterium avium subsp. paratuberculosis
agcgccgcguucacccgc

SEQ ID NO: 2813122 - RNA, 21 nt, Mycobacterium avium subsp. paratuberculosis
agcgccgcguugucggcgucc

SEQ ID NO: 2813123 - RNA, 19 nt, Mycobacterium avium subsp. paratuberculosis
agcgccgcuucgucgccgg

SEQ ID NO: 2813124 - RNA, 22 nt, Mycobacterium avium subsp. paratuberculosis
agcgccggaccgauccggcgcc

SEQ ID NO: 2813125 - RNA, 13 nt, Mycobacterium avium subsp. paratuberculosis
agcgccggacgcu

SEQ ID NO: 2813126 - RNA, 22 nt, Mycobacterium avium subsp. paratuberculosis
agcgccggacgcuaagcgcuga

SEQ ID NO: 2813127 - RNA, 21 nt, Mycobacterium avium subsp. paratuberculosis
agcgccggcaacaacgccagc

SEQ ID NO: 2813128 - RNA, 13 nt, Mycobacterium avium subsp. paratuberculosis
agcgccggcacca

SEQ ID NO: 2813129 - RNA, 16 nt, Mycobacterium avium subsp. paratuberculosis
agcgccggcagcaacc

SEQ ID NO: 2813130 - RNA, 19 nt, Mycobacterium avium subsp. paratuberculosis
agcgccggguugcaggcgc

SEQ ID NO: 2813131 - RNA, 20 nt, Mycobacterium avium subsp. paratuberculosis
agcgccggguugcaggcgcc

SEQ ID NO: 2813132 - RNA, 18 nt, Mycobacterium avium subsp. paratuberculosis
agcgccgguaggccgcgc

SEQ ID NO: 2813133 - RNA, 19 nt, Mycobacterium avium subsp. paratuberculosis
agcgccgguaggccgcgcc

SEQ ID NO: 2813134 - RNA, 22 nt, Mycobacterium avium subsp. paratuberculosis
agcgccgguaggccgcgccgau

SEQ ID NO: 2813135 - RNA, 16 nt, Mycobacterium avium subsp. paratuberculosis
agcgccgucaucaccg

SEQ ID NO: 2813136 - RNA, 18 nt, Mycobacterium avium subsp. paratuberculosis
agcgccgucaucaccgcc

SEQ ID NO: 2813137 - RNA, 20 nt, Mycobacterium avium subsp. paratuberculosis
agcgccgucaucaccgccga

SEQ ID NO: 2813138 - RNA, 21 nt, Mycobacterium avium subsp. paratuberculosis
agcgccgucaucaccgccgag

SEQ ID NO: 2813139 - RNA, 22 nt, Mycobacterium avium subsp. paratuberculosis
agcgccgucaucaccgccgagg

SEQ ID NO: 2813140 - RNA, 15 nt, Mycobacterium avium subsp. paratuberculosis
agcgccguccgcacc

SEQ ID NO: 2813141 - RNA, 18 nt, Mycobacterium avium subsp. paratuberculosis
agcgccguccgcaccgcg

SEQ ID NO: 2813142 - RNA, 18 nt, Mycobacterium avium subsp. paratuberculosis
agcgccgucuccucgacc

SEQ ID NO: 2813143 - RNA, 14 nt, Mycobacterium avium subsp. paratuberculosis
agcgccuccagccg

SEQ ID NO: 2813144 - RNA, 16 nt, Mycobacterium avium subsp. paratuberculosis
agcgccuccagccgcu

SEQ ID NO: 2813145 - RNA, 13 nt, Mycobacterium avium subsp. paratuberculosis
agcgccucccgga

SEQ ID NO: 2813146 - RNA, 19 nt, Mycobacterium avium subsp. paratuberculosis
agcgccucccggaccacca

SEQ ID NO: 2813147 - RNA, 14 nt, Mycobacterium avium subsp. paratuberculosis
agcgccucgagcaa

SEQ ID NO: 2813148 - RNA, 20 nt, Mycobacterium avium subsp. paratuberculosis
agcgccucgagcaacggccg

SEQ ID NO: 2813149 - RNA, 21 nt, Mycobacterium avium subsp. paratuberculosis
agcgccucgagcaacggccgc

SEQ ID NO: 2813150 - RNA, 13 nt, Mycobacterium avium subsp. paratuberculosis
agcgccucgccgg

SEQ ID NO: 2813151 - RNA, 15 nt, Mycobacterium avium subsp. paratuberculosis
agcgccucgccgggc

SEQ ID NO: 2813152 - RNA, 17 nt, Mycobacterium avium subsp. paratuberculosis
agcgccucgcggucgac

SEQ ID NO: 2813153 - RNA, 22 nt, Mycobacterium avium subsp. paratuberculosis
agcgccucgcuaaucgccgcgc

SEQ ID NO: 2813154 - RNA, 15 nt, Mycobacterium avium subsp. paratuberculosis
agcgccucggcgauc

SEQ ID NO: 2813155 - RNA, 21 nt, Mycobacterium avium subsp. paratuberculosis
agcgccucggcgaucggccgc

SEQ ID NO: 2813156 - RNA, 18 nt, Mycobacterium avium subsp. paratuberculosis
agcgccucggcgggccgc

SEQ ID NO: 2813157 - RNA, 21 nt, Mycobacterium avium subsp. paratuberculosis
agcgccucggcgggccgcccg

SEQ ID NO: 2813158 - RNA, 17 nt, Mycobacterium avium subsp. paratuberculosis
agcgccucggcgucacc

SEQ ID NO: 2813159 - RNA, 14 nt, Mycobacterium avium subsp. paratuberculosis
agcgccucggcgug

SEQ ID NO: 2813160 - RNA, 17 nt, Mycobacterium avium subsp. paratuberculosis
agcgccucggcguggca

SEQ ID NO: 2813161 - RNA, 18 nt, Mycobacterium avium subsp. paratuberculosis
agcgccucggcguggcag

SEQ ID NO: 2813162 - RNA, 20 nt, Mycobacterium avium subsp. paratuberculosis
agcgccucggcguggcaggc

SEQ ID NO: 2813163 - RNA, 21 nt, Mycobacterium avium subsp. paratuberculosis
agcgccucggcguggcaggcg

SEQ ID NO: 2813164 - RNA, 16 nt, Mycobacterium avium subsp. paratuberculosis
agcgccucgucgagcc

SEQ ID NO: 2813165 - RNA, 20 nt, Mycobacterium avium subsp. paratuberculosis
agcgccucgucgagccgggc

SEQ ID NO: 2813166 - RNA, 14 nt, Mycobacterium avium subsp. paratuberculosis
agcgccugcccgga

SEQ ID NO: 2813167 - RNA, 16 nt, Mycobacterium avium subsp. paratuberculosis
agcgccugcccggaga

SEQ ID NO: 2813168 - RNA, 17 nt, Mycobacterium avium subsp. paratuberculosis
agcgccugcugccagga

SEQ ID NO: 2813169 - RNA, 15 nt, Mycobacterium avium subsp. paratuberculosis
agcgccugggcguac

SEQ ID NO: 2813170 - RNA, 22 nt, Mycobacterium avium subsp. paratuberculosis
agcgccugggcguacagcggcg

SEQ ID NO: 2813171 - RNA, 15 nt, Mycobacterium avium subsp. paratuberculosis
agcgccugguccucc

SEQ ID NO: 2813172 - RNA, 20 nt, Mycobacterium avium subsp. paratuberculosis
agcgccuucuccagcuccuc

SEQ ID NO: 2813173 - RNA, 14 nt, Mycobacterium avium subsp. paratuberculosis
agcgcgaaaaccag

SEQ ID NO: 2813174 - RNA, 16 nt, Mycobacterium avium subsp. paratuberculosis
agcgcgaaaaccagca

SEQ ID NO: 2813175 - RNA, 17 nt, Mycobacterium avium subsp. paratuberculosis
agcgcgaaaaccagcac

SEQ ID NO: 2813176 - RNA, 18 nt, Mycobacterium avium subsp. paratuberculosis
agcgcgaaaaccagcacc

SEQ ID NO: 2813177 - RNA, 19 nt, Mycobacterium avium subsp. paratuberculosis
agcgcgaaaaccagcaccg

SEQ ID NO: 2813178 - RNA, 21 nt, Mycobacterium avium subsp. paratuberculosis
agcgcgaaaaccagcaccggc

SEQ ID NO: 2813179 - RNA, 15 nt, Mycobacterium avium subsp. paratuberculosis
agcgcgaaagcagca

SEQ ID NO: 2813180 - RNA, 16 nt, Mycobacterium avium subsp. paratuberculosis
agcgcgaagcccucuu

SEQ ID NO: 2813181 - RNA, 12 nt, Mycobacterium avium subsp. paratuberculosis
agcgcgacaccg

SEQ ID NO: 2813182 - RNA, 22 nt, Mycobacterium avium subsp. paratuberculosis
agcgcgcucaaccgcccagcgg

SEQ ID NO: 2813183 - RNA, 15 nt, Mycobacterium avium subsp. paratuberculosis
agcgcgcugaucgcc

SEQ ID NO: 2813184 - RNA, 19 nt, Mycobacterium avium subsp. paratuberculosis
agcgcgcuguaggucgcgu

SEQ ID NO: 2813185 - RNA, 23 nt, Mycobacterium avium subsp. paratuberculosis
agcgcgcuuaauacagcgcguug

SEQ ID NO: 2813186 - RNA, 15 nt, Mycobacterium avium subsp. paratuberculosis
agcgcggacaccagg

SEQ ID NO: 2813187 - RNA, 21 nt, Mycobacterium avium subsp. paratuberculosis
agcgcggauuccagcgcgacc

SEQ ID NO: 2813188 - RNA, 13 nt, Mycobacterium avium subsp. paratuberculosis
agcgcggcaugcc

SEQ ID NO: 2813189 - RNA, 18 nt, Mycobacterium avium subsp. paratuberculosis
agcgcggcaugccgcccg

SEQ ID NO: 2813190 - RNA, 20 nt, Mycobacterium avium subsp. paratuberculosis
agcgcggcauggcuggcggc

SEQ ID NO: 2813191 - RNA, 12 nt, Mycobacterium avium subsp. paratuberculosis
agcgcggccaca

SEQ ID NO: 2813192 - RNA, 12 nt, Mycobacterium avium subsp. paratuberculosis
agcgcggccacc

SEQ ID NO: 2813193 - RNA, 14 nt, Mycobacterium avium subsp. paratuberculosis
agcgcggccaccac

SEQ ID NO: 2813194 - RNA, 16 nt, Mycobacterium avium subsp. paratuberculosis
agcgcggccaccacca

SEQ ID NO: 2813195 - RNA, 13 nt, Mycobacterium avium subsp. paratuberculosis
agcgcggccaccu

SEQ ID NO: 2813196 - RNA, 13 nt, Mycobacterium avium subsp. paratuberculosis
agcgcggccagca

SEQ ID NO: 2813197 - RNA, 15 nt, Mycobacterium avium subsp. paratuberculosis
agcgcggccagcacg

SEQ ID NO: 2813198 - RNA, 16 nt, Mycobacterium avium subsp. paratuberculosis
agcgcggcccgcggcg

SEQ ID NO: 2813199 - RNA, 17 nt, Mycobacterium avium subsp. paratuberculosis
agcgcggccgcccgucg

SEQ ID NO: 2813200 - RNA, 13 nt, Mycobacterium avium subsp. paratuberculosis
agcgcggccgggc

SEQ ID NO: 2813201 - RNA, 19 nt, Mycobacterium avium subsp. paratuberculosis
agcgcggcgaacccgagca

SEQ ID NO: 2813202 - RNA, 22 nt, Mycobacterium avium subsp. paratuberculosis
agcgcggcgacauuggccgcgc

SEQ ID NO: 2813203 - RNA, 13 nt, Mycobacterium avium subsp. paratuberculosis
agcgcggcgauca

SEQ ID NO: 2813204 - RNA, 18 nt, Mycobacterium avium subsp. paratuberculosis
agcgcggcgaucagcagc

SEQ ID NO: 2813205 - RNA, 19 nt, Mycobacterium avium subsp. paratuberculosis
agcgcggcgaucagcagca

SEQ ID NO: 2813206 - RNA, 16 nt, Mycobacterium avium subsp. paratuberculosis
agcgcggcgaucagcu

SEQ ID NO: 2813207 - RNA, 21 nt, Mycobacterium avium subsp. paratuberculosis
agcgcggcgaucgucaugccu

SEQ ID NO: 2813208 - RNA, 12 nt, Mycobacterium avium subsp. paratuberculosis
agcgcggcgaug

SEQ ID NO: 2813209 - RNA, 20 nt, Mycobacterium avium subsp. paratuberculosis
agcgcggcgaugaccgccug

SEQ ID NO: 2813210 - RNA, 23 nt, Mycobacterium avium subsp. paratuberculosis
agcgcggcgaugaccgccugcgg

SEQ ID NO: 2813211 - RNA, 16 nt, Mycobacterium avium subsp. paratuberculosis
agcgcggcggagguca

SEQ ID NO: 2813212 - RNA, 17 nt, Mycobacterium avium subsp. paratuberculosis
agcgcggcggaggucag

SEQ ID NO: 2813213 - RNA, 13 nt, Mycobacterium avium subsp. paratuberculosis
agcgcggcggcca

SEQ ID NO: 2813214 - RNA, 17 nt, Mycobacterium avium subsp. paratuberculosis
agcgcggcggccagcuc

SEQ ID NO: 2813215 - RNA, 16 nt, Mycobacterium avium subsp. paratuberculosis
agcgcggcggccucgg

SEQ ID NO: 2813216 - RNA, 19 nt, Mycobacterium avium subsp. paratuberculosis
agcgcggcggcgccgucgc

SEQ ID NO: 2813217 - RNA, 22 nt, Mycobacterium avium subsp. paratuberculosis
agcgcggcggcgccgucgccga

SEQ ID NO: 2813218 - RNA, 15 nt, Mycobacterium avium subsp. paratuberculosis
agcgcggcgggccag

SEQ ID NO: 2813219 - RNA, 22 nt, Mycobacterium avium subsp. paratuberculosis
agcgcggcgggccagucgccgc

SEQ ID NO: 2813220 - RNA, 18 nt, Mycobacterium avium subsp. paratuberculosis
agcgcggcggucgcgcgc

SEQ ID NO: 2813221 - RNA, 20 nt, Mycobacterium avium subsp. paratuberculosis
agcgcgggcaccgucgucgc

SEQ ID NO: 2813222 - RNA, 14 nt, Mycobacterium avium subsp. paratuberculosis
agcgcgggcagccc

SEQ ID NO: 2813223 - RNA, 17 nt, Mycobacterium avium subsp. paratuberculosis
agcgcgggcagcccagg

SEQ ID NO: 2813224 - RNA, 18 nt, Mycobacterium avium subsp. paratuberculosis
agcgcgggcagcccaggu

SEQ ID NO: 2813225 - RNA, 13 nt, Mycobacterium avium subsp. paratuberculosis
agcgcgggccagc

SEQ ID NO: 2813226 - RNA, 14 nt, Mycobacterium avium subsp. paratuberculosis
agcgcgggccagca

SEQ ID NO: 2813227 - RNA, 17 nt, Mycobacterium avium subsp. paratuberculosis
agcgcggggucggccag

SEQ ID NO: 2813228 - RNA, 18 nt, Mycobacterium avium subsp. paratuberculosis
agcgcggggucggccagu

SEQ ID NO: 2813229 - RNA, 21 nt, Mycobacterium avium subsp. paratuberculosis
agcgcggggucggccagucgu

SEQ ID NO: 2813230 - RNA, 16 nt, Mycobacterium avium subsp. paratuberculosis
agcgcggucagcccgc

SEQ ID NO: 2813231 - RNA, 16 nt, Mycobacterium avium subsp. paratuberculosis
agcgcggucgccacca

SEQ ID NO: 2813232 - RNA, 19 nt, Mycobacterium avium subsp. paratuberculosis
agcgcggucgccaccacca

SEQ ID NO: 2813233 - RNA, 22 nt, Mycobacterium avium subsp. paratuberculosis
agcgcggucgccaccaccagcg

SEQ ID NO: 2813234 - RNA, 23 nt, Mycobacterium avium subsp. paratuberculosis
agcgcggugaagucggugcccag

SEQ ID NO: 2813235 - RNA, 16 nt, Mycobacterium avium subsp. paratuberculosis
agcgcggugagcagca

SEQ ID NO: 2813236 - RNA, 13 nt, Mycobacterium avium subsp. paratuberculosis
agcgcggugaugu

SEQ ID NO: 2813237 - RNA, 19 nt, Mycobacterium avium subsp. paratuberculosis
agcgcggugaugugcagga

SEQ ID NO: 2813238 - RNA, 16 nt, Mycobacterium avium subsp. paratuberculosis
agcgcggugcccagcc

SEQ ID NO: 2813239 - RNA, 18 nt, Mycobacterium avium subsp. paratuberculosis
agcgcggugcccagccag

SEQ ID NO: 2813240 - RNA, 23 nt, Mycobacterium avium subsp. paratuberculosis
agcgcggugcccagccaggccgc

SEQ ID NO: 2813241 - RNA, 14 nt, Mycobacterium avium subsp. paratuberculosis
agcgcggugccgac

SEQ ID NO: 2813242 - RNA, 16 nt, Mycobacterium avium subsp. paratuberculosis
agcgcggugccgaccu

SEQ ID NO: 2813243 - RNA, 14 nt, Mycobacterium avium subsp. paratuberculosis
agcgcgguggccag

SEQ ID NO: 2813244 - RNA, 16 nt, Mycobacterium avium subsp. paratuberculosis
agcgcgguggccagca

SEQ ID NO: 2813245 - RNA, 17 nt, Mycobacterium avium subsp. paratuberculosis
agcgcgguggccagcag

SEQ ID NO: 2813246 - RNA, 18 nt, Mycobacterium avium subsp. paratuberculosis
agcgcgguggccagcagg

SEQ ID NO: 2813247 - RNA, 23 nt, Mycobacterium avium subsp. paratuberculosis
agcgcgguguacagcgcgccgcg

SEQ ID NO: 2813248 - RNA, 19 nt, Mycobacterium avium subsp. paratuberculosis
agcgcggugugcggcggcu

SEQ ID NO: 2813249 - RNA, 20 nt, Mycobacterium avium subsp. paratuberculosis
agcgcguagagcaucagguc

SEQ ID NO: 2813250 - RNA, 16 nt, Mycobacterium avium subsp. paratuberculosis
agcgcguaggugcggu

SEQ ID NO: 2813251 - RNA, 16 nt, Mycobacterium avium subsp. paratuberculosis
agcgcguagucggcgu

SEQ ID NO: 2813252 - RNA, 21 nt, Mycobacterium avium subsp. paratuberculosis
agcgcguagucggcgucggcc

SEQ ID NO: 2813253 - RNA, 23 nt, Mycobacterium avium subsp. paratuberculosis
agcgcguagucggcgucggccac

SEQ ID NO: 2813254 - RNA, 16 nt, Mycobacterium avium subsp. paratuberculosis
agcgcguccaaccgcg

SEQ ID NO: 2813255 - RNA, 14 nt, Mycobacterium avium subsp. paratuberculosis
agcgcguccaggug

SEQ ID NO: 2813256 - RNA, 20 nt, Mycobacterium avium subsp. paratuberculosis
agcgcguccaggugcgccgc

SEQ ID NO: 2813257 - RNA, 23 nt, Mycobacterium avium subsp. paratuberculosis
agcgcguccaggugcgccgccgc

SEQ ID NO: 2813258 - RNA, 14 nt, Mycobacterium avium subsp. paratuberculosis
agcgcgucgaccag

SEQ ID NO: 2813259 - RNA, 18 nt, Mycobacterium avium subsp. paratuberculosis
agcgcgucgaccagccgc

SEQ ID NO: 2813260 - RNA, 19 nt, Mycobacterium avium subsp. paratuberculosis
agcgcgucgaccagccgca

SEQ ID NO: 2813261 - RNA, 12 nt, Mycobacterium avium subsp. paratuberculosis
agcgcgucgacg

SEQ ID NO: 2813262 - RNA, 13 nt, Mycobacterium avium subsp. paratuberculosis
agcgcgucgacgc

SEQ ID NO: 2813263 - RNA, 22 nt, Mycobacterium avium subsp. paratuberculosis
agcgcgucgacgcggucgaaca

SEQ ID NO: 2813264 - RNA, 14 nt, Mycobacterium avium subsp. paratuberculosis
agcgcgucgagcac

SEQ ID NO: 2813265 - RNA, 18 nt, Mycobacterium avium subsp. paratuberculosis
agcgcgucgaggucgcgc

SEQ ID NO: 2813266 - RNA, 20 nt, Mycobacterium avium subsp. paratuberculosis
agcgcgucgcacagcgccgc

SEQ ID NO: 2813267 - RNA, 22 nt, Mycobacterium avium subsp. paratuberculosis
agcgcgucgcacagcgccgcgu

SEQ ID NO: 2813268 - RNA, 19 nt, Mycobacterium avium subsp. paratuberculosis
agcgcgucgcgcccggcgu

SEQ ID NO: 2813269 - RNA, 14 nt, Mycobacterium avium subsp. paratuberculosis
agcgcgucggccag

SEQ ID NO: 2813270 - RNA, 16 nt, Mycobacterium avium subsp. paratuberculosis
agcgcgucggccagca

SEQ ID NO: 2813271 - RNA, 22 nt, Mycobacterium avium subsp. paratuberculosis
agcgcgucggccagcaccacca

SEQ ID NO: 2813272 - RNA, 16 nt, Mycobacterium avium subsp. paratuberculosis
agcgcgucggccagcg

SEQ ID NO: 2813273 - RNA, 18 nt, Mycobacterium avium subsp. paratuberculosis
agcgcgucggccagcgcg

SEQ ID NO: 2813274 - RNA, 23 nt, Mycobacterium avium subsp. paratuberculosis
agcgcgucggccagcgcgcgggc

SEQ ID NO: 2813275 - RNA, 19 nt, Mycobacterium avium subsp. paratuberculosis
agcgcgucggcgaccgcgc

SEQ ID NO: 2813276 - RNA, 22 nt, Mycobacterium avium subsp. paratuberculosis
agcgcgucgggcucggccgccg

SEQ ID NO: 2813277 - RNA, 23 nt, Mycobacterium avium subsp. paratuberculosis
agcgcgucgggcucggccgccga

SEQ ID NO: 2813278 - RNA, 22 nt, Mycobacterium avium subsp. paratuberculosis
agcgcgucgucgauggccacca

SEQ ID NO: 2813279 - RNA, 16 nt, Mycobacterium avium subsp. paratuberculosis
agcgcgucgucgccga

SEQ ID NO: 2813280 - RNA, 17 nt, Mycobacterium avium subsp. paratuberculosis
agcgcgucgucgccgaa

SEQ ID NO: 2813281 - RNA, 14 nt, Mycobacterium avium subsp. paratuberculosis
agcgcgucgugcaa

SEQ ID NO: 2813282 - RNA, 18 nt, Mycobacterium avium subsp. paratuberculosis
agcgcgugaccccggcga

SEQ ID NO: 2813283 - RNA, 13 nt, Mycobacterium avium subsp. paratuberculosis
agcgcgugaucgg

SEQ ID NO: 2813284 - RNA, 17 nt, Mycobacterium avium subsp. paratuberculosis
agcgcgugaucggugcc

SEQ ID NO: 2813285 - RNA, 14 nt, Mycobacterium avium subsp. paratuberculosis
agcgcguucuccac

SEQ ID NO: 2813286 - RNA, 18 nt, Mycobacterium avium subsp. paratuberculosis
agcgcguucuccaccgcg

SEQ ID NO: 2813287 - RNA, 19 nt, Mycobacterium avium subsp. paratuberculosis
agcgcguucuccaccgcgc

SEQ ID NO: 2813288 - RNA, 21 nt, Mycobacterium avium subsp. paratuberculosis
agcgcguugcggaucucgacc

SEQ ID NO: 2813289 - RNA, 15 nt, Mycobacterium avium subsp. paratuberculosis
agcgcguugcggccg

SEQ ID NO: 2813290 - RNA, 19 nt, Mycobacterium avium subsp. paratuberculosis
agcgcguugcggccgucca

SEQ ID NO: 2813291 - RNA, 22 nt, Mycobacterium avium subsp. paratuberculosis
agcgcguugcggccguccagcg

SEQ ID NO: 2813292 - RNA, 14 nt, Mycobacterium avium subsp. paratuberculosis
agcgcguuggccag

SEQ ID NO: 2813293 - RNA, 16 nt, Mycobacterium avium subsp. paratuberculosis
agcgcguuggccaggu

SEQ ID NO: 2813294 - RNA, 13 nt, Mycobacterium avium subsp. paratuberculosis
agcgcuaaccgcg

SEQ ID NO: 2813295 - RNA, 14 nt, Mycobacterium avium subsp. paratuberculosis
agcgcuacugccgc

SEQ ID NO: 2813296 - RNA, 23 nt, Mycobacterium avium subsp. paratuberculosis
agcgcuccugcagcgcggcgauc

SEQ ID NO: 2813297 - RNA, 21 nt, Mycobacterium avium subsp. paratuberculosis
agcgcucgcggauguccgacc

SEQ ID NO: 2813298 - RNA, 19 nt, Mycobacterium avium subsp. paratuberculosis
agcgcucgucguagucgag

SEQ ID NO: 2813299 - RNA, 18 nt, Mycobacterium avium subsp. paratuberculosis
agcgcucgucgucggaga

SEQ ID NO: 2813300 - RNA, 21 nt, Mycobacterium avium subsp. paratuberculosis
agcgcugcauagucggcccga

SEQ ID NO: 2813301 - RNA, 14 nt, Mycobacterium avium subsp. paratuberculosis
agcgcugcccgugc

SEQ ID NO: 2813302 - RNA, 17 nt, Mycobacterium avium subsp. paratuberculosis
agcgcugcccgugccgc

SEQ ID NO: 2813303 - RNA, 20 nt, Mycobacterium avium subsp. paratuberculosis
agcgcugcccgugccgcacc

SEQ ID NO: 2813304 - RNA, 24 nt, Mycobacterium avium subsp. paratuberculosis
agcgcugcccgugccgcaccuggu

SEQ ID NO: 2813305 - RNA, 16 nt, Mycobacterium avium subsp. paratuberculosis
agcgcuggccggccac

SEQ ID NO: 2813306 - RNA, 12 nt, Mycobacterium avium subsp. paratuberculosis
agcgcuggguga

SEQ ID NO: 2813307 - RNA, 19 nt, Mycobacterium avium subsp. paratuberculosis
agcgcugguaguacaccgg

SEQ ID NO: 2813308 - RNA, 22 nt, Mycobacterium avium subsp. paratuberculosis
agcgcugguaguacaccgggcu

SEQ ID NO: 2813309 - RNA, 15 nt, Mycobacterium avium subsp. paratuberculosis
agcgcuggucggcga

SEQ ID NO: 2813310 - RNA, 16 nt, Mycobacterium avium subsp. paratuberculosis
agcgcugucgcgggcc

SEQ ID NO: 2813311 - RNA, 15 nt, Mycobacterium avium subsp. paratuberculosis
agcgcuuccagcgcg

SEQ ID NO: 2813312 - RNA, 19 nt, Mycobacterium avium subsp. paratuberculosis
agcgcuuccagcgcggcga

SEQ ID NO: 2813313 - RNA, 19 nt, Mycobacterium avium subsp. paratuberculosis
agcgcuucgcgcuguucgg

SEQ ID NO: 2813314 - RNA, 17 nt, Mycobacterium avium subsp. paratuberculosis
agcgcuugucgcagacc

SEQ ID NO: 2813315 - RNA, 14 nt, Mycobacterium avium subsp. paratuberculosis
agcgcuuucgccga

SEQ ID NO: 2813316 - RNA, 18 nt, Mycobacterium avium subsp. paratuberculosis
agcgcuuucgcgcacgcc

SEQ ID NO: 2813317 - RNA, 19 nt, Mycobacterium avium subsp. paratuberculosis
agcgcuuucgcuggucgcg

SEQ ID NO: 2813318 - RNA, 22 nt, Mycobacterium avium subsp. paratuberculosis
agcggaaacgacgucgccacca

SEQ ID NO: 2813319 - RNA, 21 nt, Mycobacterium avium subsp. paratuberculosis
agcggaaccgggggccgucac

SEQ ID NO: 2813320 - RNA, 14 nt, Mycobacterium avium subsp. paratuberculosis
agcggaagcugccg

SEQ ID NO: 2813321 - RNA, 18 nt, Mycobacterium avium subsp. paratuberculosis
agcggaagcugccguugc

SEQ ID NO: 2813322 - RNA, 19 nt, Mycobacterium avium subsp. paratuberculosis
agcggaaucgcccgggcca

SEQ ID NO: 2813323 - RNA, 19 nt, Mycobacterium avium subsp. paratuberculosis
agcggaaugaacgcggcca

SEQ ID NO: 2813324 - RNA, 22 nt, Mycobacterium avium subsp. paratuberculosis
agcggaaugaacgcggccaggg

SEQ ID NO: 2813325 - RNA, 16 nt, Mycobacterium avium subsp. paratuberculosis
agcggacccggucggc

SEQ ID NO: 2813326 - RNA, 17 nt, Mycobacterium avium subsp. paratuberculosis
agcggacccggucggcc

SEQ ID NO: 2813327 - RNA, 22 nt, Mycobacterium avium subsp. paratuberculosis
agcggacccggucggccgcgug

SEQ ID NO: 2813328 - RNA, 22 nt, Mycobacterium avium subsp. paratuberculosis
agcggacccuucagccagaucg

SEQ ID NO: 2813329 - RNA, 16 nt, Mycobacterium avium subsp. paratuberculosis
agcggacgacggccag

SEQ ID NO: 2813330 - RNA, 18 nt, Mycobacterium avium subsp. paratuberculosis
agcggagugaccgccagc

SEQ ID NO: 2813331 - RNA, 23 nt, Mycobacterium avium subsp. paratuberculosis
agcggagugaccgccagcaccgc

SEQ ID NO: 2813332 - RNA, 18 nt, Mycobacterium avium subsp. paratuberculosis
agcggaucaggucgguca

SEQ ID NO: 2813333 - RNA, 22 nt, Mycobacterium avium subsp. paratuberculosis
agcggaucgagguagcgugcgc

SEQ ID NO: 2813334 - RNA, 14 nt, Mycobacterium avium subsp. paratuberculosis
agcggaucggccug

SEQ ID NO: 2813335 - RNA, 16 nt, Mycobacterium avium subsp. paratuberculosis
agcggaucggcggcga

SEQ ID NO: 2813336 - RNA, 17 nt, Mycobacterium avium subsp. paratuberculosis
agcggaucggcggcgac

SEQ ID NO: 2813337 - RNA, 21 nt, Mycobacterium avium subsp. paratuberculosis
agcggaugccggaggcgccgu

SEQ ID NO: 2813338 - RNA, 20 nt, Mycobacterium avium subsp. paratuberculosis
agcggauggcgacggcgacg

SEQ ID NO: 2813339 - RNA, 15 nt, Mycobacterium avium subsp. paratuberculosis
agcggauggcgccgu

SEQ ID NO: 2813340 - RNA, 17 nt, Mycobacterium avium subsp. paratuberculosis
agcggauggcgccgucg

SEQ ID NO: 2813341 - RNA, 18 nt, Mycobacterium avium subsp. paratuberculosis
agcggauggcgccgucga

SEQ ID NO: 2813342 - RNA, 23 nt, Mycobacterium avium subsp. paratuberculosis
agcggauugaccagcacguugug

SEQ ID NO: 2813343 - RNA, 21 nt, Mycobacterium avium subsp. paratuberculosis
agcggcaaaauagcugcgaca

SEQ ID NO: 2813344 - RNA, 23 nt, Mycobacterium avium subsp. paratuberculosis
agcggcaaaauagcugcgacaga

SEQ ID NO: 2813345 - RNA, 14 nt, Mycobacterium avium subsp. paratuberculosis
agcggcaacacgcc

SEQ ID NO: 2813346 - RNA, 22 nt, Mycobacterium avium subsp. paratuberculosis
agcggcaacacgccggcggcca

SEQ ID NO: 2813347 - RNA, 15 nt, Mycobacterium avium subsp. paratuberculosis
agcggcacccggucc

SEQ ID NO: 2813348 - RNA, 21 nt, Mycobacterium avium subsp. paratuberculosis
agcggcacccgguccggcccg

SEQ ID NO: 2813349 - RNA, 13 nt, Mycobacterium avium subsp. paratuberculosis
agcggcaccgcca

SEQ ID NO: 2813350 - RNA, 12 nt, Mycobacterium avium subsp. paratuberculosis
agcggcaccguc

SEQ ID NO: 2813351 - RNA, 16 nt, Mycobacterium avium subsp. paratuberculosis
agcggcgccuggucaa

SEQ ID NO: 2813352 - RNA, 22 nt, Mycobacterium avium subsp. paratuberculosis
agcggcgccuggucaaggugcu

SEQ ID NO: 2813353 - RNA, 15 nt, Mycobacterium avium subsp. paratuberculosis
agcggcgcgccgggc

SEQ ID NO: 2813354 - RNA, 16 nt, Mycobacterium avium subsp. paratuberculosis
agcggcgcgccgggca

SEQ ID NO: 2813355 - RNA, 18 nt, Mycobacterium avium subsp. paratuberculosis
agcggcgcgccgggcagc

SEQ ID NO: 2813356 - RNA, 15 nt, Mycobacterium avium subsp. paratuberculosis
agcggcgcgcgccgc

SEQ ID NO: 2813357 - RNA, 21 nt, Mycobacterium avium subsp. paratuberculosis
agcggcgcgcgccgcagcgcg

SEQ ID NO: 2813358 - RNA, 16 nt, Mycobacterium avium subsp. paratuberculosis
agcggcgcgggucgcg

SEQ ID NO: 2813359 - RNA, 22 nt, Mycobacterium avium subsp. paratuberculosis
agcggcgcgggucgcgguucgc

SEQ ID NO: 2813360 - RNA, 19 nt, Mycobacterium avium subsp. paratuberculosis
agcggcgcgguuucggcgu

SEQ ID NO: 2813361 - RNA, 23 nt, Mycobacterium avium subsp. paratuberculosis
agcggcgcgguuucggcgucgcc

SEQ ID NO: 2813362 - RNA, 22 nt, Mycobacterium avium subsp. paratuberculosis
agcggcgcguccauggucgagc

SEQ ID NO: 2813363 - RNA, 23 nt, Mycobacterium avium subsp. paratuberculosis
agcggcgcguccauggucgagcc

SEQ ID NO: 2813364 - RNA, 15 nt, Mycobacterium avium subsp. paratuberculosis
agcggcgcgucgcug

SEQ ID NO: 2813365 - RNA, 18 nt, Mycobacterium avium subsp. paratuberculosis
agcggcgcgucgcugggc

SEQ ID NO: 2813366 - RNA, 21 nt, Mycobacterium avium subsp. paratuberculosis
agcggcgcgucgcugggcagc

SEQ ID NO: 2813367 - RNA, 23 nt, Mycobacterium avium subsp. paratuberculosis
agcggcgcgucgcugggcagccg

SEQ ID NO: 2813368 - RNA, 14 nt, Mycobacterium avium subsp. paratuberculosis
agcggcgcugcagc

SEQ ID NO: 2813369 - RNA, 17 nt, Mycobacterium avium subsp. paratuberculosis
agcggcgcugcagcagc

SEQ ID NO: 2813370 - RNA, 14 nt, Mycobacterium avium subsp. paratuberculosis
agcggcgcuugacg

SEQ ID NO: 2813371 - RNA, 21 nt, Mycobacterium avium subsp. paratuberculosis
agcggcgcuugacgaacgcca

SEQ ID NO: 2813372 - RNA, 14 nt, Mycobacterium avium subsp. paratuberculosis
agcggcggaggggc

SEQ ID NO: 2813373 - RNA, 19 nt, Mycobacterium avium subsp. paratuberculosis
agcggcggaugggugcggu

SEQ ID NO: 2813374 - RNA, 19 nt, Mycobacterium avium subsp. paratuberculosis
agcggcggccaguugacgu

SEQ ID NO: 2813375 - RNA, 23 nt, Mycobacterium avium subsp. paratuberculosis
agcggcggccauucaucgcgcac

SEQ ID NO: 2813376 - RNA, 14 nt, Mycobacterium avium subsp. paratuberculosis
agcggcgggcccag

SEQ ID NO: 2813377 - RNA, 16 nt, Mycobacterium avium subsp. paratuberculosis
agcggcgggcccagca

SEQ ID NO: 2813378 - RNA, 19 nt, Mycobacterium avium subsp. paratuberculosis
agcggcgggcccagcagau

SEQ ID NO: 2813379 - RNA, 16 nt, Mycobacterium avium subsp. paratuberculosis
agcggcggucggcgcc

SEQ ID NO: 2813380 - RNA, 17 nt, Mycobacterium avium subsp. paratuberculosis
agcggcggucggcgccg

SEQ ID NO: 2813381 - RNA, 16 nt, Mycobacterium avium subsp. paratuberculosis
agcggcguaccgcggc

SEQ ID NO: 2813382 - RNA, 17 nt, Mycobacterium avium subsp. paratuberculosis
agcggcguaccgcggcg

SEQ ID NO: 2813383 - RNA, 19 nt, Mycobacterium avium subsp. paratuberculosis
agcggcguaccgcggcggc

SEQ ID NO: 2813384 - RNA, 21 nt, Mycobacterium avium subsp. paratuberculosis
agcggcguaccgcggcggcgu

SEQ ID NO: 2813385 - RNA, 17 nt, Mycobacterium avium subsp. paratuberculosis
agcggcgucgucgucga

SEQ ID NO: 2813386 - RNA, 19 nt, Mycobacterium avium subsp. paratuberculosis
agcggcgugaccgggaagu

SEQ ID NO: 2813387 - RNA, 18 nt, Mycobacterium avium subsp. paratuberculosis
agcggcgugcugcgcagc

SEQ ID NO: 2813388 - RNA, 22 nt, Mycobacterium avium subsp. paratuberculosis
agcggcgugcugcgcagcagcg

SEQ ID NO: 2813389 - RNA, 17 nt, Mycobacterium avium subsp. paratuberculosis
agcggcuaagccggcgu

SEQ ID NO: 2813390 - RNA, 17 nt, Mycobacterium avium subsp. paratuberculosis
agcggcucgcgggugcg

SEQ ID NO: 2813391 - RNA, 21 nt, Mycobacterium avium subsp. paratuberculosis
agcggcucggccuucggggug

SEQ ID NO: 2813392 - RNA, 20 nt, Mycobacterium avium subsp. paratuberculosis
agcggcugaccgagcggcgc

SEQ ID NO: 2813393 - RNA, 14 nt, Mycobacterium avium subsp. paratuberculosis
agcggcugcagcag

SEQ ID NO: 2813394 - RNA, 18 nt, Mycobacterium avium subsp. paratuberculosis
agcggcugcagcagaugc

SEQ ID NO: 2813395 - RNA, 21 nt, Mycobacterium avium subsp. paratuberculosis
agcggcugcugcagcgcccgg

SEQ ID NO: 2813396 - RNA, 15 nt, Mycobacterium avium subsp. paratuberculosis
agcggcugcuggucg

SEQ ID NO: 2813397 - RNA, 20 nt, Mycobacterium avium subsp. paratuberculosis
agcggcuguagcacccggcc

SEQ ID NO: 2813398 - RNA, 19 nt, Mycobacterium avium subsp. paratuberculosis
agcggcuugaccggcucgc

SEQ ID NO: 2813399 - RNA, 20 nt, Mycobacterium avium subsp. paratuberculosis
agcggcuugaccggcucgcc

SEQ ID NO: 2813400 - RNA, 18 nt, Mycobacterium avium subsp. paratuberculosis
agcggcuugagcgccagc

SEQ ID NO: 2813401 - RNA, 20 nt, Mycobacterium avium subsp. paratuberculosis
agcggcuugagcgccagcgc

SEQ ID NO: 2813402 - RNA, 21 nt, Mycobacterium avium subsp. paratuberculosis
agcggcuugagcgccagcgcg

SEQ ID NO: 2813403 - RNA, 16 nt, Mycobacterium avium subsp. paratuberculosis
agcggcuugccgccgc

SEQ ID NO: 2813404 - RNA, 20 nt, Mycobacterium avium subsp. paratuberculosis
agcggcuuggucaccagcuc

SEQ ID NO: 2813405 - RNA, 21 nt, Mycobacterium avium subsp. paratuberculosis
agcgggaacaccacgucgucc

SEQ ID NO: 2813406 - RNA, 19 nt, Mycobacterium avium subsp. paratuberculosis
agcgggaacgcgucgaaca

SEQ ID NO: 2813407 - RNA, 15 nt, Mycobacterium avium subsp. paratuberculosis
agcgggaagcugcug

SEQ ID NO: 2813408 - RNA, 12 nt, Mycobacterium avium subsp. paratuberculosis
agcgggacagca

SEQ ID NO: 2813409 - RNA, 15 nt, Mycobacterium avium subsp. paratuberculosis
agcgggacgcgcaga

SEQ ID NO: 2813410 - RNA, 16 nt, Mycobacterium avium subsp. paratuberculosis
agcgggacugcagcgc

SEQ ID NO: 2813411 - RNA, 15 nt, Mycobacterium avium subsp. paratuberculosis
agcgggagccggcca

SEQ ID NO: 2813412 - RNA, 21 nt, Mycobacterium avium subsp. paratuberculosis
agcgggauacccaugaucgcc

SEQ ID NO: 2813413 - RNA, 15 nt, Mycobacterium avium subsp. paratuberculosis
agcgggaucccgcag

SEQ ID NO: 2813414 - RNA, 17 nt, Mycobacterium avium subsp. paratuberculosis
agcgggaucugcgccgc

SEQ ID NO: 2813415 - RNA, 22 nt, Mycobacterium avium subsp. paratuberculosis
agcgggaucugcgccgccuccg

SEQ ID NO: 2813416 - RNA, 17 nt, Mycobacterium avium subsp. paratuberculosis
agcgggauuggcgccac

SEQ ID NO: 2813417 - RNA, 20 nt, Mycobacterium avium subsp. paratuberculosis
agcgggauuggcgccacugc

SEQ ID NO: 2813418 - RNA, 14 nt, Mycobacterium avium subsp. paratuberculosis
agcgggcacgccgc

SEQ ID NO: 2813419 - RNA, 17 nt, Mycobacterium avium subsp. paratuberculosis
agcgggcacgccgccgc

SEQ ID NO: 2813420 - RNA, 12 nt, Mycobacterium avium subsp. paratuberculosis
agcgggccacgc

SEQ ID NO: 2813421 - RNA, 22 nt, Mycobacterium avium subsp. paratuberculosis
agcgggccaggauguucacccc

SEQ ID NO: 2813422 - RNA, 21 nt, Mycobacterium avium subsp. paratuberculosis
agcgggcccgccuuccgggaa

SEQ ID NO: 2813423 - RNA, 13 nt, Mycobacterium avium subsp. paratuberculosis
agcgggcccgggc

SEQ ID NO: 2813424 - RNA, 15 nt, Mycobacterium avium subsp. paratuberculosis
agcgggcccgggcug

SEQ ID NO: 2813425 - RNA, 13 nt, Mycobacterium avium subsp. paratuberculosis
agcgggccgacag

SEQ ID NO: 2813426 - RNA, 16 nt, Mycobacterium avium subsp. paratuberculosis
agcgggccgacagcac

SEQ ID NO: 2813427 - RNA, 22 nt, Mycobacterium avium subsp. paratuberculosis
agcgggccgacagcacgccggg

SEQ ID NO: 2813428 - RNA, 23 nt, Mycobacterium avium subsp. paratuberculosis
agcgggccgacagcacgccgggc

SEQ ID NO: 2813429 - RNA, 18 nt, Mycobacterium avium subsp. paratuberculosis
agcgggccgaccgucagc

SEQ ID NO: 2813430 - RNA, 21 nt, Mycobacterium avium subsp. paratuberculosis
agcgggccgaccuggcggccg

SEQ ID NO: 2813431 - RNA, 19 nt, Mycobacterium avium subsp. paratuberculosis
agcgggccgagcguucggc

SEQ ID NO: 2813432 - RNA, 21 nt, Mycobacterium avium subsp. paratuberculosis
agcgggccgagcguucggcgc

SEQ ID NO: 2813433 - RNA, 13 nt, Mycobacterium avium subsp. paratuberculosis
agcgggccgauca

SEQ ID NO: 2813434 - RNA, 23 nt, Mycobacterium avium subsp. paratuberculosis
agcgggccggcgucgucgagcac

SEQ ID NO: 2813435 - RNA, 18 nt, Mycobacterium avium subsp. paratuberculosis
agcgucacgcuagcguga

SEQ ID NO: 2813436 - RNA, 20 nt, Mycobacterium avium subsp. paratuberculosis
agcgucacgcuagcgugaca

SEQ ID NO: 2813437 - RNA, 15 nt, Mycobacterium avium subsp. paratuberculosis
agcgucacgcuggcg

SEQ ID NO: 2813438 - RNA, 16 nt, Mycobacterium avium subsp. paratuberculosis
agcgucacgcuggcgu

SEQ ID NO: 2813439 - RNA, 17 nt, Mycobacterium avium subsp. paratuberculosis
agcgucacgcuggcgug

SEQ ID NO: 2813440 - RNA, 20 nt, Mycobacterium avium subsp. paratuberculosis
agcgucacgcuggcgugaca

SEQ ID NO: 2813441 - RNA, 21 nt, Mycobacterium avium subsp. paratuberculosis
agcgucacgcuggcgugacag

SEQ ID NO: 2813442 - RNA, 20 nt, Mycobacterium avium subsp. paratuberculosis
agcgucacgcuggcgugacg

SEQ ID NO: 2813443 - RNA, 21 nt, Mycobacterium avium subsp. paratuberculosis
agcgucacgcuggcguggcac

SEQ ID NO: 2813444 - RNA, 21 nt, Mycobacterium avium subsp. paratuberculosis
agcgucagcaccgcgacggug

SEQ ID NO: 2813445 - RNA, 17 nt, Mycobacterium avium subsp. paratuberculosis
agcgucagcaucgccgu

SEQ ID NO: 2813446 - RNA, 23 nt, Mycobacterium avium subsp. paratuberculosis
agcgucagggcgacuccggcgcc

SEQ ID NO: 2813447 - RNA, 14 nt, Mycobacterium avium subsp. paratuberculosis
agcgucauuccgcc

SEQ ID NO: 2813448 - RNA, 15 nt, Mycobacterium avium subsp. paratuberculosis
agcgucauuccgccg

SEQ ID NO: 2813449 - RNA, 16 nt, Mycobacterium avium subsp. paratuberculosis
agcgucauuccgccgc

SEQ ID NO: 2813450 - RNA, 21 nt, Mycobacterium avium subsp. paratuberculosis
agcgucauuccgccgcgcccg

SEQ ID NO: 2813451 - RNA, 22 nt, Mycobacterium avium subsp. paratuberculosis
agcgucauuccgccgcgcccgu

SEQ ID NO: 2813452 - RNA, 18 nt, Mycobacterium avium subsp. paratuberculosis
agcguccaguccggcgug

SEQ ID NO: 2813453 - RNA, 19 nt, Mycobacterium avium subsp. paratuberculosis
agcguccaguccggcgugc

SEQ ID NO: 2813454 - RNA, 14 nt, Mycobacterium avium subsp. paratuberculosis
agcgucccgucggc

SEQ ID NO: 2813455 - RNA, 15 nt, Mycobacterium avium subsp. paratuberculosis
agcgucgacugcacc

SEQ ID NO: 2813456 - RNA, 16 nt, Mycobacterium avium subsp. paratuberculosis
agcgucgacugcaccg

SEQ ID NO: 2813457 - RNA, 20 nt, Mycobacterium avium subsp. paratuberculosis
agcgucgaguuguugggccg

SEQ ID NO: 2813458 - RNA, 18 nt, Mycobacterium avium subsp. paratuberculosis
agcgucgaugugggccgc

SEQ ID NO: 2813459 - RNA, 22 nt, Mycobacterium avium subsp. paratuberculosis
agcgucgaugugggccgcagca

SEQ ID NO: 2813460 - RNA, 14 nt, Mycobacterium avium subsp. paratuberculosis
agcgucgccaccac

SEQ ID NO: 2813461 - RNA, 16 nt, Mycobacterium avium subsp. paratuberculosis
agcgucgccagccgcc

SEQ ID NO: 2813462 - RNA, 18 nt, Mycobacterium avium subsp. paratuberculosis
agcgucgccagccgccgg

SEQ ID NO: 2813463 - RNA, 19 nt, Mycobacterium avium subsp. paratuberculosis
agcgucgccagccgccggc

SEQ ID NO: 2813464 - RNA, 19 nt, Mycobacterium avium subsp. paratuberculosis
agcgucgccaugccgucgc

SEQ ID NO: 2813465 - RNA, 23 nt, Mycobacterium avium subsp. paratuberculosis
agcgucgccaugccgucgcgcac

SEQ ID NO: 2813466 - RNA, 13 nt, Mycobacterium avium subsp. paratuberculosis
agcgucgccgccc

SEQ ID NO: 2813467 - RNA, 18 nt, Mycobacterium avium subsp. paratuberculosis
agcgucgccgccccgagu

SEQ ID NO: 2813468 - RNA, 12 nt, Mycobacterium avium subsp. paratuberculosis
agcgucgcggcc

SEQ ID NO: 2813469 - RNA, 16 nt, Mycobacterium avium subsp. paratuberculosis
agcgucgcggccggga

SEQ ID NO: 2813470 - RNA, 19 nt, Mycobacterium avium subsp. paratuberculosis
agcgucggcgugcccgccg

SEQ ID NO: 2813471 - RNA, 19 nt, Mycobacterium avium subsp. paratuberculosis
agcgucggucucgacguug

SEQ ID NO: 2813472 - RNA, 16 nt, Mycobacterium avium subsp. paratuberculosis
agcgucgucaggccgu

SEQ ID NO: 2813473 - RNA, 15 nt, Mycobacterium avium subsp. paratuberculosis
agcgucguccaugcc

SEQ ID NO: 2813474 - RNA, 18 nt, Mycobacterium avium subsp. paratuberculosis
agcgucguccaugcccgc

SEQ ID NO: 2813475 - RNA, 19 nt, Mycobacterium avium subsp. paratuberculosis
agcgucguccaugcccgcc

SEQ ID NO: 2813476 - RNA, 14 nt, Mycobacterium avium subsp. paratuberculosis
agcgucgugcgggc

SEQ ID NO: 2813477 - RNA, 15 nt, Mycobacterium avium subsp. paratuberculosis
agcgucgugcgggcu

SEQ ID NO: 2813478 - RNA, 18 nt, Mycobacterium avium subsp. paratuberculosis
agcgucgugcgggcuccg

SEQ ID NO: 2813479 - RNA, 20 nt, Mycobacterium avium subsp. paratuberculosis
agcgucgugcgggcuccgca

SEQ ID NO: 2813480 - RNA, 21 nt, Mycobacterium avium subsp. paratuberculosis
agcgucucccgggugcgcguc

SEQ ID NO: 2813481 - RNA, 15 nt, Mycobacterium avium subsp. paratuberculosis
agcgucuccggcggg

SEQ ID NO: 2813482 - RNA, 17 nt, Mycobacterium avium subsp. paratuberculosis
agcgucuccggcgggcu

SEQ ID NO: 2813483 - RNA, 15 nt, Mycobacterium avium subsp. paratuberculosis
agcgucuccucgacc

SEQ ID NO: 2813484 - RNA, 13 nt, Mycobacterium avium subsp. paratuberculosis
agcgucucggcga

SEQ ID NO: 2813485 - RNA, 22 nt, Mycobacterium avium subsp. paratuberculosis
agcgucucggcgaucagcugcc

SEQ ID NO: 2813486 - RNA, 14 nt, Mycobacterium avium subsp. paratuberculosis
agcgucucggcggc

SEQ ID NO: 2813487 - RNA, 16 nt, Mycobacterium avium subsp. paratuberculosis
agcgucucggcggccg

SEQ ID NO: 2813488 - RNA, 21 nt, Mycobacterium avium subsp. paratuberculosis
agcgucucggcggccgagcgc

SEQ ID NO: 2813489 - RNA, 15 nt, Mycobacterium avium subsp. paratuberculosis
agcgucugcgccagc

SEQ ID NO: 2813490 - RNA, 16 nt, Mycobacterium avium subsp. paratuberculosis
agcgucugcgccagcu

SEQ ID NO: 2813491 - RNA, 19 nt, Mycobacterium avium subsp. paratuberculosis
agcgucugcgccccggcgu

SEQ ID NO: 2813492 - RNA, 20 nt, Mycobacterium avium subsp. paratuberculosis
agcgucugcgccccggcguc

SEQ ID NO: 2813493 - RNA, 15 nt, Mycobacterium avium subsp. paratuberculosis
agcgucuggcagccg

SEQ ID NO: 2813494 - RNA, 20 nt, Mycobacterium avium subsp. paratuberculosis
agcgucuggcagccggccgg

SEQ ID NO: 2813495 - RNA, 15 nt, Mycobacterium avium subsp. paratuberculosis
agcgucuggcgggug

SEQ ID NO: 2813496 - RNA, 21 nt, Mycobacterium avium subsp. paratuberculosis
agcgucuucuucucgccgucc

SEQ ID NO: 2813497 - RNA, 15 nt, Mycobacterium avium subsp. paratuberculosis
agcgucuugcccagc

SEQ ID NO: 2813498 - RNA, 16 nt, Mycobacterium avium subsp. paratuberculosis
agcgucuugcccagcg

SEQ ID NO: 2813499 - RNA, 16 nt, Mycobacterium avium subsp. paratuberculosis
agcgucuuguuggcga

SEQ ID NO: 2813500 - RNA, 19 nt, Mycobacterium avium subsp. paratuberculosis
agcgugaaacuaacuucac

SEQ ID NO: 2813501 - RNA, 20 nt, Mycobacterium avium subsp. paratuberculosis
agcgugaaacuaacuucacg

SEQ ID NO: 2813502 - RNA, 20 nt, Mycobacterium avium subsp. paratuberculosis
agcgugaaacuaguuucacg

SEQ ID NO: 2813503 - RNA, 12 nt, Mycobacterium avium subsp. paratuberculosis
agcgugaacacc

SEQ ID NO: 2813504 - RNA, 14 nt, Mycobacterium avium subsp. paratuberculosis
agcgugaacaccgc

SEQ ID NO: 2813505 - RNA, 16 nt, Mycobacterium avium subsp. paratuberculosis
agcgugaacaccgcgu

SEQ ID NO: 2813506 - RNA, 21 nt, Mycobacterium avium subsp. paratuberculosis
agcgugaacaccgcguuggcc

SEQ ID NO: 2813507 - RNA, 15 nt, Mycobacterium avium subsp. paratuberculosis
agcgugaacagcgcc

SEQ ID NO: 2813508 - RNA, 16 nt, Mycobacterium avium subsp. paratuberculosis
agcgugaacagcgccc

SEQ ID NO: 2813509 - RNA, 18 nt, Mycobacterium avium subsp. paratuberculosis
agcgugaacagcgcccgg

SEQ ID NO: 2813510 - RNA, 19 nt, Mycobacterium avium subsp. paratuberculosis
agcgugaacagcgcccggc

SEQ ID NO: 2813511 - RNA, 20 nt, Mycobacterium avium subsp. paratuberculosis
agcgugaacagcgcccggcc

SEQ ID NO: 2813512 - RNA, 23 nt, Mycobacterium avium subsp. paratuberculosis
agcgugaacagcgcccggccgug

SEQ ID NO: 2813513 - RNA, 20 nt, Mycobacterium avium subsp. paratuberculosis
agcgugaacuuaacuucacg

SEQ ID NO: 2813514 - RNA, 21 nt, Mycobacterium avium subsp. paratuberculosis
agcgugaacuuaacuucacgc

SEQ ID NO: 2813515 - RNA, 21 nt, Mycobacterium avium subsp. paratuberculosis
agcgugaagcuagcuucacgc

SEQ ID NO: 2813516 - RNA, 20 nt, Mycobacterium avium subsp. paratuberculosis
agcgugaaguuaacuucacg

SEQ ID NO: 2813517 - RNA, 20 nt, Mycobacterium avium subsp. paratuberculosis
agcgugaaguuaguuucacg

SEQ ID NO: 2813518 - RNA, 21 nt, Mycobacterium avium subsp. paratuberculosis
agcgugaaguuaguuucacgc

SEQ ID NO: 2813519 - RNA, 21 nt, Mycobacterium avium subsp. paratuberculosis
agcucaugguguuccaccagc

SEQ ID NO: 2813520 - RNA, 21 nt, Mycobacterium avium subsp. paratuberculosis
agcucaugucguacgggcgca

SEQ ID NO: 2813521 - RNA, 17 nt, Mycobacterium avium subsp. paratuberculosis
agcucaugugggggguc

SEQ ID NO: 2813522 - RNA, 18 nt, Mycobacterium avium subsp. paratuberculosis
agcucauguggggggucg

SEQ ID NO: 2813523 - RNA, 13 nt, Mycobacterium avium subsp. paratuberculosis
agcuccaacagcc

SEQ ID NO: 2813524 - RNA, 19 nt, Mycobacterium avium subsp. paratuberculosis
agcuccaaugcggccgacu

SEQ ID NO: 2813525 - RNA, 14 nt, Mycobacterium avium subsp. paratuberculosis
agcuccagcagccc

SEQ ID NO: 2813526 - RNA, 22 nt, Mycobacterium avium subsp. paratuberculosis
agcuccaucgacggaucgcccu

SEQ ID NO: 2813527 - RNA, 17 nt, Mycobacterium avium subsp. paratuberculosis
agcucccacgacgacug

SEQ ID NO: 2813528 - RNA, 21 nt, Mycobacterium avium subsp. paratuberculosis
agcucccaggacgcggugacg

SEQ ID NO: 2813529 - RNA, 20 nt, Mycobacterium avium subsp. paratuberculosis
agcucccccgacaccgccag

SEQ ID NO: 2813530 - RNA, 23 nt, Mycobacterium avium subsp. paratuberculosis
agcucccccgacaccgccagcag

SEQ ID NO: 2813531 - RNA, 14 nt, Mycobacterium avium subsp. paratuberculosis
agcucccccggcgu

SEQ ID NO: 2813532 - RNA, 19 nt, Mycobacterium avium subsp. paratuberculosis
agcucccccggcgugagcg

SEQ ID NO: 2813533 - RNA, 17 nt, Mycobacterium avium subsp. paratuberculosis
agcucccccgucgggcc

SEQ ID NO: 2813534 - RNA, 13 nt, Mycobacterium avium subsp. paratuberculosis
agcucccgagcau

SEQ ID NO: 2813535 - RNA, 21 nt, Mycobacterium avium subsp. paratuberculosis
agcucccgagcaucgccgagc

SEQ ID NO: 2813536 - RNA, 18 nt, Mycobacterium avium subsp. paratuberculosis
agcucccgggcggcgccg

SEQ ID NO: 2813537 - RNA, 13 nt, Mycobacterium avium subsp. paratuberculosis
agcuccgccaccc

SEQ ID NO: 2813538 - RNA, 15 nt, Mycobacterium avium subsp. paratuberculosis
agcuccgccacccug

SEQ ID NO: 2813539 - RNA, 21 nt, Mycobacterium avium subsp. paratuberculosis
agcuccgggucgaccgccucg

SEQ ID NO: 2813540 - RNA, 17 nt, Mycobacterium avium subsp. paratuberculosis
agcuccguccaccggca

SEQ ID NO: 2813541 - RNA, 16 nt, Mycobacterium avium subsp. paratuberculosis
agcuccuccugcggug

SEQ ID NO: 2813542 - RNA, 20 nt, Mycobacterium avium subsp. paratuberculosis
agcuccucgcggaacugcuc

SEQ ID NO: 2813543 - RNA, 14 nt, Mycobacterium avium subsp. paratuberculosis
agcuccucggccag

SEQ ID NO: 2813544 - RNA, 13 nt, Mycobacterium avium subsp. paratuberculosis
agcuccucggcgg

SEQ ID NO: 2813545 - RNA, 20 nt, Mycobacterium avium subsp. paratuberculosis
agcuccuggaagaagucggu

SEQ ID NO: 2813546 - RNA, 21 nt, Mycobacterium avium subsp. paratuberculosis
agcuccuugagccgccgcggc

SEQ ID NO: 2813547 - RNA, 18 nt, Mycobacterium avium subsp. paratuberculosis
agcucgaacaccgucgag

SEQ ID NO: 2813548 - RNA, 18 nt, Mycobacterium avium subsp. paratuberculosis
agcucgaaggugaccauc

SEQ ID NO: 2813549 - RNA, 19 nt, Mycobacterium avium subsp. paratuberculosis
agcucgaaggugcccgcau

SEQ ID NO: 2813550 - RNA, 18 nt, Mycobacterium avium subsp. paratuberculosis
agcucgacaucggccgcc

SEQ ID NO: 2813551 - RNA, 17 nt, Mycobacterium avium subsp. paratuberculosis
agcucgaccagccgggu

SEQ ID NO: 2813552 - RNA, 19 nt, Mycobacterium avium subsp. paratuberculosis
agcucgacgaccucgccga

SEQ ID NO: 2813553 - RNA, 20 nt, Mycobacterium avium subsp. paratuberculosis
agcucgacgaccucgccgac

SEQ ID NO: 2813554 - RNA, 19 nt, Mycobacterium avium subsp. paratuberculosis
agcucgacgacuucggccu

SEQ ID NO: 2813555 - RNA, 18 nt, Mycobacterium avium subsp. paratuberculosis
agcucgaggccgcgggcg

SEQ ID NO: 2813556 - RNA, 12 nt, Mycobacterium avium subsp. paratuberculosis
agcucgaucacc

SEQ ID NO: 2813557 - RNA, 18 nt, Mycobacterium avium subsp. paratuberculosis
agcucgaucacccagguc

SEQ ID NO: 2813558 - RNA, 14 nt, Mycobacterium avium subsp. paratuberculosis
agcucgaucgccgc

SEQ ID NO: 2813559 - RNA, 19 nt, Mycobacterium avium subsp. paratuberculosis
agcucgaucgccgcgccca

SEQ ID NO: 2813560 - RNA, 20 nt, Mycobacterium avium subsp. paratuberculosis
agcucgaugccguucgcgcc

SEQ ID NO: 2813561 - RNA, 14 nt, Mycobacterium avium subsp. paratuberculosis
agcucgauggugcc

SEQ ID NO: 2813562 - RNA, 19 nt, Mycobacterium avium subsp. paratuberculosis
agcucgauggugccgucgg

SEQ ID NO: 2813563 - RNA, 21 nt, Mycobacterium avium subsp. paratuberculosis
agcucgauguccagguaggcg

SEQ ID NO: 2813564 - RNA, 21 nt, Mycobacterium avium subsp. paratuberculosis
agcucgcaaacgaaucgagcc

SEQ ID NO: 2813565 - RNA, 19 nt, Mycobacterium avium subsp. paratuberculosis
agcucgcagucgaucagcg

SEQ ID NO: 2813566 - RNA, 21 nt, Mycobacterium avium subsp. paratuberculosis
agcucgcccagcaccgucugc

SEQ ID NO: 2813567 - RNA, 15 nt, Mycobacterium avium subsp. paratuberculosis
agcucgccgagcgug

SEQ ID NO: 2813568 - RNA, 20 nt, Mycobacterium avium subsp. paratuberculosis
agcucgccgauguggcgggc

SEQ ID NO: 2813569 - RNA, 22 nt, Mycobacterium avium subsp. paratuberculosis
agcucgccgauguggcgggcgu

SEQ ID NO: 2813570 - RNA, 16 nt, Mycobacterium avium subsp. paratuberculosis
agcucgccgccgacga

SEQ ID NO: 2813571 - RNA, 13 nt, Mycobacterium avium subsp. paratuberculosis
agcucgccgcggc

SEQ ID NO: 2813572 - RNA, 17 nt, Mycobacterium avium subsp. paratuberculosis
agcucgccgcggccacg

SEQ ID NO: 2813573 - RNA, 21 nt, Mycobacterium avium subsp. paratuberculosis
agcucgccgcggccacgcucg

SEQ ID NO: 2813574 - RNA, 19 nt, Mycobacterium avium subsp. paratuberculosis
agcucgccgcugucgucga

SEQ ID NO: 2813575 - RNA, 16 nt, Mycobacterium avium subsp. paratuberculosis
agcucgccggccgcgg

SEQ ID NO: 2813576 - RNA, 14 nt, Mycobacterium avium subsp. paratuberculosis
agcucgccggcgcg

SEQ ID NO: 2813577 - RNA, 17 nt, Mycobacterium avium subsp. paratuberculosis
agcucgccggcgcgcag

SEQ ID NO: 2813578 - RNA, 19 nt, Mycobacterium avium subsp. paratuberculosis
agcucgccggcgcgcagcc

SEQ ID NO: 2813579 - RNA, 19 nt, Mycobacterium avium subsp. paratuberculosis
agcucgccgguggcggcga

SEQ ID NO: 2813580 - RNA, 20 nt, Mycobacterium avium subsp. paratuberculosis
agcucgccgguggcggcgac

SEQ ID NO: 2813581 - RNA, 16 nt, Mycobacterium avium subsp. paratuberculosis
agcucgcgaagcgcga

SEQ ID NO: 2813582 - RNA, 17 nt, Mycobacterium avium subsp. paratuberculosis
agcucgcgaagcgcgau

SEQ ID NO: 2813583 - RNA, 13 nt, Mycobacterium avium subsp. paratuberculosis
agcucgcgcagcc

SEQ ID NO: 2813584 - RNA, 14 nt, Mycobacterium avium subsp. paratuberculosis
agcucgcgcagccg

SEQ ID NO: 2813585 - RNA, 17 nt, Mycobacterium avium subsp. paratuberculosis
agcucgcgcagccggcc

SEQ ID NO: 2813586 - RNA, 18 nt, Mycobacterium avium subsp. paratuberculosis
agcucgcgcagccggccg

SEQ ID NO: 2813587 - RNA, 23 nt, Mycobacterium avium subsp. paratuberculosis
agcucgcgcagccggccgaccgc

SEQ ID NO: 2813588 - RNA, 15 nt, Mycobacterium avium subsp. paratuberculosis
agcucgcgcagcugg

SEQ ID NO: 2813589 - RNA, 17 nt, Mycobacterium avium subsp. paratuberculosis
agcucgcgcagcuggcc

SEQ ID NO: 2813590 - RNA, 14 nt, Mycobacterium avium subsp. paratuberculosis
agcucgcgcccggc

SEQ ID NO: 2813591 - RNA, 15 nt, Mycobacterium avium subsp. paratuberculosis
agcucgcgcccggcc

SEQ ID NO: 2813592 - RNA, 17 nt, Mycobacterium avium subsp. paratuberculosis
agcucgcgcccggccag

SEQ ID NO: 2813593 - RNA, 14 nt, Mycobacterium avium subsp. paratuberculosis
agcucgcgccgacc

SEQ ID NO: 2813594 - RNA, 20 nt, Mycobacterium avium subsp. paratuberculosis
agcucgcgccgacccgcccg

SEQ ID NO: 2813595 - RNA, 20 nt, Mycobacterium avium subsp. paratuberculosis
agcucgcgcugaagccgcug

SEQ ID NO: 2813596 - RNA, 22 nt, Mycobacterium avium subsp. paratuberculosis
agcucgcgcugaagccgcugga

SEQ ID NO: 2813597 - RNA, 12 nt, Mycobacterium avium subsp. paratuberculosis
agcucgcgcugc

SEQ ID NO: 2813598 - RNA, 23 nt, Mycobacterium avium subsp. paratuberculosis
agcucgcggauccgggccggcgu

SEQ ID NO: 2813599 - RNA, 14 nt, Mycobacterium avium subsp. paratuberculosis
agcucgcggcgcag

SEQ ID NO: 2813600 - RNA, 17 nt, Mycobacterium avium subsp. paratuberculosis
agcucgcggcgcagcuc

SEQ ID NO: 2813601 - RNA, 12 nt, Mycobacterium avium subsp. paratuberculosis
agcucgcguacg

SEQ ID NO: 2813602 - RNA, 15 nt, Mycobacterium avium subsp. paratuberculosis
agcucgcguacgacc

SEQ ID NO: 2813603 - RNA, 18 nt, Mycobacterium avium subsp. paratuberculosis
agcucgcguagcgaggug

SEQ ID NO: 2813604 - RNA, 13 nt, Mycobacterium avium subsp. paratuberculosis
agcugccgaccag

SEQ ID NO: 2813605 - RNA, 16 nt, Mycobacterium avium subsp. paratuberculosis
agcugccgaccaggaa

SEQ ID NO: 2813606 - RNA, 23 nt, Mycobacterium avium subsp. paratuberculosis
agcugccgcgacucggugucgcu

SEQ ID NO: 2813607 - RNA, 21 nt, Mycobacterium avium subsp. paratuberculosis
agcugccggccguugcgggug

SEQ ID NO: 2813608 - RNA, 22 nt, Mycobacterium avium subsp. paratuberculosis
agcugccggcgaccagccccuc

SEQ ID NO: 2813609 - RNA, 14 nt, Mycobacterium avium subsp. paratuberculosis
agcugccggcggcc

SEQ ID NO: 2813610 - RNA, 20 nt, Mycobacterium avium subsp. paratuberculosis
agcugccggcggccgccggc

SEQ ID NO: 2813611 - RNA, 12 nt, Mycobacterium avium subsp. paratuberculosis
agcugccguccg

SEQ ID NO: 2813612 - RNA, 15 nt, Mycobacterium avium subsp. paratuberculosis
agcugccguccgggu

SEQ ID NO: 2813613 - RNA, 17 nt, Mycobacterium avium subsp. paratuberculosis
agcugcgaaucgucggc

SEQ ID NO: 2813614 - RNA, 16 nt, Mycobacterium avium subsp. paratuberculosis
agcugcgcccacgugc

SEQ ID NO: 2813615 - RNA, 22 nt, Mycobacterium avium subsp. paratuberculosis
agcugcgcccacgugccaucgc

SEQ ID NO: 2813616 - RNA, 17 nt, Mycobacterium avium subsp. paratuberculosis
agcugcgccgcgucgac

SEQ ID NO: 2813617 - RNA, 13 nt, Mycobacterium avium subsp. paratuberculosis
agcugcgccggcu

SEQ ID NO: 2813618 - RNA, 17 nt, Mycobacterium avium subsp. paratuberculosis
agcugcgcgccccggcc

SEQ ID NO: 2813619 - RNA, 19 nt, Mycobacterium avium subsp. paratuberculosis
agcugcgcgccccggcccg

SEQ ID NO: 2813620 - RNA, 23 nt, Mycobacterium avium subsp. paratuberculosis
agcugcgcgccccggcccggcga

SEQ ID NO: 2813621 - RNA, 15 nt, Mycobacterium avium subsp. paratuberculosis
agcugcgcgccggcg

SEQ ID NO: 2813622 - RNA, 17 nt, Mycobacterium avium subsp. paratuberculosis
agcugcgcgccggcggc

SEQ ID NO: 2813623 - RNA, 19 nt, Mycobacterium avium subsp. paratuberculosis
agcugcgcgccggcggccg

SEQ ID NO: 2813624 - RNA, 23 nt, Mycobacterium avium subsp. paratuberculosis
agcugcgcgccggcggccgccgc

SEQ ID NO: 2813625 - RNA, 23 nt, Mycobacterium avium subsp. paratuberculosis
agcugcgcgggcgcggccagcgc

SEQ ID NO: 2813626 - RNA, 16 nt, Mycobacterium avium subsp. paratuberculosis
agcugcggaucgggcg

SEQ ID NO: 2813627 - RNA, 23 nt, Mycobacterium avium subsp. paratuberculosis
agcugcggaucgggcguggcguc

SEQ ID NO: 2813628 - RNA, 18 nt, Mycobacterium avium subsp. paratuberculosis
agcugcucggccaccgcg

SEQ ID NO: 2813629 - RNA, 21 nt, Mycobacterium avium subsp. paratuberculosis
agcugcucggccaccgcgcgg

SEQ ID NO: 2813630 - RNA, 23 nt, Mycobacterium avium subsp. paratuberculosis
agcugcucguccuggcgcuggug

SEQ ID NO: 2813631 - RNA, 18 nt, Mycobacterium avium subsp. paratuberculosis
agcugcugcggccggacc

SEQ ID NO: 2813632 - RNA, 19 nt, Mycobacterium avium subsp. paratuberculosis
agcugcuggcuucgcggau

SEQ ID NO: 2813633 - RNA, 21 nt, Mycobacterium avium subsp. paratuberculosis
agcugcugucgaacaccgugc

SEQ ID NO: 2813634 - RNA, 15 nt, Mycobacterium avium subsp. paratuberculosis
agcugcuucgucgcc

SEQ ID NO: 2813635 - RNA, 19 nt, Mycobacterium avium subsp. paratuberculosis
agcuggaaauaggccgggc

SEQ ID NO: 2813636 - RNA, 20 nt, Mycobacterium avium subsp. paratuberculosis
agcuggaaauaggccgggca

SEQ ID NO: 2813637 - RNA, 22 nt, Mycobacterium avium subsp. paratuberculosis
agcuggaacaccacggccggca

SEQ ID NO: 2813638 - RNA, 17 nt, Mycobacterium avium subsp. paratuberculosis
agcuggagaggcccggc

SEQ ID NO: 2813639 - RNA, 17 nt, Mycobacterium avium subsp. paratuberculosis
agcuggauggcgcccag

SEQ ID NO: 2813640 - RNA, 21 nt, Mycobacterium avium subsp. paratuberculosis
agcuggauggcgcccagcccg

SEQ ID NO: 2813641 - RNA, 19 nt, Mycobacterium avium subsp. paratuberculosis
agcuggauucgucgcuggc

SEQ ID NO: 2813642 - RNA, 20 nt, Mycobacterium avium subsp. paratuberculosis
agcuggauucgucgcuggcc

SEQ ID NO: 2813643 - RNA, 13 nt, Mycobacterium avium subsp. paratuberculosis
agcuggccaccgc

SEQ ID NO: 2813644 - RNA, 14 nt, Mycobacterium avium subsp. paratuberculosis
agcuggccaccgca

SEQ ID NO: 2813645 - RNA, 18 nt, Mycobacterium avium subsp. paratuberculosis
agcuggccaccgcaucgc

SEQ ID NO: 2813646 - RNA, 15 nt, Mycobacterium avium subsp. paratuberculosis
agcuggccgcccacc

SEQ ID NO: 2813647 - RNA, 19 nt, Mycobacterium avium subsp. paratuberculosis
agcuggccgcccaccacga

SEQ ID NO: 2813648 - RNA, 14 nt, Mycobacterium avium subsp. paratuberculosis
agcuggccgugcac

SEQ ID NO: 2813649 - RNA, 21 nt, Mycobacterium avium subsp. paratuberculosis
agcuggccgugcaccgucgcc

SEQ ID NO: 2813650 - RNA, 20 nt, Mycobacterium avium subsp. paratuberculosis
agcuggcgaauccgggccuc

SEQ ID NO: 2813651 - RNA, 13 nt, Mycobacterium avium subsp. paratuberculosis
agcuggcgccgaa

SEQ ID NO: 2813652 - RNA, 21 nt, Mycobacterium avium subsp. paratuberculosis
agcuggcggucgcugaccccg

SEQ ID NO: 2813653 - RNA, 19 nt, Mycobacterium avium subsp. paratuberculosis
agcugggacagcgucacca

SEQ ID NO: 2813654 - RNA, 13 nt, Mycobacterium avium subsp. paratuberculosis
agcugggcagcca

SEQ ID NO: 2813655 - RNA, 15 nt, Mycobacterium avium subsp. paratuberculosis
agcugggccagcgcg

SEQ ID NO: 2813656 - RNA, 18 nt, Mycobacterium avium subsp. paratuberculosis
agcugggccagcgcggug

SEQ ID NO: 2813657 - RNA, 12 nt, Mycobacterium avium subsp. paratuberculosis
agcugggccggc

SEQ ID NO: 2813658 - RNA, 15 nt, Mycobacterium avium subsp. paratuberculosis
agcugggccggcgcc

SEQ ID NO: 2813659 - RNA, 14 nt, Mycobacterium avium subsp. paratuberculosis
agcugggcggcgcg

SEQ ID NO: 2813660 - RNA, 17 nt, Mycobacterium avium subsp. paratuberculosis
agcugggcggcgcgcug

SEQ ID NO: 2813661 - RNA, 18 nt, Mycobacterium avium subsp. paratuberculosis
agcugggcggcgcgcugc

SEQ ID NO: 2813662 - RNA, 21 nt, Mycobacterium avium subsp. paratuberculosis
agcugggcggcgcgcugcggc

SEQ ID NO: 2813663 - RNA, 14 nt, Mycobacterium avium subsp. paratuberculosis
agcugggcguacug

SEQ ID NO: 2813664 - RNA, 20 nt, Mycobacterium avium subsp. paratuberculosis
agcugggcguacugcucggc

SEQ ID NO: 2813665 - RNA, 21 nt, Mycobacterium avium subsp. paratuberculosis
agcuggguggucaccagcgcg

SEQ ID NO: 2813666 - RNA, 20 nt, Mycobacterium avium subsp. paratuberculosis
agcuggucccacagcggggu

SEQ ID NO: 2813667 - RNA, 17 nt, Mycobacterium avium subsp. paratuberculosis
agcugguccggccggcc

SEQ ID NO: 2813668 - RNA, 19 nt, Mycobacterium avium subsp. paratuberculosis
agcuggugaagcugccgac

SEQ ID NO: 2813669 - RNA, 22 nt, Mycobacterium avium subsp. paratuberculosis
agcuggugaagcugccgaccag

SEQ ID NO: 2813670 - RNA, 17 nt, Mycobacterium avium subsp. paratuberculosis
agcuggugcgcagcccg

SEQ ID NO: 2813671 - RNA, 18 nt, Mycobacterium avium subsp. paratuberculosis
agcuggugggccaucgcc

SEQ ID NO: 2813672 - RNA, 20 nt, Mycobacterium avium subsp. paratuberculosis
agcugguggugaucggccag

SEQ ID NO: 2813673 - RNA, 23 nt, Mycobacterium avium subsp. paratuberculosis
agcugguggugaucggccaggcg

SEQ ID NO: 2813674 - RNA, 15 nt, Mycobacterium avium subsp. paratuberculosis
agcugguuucggguc

SEQ ID NO: 2813675 - RNA, 14 nt, Mycobacterium avium subsp. paratuberculosis
agcugucggguggc

SEQ ID NO: 2813676 - RNA, 16 nt, Mycobacterium avium subsp. paratuberculosis
agcugugccgcggugc

SEQ ID NO: 2813677 - RNA, 23 nt, Mycobacterium avium subsp. paratuberculosis
agcuguuggccagcuugcagcug

SEQ ID NO: 2813678 - RNA, 14 nt, Mycobacterium avium subsp. paratuberculosis
agcuucacgcucgg

SEQ ID NO: 2813679 - RNA, 15 nt, Mycobacterium avium subsp. paratuberculosis
agcuucacgcucggc

SEQ ID NO: 2813680 - RNA, 16 nt, Mycobacterium avium subsp. paratuberculosis
agcuucacguucggcg

SEQ ID NO: 2813681 - RNA, 19 nt, Mycobacterium avium subsp. paratuberculosis
agcuucacguucggcgagu

SEQ ID NO: 2813682 - RNA, 20 nt, Mycobacterium avium subsp. paratuberculosis
agcuucacguucggcgagug

SEQ ID NO: 2813683 - RNA, 12 nt, Mycobacterium avium subsp. paratuberculosis
agcuuccgaacc

SEQ ID NO: 2813684 - RNA, 16 nt, Mycobacterium avium subsp. paratuberculosis
agcuucggcgccgagc

SEQ ID NO: 2813685 - RNA, 18 nt, Mycobacterium avium subsp. paratuberculosis
agcuucucggugaucacc

SEQ ID NO: 2813686 - RNA, 22 nt, Mycobacterium avium subsp. paratuberculosis
agcuucucggugaucacccgcc

SEQ ID NO: 2813687 - RNA, 16 nt, Mycobacterium avium subsp. paratuberculosis
agcuucugcagcucgc

SEQ ID NO: 2813688 - RNA, 15 nt, Mycobacterium avium subsp. paratuberculosis
aggaggcacuggcgc

SEQ ID NO: 2813689 - RNA, 16 nt, Mycobacterium avium subsp. paratuberculosis
aggaggccagcugcac

SEQ ID NO: 2813690 - RNA, 14 nt, Mycobacterium avium subsp. paratuberculosis
aggaggccgcggcg

SEQ ID NO: 2813691 - RNA, 15 nt, Mycobacterium avium subsp. paratuberculosis
aggaggcggccaaca

SEQ ID NO: 2813692 - RNA, 22 nt, Mycobacterium avium subsp. paratuberculosis
aggagucgggaaaucggaccca

SEQ ID NO: 2813693 - RNA, 21 nt, Mycobacterium avium subsp. paratuberculosis
aggaguuuuucgggguggugg

SEQ ID NO: 2813694 - RNA, 20 nt, Mycobacterium avium subsp. paratuberculosis
aggaucaacucgucgggggu

SEQ ID NO: 2813695 - RNA, 13 nt, Mycobacterium avium subsp. paratuberculosis
aggaucagcagcc

SEQ ID NO: 2813696 - RNA, 17 nt, Mycobacterium avium subsp. paratuberculosis
aggauccaguuccagug

SEQ ID NO: 2813697 - RNA, 18 nt, Mycobacterium avium subsp. paratuberculosis
aggauccgcucgacgagu

SEQ ID NO: 2813698 - RNA, 13 nt, Mycobacterium avium subsp. paratuberculosis
aggaucgacgucg

SEQ ID NO: 2813699 - RNA, 14 nt, Mycobacterium avium subsp. paratuberculosis
aggaucgcggccac

SEQ ID NO: 2813700 - RNA, 15 nt, Mycobacterium avium subsp. paratuberculosis
aggaucgcggccacg

SEQ ID NO: 2813701 - RNA, 15 nt, Mycobacterium avium subsp. paratuberculosis
aggaucgcggugacc

SEQ ID NO: 2813702 - RNA, 18 nt, Mycobacterium avium subsp. paratuberculosis
aggaucucccggguggcc

SEQ ID NO: 2813703 - RNA, 15 nt, Mycobacterium avium subsp. paratuberculosis
aggaucucgcgggcc

SEQ ID NO: 2813704 - RNA, 20 nt, Mycobacterium avium subsp. paratuberculosis
aggaucucgcgggcccgcgc

SEQ ID NO: 2813705 - RNA, 23 nt, Mycobacterium avium subsp. paratuberculosis
aggaucucgcgggcccgcgcggc

SEQ ID NO: 2813706 - RNA, 19 nt, Mycobacterium avium subsp. paratuberculosis
aggaucugcacgucggcgg

SEQ ID NO: 2813707 - RNA, 21 nt, Mycobacterium avium subsp. paratuberculosis
aggaucugcacgucggcggcc

SEQ ID NO: 2813708 - RNA, 14 nt, Mycobacterium avium subsp. paratuberculosis
aggaucugcagcac

SEQ ID NO: 2813709 - RNA, 16 nt, Mycobacterium avium subsp. paratuberculosis
aggaucugggcggcgg

SEQ ID NO: 2813710 - RNA, 16 nt, Mycobacterium avium subsp. paratuberculosis
aggaucuggugcgcgc

SEQ ID NO: 2813711 - RNA, 18 nt, Mycobacterium avium subsp. paratuberculosis
aggaucuugucggcggcc

SEQ ID NO: 2813712 - RNA, 19 nt, Mycobacterium avium subsp. paratuberculosis
aggaucuugucggcggccu

SEQ ID NO: 2813713 - RNA, 22 nt, Mycobacterium avium subsp. paratuberculosis
aggaucuuugcauacagcaggc

SEQ ID NO: 2813714 - RNA, 11 nt, Mycobacterium avium subsp. paratuberculosis
aggaugaccgc

SEQ ID NO: 2813715 - RNA, 15 nt, Mycobacterium avium subsp. paratuberculosis
aggaugaccgcggcg

SEQ ID NO: 2813716 - RNA, 22 nt, Mycobacterium avium subsp. paratuberculosis
aggaugaccgcgucggcgccgu

SEQ ID NO: 2813717 - RNA, 17 nt, Mycobacterium avium subsp. paratuberculosis
aggaugagcugggcggc

SEQ ID NO: 2813718 - RNA, 19 nt, Mycobacterium avium subsp. paratuberculosis
aggaugagcugggcggcgc

SEQ ID NO: 2813719 - RNA, 17 nt, Mycobacterium avium subsp. paratuberculosis
aggaugcccagcaccac

SEQ ID NO: 2813720 - RNA, 16 nt, Mycobacterium avium subsp. paratuberculosis
aggaugccgcccacca

SEQ ID NO: 2813721 - RNA, 19 nt, Mycobacterium avium subsp. paratuberculosis
aggaugccgcccaccaccg

SEQ ID NO: 2813722 - RNA, 22 nt, Mycobacterium avium subsp. paratuberculosis
aggauggggucgcgggcgccga

SEQ ID NO: 2813723 - RNA, 17 nt, Mycobacterium avium subsp. paratuberculosis
aggaugguggugcaggc

SEQ ID NO: 2813724 - RNA, 20 nt, Mycobacterium avium subsp. paratuberculosis
aggaugguggugcaggcgaa

SEQ ID NO: 2813725 - RNA, 13 nt, Mycobacterium avium subsp. paratuberculosis
aggaugucgccgc

SEQ ID NO: 2813726 - RNA, 22 nt, Mycobacterium avium subsp. paratuberculosis
aggaugucguccucggucaggc

SEQ ID NO: 2813727 - RNA, 19 nt, Mycobacterium avium subsp. paratuberculosis
aggauguucaccccggcgc

SEQ ID NO: 2813728 - RNA, 23 nt, Mycobacterium avium subsp. paratuberculosis
aggauucccgaccccgccagcac

SEQ ID NO: 2813729 - RNA, 17 nt, Mycobacterium avium subsp. paratuberculosis
aggauuccgucggcggc

SEQ ID NO: 2813730 - RNA, 13 nt, Mycobacterium avium subsp. paratuberculosis
aggcaacucgcga

SEQ ID NO: 2813731 - RNA, 15 nt, Mycobacterium avium subsp. paratuberculosis
aggcaagucgucggu

SEQ ID NO: 2813732 - RNA, 13 nt, Mycobacterium avium subsp. paratuberculosis
aggcacacgaaca

SEQ ID NO: 2813733 - RNA, 15 nt, Mycobacterium avium subsp. paratuberculosis
aggcacagcagggca

SEQ ID NO: 2813734 - RNA, 15 nt, Mycobacterium avium subsp. paratuberculosis
aggcacccgcugcac

SEQ ID NO: 2813735 - RNA, 17 nt, Mycobacterium avium subsp. paratuberculosis
aggcacccgcugcacca

SEQ ID NO: 2813736 - RNA, 19 nt, Mycobacterium avium subsp. paratuberculosis
aggcacccgcugcaccagc

SEQ ID NO: 2813737 - RNA, 21 nt, Mycobacterium avium subsp. paratuberculosis
aggcaccgaacgccagcagcu

SEQ ID NO: 2813738 - RNA, 13 nt, Mycobacterium avium subsp. paratuberculosis
aggcacggcccgu

SEQ ID NO: 2813739 - RNA, 22 nt, Mycobacterium avium subsp. paratuberculosis
aggcacuccugguuucgggggu

SEQ ID NO: 2813740 - RNA, 23 nt, Mycobacterium avium subsp. paratuberculosis
aggcacuccugguuucgggggua

SEQ ID NO: 2813741 - RNA, 17 nt, Mycobacterium avium subsp. paratuberculosis
aggcacucgaucagcac

SEQ ID NO: 2813742 - RNA, 15 nt, Mycobacterium avium subsp. paratuberculosis
aggcacucgcccagg

SEQ ID NO: 2813743 - RNA, 15 nt, Mycobacterium avium subsp. paratuberculosis
aggcagaagcuccac

SEQ ID NO: 2813744 - RNA, 21 nt, Mycobacterium avium subsp. paratuberculosis
aggcagaagcuccacgccgcc

SEQ ID NO: 2813745 - RNA, 16 nt, Mycobacterium avium subsp. paratuberculosis
aggcagacccccagca

SEQ ID NO: 2813746 - RNA, 22 nt, Mycobacterium avium subsp. paratuberculosis
aggcagacccccagcagcgggg

SEQ ID NO: 2813747 - RNA, 12 nt, Mycobacterium avium subsp. paratuberculosis
aggcagcagcca

SEQ ID NO: 2813748 - RNA, 13 nt, Mycobacterium avium subsp. paratuberculosis
aggcagcccggcu

SEQ ID NO: 2813749 - RNA, 23 nt, Mycobacterium avium subsp. paratuberculosis
aggcagcccggcugcgcagcgca

SEQ ID NO: 2813750 - RNA, 22 nt, Mycobacterium avium subsp. paratuberculosis
aggcagcgcggauuccagcgcg

SEQ ID NO: 2813751 - RNA, 20 nt, Mycobacterium avium subsp. paratuberculosis
aggcaggcacugaucccucc

SEQ ID NO: 2813752 - RNA, 20 nt, Mycobacterium avium subsp. paratuberculosis
aggcaggccccuccagcugg

SEQ ID NO: 2813753 - RNA, 15 nt, Mycobacterium avium subsp. paratuberculosis
aggcaggccggcagc

SEQ ID NO: 2813754 - RNA, 13 nt, Mycobacterium avium subsp. paratuberculosis
aggcaggcggcca

SEQ ID NO: 2813755 - RNA, 20 nt, Mycobacterium avium subsp. paratuberculosis
aggcaguuccaugucgacga

SEQ ID NO: 2813756 - RNA, 18 nt, Mycobacterium avium subsp. paratuberculosis
aggcaguucgaugccggg

SEQ ID NO: 2813757 - RNA, 20 nt, Mycobacterium avium subsp. paratuberculosis
aggcaguucgaugccgggca

SEQ ID NO: 2813758 - RNA, 20 nt, Mycobacterium avium subsp. paratuberculosis
aggcaugggaucagcagcac

SEQ ID NO: 2813759 - RNA, 16 nt, Mycobacterium avium subsp. paratuberculosis
aggcauuccaccgcgc

SEQ ID NO: 2813760 - RNA, 13 nt, Mycobacterium avium subsp. paratuberculosis
aggccaacagcag

SEQ ID NO: 2813761 - RNA, 14 nt, Mycobacterium avium subsp. paratuberculosis
aggccaacagcagc

SEQ ID NO: 2813762 - RNA, 13 nt, Mycobacterium avium subsp. paratuberculosis
aggccaacgagcg

SEQ ID NO: 2813763 - RNA, 17 nt, Mycobacterium avium subsp. paratuberculosis
aggccaacgagcgcgcc

SEQ ID NO: 2813764 - RNA, 14 nt, Mycobacterium avium subsp. paratuberculosis
aggccaacucgcga

SEQ ID NO: 2813765 - RNA, 15 nt, Mycobacterium avium subsp. paratuberculosis
aggccaaggccagca

SEQ ID NO: 2813766 - RNA, 17 nt, Mycobacterium avium subsp. paratuberculosis
aggccacccgggcgccg

SEQ ID NO: 2813767 - RNA, 19 nt, Mycobacterium avium subsp. paratuberculosis
aggccacccgggcgccggc

SEQ ID NO: 2813768 - RNA, 14 nt, Mycobacterium avium subsp. paratuberculosis
aggccaccgcgccg

SEQ ID NO: 2813769 - RNA, 14 nt, Mycobacterium avium subsp. paratuberculosis
aggccacgcccacg

SEQ ID NO: 2813770 - RNA, 16 nt, Mycobacterium avium subsp. paratuberculosis
aggccacgcccacgcc

SEQ ID NO: 2813771 - RNA, 13 nt, Mycobacterium avium subsp. paratuberculosis
aggccagcaaccg

SEQ ID NO: 2813772 - RNA, 15 nt, Mycobacterium avium subsp. paratuberculosis
aggccagcaaccgcc

SEQ ID NO: 2813773 - RNA, 22 nt, Mycobacterium avium subsp. paratuberculosis
aggccgccugcccgggcgccga

SEQ ID NO: 2813774 - RNA, 23 nt, Mycobacterium avium subsp. paratuberculosis
aggccgccugcccgggcgccgag

SEQ ID NO: 2813775 - RNA, 17 nt, Mycobacterium avium subsp. paratuberculosis
aggccgcgacgggcugu

SEQ ID NO: 2813776 - RNA, 14 nt, Mycobacterium avium subsp. paratuberculosis
aggccgcgagcccg

SEQ ID NO: 2813777 - RNA, 23 nt, Mycobacterium avium subsp. paratuberculosis
aggccgcgaggauuucgcucagc

SEQ ID NO: 2813778 - RNA, 15 nt, Mycobacterium avium subsp. paratuberculosis
aggccgcgcagaugg

SEQ ID NO: 2813779 - RNA, 15 nt, Mycobacterium avium subsp. paratuberculosis
aggccgcgccgauca

SEQ ID NO: 2813780 - RNA, 17 nt, Mycobacterium avium subsp. paratuberculosis
aggccgcgccgaucacg

SEQ ID NO: 2813781 - RNA, 19 nt, Mycobacterium avium subsp. paratuberculosis
aggccgcgcgggcggcguc

SEQ ID NO: 2813782 - RNA, 22 nt, Mycobacterium avium subsp. paratuberculosis
aggccgcgcgggcggcgucgua

SEQ ID NO: 2813783 - RNA, 12 nt, Mycobacterium avium subsp. paratuberculosis
aggccgcgcuga

SEQ ID NO: 2813784 - RNA, 21 nt, Mycobacterium avium subsp. paratuberculosis
aggccgcgcugaacgcggugg

SEQ ID NO: 2813785 - RNA, 14 nt, Mycobacterium avium subsp. paratuberculosis
aggccgcgcuggcg

SEQ ID NO: 2813786 - RNA, 16 nt, Mycobacterium avium subsp. paratuberculosis
aggccgcgcuggcgca

SEQ ID NO: 2813787 - RNA, 18 nt, Mycobacterium avium subsp. paratuberculosis
aggccgcgcuggcgcagg

SEQ ID NO: 2813788 - RNA, 19 nt, Mycobacterium avium subsp. paratuberculosis
aggccgcgcuggcgcaggc

SEQ ID NO: 2813789 - RNA, 15 nt, Mycobacterium avium subsp. paratuberculosis
aggccgcggccgucg

SEQ ID NO: 2813790 - RNA, 16 nt, Mycobacterium avium subsp. paratuberculosis
aggccgcggccgucgu

SEQ ID NO: 2813791 - RNA, 20 nt, Mycobacterium avium subsp. paratuberculosis
aggccgcggcgacacccagc

SEQ ID NO: 2813792 - RNA, 15 nt, Mycobacterium avium subsp. paratuberculosis
aggccgcggguggcg

SEQ ID NO: 2813793 - RNA, 20 nt, Mycobacterium avium subsp. paratuberculosis
aggccgcggguggcgccaca

SEQ ID NO: 2813794 - RNA, 13 nt, Mycobacterium avium subsp. paratuberculosis
aggccgcggucgc

SEQ ID NO: 2813795 - RNA, 21 nt, Mycobacterium avium subsp. paratuberculosis
aggccgcggucgccccggccg

SEQ ID NO: 2813796 - RNA, 17 nt, Mycobacterium avium subsp. paratuberculosis
aggccgcguagcucgcc

SEQ ID NO: 2813797 - RNA, 21 nt, Mycobacterium avium subsp. paratuberculosis
aggccgcguagcucgccgcgg

SEQ ID NO: 2813798 - RNA, 20 nt, Mycobacterium avium subsp. paratuberculosis
aggccgcguaggccuugcug

SEQ ID NO: 2813799 - RNA, 16 nt, Mycobacterium avium subsp. paratuberculosis
aggccgcugacaagcg

SEQ ID NO: 2813800 - RNA, 18 nt, Mycobacterium avium subsp. paratuberculosis
aggccgcugacaagcgca

SEQ ID NO: 2813801 - RNA, 15 nt, Mycobacterium avium subsp. paratuberculosis
aggccggcagccggc

SEQ ID NO: 2813802 - RNA, 18 nt, Mycobacterium avium subsp. paratuberculosis
aggccggcagccggcgcg

SEQ ID NO: 2813803 - RNA, 12 nt, Mycobacterium avium subsp. paratuberculosis
aggccggccacc

SEQ ID NO: 2813804 - RNA, 16 nt, Mycobacterium avium subsp. paratuberculosis
aggccggccaccaggu

SEQ ID NO: 2813805 - RNA, 18 nt, Mycobacterium avium subsp. paratuberculosis
aggccggccgcagcugcu

SEQ ID NO: 2813806 - RNA, 19 nt, Mycobacterium avium subsp. paratuberculosis
aggccggccgcagcugcug

SEQ ID NO: 2813807 - RNA, 16 nt, Mycobacterium avium subsp. paratuberculosis
aggccggccugccacc

SEQ ID NO: 2813808 - RNA, 19 nt, Mycobacterium avium subsp. paratuberculosis
aggccggccugccaccgcg

SEQ ID NO: 2813809 - RNA, 22 nt, Mycobacterium avium subsp. paratuberculosis
aggccggccugccggaugccgc

SEQ ID NO: 2813810 - RNA, 13 nt, Mycobacterium avium subsp. paratuberculosis
aggccggcgacga

SEQ ID NO: 2813811 - RNA, 15 nt, Mycobacterium avium subsp. paratuberculosis
aggccggcgacgaua

SEQ ID NO: 2813812 - RNA, 23 nt, Mycobacterium avium subsp. paratuberculosis
aggccggcgacgauaucggccgc

SEQ ID NO: 2813813 - RNA, 17 nt, Mycobacterium avium subsp. paratuberculosis
aggccggcgacgccggc

SEQ ID NO: 2813814 - RNA, 15 nt, Mycobacterium avium subsp. paratuberculosis
aggccggcgacggcg

SEQ ID NO: 2813815 - RNA, 17 nt, Mycobacterium avium subsp. paratuberculosis
aggccggcgagcucgcg

SEQ ID NO: 2813816 - RNA, 13 nt, Mycobacterium avium subsp. paratuberculosis
aggccggcgccgg

SEQ ID NO: 2813817 - RNA, 14 nt, Mycobacterium avium subsp. paratuberculosis
aggccggcgccggg

SEQ ID NO: 2813818 - RNA, 21 nt, Mycobacterium avium subsp. paratuberculosis
aggccgggaaugucgcgcagc

SEQ ID NO: 2813819 - RNA, 20 nt, Mycobacterium avium subsp. paratuberculosis
aggccgggcagugcgcggcg

SEQ ID NO: 2813820 - RNA, 22 nt, Mycobacterium avium subsp. paratuberculosis
aggccgggcagugcgcggcguc

SEQ ID NO: 2813821 - RNA, 16 nt, Mycobacterium avium subsp. paratuberculosis
aggccgggcuggcgcu

SEQ ID NO: 2813822 - RNA, 18 nt, Mycobacterium avium subsp. paratuberculosis
aggccgggcuggcgcugg

SEQ ID NO: 2813823 - RNA, 15 nt, Mycobacterium avium subsp. paratuberculosis
aggccggucacccag

SEQ ID NO: 2813824 - RNA, 18 nt, Mycobacterium avium subsp. paratuberculosis
aggccggucacccaggcc

SEQ ID NO: 2813825 - RNA, 12 nt, Mycobacterium avium subsp. paratuberculosis
aggccggucagc

SEQ ID NO: 2813826 - RNA, 17 nt, Mycobacterium avium subsp. paratuberculosis
aggccguagcgagcgcu

SEQ ID NO: 2813827 - RNA, 15 nt, Mycobacterium avium subsp. paratuberculosis
aggccguagcggcuc

SEQ ID NO: 2813828 - RNA, 15 nt, Mycobacterium avium subsp. paratuberculosis
aggccguaucccacc

SEQ ID NO: 2813829 - RNA, 19 nt, Mycobacterium avium subsp. paratuberculosis
aggccguaucccaccacga

SEQ ID NO: 2813830 - RNA, 20 nt, Mycobacterium avium subsp. paratuberculosis
aggccguaucccaccacgaa

SEQ ID NO: 2813831 - RNA, 14 nt, Mycobacterium avium subsp. paratuberculosis
aggccgucgccggu

SEQ ID NO: 2813832 - RNA, 20 nt, Mycobacterium avium subsp. paratuberculosis
aggccgucggcgcggccgga

SEQ ID NO: 2813833 - RNA, 15 nt, Mycobacterium avium subsp. paratuberculosis
aggccgucucgagcc

SEQ ID NO: 2813834 - RNA, 18 nt, Mycobacterium avium subsp. paratuberculosis
aggccgucucgagccggc

SEQ ID NO: 2813835 - RNA, 23 nt, Mycobacterium avium subsp. paratuberculosis
aggccgucucgagccggcgcacu

SEQ ID NO: 2813836 - RNA, 18 nt, Mycobacterium avium subsp. paratuberculosis
aggccgugaucggccagc

SEQ ID NO: 2813837 - RNA, 12 nt, Mycobacterium avium subsp. paratuberculosis
aggccguucagg

SEQ ID NO: 2813838 - RNA, 16 nt, Mycobacterium avium subsp. paratuberculosis
aggccguuguccgucg

SEQ ID NO: 2813839 - RNA, 17 nt, Mycobacterium avium subsp. paratuberculosis
aggccguuguccgucga

SEQ ID NO: 2813840 - RNA, 14 nt, Mycobacterium avium subsp. paratuberculosis
aggccguuguggcc

SEQ ID NO: 2813841 - RNA, 15 nt, Mycobacterium avium subsp. paratuberculosis
aggccuccaggcuga

SEQ ID NO: 2813842 - RNA, 21 nt, Mycobacterium avium subsp. paratuberculosis
aggccuccagguagacgaugc

SEQ ID NO: 2813843 - RNA, 20 nt, Mycobacterium avium subsp. paratuberculosis
aggccucgaggaucgcggcc

SEQ ID NO: 2813844 - RNA, 17 nt, Mycobacterium avium subsp. paratuberculosis
aggccucguggaacacc

SEQ ID NO: 2813845 - RNA, 15 nt, Mycobacterium avium subsp. paratuberculosis
aggccucuacucagc

SEQ ID NO: 2813846 - RNA, 18 nt, Mycobacterium avium subsp. paratuberculosis
aggccucuacucagccga

SEQ ID NO: 2813847 - RNA, 20 nt, Mycobacterium avium subsp. paratuberculosis
aggccugcgccuuggccucg

SEQ ID NO: 2813848 - RNA, 16 nt, Mycobacterium avium subsp. paratuberculosis
aggccugcgcggccgc

SEQ ID NO: 2813849 - RNA, 17 nt, Mycobacterium avium subsp. paratuberculosis
aggccugcgcggccgcg

SEQ ID NO: 2813850 - RNA, 18 nt, Mycobacterium avium subsp. paratuberculosis
aggccugcgcggccgcgu

SEQ ID NO: 2813851 - RNA, 19 nt, Mycobacterium avium subsp. paratuberculosis
aggccugcgcggccgcguc

SEQ ID NO: 2813852 - RNA, 14 nt, Mycobacterium avium subsp. paratuberculosis
aggccuggaacacc

SEQ ID NO: 2813853 - RNA, 19 nt, Mycobacterium avium subsp. paratuberculosis
aggccuggaacacccaggu

SEQ ID NO: 2813854 - RNA, 21 nt, Mycobacterium avium subsp. paratuberculosis
aggccuugcugagccggcccu

SEQ ID NO: 2813855 - RNA, 21 nt, Mycobacterium avium subsp. paratuberculosis
aggccuuggugugagggcgug

SEQ ID NO: 2813856 - RNA, 20 nt, Mycobacterium avium subsp. paratuberculosis
aggcgaaauaacccaccccg

SEQ ID NO: 2813857 - RNA, 20 nt, Mycobacterium avium subsp. paratuberculosis
aggcgaacaccagcccggcc

SEQ ID NO: 2813858 - RNA, 16 nt, Mycobacterium avium subsp. paratuberculosis
aggcggacggcgaccu

SEQ ID NO: 2813859 - RNA, 15 nt, Mycobacterium avium subsp. paratuberculosis
aggcggaucggcccg

SEQ ID NO: 2813860 - RNA, 21 nt, Mycobacterium avium subsp. paratuberculosis
aggcggaucuucucgcugcuc

SEQ ID NO: 2813861 - RNA, 17 nt, Mycobacterium avium subsp. paratuberculosis
aggcggccacacuggcc

SEQ ID NO: 2813862 - RNA, 22 nt, Mycobacterium avium subsp. paratuberculosis
aggcggccaccgcggccagcug

SEQ ID NO: 2813863 - RNA, 15 nt, Mycobacterium avium subsp. paratuberculosis
aggcggccagcacca

SEQ ID NO: 2813864 - RNA, 14 nt, Mycobacterium avium subsp. paratuberculosis
aggcggccagcgcc

SEQ ID NO: 2813865 - RNA, 19 nt, Mycobacterium avium subsp. paratuberculosis
aggcggccagcgcccgcgg

SEQ ID NO: 2813866 - RNA, 21 nt, Mycobacterium avium subsp. paratuberculosis
aggcggccagcgcccgcgggu

SEQ ID NO: 2813867 - RNA, 20 nt, Mycobacterium avium subsp. paratuberculosis
aggcggccagcucccgggcg

SEQ ID NO: 2813868 - RNA, 18 nt, Mycobacterium avium subsp. paratuberculosis
aggcggccagggcggcgc

SEQ ID NO: 2813869 - RNA, 20 nt, Mycobacterium avium subsp. paratuberculosis
aggcggcccgcucgaugucg

SEQ ID NO: 2813870 - RNA, 12 nt, Mycobacterium avium subsp. paratuberculosis
aggcggccgcga

SEQ ID NO: 2813871 - RNA, 13 nt, Mycobacterium avium subsp. paratuberculosis
aggcggccgcgag

SEQ ID NO: 2813872 - RNA, 14 nt, Mycobacterium avium subsp. paratuberculosis
aggcggccggcccg

SEQ ID NO: 2813873 - RNA, 21 nt, Mycobacterium avium subsp. paratuberculosis
aggcggccggcccggcccgac

SEQ ID NO: 2813874 - RNA, 22 nt, Mycobacterium avium subsp. paratuberculosis
aggcggccgggaucuggccggu

SEQ ID NO: 2813875 - RNA, 11 nt, Mycobacterium avium subsp. paratuberculosis
aggcggcgacg

SEQ ID NO: 2813876 - RNA, 20 nt, Mycobacterium avium subsp. paratuberculosis
aggcggcgacgaacgccggc

SEQ ID NO: 2813877 - RNA, 14 nt, Mycobacterium avium subsp. paratuberculosis
aggcggcgcagcca

SEQ ID NO: 2813878 - RNA, 13 nt, Mycobacterium avium subsp. paratuberculosis
aggcggcgccggc

SEQ ID NO: 2813879 - RNA, 18 nt, Mycobacterium avium subsp. paratuberculosis
aggcggcgccggccgggc

SEQ ID NO: 2813880 - RNA, 13 nt, Mycobacterium avium subsp. paratuberculosis
aggcggcgccguc

SEQ ID NO: 2813881 - RNA, 14 nt, Mycobacterium avium subsp. paratuberculosis
aggcggcgccgucg

SEQ ID NO: 2813882 - RNA, 14 nt, Mycobacterium avium subsp. paratuberculosis
aggcggcgcgcagc

SEQ ID NO: 2813883 - RNA, 17 nt, Mycobacterium avium subsp. paratuberculosis
aggcggcgcgcagccgg

SEQ ID NO: 2813884 - RNA, 21 nt, Mycobacterium avium subsp. paratuberculosis
aggcggcgcgcagccggccgu

SEQ ID NO: 2813885 - RNA, 17 nt, Mycobacterium avium subsp. paratuberculosis
aggcggcgggggcgggc

SEQ ID NO: 2813886 - RNA, 22 nt, Mycobacterium avium subsp. paratuberculosis
aggcggcgguauucgucacccc

SEQ ID NO: 2813887 - RNA, 18 nt, Mycobacterium avium subsp. paratuberculosis
aggcggcguagucggcgc

SEQ ID NO: 2813888 - RNA, 21 nt, Mycobacterium avium subsp. paratuberculosis
aggcggcguagucggcgcagc

SEQ ID NO: 2813889 - RNA, 14 nt, Mycobacterium avium subsp. paratuberculosis
aggcggcgucgaug

SEQ ID NO: 2813890 - RNA, 17 nt, Mycobacterium avium subsp. paratuberculosis
aggcggcgucgaugucg

SEQ ID NO: 2813891 - RNA, 20 nt, Mycobacterium avium subsp. paratuberculosis
aggcggcugucgacaggauc

SEQ ID NO: 2813892 - RNA, 21 nt, Mycobacterium avium subsp. paratuberculosis
aggcgggccaccacaguggcc

SEQ ID NO: 2813893 - RNA, 15 nt, Mycobacterium avium subsp. paratuberculosis
aggcgggccagcucg

SEQ ID NO: 2813894 - RNA, 22 nt, Mycobacterium avium subsp. paratuberculosis
aggcggggguucguugcgccgc

SEQ ID NO: 2813895 - RNA, 21 nt, Mycobacterium avium subsp. paratuberculosis
aggcgggugaggacgcccggc

SEQ ID NO: 2813896 - RNA, 20 nt, Mycobacterium avium subsp. paratuberculosis
aggcggguguauucgcccac

SEQ ID NO: 2813897 - RNA, 12 nt, Mycobacterium avium subsp. paratuberculosis
aggcggucgacu

SEQ ID NO: 2813898 - RNA, 22 nt, Mycobacterium avium subsp. paratuberculosis
aggcggucgacuggucgucgag

SEQ ID NO: 2813899 - RNA, 20 nt, Mycobacterium avium subsp. paratuberculosis
aggcggucgugucagggaug

SEQ ID NO: 2813900 - RNA, 23 nt, Mycobacterium avium subsp. paratuberculosis
aggcgguggcgcacaacccggac

SEQ ID NO: 2813901 - RNA, 13 nt, Mycobacterium avium subsp. paratuberculosis
aggcggugguggg

SEQ ID NO: 2813902 - RNA, 15 nt, Mycobacterium avium subsp. paratuberculosis
aggcgguuucaccga

SEQ ID NO: 2813903 - RNA, 17 nt, Mycobacterium avium subsp. paratuberculosis
aggcgguuucaccgagg

SEQ ID NO: 2813904 - RNA, 15 nt, Mycobacterium avium subsp. paratuberculosis
aggcguacaccaggg

SEQ ID NO: 2813905 - RNA, 16 nt, Mycobacterium avium subsp. paratuberculosis
aggcguagcugcaggc

SEQ ID NO: 2813906 - RNA, 17 nt, Mycobacterium avium subsp. paratuberculosis
aggcguagcugcaggcg

SEQ ID NO: 2813907 - RNA, 14 nt, Mycobacterium avium subsp. paratuberculosis
aggcguccagcgcg

SEQ ID NO: 2813908 - RNA, 22 nt, Mycobacterium avium subsp. paratuberculosis
aggcguccagggccaccgcguc

SEQ ID NO: 2813909 - RNA, 13 nt, Mycobacterium avium subsp. paratuberculosis
aggcguccuccuc

SEQ ID NO: 2813910 - RNA, 22 nt, Mycobacterium avium subsp. paratuberculosis
aggcguccuccucguccgcggc

SEQ ID NO: 2813911 - RNA, 23 nt, Mycobacterium avium subsp. paratuberculosis
aggcguccuccucguccgcggcg

SEQ ID NO: 2813912 - RNA, 22 nt, Mycobacterium avium subsp. paratuberculosis
aggcguccuugauccgggcgcc

SEQ ID NO: 2813913 - RNA, 20 nt, Mycobacterium avium subsp. paratuberculosis
aggcgucgaacgggccgggc

SEQ ID NO: 2813914 - RNA, 21 nt, Mycobacterium avium subsp. paratuberculosis
aggcgucgaacgggccgggca

SEQ ID NO: 2813915 - RNA, 11 nt, Mycobacterium avium subsp. paratuberculosis
aggcgucgacg

SEQ ID NO: 2813916 - RNA, 13 nt, Mycobacterium avium subsp. paratuberculosis
aggcgucgacgcg

SEQ ID NO: 2813917 - RNA, 14 nt, Mycobacterium avium subsp. paratuberculosis
aggcgucgcgcagc

SEQ ID NO: 2813918 - RNA, 17 nt, Mycobacterium avium subsp. paratuberculosis
aggcgucgcgcagcagc

SEQ ID NO: 2813919 - RNA, 19 nt, Mycobacterium avium subsp. paratuberculosis
aggcgucggucagcaggcg

SEQ ID NO: 2813920 - RNA, 15 nt, Mycobacterium avium subsp. paratuberculosis
aggcgucgucggccc

SEQ ID NO: 2813921 - RNA, 20 nt, Mycobacterium avium subsp. paratuberculosis
aggcgucgucggcccagucc

SEQ ID NO: 2813922 - RNA, 15 nt, Mycobacterium avium subsp. paratuberculosis
aggcgugcacccggu

SEQ ID NO: 2813923 - RNA, 13 nt, Mycobacterium avium subsp. paratuberculosis
aggcgugcagccc

SEQ ID NO: 2813924 - RNA, 18 nt, Mycobacterium avium subsp. paratuberculosis
aggcgugccgcugggagc

SEQ ID NO: 2813925 - RNA, 14 nt, Mycobacterium avium subsp. paratuberculosis
aggcgugcgacucg

SEQ ID NO: 2813926 - RNA, 21 nt, Mycobacterium avium subsp. paratuberculosis
aggcguggguuccgccgucga

SEQ ID NO: 2813927 - RNA, 19 nt, Mycobacterium avium subsp. paratuberculosis
aggcguggucggcgcgguc

SEQ ID NO: 2813928 - RNA, 18 nt, Mycobacterium avium subsp. paratuberculosis
aggcguugaucacguugu

SEQ ID NO: 2813929 - RNA, 14 nt, Mycobacterium avium subsp. paratuberculosis
aggcguugcaccgc

SEQ ID NO: 2813930 - RNA, 22 nt, Mycobacterium avium subsp. paratuberculosis
aggcguugcgucccgcgccgga

SEQ ID NO: 2813931 - RNA, 17 nt, Mycobacterium avium subsp. paratuberculosis
aggcguuggagccgacc

SEQ ID NO: 2813932 - RNA, 19 nt, Mycobacterium avium subsp. paratuberculosis
aggcguuguugaggaacgc

SEQ ID NO: 2813933 - RNA, 16 nt, Mycobacterium avium subsp. paratuberculosis
aggcguuucguguggu

SEQ ID NO: 2813934 - RNA, 13 nt, Mycobacterium avium subsp. paratuberculosis
aggcucacgcugc

SEQ ID NO: 2813935 - RNA, 17 nt, Mycobacterium avium subsp. paratuberculosis
aggcucacgcugccaaa

SEQ ID NO: 2813936 - RNA, 16 nt, Mycobacterium avium subsp. paratuberculosis
aggcucacguagucga

SEQ ID NO: 2813937 - RNA, 13 nt, Mycobacterium avium subsp. paratuberculosis
aggcucagcagca

SEQ ID NO: 2813938 - RNA, 18 nt, Mycobacterium avium subsp. paratuberculosis
aggcucaggaucagcagc

SEQ ID NO: 2813939 - RNA, 19 nt, Mycobacterium avium subsp. paratuberculosis
aggcucaggaucagcagcc

SEQ ID NO: 2813940 - RNA, 16 nt, Mycobacterium avium subsp. paratuberculosis
aggcucgccacgcgua

SEQ ID NO: 2813941 - RNA, 16 nt, Mycobacterium avium subsp. paratuberculosis
aggcucggcagccggc

SEQ ID NO: 2813942 - RNA, 12 nt, Mycobacterium avium subsp. paratuberculosis
aggcugaacacc

SEQ ID NO: 2813943 - RNA, 20 nt, Mycobacterium avium subsp. paratuberculosis
agggcgacuccggcgccggu

SEQ ID NO: 2813944 - RNA, 21 nt, Mycobacterium avium subsp. paratuberculosis
agggcgacuccggcgccgguc

SEQ ID NO: 2813945 - RNA, 22 nt, Mycobacterium avium subsp. paratuberculosis
agggcgagcucguucucggcga

SEQ ID NO: 2813946 - RNA, 14 nt, Mycobacterium avium subsp. paratuberculosis
agggcgaggacggc

SEQ ID NO: 2813947 - RNA, 21 nt, Mycobacterium avium subsp. paratuberculosis
agggcgauaaccucggcggcg

SEQ ID NO: 2813948 - RNA, 18 nt, Mycobacterium avium subsp. paratuberculosis
agggcgaucaccgcggcc

SEQ ID NO: 2813949 - RNA, 23 nt, Mycobacterium avium subsp. paratuberculosis
agggcgaucaccgcggccaccug

SEQ ID NO: 2813950 - RNA, 22 nt, Mycobacterium avium subsp. paratuberculosis
agggcgauggccauggccagga

SEQ ID NO: 2813951 - RNA, 15 nt, Mycobacterium avium subsp. paratuberculosis
agggcgccagcaccu

SEQ ID NO: 2813952 - RNA, 16 nt, Mycobacterium avium subsp. paratuberculosis
agggcgccagcaccuc

SEQ ID NO: 2813953 - RNA, 12 nt, Mycobacterium avium subsp. paratuberculosis
agggcgccgucg

SEQ ID NO: 2813954 - RNA, 22 nt, Mycobacterium avium subsp. paratuberculosis
agggcgccgucggcgggggauc

SEQ ID NO: 2813955 - RNA, 20 nt, Mycobacterium avium subsp. paratuberculosis
agggcgccguuguaggccgc

SEQ ID NO: 2813956 - RNA, 13 nt, Mycobacterium avium subsp. paratuberculosis
agggcgcggcgca

SEQ ID NO: 2813957 - RNA, 17 nt, Mycobacterium avium subsp. paratuberculosis
agggcgcggcgcaccga

SEQ ID NO: 2813958 - RNA, 21 nt, Mycobacterium avium subsp. paratuberculosis
agggcgcggcguagccgccgg

SEQ ID NO: 2813959 - RNA, 15 nt, Mycobacterium avium subsp. paratuberculosis
agggcgcgucgaucg

SEQ ID NO: 2813960 - RNA, 19 nt, Mycobacterium avium subsp. paratuberculosis
agggcgcucaucaggcggc

SEQ ID NO: 2813961 - RNA, 22 nt, Mycobacterium avium subsp. paratuberculosis
agggcgcucaucaggcggccgg

SEQ ID NO: 2813962 - RNA, 20 nt, Mycobacterium avium subsp. paratuberculosis
agggcggaaucgcgguagcg

SEQ ID NO: 2813963 - RNA, 13 nt, Mycobacterium avium subsp. paratuberculosis
agggcggcgccgc

SEQ ID NO: 2813964 - RNA, 14 nt, Mycobacterium avium subsp. paratuberculosis
agggcggcgccggc

SEQ ID NO: 2813965 - RNA, 15 nt, Mycobacterium avium subsp. paratuberculosis
agggcggcgccggca

SEQ ID NO: 2813966 - RNA, 20 nt, Mycobacterium avium subsp. paratuberculosis
agggcggcgcgcgccagcgu

SEQ ID NO: 2813967 - RNA, 17 nt, Mycobacterium avium subsp. paratuberculosis
agggcgggcaggcccga

SEQ ID NO: 2813968 - RNA, 19 nt, Mycobacterium avium subsp. paratuberculosis
agggcgggccagcucgaac

SEQ ID NO: 2813969 - RNA, 12 nt, Mycobacterium avium subsp. paratuberculosis
agggcggggcag

SEQ ID NO: 2813970 - RNA, 22 nt, Mycobacterium avium subsp. paratuberculosis
agggcggguaggcgccgaugcc

SEQ ID NO: 2813971 - RNA, 14 nt, Mycobacterium avium subsp. paratuberculosis
agggcgggucgucg

SEQ ID NO: 2813972 - RNA, 20 nt, Mycobacterium avium subsp. paratuberculosis
agggcggugcggugcgccgc

SEQ ID NO: 2813973 - RNA, 16 nt, Mycobacterium avium subsp. paratuberculosis
agggcgguggcggcga

SEQ ID NO: 2813974 - RNA, 13 nt, Mycobacterium avium subsp. paratuberculosis
agggcgucgagcg

SEQ ID NO: 2813975 - RNA, 20 nt, Mycobacterium avium subsp. paratuberculosis
agggcgucggacaugccggc

SEQ ID NO: 2813976 - RNA, 18 nt, Mycobacterium avium subsp. paratuberculosis
agggcguggaacgcgucg

SEQ ID NO: 2813977 - RNA, 21 nt, Mycobacterium avium subsp. paratuberculosis
agggcguguugcaggcggacc

SEQ ID NO: 2813978 - RNA, 22 nt, Mycobacterium avium subsp. paratuberculosis
agggcguguugcaggcggaccu

SEQ ID NO: 2813979 - RNA, 16 nt, Mycobacterium avium subsp. paratuberculosis
agggcguucgacgucc

SEQ ID NO: 2813980 - RNA, 13 nt, Mycobacterium avium subsp. paratuberculosis
agggcguugauca

SEQ ID NO: 2813981 - RNA, 21 nt, Mycobacterium avium subsp. paratuberculosis
agggcguuugccacugagcgc

SEQ ID NO: 2813982 - RNA, 18 nt, Mycobacterium avium subsp. paratuberculosis
agggcuccccggacagcc

SEQ ID NO: 2813983 - RNA, 20 nt, Mycobacterium avium subsp. paratuberculosis
agggcuccgcgcugaccagc

SEQ ID NO: 2813984 - RNA, 21 nt, Mycobacterium avium subsp. paratuberculosis
agggcuccgcgcugaccagcg

SEQ ID NO: 2813985 - RNA, 20 nt, Mycobacterium avium subsp. paratuberculosis
agggcucgcaaccgucuugg

SEQ ID NO: 2813986 - RNA, 15 nt, Mycobacterium avium subsp. paratuberculosis
agggcucggcgucgu

SEQ ID NO: 2813987 - RNA, 13 nt, Mycobacterium avium subsp. paratuberculosis
aggggagcggcgg

SEQ ID NO: 2813988 - RNA, 16 nt, Mycobacterium avium subsp. paratuberculosis
aggggauccagcggcg

SEQ ID NO: 2813989 - RNA, 23 nt, Mycobacterium avium subsp. paratuberculosis
aggggauuuuuuggggcggggcg

SEQ ID NO: 2813990 - RNA, 16 nt, Mycobacterium avium subsp. paratuberculosis
aggggcagaccaggac

SEQ ID NO: 2813991 - RNA, 15 nt, Mycobacterium avium subsp. paratuberculosis
aggggcagcagcaga

SEQ ID NO: 2813992 - RNA, 15 nt, Mycobacterium avium subsp. paratuberculosis
aggggcagcugauag

SEQ ID NO: 2813993 - RNA, 19 nt, Mycobacterium avium subsp. paratuberculosis
aggggcagggcauccggga

SEQ ID NO: 2813994 - RNA, 12 nt, Mycobacterium avium subsp. paratuberculosis
aggggcgcggca

SEQ ID NO: 2813995 - RNA, 20 nt, Mycobacterium avium subsp. paratuberculosis
aggggcuguccucccagcgc

SEQ ID NO: 2813996 - RNA, 19 nt, Mycobacterium avium subsp. paratuberculosis
aggggcuugagcgcgucgu

SEQ ID NO: 2813997 - RNA, 20 nt, Mycobacterium avium subsp. paratuberculosis
aggggcuuggcgacgaaguc

SEQ ID NO: 2813998 - RNA, 19 nt, Mycobacterium avium subsp. paratuberculosis
aggggcuuuugcgucugcu

SEQ ID NO: 2813999 - RNA, 22 nt, Mycobacterium avium subsp. paratuberculosis
agggggucaucagugaccgcac

SEQ ID NO: 2814000 - RNA, 18 nt, Mycobacterium avium subsp. paratuberculosis
agggguccggggcacggu

SEQ ID NO: 2814001 - RNA, 13 nt, Mycobacterium avium subsp. paratuberculosis
aggggucggugcg

SEQ ID NO: 2814002 - RNA, 19 nt, Mycobacterium avium subsp. paratuberculosis
agggucaagauaccggccg

SEQ ID NO: 2814003 - RNA, 20 nt, Mycobacterium avium subsp. paratuberculosis
agggucaagauaccggccgg

SEQ ID NO: 2814004 - RNA, 22 nt, Mycobacterium avium subsp. paratuberculosis
agggucaagauaccggccggcg

SEQ ID NO: 2814005 - RNA, 20 nt, Mycobacterium avium subsp. paratuberculosis
agggucagcgcuuccagcgc

SEQ ID NO: 2814006 - RNA, 16 nt, Mycobacterium avium subsp. paratuberculosis
agggucaucgcgccgg

SEQ ID NO: 2814007 - RNA, 13 nt, Mycobacterium avium subsp. paratuberculosis
aggguccgccguc

SEQ ID NO: 2814008 - RNA, 14 nt, Mycobacterium avium subsp. paratuberculosis
aggguccgccgucg

SEQ ID NO: 2814009 - RNA, 15 nt, Mycobacterium avium subsp. paratuberculosis
aggguccgccgucga

SEQ ID NO: 2814010 - RNA, 14 nt, Mycobacterium avium subsp. paratuberculosis
agggucgccaggcc

SEQ ID NO: 2814011 - RNA, 16 nt, Mycobacterium avium subsp. paratuberculosis
agggucgggugcggcg

SEQ ID NO: 2814012 - RNA, 13 nt, Mycobacterium avium subsp. paratuberculosis
agggucgguggcc

SEQ ID NO: 2814013 - RNA, 15 nt, Mycobacterium avium subsp. paratuberculosis
agggucucgcgcagc

SEQ ID NO: 2814014 - RNA, 21 nt, Mycobacterium avium subsp. paratuberculosis
agggucugcgaagacccgaaa

SEQ ID NO: 2814015 - RNA, 15 nt, Mycobacterium avium subsp. paratuberculosis
agggucuggcccggu

SEQ ID NO: 2814016 - RNA, 15 nt, Mycobacterium avium subsp. paratuberculosis
agggugacgguggcg

SEQ ID NO: 2814017 - RNA, 22 nt, Mycobacterium avium subsp. paratuberculosis
agggugaugacguuggugaucg

SEQ ID NO: 2814018 - RNA, 18 nt, Mycobacterium avium subsp. paratuberculosis
agggugccccgcaccgcc

SEQ ID NO: 2814019 - RNA, 18 nt, Mycobacterium avium subsp. paratuberculosis
agggugccccgcgaccgc

SEQ ID NO: 2814020 - RNA, 22 nt, Mycobacterium avium subsp. paratuberculosis
agggugccccgcgaccgcagca

SEQ ID NO: 2814021 - RNA, 16 nt, Mycobacterium avium subsp. paratuberculosis
agggugccgacgaccu

SEQ ID NO: 2814022 - RNA, 21 nt, Mycobacterium avium subsp. paratuberculosis
agggugccgauguaggacagg

SEQ ID NO: 2814023 - RNA, 17 nt, Mycobacterium avium subsp. paratuberculosis
agggugccgccgcccgu

SEQ ID NO: 2814024 - RNA, 13 nt, Mycobacterium avium subsp. paratuberculosis
agggugccgccgg

SEQ ID NO: 2814025 - RNA, 18 nt, Mycobacterium avium subsp. paratuberculosis
agggugccgccgggcacc

SEQ ID NO: 2814026 - RNA, 19 nt, Mycobacterium avium subsp. paratuberculosis
agggugccgccgggcaccu

SEQ ID NO: 2814027 - RNA, 23 nt, Mycobacterium avium subsp. paratuberculosis
aggucgaccgcgcaccggcgcug

SEQ ID NO: 2814028 - RNA, 16 nt, Mycobacterium avium subsp. paratuberculosis
aggucgacgccccgcg

SEQ ID NO: 2814029 - RNA, 18 nt, Mycobacterium avium subsp. paratuberculosis
aggucgacggagucgucg

SEQ ID NO: 2814030 - RNA, 19 nt, Mycobacterium avium subsp. paratuberculosis
aggucgacggagucgucgg

SEQ ID NO: 2814031 - RNA, 17 nt, Mycobacterium avium subsp. paratuberculosis
aggucgacggggucgga

SEQ ID NO: 2814032 - RNA, 19 nt, Mycobacterium avium subsp. paratuberculosis
aggucgacggggucggaca

SEQ ID NO: 2814033 - RNA, 20 nt, Mycobacterium avium subsp. paratuberculosis
aggucgacggggucggacag

SEQ ID NO: 2814034 - RNA, 14 nt, Mycobacterium avium subsp. paratuberculosis
aggucgagcaccag

SEQ ID NO: 2814035 - RNA, 20 nt, Mycobacterium avium subsp. paratuberculosis
aggucgaggccggccagcgg

SEQ ID NO: 2814036 - RNA, 15 nt, Mycobacterium avium subsp. paratuberculosis
aggucgaucagcggu

SEQ ID NO: 2814037 - RNA, 22 nt, Mycobacterium avium subsp. paratuberculosis
aggucgaucagcgguccacccg

SEQ ID NO: 2814038 - RNA, 16 nt, Mycobacterium avium subsp. paratuberculosis
aggucgaucucggcca

SEQ ID NO: 2814039 - RNA, 17 nt, Mycobacterium avium subsp. paratuberculosis
aggucgaucucggccag

SEQ ID NO: 2814040 - RNA, 17 nt, Mycobacterium avium subsp. paratuberculosis
aggucgcacaccagcac

SEQ ID NO: 2814041 - RNA, 20 nt, Mycobacterium avium subsp. paratuberculosis
aggucgcacaccagcacggc

SEQ ID NO: 2814042 - RNA, 18 nt, Mycobacterium avium subsp. paratuberculosis
aggucgcacaggaugccc

SEQ ID NO: 2814043 - RNA, 13 nt, Mycobacterium avium subsp. paratuberculosis
aggucgcccagau

SEQ ID NO: 2814044 - RNA, 15 nt, Mycobacterium avium subsp. paratuberculosis
aggucgcccggcucg

SEQ ID NO: 2814045 - RNA, 19 nt, Mycobacterium avium subsp. paratuberculosis
aggucgccgacagcgucgu

SEQ ID NO: 2814046 - RNA, 18 nt, Mycobacterium avium subsp. paratuberculosis
aggucgccgauccagccg

SEQ ID NO: 2814047 - RNA, 22 nt, Mycobacterium avium subsp. paratuberculosis
aggucgccgauccagccgucgu

SEQ ID NO: 2814048 - RNA, 23 nt, Mycobacterium avium subsp. paratuberculosis
aggucgccgcgcagcaccgcguc

SEQ ID NO: 2814049 - RNA, 16 nt, Mycobacterium avium subsp. paratuberculosis
aggucgccggugucau

SEQ ID NO: 2814050 - RNA, 14 nt, Mycobacterium avium subsp. paratuberculosis
aggucgccggugug

SEQ ID NO: 2814051 - RNA, 17 nt, Mycobacterium avium subsp. paratuberculosis
aggucgccuccagguga

SEQ ID NO: 2814052 - RNA, 18 nt, Mycobacterium avium subsp. paratuberculosis
aggucgccuccaggugaa

SEQ ID NO: 2814053 - RNA, 16 nt, Mycobacterium avium subsp. paratuberculosis
aggucgcgaccgccgg

SEQ ID NO: 2814054 - RNA, 20 nt, Mycobacterium avium subsp. paratuberculosis
aggucgcgccggagccggag

SEQ ID NO: 2814055 - RNA, 24 nt, Mycobacterium avium subsp. paratuberculosis
aggucgcggauacgcccggccacc

SEQ ID NO: 2814056 - RNA, 12 nt, Mycobacterium avium subsp. paratuberculosis
aggucgcggcgc

SEQ ID NO: 2814057 - RNA, 20 nt, Mycobacterium avium subsp. paratuberculosis
aggucgcggcggccggcgcc

SEQ ID NO: 2814058 - RNA, 17 nt, Mycobacterium avium subsp. paratuberculosis
aggucgcggugggcgcg

SEQ ID NO: 2814059 - RNA, 21 nt, Mycobacterium avium subsp. paratuberculosis
aggucgcggugggcgcgggcc

SEQ ID NO: 2814060 - RNA, 21 nt, Mycobacterium avium subsp. paratuberculosis
aggucgcugcgcucgccgucg

SEQ ID NO: 2814061 - RNA, 19 nt, Mycobacterium avium subsp. paratuberculosis
aggucggacgccuccccca

SEQ ID NO: 2814062 - RNA, 20 nt, Mycobacterium avium subsp. paratuberculosis
aggucggacgccucccccac

SEQ ID NO: 2814063 - RNA, 23 nt, Mycobacterium avium subsp. paratuberculosis
aggucggacgccucccccacccg

SEQ ID NO: 2814064 - RNA, 21 nt, Mycobacterium avium subsp. paratuberculosis
aggucggccagcaggucgucg

SEQ ID NO: 2814065 - RNA, 14 nt, Mycobacterium avium subsp. paratuberculosis
aggucggccagcgc

SEQ ID NO: 2814066 - RNA, 17 nt, Mycobacterium avium subsp. paratuberculosis
aggucggccagcgccgc

SEQ ID NO: 2814067 - RNA, 18 nt, Mycobacterium avium subsp. paratuberculosis
aggucggccagcgccgcc

SEQ ID NO: 2814068 - RNA, 20 nt, Mycobacterium avium subsp. paratuberculosis
aggucggccagcgccgcccg

SEQ ID NO: 2814069 - RNA, 16 nt, Mycobacterium avium subsp. paratuberculosis
aggucggccagcugcg

SEQ ID NO: 2814070 - RNA, 20 nt, Mycobacterium avium subsp. paratuberculosis
aggucggccagcugcggguu

SEQ ID NO: 2814071 - RNA, 20 nt, Mycobacterium avium subsp. paratuberculosis
aggucggccgcggccggcgg

SEQ ID NO: 2814072 - RNA, 21 nt, Mycobacterium avium subsp. paratuberculosis
aggucggcgggagccggcggc

SEQ ID NO: 2814073 - RNA, 20 nt, Mycobacterium avium subsp. paratuberculosis
aggucggcggucgcggugcc

SEQ ID NO: 2814074 - RNA, 13 nt, Mycobacterium avium subsp. paratuberculosis
aggucggcgugau

SEQ ID NO: 2814075 - RNA, 19 nt, Mycobacterium avium subsp. paratuberculosis
aggucgggacguccgcgcg

SEQ ID NO: 2814076 - RNA, 20 nt, Mycobacterium avium subsp. paratuberculosis
aggucgggacguccgcgcga

SEQ ID NO: 2814077 - RNA, 12 nt, Mycobacterium avium subsp. paratuberculosis
aggucgggcucg

SEQ ID NO: 2814078 - RNA, 20 nt, Mycobacterium avium subsp. paratuberculosis
aggucggggcccguccccac

SEQ ID NO: 2814079 - RNA, 21 nt, Mycobacterium avium subsp. paratuberculosis
aggucggggcccguccccacc

SEQ ID NO: 2814080 - RNA, 13 nt, Mycobacterium avium subsp. paratuberculosis
aggucggugaggc

SEQ ID NO: 2814081 - RNA, 17 nt, Mycobacterium avium subsp. paratuberculosis
aggucggugaggcuggg

SEQ ID NO: 2814082 - RNA, 21 nt, Mycobacterium avium subsp. paratuberculosis
aggucggugcgcgggguggcg

SEQ ID NO: 2814083 - RNA, 23 nt, Mycobacterium avium subsp. paratuberculosis
aggucggugcgcgggguggcgcc

SEQ ID NO: 2814084 - RNA, 15 nt, Mycobacterium avium subsp. paratuberculosis
aggucgguggccacc

SEQ ID NO: 2814085 - RNA, 16 nt, Mycobacterium avium subsp. paratuberculosis
aggucgguggccacca

SEQ ID NO: 2814086 - RNA, 17 nt, Mycobacterium avium subsp. paratuberculosis
aggucgguggccaccac

SEQ ID NO: 2814087 - RNA, 15 nt, Mycobacterium avium subsp. paratuberculosis
aggucgucgacgucc

SEQ ID NO: 2814088 - RNA, 17 nt, Mycobacterium avium subsp. paratuberculosis
aggucgucgagggccac

SEQ ID NO: 2814089 - RNA, 19 nt, Mycobacterium avium subsp. paratuberculosis
aggucgucgagggccaccg

SEQ ID NO: 2814090 - RNA, 15 nt, Mycobacterium avium subsp. paratuberculosis
aggucgucgcgucca

SEQ ID NO: 2814091 - RNA, 19 nt, Mycobacterium avium subsp. paratuberculosis
aggucgucgcguccagcau

SEQ ID NO: 2814092 - RNA, 21 nt, Mycobacterium avium subsp. paratuberculosis
aggucgucgcguccagcaugc

SEQ ID NO: 2814093 - RNA, 22 nt, Mycobacterium avium subsp. paratuberculosis
aggucgucgcguccagcaugcc

SEQ ID NO: 2814094 - RNA, 14 nt, Mycobacterium avium subsp. paratuberculosis
aggucgucggccag

SEQ ID NO: 2814095 - RNA, 13 nt, Mycobacterium avium subsp. paratuberculosis
aggucgucgggcg

SEQ ID NO: 2814096 - RNA, 13 nt, Mycobacterium avium subsp. paratuberculosis
aggucguggcgcc

SEQ ID NO: 2814097 - RNA, 16 nt, Mycobacterium avium subsp. paratuberculosis
aggucguggcgccgag

SEQ ID NO: 2814098 - RNA, 17 nt, Mycobacterium avium subsp. paratuberculosis
aggucguggcgccgagg

SEQ ID NO: 2814099 - RNA, 18 nt, Mycobacterium avium subsp. paratuberculosis
aggucguggcgccgagga

SEQ ID NO: 2814100 - RNA, 16 nt, Mycobacterium avium subsp. paratuberculosis
aggucguucauucagc

SEQ ID NO: 2814101 - RNA, 21 nt, Mycobacterium avium subsp. paratuberculosis
aggucuccguugucgaggucg

SEQ ID NO: 2814102 - RNA, 17 nt, Mycobacterium avium subsp. paratuberculosis
aggucugaaaugccggg

SEQ ID NO: 2814103 - RNA, 14 nt, Mycobacterium avium subsp. paratuberculosis
aggucugcagcagc

SEQ ID NO: 2814104 - RNA, 15 nt, Mycobacterium avium subsp. paratuberculosis
aggucugcagcagcc

SEQ ID NO: 2814105 - RNA, 22 nt, Mycobacterium avium subsp. paratuberculosis
aggucuuucaucgccccggcga

SEQ ID NO: 2814106 - RNA, 14 nt, Mycobacterium avium subsp. paratuberculosis
aggugaacagcagc

SEQ ID NO: 2814107 - RNA, 15 nt, Mycobacterium avium subsp. paratuberculosis
aggugaacagcagcc

SEQ ID NO: 2814108 - RNA, 21 nt, Mycobacterium avium subsp. paratuberculosis
aggugaagccguugucgaguu

SEQ ID NO: 2814109 - RNA, 21 nt, Mycobacterium avium subsp. paratuberculosis
aggugaauaccacugcgcgcc

SEQ ID NO: 2814110 - RNA, 15 nt, Mycobacterium avium subsp. paratuberculosis
aggugaaugcucagc

SEQ ID NO: 2814111 - RNA, 19 nt, Mycobacterium avium subsp. paratuberculosis
aggugggcuuagcggggug

SEQ ID NO: 2814112 - RNA, 18 nt, Mycobacterium avium subsp. paratuberculosis
agguggucucccagacgu

SEQ ID NO: 2814113 - RNA, 20 nt, Mycobacterium avium subsp. paratuberculosis
agguggucucccagacgucg

SEQ ID NO: 2814114 - RNA, 21 nt, Mycobacterium avium subsp. paratuberculosis
agguggucucccagacgucga

SEQ ID NO: 2814115 - RNA, 21 nt, Mycobacterium avium subsp. paratuberculosis
aggugguuucggggucgccgu

SEQ ID NO: 2814116 - RNA, 14 nt, Mycobacterium avium subsp. paratuberculosis
agguguccagcccu

SEQ ID NO: 2814117 - RNA, 15 nt, Mycobacterium avium subsp. paratuberculosis
agguguccggcccga

SEQ ID NO: 2814118 - RNA, 15 nt, Mycobacterium avium subsp. paratuberculosis
aggugucgcacugcu

SEQ ID NO: 2814119 - RNA, 17 nt, Mycobacterium avium subsp. paratuberculosis
aggugugaggagucggg

SEQ ID NO: 2814120 - RNA, 19 nt, Mycobacterium avium subsp. paratuberculosis
aggugugaggagucgggca

SEQ ID NO: 2814121 - RNA, 16 nt, Mycobacterium avium subsp. paratuberculosis
aggugugcggcaagcg

SEQ ID NO: 2814122 - RNA, 17 nt, Mycobacterium avium subsp. paratuberculosis
agguucagcccggcgcu

SEQ ID NO: 2814123 - RNA, 22 nt, Mycobacterium avium subsp. paratuberculosis
agguucagcccggcgcugcgcc

SEQ ID NO: 2814124 - RNA, 15 nt, Mycobacterium avium subsp. paratuberculosis
agguucaggcccgcg

SEQ ID NO: 2814125 - RNA, 13 nt, Mycobacterium avium subsp. paratuberculosis
agguucaggcuga

SEQ ID NO: 2814126 - RNA, 16 nt, Mycobacterium avium subsp. paratuberculosis
agguucauccccgcgg

SEQ ID NO: 2814127 - RNA, 19 nt, Mycobacterium avium subsp. paratuberculosis
agguucaugugaccggggu

SEQ ID NO: 2814128 - RNA, 19 nt, Mycobacterium avium subsp. paratuberculosis
agguuccggugucgagccg

SEQ ID NO: 2814129 - RNA, 21 nt, Mycobacterium avium subsp. paratuberculosis
agguucuucugcgcgaugucg

SEQ ID NO: 2814130 - RNA, 19 nt, Mycobacterium avium subsp. paratuberculosis
agguucuuggcggccugcu

SEQ ID NO: 2814131 - RNA, 20 nt, Mycobacterium avium subsp. paratuberculosis
agguugacgugcaccggcga

SEQ ID NO: 2814132 - RNA, 18 nt, Mycobacterium avium subsp. paratuberculosis
agguugauccgcgcgucu

SEQ ID NO: 2814133 - RNA, 16 nt, Mycobacterium avium subsp. paratuberculosis
agguugcgcagcagcc

SEQ ID NO: 2814134 - RNA, 15 nt, Mycobacterium avium subsp. paratuberculosis
agguugcgccguccg

SEQ ID NO: 2814135 - RNA, 13 nt, Mycobacterium avium subsp. paratuberculosis
agguuggacaccu

SEQ ID NO: 2814136 - RNA, 13 nt, Mycobacterium avium subsp. paratuberculosis
agguuggcggcgg

SEQ ID NO: 2814137 - RNA, 15 nt, Mycobacterium avium subsp. paratuberculosis
agguuggucagcagc

SEQ ID NO: 2814138 - RNA, 22 nt, Mycobacterium avium subsp. paratuberculosis
agguuguagucggcgccgacgg

SEQ ID NO: 2814139 - RNA, 16 nt, Mycobacterium avium subsp. paratuberculosis
agguugucgucgggca

SEQ ID NO: 2814140 - RNA, 14 nt, Mycobacterium avium subsp. paratuberculosis
agguuuugcagcgg

SEQ ID NO: 2814141 - RNA, 22 nt, Mycobacterium avium subsp. paratuberculosis
aguaaggccgaggcgagugagg

SEQ ID NO: 2814142 - RNA, 13 nt, Mycobacterium avium subsp. paratuberculosis
aguacaccaccgc

SEQ ID NO: 2814143 - RNA, 18 nt, Mycobacterium avium subsp. paratuberculosis
aguacaccaccgcggcga

SEQ ID NO: 2814144 - RNA, 14 nt, Mycobacterium avium subsp. paratuberculosis
aguacaccucgagc

SEQ ID NO: 2814145 - RNA, 19 nt, Mycobacterium avium subsp. paratuberculosis
aguacaccucgagcuugcc

SEQ ID NO: 2814146 - RNA, 19 nt, Mycobacterium avium subsp. paratuberculosis
aguacagcuaggccagcag

SEQ ID NO: 2814147 - RNA, 21 nt, Mycobacterium avium subsp. paratuberculosis
aguacagcuaggccagcagcg

SEQ ID NO: 2814148 - RNA, 13 nt, Mycobacterium avium subsp. paratuberculosis
aguacaggccgua

SEQ ID NO: 2814149 - RNA, 15 nt, Mycobacterium avium subsp. paratuberculosis
aguaccccgggcuga

SEQ ID NO: 2814150 - RNA, 14 nt, Mycobacterium avium subsp. paratuberculosis
aguacccgccgcac

SEQ ID NO: 2814151 - RNA, 16 nt, Mycobacterium avium subsp. paratuberculosis
aguacccgccgcaccu

SEQ ID NO: 2814152 - RNA, 18 nt, Mycobacterium avium subsp. paratuberculosis
aguaccggcgaugccagc

SEQ ID NO: 2814153 - RNA, 14 nt, Mycobacterium avium subsp. paratuberculosis
aguacgcgccggcc

SEQ ID NO: 2814154 - RNA, 14 nt, Mycobacterium avium subsp. paratuberculosis
aguacucggucacc

SEQ ID NO: 2814155 - RNA, 19 nt, Mycobacterium avium subsp. paratuberculosis
aguacucgguguagagcac

SEQ ID NO: 2814156 - RNA, 15 nt, Mycobacterium avium subsp. paratuberculosis
aguacugcucgacgu

SEQ ID NO: 2814157 - RNA, 16 nt, Mycobacterium avium subsp. paratuberculosis
aguagaacuucgccag

SEQ ID NO: 2814158 - RNA, 16 nt, Mycobacterium avium subsp. paratuberculosis
aguagcaggcaucgcg

SEQ ID NO: 2814159 - RNA, 14 nt, Mycobacterium avium subsp. paratuberculosis
aguagcaucgggga

SEQ ID NO: 2814160 - RNA, 19 nt, Mycobacterium avium subsp. paratuberculosis
aguagcccggagugaaguc

SEQ ID NO: 2814161 - RNA, 18 nt, Mycobacterium avium subsp. paratuberculosis
aguagccgaucuccaccg

SEQ ID NO: 2814162 - RNA, 12 nt, Mycobacterium avium subsp. paratuberculosis
aguagccgccgg

SEQ ID NO: 2814163 - RNA, 19 nt, Mycobacterium avium subsp. paratuberculosis
aguagccggccagcgucgc

SEQ ID NO: 2814164 - RNA, 14 nt, Mycobacterium avium subsp. paratuberculosis
aguagccggcgauc

SEQ ID NO: 2814165 - RNA, 22 nt, Mycobacterium avium subsp. paratuberculosis
aguagccgguucgucccgcgcg

SEQ ID NO: 2814166 - RNA, 23 nt, Mycobacterium avium subsp. paratuberculosis
aguagcugcccugaagcugggcg

SEQ ID NO: 2814167 - RNA, 18 nt, Mycobacterium avium subsp. paratuberculosis
aguaggcggcugucgaca

SEQ ID NO: 2814168 - RNA, 19 nt, Mycobacterium avium subsp. paratuberculosis
aguagugguccaccgccgc

SEQ ID NO: 2814169 - RNA, 13 nt, Mycobacterium avium subsp. paratuberculosis
aguaguuccggcg

SEQ ID NO: 2814170 - RNA, 23 nt, Mycobacterium avium subsp. paratuberculosis
aguaguuccggcgguccugcggc

SEQ ID NO: 2814171 - RNA, 18 nt, Mycobacterium avium subsp. paratuberculosis
aguauccggucagcgcca

SEQ ID NO: 2814172 - RNA, 18 nt, Mycobacterium avium subsp. paratuberculosis
aguaucgccacgccgacc

SEQ ID NO: 2814173 - RNA, 17 nt, Mycobacterium avium subsp. paratuberculosis
aguaucuuguucgccga

SEQ ID NO: 2814174 - RNA, 12 nt, Mycobacterium avium subsp. paratuberculosis
agucacccggcc

SEQ ID NO: 2814175 - RNA, 14 nt, Mycobacterium avium subsp. paratuberculosis
agucacccggcccc

SEQ ID NO: 2814176 - RNA, 21 nt, Mycobacterium avium subsp. paratuberculosis
agucacccggcuggccgcaca

SEQ ID NO: 2814177 - RNA, 15 nt, Mycobacterium avium subsp. paratuberculosis
agucagcgcgugacc

SEQ ID NO: 2814178 - RNA, 21 nt, Mycobacterium avium subsp. paratuberculosis
agucaucaccggggaucaccu

SEQ ID NO: 2814179 - RNA, 23 nt, Mycobacterium avium subsp. paratuberculosis
agucaugccgcgcucgucgauca

SEQ ID NO: 2814180 - RNA, 19 nt, Mycobacterium avium subsp. paratuberculosis
agucauucugaauucggcc

SEQ ID NO: 2814181 - RNA, 22 nt, Mycobacterium avium subsp. paratuberculosis
agucauucugaauucggccacc

SEQ ID NO: 2814182 - RNA, 14 nt, Mycobacterium avium subsp. paratuberculosis
aguccaccggcgga

SEQ ID NO: 2814183 - RNA, 14 nt, Mycobacterium avium subsp. paratuberculosis
aguccacgacgucc

SEQ ID NO: 2814184 - RNA, 15 nt, Mycobacterium avium subsp. paratuberculosis
aguccagcacggcga

SEQ ID NO: 2814185 - RNA, 13 nt, Mycobacterium avium subsp. paratuberculosis
aguccagccagcc

SEQ ID NO: 2814186 - RNA, 16 nt, Mycobacterium avium subsp. paratuberculosis
aguccagccagccgcg

SEQ ID NO: 2814187 - RNA, 20 nt, Mycobacterium avium subsp. paratuberculosis
aguccagcgaaucgaccggg

SEQ ID NO: 2814188 - RNA, 13 nt, Mycobacterium avium subsp. paratuberculosis
aguccagcucgcg

SEQ ID NO: 2814189 - RNA, 20 nt, Mycobacterium avium subsp. paratuberculosis
aguccagggugucgucgucg

SEQ ID NO: 2814190 - RNA, 17 nt, Mycobacterium avium subsp. paratuberculosis
aguccaggucgaucucg

SEQ ID NO: 2814191 - RNA, 16 nt, Mycobacterium avium subsp. paratuberculosis
agucccacugcccgua

SEQ ID NO: 2814192 - RNA, 14 nt, Mycobacterium avium subsp. paratuberculosis
agucccagaucgua

SEQ ID NO: 2814193 - RNA, 19 nt, Mycobacterium avium subsp. paratuberculosis
agucccagcacagccgucg

SEQ ID NO: 2814194 - RNA, 19 nt, Mycobacterium avium subsp. paratuberculosis
aguccccgggugggugcuc

SEQ ID NO: 2814195 - RNA, 16 nt, Mycobacterium avium subsp. paratuberculosis
aguccccgguucacca

SEQ ID NO: 2814196 - RNA, 13 nt, Mycobacterium avium subsp. paratuberculosis
agucgcugggugu

SEQ ID NO: 2814197 - RNA, 21 nt, Mycobacterium avium subsp. paratuberculosis
agucgcuggucgaaccgcgag

SEQ ID NO: 2814198 - RNA, 18 nt, Mycobacterium avium subsp. paratuberculosis
agucgcuguuggcgacgg

SEQ ID NO: 2814199 - RNA, 15 nt, Mycobacterium avium subsp. paratuberculosis
agucggagacccgcc

SEQ ID NO: 2814200 - RNA, 12 nt, Mycobacterium avium subsp. paratuberculosis
agucggccaccg

SEQ ID NO: 2814201 - RNA, 13 nt, Mycobacterium avium subsp. paratuberculosis
agucggccaccgc

SEQ ID NO: 2814202 - RNA, 14 nt, Mycobacterium avium subsp. paratuberculosis
agucggccaccgcg

SEQ ID NO: 2814203 - RNA, 20 nt, Mycobacterium avium subsp. paratuberculosis
agucggccacguugccgggu

SEQ ID NO: 2814204 - RNA, 16 nt, Mycobacterium avium subsp. paratuberculosis
agucggccaucagcac

SEQ ID NO: 2814205 - RNA, 19 nt, Mycobacterium avium subsp. paratuberculosis
agucggccaucagcaccga

SEQ ID NO: 2814206 - RNA, 14 nt, Mycobacterium avium subsp. paratuberculosis
agucggcccaggcc

SEQ ID NO: 2814207 - RNA, 15 nt, Mycobacterium avium subsp. paratuberculosis
agucggcccaggcca

SEQ ID NO: 2814208 - RNA, 18 nt, Mycobacterium avium subsp. paratuberculosis
agucggcccaggccaaca

SEQ ID NO: 2814209 - RNA, 14 nt, Mycobacterium avium subsp. paratuberculosis
agucggcccgccgg

SEQ ID NO: 2814210 - RNA, 16 nt, Mycobacterium avium subsp. paratuberculosis
agucggcccgccgggc

SEQ ID NO: 2814211 - RNA, 12 nt, Mycobacterium avium subsp. paratuberculosis
agucggccuccu

SEQ ID NO: 2814212 - RNA, 21 nt, Mycobacterium avium subsp. paratuberculosis
agucggccuccuccucgcugc

SEQ ID NO: 2814213 - RNA, 22 nt, Mycobacterium avium subsp. paratuberculosis
agucggccugcagcucggugcg

SEQ ID NO: 2814214 - RNA, 15 nt, Mycobacterium avium subsp. paratuberculosis
agucggcgaaggcgc

SEQ ID NO: 2814215 - RNA, 20 nt, Mycobacterium avium subsp. paratuberculosis
agucggcgaaggcgcgcagg

SEQ ID NO: 2814216 - RNA, 21 nt, Mycobacterium avium subsp. paratuberculosis
agucggcgccgacggccagca

SEQ ID NO: 2814217 - RNA, 22 nt, Mycobacterium avium subsp. paratuberculosis
agucggcgccgacggccagcag

SEQ ID NO: 2814218 - RNA, 24 nt, Mycobacterium avium subsp. paratuberculosis
agucggcguccgugccguccggcc

SEQ ID NO: 2814219 - RNA, 15 nt, Mycobacterium avium subsp. paratuberculosis
agucggcgucggcca

SEQ ID NO: 2814220 - RNA, 20 nt, Mycobacterium avium subsp. paratuberculosis
agucggcgucggccaccgcg

SEQ ID NO: 2814221 - RNA, 22 nt, Mycobacterium avium subsp. paratuberculosis
agucggcgucggccaccgcgcc

SEQ ID NO: 2814222 - RNA, 15 nt, Mycobacterium avium subsp. paratuberculosis
agucggcgucuucgg

SEQ ID NO: 2814223 - RNA, 21 nt, Mycobacterium avium subsp. paratuberculosis
agucgggaaaucggacccagc

SEQ ID NO: 2814224 - RNA, 16 nt, Mycobacterium avium subsp. paratuberculosis
agucgggauagggcgc

SEQ ID NO: 2814225 - RNA, 20 nt, Mycobacterium avium subsp. paratuberculosis
agucgggcaaucggacccag

SEQ ID NO: 2814226 - RNA, 19 nt, Mycobacterium avium subsp. paratuberculosis
agucggucagcgucgccgc

SEQ ID NO: 2814227 - RNA, 15 nt, Mycobacterium avium subsp. paratuberculosis
agucggugagcaccg

SEQ ID NO: 2814228 - RNA, 16 nt, Mycobacterium avium subsp. paratuberculosis
agucggugagcaccgu

SEQ ID NO: 2814229 - RNA, 17 nt, Mycobacterium avium subsp. paratuberculosis
agucggugcagugaugc

SEQ ID NO: 2814230 - RNA, 16 nt, Mycobacterium avium subsp. paratuberculosis
agucggugcccagcgc

SEQ ID NO: 2814231 - RNA, 17 nt, Mycobacterium avium subsp. paratuberculosis
agucggugcccagcgcg

SEQ ID NO: 2814232 - RNA, 23 nt, Mycobacterium avium subsp. paratuberculosis
agucggugcccagcgcgaggucg

SEQ ID NO: 2814233 - RNA, 23 nt, Mycobacterium avium subsp. paratuberculosis
agucggugcccuugguguaggcg

SEQ ID NO: 2814234 - RNA, 18 nt, Mycobacterium avium subsp. paratuberculosis
agucgguuucgaccugcg

SEQ ID NO: 2814235 - RNA, 22 nt, Mycobacterium avium subsp. paratuberculosis
agucguacucccaggccgcggc

SEQ ID NO: 2814236 - RNA, 17 nt, Mycobacterium avium subsp. paratuberculosis
agucguccagcgucgac

SEQ ID NO: 2814237 - RNA, 18 nt, Mycobacterium avium subsp. paratuberculosis
agucgucgaucucgguga

SEQ ID NO: 2814238 - RNA, 15 nt, Mycobacterium avium subsp. paratuberculosis
agucgucgcgcacca

SEQ ID NO: 2814239 - RNA, 21 nt, Mycobacterium avium subsp. paratuberculosis
agucgucgcgcaccagcucga

SEQ ID NO: 2814240 - RNA, 16 nt, Mycobacterium avium subsp. paratuberculosis
agucgucggcgcgguu

SEQ ID NO: 2814241 - RNA, 16 nt, Mycobacterium avium subsp. paratuberculosis
agucgugacgcggcgu

SEQ ID NO: 2814242 - RNA, 23 nt, Mycobacterium avium subsp. paratuberculosis
agucguucagcugcagccggccg

SEQ ID NO: 2814243 - RNA, 21 nt, Mycobacterium avium subsp. paratuberculosis
agucguucuccagcccucgug

SEQ ID NO: 2814244 - RNA, 23 nt, Mycobacterium avium subsp. paratuberculosis
agucguuggugaacagguaggcg

SEQ ID NO: 2814245 - RNA, 17 nt, Mycobacterium avium subsp. paratuberculosis
agucguugucggcgguc

SEQ ID NO: 2814246 - RNA, 19 nt, Mycobacterium avium subsp. paratuberculosis
agucuacuuggccagcugc

SEQ ID NO: 2814247 - RNA, 17 nt, Mycobacterium avium subsp. paratuberculosis
agucuuaucuaucuucg

SEQ ID NO: 2814248 - RNA, 13 nt, Mycobacterium avium subsp. paratuberculosis
agucuucggccau

SEQ ID NO: 2814249 - RNA, 14 nt, Mycobacterium avium subsp. paratuberculosis
agugaaccccgggc

SEQ ID NO: 2814250 - RNA, 19 nt, Mycobacterium avium subsp. paratuberculosis
agugaccgccagcaccgcg

SEQ ID NO: 2814251 - RNA, 20 nt, Mycobacterium avium subsp. paratuberculosis
agugaccgccagcaccgcgg

SEQ ID NO: 2814252 - RNA, 20 nt, Mycobacterium avium subsp. paratuberculosis
agugacgccgcucggccagc

SEQ ID NO: 2814253 - RNA, 23 nt, Mycobacterium avium subsp. paratuberculosis
agugacgccgcucggccagcgca

SEQ ID NO: 2814254 - RNA, 13 nt, Mycobacterium avium subsp. paratuberculosis
agugaggccagca

SEQ ID NO: 2814255 - RNA, 14 nt, Mycobacterium avium subsp. paratuberculosis
agugaggccagcac

SEQ ID NO: 2814256 - RNA, 23 nt, Mycobacterium avium subsp. paratuberculosis
agugaggccagcacccggucggu

SEQ ID NO: 2814257 - RNA, 14 nt, Mycobacterium avium subsp. paratuberculosis
agugaggccgaggc

SEQ ID NO: 2814258 - RNA, 17 nt, Mycobacterium avium subsp. paratuberculosis
agugaggccgaggcgag

SEQ ID NO: 2814259 - RNA, 21 nt, Mycobacterium avium subsp. paratuberculosis
agugaggggauccagcggcgg

SEQ ID NO: 2814260 - RNA, 22 nt, Mycobacterium avium subsp. paratuberculosis
agugaugcuguuaccgucgggc

SEQ ID NO: 2814261 - RNA, 14 nt, Mycobacterium avium subsp. paratuberculosis
agugcaacuaccga

SEQ ID NO: 2814262 - RNA, 21 nt, Mycobacterium avium subsp. paratuberculosis
agugcacgccgaggcgugccg

SEQ ID NO: 2814263 - RNA, 14 nt, Mycobacterium avium subsp. paratuberculosis
agugcacgcucggc

SEQ ID NO: 2814264 - RNA, 16 nt, Mycobacterium avium subsp. paratuberculosis
agugcacgcucggcgg

SEQ ID NO: 2814265 - RNA, 14 nt, Mycobacterium avium subsp. paratuberculosis
agugcacucggcga

SEQ ID NO: 2814266 - RNA, 14 nt, Mycobacterium avium subsp. paratuberculosis
agugcagccgcccg

SEQ ID NO: 2814267 - RNA, 18 nt, Mycobacterium avium subsp. paratuberculosis
agugcaguucgaugccga

SEQ ID NO: 2814268 - RNA, 19 nt, Mycobacterium avium subsp. paratuberculosis
agugcaguucgaugccgau

SEQ ID NO: 2814269 - RNA, 24 nt, Mycobacterium avium subsp. paratuberculosis
agugcaucggcaguccgcgccggu

SEQ ID NO: 2814270 - RNA, 13 nt, Mycobacterium avium subsp. paratuberculosis
agugcaugccggc

SEQ ID NO: 2814271 - RNA, 21 nt, Mycobacterium avium subsp. paratuberculosis
agugccaacacggcggcgcgc

SEQ ID NO: 2814272 - RNA, 16 nt, Mycobacterium avium subsp. paratuberculosis
agugccaccaccacgg

SEQ ID NO: 2814273 - RNA, 13 nt, Mycobacterium avium subsp. paratuberculosis
agugccccacaag

SEQ ID NO: 2814274 - RNA, 23 nt, Mycobacterium avium subsp. paratuberculosis
agugcccgcccagcugcacccac

SEQ ID NO: 2814275 - RNA, 14 nt, Mycobacterium avium subsp. paratuberculosis
agugccgcaccagc

SEQ ID NO: 2814276 - RNA, 15 nt, Mycobacterium avium subsp. paratuberculosis
agugccgcaccagca

SEQ ID NO: 2814277 - RNA, 17 nt, Mycobacterium avium subsp. paratuberculosis
agugccgcaccagcacc

SEQ ID NO: 2814278 - RNA, 18 nt, Mycobacterium avium subsp. paratuberculosis
agugccgcaggugguggg

SEQ ID NO: 2814279 - RNA, 18 nt, Mycobacterium avium subsp. paratuberculosis
agugccggccagcucgcc

SEQ ID NO: 2814280 - RNA, 18 nt, Mycobacterium avium subsp. paratuberculosis
aguucugcuugagccgcc

SEQ ID NO: 2814281 - RNA, 21 nt, Mycobacterium avium subsp. paratuberculosis
aguucugguaggcggccggga

SEQ ID NO: 2814282 - RNA, 15 nt, Mycobacterium avium subsp. paratuberculosis
aguugacuccucugc

SEQ ID NO: 2814283 - RNA, 19 nt, Mycobacterium avium subsp. paratuberculosis
aguugacuccucugccaga

SEQ ID NO: 2814284 - RNA, 15 nt, Mycobacterium avium subsp. paratuberculosis
aguugaucgcggcgg

SEQ ID NO: 2814285 - RNA, 16 nt, Mycobacterium avium subsp. paratuberculosis
aguugaucgcggcgga

SEQ ID NO: 2814286 - RNA, 12 nt, Mycobacterium avium subsp. paratuberculosis
aguugcaccggc

SEQ ID NO: 2814287 - RNA, 15 nt, Mycobacterium avium subsp. paratuberculosis
aguugcaccggcacc

SEQ ID NO: 2814288 - RNA, 18 nt, Mycobacterium avium subsp. paratuberculosis
aguugcacucucgcggca

SEQ ID NO: 2814289 - RNA, 22 nt, Mycobacterium avium subsp. paratuberculosis
aguugcccaacuggcgaccggu

SEQ ID NO: 2814290 - RNA, 16 nt, Mycobacterium avium subsp. paratuberculosis
aguugccccguguggu

SEQ ID NO: 2814291 - RNA, 22 nt, Mycobacterium avium subsp. paratuberculosis
aguugccgauggcgguccacca

SEQ ID NO: 2814292 - RNA, 14 nt, Mycobacterium avium subsp. paratuberculosis
aguugccggucagg

SEQ ID NO: 2814293 - RNA, 16 nt, Mycobacterium avium subsp. paratuberculosis
aguugccggucaggca

SEQ ID NO: 2814294 - RNA, 18 nt, Mycobacterium avium subsp. paratuberculosis
aguugccguuguccuuga

SEQ ID NO: 2814295 - RNA, 14 nt, Mycobacterium avium subsp. paratuberculosis
aguugcgcgccgau

SEQ ID NO: 2814296 - RNA, 19 nt, Mycobacterium avium subsp. paratuberculosis
aguugcggccggcgguguc

SEQ ID NO: 2814297 - RNA, 21 nt, Mycobacterium avium subsp. paratuberculosis
aguuggccggcuucucggcgu

SEQ ID NO: 2814298 - RNA, 12 nt, Mycobacterium avium subsp. paratuberculosis
aguuggccuccc

SEQ ID NO: 2814299 - RNA, 13 nt, Mycobacterium avium subsp. paratuberculosis
aguuggccuccca

SEQ ID NO: 2814300 - RNA, 14 nt, Mycobacterium avium subsp. paratuberculosis
aguuggcggcggug

SEQ ID NO: 2814301 - RNA, 17 nt, Mycobacterium avium subsp. paratuberculosis
aguuggcggcggugauc

SEQ ID NO: 2814302 - RNA, 16 nt, Mycobacterium avium subsp. paratuberculosis
aguuggcgucgucggc

SEQ ID NO: 2814303 - RNA, 16 nt, Mycobacterium avium subsp. paratuberculosis
aguuggggccggccgc

SEQ ID NO: 2814304 - RNA, 17 nt, Mycobacterium avium subsp. paratuberculosis
aguugggggccagcgcc

SEQ ID NO: 2814305 - RNA, 20 nt, Mycobacterium avium subsp. paratuberculosis
aguugggggccagcgccgag

SEQ ID NO: 2814306 - RNA, 22 nt, Mycobacterium avium subsp. paratuberculosis
aguugggucacaucgcguuagc

SEQ ID NO: 2814307 - RNA, 20 nt, Mycobacterium avium subsp. paratuberculosis
aguuggucgaugucggugcg

SEQ ID NO: 2814308 - RNA, 14 nt, Mycobacterium avium subsp. paratuberculosis
aguuggugcugggc

SEQ ID NO: 2814309 - RNA, 16 nt, Mycobacterium avium subsp. paratuberculosis
aguuguagcgcagcau

SEQ ID NO: 2814310 - RNA, 16 nt, Mycobacterium avium subsp. paratuberculosis
aguugucggugaaguc

SEQ ID NO: 2814311 - RNA, 22 nt, Mycobacterium avium subsp. paratuberculosis
aguuguucgacugcaggaacaa

SEQ ID NO: 2814312 - RNA, 15 nt, Mycobacterium avium subsp. paratuberculosis
aguuguuggccgggc

SEQ ID NO: 2814313 - RNA, 16 nt, Mycobacterium avium subsp. paratuberculosis
aguuguuggccgggca

SEQ ID NO: 2814314 - RNA, 18 nt, Mycobacterium avium subsp. paratuberculosis
aguuuccccaccaggcgc

SEQ ID NO: 2814315 - RNA, 18 nt, Mycobacterium avium subsp. paratuberculosis
aguuugcccucgucgacc

SEQ ID NO: 2814316 - RNA, 15 nt, Mycobacterium avium subsp. paratuberculosis
aguuugccgucggga

SEQ ID NO: 2814317 - RNA, 19 nt, Mycobacterium avium subsp. paratuberculosis
aguuuuucgggguggugga

SEQ ID NO: 2814318 - RNA, 21 nt, Mycobacterium avium subsp. paratuberculosis
auaaaccugguuggcgacagg

SEQ ID NO: 2814319 - RNA, 14 nt, Mycobacterium avium subsp. paratuberculosis
auaaccucggcggc

SEQ ID NO: 2814320 - RNA, 20 nt, Mycobacterium avium subsp. paratuberculosis
auaaccucggcggcggcgcg

SEQ ID NO: 2814321 - RNA, 13 nt, Mycobacterium avium subsp. paratuberculosis
auaacgccggccc

SEQ ID NO: 2814322 - RNA, 18 nt, Mycobacterium avium subsp. paratuberculosis
auaaggggguagauguca

SEQ ID NO: 2814323 - RNA, 16 nt, Mycobacterium avium subsp. paratuberculosis
auacacgccuggacag

SEQ ID NO: 2814324 - RNA, 14 nt, Mycobacterium avium subsp. paratuberculosis
auacagcagcugcg

SEQ ID NO: 2814325 - RNA, 14 nt, Mycobacterium avium subsp. paratuberculosis
auacagcggcgcgc

SEQ ID NO: 2814326 - RNA, 20 nt, Mycobacterium avium subsp. paratuberculosis
auacagcggcgcgcgccgca

SEQ ID NO: 2814327 - RNA, 23 nt, Mycobacterium avium subsp. paratuberculosis
auacagcggcgcgcgccgcagcg

SEQ ID NO: 2814328 - RNA, 14 nt, Mycobacterium avium subsp. paratuberculosis
auaccacugcgcgc

SEQ ID NO: 2814329 - RNA, 22 nt, Mycobacterium avium subsp. paratuberculosis
auaccacugcgcgcccgagcau

SEQ ID NO: 2814330 - RNA, 14 nt, Mycobacterium avium subsp. paratuberculosis
auaccagggcgagg

SEQ ID NO: 2814331 - RNA, 16 nt, Mycobacterium avium subsp. paratuberculosis
auacccgaccagcacc

SEQ ID NO: 2814332 - RNA, 15 nt, Mycobacterium avium subsp. paratuberculosis
auacccgcgcggcgc

SEQ ID NO: 2814333 - RNA, 13 nt, Mycobacterium avium subsp. paratuberculosis
auaccggccagca

SEQ ID NO: 2814334 - RNA, 16 nt, Mycobacterium avium subsp. paratuberculosis
auaccggccagcacga

SEQ ID NO: 2814335 - RNA, 14 nt, Mycobacterium avium subsp. paratuberculosis
auaccggcccagcg

SEQ ID NO: 2814336 - RNA, 21 nt, Mycobacterium avium subsp. paratuberculosis
auaccugcguccgauaccagc

SEQ ID NO: 2814337 - RNA, 23 nt, Mycobacterium avium subsp. paratuberculosis
auacgacgggauggucucguaga

SEQ ID NO: 2814338 - RNA, 18 nt, Mycobacterium avium subsp. paratuberculosis
auacgccaucagcaccac

SEQ ID NO: 2814339 - RNA, 20 nt, Mycobacterium avium subsp. paratuberculosis
auacgccucaccccagcgcg

SEQ ID NO: 2814340 - RNA, 22 nt, Mycobacterium avium subsp. paratuberculosis
auacgccucaccccagcgcgac

SEQ ID NO: 2814341 - RNA, 15 nt, Mycobacterium avium subsp. paratuberculosis
auacucguccucccg

SEQ ID NO: 2814342 - RNA, 16 nt, Mycobacterium avium subsp. paratuberculosis
auacucguccucccgg

SEQ ID NO: 2814343 - RNA, 20 nt, Mycobacterium avium subsp. paratuberculosis
auacugcuugccgucgacgc

SEQ ID NO: 2814344 - RNA, 13 nt, Mycobacterium avium subsp. paratuberculosis
auagagcaccgcg

SEQ ID NO: 2814345 - RNA, 21 nt, Mycobacterium avium subsp. paratuberculosis
auagagcuggugggccaucgc

SEQ ID NO: 2814346 - RNA, 15 nt, Mycobacterium avium subsp. paratuberculosis
auagaucaucccggc

SEQ ID NO: 2814347 - RNA, 13 nt, Mycobacterium avium subsp. paratuberculosis
auagcacccgcuu

SEQ ID NO: 2814348 - RNA, 20 nt, Mycobacterium avium subsp. paratuberculosis
auagccaucagaacgcccgc

SEQ ID NO: 2814349 - RNA, 13 nt, Mycobacterium avium subsp. paratuberculosis
auagcccagccag

SEQ ID NO: 2814350 - RNA, 22 nt, Mycobacterium avium subsp. paratuberculosis
auagccccgccaggcggcgacg

SEQ ID NO: 2814351 - RNA, 14 nt, Mycobacterium avium subsp. paratuberculosis
auagcccgccgcgg

SEQ ID NO: 2814352 - RNA, 16 nt, Mycobacterium avium subsp. paratuberculosis
auagccgagcggcgcc

SEQ ID NO: 2814353 - RNA, 23 nt, Mycobacterium avium subsp. paratuberculosis
auagccggccgcgucgccgacca

SEQ ID NO: 2814354 - RNA, 21 nt, Mycobacterium avium subsp. paratuberculosis
auagccggugaucgcggcgcu

SEQ ID NO: 2814355 - RNA, 15 nt, Mycobacterium avium subsp. paratuberculosis
auagccgucggcgga

SEQ ID NO: 2814356 - RNA, 17 nt, Mycobacterium avium subsp. paratuberculosis
auagccgucggcggccu

SEQ ID NO: 2814357 - RNA, 22 nt, Mycobacterium avium subsp. paratuberculosis
auagccuuugccgugcucggcg

SEQ ID NO: 2814358 - RNA, 23 nt, Mycobacterium avium subsp. paratuberculosis
auagccuuugccgugcucggcgg

SEQ ID NO: 2814359 - RNA, 19 nt, Mycobacterium avium subsp. paratuberculosis
auagcgggcuaggcucggc

SEQ ID NO: 2814360 - RNA, 17 nt, Mycobacterium avium subsp. paratuberculosis
auagcucaggugcgacg

SEQ ID NO: 2814361 - RNA, 15 nt, Mycobacterium avium subsp. paratuberculosis
auagcuggcgccgaa

SEQ ID NO: 2814362 - RNA, 22 nt, Mycobacterium avium subsp. paratuberculosis
auaggacccggcgagcggcacc

SEQ ID NO: 2814363 - RNA, 13 nt, Mycobacterium avium subsp. paratuberculosis
auaggccagcgcg

SEQ ID NO: 2814364 - RNA, 22 nt, Mycobacterium avium subsp. paratuberculosis
auaguucgccgccgccagcacc

SEQ ID NO: 2814365 - RNA, 18 nt, Mycobacterium avium subsp. paratuberculosis
aucagcaccgccacgccg

SEQ ID NO: 2814366 - RNA, 13 nt, Mycobacterium avium subsp. paratuberculosis
aucagcaccgcga

SEQ ID NO: 2814367 - RNA, 14 nt, Mycobacterium avium subsp. paratuberculosis
aucagcaccgcgaa

SEQ ID NO: 2814368 - RNA, 24 nt, Mycobacterium avium subsp. paratuberculosis
aucagcaccgcgaacaucgccagc

SEQ ID NO: 2814369 - RNA, 18 nt, Mycobacterium avium subsp. paratuberculosis
aucagcaccgggugauac

SEQ ID NO: 2814370 - RNA, 19 nt, Mycobacterium avium subsp. paratuberculosis
aucagcaccgggugauacc

SEQ ID NO: 2814371 - RNA, 23 nt, Mycobacterium avium subsp. paratuberculosis
aucagcaccguccacagccggcg

SEQ ID NO: 2814372 - RNA, 13 nt, Mycobacterium avium subsp. paratuberculosis
aucagcacgucgc

SEQ ID NO: 2814373 - RNA, 22 nt, Mycobacterium avium subsp. paratuberculosis
aucagcacuucauggucgucgu

SEQ ID NO: 2814374 - RNA, 22 nt, Mycobacterium avium subsp. paratuberculosis
aucagcagaugcgcgucgcggc

SEQ ID NO: 2814375 - RNA, 11 nt, Mycobacterium avium subsp. paratuberculosis
aucagcagcac

SEQ ID NO: 2814376 - RNA, 18 nt, Mycobacterium avium subsp. paratuberculosis
aucagcagcacauccggu

SEQ ID NO: 2814377 - RNA, 19 nt, Mycobacterium avium subsp. paratuberculosis
aucagcagcacauccgguu

SEQ ID NO: 2814378 - RNA, 20 nt, Mycobacterium avium subsp. paratuberculosis
aucagcagcaccuggaucca

SEQ ID NO: 2814379 - RNA, 15 nt, Mycobacterium avium subsp. paratuberculosis
aucagcagccgggcc

SEQ ID NO: 2814380 - RNA, 16 nt, Mycobacterium avium subsp. paratuberculosis
aucagcagcgccucgc

SEQ ID NO: 2814381 - RNA, 23 nt, Mycobacterium avium subsp. paratuberculosis
aucagcagcuugaucgccggggc

SEQ ID NO: 2814382 - RNA, 23 nt, Mycobacterium avium subsp. paratuberculosis
aucagcaggcccucggccagcca

SEQ ID NO: 2814383 - RNA, 17 nt, Mycobacterium avium subsp. paratuberculosis
aucagcaggcuggcggc

SEQ ID NO: 2814384 - RNA, 20 nt, Mycobacterium avium subsp. paratuberculosis
aucagcaggcuggcggcgau

SEQ ID NO: 2814385 - RNA, 21 nt, Mycobacterium avium subsp. paratuberculosis
aucagcagguugauccgcgcg

SEQ ID NO: 2814386 - RNA, 15 nt, Mycobacterium avium subsp. paratuberculosis
aucagcagugccccg

SEQ ID NO: 2814387 - RNA, 15 nt, Mycobacterium avium subsp. paratuberculosis
aucagcaugccgguc

SEQ ID NO: 2814388 - RNA, 20 nt, Mycobacterium avium subsp. paratuberculosis
aucagcaugucgcccgcguc

SEQ ID NO: 2814389 - RNA, 22 nt, Mycobacterium avium subsp. paratuberculosis
aucagccccagggugcgccgcu

SEQ ID NO: 2814390 - RNA, 16 nt, Mycobacterium avium subsp. paratuberculosis
aucagcccgcccacca

SEQ ID NO: 2814391 - RNA, 14 nt, Mycobacterium avium subsp. paratuberculosis
aucagcccggcguc

SEQ ID NO: 2814392 - RNA, 15 nt, Mycobacterium avium subsp. paratuberculosis
aucagccgagccggg

SEQ ID NO: 2814393 - RNA, 22 nt, Mycobacterium avium subsp. paratuberculosis
aucagccgauacaugugccgau

SEQ ID NO: 2814394 - RNA, 11 nt, Mycobacterium avium subsp. paratuberculosis
aucagccgccc

SEQ ID NO: 2814395 - RNA, 12 nt, Mycobacterium avium subsp. paratuberculosis
aucagccgccgu

SEQ ID NO: 2814396 - RNA, 13 nt, Mycobacterium avium subsp. paratuberculosis
aucagccgccguc

SEQ ID NO: 2814397 - RNA, 19 nt, Mycobacterium avium subsp. paratuberculosis
aucagccgccgucgcgcca

SEQ ID NO: 2814398 - RNA, 19 nt, Mycobacterium avium subsp. paratuberculosis
aucagccggcgagcgcgcu

SEQ ID NO: 2814399 - RNA, 22 nt, Mycobacterium avium subsp. paratuberculosis
aucagccggcgagcgcgcugau

SEQ ID NO: 2814400 - RNA, 19 nt, Mycobacterium avium subsp. paratuberculosis
aucagccggguagcgccgc

SEQ ID NO: 2814401 - RNA, 15 nt, Mycobacterium avium subsp. paratuberculosis
aucagccugcgguga

SEQ ID NO: 2814402 - RNA, 17 nt, Mycobacterium avium subsp. paratuberculosis
aucagcgacaccacggu

SEQ ID NO: 2814403 - RNA, 14 nt, Mycobacterium avium subsp. paratuberculosis
aucagcgacgucag

SEQ ID NO: 2814404 - RNA, 19 nt, Mycobacterium avium subsp. paratuberculosis
aucagcgacucgaccccgc

SEQ ID NO: 2814405 - RNA, 22 nt, Mycobacterium avium subsp. paratuberculosis
aucagcgacucgaccccgccca

SEQ ID NO: 2814406 - RNA, 13 nt, Mycobacterium avium subsp. paratuberculosis
aucagcgccacca

SEQ ID NO: 2814407 - RNA, 17 nt, Mycobacterium avium subsp. paratuberculosis
aucagcgccaccagcac

SEQ ID NO: 2814408 - RNA, 15 nt, Mycobacterium avium subsp. paratuberculosis
aucagcgccagcaac

SEQ ID NO: 2814409 - RNA, 23 nt, Mycobacterium avium subsp. paratuberculosis
aucagcgccagcaacacccagcc

SEQ ID NO: 2814410 - RNA, 19 nt, Mycobacterium avium subsp. paratuberculosis
aucagcgccagguggguga

SEQ ID NO: 2814411 - RNA, 14 nt, Mycobacterium avium subsp. paratuberculosis
aucagcgcccgcgc

SEQ ID NO: 2814412 - RNA, 14 nt, Mycobacterium avium subsp. paratuberculosis
aucagcgccugguc

SEQ ID NO: 2814413 - RNA, 19 nt, Mycobacterium avium subsp. paratuberculosis
aucagcgccugguccuccc

SEQ ID NO: 2814414 - RNA, 15 nt, Mycobacterium avium subsp. paratuberculosis
aucagcgcgcacagc

SEQ ID NO: 2814415 - RNA, 12 nt, Mycobacterium avium subsp. paratuberculosis
aucagcgcgccg

SEQ ID NO: 2814416 - RNA, 14 nt, Mycobacterium avium subsp. paratuberculosis
aucagcgcgccgcc

SEQ ID NO: 2814417 - RNA, 15 nt, Mycobacterium avium subsp. paratuberculosis
aucagcgcgccgccc

SEQ ID NO: 2814418 - RNA, 16 nt, Mycobacterium avium subsp. paratuberculosis
aucagcgcgccgccca

SEQ ID NO: 2814419 - RNA, 13 nt, Mycobacterium avium subsp. paratuberculosis
aucagcgcgucga

SEQ ID NO: 2814420 - RNA, 20 nt, Mycobacterium avium subsp. paratuberculosis
aucagcggagugaccgccag

SEQ ID NO: 2814421 - RNA, 14 nt, Mycobacterium avium subsp. paratuberculosis
aucagcggcgggcc

SEQ ID NO: 2814422 - RNA, 13 nt, Mycobacterium avium subsp. paratuberculosis
aucagcggggcgu

SEQ ID NO: 2814423 - RNA, 17 nt, Mycobacterium avium subsp. paratuberculosis
aucagcggggcguccag

SEQ ID NO: 2814424 - RNA, 19 nt, Mycobacterium avium subsp. paratuberculosis
aucagcggggcguccagcg

SEQ ID NO: 2814425 - RNA, 14 nt, Mycobacterium avium subsp. paratuberculosis
aucagcguguugga

SEQ ID NO: 2814426 - RNA, 20 nt, Mycobacterium avium subsp. paratuberculosis
aucagcguguuggacgcccg

SEQ ID NO: 2814427 - RNA, 17 nt, Mycobacterium avium subsp. paratuberculosis
aucagcguuccggcggc

SEQ ID NO: 2814428 - RNA, 21 nt, Mycobacterium avium subsp. paratuberculosis
aucagcguuccggcggccggc

SEQ ID NO: 2814429 - RNA, 14 nt, Mycobacterium avium subsp. paratuberculosis
aucagcucgccgau

SEQ ID NO: 2814430 - RNA, 14 nt, Mycobacterium avium subsp. paratuberculosis
aucagcucggcagc

SEQ ID NO: 2814431 - RNA, 18 nt, Mycobacterium avium subsp. paratuberculosis
aucagcucguggcgggcc

SEQ ID NO: 2814432 - RNA, 17 nt, Mycobacterium avium subsp. paratuberculosis
aucagcugcucggccac

SEQ ID NO: 2814433 - RNA, 22 nt, Mycobacterium avium subsp. paratuberculosis
aucagcugcucggccaccgcgc

SEQ ID NO: 2814434 - RNA, 19 nt, Mycobacterium avium subsp. paratuberculosis
aucaggaucgacgucgacu

SEQ ID NO: 2814435 - RNA, 22 nt, Mycobacterium avium subsp. paratuberculosis
aucaggaucggcgggcgccgaa

SEQ ID NO: 2814436 - RNA, 15 nt, Mycobacterium avium subsp. paratuberculosis
aucaggaucugcgca

SEQ ID NO: 2814437 - RNA, 17 nt, Mycobacterium avium subsp. paratuberculosis
aucaggaugacgccgcg

SEQ ID NO: 2814438 - RNA, 20 nt, Mycobacterium avium subsp. paratuberculosis
aucaggccggccaccagguc

SEQ ID NO: 2814439 - RNA, 14 nt, Mycobacterium avium subsp. paratuberculosis
aucaggcgcagccc

SEQ ID NO: 2814440 - RNA, 21 nt, Mycobacterium avium subsp. paratuberculosis
aucaggcgcagcccgagcggc

SEQ ID NO: 2814441 - RNA, 14 nt, Mycobacterium avium subsp. paratuberculosis
aucaggcggccggc

SEQ ID NO: 2814442 - RNA, 15 nt, Mycobacterium avium subsp. paratuberculosis
aucaggcggccggcc

SEQ ID NO: 2814443 - RNA, 16 nt, Mycobacterium avium subsp. paratuberculosis
aucaggcggccggccc

SEQ ID NO: 2814444 - RNA, 23 nt, Mycobacterium avium subsp. paratuberculosis
aucaggcggucgaacgcggcgcc

SEQ ID NO: 2814445 - RNA, 22 nt, Mycobacterium avium subsp. paratuberculosis
aucaggcugccgcugcgccggc

SEQ ID NO: 2814446 - RNA, 19 nt, Mycobacterium avium subsp. paratuberculosis
aucagggcccacagcagcc

SEQ ID NO: 2814447 - RNA, 20 nt, Mycobacterium avium subsp. paratuberculosis
aucagggccgcggccgccgc

SEQ ID NO: 2814448 - RNA, 14 nt, Mycobacterium avium subsp. paratuberculosis
aucagggcggcgcg

SEQ ID NO: 2814449 - RNA, 19 nt, Mycobacterium avium subsp. paratuberculosis
aucagggcggcgcgcgcca

SEQ ID NO: 2814450 - RNA, 23 nt, Mycobacterium avium subsp. paratuberculosis
auccgcgccgaacgcaccaccgc

SEQ ID NO: 2814451 - RNA, 16 nt, Mycobacterium avium subsp. paratuberculosis
auccgcgccgcgaugc

SEQ ID NO: 2814452 - RNA, 17 nt, Mycobacterium avium subsp. paratuberculosis
auccgcgcggccaccag

SEQ ID NO: 2814453 - RNA, 15 nt, Mycobacterium avium subsp. paratuberculosis
auccgcgggccggca

SEQ ID NO: 2814454 - RNA, 21 nt, Mycobacterium avium subsp. paratuberculosis
auccgcggguacggucggccg

SEQ ID NO: 2814455 - RNA, 22 nt, Mycobacterium avium subsp. paratuberculosis
auccgcggguacggucggccgu

SEQ ID NO: 2814456 - RNA, 13 nt, Mycobacterium avium subsp. paratuberculosis
auccgcggucgac

SEQ ID NO: 2814457 - RNA, 15 nt, Mycobacterium avium subsp. paratuberculosis
auccgcggucgacca

SEQ ID NO: 2814458 - RNA, 15 nt, Mycobacterium avium subsp. paratuberculosis
auccgcucgccgcgg

SEQ ID NO: 2814459 - RNA, 14 nt, Mycobacterium avium subsp. paratuberculosis
auccgcucgccguc

SEQ ID NO: 2814460 - RNA, 15 nt, Mycobacterium avium subsp. paratuberculosis
auccgcuggugcgcg

SEQ ID NO: 2814461 - RNA, 20 nt, Mycobacterium avium subsp. paratuberculosis
auccgcuggugcgcgccggc

SEQ ID NO: 2814462 - RNA, 22 nt, Mycobacterium avium subsp. paratuberculosis
auccggaacacgugauccaggu

SEQ ID NO: 2814463 - RNA, 16 nt, Mycobacterium avium subsp. paratuberculosis
auccggaucgggcggu

SEQ ID NO: 2814464 - RNA, 20 nt, Mycobacterium avium subsp. paratuberculosis
auccggcacugaaggcgcgg

SEQ ID NO: 2814465 - RNA, 22 nt, Mycobacterium avium subsp. paratuberculosis
auccggcacugaaggcgcgggc

SEQ ID NO: 2814466 - RNA, 16 nt, Mycobacterium avium subsp. paratuberculosis
auccggcagcgcucgu

SEQ ID NO: 2814467 - RNA, 13 nt, Mycobacterium avium subsp. paratuberculosis
auccggccgcgga

SEQ ID NO: 2814468 - RNA, 13 nt, Mycobacterium avium subsp. paratuberculosis
auccggccgcugg

SEQ ID NO: 2814469 - RNA, 14 nt, Mycobacterium avium subsp. paratuberculosis
auccggccggcggc

SEQ ID NO: 2814470 - RNA, 16 nt, Mycobacterium avium subsp. paratuberculosis
auccggccggcggcgg

SEQ ID NO: 2814471 - RNA, 17 nt, Mycobacterium avium subsp. paratuberculosis
auccggccggcggcggu

SEQ ID NO: 2814472 - RNA, 14 nt, Mycobacterium avium subsp. paratuberculosis
auccggcgcccgau

SEQ ID NO: 2814473 - RNA, 13 nt, Mycobacterium avium subsp. paratuberculosis
auccggcgccgcg

SEQ ID NO: 2814474 - RNA, 19 nt, Mycobacterium avium subsp. paratuberculosis
auccggcgccgcgggcgcc

SEQ ID NO: 2814475 - RNA, 17 nt, Mycobacterium avium subsp. paratuberculosis
auccggcgcgccgcgau

SEQ ID NO: 2814476 - RNA, 20 nt, Mycobacterium avium subsp. paratuberculosis
auccggcgcguuccaucagc

SEQ ID NO: 2814477 - RNA, 21 nt, Mycobacterium avium subsp. paratuberculosis
auccggcggcgcucagcgcgg

SEQ ID NO: 2814478 - RNA, 23 nt, Mycobacterium avium subsp. paratuberculosis
auccggcggcgcucagcgcggcg

SEQ ID NO: 2814479 - RNA, 19 nt, Mycobacterium avium subsp. paratuberculosis
auccggcgucucagucggc

SEQ ID NO: 2814480 - RNA, 18 nt, Mycobacterium avium subsp. paratuberculosis
auccggcuccacagcagu

SEQ ID NO: 2814481 - RNA, 13 nt, Mycobacterium avium subsp. paratuberculosis
auccggcugagca

SEQ ID NO: 2814482 - RNA, 20 nt, Mycobacterium avium subsp. paratuberculosis
auccggcugagcagcucgcg

SEQ ID NO: 2814483 - RNA, 18 nt, Mycobacterium avium subsp. paratuberculosis
auccgggaggccagcacc

SEQ ID NO: 2814484 - RNA, 20 nt, Mycobacterium avium subsp. paratuberculosis
auccgggccaccaccacggc

SEQ ID NO: 2814485 - RNA, 14 nt, Mycobacterium avium subsp. paratuberculosis
auccgggccgccgc

SEQ ID NO: 2814486 - RNA, 16 nt, Mycobacterium avium subsp. paratuberculosis
auccgggccgccgcgg

SEQ ID NO: 2814487 - RNA, 17 nt, Mycobacterium avium subsp. paratuberculosis
auccgggccgccgcgga

SEQ ID NO: 2814488 - RNA, 13 nt, Mycobacterium avium subsp. paratuberculosis
auccgggccggcg

SEQ ID NO: 2814489 - RNA, 15 nt, Mycobacterium avium subsp. paratuberculosis
auccgggcgcggaug

SEQ ID NO: 2814490 - RNA, 13 nt, Mycobacterium avium subsp. paratuberculosis
auccgggcggcca

SEQ ID NO: 2814491 - RNA, 17 nt, Mycobacterium avium subsp. paratuberculosis
auccgggcggccagccg

SEQ ID NO: 2814492 - RNA, 16 nt, Mycobacterium avium subsp. paratuberculosis
auccggggucagggcg

SEQ ID NO: 2814493 - RNA, 18 nt, Mycobacterium avium subsp. paratuberculosis
auccggggucagggcgcu

SEQ ID NO: 2814494 - RNA, 13 nt, Mycobacterium avium subsp. paratuberculosis
auccgggugucga

SEQ ID NO: 2814495 - RNA, 20 nt, Mycobacterium avium subsp. paratuberculosis
auccgguaccagaucgagcu

SEQ ID NO: 2814496 - RNA, 19 nt, Mycobacterium avium subsp. paratuberculosis
auccgguagaagaccaccu

SEQ ID NO: 2814497 - RNA, 18 nt, Mycobacterium avium subsp. paratuberculosis
auccggucagcgccagca

SEQ ID NO: 2814498 - RNA, 22 nt, Mycobacterium avium subsp. paratuberculosis
auccggucauccucgccgcgcc

SEQ ID NO: 2814499 - RNA, 23 nt, Mycobacterium avium subsp. paratuberculosis
auccggucauccucgccgcgcca

SEQ ID NO: 2814500 - RNA, 19 nt, Mycobacterium avium subsp. paratuberculosis
auccgguccagaucggcgc

SEQ ID NO: 2814501 - RNA, 14 nt, Mycobacterium avium subsp. paratuberculosis
auccggucgaugaa

SEQ ID NO: 2814502 - RNA, 12 nt, Mycobacterium avium subsp. paratuberculosis
auccggugaccg

SEQ ID NO: 2814503 - RNA, 19 nt, Mycobacterium avium subsp. paratuberculosis
auccggugaccgcgacgcu

SEQ ID NO: 2814504 - RNA, 15 nt, Mycobacterium avium subsp. paratuberculosis
auccggugccgagcg

SEQ ID NO: 2814505 - RNA, 16 nt, Mycobacterium avium subsp. paratuberculosis
auccgucgccccgcac

SEQ ID NO: 2814506 - RNA, 17 nt, Mycobacterium avium subsp. paratuberculosis
auccgucgccccgcacc

SEQ ID NO: 2814507 - RNA, 20 nt, Mycobacterium avium subsp. paratuberculosis
auccucagcacggccgcggc

SEQ ID NO: 2814508 - RNA, 17 nt, Mycobacterium avium subsp. paratuberculosis
auccucagcagcuagcc

SEQ ID NO: 2814509 - RNA, 22 nt, Mycobacterium avium subsp. paratuberculosis
auccucagcagcuagcccagaa

SEQ ID NO: 2814510 - RNA, 13 nt, Mycobacterium avium subsp. paratuberculosis
auccucgccgcgc

SEQ ID NO: 2814511 - RNA, 14 nt, Mycobacterium avium subsp. paratuberculosis
auccucgccgcggg

SEQ ID NO: 2814512 - RNA, 19 nt, Mycobacterium avium subsp. paratuberculosis
auccucgccgcgggccagc

SEQ ID NO: 2814513 - RNA, 14 nt, Mycobacterium avium subsp. paratuberculosis
auccugcccggucu

SEQ ID NO: 2814514 - RNA, 17 nt, Mycobacterium avium subsp. paratuberculosis
auccugcuggccgggcu

SEQ ID NO: 2814515 - RNA, 23 nt, Mycobacterium avium subsp. paratuberculosis
auccuggccgauggucagcugcc

SEQ ID NO: 2814516 - RNA, 22 nt, Mycobacterium avium subsp. paratuberculosis
auccuggccuggucggccggca

SEQ ID NO: 2814517 - RNA, 20 nt, Mycobacterium avium subsp. paratuberculosis
auccugguccggcgcccgau

SEQ ID NO: 2814518 - RNA, 17 nt, Mycobacterium avium subsp. paratuberculosis
auccuguuccccggcgg

SEQ ID NO: 2814519 - RNA, 19 nt, Mycobacterium avium subsp. paratuberculosis
aucgaacagggcggcgggc

SEQ ID NO: 2814520 - RNA, 20 nt, Mycobacterium avium subsp. paratuberculosis
aucgaacagggcggcgggcc

SEQ ID NO: 2814521 - RNA, 13 nt, Mycobacterium avium subsp. paratuberculosis
aucgaaccgccgc

SEQ ID NO: 2814522 - RNA, 16 nt, Mycobacterium avium subsp. paratuberculosis
aucgaaccgccgcgcu

SEQ ID NO: 2814523 - RNA, 20 nt, Mycobacterium avium subsp. paratuberculosis
aucgaacggcggaaccgggc

SEQ ID NO: 2814524 - RNA, 17 nt, Mycobacterium avium subsp. paratuberculosis
aucgaaggccaggugca

SEQ ID NO: 2814525 - RNA, 16 nt, Mycobacterium avium subsp. paratuberculosis
aucgaaugcagcggcu

SEQ ID NO: 2814526 - RNA, 12 nt, Mycobacterium avium subsp. paratuberculosis
aucgacaccucg

SEQ ID NO: 2814527 - RNA, 22 nt, Mycobacterium avium subsp. paratuberculosis
aucgacagguucuuggcggccu

SEQ ID NO: 2814528 - RNA, 17 nt, Mycobacterium avium subsp. paratuberculosis
aucgacaugcccggcga

SEQ ID NO: 2814529 - RNA, 15 nt, Mycobacterium avium subsp. paratuberculosis
aucgacccccaccgc

SEQ ID NO: 2814530 - RNA, 18 nt, Mycobacterium avium subsp. paratuberculosis
aucgacccccaccgcgac

SEQ ID NO: 2814531 - RNA, 19 nt, Mycobacterium avium subsp. paratuberculosis
aucgacccccaccgcgaca

SEQ ID NO: 2814532 - RNA, 19 nt, Mycobacterium avium subsp. paratuberculosis
aucgacgacgccagcugcc

SEQ ID NO: 2814533 - RNA, 15 nt, Mycobacterium avium subsp. paratuberculosis
aucgacgagccgggc

SEQ ID NO: 2814534 - RNA, 15 nt, Mycobacterium avium subsp. paratuberculosis
aucgacgccaugggc

SEQ ID NO: 2814535 - RNA, 16 nt, Mycobacterium avium subsp. paratuberculosis
aucgccaucagcagcg

SEQ ID NO: 2814536 - RNA, 17 nt, Mycobacterium avium subsp. paratuberculosis
aucgcccaacaacucga

SEQ ID NO: 2814537 - RNA, 18 nt, Mycobacterium avium subsp. paratuberculosis
aucgcccaacaacucgac

SEQ ID NO: 2814538 - RNA, 16 nt, Mycobacterium avium subsp. paratuberculosis
aucgcccagcaccgcg

SEQ ID NO: 2814539 - RNA, 17 nt, Mycobacterium avium subsp. paratuberculosis
aucgcccagcaccgcga

SEQ ID NO: 2814540 - RNA, 18 nt, Mycobacterium avium subsp. paratuberculosis
aucgcccagcaccgcgac

SEQ ID NO: 2814541 - RNA, 13 nt, Mycobacterium avium subsp. paratuberculosis
aucgcccagcgca

SEQ ID NO: 2814542 - RNA, 15 nt, Mycobacterium avium subsp. paratuberculosis
aucgcccagcgcagc

SEQ ID NO: 2814543 - RNA, 18 nt, Mycobacterium avium subsp. paratuberculosis
aucgcccaucaccgcacc

SEQ ID NO: 2814544 - RNA, 22 nt, Mycobacterium avium subsp. paratuberculosis
aucgcccaucaccgcaccgacg

SEQ ID NO: 2814545 - RNA, 14 nt, Mycobacterium avium subsp. paratuberculosis
aucgcccauuugcc

SEQ ID NO: 2814546 - RNA, 15 nt, Mycobacterium avium subsp. paratuberculosis
aucgccccaggcgga

SEQ ID NO: 2814547 - RNA, 21 nt, Mycobacterium avium subsp. paratuberculosis
aucgccccgcuggaacgccga

SEQ ID NO: 2814548 - RNA, 13 nt, Mycobacterium avium subsp. paratuberculosis
aucgccccggaga

SEQ ID NO: 2814549 - RNA, 18 nt, Mycobacterium avium subsp. paratuberculosis
aucgccccggcgacgucg

SEQ ID NO: 2814550 - RNA, 12 nt, Mycobacterium avium subsp. paratuberculosis
aucgcccgccgc

SEQ ID NO: 2814551 - RNA, 16 nt, Mycobacterium avium subsp. paratuberculosis
aucgcccgccgcgagc

SEQ ID NO: 2814552 - RNA, 18 nt, Mycobacterium avium subsp. paratuberculosis
aucgcccgcuccgcgggc

SEQ ID NO: 2814553 - RNA, 21 nt, Mycobacterium avium subsp. paratuberculosis
aucgcccgcuccgcgggcagc

SEQ ID NO: 2814554 - RNA, 17 nt, Mycobacterium avium subsp. paratuberculosis
aucgcccgcuccgcggu

SEQ ID NO: 2814555 - RNA, 20 nt, Mycobacterium avium subsp. paratuberculosis
aucgcccgcuccgcggugcu

SEQ ID NO: 2814556 - RNA, 13 nt, Mycobacterium avium subsp. paratuberculosis
aucgcccggcgcc

SEQ ID NO: 2814557 - RNA, 14 nt, Mycobacterium avium subsp. paratuberculosis
aucgcccggcgccc

SEQ ID NO: 2814558 - RNA, 16 nt, Mycobacterium avium subsp. paratuberculosis
aucgcccgggcggcgg

SEQ ID NO: 2814559 - RNA, 18 nt, Mycobacterium avium subsp. paratuberculosis
aucgcccgggcggcgggg

SEQ ID NO: 2814560 - RNA, 20 nt, Mycobacterium avium subsp. paratuberculosis
aucgcccgggcggcggggcu

SEQ ID NO: 2814561 - RNA, 20 nt, Mycobacterium avium subsp. paratuberculosis
aucgcccgguaggccgccgc

SEQ ID NO: 2814562 - RNA, 18 nt, Mycobacterium avium subsp. paratuberculosis
aucgcccgguccaucccg

SEQ ID NO: 2814563 - RNA, 12 nt, Mycobacterium avium subsp. paratuberculosis
aucgcccggugc

SEQ ID NO: 2814564 - RNA, 22 nt, Mycobacterium avium subsp. paratuberculosis
aucgcccggugcgccagcguga

SEQ ID NO: 2814565 - RNA, 16 nt, Mycobacterium avium subsp. paratuberculosis
aucgccgaaccgggcg

SEQ ID NO: 2814566 - RNA, 23 nt, Mycobacterium avium subsp. paratuberculosis
aucgccgaaccgggcgcgcagau

SEQ ID NO: 2814567 - RNA, 17 nt, Mycobacterium avium subsp. paratuberculosis
aucgccgaacgccucga

SEQ ID NO: 2814568 - RNA, 18 nt, Mycobacterium avium subsp. paratuberculosis
aucgccgacgccagcacg

SEQ ID NO: 2814569 - RNA, 13 nt, Mycobacterium avium subsp. paratuberculosis
aucgccgacgucu

SEQ ID NO: 2814570 - RNA, 15 nt, Mycobacterium avium subsp. paratuberculosis
aucgccgagcgcauc

SEQ ID NO: 2814571 - RNA, 19 nt, Mycobacterium avium subsp. paratuberculosis
aucgccgagguagccgcgc

SEQ ID NO: 2814572 - RNA, 20 nt, Mycobacterium avium subsp. paratuberculosis
aucgccgagguagccgcgca

SEQ ID NO: 2814573 - RNA, 17 nt, Mycobacterium avium subsp. paratuberculosis
aucgccgauccggcgcc

SEQ ID NO: 2814574 - RNA, 23 nt, Mycobacterium avium subsp. paratuberculosis
aucgccgauccggcgccgcgggc

SEQ ID NO: 2814575 - RNA, 15 nt, Mycobacterium avium subsp. paratuberculosis
aucgccgccaucgcc

SEQ ID NO: 2814576 - RNA, 20 nt, Mycobacterium avium subsp. paratuberculosis
aucgccgccaucgccgccgc

SEQ ID NO: 2814577 - RNA, 24 nt, Mycobacterium avium subsp. paratuberculosis
aucgccgccaucgccgccgccauc

SEQ ID NO: 2814578 - RNA, 18 nt, Mycobacterium avium subsp. paratuberculosis
aucgccgcccaucggcag

SEQ ID NO: 2814579 - RNA, 17 nt, Mycobacterium avium subsp. paratuberculosis
aucgccgcgcacccggc

SEQ ID NO: 2814580 - RNA, 16 nt, Mycobacterium avium subsp. paratuberculosis
aucgccgcgcccagca

SEQ ID NO: 2814581 - RNA, 20 nt, Mycobacterium avium subsp. paratuberculosis
aucgccgcggaccccagcgu

SEQ ID NO: 2814582 - RNA, 16 nt, Mycobacterium avium subsp. paratuberculosis
aucgccgcggugcgcg

SEQ ID NO: 2814583 - RNA, 13 nt, Mycobacterium avium subsp. paratuberculosis
aucgccggacagc

SEQ ID NO: 2814584 - RNA, 17 nt, Mycobacterium avium subsp. paratuberculosis
aucgccggacagcgggc

SEQ ID NO: 2814585 - RNA, 18 nt, Mycobacterium avium subsp. paratuberculosis
aucgccggacagcgggcc

SEQ ID NO: 2814586 - RNA, 17 nt, Mycobacterium avium subsp. paratuberculosis
aucgccggaucgagcac

SEQ ID NO: 2814587 - RNA, 19 nt, Mycobacterium avium subsp. paratuberculosis
aucgccggaucgagcaccc

SEQ ID NO: 2814588 - RNA, 16 nt, Mycobacterium avium subsp. paratuberculosis
aucgccggaucgccga

SEQ ID NO: 2814589 - RNA, 19 nt, Mycobacterium avium subsp. paratuberculosis
aucgccggaucgccgaggu

SEQ ID NO: 2814590 - RNA, 16 nt, Mycobacterium avium subsp. paratuberculosis
aucgccggcgaccgug

SEQ ID NO: 2814591 - RNA, 17 nt, Mycobacterium avium subsp. paratuberculosis
aucgccggcgcgcugaa

SEQ ID NO: 2814592 - RNA, 20 nt, Mycobacterium avium subsp. paratuberculosis
aucgccgggauauucgccca

SEQ ID NO: 2814593 - RNA, 19 nt, Mycobacterium avium subsp. paratuberculosis
aucgccgggauggugagcc

SEQ ID NO: 2814594 - RNA, 13 nt, Mycobacterium avium subsp. paratuberculosis
aucgccggggauc

SEQ ID NO: 2814595 - RNA, 19 nt, Mycobacterium avium subsp. paratuberculosis
aucgccggggcgcugagca

SEQ ID NO: 2814596 - RNA, 21 nt, Mycobacterium avium subsp. paratuberculosis
aucgccgggucgcacgccggu

SEQ ID NO: 2814597 - RNA, 19 nt, Mycobacterium avium subsp. paratuberculosis
aucgccggugcggccgcga

SEQ ID NO: 2814598 - RNA, 21 nt, Mycobacterium avium subsp. paratuberculosis
aucgccgucacguagcgcggc

SEQ ID NO: 2814599 - RNA, 14 nt, Mycobacterium avium subsp. paratuberculosis
aucgccguccacgg

SEQ ID NO: 2814600 - RNA, 22 nt, Mycobacterium avium subsp. paratuberculosis
aucgccguccacgggucgccgu

SEQ ID NO: 2814601 - RNA, 13 nt, Mycobacterium avium subsp. paratuberculosis
aucgccgucgcca

SEQ ID NO: 2814602 - RNA, 14 nt, Mycobacterium avium subsp. paratuberculosis
aucgccgugagauc

SEQ ID NO: 2814603 - RNA, 22 nt, Mycobacterium avium subsp. paratuberculosis
aucgccgugagauccagcagcc

SEQ ID NO: 2814604 - RNA, 23 nt, Mycobacterium avium subsp. paratuberculosis
aucgccgugagauccagcagcca

SEQ ID NO: 2814605 - RNA, 17 nt, Mycobacterium avium subsp. paratuberculosis
aucgccucgaccaggcu

SEQ ID NO: 2814606 - RNA, 14 nt, Mycobacterium avium subsp. paratuberculosis
aucgccucggccgc

SEQ ID NO: 2814607 - RNA, 17 nt, Mycobacterium avium subsp. paratuberculosis
aucgccucggcggccgc

SEQ ID NO: 2814608 - RNA, 21 nt, Mycobacterium avium subsp. paratuberculosis
aucgccucggcggccgcccgg

SEQ ID NO: 2814609 - RNA, 19 nt, Mycobacterium avium subsp. paratuberculosis
aucgccucggucgcgugac

SEQ ID NO: 2814610 - RNA, 18 nt, Mycobacterium avium subsp. paratuberculosis
aucgccugagcaaccggu

SEQ ID NO: 2814611 - RNA, 16 nt, Mycobacterium avium subsp. paratuberculosis
aucgccuguccgacca

SEQ ID NO: 2814612 - RNA, 15 nt, Mycobacterium avium subsp. paratuberculosis
aucgccuuggcucgg

SEQ ID NO: 2814613 - RNA, 19 nt, Mycobacterium avium subsp. paratuberculosis
aucgccuuggcucgggcca

SEQ ID NO: 2814614 - RNA, 15 nt, Mycobacterium avium subsp. paratuberculosis
aucgcgaacgcgccg

SEQ ID NO: 2814615 - RNA, 17 nt, Mycobacterium avium subsp. paratuberculosis
aucgcgaacgcgccggu

SEQ ID NO: 2814616 - RNA, 19 nt, Mycobacterium avium subsp. paratuberculosis
aucgcgaagaccagcgugu

SEQ ID NO: 2814617 - RNA, 22 nt, Mycobacterium avium subsp. paratuberculosis
aucgcgaaguagacgagcucac

SEQ ID NO: 2814618 - RNA, 16 nt, Mycobacterium avium subsp. paratuberculosis
aucgcgaccaccggcc

SEQ ID NO: 2814619 - RNA, 18 nt, Mycobacterium avium subsp. paratuberculosis
aucgcgacggccggggcc

SEQ ID NO: 2814620 - RNA, 23 nt, Mycobacterium avium subsp. paratuberculosis
aucggauggugcccaccgggcag

SEQ ID NO: 2814621 - RNA, 17 nt, Mycobacterium avium subsp. paratuberculosis
aucggauucggguggcg

SEQ ID NO: 2814622 - RNA, 22 nt, Mycobacterium avium subsp. paratuberculosis
aucggauucggguggcgucgcc

SEQ ID NO: 2814623 - RNA, 17 nt, Mycobacterium avium subsp. paratuberculosis
aucggauucgucgguca

SEQ ID NO: 2814624 - RNA, 14 nt, Mycobacterium avium subsp. paratuberculosis
aucggcacgccggg

SEQ ID NO: 2814625 - RNA, 15 nt, Mycobacterium avium subsp. paratuberculosis
aucggcacgucgagc

SEQ ID NO: 2814626 - RNA, 16 nt, Mycobacterium avium subsp. paratuberculosis
aucggcacgucgagca

SEQ ID NO: 2814627 - RNA, 16 nt, Mycobacterium avium subsp. paratuberculosis
aucggcagcccggagg

SEQ ID NO: 2814628 - RNA, 15 nt, Mycobacterium avium subsp. paratuberculosis
aucggcagcgccaac

SEQ ID NO: 2814629 - RNA, 16 nt, Mycobacterium avium subsp. paratuberculosis
aucggcagcgcgcccu

SEQ ID NO: 2814630 - RNA, 15 nt, Mycobacterium avium subsp. paratuberculosis
aucggcagcgcguug

SEQ ID NO: 2814631 - RNA, 23 nt, Mycobacterium avium subsp. paratuberculosis
aucggcaggauccggucgaucac

SEQ ID NO: 2814632 - RNA, 12 nt, Mycobacterium avium subsp. paratuberculosis
aucggcaggucg

SEQ ID NO: 2814633 - RNA, 17 nt, Mycobacterium avium subsp. paratuberculosis
aucggcaggucgucgac

SEQ ID NO: 2814634 - RNA, 19 nt, Mycobacterium avium subsp. paratuberculosis
aucggcaggucgucgacgu

SEQ ID NO: 2814635 - RNA, 18 nt, Mycobacterium avium subsp. paratuberculosis
aucggcaguccgcgccgg

SEQ ID NO: 2814636 - RNA, 19 nt, Mycobacterium avium subsp. paratuberculosis
aucggcaguccgcgccggu

SEQ ID NO: 2814637 - RNA, 20 nt, Mycobacterium avium subsp. paratuberculosis
aucggcaucgcgcgcggcga

SEQ ID NO: 2814638 - RNA, 21 nt, Mycobacterium avium subsp. paratuberculosis
aucggcaucgcgcgcggcgac

SEQ ID NO: 2814639 - RNA, 21 nt, Mycobacterium avium subsp. paratuberculosis
aucggcaugacgcccagcugc

SEQ ID NO: 2814640 - RNA, 15 nt, Mycobacterium avium subsp. paratuberculosis
aucggccagccacgc

SEQ ID NO: 2814641 - RNA, 15 nt, Mycobacterium avium subsp. paratuberculosis
aucggccagcgcggc

SEQ ID NO: 2814642 - RNA, 18 nt, Mycobacterium avium subsp. paratuberculosis
aucggccaggcgcccagc

SEQ ID NO: 2814643 - RNA, 18 nt, Mycobacterium avium subsp. paratuberculosis
aucggcccccgggcccga

SEQ ID NO: 2814644 - RNA, 19 nt, Mycobacterium avium subsp. paratuberculosis
aucggcccccgggcccgaa

SEQ ID NO: 2814645 - RNA, 21 nt, Mycobacterium avium subsp. paratuberculosis
aucggcccgaucucgcgcggg

SEQ ID NO: 2814646 - RNA, 23 nt, Mycobacterium avium subsp. paratuberculosis
aucggcccgaucucgcgcggguc

SEQ ID NO: 2814647 - RNA, 13 nt, Mycobacterium avium subsp. paratuberculosis
aucggcccggcca

SEQ ID NO: 2814648 - RNA, 14 nt, Mycobacterium avium subsp. paratuberculosis
aucggcccggccaa

SEQ ID NO: 2814649 - RNA, 22 nt, Mycobacterium avium subsp. paratuberculosis
aucggcccggccaacgggaaga

SEQ ID NO: 2814650 - RNA, 18 nt, Mycobacterium avium subsp. paratuberculosis
aucggccgcaagcgaagc

SEQ ID NO: 2814651 - RNA, 13 nt, Mycobacterium avium subsp. paratuberculosis
aucggccgcgggg

SEQ ID NO: 2814652 - RNA, 18 nt, Mycobacterium avium subsp. paratuberculosis
aucggccgcggggccggc

SEQ ID NO: 2814653 - RNA, 21 nt, Mycobacterium avium subsp. paratuberculosis
aucggccgcggggccggcgcu

SEQ ID NO: 2814654 - RNA, 22 nt, Mycobacterium avium subsp. paratuberculosis
aucggccgcggggccggcgcug

SEQ ID NO: 2814655 - RNA, 16 nt, Mycobacterium avium subsp. paratuberculosis
aucggccgcgucgggc

SEQ ID NO: 2814656 - RNA, 16 nt, Mycobacterium avium subsp. paratuberculosis
aucggccgcugcccgg

SEQ ID NO: 2814657 - RNA, 16 nt, Mycobacterium avium subsp. paratuberculosis
aucggccgcugcgggc

SEQ ID NO: 2814658 - RNA, 23 nt, Mycobacterium avium subsp. paratuberculosis
aucggccgcugcgggcgggccgc

SEQ ID NO: 2814659 - RNA, 20 nt, Mycobacterium avium subsp. paratuberculosis
aucggccgggucgcaggcag

SEQ ID NO: 2814660 - RNA, 22 nt, Mycobacterium avium subsp. paratuberculosis
aucggccgggucgcaggcagca

SEQ ID NO: 2814661 - RNA, 14 nt, Mycobacterium avium subsp. paratuberculosis
aucggcgacgccgc

SEQ ID NO: 2814662 - RNA, 15 nt, Mycobacterium avium subsp. paratuberculosis
aucggcgacgccgcc

SEQ ID NO: 2814663 - RNA, 17 nt, Mycobacterium avium subsp. paratuberculosis
aucggcgacgccgccgu

SEQ ID NO: 2814664 - RNA, 18 nt, Mycobacterium avium subsp. paratuberculosis
aucggcgacgccgccguc

SEQ ID NO: 2814665 - RNA, 16 nt, Mycobacterium avium subsp. paratuberculosis
aucggcgagugcaccu

SEQ ID NO: 2814666 - RNA, 16 nt, Mycobacterium avium subsp. paratuberculosis
aucggcgccacgacca

SEQ ID NO: 2814667 - RNA, 15 nt, Mycobacterium avium subsp. paratuberculosis
aucggcgcccaccgc

SEQ ID NO: 2814668 - RNA, 16 nt, Mycobacterium avium subsp. paratuberculosis
aucggcgcccaccgcg

SEQ ID NO: 2814669 - RNA, 20 nt, Mycobacterium avium subsp. paratuberculosis
aucggcgcccaccgcggcgc

SEQ ID NO: 2814670 - RNA, 21 nt, Mycobacterium avium subsp. paratuberculosis
aucggcgcccaccgcggcgcg

SEQ ID NO: 2814671 - RNA, 21 nt, Mycobacterium avium subsp. paratuberculosis
aucggcgccgaauucgguugu

SEQ ID NO: 2814672 - RNA, 14 nt, Mycobacterium avium subsp. paratuberculosis
aucggcgccgacgg

SEQ ID NO: 2814673 - RNA, 17 nt, Mycobacterium avium subsp. paratuberculosis
aucggcgccugcgagca

SEQ ID NO: 2814674 - RNA, 19 nt, Mycobacterium avium subsp. paratuberculosis
aucggcgcgaagucgagca

SEQ ID NO: 2814675 - RNA, 13 nt, Mycobacterium avium subsp. paratuberculosis
aucggcgcgccga

SEQ ID NO: 2814676 - RNA, 14 nt, Mycobacterium avium subsp. paratuberculosis
aucggcgcgccgaa

SEQ ID NO: 2814677 - RNA, 13 nt, Mycobacterium avium subsp. paratuberculosis
aucggcgcgcggg

SEQ ID NO: 2814678 - RNA, 12 nt, Mycobacterium avium subsp. paratuberculosis
aucggcgcgucg

SEQ ID NO: 2814679 - RNA, 14 nt, Mycobacterium avium subsp. paratuberculosis
aucggcgcgucggc

SEQ ID NO: 2814680 - RNA, 14 nt, Mycobacterium avium subsp. paratuberculosis
aucggcggaacccg

SEQ ID NO: 2814681 - RNA, 22 nt, Mycobacterium avium subsp. paratuberculosis
aucggcggaagcucaucgaggu

SEQ ID NO: 2814682 - RNA, 21 nt, Mycobacterium avium subsp. paratuberculosis
aucggcggccaccagccggcc

SEQ ID NO: 2814683 - RNA, 23 nt, Mycobacterium avium subsp. paratuberculosis
aucggcggccaccagccggccgg

SEQ ID NO: 2814684 - RNA, 13 nt, Mycobacterium avium subsp. paratuberculosis
aucggcggccugc

SEQ ID NO: 2814685 - RNA, 19 nt, Mycobacterium avium subsp. paratuberculosis
aucggcggccugcggcggc

SEQ ID NO: 2814686 - RNA, 15 nt, Mycobacterium avium subsp. paratuberculosis
aucggcggcgacggc

SEQ ID NO: 2814687 - RNA, 17 nt, Mycobacterium avium subsp. paratuberculosis
aucggcggcucgccggc

SEQ ID NO: 2814688 - RNA, 18 nt, Mycobacterium avium subsp. paratuberculosis
aucggcgggacccgcgac

SEQ ID NO: 2814689 - RNA, 16 nt, Mycobacterium avium subsp. paratuberculosis
aucggcgggcgccgaa

SEQ ID NO: 2814690 - RNA, 19 nt, Mycobacterium avium subsp. paratuberculosis
aucggcgggugcgggcgcu

SEQ ID NO: 2814691 - RNA, 21 nt, Mycobacterium avium subsp. paratuberculosis
aucggcggucccgugcgccgc

SEQ ID NO: 2814692 - RNA, 16 nt, Mycobacterium avium subsp. paratuberculosis
aucggcgguccgccgc

SEQ ID NO: 2814693 - RNA, 19 nt, Mycobacterium avium subsp. paratuberculosis
aucggcgguccgccgcagc

SEQ ID NO: 2814694 - RNA, 21 nt, Mycobacterium avium subsp. paratuberculosis
aucggcgugaauccucagcac

SEQ ID NO: 2814695 - RNA, 17 nt, Mycobacterium avium subsp. paratuberculosis
aucggcguuggcggcgu

SEQ ID NO: 2814696 - RNA, 20 nt, Mycobacterium avium subsp. paratuberculosis
aucggcguuggcggcgucga

SEQ ID NO: 2814697 - RNA, 22 nt, Mycobacterium avium subsp. paratuberculosis
aucggcguuggcggcgucgagu

SEQ ID NO: 2814698 - RNA, 19 nt, Mycobacterium avium subsp. paratuberculosis
aucggcucaccgaacgcga

SEQ ID NO: 2814699 - RNA, 21 nt, Mycobacterium avium subsp. paratuberculosis
aucggcuccagcgcccgccgc

SEQ ID NO: 2814700 - RNA, 17 nt, Mycobacterium avium subsp. paratuberculosis
aucggcucgagcucguc

SEQ ID NO: 2814701 - RNA, 19 nt, Mycobacterium avium subsp. paratuberculosis
aucggcucggcgccccacg

SEQ ID NO: 2814702 - RNA, 22 nt, Mycobacterium avium subsp. paratuberculosis
aucggcucggcgccccacgccu

SEQ ID NO: 2814703 - RNA, 14 nt, Mycobacterium avium subsp. paratuberculosis
aucggcugcgggcc

SEQ ID NO: 2814704 - RNA, 18 nt, Mycobacterium avium subsp. paratuberculosis
aucucaccggcggcggcc

SEQ ID NO: 2814705 - RNA, 15 nt, Mycobacterium avium subsp. paratuberculosis
aucuccaccgagugc

SEQ ID NO: 2814706 - RNA, 16 nt, Mycobacterium avium subsp. paratuberculosis
aucuccaccgagugcg

SEQ ID NO: 2814707 - RNA, 12 nt, Mycobacterium avium subsp. paratuberculosis
aucuccagcagc

SEQ ID NO: 2814708 - RNA, 13 nt, Mycobacterium avium subsp. paratuberculosis
aucuccagcagcu

SEQ ID NO: 2814709 - RNA, 14 nt, Mycobacterium avium subsp. paratuberculosis
aucuccagcagcuu

SEQ ID NO: 2814710 - RNA, 17 nt, Mycobacterium avium subsp. paratuberculosis
aucuccagcggccgggc

SEQ ID NO: 2814711 - RNA, 13 nt, Mycobacterium avium subsp. paratuberculosis
aucuccagcuccg

SEQ ID NO: 2814712 - RNA, 17 nt, Mycobacterium avium subsp. paratuberculosis
aucuccagcuccgcggc

SEQ ID NO: 2814713 - RNA, 17 nt, Mycobacterium avium subsp. paratuberculosis
aucuccaggcucgacaa

SEQ ID NO: 2814714 - RNA, 15 nt, Mycobacterium avium subsp. paratuberculosis
aucuccaucccgcug

SEQ ID NO: 2814715 - RNA, 14 nt, Mycobacterium avium subsp. paratuberculosis
aucuccgagucggc

SEQ ID NO: 2814716 - RNA, 19 nt, Mycobacterium avium subsp. paratuberculosis
aucuccgccuucgacgaug

SEQ ID NO: 2814717 - RNA, 14 nt, Mycobacterium avium subsp. paratuberculosis
aucuccgcggcgau

SEQ ID NO: 2814718 - RNA, 15 nt, Mycobacterium avium subsp. paratuberculosis
aucuccgcggcgaug

SEQ ID NO: 2814719 - RNA, 20 nt, Mycobacterium avium subsp. paratuberculosis
aucuccgcggcgaugaccgg

SEQ ID NO: 2814720 - RNA, 19 nt, Mycobacterium avium subsp. paratuberculosis
aucuccggcacguugacgu

SEQ ID NO: 2814721 - RNA, 12 nt, Mycobacterium avium subsp. paratuberculosis
aucuccggccgg

SEQ ID NO: 2814722 - RNA, 23 nt, Mycobacterium avium subsp. paratuberculosis
aucuccuuggggcugaccucgcc

SEQ ID NO: 2814723 - RNA, 18 nt, Mycobacterium avium subsp. paratuberculosis
aucucgaaugcggcugcc

SEQ ID NO: 2814724 - RNA, 23 nt, Mycobacterium avium subsp. paratuberculosis
aucucgaaugcggcugccggcca

SEQ ID NO: 2814725 - RNA, 15 nt, Mycobacterium avium subsp. paratuberculosis
aucucgaccagcgcc

SEQ ID NO: 2814726 - RNA, 16 nt, Mycobacterium avium subsp. paratuberculosis
aucucgaccagcgccg

SEQ ID NO: 2814727 - RNA, 19 nt, Mycobacterium avium subsp. paratuberculosis
aucucgaccagcgccgaga

SEQ ID NO: 2814728 - RNA, 19 nt, Mycobacterium avium subsp. paratuberculosis
aucucgacccgggccaggu

SEQ ID NO: 2814729 - RNA, 21 nt, Mycobacterium avium subsp. paratuberculosis
aucucgaccucgucggcggcg

SEQ ID NO: 2814730 - RNA, 22 nt, Mycobacterium avium subsp. paratuberculosis
aucucgaccugggucaucaccu

SEQ ID NO: 2814731 - RNA, 17 nt, Mycobacterium avium subsp. paratuberculosis
aucucgaccuucuuguc

SEQ ID NO: 2814732 - RNA, 20 nt, Mycobacterium avium subsp. paratuberculosis
aucucgacggugaccggcuc

SEQ ID NO: 2814733 - RNA, 16 nt, Mycobacterium avium subsp. paratuberculosis
aucucgagcauccggu

SEQ ID NO: 2814734 - RNA, 18 nt, Mycobacterium avium subsp. paratuberculosis
aucucgauggccucgucg

SEQ ID NO: 2814735 - RNA, 13 nt, Mycobacterium avium subsp. paratuberculosis
aucucgccgagca

SEQ ID NO: 2814736 - RNA, 13 nt, Mycobacterium avium subsp. paratuberculosis
aucucgccgagcg

SEQ ID NO: 2814737 - RNA, 19 nt, Mycobacterium avium subsp. paratuberculosis
aucucgccgcggugguggg

SEQ ID NO: 2814738 - RNA, 21 nt, Mycobacterium avium subsp. paratuberculosis
aucucgccgcgguggugggcg

SEQ ID NO: 2814739 - RNA, 15 nt, Mycobacterium avium subsp. paratuberculosis
aucucgcgccgcgca

SEQ ID NO: 2814740 - RNA, 13 nt, Mycobacterium avium subsp. paratuberculosis
aucucgcgggccc

SEQ ID NO: 2814741 - RNA, 18 nt, Mycobacterium avium subsp. paratuberculosis
aucucgcgggcccgcgcg

SEQ ID NO: 2814742 - RNA, 22 nt, Mycobacterium avium subsp. paratuberculosis
aucucgcgggcccgcgcggcgg

SEQ ID NO: 2814743 - RNA, 13 nt, Mycobacterium avium subsp. paratuberculosis
aucucggcggcga

SEQ ID NO: 2814744 - RNA, 18 nt, Mycobacterium avium subsp. paratuberculosis
aucucggcguacagcccg

SEQ ID NO: 2814745 - RNA, 19 nt, Mycobacterium avium subsp. paratuberculosis
aucucgggagugcggccca

SEQ ID NO: 2814746 - RNA, 22 nt, Mycobacterium avium subsp. paratuberculosis
aucucggugagcagaaccaccu

SEQ ID NO: 2814747 - RNA, 23 nt, Mycobacterium avium subsp. paratuberculosis
aucucggugagcagaaccaccug

SEQ ID NO: 2814748 - RNA, 14 nt, Mycobacterium avium subsp. paratuberculosis
aucucggugccggu

SEQ ID NO: 2814749 - RNA, 14 nt, Mycobacterium avium subsp. paratuberculosis
aucucggugccguc

SEQ ID NO: 2814750 - RNA, 24 nt, Mycobacterium avium subsp. paratuberculosis
aucucggugguggccaucgcggcc

SEQ ID NO: 2814751 - RNA, 17 nt, Mycobacterium avium subsp. paratuberculosis
aucucguagcccaccuc

SEQ ID NO: 2814752 - RNA, 19 nt, Mycobacterium avium subsp. paratuberculosis
aucucguagguggccagca

SEQ ID NO: 2814753 - RNA, 14 nt, Mycobacterium avium subsp. paratuberculosis
aucucgucgaugac

SEQ ID NO: 2814754 - RNA, 13 nt, Mycobacterium avium subsp. paratuberculosis
aucucgucgcgca

SEQ ID NO: 2814755 - RNA, 15 nt, Mycobacterium avium subsp. paratuberculosis
aucucgucgcgcagc

SEQ ID NO: 2814756 - RNA, 16 nt, Mycobacterium avium subsp. paratuberculosis
aucucgucgcgcagcu

SEQ ID NO: 2814757 - RNA, 18 nt, Mycobacterium avium subsp. paratuberculosis
aucucgucgcgcagcugg

SEQ ID NO: 2814758 - RNA, 14 nt, Mycobacterium avium subsp. paratuberculosis
aucucgucggcggc

SEQ ID NO: 2814759 - RNA, 22 nt, Mycobacterium avium subsp. paratuberculosis
aucucgucgggaaugucggcgu

SEQ ID NO: 2814760 - RNA, 18 nt, Mycobacterium avium subsp. paratuberculosis
aucucgucgggcaccgcc

SEQ ID NO: 2814761 - RNA, 14 nt, Mycobacterium avium subsp. paratuberculosis
aucucgucgggcca

SEQ ID NO: 2814762 - RNA, 15 nt, Mycobacterium avium subsp. paratuberculosis
aucucgucggggcgc

SEQ ID NO: 2814763 - RNA, 19 nt, Mycobacterium avium subsp. paratuberculosis
aucucgugggucagcuuca

SEQ ID NO: 2814764 - RNA, 15 nt, Mycobacterium avium subsp. paratuberculosis
aucucguugcggcgc

SEQ ID NO: 2814765 - RNA, 16 nt, Mycobacterium avium subsp. paratuberculosis
aucucguugcggcgca

SEQ ID NO: 2814766 - RNA, 15 nt, Mycobacterium avium subsp. paratuberculosis
aucucuucgccggac

SEQ ID NO: 2814767 - RNA, 15 nt, Mycobacterium avium subsp. paratuberculosis
aucugaccgagcagc

SEQ ID NO: 2814768 - RNA, 16 nt, Mycobacterium avium subsp. paratuberculosis
aucugaccgagcagcg

SEQ ID NO: 2814769 - RNA, 18 nt, Mycobacterium avium subsp. paratuberculosis
aucugcacacgggcccgu

SEQ ID NO: 2814770 - RNA, 19 nt, Mycobacterium avium subsp. paratuberculosis
aucugcacgucggcggccg

SEQ ID NO: 2814771 - RNA, 23 nt, Mycobacterium avium subsp. paratuberculosis
aucugcagcacgcccagaucgac

SEQ ID NO: 2814772 - RNA, 16 nt, Mycobacterium avium subsp. paratuberculosis
aucugcaggccgaggc

SEQ ID NO: 2814773 - RNA, 17 nt, Mycobacterium avium subsp. paratuberculosis
aucugccgggcggcgac

SEQ ID NO: 2814774 - RNA, 15 nt, Mycobacterium avium subsp. paratuberculosis
aucugccggugccgc

SEQ ID NO: 2814775 - RNA, 18 nt, Mycobacterium avium subsp. paratuberculosis
aucugccggugccgccgg

SEQ ID NO: 2814776 - RNA, 23 nt, Mycobacterium avium subsp. paratuberculosis
aucugcggaccaucuacgaccuc

SEQ ID NO: 2814777 - RNA, 14 nt, Mycobacterium avium subsp. paratuberculosis
aucugcggcaccac

SEQ ID NO: 2814778 - RNA, 17 nt, Mycobacterium avium subsp. paratuberculosis
aucugcuccgggguggc

SEQ ID NO: 2814779 - RNA, 22 nt, Mycobacterium avium subsp. paratuberculosis
aucugcuccucggucagcggcg

SEQ ID NO: 2814780 - RNA, 23 nt, Mycobacterium avium subsp. paratuberculosis
aucugcuccucggucagcggcgu

SEQ ID NO: 2814781 - RNA, 13 nt, Mycobacterium avium subsp. paratuberculosis
aucugcucggcgu

SEQ ID NO: 2814782 - RNA, 19 nt, Mycobacterium avium subsp. paratuberculosis
aucugcucggugucgaucg

SEQ ID NO: 2814783 - RNA, 15 nt, Mycobacterium avium subsp. paratuberculosis
aucugcucgugguuc

SEQ ID NO: 2814784 - RNA, 17 nt, Mycobacterium avium subsp. paratuberculosis
aucugcuuggucaccug

SEQ ID NO: 2814785 - RNA, 17 nt, Mycobacterium avium subsp. paratuberculosis
aucuggaacauggccuu

SEQ ID NO: 2814786 - RNA, 14 nt, Mycobacterium avium subsp. paratuberculosis
aucuggccgcgggu

SEQ ID NO: 2814787 - RNA, 23 nt, Mycobacterium avium subsp. paratuberculosis
aucuggcgaucgaugcccagcgc

SEQ ID NO: 2814788 - RNA, 18 nt, Mycobacterium avium subsp. paratuberculosis
aucuggcgguuggacagg

SEQ ID NO: 2814789 - RNA, 22 nt, Mycobacterium avium subsp. paratuberculosis
augaugaccgacauggccagca

SEQ ID NO: 2814790 - RNA, 16 nt, Mycobacterium avium subsp. paratuberculosis
augaugaugccgccca

SEQ ID NO: 2814791 - RNA, 19 nt, Mycobacterium avium subsp. paratuberculosis
augaugcccuuggcggcca

SEQ ID NO: 2814792 - RNA, 21 nt, Mycobacterium avium subsp. paratuberculosis
augaugcccuuggcggccacg

SEQ ID NO: 2814793 - RNA, 16 nt, Mycobacterium avium subsp. paratuberculosis
augaugccgcccauca

SEQ ID NO: 2814794 - RNA, 18 nt, Mycobacterium avium subsp. paratuberculosis
augauggucagccgcacc

SEQ ID NO: 2814795 - RNA, 23 nt, Mycobacterium avium subsp. paratuberculosis
augauggugggcaccgcgaacga

SEQ ID NO: 2814796 - RNA, 15 nt, Mycobacterium avium subsp. paratuberculosis
augauguagcggcgg

SEQ ID NO: 2814797 - RNA, 14 nt, Mycobacterium avium subsp. paratuberculosis
augaugucggccgg

SEQ ID NO: 2814798 - RNA, 15 nt, Mycobacterium avium subsp. paratuberculosis
augaugucggccggc

SEQ ID NO: 2814799 - RNA, 16 nt, Mycobacterium avium subsp. paratuberculosis
augaugucggccggca

SEQ ID NO: 2814800 - RNA, 15 nt, Mycobacterium avium subsp. paratuberculosis
augaugucggcggcc

SEQ ID NO: 2814801 - RNA, 19 nt, Mycobacterium avium subsp. paratuberculosis
augaugucguuggugucga

SEQ ID NO: 2814802 - RNA, 18 nt, Mycobacterium avium subsp. paratuberculosis
augauguucuccggcccg

SEQ ID NO: 2814803 - RNA, 21 nt, Mycobacterium avium subsp. paratuberculosis
augauugcgugcccggccagc

SEQ ID NO: 2814804 - RNA, 19 nt, Mycobacterium avium subsp. paratuberculosis
augcacccggacgugaucg

SEQ ID NO: 2814805 - RNA, 20 nt, Mycobacterium avium subsp. paratuberculosis
augcaccggugcaccgcgcg

SEQ ID NO: 2814806 - RNA, 17 nt, Mycobacterium avium subsp. paratuberculosis
augcaccucgcccugca

SEQ ID NO: 2814807 - RNA, 22 nt, Mycobacterium avium subsp. paratuberculosis
augcacgaucucccaacgcagc

SEQ ID NO: 2814808 - RNA, 15 nt, Mycobacterium avium subsp. paratuberculosis
augcacggucggccc

SEQ ID NO: 2814809 - RNA, 17 nt, Mycobacterium avium subsp. paratuberculosis
augcacggucggccccg

SEQ ID NO: 2814810 - RNA, 16 nt, Mycobacterium avium subsp. paratuberculosis
augcagaacagccggu

SEQ ID NO: 2814811 - RNA, 14 nt, Mycobacterium avium subsp. paratuberculosis
augcagaucaccac

SEQ ID NO: 2814812 - RNA, 17 nt, Mycobacterium avium subsp. paratuberculosis
augcagaucaccacggu

SEQ ID NO: 2814813 - RNA, 18 nt, Mycobacterium avium subsp. paratuberculosis
augcagcagguugcggug

SEQ ID NO: 2814814 - RNA, 22 nt, Mycobacterium avium subsp. paratuberculosis
augcagccgccgcggagcggcg

SEQ ID NO: 2814815 - RNA, 23 nt, Mycobacterium avium subsp. paratuberculosis
augcagugguugagcagcagacc

SEQ ID NO: 2814816 - RNA, 22 nt, Mycobacterium avium subsp. paratuberculosis
augccaagccauuucagcagcg

SEQ ID NO: 2814817 - RNA, 23 nt, Mycobacterium avium subsp. paratuberculosis
augccaagccauuucagcagcgc

SEQ ID NO: 2814818 - RNA, 15 nt, Mycobacterium avium subsp. paratuberculosis
augccagacgcgcac

SEQ ID NO: 2814819 - RNA, 16 nt, Mycobacterium avium subsp. paratuberculosis
augccagacgcgcacc

SEQ ID NO: 2814820 - RNA, 19 nt, Mycobacterium avium subsp. paratuberculosis
augccagacgcgcaccgcc

SEQ ID NO: 2814821 - RNA, 21 nt, Mycobacterium avium subsp. paratuberculosis
augccagacgcgcaccgccac

SEQ ID NO: 2814822 - RNA, 23 nt, Mycobacterium avium subsp. paratuberculosis
augccagacgcgcaccgccaccg

SEQ ID NO: 2814823 - RNA, 15 nt, Mycobacterium avium subsp. paratuberculosis
augccagcagguccg

SEQ ID NO: 2814824 - RNA, 15 nt, Mycobacterium avium subsp. paratuberculosis
augccagucaagcgc

SEQ ID NO: 2814825 - RNA, 16 nt, Mycobacterium avium subsp. paratuberculosis
augccaguccugggcc

SEQ ID NO: 2814826 - RNA, 23 nt, Mycobacterium avium subsp. paratuberculosis
augccaguccugggccggggcuu

SEQ ID NO: 2814827 - RNA, 16 nt, Mycobacterium avium subsp. paratuberculosis
augccaguuuuuggcg

SEQ ID NO: 2814828 - RNA, 15 nt, Mycobacterium avium subsp. paratuberculosis
augcccaccaucccg

SEQ ID NO: 2814829 - RNA, 20 nt, Mycobacterium avium subsp. paratuberculosis
augcccaccaucccgccgcc

SEQ ID NO: 2814830 - RNA, 21 nt, Mycobacterium avium subsp. paratuberculosis
augcccacgccgucgacccgu

SEQ ID NO: 2814831 - RNA, 22 nt, Mycobacterium avium subsp. paratuberculosis
augcccagcaguccggcgguca

SEQ ID NO: 2814832 - RNA, 12 nt, Mycobacterium avium subsp. paratuberculosis
augcccagcgcg

SEQ ID NO: 2814833 - RNA, 21 nt, Mycobacterium avium subsp. paratuberculosis
augcccaggcccaccagcugg

SEQ ID NO: 2814834 - RNA, 12 nt, Mycobacterium avium subsp. paratuberculosis
augcccaggccg

SEQ ID NO: 2814835 - RNA, 15 nt, Mycobacterium avium subsp. paratuberculosis
augcccagggcgcgu

SEQ ID NO: 2814836 - RNA, 14 nt, Mycobacterium avium subsp. paratuberculosis
augcccaucacgcc

SEQ ID NO: 2814837 - RNA, 16 nt, Mycobacterium avium subsp. paratuberculosis
augcccaugucgaucg

SEQ ID NO: 2814838 - RNA, 13 nt, Mycobacterium avium subsp. paratuberculosis
augccccaggcga

SEQ ID NO: 2814839 - RNA, 21 nt, Mycobacterium avium subsp. paratuberculosis
augccccaggugacgccgcac

SEQ ID NO: 2814840 - RNA, 23 nt, Mycobacterium avium subsp. paratuberculosis
augcccccgaaaugcaucagcgu

SEQ ID NO: 2814841 - RNA, 20 nt, Mycobacterium avium subsp. paratuberculosis
augccccguauugccgucgg

SEQ ID NO: 2814842 - RNA, 16 nt, Mycobacterium avium subsp. paratuberculosis
augcccgacaccgccc

SEQ ID NO: 2814843 - RNA, 18 nt, Mycobacterium avium subsp. paratuberculosis
augcccgccacggccagc

SEQ ID NO: 2814844 - RNA, 22 nt, Mycobacterium avium subsp. paratuberculosis
augcccgccacggccagcaccg

SEQ ID NO: 2814845 - RNA, 12 nt, Mycobacterium avium subsp. paratuberculosis
augcccgccccg

SEQ ID NO: 2814846 - RNA, 18 nt, Mycobacterium avium subsp. paratuberculosis
augcccgccccgcccggc

SEQ ID NO: 2814847 - RNA, 14 nt, Mycobacterium avium subsp. paratuberculosis
augcccgccccgga

SEQ ID NO: 2814848 - RNA, 21 nt, Mycobacterium avium subsp. paratuberculosis
augcccgccccggacauccau

SEQ ID NO: 2814849 - RNA, 17 nt, Mycobacterium avium subsp. paratuberculosis
augcccgccgcgucagc

SEQ ID NO: 2814850 - RNA, 22 nt, Mycobacterium avium subsp. paratuberculosis
augcccgccgcgucagcggcgg

SEQ ID NO: 2814851 - RNA, 21 nt, Mycobacterium avium subsp. paratuberculosis
augcccgccgcugacgcggcg

SEQ ID NO: 2814852 - RNA, 18 nt, Mycobacterium avium subsp. paratuberculosis
augcccgcgaacgccucg

SEQ ID NO: 2814853 - RNA, 20 nt, Mycobacterium avium subsp. paratuberculosis
augcccgcgaacgccucguu

SEQ ID NO: 2814854 - RNA, 14 nt, Mycobacterium avium subsp. paratuberculosis
augcccgcgccgac

SEQ ID NO: 2814855 - RNA, 17 nt, Mycobacterium avium subsp. paratuberculosis
augcccgcggugcaguc

SEQ ID NO: 2814856 - RNA, 15 nt, Mycobacterium avium subsp. paratuberculosis
augcccgcguccugc

SEQ ID NO: 2814857 - RNA, 21 nt, Mycobacterium avium subsp. paratuberculosis
augcccgcguccugcagcgcc

SEQ ID NO: 2814858 - RNA, 16 nt, Mycobacterium avium subsp. paratuberculosis
augcccggcgacggcg

SEQ ID NO: 2814859 - RNA, 18 nt, Mycobacterium avium subsp. paratuberculosis
augcccggcgacggcgcc

SEQ ID NO: 2814860 - RNA, 20 nt, Mycobacterium avium subsp. paratuberculosis
augcccggcgacggcgccug

SEQ ID NO: 2814861 - RNA, 22 nt, Mycobacterium avium subsp. paratuberculosis
augcccggcgacggcgccugau

SEQ ID NO: 2814862 - RNA, 20 nt, Mycobacterium avium subsp. paratuberculosis
augcccgggccgucaucgcc

SEQ ID NO: 2814863 - RNA, 21 nt, Mycobacterium avium subsp. paratuberculosis
augcccgggccguccgggugc

SEQ ID NO: 2814864 - RNA, 18 nt, Mycobacterium avium subsp. paratuberculosis
augcccgggcgacuucgu

SEQ ID NO: 2814865 - RNA, 9 nt, Mycobacterium avium subsp. paratuberculosis
augcccgua

SEQ ID NO: 2814866 - RNA, 17 nt, Mycobacterium avium subsp. paratuberculosis
augcccguagaugccgg

SEQ ID NO: 2814867 - RNA, 17 nt, Mycobacterium avium subsp. paratuberculosis
augcccgucacggccgu

SEQ ID NO: 2814868 - RNA, 18 nt, Mycobacterium avium subsp. paratuberculosis
augcccgucacggccguc

SEQ ID NO: 2814869 - RNA, 22 nt, Mycobacterium avium subsp. paratuberculosis
augcccgucgggcgggguggcc

SEQ ID NO: 2814870 - RNA, 17 nt, Mycobacterium avium subsp. paratuberculosis
augcccgugaucgccac

SEQ ID NO: 2814871 - RNA, 21 nt, Mycobacterium avium subsp. paratuberculosis
augcccucguagcggccgcac

SEQ ID NO: 2814872 - RNA, 22 nt, Mycobacterium avium subsp. paratuberculosis
augcccugcacgaucucggcgg

SEQ ID NO: 2814873 - RNA, 23 nt, Mycobacterium avium subsp. paratuberculosis
augccggcguccaguucggccag

SEQ ID NO: 2814874 - RNA, 16 nt, Mycobacterium avium subsp. paratuberculosis
augccgggcaaccaca

SEQ ID NO: 2814875 - RNA, 17 nt, Mycobacterium avium subsp. paratuberculosis
augccgggcaaccacag

SEQ ID NO: 2814876 - RNA, 23 nt, Mycobacterium avium subsp. paratuberculosis
augccgggcaaccacagcggcgc

SEQ ID NO: 2814877 - RNA, 13 nt, Mycobacterium avium subsp. paratuberculosis
augccgggccagc

SEQ ID NO: 2814878 - RNA, 17 nt, Mycobacterium avium subsp. paratuberculosis
augccgggccagccggc

SEQ ID NO: 2814879 - RNA, 19 nt, Mycobacterium avium subsp. paratuberculosis
augccgggccagccggccc

SEQ ID NO: 2814880 - RNA, 18 nt, Mycobacterium avium subsp. paratuberculosis
augccggguuucggcccg

SEQ ID NO: 2814881 - RNA, 20 nt, Mycobacterium avium subsp. paratuberculosis
augccggguuucggcccggc

SEQ ID NO: 2814882 - RNA, 21 nt, Mycobacterium avium subsp. paratuberculosis
augccggguuucggcccggcu

SEQ ID NO: 2814883 - RNA, 22 nt, Mycobacterium avium subsp. paratuberculosis
augccggguuucggcccggcuc

SEQ ID NO: 2814884 - RNA, 15 nt, Mycobacterium avium subsp. paratuberculosis
augccgguacggccg

SEQ ID NO: 2814885 - RNA, 17 nt, Mycobacterium avium subsp. paratuberculosis
augccgguacggccgac

SEQ ID NO: 2814886 - RNA, 22 nt, Mycobacterium avium subsp. paratuberculosis
augccggucauccgggccacca

SEQ ID NO: 2814887 - RNA, 14 nt, Mycobacterium avium subsp. paratuberculosis
augccgguguucaa

SEQ ID NO: 2814888 - RNA, 21 nt, Mycobacterium avium subsp. paratuberculosis
augccguaaguggcgccgcgg

SEQ ID NO: 2814889 - RNA, 20 nt, Mycobacterium avium subsp. paratuberculosis
augccgucacugucggcgcg

SEQ ID NO: 2814890 - RNA, 22 nt, Mycobacterium avium subsp. paratuberculosis
augccguccagcaacgccgaca

SEQ ID NO: 2814891 - RNA, 18 nt, Mycobacterium avium subsp. paratuberculosis
augccgucggcgcccggc

SEQ ID NO: 2814892 - RNA, 15 nt, Mycobacterium avium subsp. paratuberculosis
augccgugccagccg

SEQ ID NO: 2814893 - RNA, 16 nt, Mycobacterium avium subsp. paratuberculosis
augccgugcgcgcugg

SEQ ID NO: 2814894 - RNA, 18 nt, Mycobacterium avium subsp. paratuberculosis
augccgugcgcgcuggug

SEQ ID NO: 2814895 - RNA, 16 nt, Mycobacterium avium subsp. paratuberculosis
augccguucgcgccgu

SEQ ID NO: 2814896 - RNA, 17 nt, Mycobacterium avium subsp. paratuberculosis
augccguugccaggccg

SEQ ID NO: 2814897 - RNA, 20 nt, Mycobacterium avium subsp. paratuberculosis
augccguugccaggccgcga

SEQ ID NO: 2814898 - RNA, 23 nt, Mycobacterium avium subsp. paratuberculosis
augccguugccaggccgcgagca

SEQ ID NO: 2814899 - RNA, 17 nt, Mycobacterium avium subsp. paratuberculosis
augccguuggugacgcu

SEQ ID NO: 2814900 - RNA, 19 nt, Mycobacterium avium subsp. paratuberculosis
augccuacaggugccggcg

SEQ ID NO: 2814901 - RNA, 18 nt, Mycobacterium avium subsp. paratuberculosis
augccuaggggagcagca

SEQ ID NO: 2814902 - RNA, 20 nt, Mycobacterium avium subsp. paratuberculosis
augccucuucggcgcgccgg

SEQ ID NO: 2814903 - RNA, 12 nt, Mycobacterium avium subsp. paratuberculosis
augccuuggcgg

SEQ ID NO: 2814904 - RNA, 20 nt, Mycobacterium avium subsp. paratuberculosis
augccuuggcggcguggggu

SEQ ID NO: 2814905 - RNA, 17 nt, Mycobacterium avium subsp. paratuberculosis
augccuuucagcucgau

SEQ ID NO: 2814906 - RNA, 15 nt, Mycobacterium avium subsp. paratuberculosis
augcgacaccgcguc

SEQ ID NO: 2814907 - RNA, 13 nt, Mycobacterium avium subsp. paratuberculosis
augcgaccacgac

SEQ ID NO: 2814908 - RNA, 21 nt, Mycobacterium avium subsp. paratuberculosis
augcgaccacgaccgggucug

SEQ ID NO: 2814909 - RNA, 15 nt, Mycobacterium avium subsp. paratuberculosis
augcgacgcaccucg

SEQ ID NO: 2814910 - RNA, 17 nt, Mycobacterium avium subsp. paratuberculosis
augcgcaagcaccggcu

SEQ ID NO: 2814911 - RNA, 14 nt, Mycobacterium avium subsp. paratuberculosis
augcgcaccaucac

SEQ ID NO: 2814912 - RNA, 13 nt, Mycobacterium avium subsp. paratuberculosis
augcgcacccccg

SEQ ID NO: 2814913 - RNA, 21 nt, Mycobacterium avium subsp. paratuberculosis
augcgcaccgcggcgugcgcc

SEQ ID NO: 2814914 - RNA, 20 nt, Mycobacterium avium subsp. paratuberculosis
augcgcaccgugccgcccgu

SEQ ID NO: 2814915 - RNA, 15 nt, Mycobacterium avium subsp. paratuberculosis
augcgcaccugcggc

SEQ ID NO: 2814916 - RNA, 17 nt, Mycobacterium avium subsp. paratuberculosis
augcgcaccugcggccc

SEQ ID NO: 2814917 - RNA, 19 nt, Mycobacterium avium subsp. paratuberculosis
augcgcacgucggccgcca

SEQ ID NO: 2814918 - RNA, 22 nt, Mycobacterium avium subsp. paratuberculosis
augcgcacgucggccgccaggg

SEQ ID NO: 2814919 - RNA, 16 nt, Mycobacterium avium subsp. paratuberculosis
augcgcagcgcccagg

SEQ ID NO: 2814920 - RNA, 17 nt, Mycobacterium avium subsp. paratuberculosis
augcgcagcgcccaggc

SEQ ID NO: 2814921 - RNA, 16 nt, Mycobacterium avium subsp. paratuberculosis
augcgccaccgacacc

SEQ ID NO: 2814922 - RNA, 20 nt, Mycobacterium avium subsp. paratuberculosis
augcgccaccgacaccaccg

SEQ ID NO: 2814923 - RNA, 23 nt, Mycobacterium avium subsp. paratuberculosis
augcgcccgcugcggcgcagguu

SEQ ID NO: 2814924 - RNA, 14 nt, Mycobacterium avium subsp. paratuberculosis
augcgccggcggcc

SEQ ID NO: 2814925 - RNA, 13 nt, Mycobacterium avium subsp. paratuberculosis
augcgccggcggu

SEQ ID NO: 2814926 - RNA, 16 nt, Mycobacterium avium subsp. paratuberculosis
augcgccggguccagc

SEQ ID NO: 2814927 - RNA, 14 nt, Mycobacterium avium subsp. paratuberculosis
augcgccugcacgg

SEQ ID NO: 2814928 - RNA, 23 nt, Mycobacterium avium subsp. paratuberculosis
augcgccugcacggugccgccgu

SEQ ID NO: 2814929 - RNA, 16 nt, Mycobacterium avium subsp. paratuberculosis
augcgcgagucgagca

SEQ ID NO: 2814930 - RNA, 19 nt, Mycobacterium avium subsp. paratuberculosis
augcgcgagucgagcaccg

SEQ ID NO: 2814931 - RNA, 13 nt, Mycobacterium avium subsp. paratuberculosis
augcgcgccacca

SEQ ID NO: 2814932 - RNA, 17 nt, Mycobacterium avium subsp. paratuberculosis
augcgcgccaccaggcg

SEQ ID NO: 2814933 - RNA, 20 nt, Mycobacterium avium subsp. paratuberculosis
augcgcgccaccaggcgguc

SEQ ID NO: 2814934 - RNA, 17 nt, Mycobacterium avium subsp. paratuberculosis
augcgcgccagcagcgc

SEQ ID NO: 2814935 - RNA, 16 nt, Mycobacterium avium subsp. paratuberculosis
augcgcgucgcggcgc

SEQ ID NO: 2814936 - RNA, 19 nt, Mycobacterium avium subsp. paratuberculosis
augcgcgucgcggcgcgga

SEQ ID NO: 2814937 - RNA, 18 nt, Mycobacterium avium subsp. paratuberculosis
augcgcgugacgcgcgug

SEQ ID NO: 2814938 - RNA, 14 nt, Mycobacterium avium subsp. paratuberculosis
augcgcucacccaa

SEQ ID NO: 2814939 - RNA, 13 nt, Mycobacterium avium subsp. paratuberculosis
augcgcucgccga

SEQ ID NO: 2814940 - RNA, 17 nt, Mycobacterium avium subsp. paratuberculosis
augcgcucggcgaccug

SEQ ID NO: 2814941 - RNA, 23 nt, Mycobacterium avium subsp. paratuberculosis
augcgcugcuuagccccucccac

SEQ ID NO: 2814942 - RNA, 14 nt, Mycobacterium avium subsp. paratuberculosis
augcggaccgggga

SEQ ID NO: 2814943 - RNA, 13 nt, Mycobacterium avium subsp. paratuberculosis
augcggaucucgg

SEQ ID NO: 2814944 - RNA, 17 nt, Mycobacterium avium subsp. paratuberculosis
augcggaugcccgccgg

SEQ ID NO: 2814945 - RNA, 18 nt, Mycobacterium avium subsp. paratuberculosis
augcggaugcccgccggc

SEQ ID NO: 2814946 - RNA, 19 nt, Mycobacterium avium subsp. paratuberculosis
augcggaugcccgccggcg

SEQ ID NO: 2814947 - RNA, 20 nt, Mycobacterium avium subsp. paratuberculosis
augcggaugcccgccggcgu

SEQ ID NO: 2814948 - RNA, 12 nt, Mycobacterium avium subsp. paratuberculosis
augcggcaccag

SEQ ID NO: 2814949 - RNA, 15 nt, Mycobacterium avium subsp. paratuberculosis
augcggcaccagccc

SEQ ID NO: 2814950 - RNA, 16 nt, Mycobacterium avium subsp. paratuberculosis
augcggcaccagcccg

SEQ ID NO: 2814951 - RNA, 22 nt, Mycobacterium avium subsp. paratuberculosis
augcggccauguccccgccggu

SEQ ID NO: 2814952 - RNA, 15 nt, Mycobacterium avium subsp. paratuberculosis
augcggcccagcccg

SEQ ID NO: 2814953 - RNA, 19 nt, Mycobacterium avium subsp. paratuberculosis
augcggcccagcccggcca

SEQ ID NO: 2814954 - RNA, 21 nt, Mycobacterium avium subsp. paratuberculosis
augcggcccagcccggccagc

SEQ ID NO: 2814955 - RNA, 23 nt, Mycobacterium avium subsp. paratuberculosis
augcggcccagcccggccagcac

SEQ ID NO: 2814956 - RNA, 15 nt, Mycobacterium avium subsp. paratuberculosis
augcggcccggccac

SEQ ID NO: 2814957 - RNA, 21 nt, Mycobacterium avium subsp. paratuberculosis
auggccggcgaaccgccgcac

SEQ ID NO: 2814958 - RNA, 14 nt, Mycobacterium avium subsp. paratuberculosis
auggccggcuaccg

SEQ ID NO: 2814959 - RNA, 17 nt, Mycobacterium avium subsp. paratuberculosis
auggccggcuaccgcgc

SEQ ID NO: 2814960 - RNA, 13 nt, Mycobacterium avium subsp. paratuberculosis
auggccgggcagg

SEQ ID NO: 2814961 - RNA, 17 nt, Mycobacterium avium subsp. paratuberculosis
auggccgggcaggccgg

SEQ ID NO: 2814962 - RNA, 19 nt, Mycobacterium avium subsp. paratuberculosis
auggccgucgggucggcga

SEQ ID NO: 2814963 - RNA, 18 nt, Mycobacterium avium subsp. paratuberculosis
auggccucgucgcggaac

SEQ ID NO: 2814964 - RNA, 18 nt, Mycobacterium avium subsp. paratuberculosis
auggcgaacacgucggcc

SEQ ID NO: 2814965 - RNA, 22 nt, Mycobacterium avium subsp. paratuberculosis
auggcgaacaggaugcggguga

SEQ ID NO: 2814966 - RNA, 20 nt, Mycobacterium avium subsp. paratuberculosis
auggcgaacauggucgccca

SEQ ID NO: 2814967 - RNA, 22 nt, Mycobacterium avium subsp. paratuberculosis
auggcgaaguagucggcguccg

SEQ ID NO: 2814968 - RNA, 15 nt, Mycobacterium avium subsp. paratuberculosis
auggcgaccgcgacg

SEQ ID NO: 2814969 - RNA, 16 nt, Mycobacterium avium subsp. paratuberculosis
auggcgaccgcgcagg

SEQ ID NO: 2814970 - RNA, 22 nt, Mycobacterium avium subsp. paratuberculosis
auggcgacggucugccgggaca

SEQ ID NO: 2814971 - RNA, 17 nt, Mycobacterium avium subsp. paratuberculosis
auggcgaucaccccggc

SEQ ID NO: 2814972 - RNA, 17 nt, Mycobacterium avium subsp. paratuberculosis
auggcgaucagaugcuc

SEQ ID NO: 2814973 - RNA, 14 nt, Mycobacterium avium subsp. paratuberculosis
auggcgaugaccag

SEQ ID NO: 2814974 - RNA, 16 nt, Mycobacterium avium subsp. paratuberculosis
auggcgaugacgucgu

SEQ ID NO: 2814975 - RNA, 14 nt, Mycobacterium avium subsp. paratuberculosis
auggcgaugccgga

SEQ ID NO: 2814976 - RNA, 15 nt, Mycobacterium avium subsp. paratuberculosis
auggcgcaccgcggc

SEQ ID NO: 2814977 - RNA, 17 nt, Mycobacterium avium subsp. paratuberculosis
auggcgcaccgcggccu

SEQ ID NO: 2814978 - RNA, 13 nt, Mycobacterium avium subsp. paratuberculosis
auggcgcagaaca

SEQ ID NO: 2814979 - RNA, 13 nt, Mycobacterium avium subsp. paratuberculosis
auggcgcccagcc

SEQ ID NO: 2814980 - RNA, 18 nt, Mycobacterium avium subsp. paratuberculosis
auggcgcccagcccgagc

SEQ ID NO: 2814981 - RNA, 19 nt, Mycobacterium avium subsp. paratuberculosis
auggcgcccagcccgagca

SEQ ID NO: 2814982 - RNA, 19 nt, Mycobacterium avium subsp. paratuberculosis
auggcgcccggcagccgcu

SEQ ID NO: 2814983 - RNA, 20 nt, Mycobacterium avium subsp. paratuberculosis
auggcgccgaucgcgcgcag

SEQ ID NO: 2814984 - RNA, 12 nt, Mycobacterium avium subsp. paratuberculosis
auggcgcggccc

SEQ ID NO: 2814985 - RNA, 15 nt, Mycobacterium avium subsp. paratuberculosis
auggcgcggcccagu

SEQ ID NO: 2814986 - RNA, 13 nt, Mycobacterium avium subsp. paratuberculosis
auggcgcggcgca

SEQ ID NO: 2814987 - RNA, 22 nt, Mycobacterium avium subsp. paratuberculosis
auggcgcggcgcaccgcccgcg

SEQ ID NO: 2814988 - RNA, 16 nt, Mycobacterium avium subsp. paratuberculosis
auggcgcugcgcgaca

SEQ ID NO: 2814989 - RNA, 16 nt, Mycobacterium avium subsp. paratuberculosis
auggcgcuggccgcga

SEQ ID NO: 2814990 - RNA, 12 nt, Mycobacterium avium subsp. paratuberculosis
auggcggcccgc

SEQ ID NO: 2814991 - RNA, 14 nt, Mycobacterium avium subsp. paratuberculosis
auggcggccgccgc

SEQ ID NO: 2814992 - RNA, 18 nt, Mycobacterium avium subsp. paratuberculosis
auggcggccgccgcgauc

SEQ ID NO: 2814993 - RNA, 13 nt, Mycobacterium avium subsp. paratuberculosis
auggcggccugca

SEQ ID NO: 2814994 - RNA, 13 nt, Mycobacterium avium subsp. paratuberculosis
auggcggcggccc

SEQ ID NO: 2814995 - RNA, 15 nt, Mycobacterium avium subsp. paratuberculosis
auggcggcggcccgc

SEQ ID NO: 2814996 - RNA, 18 nt, Mycobacterium avium subsp. paratuberculosis
auggcggcggcccgccgc

SEQ ID NO: 2814997 - RNA, 21 nt, Mycobacterium avium subsp. paratuberculosis
auggcggcggcccgccgcgcc

SEQ ID NO: 2814998 - RNA, 14 nt, Mycobacterium avium subsp. paratuberculosis
auggcggcggcugc

SEQ ID NO: 2814999 - RNA, 14 nt, Mycobacterium avium subsp. paratuberculosis
auggcggcgucgag

SEQ ID NO: 2815000 - RNA, 12 nt, Mycobacterium avium subsp. paratuberculosis
auggcgggccgc

SEQ ID NO: 2815001 - RNA, 17 nt, Mycobacterium avium subsp. paratuberculosis
auggcgggcgcgccggc

SEQ ID NO: 2815002 - RNA, 20 nt, Mycobacterium avium subsp. paratuberculosis
auggcgggcgcgccggcgcg

SEQ ID NO: 2815003 - RNA, 17 nt, Mycobacterium avium subsp. paratuberculosis
auggcgguccaccacca

SEQ ID NO: 2815004 - RNA, 21 nt, Mycobacterium avium subsp. paratuberculosis
auggcgguccaccaccacacc

SEQ ID NO: 2815005 - RNA, 23 nt, Mycobacterium avium subsp. paratuberculosis
auggcgguccaccaccacacccg

SEQ ID NO: 2815006 - RNA, 23 nt, Mycobacterium avium subsp. paratuberculosis
auggcguagcgggucagcuccac

SEQ ID NO: 2815007 - RNA, 15 nt, Mycobacterium avium subsp. paratuberculosis
auggcguccaccgac

SEQ ID NO: 2815008 - RNA, 12 nt, Mycobacterium avium subsp. paratuberculosis
auggcgucgacg

SEQ ID NO: 2815009 - RNA, 21 nt, Mycobacterium avium subsp. paratuberculosis
auggcgucgacgugcgcggcg

SEQ ID NO: 2815010 - RNA, 15 nt, Mycobacterium avium subsp. paratuberculosis
auggcgugccacagc

SEQ ID NO: 2815011 - RNA, 16 nt, Mycobacterium avium subsp. paratuberculosis
auggcgugccacagca

SEQ ID NO: 2815012 - RNA, 22 nt, Mycobacterium avium subsp. paratuberculosis
auggcgugccggcgcugcccgu

SEQ ID NO: 2815013 - RNA, 15 nt, Mycobacterium avium subsp. paratuberculosis
auggcguucugcacc

SEQ ID NO: 2815014 - RNA, 19 nt, Mycobacterium avium subsp. paratuberculosis
auggcucagcgcaccgccg

SEQ ID NO: 2815015 - RNA, 21 nt, Mycobacterium avium subsp. paratuberculosis
auggcucagcgcaccgccguc

SEQ ID NO: 2815016 - RNA, 13 nt, Mycobacterium avium subsp. paratuberculosis
auggcucgcgggg

SEQ ID NO: 2815017 - RNA, 18 nt, Mycobacterium avium subsp. paratuberculosis
auggcuggcggcaacggc

SEQ ID NO: 2815018 - RNA, 19 nt, Mycobacterium avium subsp. paratuberculosis
auggcuuccgccgagacgg

SEQ ID NO: 2815019 - RNA, 16 nt, Mycobacterium avium subsp. paratuberculosis
augggaaccgcucggc

SEQ ID NO: 2815020 - RNA, 18 nt, Mycobacterium avium subsp. paratuberculosis
augggaucagcagcaccg

SEQ ID NO: 2815021 - RNA, 11 nt, Mycobacterium avium subsp. paratuberculosis
augggccaggu

SEQ ID NO: 2815022 - RNA, 14 nt, Mycobacterium avium subsp. paratuberculosis
augggccgcccgcu

SEQ ID NO: 2815023 - RNA, 21 nt, Mycobacterium avium subsp. paratuberculosis
augggcgcgaucaggcugccg

SEQ ID NO: 2815024 - RNA, 18 nt, Mycobacterium avium subsp. paratuberculosis
augggcgcguuggccggc

SEQ ID NO: 2815025 - RNA, 19 nt, Mycobacterium avium subsp. paratuberculosis
augggcgugccggcccggc

SEQ ID NO: 2815026 - RNA, 16 nt, Mycobacterium avium subsp. paratuberculosis
augggcucgaccacgc

SEQ ID NO: 2815027 - RNA, 12 nt, Mycobacterium avium subsp. paratuberculosis
augggcucgagc

SEQ ID NO: 2815028 - RNA, 19 nt, Mycobacterium avium subsp. paratuberculosis
augggcugcgcgucgagca

SEQ ID NO: 2815029 - RNA, 17 nt, Mycobacterium avium subsp. paratuberculosis
auggggauggugcgccg

SEQ ID NO: 2815030 - RNA, 15 nt, Mycobacterium avium subsp. paratuberculosis
auggggcaguagcga

SEQ ID NO: 2815031 - RNA, 20 nt, Mycobacterium avium subsp. paratuberculosis
augggggugccgcagcggcg

SEQ ID NO: 2815032 - RNA, 19 nt, Mycobacterium avium subsp. paratuberculosis
auggggugaugcgucccgu

SEQ ID NO: 2815033 - RNA, 21 nt, Mycobacterium avium subsp. paratuberculosis
augggguugaccuugaccagc

SEQ ID NO: 2815034 - RNA, 17 nt, Mycobacterium avium subsp. paratuberculosis
augggucucggcgaggc

SEQ ID NO: 2815035 - RNA, 23 nt, Mycobacterium avium subsp. paratuberculosis
augggugcgguugagcaccagcc

SEQ ID NO: 2815036 - RNA, 21 nt, Mycobacterium avium subsp. paratuberculosis
auggguggcgaucaccgcggc

SEQ ID NO: 2815037 - RNA, 13 nt, Mycobacterium avium subsp. paratuberculosis
augggugggcagc

SEQ ID NO: 2815038 - RNA, 18 nt, Mycobacterium avium subsp. paratuberculosis
auggguggucaccguguu

SEQ ID NO: 2815039 - RNA, 20 nt, Mycobacterium avium subsp. paratuberculosis
auggguguaacgcgucgacg

SEQ ID NO: 2815040 - RNA, 22 nt, Mycobacterium avium subsp. paratuberculosis
auggguucuucgaccacgcgcc

SEQ ID NO: 2815041 - RNA, 19 nt, Mycobacterium avium subsp. paratuberculosis
augguauccgaucgcggcc

SEQ ID NO: 2815042 - RNA, 20 nt, Mycobacterium avium subsp. paratuberculosis
augucgccgaacgccaccac

SEQ ID NO: 2815043 - RNA, 17 nt, Mycobacterium avium subsp. paratuberculosis
augucgccggcgaccgc

SEQ ID NO: 2815044 - RNA, 20 nt, Mycobacterium avium subsp. paratuberculosis
augucgccggcgaccgccuu

SEQ ID NO: 2815045 - RNA, 17 nt, Mycobacterium avium subsp. paratuberculosis
augucgccggcggcgau

SEQ ID NO: 2815046 - RNA, 21 nt, Mycobacterium avium subsp. paratuberculosis
augucgccguacaucauggcg

SEQ ID NO: 2815047 - RNA, 15 nt, Mycobacterium avium subsp. paratuberculosis
augucgcgcagcauc

SEQ ID NO: 2815048 - RNA, 20 nt, Mycobacterium avium subsp. paratuberculosis
augucgcgcagcauccgcac

SEQ ID NO: 2815049 - RNA, 13 nt, Mycobacterium avium subsp. paratuberculosis
augucgcggcgca

SEQ ID NO: 2815050 - RNA, 21 nt, Mycobacterium avium subsp. paratuberculosis
augucgcugccgccgccggcg

SEQ ID NO: 2815051 - RNA, 23 nt, Mycobacterium avium subsp. paratuberculosis
augucgcugccgccgccggcggu

SEQ ID NO: 2815052 - RNA, 18 nt, Mycobacterium avium subsp. paratuberculosis
augucggacucgcgccgg

SEQ ID NO: 2815053 - RNA, 15 nt, Mycobacterium avium subsp. paratuberculosis
augucggccagcgcg

SEQ ID NO: 2815054 - RNA, 13 nt, Mycobacterium avium subsp. paratuberculosis
augucggccagga

SEQ ID NO: 2815055 - RNA, 14 nt, Mycobacterium avium subsp. paratuberculosis
augucggcgacccg

SEQ ID NO: 2815056 - RNA, 15 nt, Mycobacterium avium subsp. paratuberculosis
augucggcggcccgg

SEQ ID NO: 2815057 - RNA, 22 nt, Mycobacterium avium subsp. paratuberculosis
augucggcuucguacggcccgg

SEQ ID NO: 2815058 - RNA, 22 nt, Mycobacterium avium subsp. paratuberculosis
augucgguaaggcaggcacuga

SEQ ID NO: 2815059 - RNA, 19 nt, Mycobacterium avium subsp. paratuberculosis
augucggugagcgccaccc

SEQ ID NO: 2815060 - RNA, 20 nt, Mycobacterium avium subsp. paratuberculosis
augucggugagcgccacccc

SEQ ID NO: 2815061 - RNA, 13 nt, Mycobacterium avium subsp. paratuberculosis
augucggugccga

SEQ ID NO: 2815062 - RNA, 17 nt, Mycobacterium avium subsp. paratuberculosis
augucggugcggcgggc

SEQ ID NO: 2815063 - RNA, 19 nt, Mycobacterium avium subsp. paratuberculosis
augucgguggacagcgcga

SEQ ID NO: 2815064 - RNA, 24 nt, Mycobacterium avium subsp. paratuberculosis
augucgguggccuuggccaccacg

SEQ ID NO: 2815065 - RNA, 15 nt, Mycobacterium avium subsp. paratuberculosis
augucgguggcgcgc

SEQ ID NO: 2815066 - RNA, 22 nt, Mycobacterium avium subsp. paratuberculosis
augucggugguguggcaggugg

SEQ ID NO: 2815067 - RNA, 18 nt, Mycobacterium avium subsp. paratuberculosis
augucggugugcagcagc

SEQ ID NO: 2815068 - RNA, 21 nt, Mycobacterium avium subsp. paratuberculosis
augucggugugcagcagcucg

SEQ ID NO: 2815069 - RNA, 14 nt, Mycobacterium avium subsp. paratuberculosis
augucguacgggcg

SEQ ID NO: 2815070 - RNA, 17 nt, Mycobacterium avium subsp. paratuberculosis
augucguccucccggcc

SEQ ID NO: 2815071 - RNA, 19 nt, Mycobacterium avium subsp. paratuberculosis
augucguccucggucaggc

SEQ ID NO: 2815072 - RNA, 13 nt, Mycobacterium avium subsp. paratuberculosis
augucgucgggcg

SEQ ID NO: 2815073 - RNA, 15 nt, Mycobacterium avium subsp. paratuberculosis
augucgucgucgacg

SEQ ID NO: 2815074 - RNA, 19 nt, Mycobacterium avium subsp. paratuberculosis
augucgugaccaaugcggu

SEQ ID NO: 2815075 - RNA, 14 nt, Mycobacterium avium subsp. paratuberculosis
augucguugaugcc

SEQ ID NO: 2815076 - RNA, 19 nt, Mycobacterium avium subsp. paratuberculosis
augucguugaugccgucga

SEQ ID NO: 2815077 - RNA, 16 nt, Mycobacterium avium subsp. paratuberculosis
augucguuggugucga

SEQ ID NO: 2815078 - RNA, 14 nt, Mycobacterium avium subsp. paratuberculosis
augucuagccgccg

SEQ ID NO: 2815079 - RNA, 19 nt, Mycobacterium avium subsp. paratuberculosis
augucuagccgccgagcgu

SEQ ID NO: 2815080 - RNA, 19 nt, Mycobacterium avium subsp. paratuberculosis
augugacgcgggaccgggc

SEQ ID NO: 2815081 - RNA, 23 nt, Mycobacterium avium subsp. paratuberculosis
augugacgcgggaccgggcccgg

SEQ ID NO: 2815082 - RNA, 16 nt, Mycobacterium avium subsp. paratuberculosis
augugagguggcuggg

SEQ ID NO: 2815083 - RNA, 16 nt, Mycobacterium avium subsp. paratuberculosis
augugccacagguaca

SEQ ID NO: 2815084 - RNA, 14 nt, Mycobacterium avium subsp. paratuberculosis
augugccugcgggc

SEQ ID NO: 2815085 - RNA, 16 nt, Mycobacterium avium subsp. paratuberculosis
augugccuggcccaga

SEQ ID NO: 2815086 - RNA, 13 nt, Mycobacterium avium subsp. paratuberculosis
augugcugcaggu

SEQ ID NO: 2815087 - RNA, 14 nt, Mycobacterium avium subsp. paratuberculosis
augugcugcagguu

SEQ ID NO: 2815088 - RNA, 14 nt, Mycobacterium avium subsp. paratuberculosis
auguggaagccgcg

SEQ ID NO: 2815089 - RNA, 20 nt, Mycobacterium avium subsp. paratuberculosis
auguggaagccgcgaucggc

SEQ ID NO: 2815090 - RNA, 18 nt, Mycobacterium avium subsp. paratuberculosis
augugggccgcagcagcg

SEQ ID NO: 2815091 - RNA, 15 nt, Mycobacterium avium subsp. paratuberculosis
augugggcgucgucg

SEQ ID NO: 2815092 - RNA, 13 nt, Mycobacterium avium subsp. paratuberculosis
auguggucggcca

SEQ ID NO: 2815093 - RNA, 22 nt, Mycobacterium avium subsp. paratuberculosis
auguugaugaucgagccgcggc

SEQ ID NO: 2815094 - RNA, 12 nt, Mycobacterium avium subsp. paratuberculosis
auguugcggccg

SEQ ID NO: 2815095 - RNA, 14 nt, Mycobacterium avium subsp. paratuberculosis
auguugcggccggc

SEQ ID NO: 2815096 - RNA, 14 nt, Mycobacterium avium subsp. paratuberculosis
auguugggccaugc

SEQ ID NO: 2815097 - RNA, 17 nt, Mycobacterium avium subsp. paratuberculosis
auguuguccggaacacc

SEQ ID NO: 2815098 - RNA, 19 nt, Mycobacterium avium subsp. paratuberculosis
auguugugcaggcagccgu

SEQ ID NO: 2815099 - RNA, 15 nt, Mycobacterium avium subsp. paratuberculosis
auguugugcccgacg

SEQ ID NO: 2815100 - RNA, 18 nt, Mycobacterium avium subsp. paratuberculosis
auguugugcccgacggcg

SEQ ID NO: 2815101 - RNA, 17 nt, Mycobacterium avium subsp. paratuberculosis
auuaaccggcaggccgu

SEQ ID NO: 2815102 - RNA, 14 nt, Mycobacterium avium subsp. paratuberculosis
auuaagcuggcagg

SEQ ID NO: 2815103 - RNA, 14 nt, Mycobacterium avium subsp. paratuberculosis
auuacgaccaguuc

SEQ ID NO: 2815104 - RNA, 22 nt, Mycobacterium avium subsp. paratuberculosis
auuacgguacuguuacgcccga

SEQ ID NO: 2815105 - RNA, 21 nt, Mycobacterium avium subsp. paratuberculosis
auuacucgccggcggcgccgg

SEQ ID NO: 2815106 - RNA, 23 nt, Mycobacterium avium subsp. paratuberculosis
auuaggucgguggccaccaccga

SEQ ID NO: 2815107 - RNA, 16 nt, Mycobacterium avium subsp. paratuberculosis
auucacgaggccgggc

SEQ ID NO: 2815108 - RNA, 14 nt, Mycobacterium avium subsp. paratuberculosis
auucacgcagcugg

SEQ ID NO: 2815109 - RNA, 19 nt, Mycobacterium avium subsp. paratuberculosis
auucagcgucgccaugccg

SEQ ID NO: 2815110 - RNA, 14 nt, Mycobacterium avium subsp. paratuberculosis
auucaggucaccgc

SEQ ID NO: 2815111 - RNA, 16 nt, Mycobacterium avium subsp. paratuberculosis
auuccaccguggucgg

SEQ ID NO: 2815112 - RNA, 15 nt, Mycobacterium avium subsp. paratuberculosis
auuccagaucugucu

SEQ ID NO: 2815113 - RNA, 10 nt, Mycobacterium avium subsp. paratuberculosis
auuccagcaa

SEQ ID NO: 2815114 - RNA, 21 nt, Mycobacterium avium subsp. paratuberculosis
auuccagcaacugcucgacca

SEQ ID NO: 2815115 - RNA, 13 nt, Mycobacterium avium subsp. paratuberculosis
auuccagcgcgac

SEQ ID NO: 2815116 - RNA, 23 nt, Mycobacterium avium subsp. paratuberculosis
auuccagcgcguagucggcgucg

SEQ ID NO: 2815117 - RNA, 14 nt, Mycobacterium avium subsp. paratuberculosis
auuccaugucgucg

SEQ ID NO: 2815118 - RNA, 14 nt, Mycobacterium avium subsp. paratuberculosis
auuccccguaguca

SEQ ID NO: 2815119 - RNA, 14 nt, Mycobacterium avium subsp. paratuberculosis
auucccgaccccgc

SEQ ID NO: 2815120 - RNA, 14 nt, Mycobacterium avium subsp. paratuberculosis
auucccgccgccgc

SEQ ID NO: 2815121 - RNA, 14 nt, Mycobacterium avium subsp. paratuberculosis
auuccgacgugccg

SEQ ID NO: 2815122 - RNA, 16 nt, Mycobacterium avium subsp. paratuberculosis
auuccgacgugccgug

SEQ ID NO: 2815123 - RNA, 14 nt, Mycobacterium avium subsp. paratuberculosis
auuccgccagaacg

SEQ ID NO: 2815124 - RNA, 13 nt, Mycobacterium avium subsp. paratuberculosis
auuccggcgcgau

SEQ ID NO: 2815125 - RNA, 20 nt, Mycobacterium avium subsp. paratuberculosis
auuccggggaaccgcccuuc

SEQ ID NO: 2815126 - RNA, 22 nt, Mycobacterium avium subsp. paratuberculosis
auuccggggaaccgcccuucca

SEQ ID NO: 2815127 - RNA, 15 nt, Mycobacterium avium subsp. paratuberculosis
auuucccgacuccuc

SEQ ID NO: 2815128 - RNA, 13 nt, Mycobacterium avium subsp. paratuberculosis
auuuccuggccga

SEQ ID NO: 2815129 - RNA, 14 nt, Mycobacterium avium subsp. paratuberculosis
auuucgagcacacg

SEQ ID NO: 2815130 - RNA, 18 nt, Mycobacterium avium subsp. paratuberculosis
auuucgccugcagccgcc

SEQ ID NO: 2815131 - RNA, 17 nt, Mycobacterium avium subsp. paratuberculosis
auuucggacggcgacgg

SEQ ID NO: 2815132 - RNA, 20 nt, Mycobacterium avium subsp. paratuberculosis
auuucggcguggcgguggcg

SEQ ID NO: 2815133 - RNA, 15 nt, Mycobacterium avium subsp. paratuberculosis
auuuggcuagcgggc

SEQ ID NO: 2815134 - RNA, 16 nt, Mycobacterium avium subsp. paratuberculosis
caaaaacgagaugccc

SEQ ID NO: 2815135 - RNA, 13 nt, Mycobacterium avium subsp. paratuberculosis
caaaacaacgcgc

SEQ ID NO: 2815136 - RNA, 17 nt, Mycobacterium avium subsp. paratuberculosis
caaaacgcugggcgccg

SEQ ID NO: 2815137 - RNA, 17 nt, Mycobacterium avium subsp. paratuberculosis
caaaagcauccggccgu

SEQ ID NO: 2815138 - RNA, 23 nt, Mycobacterium avium subsp. paratuberculosis
caaaagcauccggccgucgucgg

SEQ ID NO: 2815139 - RNA, 15 nt, Mycobacterium avium subsp. paratuberculosis
caaaagcccgagauc

SEQ ID NO: 2815140 - RNA, 15 nt, Mycobacterium avium subsp. paratuberculosis
caaaauagcugcgac

SEQ ID NO: 2815141 - RNA, 23 nt, Mycobacterium avium subsp. paratuberculosis
caaacacgagcagacccgccgcg

SEQ ID NO: 2815142 - RNA, 18 nt, Mycobacterium avium subsp. paratuberculosis
caaacccagcaccaacag

SEQ ID NO: 2815143 - RNA, 21 nt, Mycobacterium avium subsp. paratuberculosis
caaacccauugucgccgugcg

SEQ ID NO: 2815144 - RNA, 18 nt, Mycobacterium avium subsp. paratuberculosis
caaaccccuuggcgucca

SEQ ID NO: 2815145 - RNA, 16 nt, Mycobacterium avium subsp. paratuberculosis
caaacccguugcagca

SEQ ID NO: 2815146 - RNA, 12 nt, Mycobacterium avium subsp. paratuberculosis
caaaccgaccgc

SEQ ID NO: 2815147 - RNA, 16 nt, Mycobacterium avium subsp. paratuberculosis
caaaccgaccgccgcg

SEQ ID NO: 2815148 - RNA, 18 nt, Mycobacterium avium subsp. paratuberculosis
caaaccgaccgccgcggc

SEQ ID NO: 2815149 - RNA, 13 nt, Mycobacterium avium subsp. paratuberculosis
caaaccggaccgc

SEQ ID NO: 2815150 - RNA, 17 nt, Mycobacterium avium subsp. paratuberculosis
caaaccggaccgccgcg

SEQ ID NO: 2815151 - RNA, 17 nt, Mycobacterium avium subsp. paratuberculosis
caaaccguugaccacca

SEQ ID NO: 2815152 - RNA, 15 nt, Mycobacterium avium subsp. paratuberculosis
caaacgaaucgagcc

SEQ ID NO: 2815153 - RNA, 18 nt, Mycobacterium avium subsp. paratuberculosis
caaacgaaucgagccgcc

SEQ ID NO: 2815154 - RNA, 15 nt, Mycobacterium avium subsp. paratuberculosis
caaacuccgggggau

SEQ ID NO: 2815155 - RNA, 12 nt, Mycobacterium avium subsp. paratuberculosis
caaacugacagg

SEQ ID NO: 2815156 - RNA, 23 nt, Mycobacterium avium subsp. paratuberculosis
caaagaucacagcgcccuugagc

SEQ ID NO: 2815157 - RNA, 19 nt, Mycobacterium avium subsp. paratuberculosis
caaagcaccgcgaacagca

SEQ ID NO: 2815158 - RNA, 14 nt, Mycobacterium avium subsp. paratuberculosis
caaagcccgggaug

SEQ ID NO: 2815159 - RNA, 18 nt, Mycobacterium avium subsp. paratuberculosis
caaagccgguggcagccc

SEQ ID NO: 2815160 - RNA, 18 nt, Mycobacterium avium subsp. paratuberculosis
caaagccguucgcgccga

SEQ ID NO: 2815161 - RNA, 18 nt, Mycobacterium avium subsp. paratuberculosis
caaagccuacggcgccgg

SEQ ID NO: 2815162 - RNA, 19 nt, Mycobacterium avium subsp. paratuberculosis
caaagcggcuaagccggcg

SEQ ID NO: 2815163 - RNA, 20 nt, Mycobacterium avium subsp. paratuberculosis
caaagcguugccgcgcgccc

SEQ ID NO: 2815164 - RNA, 17 nt, Mycobacterium avium subsp. paratuberculosis
caaauagccgucggcgg

SEQ ID NO: 2815165 - RNA, 16 nt, Mycobacterium avium subsp. paratuberculosis
caaauccagcagcgcg

SEQ ID NO: 2815166 - RNA, 18 nt, Mycobacterium avium subsp. paratuberculosis
caaaucccgcagcucgca

SEQ ID NO: 2815167 - RNA, 23 nt, Mycobacterium avium subsp. paratuberculosis
caaauccggcagcgcucgucguc

SEQ ID NO: 2815168 - RNA, 16 nt, Mycobacterium avium subsp. paratuberculosis
caaaucgcuugcgccg

SEQ ID NO: 2815169 - RNA, 18 nt, Mycobacterium avium subsp. paratuberculosis
caaaucgcuugcgccgca

SEQ ID NO: 2815170 - RNA, 17 nt, Mycobacterium avium subsp. paratuberculosis
caacaacgccagcguga

SEQ ID NO: 2815171 - RNA, 22 nt, Mycobacterium avium subsp. paratuberculosis
caacaacucgacgcucggcgau

SEQ ID NO: 2815172 - RNA, 17 nt, Mycobacterium avium subsp. paratuberculosis
caacaacuucgagcaga

SEQ ID NO: 2815173 - RNA, 16 nt, Mycobacterium avium subsp. paratuberculosis
caacaccaacgacagc

SEQ ID NO: 2815174 - RNA, 18 nt, Mycobacterium avium subsp. paratuberculosis
caacaccaacgacagcga

SEQ ID NO: 2815175 - RNA, 20 nt, Mycobacterium avium subsp. paratuberculosis
caacaccaacgacagcgacg

SEQ ID NO: 2815176 - RNA, 14 nt, Mycobacterium avium subsp. paratuberculosis
caacaccaccuugg

SEQ ID NO: 2815177 - RNA, 13 nt, Mycobacterium avium subsp. paratuberculosis
caacaccacgucg

SEQ ID NO: 2815178 - RNA, 17 nt, Mycobacterium avium subsp. paratuberculosis
caacaccagcuggaugg

SEQ ID NO: 2815179 - RNA, 19 nt, Mycobacterium avium subsp. paratuberculosis
caacacccagccgcugaac

SEQ ID NO: 2815180 - RNA, 21 nt, Mycobacterium avium subsp. paratuberculosis
caacacccccgcgcugcccag

SEQ ID NO: 2815181 - RNA, 17 nt, Mycobacterium avium subsp. paratuberculosis
caacacccuugcgccgc

SEQ ID NO: 2815182 - RNA, 18 nt, Mycobacterium avium subsp. paratuberculosis
caacaccgaaagccgaca

SEQ ID NO: 2815183 - RNA, 18 nt, Mycobacterium avium subsp. paratuberculosis
caacaccgaaagccguac

SEQ ID NO: 2815184 - RNA, 12 nt, Mycobacterium avium subsp. paratuberculosis
caacaccggcgg

SEQ ID NO: 2815185 - RNA, 15 nt, Mycobacterium avium subsp. paratuberculosis
caacaccggcggcga

SEQ ID NO: 2815186 - RNA, 18 nt, Mycobacterium avium subsp. paratuberculosis
caacaccggcggcgacgg

SEQ ID NO: 2815187 - RNA, 20 nt, Mycobacterium avium subsp. paratuberculosis
caacaccgggauccggcgcg

SEQ ID NO: 2815188 - RNA, 17 nt, Mycobacterium avium subsp. paratuberculosis
caacaccgguccggccg

SEQ ID NO: 2815189 - RNA, 13 nt, Mycobacterium avium subsp. paratuberculosis
caacaccucggcg

SEQ ID NO: 2815190 - RNA, 15 nt, Mycobacterium avium subsp. paratuberculosis
caacaccucggcgac

SEQ ID NO: 2815191 - RNA, 16 nt, Mycobacterium avium subsp. paratuberculosis
caacaccucggcgacg

SEQ ID NO: 2815192 - RNA, 17 nt, Mycobacterium avium subsp. paratuberculosis
caacaccucggcgacgu

SEQ ID NO: 2815193 - RNA, 23 nt, Mycobacterium avium subsp. paratuberculosis
caacaccucggcgacguccuuga

SEQ ID NO: 2815194 - RNA, 13 nt, Mycobacterium avium subsp. paratuberculosis
caacaccucgggc

SEQ ID NO: 2815195 - RNA, 18 nt, Mycobacterium avium subsp. paratuberculosis
caacacgauggcggccca

SEQ ID NO: 2815196 - RNA, 16 nt, Mycobacterium avium subsp. paratuberculosis
caacacggcggcgcgc

SEQ ID NO: 2815197 - RNA, 22 nt, Mycobacterium avium subsp. paratuberculosis
caacacggcggcgcgcacguca

SEQ ID NO: 2815198 - RNA, 16 nt, Mycobacterium avium subsp. paratuberculosis
caacacgucguccggc

SEQ ID NO: 2815199 - RNA, 19 nt, Mycobacterium avium subsp. paratuberculosis
caacacgucguccggcgcg

SEQ ID NO: 2815200 - RNA, 20 nt, Mycobacterium avium subsp. paratuberculosis
caacacgucguccggcgcgc

SEQ ID NO: 2815201 - RNA, 21 nt, Mycobacterium avium subsp. paratuberculosis
caacacgucguccggcgcgca

SEQ ID NO: 2815202 - RNA, 16 nt, Mycobacterium avium subsp. paratuberculosis
caacacgucgucgugc

SEQ ID NO: 2815203 - RNA, 19 nt, Mycobacterium avium subsp. paratuberculosis
caacacucgagcgcgcuca

SEQ ID NO: 2815204 - RNA, 19 nt, Mycobacterium avium subsp. paratuberculosis
caacacuuuuaaggagcaa

SEQ ID NO: 2815205 - RNA, 17 nt, Mycobacterium avium subsp. paratuberculosis
caacagcaccagcacca

SEQ ID NO: 2815206 - RNA, 17 nt, Mycobacterium avium subsp. paratuberculosis
caacagcaccucgucgc

SEQ ID NO: 2815207 - RNA, 14 nt, Mycobacterium avium subsp. paratuberculosis
caacagcagcagaa

SEQ ID NO: 2815208 - RNA, 20 nt, Mycobacterium avium subsp. paratuberculosis
caacagcagcgaggcgucca

SEQ ID NO: 2815209 - RNA, 14 nt, Mycobacterium avium subsp. paratuberculosis
caacagcagcgccg

SEQ ID NO: 2815210 - RNA, 20 nt, Mycobacterium avium subsp. paratuberculosis
caacagcagcgccgcggccg

SEQ ID NO: 2815211 - RNA, 12 nt, Mycobacterium avium subsp. paratuberculosis
caacagcagcgg

SEQ ID NO: 2815212 - RNA, 19 nt, Mycobacterium avium subsp. paratuberculosis
caaccgggauaccgcgacc

SEQ ID NO: 2815213 - RNA, 23 nt, Mycobacterium avium subsp. paratuberculosis
caaccgggauaccgcgaccgccu

SEQ ID NO: 2815214 - RNA, 21 nt, Mycobacterium avium subsp. paratuberculosis
caaccgguagaagaugcgccg

SEQ ID NO: 2815215 - RNA, 23 nt, Mycobacterium avium subsp. paratuberculosis
caaccgguagaagaugcgccggg

SEQ ID NO: 2815216 - RNA, 19 nt, Mycobacterium avium subsp. paratuberculosis
caaccgguagcgguccucg

SEQ ID NO: 2815217 - RNA, 20 nt, Mycobacterium avium subsp. paratuberculosis
caaccgguagcgguccucga

SEQ ID NO: 2815218 - RNA, 20 nt, Mycobacterium avium subsp. paratuberculosis
caaccgguccaguccggccg

SEQ ID NO: 2815219 - RNA, 17 nt, Mycobacterium avium subsp. paratuberculosis
caaccgguccgccgucg

SEQ ID NO: 2815220 - RNA, 18 nt, Mycobacterium avium subsp. paratuberculosis
caaccgguucggacacgg

SEQ ID NO: 2815221 - RNA, 23 nt, Mycobacterium avium subsp. paratuberculosis
caaccgucaguucguagaucacg

SEQ ID NO: 2815222 - RNA, 20 nt, Mycobacterium avium subsp. paratuberculosis
caaccgugacugggugggac

SEQ ID NO: 2815223 - RNA, 15 nt, Mycobacterium avium subsp. paratuberculosis
caaccguucaacggc

SEQ ID NO: 2815224 - RNA, 20 nt, Mycobacterium avium subsp. paratuberculosis
caaccguuggugcgguguca

SEQ ID NO: 2815225 - RNA, 15 nt, Mycobacterium avium subsp. paratuberculosis
caaccugggcggcgg

SEQ ID NO: 2815226 - RNA, 17 nt, Mycobacterium avium subsp. paratuberculosis
caaccugggcggcggcg

SEQ ID NO: 2815227 - RNA, 20 nt, Mycobacterium avium subsp. paratuberculosis
caaccugggcggcggcggga

SEQ ID NO: 2815228 - RNA, 18 nt, Mycobacterium avium subsp. paratuberculosis
caaccugugccauagacc

SEQ ID NO: 2815229 - RNA, 17 nt, Mycobacterium avium subsp. paratuberculosis
caacgacagcgacgggc

SEQ ID NO: 2815230 - RNA, 19 nt, Mycobacterium avium subsp. paratuberculosis
caacgacagcgacgggccg

SEQ ID NO: 2815231 - RNA, 23 nt, Mycobacterium avium subsp. paratuberculosis
caacgacauccagaugcccagca

SEQ ID NO: 2815232 - RNA, 20 nt, Mycobacterium avium subsp. paratuberculosis
caacgacccggccaccgccg

SEQ ID NO: 2815233 - RNA, 23 nt, Mycobacterium avium subsp. paratuberculosis
caacgacccgucggggugcgcca

SEQ ID NO: 2815234 - RNA, 14 nt, Mycobacterium avium subsp. paratuberculosis
caacgacgucggcg

SEQ ID NO: 2815235 - RNA, 15 nt, Mycobacterium avium subsp. paratuberculosis
caacgacgucggcgu

SEQ ID NO: 2815236 - RNA, 18 nt, Mycobacterium avium subsp. paratuberculosis
caacgacgucggcgucau

SEQ ID NO: 2815237 - RNA, 20 nt, Mycobacterium avium subsp. paratuberculosis
caacgacgucggcgucaucg

SEQ ID NO: 2815238 - RNA, 22 nt, Mycobacterium avium subsp. paratuberculosis
caacgagacacccucgcgcagg

SEQ ID NO: 2815239 - RNA, 20 nt, Mycobacterium avium subsp. paratuberculosis
caacgagcgcgccgaggugg

SEQ ID NO: 2815240 - RNA, 22 nt, Mycobacterium avium subsp. paratuberculosis
caacgagcugacgaacgcgccg

SEQ ID NO: 2815241 - RNA, 16 nt, Mycobacterium avium subsp. paratuberculosis
caacgaggcacggccc

SEQ ID NO: 2815242 - RNA, 19 nt, Mycobacterium avium subsp. paratuberculosis
caacgaggccagggcccgc

SEQ ID NO: 2815243 - RNA, 14 nt, Mycobacterium avium subsp. paratuberculosis
caacgaggcccgga

SEQ ID NO: 2815244 - RNA, 16 nt, Mycobacterium avium subsp. paratuberculosis
caacgaggcccggacg

SEQ ID NO: 2815245 - RNA, 22 nt, Mycobacterium avium subsp. paratuberculosis
caacgaggcccggacggccacc

SEQ ID NO: 2815246 - RNA, 23 nt, Mycobacterium avium subsp. paratuberculosis
caacgauuuccgguuccucggcg

SEQ ID NO: 2815247 - RNA, 19 nt, Mycobacterium avium subsp. paratuberculosis
caacgcaaugcgucgcggc

SEQ ID NO: 2815248 - RNA, 15 nt, Mycobacterium avium subsp. paratuberculosis
caacgcacgggcggc

SEQ ID NO: 2815249 - RNA, 21 nt, Mycobacterium avium subsp. paratuberculosis
caacgccacaaacagcgcggc

SEQ ID NO: 2815250 - RNA, 14 nt, Mycobacterium avium subsp. paratuberculosis
caacgccgccgaca

SEQ ID NO: 2815251 - RNA, 15 nt, Mycobacterium avium subsp. paratuberculosis
caacgccgccuccga

SEQ ID NO: 2815252 - RNA, 17 nt, Mycobacterium avium subsp. paratuberculosis
caacgccgccuccgaca

SEQ ID NO: 2815253 - RNA, 19 nt, Mycobacterium avium subsp. paratuberculosis
caacgccgcgcgcagcaca

SEQ ID NO: 2815254 - RNA, 13 nt, Mycobacterium avium subsp. paratuberculosis
caacgccggcgug

SEQ ID NO: 2815255 - RNA, 14 nt, Mycobacterium avium subsp. paratuberculosis
caacgccggcgugc

SEQ ID NO: 2815256 - RNA, 14 nt, Mycobacterium avium subsp. paratuberculosis
caacgccgggucga

SEQ ID NO: 2815257 - RNA, 19 nt, Mycobacterium avium subsp. paratuberculosis
caacgccgggucgacgccg

SEQ ID NO: 2815258 - RNA, 20 nt, Mycobacterium avium subsp. paratuberculosis
caacgccgggucgacgccga

SEQ ID NO: 2815259 - RNA, 23 nt, Mycobacterium avium subsp. paratuberculosis
caacgccuccgaauccagcgcgc

SEQ ID NO: 2815260 - RNA, 22 nt, Mycobacterium avium subsp. paratuberculosis
caacgccucgucgaccgcggcc

SEQ ID NO: 2815261 - RNA, 22 nt, Mycobacterium avium subsp. paratuberculosis
caacgcgauucucgcugcggcg

SEQ ID NO: 2815262 - RNA, 23 nt, Mycobacterium avium subsp. paratuberculosis
caacgcgcagccaggacuccuug

SEQ ID NO: 2815263 - RNA, 14 nt, Mycobacterium avium subsp. paratuberculosis
caacgcgccgaugc

SEQ ID NO: 2815264 - RNA, 15 nt, Mycobacterium avium subsp. paratuberculosis
caacgcgccgaugcc

SEQ ID NO: 2815265 - RNA, 14 nt, Mycobacterium avium subsp. paratuberculosis
caacgcgccggcgg

SEQ ID NO: 2815266 - RNA, 15 nt, Mycobacterium avium subsp. paratuberculosis
caacgcgccggcggu

SEQ ID NO: 2815267 - RNA, 16 nt, Mycobacterium avium subsp. paratuberculosis
caacgcgccggcgguc

SEQ ID NO: 2815268 - RNA, 18 nt, Mycobacterium avium subsp. paratuberculosis
caacgcgccggcggucga

SEQ ID NO: 2815269 - RNA, 22 nt, Mycobacterium avium subsp. paratuberculosis
caacgcgccggcggucgacacg

SEQ ID NO: 2815270 - RNA, 18 nt, Mycobacterium avium subsp. paratuberculosis
caacgcgcgcgacggcgc

SEQ ID NO: 2815271 - RNA, 17 nt, Mycobacterium avium subsp. paratuberculosis
caacgcggcaugaccgg

SEQ ID NO: 2815272 - RNA, 14 nt, Mycobacterium avium subsp. paratuberculosis
caacgcggccacca

SEQ ID NO: 2815273 - RNA, 14 nt, Mycobacterium avium subsp. paratuberculosis
caacgcggcgccgg

SEQ ID NO: 2815274 - RNA, 14 nt, Mycobacterium avium subsp. paratuberculosis
caacgcggcgguga

SEQ ID NO: 2815275 - RNA, 16 nt, Mycobacterium avium subsp. paratuberculosis
caacgcggcggugacg

SEQ ID NO: 2815276 - RNA, 20 nt, Mycobacterium avium subsp. paratuberculosis
caacgcggcggugacgaacc

SEQ ID NO: 2815277 - RNA, 20 nt, Mycobacterium avium subsp. paratuberculosis
caacgcgguguuggcggcgu

SEQ ID NO: 2815278 - RNA, 21 nt, Mycobacterium avium subsp. paratuberculosis
caacgcgucgaacagccgggc

SEQ ID NO: 2815279 - RNA, 22 nt, Mycobacterium avium subsp. paratuberculosis
caacgcgucgaacagccgggcc

SEQ ID NO: 2815280 - RNA, 15 nt, Mycobacterium avium subsp. paratuberculosis
caacgcgucggcgcc

SEQ ID NO: 2815281 - RNA, 16 nt, Mycobacterium avium subsp. paratuberculosis
caacgcgugaugcagc

SEQ ID NO: 2815282 - RNA, 14 nt, Mycobacterium avium subsp. paratuberculosis
caacgcguucuccu

SEQ ID NO: 2815283 - RNA, 17 nt, Mycobacterium avium subsp. paratuberculosis
caacgcguucuccucga

SEQ ID NO: 2815284 - RNA, 22 nt, Mycobacterium avium subsp. paratuberculosis
caacgcuuucgggucgacgagc

SEQ ID NO: 2815285 - RNA, 16 nt, Mycobacterium avium subsp. paratuberculosis
caacggauagcguccg

SEQ ID NO: 2815286 - RNA, 19 nt, Mycobacterium avium subsp. paratuberculosis
caacggaucgagcgcaccg

SEQ ID NO: 2815287 - RNA, 20 nt, Mycobacterium avium subsp. paratuberculosis
caacggauucagcgucgcca

SEQ ID NO: 2815288 - RNA, 20 nt, Mycobacterium avium subsp. paratuberculosis
caacggcaccaccacggugg

SEQ ID NO: 2815289 - RNA, 14 nt, Mycobacterium avium subsp. paratuberculosis
caacggcaccgaca

SEQ ID NO: 2815290 - RNA, 14 nt, Mycobacterium avium subsp. paratuberculosis
caacggccaaccgc

SEQ ID NO: 2815291 - RNA, 20 nt, Mycobacterium avium subsp. paratuberculosis
caacggccaaccgcccggcg

SEQ ID NO: 2815292 - RNA, 12 nt, Mycobacterium avium subsp. paratuberculosis
caacggccccca

SEQ ID NO: 2815293 - RNA, 14 nt, Mycobacterium avium subsp. paratuberculosis
caacggccgcacgu

SEQ ID NO: 2815294 - RNA, 14 nt, Mycobacterium avium subsp. paratuberculosis
caacggccggcgcc

SEQ ID NO: 2815295 - RNA, 15 nt, Mycobacterium avium subsp. paratuberculosis
caacggccggcgccg

SEQ ID NO: 2815296 - RNA, 23 nt, Mycobacterium avium subsp. paratuberculosis
caagacguccgcgucggcgccgg

SEQ ID NO: 2815297 - RNA, 14 nt, Mycobacterium avium subsp. paratuberculosis
caagauaccggccg

SEQ ID NO: 2815298 - RNA, 15 nt, Mycobacterium avium subsp. paratuberculosis
caagauaccggccgg

SEQ ID NO: 2815299 - RNA, 14 nt, Mycobacterium avium subsp. paratuberculosis
caagauaggagaca

SEQ ID NO: 2815300 - RNA, 18 nt, Mycobacterium avium subsp. paratuberculosis
caagaugauugcgugccc

SEQ ID NO: 2815301 - RNA, 21 nt, Mycobacterium avium subsp. paratuberculosis
caagaugauugcgugcccggc

SEQ ID NO: 2815302 - RNA, 12 nt, Mycobacterium avium subsp. paratuberculosis
caagcaccggcu

SEQ ID NO: 2815303 - RNA, 17 nt, Mycobacterium avium subsp. paratuberculosis
caagcaccggcuggccg

SEQ ID NO: 2815304 - RNA, 15 nt, Mycobacterium avium subsp. paratuberculosis
caagcagagcagcga

SEQ ID NO: 2815305 - RNA, 14 nt, Mycobacterium avium subsp. paratuberculosis
caagcagcggcagc

SEQ ID NO: 2815306 - RNA, 16 nt, Mycobacterium avium subsp. paratuberculosis
caagcagcggcagcca

SEQ ID NO: 2815307 - RNA, 22 nt, Mycobacterium avium subsp. paratuberculosis
caagcaguaugcccgccgcuga

SEQ ID NO: 2815308 - RNA, 15 nt, Mycobacterium avium subsp. paratuberculosis
caagcaguccccgcc

SEQ ID NO: 2815309 - RNA, 21 nt, Mycobacterium avium subsp. paratuberculosis
caagccgaguuugcggugauc

SEQ ID NO: 2815310 - RNA, 17 nt, Mycobacterium avium subsp. paratuberculosis
caagccggccagcagcg

SEQ ID NO: 2815311 - RNA, 19 nt, Mycobacterium avium subsp. paratuberculosis
caagccggccagcagcggc

SEQ ID NO: 2815312 - RNA, 16 nt, Mycobacterium avium subsp. paratuberculosis
caagccggccaggccc

SEQ ID NO: 2815313 - RNA, 17 nt, Mycobacterium avium subsp. paratuberculosis
caagccggcgucgauga

SEQ ID NO: 2815314 - RNA, 21 nt, Mycobacterium avium subsp. paratuberculosis
caagccgggcggcagcagcug

SEQ ID NO: 2815315 - RNA, 21 nt, Mycobacterium avium subsp. paratuberculosis
caagcgaagccgugacccgcc

SEQ ID NO: 2815316 - RNA, 23 nt, Mycobacterium avium subsp. paratuberculosis
caagcgauuacacaucaggaucg

SEQ ID NO: 2815317 - RNA, 15 nt, Mycobacterium avium subsp. paratuberculosis
caagcgcgacaagca

SEQ ID NO: 2815318 - RNA, 21 nt, Mycobacterium avium subsp. paratuberculosis
caagcgcuuugaucagcucgc

SEQ ID NO: 2815319 - RNA, 21 nt, Mycobacterium avium subsp. paratuberculosis
caagcgguuccagaccggcgg

SEQ ID NO: 2815320 - RNA, 20 nt, Mycobacterium avium subsp. paratuberculosis
caaggagaaggccgcgcgca

SEQ ID NO: 2815321 - RNA, 17 nt, Mycobacterium avium subsp. paratuberculosis
caaggagguggucgagc

SEQ ID NO: 2815322 - RNA, 17 nt, Mycobacterium avium subsp. paratuberculosis
caaggcaaucaggcggu

SEQ ID NO: 2815323 - RNA, 13 nt, Mycobacterium avium subsp. paratuberculosis
caaggccagcaac

SEQ ID NO: 2815324 - RNA, 16 nt, Mycobacterium avium subsp. paratuberculosis
caaggccagcaaccgc

SEQ ID NO: 2815325 - RNA, 20 nt, Mycobacterium avium subsp. paratuberculosis
caaggccagcaaccgccgug

SEQ ID NO: 2815326 - RNA, 16 nt, Mycobacterium avium subsp. paratuberculosis
caaggcccccgccucg

SEQ ID NO: 2815327 - RNA, 23 nt, Mycobacterium avium subsp. paratuberculosis
caaggcccccgccucgccgguca

SEQ ID NO: 2815328 - RNA, 21 nt, Mycobacterium avium subsp. paratuberculosis
caaggccgacagguagcaggc

SEQ ID NO: 2815329 - RNA, 23 nt, Mycobacterium avium subsp. paratuberculosis
caaggccgacagguagcaggcgc

SEQ ID NO: 2815330 - RNA, 11 nt, Mycobacterium avium subsp. paratuberculosis
caaggccugcg

SEQ ID NO: 2815331 - RNA, 19 nt, Mycobacterium avium subsp. paratuberculosis
caaggccugcgccuuggcc

SEQ ID NO: 2815332 - RNA, 22 nt, Mycobacterium avium subsp. paratuberculosis
caaggccuuggugugagggcgu

SEQ ID NO: 2815333 - RNA, 13 nt, Mycobacterium avium subsp. paratuberculosis
caaggcgaugccc

SEQ ID NO: 2815334 - RNA, 18 nt, Mycobacterium avium subsp. paratuberculosis
caaggcgaugcccagcca

SEQ ID NO: 2815335 - RNA, 19 nt, Mycobacterium avium subsp. paratuberculosis
caaggcggacaacgggaua

SEQ ID NO: 2815336 - RNA, 18 nt, Mycobacterium avium subsp. paratuberculosis
caagggccaccgggccga

SEQ ID NO: 2815337 - RNA, 13 nt, Mycobacterium avium subsp. paratuberculosis
caagggccgggcg

SEQ ID NO: 2815338 - RNA, 20 nt, Mycobacterium avium subsp. paratuberculosis
caagggcggguaggcgccga

SEQ ID NO: 2815339 - RNA, 14 nt, Mycobacterium avium subsp. paratuberculosis
caaggggaacaacg

SEQ ID NO: 2815340 - RNA, 13 nt, Mycobacterium avium subsp. paratuberculosis
caaggggccgggc

SEQ ID NO: 2815341 - RNA, 19 nt, Mycobacterium avium subsp. paratuberculosis
caaggguuuugcggaucgg

SEQ ID NO: 2815342 - RNA, 17 nt, Mycobacterium avium subsp. paratuberculosis
caaggucgucgcggcca

SEQ ID NO: 2815343 - RNA, 16 nt, Mycobacterium avium subsp. paratuberculosis
caaggucuccgggcug

SEQ ID NO: 2815344 - RNA, 23 nt, Mycobacterium avium subsp. paratuberculosis
caaggugauucgcgcggcgccca

SEQ ID NO: 2815345 - RNA, 17 nt, Mycobacterium avium subsp. paratuberculosis
caaggugccguccgggu

SEQ ID NO: 2815346 - RNA, 17 nt, Mycobacterium avium subsp. paratuberculosis
caagguggacgagcagc

SEQ ID NO: 2815347 - RNA, 20 nt, Mycobacterium avium subsp. paratuberculosis
caagguguggaucaccauca

SEQ ID NO: 2815348 - RNA, 20 nt, Mycobacterium avium subsp. paratuberculosis
caagguguuguaggagcugc

SEQ ID NO: 2815349 - RNA, 19 nt, Mycobacterium avium subsp. paratuberculosis
caaguagcgcuccaccagg

SEQ ID NO: 2815350 - RNA, 15 nt, Mycobacterium avium subsp. paratuberculosis
caagucaugccgcgc

SEQ ID NO: 2815351 - RNA, 16 nt, Mycobacterium avium subsp. paratuberculosis
caagucaugccgcgcu

SEQ ID NO: 2815352 - RNA, 20 nt, Mycobacterium avium subsp. paratuberculosis
caaguccucgguggccaccu

SEQ ID NO: 2815353 - RNA, 12 nt, Mycobacterium avium subsp. paratuberculosis
caagucgaacgg

SEQ ID NO: 2815354 - RNA, 16 nt, Mycobacterium avium subsp. paratuberculosis
caagucggcggugaug

SEQ ID NO: 2815355 - RNA, 16 nt, Mycobacterium avium subsp. paratuberculosis
caagucgucggugggc

SEQ ID NO: 2815356 - RNA, 23 nt, Mycobacterium avium subsp. paratuberculosis
caagucgucggugggccgccgcg

SEQ ID NO: 2815357 - RNA, 17 nt, Mycobacterium avium subsp. paratuberculosis
caagugaugaccuggau

SEQ ID NO: 2815358 - RNA, 15 nt, Mycobacterium avium subsp. paratuberculosis
caagugcgguguggc

SEQ ID NO: 2815359 - RNA, 23 nt, Mycobacterium avium subsp. paratuberculosis
caagugcgguguggccgcggugg

SEQ ID NO: 2815360 - RNA, 16 nt, Mycobacterium avium subsp. paratuberculosis
caauacccgaccagca

SEQ ID NO: 2815361 - RNA, 17 nt, Mycobacterium avium subsp. paratuberculosis
caauacccgaccagcac

SEQ ID NO: 2815362 - RNA, 19 nt, Mycobacterium avium subsp. paratuberculosis
caauacccgaccagcaccg

SEQ ID NO: 2815363 - RNA, 14 nt, Mycobacterium avium subsp. paratuberculosis
caauacggcccggc

SEQ ID NO: 2815364 - RNA, 20 nt, Mycobacterium avium subsp. paratuberculosis
caauacggugcccgccgcga

SEQ ID NO: 2815365 - RNA, 21 nt, Mycobacterium avium subsp. paratuberculosis
caauacggugcccgccgcgac

SEQ ID NO: 2815366 - RNA, 12 nt, Mycobacterium avium subsp. paratuberculosis
caaucaccgcgg

SEQ ID NO: 2815367 - RNA, 15 nt, Mycobacterium avium subsp. paratuberculosis
caaucaggcggucga

SEQ ID NO: 2815368 - RNA, 19 nt, Mycobacterium avium subsp. paratuberculosis
caaucccguugcggugacg

SEQ ID NO: 2815369 - RNA, 13 nt, Mycobacterium avium subsp. paratuberculosis
caauccggccccg

SEQ ID NO: 2815370 - RNA, 14 nt, Mycobacterium avium subsp. paratuberculosis
caauccggccccgc

SEQ ID NO: 2815371 - RNA, 18 nt, Mycobacterium avium subsp. paratuberculosis
caauccugcccggucugc

SEQ ID NO: 2815372 - RNA, 22 nt, Mycobacterium avium subsp. paratuberculosis
caauccugcccggucugcggcc

SEQ ID NO: 2815373 - RNA, 18 nt, Mycobacterium avium subsp. paratuberculosis
caaucgcugcgagcccgg

SEQ ID NO: 2815374 - RNA, 20 nt, Mycobacterium avium subsp. paratuberculosis
caaucgcugcgagcccggcc

SEQ ID NO: 2815375 - RNA, 13 nt, Mycobacterium avium subsp. paratuberculosis
caaucggacccag

SEQ ID NO: 2815376 - RNA, 16 nt, Mycobacterium avium subsp. paratuberculosis
caaucggacccagccc

SEQ ID NO: 2815377 - RNA, 19 nt, Mycobacterium avium subsp. paratuberculosis
caaucggauuucccgcuug

SEQ ID NO: 2815378 - RNA, 12 nt, Mycobacterium avium subsp. paratuberculosis
caaucggcgccg

SEQ ID NO: 2815379 - RNA, 14 nt, Mycobacterium avium subsp. paratuberculosis
caaucggcgccggc

SEQ ID NO: 2815380 - RNA, 23 nt, Mycobacterium avium subsp. paratuberculosis
caaucgggacgccacggcgaaca

SEQ ID NO: 2815381 - RNA, 21 nt, Mycobacterium avium subsp. paratuberculosis
cacaccgcggccagcgcgcgg

SEQ ID NO: 2815382 - RNA, 16 nt, Mycobacterium avium subsp. paratuberculosis
cacaccgcggcggcgu

SEQ ID NO: 2815383 - RNA, 18 nt, Mycobacterium avium subsp. paratuberculosis
cacaccgcggcggcgucg

SEQ ID NO: 2815384 - RNA, 21 nt, Mycobacterium avium subsp. paratuberculosis
cacaccggaucggcugcgggc

SEQ ID NO: 2815385 - RNA, 13 nt, Mycobacterium avium subsp. paratuberculosis
cacaccggcgcug

SEQ ID NO: 2815386 - RNA, 14 nt, Mycobacterium avium subsp. paratuberculosis
cacaccggcgcugc

SEQ ID NO: 2815387 - RNA, 18 nt, Mycobacterium avium subsp. paratuberculosis
cacaccggcgcugcccgc

SEQ ID NO: 2815388 - RNA, 22 nt, Mycobacterium avium subsp. paratuberculosis
cacaccggcgcugcccgcgauc

SEQ ID NO: 2815389 - RNA, 17 nt, Mycobacterium avium subsp. paratuberculosis
cacaccgucgcccgccc

SEQ ID NO: 2815390 - RNA, 14 nt, Mycobacterium avium subsp. paratuberculosis
cacaccgucggcga

SEQ ID NO: 2815391 - RNA, 15 nt, Mycobacterium avium subsp. paratuberculosis
cacaccgucggcgau

SEQ ID NO: 2815392 - RNA, 21 nt, Mycobacterium avium subsp. paratuberculosis
cacaccgucggcgaucgccgg

SEQ ID NO: 2815393 - RNA, 19 nt, Mycobacterium avium subsp. paratuberculosis
cacaccgucguccacgccc

SEQ ID NO: 2815394 - RNA, 13 nt, Mycobacterium avium subsp. paratuberculosis
cacaccucggcga

SEQ ID NO: 2815395 - RNA, 14 nt, Mycobacterium avium subsp. paratuberculosis
cacaccuuccacca

SEQ ID NO: 2815396 - RNA, 19 nt, Mycobacterium avium subsp. paratuberculosis
cacaccuuccaccaccgcg

SEQ ID NO: 2815397 - RNA, 17 nt, Mycobacterium avium subsp. paratuberculosis
cacaccuucgcggucgg

SEQ ID NO: 2815398 - RNA, 22 nt, Mycobacterium avium subsp. paratuberculosis
cacaccuucgcggucggcaacc

SEQ ID NO: 2815399 - RNA, 13 nt, Mycobacterium avium subsp. paratuberculosis
cacacgaacaccg

SEQ ID NO: 2815400 - RNA, 16 nt, Mycobacterium avium subsp. paratuberculosis
cacacgaacaccggcg

SEQ ID NO: 2815401 - RNA, 20 nt, Mycobacterium avium subsp. paratuberculosis
cacacgaauacccuccgggc

SEQ ID NO: 2815402 - RNA, 23 nt, Mycobacterium avium subsp. paratuberculosis
cacacgaucucguagguggccag

SEQ ID NO: 2815403 - RNA, 15 nt, Mycobacterium avium subsp. paratuberculosis
cacacgaugcgcggu

SEQ ID NO: 2815404 - RNA, 21 nt, Mycobacterium avium subsp. paratuberculosis
cacacgcggacagggcggcga

SEQ ID NO: 2815405 - RNA, 16 nt, Mycobacterium avium subsp. paratuberculosis
cacacgcucggcgagc

SEQ ID NO: 2815406 - RNA, 16 nt, Mycobacterium avium subsp. paratuberculosis
cacacgcucggcgcgc

SEQ ID NO: 2815407 - RNA, 22 nt, Mycobacterium avium subsp. paratuberculosis
cacacgcucggcgcgcggggcc

SEQ ID NO: 2815408 - RNA, 21 nt, Mycobacterium avium subsp. paratuberculosis
cacacggcaggcggcccgcuc

SEQ ID NO: 2815409 - RNA, 12 nt, Mycobacterium avium subsp. paratuberculosis
cacacggccucg

SEQ ID NO: 2815410 - RNA, 15 nt, Mycobacterium avium subsp. paratuberculosis
cacacggccucgccc

SEQ ID NO: 2815411 - RNA, 21 nt, Mycobacterium avium subsp. paratuberculosis
cacacggccucgcccagcgcc

SEQ ID NO: 2815412 - RNA, 16 nt, Mycobacterium avium subsp. paratuberculosis
cacacggccuugccga

SEQ ID NO: 2815413 - RNA, 13 nt, Mycobacterium avium subsp. paratuberculosis
cacacgggcccgu

SEQ ID NO: 2815414 - RNA, 14 nt, Mycobacterium avium subsp. paratuberculosis
cacacgggcccguc

SEQ ID NO: 2815415 - RNA, 16 nt, Mycobacterium avium subsp. paratuberculosis
cacacggggcagaccg

SEQ ID NO: 2815416 - RNA, 23 nt, Mycobacterium avium subsp. paratuberculosis
cacacgugcggauggccccggcg

SEQ ID NO: 2815417 - RNA, 16 nt, Mycobacterium avium subsp. paratuberculosis
cacacguugagcccgg

SEQ ID NO: 2815418 - RNA, 14 nt, Mycobacterium avium subsp. paratuberculosis
cacacugaaagccg

SEQ ID NO: 2815419 - RNA, 20 nt, Mycobacterium avium subsp. paratuberculosis
cacacugaaagccgaggcgc

SEQ ID NO: 2815420 - RNA, 16 nt, Mycobacterium avium subsp. paratuberculosis
cacacuggcgugacgc

SEQ ID NO: 2815421 - RNA, 21 nt, Mycobacterium avium subsp. paratuberculosis
cacagcaccaguugcaccggc

SEQ ID NO: 2815422 - RNA, 12 nt, Mycobacterium avium subsp. paratuberculosis
cacagcaccggc

SEQ ID NO: 2815423 - RNA, 15 nt, Mycobacterium avium subsp. paratuberculosis
cacagcaccggcguc

SEQ ID NO: 2815424 - RNA, 16 nt, Mycobacterium avium subsp. paratuberculosis
cacagcaccggcgucg

SEQ ID NO: 2815425 - RNA, 17 nt, Mycobacterium avium subsp. paratuberculosis
cacagcaccggcgucga

SEQ ID NO: 2815426 - RNA, 19 nt, Mycobacterium avium subsp. paratuberculosis
cacagcaccggcgucgaca

SEQ ID NO: 2815427 - RNA, 16 nt, Mycobacterium avium subsp. paratuberculosis
cacagcagcaccagcg

SEQ ID NO: 2815428 - RNA, 19 nt, Mycobacterium avium subsp. paratuberculosis
cacagcagcacgcccagcc

SEQ ID NO: 2815429 - RNA, 15 nt, Mycobacterium avium subsp. paratuberculosis
cacagcagcagcacc

SEQ ID NO: 2815430 - RNA, 13 nt, Mycobacterium avium subsp. paratuberculosis
cacagcagccgca

SEQ ID NO: 2815431 - RNA, 15 nt, Mycobacterium avium subsp. paratuberculosis
cacagcagccgcacc

SEQ ID NO: 2815432 - RNA, 17 nt, Mycobacterium avium subsp. paratuberculosis
cacagcagccgcaccuc

SEQ ID NO: 2815433 - RNA, 21 nt, Mycobacterium avium subsp. paratuberculosis
cacagcaugaagaucagcacc

SEQ ID NO: 2815434 - RNA, 20 nt, Mycobacterium avium subsp. paratuberculosis
cacagcauguccucggggug

SEQ ID NO: 2815435 - RNA, 13 nt, Mycobacterium avium subsp. paratuberculosis
cacagccagcgcc

SEQ ID NO: 2815436 - RNA, 18 nt, Mycobacterium avium subsp. paratuberculosis
cacagccagcgcccggcg

SEQ ID NO: 2815437 - RNA, 19 nt, Mycobacterium avium subsp. paratuberculosis
cacagcccccacgcucggc

SEQ ID NO: 2815438 - RNA, 16 nt, Mycobacterium avium subsp. paratuberculosis
cacagcccgugcagga

SEQ ID NO: 2815439 - RNA, 14 nt, Mycobacterium avium subsp. paratuberculosis
cacagcccguugcu

SEQ ID NO: 2815440 - RNA, 16 nt, Mycobacterium avium subsp. paratuberculosis
cacagccgcagcagcc

SEQ ID NO: 2815441 - RNA, 17 nt, Mycobacterium avium subsp. paratuberculosis
cacagccgcagcagccg

SEQ ID NO: 2815442 - RNA, 22 nt, Mycobacterium avium subsp. paratuberculosis
cacagccgcuuggcgcgccgca

SEQ ID NO: 2815443 - RNA, 13 nt, Mycobacterium avium subsp. paratuberculosis
cacagccggcggc

SEQ ID NO: 2815444 - RNA, 15 nt, Mycobacterium avium subsp. paratuberculosis
cacagccggcggcgg

SEQ ID NO: 2815445 - RNA, 23 nt, Mycobacterium avium subsp. paratuberculosis
cacagccggcggcggcggucggc

SEQ ID NO: 2815446 - RNA, 14 nt, Mycobacterium avium subsp. paratuberculosis
cacagccggcggcu

SEQ ID NO: 2815447 - RNA, 20 nt, Mycobacterium avium subsp. paratuberculosis
cacagccggggaucgcgcag

SEQ ID NO: 2815448 - RNA, 23 nt, Mycobacterium avium subsp. paratuberculosis
cacagccggggaucgcgcagccg

SEQ ID NO: 2815449 - RNA, 14 nt, Mycobacterium avium subsp. paratuberculosis
cacagccggucaua

SEQ ID NO: 2815450 - RNA, 22 nt, Mycobacterium avium subsp. paratuberculosis
cacagccggucauaggccgcgc

SEQ ID NO: 2815451 - RNA, 20 nt, Mycobacterium avium subsp. paratuberculosis
cacagcgaaagcgcuuggcg

SEQ ID NO: 2815452 - RNA, 12 nt, Mycobacterium avium subsp. paratuberculosis
cacagcgacagg

SEQ ID NO: 2815453 - RNA, 19 nt, Mycobacterium avium subsp. paratuberculosis
cacagcgacagggugccga

SEQ ID NO: 2815454 - RNA, 18 nt, Mycobacterium avium subsp. paratuberculosis
cacagcgaggcgacgucg

SEQ ID NO: 2815455 - RNA, 19 nt, Mycobacterium avium subsp. paratuberculosis
cacagcgaggcgacgucga

SEQ ID NO: 2815456 - RNA, 13 nt, Mycobacterium avium subsp. paratuberculosis
cacagcgccacac

SEQ ID NO: 2815457 - RNA, 14 nt, Mycobacterium avium subsp. paratuberculosis
cacagcgccagcac

SEQ ID NO: 2815458 - RNA, 22 nt, Mycobacterium avium subsp. paratuberculosis
cacagcgccagcacggccacca

SEQ ID NO: 2815459 - RNA, 21 nt, Mycobacterium avium subsp. paratuberculosis
cacagcgccgcguugucggcg

SEQ ID NO: 2815460 - RNA, 23 nt, Mycobacterium avium subsp. paratuberculosis
cacagcgccucgcggucgacgga

SEQ ID NO: 2815461 - RNA, 19 nt, Mycobacterium avium subsp. paratuberculosis
cacagcgccucgucgagcc

SEQ ID NO: 2815462 - RNA, 15 nt, Mycobacterium avium subsp. paratuberculosis
cacagcgcggcggug

SEQ ID NO: 2815463 - RNA, 16 nt, Mycobacterium avium subsp. paratuberculosis
cacagcgcggcgguga

SEQ ID NO: 2815464 - RNA, 15 nt, Mycobacterium avium subsp. paratuberculosis
cacagcggaucggcc

SEQ ID NO: 2815465 - RNA, 13 nt, Mycobacterium avium subsp. paratuberculosis
cacagcggcgaca

SEQ ID NO: 2815466 - RNA, 16 nt, Mycobacterium avium subsp. paratuberculosis
cacauucccgccgccg

SEQ ID NO: 2815467 - RNA, 22 nt, Mycobacterium avium subsp. paratuberculosis
cacauugcgauacgacgggaug

SEQ ID NO: 2815468 - RNA, 18 nt, Mycobacterium avium subsp. paratuberculosis
caccaaauagccgucggc

SEQ ID NO: 2815469 - RNA, 19 nt, Mycobacterium avium subsp. paratuberculosis
caccaaauagccgucggcg

SEQ ID NO: 2815470 - RNA, 22 nt, Mycobacterium avium subsp. paratuberculosis
caccaaauagccgucggcggcc

SEQ ID NO: 2815471 - RNA, 23 nt, Mycobacterium avium subsp. paratuberculosis
caccaaauagccgucggcggccu

SEQ ID NO: 2815472 - RNA, 23 nt, Mycobacterium avium subsp. paratuberculosis
caccaacaggucggcgugcagca

SEQ ID NO: 2815473 - RNA, 15 nt, Mycobacterium avium subsp. paratuberculosis
caccaacaucgacgu

SEQ ID NO: 2815474 - RNA, 15 nt, Mycobacterium avium subsp. paratuberculosis
caccaacccgaucgg

SEQ ID NO: 2815475 - RNA, 12 nt, Mycobacterium avium subsp. paratuberculosis
caccaaccgcuc

SEQ ID NO: 2815476 - RNA, 15 nt, Mycobacterium avium subsp. paratuberculosis
caccaaccgcucggc

SEQ ID NO: 2815477 - RNA, 16 nt, Mycobacterium avium subsp. paratuberculosis
caccaaccgcucggcg

SEQ ID NO: 2815478 - RNA, 17 nt, Mycobacterium avium subsp. paratuberculosis
caccaacgacagcgacg

SEQ ID NO: 2815479 - RNA, 14 nt, Mycobacterium avium subsp. paratuberculosis
caccaacggcagca

SEQ ID NO: 2815480 - RNA, 16 nt, Mycobacterium avium subsp. paratuberculosis
caccaacggcucgccg

SEQ ID NO: 2815481 - RNA, 19 nt, Mycobacterium avium subsp. paratuberculosis
caccaacggcucgccgcgc

SEQ ID NO: 2815482 - RNA, 23 nt, Mycobacterium avium subsp. paratuberculosis
caccaacggcucgccgcgcauca

SEQ ID NO: 2815483 - RNA, 23 nt, Mycobacterium avium subsp. paratuberculosis
caccaagaaguuuccccaccagg

SEQ ID NO: 2815484 - RNA, 23 nt, Mycobacterium avium subsp. paratuberculosis
caccaaggcaaucaggcggucga

SEQ ID NO: 2815485 - RNA, 15 nt, Mycobacterium avium subsp. paratuberculosis
caccaaugcgccggc

SEQ ID NO: 2815486 - RNA, 16 nt, Mycobacterium avium subsp. paratuberculosis
caccaaugcgccggcg

SEQ ID NO: 2815487 - RNA, 19 nt, Mycobacterium avium subsp. paratuberculosis
caccaaugcgccggcggcc

SEQ ID NO: 2815488 - RNA, 15 nt, Mycobacterium avium subsp. paratuberculosis
caccaauggcggcca

SEQ ID NO: 2815489 - RNA, 14 nt, Mycobacterium avium subsp. paratuberculosis
caccaauucgcgcu

SEQ ID NO: 2815490 - RNA, 16 nt, Mycobacterium avium subsp. paratuberculosis
caccaauucgcgcugc

SEQ ID NO: 2815491 - RNA, 21 nt, Mycobacterium avium subsp. paratuberculosis
caccaauucgcgcugccaggg

SEQ ID NO: 2815492 - RNA, 14 nt, Mycobacterium avium subsp. paratuberculosis
caccacacccagcg

SEQ ID NO: 2815493 - RNA, 15 nt, Mycobacterium avium subsp. paratuberculosis
caccacacccagcgc

SEQ ID NO: 2815494 - RNA, 17 nt, Mycobacterium avium subsp. paratuberculosis
caccacacccagcgcca

SEQ ID NO: 2815495 - RNA, 13 nt, Mycobacterium avium subsp. paratuberculosis
caccacacccgcg

SEQ ID NO: 2815496 - RNA, 15 nt, Mycobacterium avium subsp. paratuberculosis
caccacacccgcggc

SEQ ID NO: 2815497 - RNA, 17 nt, Mycobacterium avium subsp. paratuberculosis
caccacacccgcggccg

SEQ ID NO: 2815498 - RNA, 18 nt, Mycobacterium avium subsp. paratuberculosis
caccacacccgcggccgc

SEQ ID NO: 2815499 - RNA, 16 nt, Mycobacterium avium subsp. paratuberculosis
caccacaguggccgcc

SEQ ID NO: 2815500 - RNA, 17 nt, Mycobacterium avium subsp. paratuberculosis
caccacaguggccgcca

SEQ ID NO: 2815501 - RNA, 22 nt, Mycobacterium avium subsp. paratuberculosis
caccacaucgguugcuccggcg

SEQ ID NO: 2815502 - RNA, 18 nt, Mycobacterium avium subsp. paratuberculosis
caccacauucccgccgcc

SEQ ID NO: 2815503 - RNA, 20 nt, Mycobacterium avium subsp. paratuberculosis
caccacauucccgccgccgc

SEQ ID NO: 2815504 - RNA, 18 nt, Mycobacterium avium subsp. paratuberculosis
caccaccaacagcagcga

SEQ ID NO: 2815505 - RNA, 17 nt, Mycobacterium avium subsp. paratuberculosis
caccaccaacggcucgc

SEQ ID NO: 2815506 - RNA, 12 nt, Mycobacterium avium subsp. paratuberculosis
caccaccacacc

SEQ ID NO: 2815507 - RNA, 20 nt, Mycobacterium avium subsp. paratuberculosis
caccaccacacccagcgcca

SEQ ID NO: 2815508 - RNA, 14 nt, Mycobacterium avium subsp. paratuberculosis
caccaccacacccg

SEQ ID NO: 2815509 - RNA, 15 nt, Mycobacterium avium subsp. paratuberculosis
caccaccacacccgc

SEQ ID NO: 2815510 - RNA, 17 nt, Mycobacterium avium subsp. paratuberculosis
caccaccacacccgcgg

SEQ ID NO: 2815511 - RNA, 14 nt, Mycobacterium avium subsp. paratuberculosis
caccaccacccccg

SEQ ID NO: 2815512 - RNA, 13 nt, Mycobacterium avium subsp. paratuberculosis
caccaccacccgg

SEQ ID NO: 2815513 - RNA, 14 nt, Mycobacterium avium subsp. paratuberculosis
caccaccaccgaca

SEQ ID NO: 2815514 - RNA, 17 nt, Mycobacterium avium subsp. paratuberculosis
caccaccaccgccguca

SEQ ID NO: 2815515 - RNA, 13 nt, Mycobacterium avium subsp. paratuberculosis
caccaccacgcga

SEQ ID NO: 2815516 - RNA, 22 nt, Mycobacterium avium subsp. paratuberculosis
caccaccacgcgaucagguccg

SEQ ID NO: 2815517 - RNA, 14 nt, Mycobacterium avium subsp. paratuberculosis
caccaccacgcugg

SEQ ID NO: 2815518 - RNA, 15 nt, Mycobacterium avium subsp. paratuberculosis
caccaccacgcuggc

SEQ ID NO: 2815519 - RNA, 17 nt, Mycobacterium avium subsp. paratuberculosis
caccaccacggagcgcc

SEQ ID NO: 2815520 - RNA, 14 nt, Mycobacterium avium subsp. paratuberculosis
caccaccacggcca

SEQ ID NO: 2815521 - RNA, 20 nt, Mycobacterium avium subsp. paratuberculosis
caccaccacggccaggaagc

SEQ ID NO: 2815522 - RNA, 15 nt, Mycobacterium avium subsp. paratuberculosis
caccaccacggccau

SEQ ID NO: 2815523 - RNA, 14 nt, Mycobacterium avium subsp. paratuberculosis
caccaccacggugg

SEQ ID NO: 2815524 - RNA, 22 nt, Mycobacterium avium subsp. paratuberculosis
caccaccacgguggcgccggca

SEQ ID NO: 2815525 - RNA, 14 nt, Mycobacterium avium subsp. paratuberculosis
caccaccacgugcc

SEQ ID NO: 2815526 - RNA, 17 nt, Mycobacterium avium subsp. paratuberculosis
caccaccacgugccccu

SEQ ID NO: 2815527 - RNA, 20 nt, Mycobacterium avium subsp. paratuberculosis
caccaccacguugcacggca

SEQ ID NO: 2815528 - RNA, 22 nt, Mycobacterium avium subsp. paratuberculosis
caccaccacguugcgcggccgc

SEQ ID NO: 2815529 - RNA, 14 nt, Mycobacterium avium subsp. paratuberculosis
caccaccagcgggc

SEQ ID NO: 2815530 - RNA, 16 nt, Mycobacterium avium subsp. paratuberculosis
caccaccagcgggcug

SEQ ID NO: 2815531 - RNA, 21 nt, Mycobacterium avium subsp. paratuberculosis
caccaccagcgggcugugccg

SEQ ID NO: 2815532 - RNA, 20 nt, Mycobacterium avium subsp. paratuberculosis
caccaccagcguguggcccu

SEQ ID NO: 2815533 - RNA, 14 nt, Mycobacterium avium subsp. paratuberculosis
caccaccagcucgu

SEQ ID NO: 2815534 - RNA, 13 nt, Mycobacterium avium subsp. paratuberculosis
caccaccaggccg

SEQ ID NO: 2815535 - RNA, 22 nt, Mycobacterium avium subsp. paratuberculosis
caccaccagguuggacaccucc

SEQ ID NO: 2815536 - RNA, 16 nt, Mycobacterium avium subsp. paratuberculosis
caccaccagucggcgc

SEQ ID NO: 2815537 - RNA, 18 nt, Mycobacterium avium subsp. paratuberculosis
caccaccagucggcgcgu

SEQ ID NO: 2815538 - RNA, 19 nt, Mycobacterium avium subsp. paratuberculosis
caccaccaugucguugacg

SEQ ID NO: 2815539 - RNA, 21 nt, Mycobacterium avium subsp. paratuberculosis
caccaccauguuccagaaccg

SEQ ID NO: 2815540 - RNA, 12 nt, Mycobacterium avium subsp. paratuberculosis
caccacccaggc

SEQ ID NO: 2815541 - RNA, 15 nt, Mycobacterium avium subsp. paratuberculosis
caccacccgcaccuc

SEQ ID NO: 2815542 - RNA, 13 nt, Mycobacterium avium subsp. paratuberculosis
caccacccgcggc

SEQ ID NO: 2815543 - RNA, 11 nt, Mycobacterium avium subsp. paratuberculosis
caccacccgga

SEQ ID NO: 2815544 - RNA, 14 nt, Mycobacterium avium subsp. paratuberculosis
caccacccggaaga

SEQ ID NO: 2815545 - RNA, 13 nt, Mycobacterium avium subsp. paratuberculosis
caccacccggcga

SEQ ID NO: 2815546 - RNA, 15 nt, Mycobacterium avium subsp. paratuberculosis
caccacccggcgauu

SEQ ID NO: 2815547 - RNA, 13 nt, Mycobacterium avium subsp. paratuberculosis
caccacccgggug

SEQ ID NO: 2815548 - RNA, 11 nt, Mycobacterium avium subsp. paratuberculosis
caccacccggu

SEQ ID NO: 2815549 - RNA, 17 nt, Mycobacterium avium subsp. paratuberculosis
caccaccgacaccccga

SEQ ID NO: 2815550 - RNA, 14 nt, Mycobacterium avium subsp. paratuberculosis
caccaccgacgcgu

SEQ ID NO: 2815551 - RNA, 22 nt, Mycobacterium avium subsp. paratuberculosis
caccacggcaccgccgcgcggc

SEQ ID NO: 2815552 - RNA, 12 nt, Mycobacterium avium subsp. paratuberculosis
caccacggccag

SEQ ID NO: 2815553 - RNA, 20 nt, Mycobacterium avium subsp. paratuberculosis
caccacggccaucacggugc

SEQ ID NO: 2815554 - RNA, 23 nt, Mycobacterium avium subsp. paratuberculosis
caccacggccaucacggugccga

SEQ ID NO: 2815555 - RNA, 12 nt, Mycobacterium avium subsp. paratuberculosis
caccacggcccg

SEQ ID NO: 2815556 - RNA, 13 nt, Mycobacterium avium subsp. paratuberculosis
caccacggcccgc

SEQ ID NO: 2815557 - RNA, 15 nt, Mycobacterium avium subsp. paratuberculosis
caccacggcccgcgc

SEQ ID NO: 2815558 - RNA, 17 nt, Mycobacterium avium subsp. paratuberculosis
caccacggcccgcgccc

SEQ ID NO: 2815559 - RNA, 12 nt, Mycobacterium avium subsp. paratuberculosis
caccacggccga

SEQ ID NO: 2815560 - RNA, 12 nt, Mycobacterium avium subsp. paratuberculosis
caccacggccgc

SEQ ID NO: 2815561 - RNA, 19 nt, Mycobacterium avium subsp. paratuberculosis
caccacggccgcagcggca

SEQ ID NO: 2815562 - RNA, 14 nt, Mycobacterium avium subsp. paratuberculosis
caccacggccgccg

SEQ ID NO: 2815563 - RNA, 17 nt, Mycobacterium avium subsp. paratuberculosis
caccacggccgccgagg

SEQ ID NO: 2815564 - RNA, 19 nt, Mycobacterium avium subsp. paratuberculosis
caccacggccgccgaggcg

SEQ ID NO: 2815565 - RNA, 20 nt, Mycobacterium avium subsp. paratuberculosis
caccacggccgccgaggcga

SEQ ID NO: 2815566 - RNA, 11 nt, Mycobacterium avium subsp. paratuberculosis
caccacggcgg

SEQ ID NO: 2815567 - RNA, 13 nt, Mycobacterium avium subsp. paratuberculosis
caccacggcggca

SEQ ID NO: 2815568 - RNA, 14 nt, Mycobacterium avium subsp. paratuberculosis
caccacggcggcau

SEQ ID NO: 2815569 - RNA, 19 nt, Mycobacterium avium subsp. paratuberculosis
caccacggcggcauguucg

SEQ ID NO: 2815570 - RNA, 15 nt, Mycobacterium avium subsp. paratuberculosis
caccacggcgucgcu

SEQ ID NO: 2815571 - RNA, 18 nt, Mycobacterium avium subsp. paratuberculosis
caccacgggucggucggc

SEQ ID NO: 2815572 - RNA, 22 nt, Mycobacterium avium subsp. paratuberculosis
caccacgggucggucggcccgc

SEQ ID NO: 2815573 - RNA, 12 nt, Mycobacterium avium subsp. paratuberculosis
caccacggucag

SEQ ID NO: 2815574 - RNA, 20 nt, Mycobacterium avium subsp. paratuberculosis
caccacggucagggccagca

SEQ ID NO: 2815575 - RNA, 23 nt, Mycobacterium avium subsp. paratuberculosis
caccacggucagggccagcaaca

SEQ ID NO: 2815576 - RNA, 20 nt, Mycobacterium avium subsp. paratuberculosis
caccacgguccccgcgcccg

SEQ ID NO: 2815577 - RNA, 22 nt, Mycobacterium avium subsp. paratuberculosis
caccacgguccccgcgcccgcc

SEQ ID NO: 2815578 - RNA, 17 nt, Mycobacterium avium subsp. paratuberculosis
caccacggucgccgcgc

SEQ ID NO: 2815579 - RNA, 16 nt, Mycobacterium avium subsp. paratuberculosis
caccacgguggccgcg

SEQ ID NO: 2815580 - RNA, 21 nt, Mycobacterium avium subsp. paratuberculosis
caccacgguggccgcgaagau

SEQ ID NO: 2815581 - RNA, 17 nt, Mycobacterium avium subsp. paratuberculosis
caccacgguggcgccgc

SEQ ID NO: 2815582 - RNA, 20 nt, Mycobacterium avium subsp. paratuberculosis
caccacgguggcgccgcgca

SEQ ID NO: 2815583 - RNA, 23 nt, Mycobacterium avium subsp. paratuberculosis
caccacgguggcgccgcgcagcc

SEQ ID NO: 2815584 - RNA, 19 nt, Mycobacterium avium subsp. paratuberculosis
caccacgguggcgccggca

SEQ ID NO: 2815585 - RNA, 20 nt, Mycobacterium avium subsp. paratuberculosis
caccacgguggcgccggcau

SEQ ID NO: 2815586 - RNA, 12 nt, Mycobacterium avium subsp. paratuberculosis
caccacggugua

SEQ ID NO: 2815587 - RNA, 14 nt, Mycobacterium avium subsp. paratuberculosis
caccacgguguagc

SEQ ID NO: 2815588 - RNA, 19 nt, Mycobacterium avium subsp. paratuberculosis
caccacgguguagcggcgg

SEQ ID NO: 2815589 - RNA, 20 nt, Mycobacterium avium subsp. paratuberculosis
caccacgguguagcggcggc

SEQ ID NO: 2815590 - RNA, 22 nt, Mycobacterium avium subsp. paratuberculosis
caccacgguguagcggcggcug

SEQ ID NO: 2815591 - RNA, 16 nt, Mycobacterium avium subsp. paratuberculosis
caccacguacuccugc

SEQ ID NO: 2815592 - RNA, 20 nt, Mycobacterium avium subsp. paratuberculosis
caccacguacuccugcgcga

SEQ ID NO: 2815593 - RNA, 16 nt, Mycobacterium avium subsp. paratuberculosis
caccacguagccgacc

SEQ ID NO: 2815594 - RNA, 19 nt, Mycobacterium avium subsp. paratuberculosis
caccacguaggcgaucagc

SEQ ID NO: 2815595 - RNA, 22 nt, Mycobacterium avium subsp. paratuberculosis
caccacguaggcgaucagcgcg

SEQ ID NO: 2815596 - RNA, 20 nt, Mycobacterium avium subsp. paratuberculosis
caccacguccaccagcacca

SEQ ID NO: 2815597 - RNA, 13 nt, Mycobacterium avium subsp. paratuberculosis
caccacguccgcg

SEQ ID NO: 2815598 - RNA, 13 nt, Mycobacterium avium subsp. paratuberculosis
caccacgucggug

SEQ ID NO: 2815599 - RNA, 13 nt, Mycobacterium avium subsp. paratuberculosis
caccacgucgucc

SEQ ID NO: 2815600 - RNA, 17 nt, Mycobacterium avium subsp. paratuberculosis
caccacgucgucggccu

SEQ ID NO: 2815601 - RNA, 18 nt, Mycobacterium avium subsp. paratuberculosis
caccacgucgucggccug

SEQ ID NO: 2815602 - RNA, 18 nt, Mycobacterium avium subsp. paratuberculosis
caccacguugcacggcag

SEQ ID NO: 2815603 - RNA, 19 nt, Mycobacterium avium subsp. paratuberculosis
caccacguugcgcccggcc

SEQ ID NO: 2815604 - RNA, 20 nt, Mycobacterium avium subsp. paratuberculosis
caccacguugcgcggccgca

SEQ ID NO: 2815605 - RNA, 19 nt, Mycobacterium avium subsp. paratuberculosis
caccacuuccagcaccggc

SEQ ID NO: 2815606 - RNA, 20 nt, Mycobacterium avium subsp. paratuberculosis
caccacuuccagcaccggcu

SEQ ID NO: 2815607 - RNA, 19 nt, Mycobacterium avium subsp. paratuberculosis
caccagaacacguuucggc

SEQ ID NO: 2815608 - RNA, 14 nt, Mycobacterium avium subsp. paratuberculosis
caccagaccggcga

SEQ ID NO: 2815609 - RNA, 15 nt, Mycobacterium avium subsp. paratuberculosis
caccagaccggcgaa

SEQ ID NO: 2815610 - RNA, 16 nt, Mycobacterium avium subsp. paratuberculosis
caccagaccggcgaag

SEQ ID NO: 2815611 - RNA, 23 nt, Mycobacterium avium subsp. paratuberculosis
caccagaccggcgaagcuaaacc

SEQ ID NO: 2815612 - RNA, 15 nt, Mycobacterium avium subsp. paratuberculosis
caccagagcgccgga

SEQ ID NO: 2815613 - RNA, 22 nt, Mycobacterium avium subsp. paratuberculosis
caccagagcgccggacucgaag

SEQ ID NO: 2815614 - RNA, 16 nt, Mycobacterium avium subsp. paratuberculosis
caccagaucgccccgc

SEQ ID NO: 2815615 - RNA, 15 nt, Mycobacterium avium subsp. paratuberculosis
caccagaugccgcuc

SEQ ID NO: 2815616 - RNA, 17 nt, Mycobacterium avium subsp. paratuberculosis
caccagaugccgcucgg

SEQ ID NO: 2815617 - RNA, 20 nt, Mycobacterium avium subsp. paratuberculosis
caccagaugccgcucggcgc

SEQ ID NO: 2815618 - RNA, 16 nt, Mycobacterium avium subsp. paratuberculosis
caccagcaacaccagg

SEQ ID NO: 2815619 - RNA, 15 nt, Mycobacterium avium subsp. paratuberculosis
caccagcacaccgga

SEQ ID NO: 2815620 - RNA, 13 nt, Mycobacterium avium subsp. paratuberculosis
caccagcaccacc

SEQ ID NO: 2815621 - RNA, 14 nt, Mycobacterium avium subsp. paratuberculosis
caccagcaccaggc

SEQ ID NO: 2815622 - RNA, 16 nt, Mycobacterium avium subsp. paratuberculosis
caccagcacccagcac

SEQ ID NO: 2815623 - RNA, 17 nt, Mycobacterium avium subsp. paratuberculosis
caccagcaccccgccgc

SEQ ID NO: 2815624 - RNA, 19 nt, Mycobacterium avium subsp. paratuberculosis
caccagcaccccgccgcag

SEQ ID NO: 2815625 - RNA, 21 nt, Mycobacterium avium subsp. paratuberculosis
caccagcaccccgccgcagcc

SEQ ID NO: 2815626 - RNA, 14 nt, Mycobacterium avium subsp. paratuberculosis
caccagcaccgaga

SEQ ID NO: 2815627 - RNA, 16 nt, Mycobacterium avium subsp. paratuberculosis
caccagcacgccguug

SEQ ID NO: 2815628 - RNA, 22 nt, Mycobacterium avium subsp. paratuberculosis
caccagcacgccguugaccccg

SEQ ID NO: 2815629 - RNA, 19 nt, Mycobacterium avium subsp. paratuberculosis
caccagcacggcgaccagc

SEQ ID NO: 2815630 - RNA, 15 nt, Mycobacterium avium subsp. paratuberculosis
caccagcacggcggc

SEQ ID NO: 2815631 - RNA, 17 nt, Mycobacterium avium subsp. paratuberculosis
caccagcacggcggcgc

SEQ ID NO: 2815632 - RNA, 17 nt, Mycobacterium avium subsp. paratuberculosis
caccagcacggucccgu

SEQ ID NO: 2815633 - RNA, 20 nt, Mycobacterium avium subsp. paratuberculosis
caccagcagacccgacggga

SEQ ID NO: 2815634 - RNA, 16 nt, Mycobacterium avium subsp. paratuberculosis
caccagcagcagguug

SEQ ID NO: 2815635 - RNA, 17 nt, Mycobacterium avium subsp. paratuberculosis
caccagcagccgcagcg

SEQ ID NO: 2815636 - RNA, 16 nt, Mycobacterium avium subsp. paratuberculosis
caccaggacgcgaccg

SEQ ID NO: 2815637 - RNA, 19 nt, Mycobacterium avium subsp. paratuberculosis
caccaggacgcgaccggcc

SEQ ID NO: 2815638 - RNA, 14 nt, Mycobacterium avium subsp. paratuberculosis
caccaggagcaccu

SEQ ID NO: 2815639 - RNA, 13 nt, Mycobacterium avium subsp. paratuberculosis
caccaggcccagg

SEQ ID NO: 2815640 - RNA, 18 nt, Mycobacterium avium subsp. paratuberculosis
caccaggcccaggccgac

SEQ ID NO: 2815641 - RNA, 19 nt, Mycobacterium avium subsp. paratuberculosis
caccaggcccaggccgacg

SEQ ID NO: 2815642 - RNA, 22 nt, Mycobacterium avium subsp. paratuberculosis
caccaggcccucgccgcgguca

SEQ ID NO: 2815643 - RNA, 14 nt, Mycobacterium avium subsp. paratuberculosis
caccaggccgaaga

SEQ ID NO: 2815644 - RNA, 16 nt, Mycobacterium avium subsp. paratuberculosis
caccaggccgaagacg

SEQ ID NO: 2815645 - RNA, 17 nt, Mycobacterium avium subsp. paratuberculosis
caccaggccgacgcugg

SEQ ID NO: 2815646 - RNA, 17 nt, Mycobacterium avium subsp. paratuberculosis
caccaggcgcaccagcu

SEQ ID NO: 2815647 - RNA, 13 nt, Mycobacterium avium subsp. paratuberculosis
caccaggcgccac

SEQ ID NO: 2815648 - RNA, 14 nt, Mycobacterium avium subsp. paratuberculosis
caccaggcgccaca

SEQ ID NO: 2815649 - RNA, 17 nt, Mycobacterium avium subsp. paratuberculosis
caccaggcgccacagca

SEQ ID NO: 2815650 - RNA, 20 nt, Mycobacterium avium subsp. paratuberculosis
caccaggcgccacagcagca

SEQ ID NO: 2815651 - RNA, 16 nt, Mycobacterium avium subsp. paratuberculosis
caccaggcgccgucga

SEQ ID NO: 2815652 - RNA, 17 nt, Mycobacterium avium subsp. paratuberculosis
caccaggcgccgucgau

SEQ ID NO: 2815653 - RNA, 22 nt, Mycobacterium avium subsp. paratuberculosis
caccaggcgccgucgauggcgc

SEQ ID NO: 2815654 - RNA, 14 nt, Mycobacterium avium subsp. paratuberculosis
caccaggcgcgggc

SEQ ID NO: 2815655 - RNA, 17 nt, Mycobacterium avium subsp. paratuberculosis
caccaggcgggucaccu

SEQ ID NO: 2815656 - RNA, 19 nt, Mycobacterium avium subsp. paratuberculosis
caccaggcgguccgacacc

SEQ ID NO: 2815657 - RNA, 19 nt, Mycobacterium avium subsp. paratuberculosis
caccaggcugaccagcgcc

SEQ ID NO: 2815658 - RNA, 21 nt, Mycobacterium avium subsp. paratuberculosis
caccaggcugcucggcgggcu

SEQ ID NO: 2815659 - RNA, 22 nt, Mycobacterium avium subsp. paratuberculosis
caccaggcugcucggcgggcuc

SEQ ID NO: 2815660 - RNA, 22 nt, Mycobacterium avium subsp. paratuberculosis
caccagggacaugccgagcagc

SEQ ID NO: 2815661 - RNA, 14 nt, Mycobacterium avium subsp. paratuberculosis
caccagggccgcga

SEQ ID NO: 2815662 - RNA, 19 nt, Mycobacterium avium subsp. paratuberculosis
caccagggccgcgagcgcu

SEQ ID NO: 2815663 - RNA, 16 nt, Mycobacterium avium subsp. paratuberculosis
caccagggcgaccgcc

SEQ ID NO: 2815664 - RNA, 13 nt, Mycobacterium avium subsp. paratuberculosis
caccagggcgucg

SEQ ID NO: 2815665 - RNA, 20 nt, Mycobacterium avium subsp. paratuberculosis
caccagggcguguugcaggc

SEQ ID NO: 2815666 - RNA, 22 nt, Mycobacterium avium subsp. paratuberculosis
caccagggcguguugcaggcgg

SEQ ID NO: 2815667 - RNA, 18 nt, Mycobacterium avium subsp. paratuberculosis
caccagggucucgcgcag

SEQ ID NO: 2815668 - RNA, 20 nt, Mycobacterium avium subsp. paratuberculosis
caccagggucucgcgcagca

SEQ ID NO: 2815669 - RNA, 21 nt, Mycobacterium avium subsp. paratuberculosis
caccagggucucgcgcagcac

SEQ ID NO: 2815670 - RNA, 20 nt, Mycobacterium avium subsp. paratuberculosis
caccagggucuucagcccgc

SEQ ID NO: 2815671 - RNA, 21 nt, Mycobacterium avium subsp. paratuberculosis
caccagggucuucagcccgcg

SEQ ID NO: 2815672 - RNA, 17 nt, Mycobacterium avium subsp. paratuberculosis
caccagggugacggagu

SEQ ID NO: 2815673 - RNA, 16 nt, Mycobacterium avium subsp. paratuberculosis
caccagggugccccgc

SEQ ID NO: 2815674 - RNA, 17 nt, Mycobacterium avium subsp. paratuberculosis
caccagggugccccgcg

SEQ ID NO: 2815675 - RNA, 20 nt, Mycobacterium avium subsp. paratuberculosis
caccagggugccccgcgacc

SEQ ID NO: 2815676 - RNA, 21 nt, Mycobacterium avium subsp. paratuberculosis
caccagggugccccgcgaccg

SEQ ID NO: 2815677 - RNA, 15 nt, Mycobacterium avium subsp. paratuberculosis
caccagggugccgcc

SEQ ID NO: 2815678 - RNA, 16 nt, Mycobacterium avium subsp. paratuberculosis
caccagggugcgcacg

SEQ ID NO: 2815679 - RNA, 19 nt, Mycobacterium avium subsp. paratuberculosis
caccagggugcgcagcgcg

SEQ ID NO: 2815680 - RNA, 22 nt, Mycobacterium avium subsp. paratuberculosis
caccagggugcgcagcgcgucg

SEQ ID NO: 2815681 - RNA, 13 nt, Mycobacterium avium subsp. paratuberculosis
caccaggguggcc

SEQ ID NO: 2815682 - RNA, 14 nt, Mycobacterium avium subsp. paratuberculosis
caccaggguggccg

SEQ ID NO: 2815683 - RNA, 16 nt, Mycobacterium avium subsp. paratuberculosis
caccaggguggccgcc

SEQ ID NO: 2815684 - RNA, 20 nt, Mycobacterium avium subsp. paratuberculosis
caccaggguggccgccacca

SEQ ID NO: 2815685 - RNA, 18 nt, Mycobacterium avium subsp. paratuberculosis
caccagguaccggcgggc

SEQ ID NO: 2815686 - RNA, 20 nt, Mycobacterium avium subsp. paratuberculosis
caccagguaccggcgggcga

SEQ ID NO: 2815687 - RNA, 23 nt, Mycobacterium avium subsp. paratuberculosis
caccagguaggcgaccaugccca

SEQ ID NO: 2815688 - RNA, 19 nt, Mycobacterium avium subsp. paratuberculosis
caccagguaggcgguggcg

SEQ ID NO: 2815689 - RNA, 20 nt, Mycobacterium avium subsp. paratuberculosis
caccagguaggcgguggcgc

SEQ ID NO: 2815690 - RNA, 20 nt, Mycobacterium avium subsp. paratuberculosis
caccagguagguggccgucg

SEQ ID NO: 2815691 - RNA, 24 nt, Mycobacterium avium subsp. paratuberculosis
caccaggucgagguccucggcgau

SEQ ID NO: 2815692 - RNA, 14 nt, Mycobacterium avium subsp. paratuberculosis
caccaggucguugc

SEQ ID NO: 2815693 - RNA, 23 nt, Mycobacterium avium subsp. paratuberculosis
caccaggucguugccggugccga

SEQ ID NO: 2815694 - RNA, 20 nt, Mycobacterium avium subsp. paratuberculosis
caccaggucuccgucggcgc

SEQ ID NO: 2815695 - RNA, 18 nt, Mycobacterium avium subsp. paratuberculosis
caccaggugaccggccug

SEQ ID NO: 2815696 - RNA, 15 nt, Mycobacterium avium subsp. paratuberculosis
caccagguggcccga

SEQ ID NO: 2815697 - RNA, 18 nt, Mycobacterium avium subsp. paratuberculosis
caccagguucacgucggg

SEQ ID NO: 2815698 - RNA, 19 nt, Mycobacterium avium subsp. paratuberculosis
caccagguucacgucgggg

SEQ ID NO: 2815699 - RNA, 16 nt, Mycobacterium avium subsp. paratuberculosis
caccagguucgcgcag

SEQ ID NO: 2815700 - RNA, 16 nt, Mycobacterium avium subsp. paratuberculosis
caccagguugucgccg

SEQ ID NO: 2815701 - RNA, 19 nt, Mycobacterium avium subsp. paratuberculosis
caccagguugucgccgcgc

SEQ ID NO: 2815702 - RNA, 20 nt, Mycobacterium avium subsp. paratuberculosis
caccagguuucgcuugugcc

SEQ ID NO: 2815703 - RNA, 22 nt, Mycobacterium avium subsp. paratuberculosis
caccaguaggucacccgguccc

SEQ ID NO: 2815704 - RNA, 17 nt, Mycobacterium avium subsp. paratuberculosis
caccagucgcacaaccg

SEQ ID NO: 2815705 - RNA, 16 nt, Mycobacterium avium subsp. paratuberculosis
caccagucgcgcagcg

SEQ ID NO: 2815706 - RNA, 19 nt, Mycobacterium avium subsp. paratuberculosis
caccagucgcgcagcguca

SEQ ID NO: 2815707 - RNA, 21 nt, Mycobacterium avium subsp. paratuberculosis
caccagucggccaucagcacc

SEQ ID NO: 2815708 - RNA, 15 nt, Mycobacterium avium subsp. paratuberculosis
caccagucggcgcgu

SEQ ID NO: 2815709 - RNA, 17 nt, Mycobacterium avium subsp. paratuberculosis
caccagugucagggcag

SEQ ID NO: 2815710 - RNA, 18 nt, Mycobacterium avium subsp. paratuberculosis
caccagugucagggcagc

SEQ ID NO: 2815711 - RNA, 19 nt, Mycobacterium avium subsp. paratuberculosis
caccaguuccaccaguguc

SEQ ID NO: 2815712 - RNA, 16 nt, Mycobacterium avium subsp. paratuberculosis
caccaguucgcguacc

SEQ ID NO: 2815713 - RNA, 20 nt, Mycobacterium avium subsp. paratuberculosis
caccaguucgcguacccgcg

SEQ ID NO: 2815714 - RNA, 19 nt, Mycobacterium avium subsp. paratuberculosis
caccaguugcaccggcacc

SEQ ID NO: 2815715 - RNA, 18 nt, Mycobacterium avium subsp. paratuberculosis
caccaguuucacgucggc

SEQ ID NO: 2815716 - RNA, 19 nt, Mycobacterium avium subsp. paratuberculosis
caccaguuucacgucggcg

SEQ ID NO: 2815717 - RNA, 21 nt, Mycobacterium avium subsp. paratuberculosis
caccaguuucacgucggcgau

SEQ ID NO: 2815718 - RNA, 16 nt, Mycobacterium avium subsp. paratuberculosis
caccaucacgucgcgc

SEQ ID NO: 2815719 - RNA, 13 nt, Mycobacterium avium subsp. paratuberculosis
caccaucagcacc

SEQ ID NO: 2815720 - RNA, 16 nt, Mycobacterium avium subsp. paratuberculosis
cacccccucggcgccg

SEQ ID NO: 2815721 - RNA, 17 nt, Mycobacterium avium subsp. paratuberculosis
caccccgaaccaguucg

SEQ ID NO: 2815722 - RNA, 16 nt, Mycobacterium avium subsp. paratuberculosis
caccccgaacccggcc

SEQ ID NO: 2815723 - RNA, 20 nt, Mycobacterium avium subsp. paratuberculosis
caccccgaacccggccagcg

SEQ ID NO: 2815724 - RNA, 19 nt, Mycobacterium avium subsp. paratuberculosis
caccccgaaccgcccgccc

SEQ ID NO: 2815725 - RNA, 14 nt, Mycobacterium avium subsp. paratuberculosis
caccccgaccgacg

SEQ ID NO: 2815726 - RNA, 23 nt, Mycobacterium avium subsp. paratuberculosis
caccccgaccgacgcggucaccg

SEQ ID NO: 2815727 - RNA, 18 nt, Mycobacterium avium subsp. paratuberculosis
caccccgagcucgggcgc

SEQ ID NO: 2815728 - RNA, 22 nt, Mycobacterium avium subsp. paratuberculosis
caccccgaucaacaccgccagc

SEQ ID NO: 2815729 - RNA, 17 nt, Mycobacterium avium subsp. paratuberculosis
caccccgaucgcgauca

SEQ ID NO: 2815730 - RNA, 23 nt, Mycobacterium avium subsp. paratuberculosis
caccccgaucggggccaggaugc

SEQ ID NO: 2815731 - RNA, 20 nt, Mycobacterium avium subsp. paratuberculosis
caccccgaugcggugccggg

SEQ ID NO: 2815732 - RNA, 23 nt, Mycobacterium avium subsp. paratuberculosis
caccccgaugcggugccgggcca

SEQ ID NO: 2815733 - RNA, 20 nt, Mycobacterium avium subsp. paratuberculosis
caccccgcagaacaccagcg

SEQ ID NO: 2815734 - RNA, 22 nt, Mycobacterium avium subsp. paratuberculosis
caccccgcagaacaccagcgca

SEQ ID NO: 2815735 - RNA, 20 nt, Mycobacterium avium subsp. paratuberculosis
caccccgccaaucaccgcgg

SEQ ID NO: 2815736 - RNA, 14 nt, Mycobacterium avium subsp. paratuberculosis
caccccgcccagcg

SEQ ID NO: 2815737 - RNA, 17 nt, Mycobacterium avium subsp. paratuberculosis
caccccgccgcagccca

SEQ ID NO: 2815738 - RNA, 13 nt, Mycobacterium avium subsp. paratuberculosis
caccccgcgaguc

SEQ ID NO: 2815739 - RNA, 17 nt, Mycobacterium avium subsp. paratuberculosis
caccccgcgagucaccg

SEQ ID NO: 2815740 - RNA, 18 nt, Mycobacterium avium subsp. paratuberculosis
caccccgcgccacgccgc

SEQ ID NO: 2815741 - RNA, 20 nt, Mycobacterium avium subsp. paratuberculosis
caccccgcgccacgccgccc

SEQ ID NO: 2815742 - RNA, 16 nt, Mycobacterium avium subsp. paratuberculosis
caccccgcgccgggcg

SEQ ID NO: 2815743 - RNA, 13 nt, Mycobacterium avium subsp. paratuberculosis
caccccgcggucg

SEQ ID NO: 2815744 - RNA, 14 nt, Mycobacterium avium subsp. paratuberculosis
caccccgcucggcc

SEQ ID NO: 2815745 - RNA, 17 nt, Mycobacterium avium subsp. paratuberculosis
caccccgcucggccagc

SEQ ID NO: 2815746 - RNA, 18 nt, Mycobacterium avium subsp. paratuberculosis
caccccgcucggccagcg

SEQ ID NO: 2815747 - RNA, 22 nt, Mycobacterium avium subsp. paratuberculosis
caccccgcucggccagcgcgcc

SEQ ID NO: 2815748 - RNA, 23 nt, Mycobacterium avium subsp. paratuberculosis
caccccgcucggccagcgcgccg

SEQ ID NO: 2815749 - RNA, 21 nt, Mycobacterium avium subsp. paratuberculosis
caccccggagauccggccgcu

SEQ ID NO: 2815750 - RNA, 22 nt, Mycobacterium avium subsp. paratuberculosis
caccccggcauagagcuggugg

SEQ ID NO: 2815751 - RNA, 23 nt, Mycobacterium avium subsp. paratuberculosis
caccccggccagggugccgacga

SEQ ID NO: 2815752 - RNA, 14 nt, Mycobacterium avium subsp. paratuberculosis
caccccggccauca

SEQ ID NO: 2815753 - RNA, 12 nt, Mycobacterium avium subsp. paratuberculosis
caccccggcgac

SEQ ID NO: 2815754 - RNA, 13 nt, Mycobacterium avium subsp. paratuberculosis
caccccggcgacg

SEQ ID NO: 2815755 - RNA, 20 nt, Mycobacterium avium subsp. paratuberculosis
caccccggcgaugaccggga

SEQ ID NO: 2815756 - RNA, 12 nt, Mycobacterium avium subsp. paratuberculosis
caccccggcgcg

SEQ ID NO: 2815757 - RNA, 13 nt, Mycobacterium avium subsp. paratuberculosis
caccccggcgcgg

SEQ ID NO: 2815758 - RNA, 13 nt, Mycobacterium avium subsp. paratuberculosis
caccccggcggcc

SEQ ID NO: 2815759 - RNA, 23 nt, Mycobacterium avium subsp. paratuberculosis
caccccggcggucggaucgagcu

SEQ ID NO: 2815760 - RNA, 13 nt, Mycobacterium avium subsp. paratuberculosis
caccccggcgucc

SEQ ID NO: 2815761 - RNA, 19 nt, Mycobacterium avium subsp. paratuberculosis
caccccggcguccacgccg

SEQ ID NO: 2815762 - RNA, 20 nt, Mycobacterium avium subsp. paratuberculosis
caccccgggaacgacggugc

SEQ ID NO: 2815763 - RNA, 18 nt, Mycobacterium avium subsp. paratuberculosis
caccccggugaccucccg

SEQ ID NO: 2815764 - RNA, 16 nt, Mycobacterium avium subsp. paratuberculosis
caccccggugccgcag

SEQ ID NO: 2815765 - RNA, 16 nt, Mycobacterium avium subsp. paratuberculosis
caccccguaggugcac

SEQ ID NO: 2815766 - RNA, 22 nt, Mycobacterium avium subsp. paratuberculosis
caccccguccaggaugagcugg

SEQ ID NO: 2815767 - RNA, 23 nt, Mycobacterium avium subsp. paratuberculosis
caccccguccaggaugagcuggg

SEQ ID NO: 2815768 - RNA, 21 nt, Mycobacterium avium subsp. paratuberculosis
caccccgucgagcagccgcaa

SEQ ID NO: 2815769 - RNA, 20 nt, Mycobacterium avium subsp. paratuberculosis
caccccgugguagacgccgg

SEQ ID NO: 2815770 - RNA, 17 nt, Mycobacterium avium subsp. paratuberculosis
caccccguugagcagcg

SEQ ID NO: 2815771 - RNA, 19 nt, Mycobacterium avium subsp. paratuberculosis
caccccguugccgccggcg

SEQ ID NO: 2815772 - RNA, 20 nt, Mycobacterium avium subsp. paratuberculosis
caccccguugccgccggcgc

SEQ ID NO: 2815773 - RNA, 14 nt, Mycobacterium avium subsp. paratuberculosis
caccccugccgcca

SEQ ID NO: 2815774 - RNA, 15 nt, Mycobacterium avium subsp. paratuberculosis
caccccugccgccac

SEQ ID NO: 2815775 - RNA, 17 nt, Mycobacterium avium subsp. paratuberculosis
caccccugccgccaccg

SEQ ID NO: 2815776 - RNA, 15 nt, Mycobacterium avium subsp. paratuberculosis
caccccuggcgggua

SEQ ID NO: 2815777 - RNA, 23 nt, Mycobacterium avium subsp. paratuberculosis
cacccgaauugccuugcuccaca

SEQ ID NO: 2815778 - RNA, 16 nt, Mycobacterium avium subsp. paratuberculosis
cacccgaccgacgccc

SEQ ID NO: 2815779 - RNA, 17 nt, Mycobacterium avium subsp. paratuberculosis
cacccgaccgacgcccg

SEQ ID NO: 2815780 - RNA, 19 nt, Mycobacterium avium subsp. paratuberculosis
cacccgaccgacgcccggc

SEQ ID NO: 2815781 - RNA, 15 nt, Mycobacterium avium subsp. paratuberculosis
cacccgacgaagccg

SEQ ID NO: 2815782 - RNA, 13 nt, Mycobacterium avium subsp. paratuberculosis
cacccgacgucga

SEQ ID NO: 2815783 - RNA, 15 nt, Mycobacterium avium subsp. paratuberculosis
cacccgacgucgacg

SEQ ID NO: 2815784 - RNA, 17 nt, Mycobacterium avium subsp. paratuberculosis
cacccgacgucgacgcg

SEQ ID NO: 2815785 - RNA, 22 nt, Mycobacterium avium subsp. paratuberculosis
cacccgacgucgacgcgggcga

SEQ ID NO: 2815786 - RNA, 22 nt, Mycobacterium avium subsp. paratuberculosis
cacccgaggccguucagguaau

SEQ ID NO: 2815787 - RNA, 17 nt, Mycobacterium avium subsp. paratuberculosis
cacccgauccacggcga

SEQ ID NO: 2815788 - RNA, 18 nt, Mycobacterium avium subsp. paratuberculosis
cacccgauccacggcgac

SEQ ID NO: 2815789 - RNA, 19 nt, Mycobacterium avium subsp. paratuberculosis
cacccgauccacggcgacc

SEQ ID NO: 2815790 - RNA, 16 nt, Mycobacterium avium subsp. paratuberculosis
cacccgaugaccggcc

SEQ ID NO: 2815791 - RNA, 20 nt, Mycobacterium avium subsp. paratuberculosis
cacccgaugaccggcccggc

SEQ ID NO: 2815792 - RNA, 15 nt, Mycobacterium avium subsp. paratuberculosis
cacccgaugcucccg

SEQ ID NO: 2815793 - RNA, 17 nt, Mycobacterium avium subsp. paratuberculosis
cacccgcaacaccacgu

SEQ ID NO: 2815794 - RNA, 19 nt, Mycobacterium avium subsp. paratuberculosis
cacccgcaacaccacgucg

SEQ ID NO: 2815795 - RNA, 12 nt, Mycobacterium avium subsp. paratuberculosis
cacccgcaacgc

SEQ ID NO: 2815796 - RNA, 18 nt, Mycobacterium avium subsp. paratuberculosis
cacccgcaacgcgcgcga

SEQ ID NO: 2815797 - RNA, 17 nt, Mycobacterium avium subsp. paratuberculosis
cacccgcaacgcugacc

SEQ ID NO: 2815798 - RNA, 21 nt, Mycobacterium avium subsp. paratuberculosis
cacccgcaacgcugaccgcag

SEQ ID NO: 2815799 - RNA, 15 nt, Mycobacterium avium subsp. paratuberculosis
cacccgcaccgugua

SEQ ID NO: 2815800 - RNA, 17 nt, Mycobacterium avium subsp. paratuberculosis
cacccgcaccucgcccg

SEQ ID NO: 2815801 - RNA, 19 nt, Mycobacterium avium subsp. paratuberculosis
cacccgcaccucgcccggc

SEQ ID NO: 2815802 - RNA, 18 nt, Mycobacterium avium subsp. paratuberculosis
cacccgcaccucgcuggc

SEQ ID NO: 2815803 - RNA, 23 nt, Mycobacterium avium subsp. paratuberculosis
cacccgcaccucgcuggcggcgc

SEQ ID NO: 2815804 - RNA, 19 nt, Mycobacterium avium subsp. paratuberculosis
cacccgggcccggucgucg

SEQ ID NO: 2815805 - RNA, 13 nt, Mycobacterium avium subsp. paratuberculosis
cacccgggccugc

SEQ ID NO: 2815806 - RNA, 16 nt, Mycobacterium avium subsp. paratuberculosis
cacccgggccugcggc

SEQ ID NO: 2815807 - RNA, 19 nt, Mycobacterium avium subsp. paratuberculosis
cacccgggccugcggcggc

SEQ ID NO: 2815808 - RNA, 20 nt, Mycobacterium avium subsp. paratuberculosis
cacccgggccugcggcggcc

SEQ ID NO: 2815809 - RNA, 19 nt, Mycobacterium avium subsp. paratuberculosis
cacccgggcgacaugcccg

SEQ ID NO: 2815810 - RNA, 20 nt, Mycobacterium avium subsp. paratuberculosis
cacccgggcgacaugcccgc

SEQ ID NO: 2815811 - RNA, 16 nt, Mycobacterium avium subsp. paratuberculosis
cacccgggcgccggcg

SEQ ID NO: 2815812 - RNA, 17 nt, Mycobacterium avium subsp. paratuberculosis
cacccgggcgccggcga

SEQ ID NO: 2815813 - RNA, 12 nt, Mycobacterium avium subsp. paratuberculosis
cacccgggcgcg

SEQ ID NO: 2815814 - RNA, 18 nt, Mycobacterium avium subsp. paratuberculosis
cacccggguggacaccgc

SEQ ID NO: 2815815 - RNA, 23 nt, Mycobacterium avium subsp. paratuberculosis
cacccggguggacaccgcgauca

SEQ ID NO: 2815816 - RNA, 22 nt, Mycobacterium avium subsp. paratuberculosis
cacccggguugcgugcagccgc

SEQ ID NO: 2815817 - RNA, 23 nt, Mycobacterium avium subsp. paratuberculosis
cacccggguugcgugcagccgca

SEQ ID NO: 2815818 - RNA, 17 nt, Mycobacterium avium subsp. paratuberculosis
cacccgguccccggagu

SEQ ID NO: 2815819 - RNA, 15 nt, Mycobacterium avium subsp. paratuberculosis
cacccgguccggccc

SEQ ID NO: 2815820 - RNA, 16 nt, Mycobacterium avium subsp. paratuberculosis
cacccgguccggcccg

SEQ ID NO: 2815821 - RNA, 17 nt, Mycobacterium avium subsp. paratuberculosis
cacccgguccggcccgg

SEQ ID NO: 2815822 - RNA, 18 nt, Mycobacterium avium subsp. paratuberculosis
cacccgguccggcccggg

SEQ ID NO: 2815823 - RNA, 14 nt, Mycobacterium avium subsp. paratuberculosis
cacccgguccggcu

SEQ ID NO: 2815824 - RNA, 21 nt, Mycobacterium avium subsp. paratuberculosis
cacccgguccuucucgcacag

SEQ ID NO: 2815825 - RNA, 22 nt, Mycobacterium avium subsp. paratuberculosis
cacccgguccuucucgcacagc

SEQ ID NO: 2815826 - RNA, 21 nt, Mycobacterium avium subsp. paratuberculosis
cacccggucgaugugcgcgcu

SEQ ID NO: 2815827 - RNA, 24 nt, Mycobacterium avium subsp. paratuberculosis
cacccggucgaugugcgcgcuggc

SEQ ID NO: 2815828 - RNA, 21 nt, Mycobacterium avium subsp. paratuberculosis
cacccggugggacugggcgcc

SEQ ID NO: 2815829 - RNA, 22 nt, Mycobacterium avium subsp. paratuberculosis
cacccggugggacugggcgccg

SEQ ID NO: 2815830 - RNA, 22 nt, Mycobacterium avium subsp. paratuberculosis
cacccgguucugggcgggcucg

SEQ ID NO: 2815831 - RNA, 23 nt, Mycobacterium avium subsp. paratuberculosis
cacccgguucugggcgggcucga

SEQ ID NO: 2815832 - RNA, 16 nt, Mycobacterium avium subsp. paratuberculosis
cacccgguugagcacc

SEQ ID NO: 2815833 - RNA, 17 nt, Mycobacterium avium subsp. paratuberculosis
cacccgguugagcaccg

SEQ ID NO: 2815834 - RNA, 19 nt, Mycobacterium avium subsp. paratuberculosis
cacccgguugagcaccgca

SEQ ID NO: 2815835 - RNA, 23 nt, Mycobacterium avium subsp. paratuberculosis
cacccguaacacgaucaccccga

SEQ ID NO: 2815836 - RNA, 14 nt, Mycobacterium avium subsp. paratuberculosis
cacccgucgacucg

SEQ ID NO: 2815837 - RNA, 18 nt, Mycobacterium avium subsp. paratuberculosis
cacccgucgacucggcgg

SEQ ID NO: 2815838 - RNA, 22 nt, Mycobacterium avium subsp. paratuberculosis
cacccgucggugaaguuggcgg

SEQ ID NO: 2815839 - RNA, 17 nt, Mycobacterium avium subsp. paratuberculosis
cacccgugggccgaccg

SEQ ID NO: 2815840 - RNA, 21 nt, Mycobacterium avium subsp. paratuberculosis
cacccgugggccgaccggccg

SEQ ID NO: 2815841 - RNA, 22 nt, Mycobacterium avium subsp. paratuberculosis
cacccgugggccgaccggccgg

SEQ ID NO: 2815842 - RNA, 18 nt, Mycobacterium avium subsp. paratuberculosis
cacccguggugggcgaac

SEQ ID NO: 2815843 - RNA, 21 nt, Mycobacterium avium subsp. paratuberculosis
cacccguggugggcgaacagc

SEQ ID NO: 2815844 - RNA, 18 nt, Mycobacterium avium subsp. paratuberculosis
cacccguuccucgacgua

SEQ ID NO: 2815845 - RNA, 15 nt, Mycobacterium avium subsp. paratuberculosis
cacccguucggcguc

SEQ ID NO: 2815846 - RNA, 18 nt, Mycobacterium avium subsp. paratuberculosis
cacccguuggcaggcccg

SEQ ID NO: 2815847 - RNA, 19 nt, Mycobacterium avium subsp. paratuberculosis
cacccguuugaggcgagca

SEQ ID NO: 2815848 - RNA, 14 nt, Mycobacterium avium subsp. paratuberculosis
cacccucaccacga

SEQ ID NO: 2815849 - RNA, 14 nt, Mycobacterium avium subsp. paratuberculosis
cacccucaccccgc

SEQ ID NO: 2815850 - RNA, 17 nt, Mycobacterium avium subsp. paratuberculosis
cacccucgaggccgacg

SEQ ID NO: 2815851 - RNA, 15 nt, Mycobacterium avium subsp. paratuberculosis
cacccucgccgccgc

SEQ ID NO: 2815852 - RNA, 16 nt, Mycobacterium avium subsp. paratuberculosis
cacccucggcccgcca

SEQ ID NO: 2815853 - RNA, 12 nt, Mycobacterium avium subsp. paratuberculosis
cacccucggcgu

SEQ ID NO: 2815854 - RNA, 14 nt, Mycobacterium avium subsp. paratuberculosis
cacccucggcgucc

SEQ ID NO: 2815855 - RNA, 18 nt, Mycobacterium avium subsp. paratuberculosis
cacccucggcgucccguc

SEQ ID NO: 2815856 - RNA, 19 nt, Mycobacterium avium subsp. paratuberculosis
cacccucgggguagccggc

SEQ ID NO: 2815857 - RNA, 22 nt, Mycobacterium avium subsp. paratuberculosis
cacccucgggguagccggcccg

SEQ ID NO: 2815858 - RNA, 12 nt, Mycobacterium avium subsp. paratuberculosis
cacccugccgac

SEQ ID NO: 2815859 - RNA, 14 nt, Mycobacterium avium subsp. paratuberculosis
cacccugccgaccu

SEQ ID NO: 2815860 - RNA, 19 nt, Mycobacterium avium subsp. paratuberculosis
cacccugccgaccugcgcg

SEQ ID NO: 2815861 - RNA, 18 nt, Mycobacterium avium subsp. paratuberculosis
cacccugcgcaccgcgga

SEQ ID NO: 2815862 - RNA, 23 nt, Mycobacterium avium subsp. paratuberculosis
cacccugcgccacaacagguucg

SEQ ID NO: 2815863 - RNA, 22 nt, Mycobacterium avium subsp. paratuberculosis
cacccuggaacuuguugacgaa

SEQ ID NO: 2815864 - RNA, 18 nt, Mycobacterium avium subsp. paratuberculosis
cacccuggcgaaccgcgg

SEQ ID NO: 2815865 - RNA, 15 nt, Mycobacterium avium subsp. paratuberculosis
cacccuucaucagca

SEQ ID NO: 2815866 - RNA, 16 nt, Mycobacterium avium subsp. paratuberculosis
cacccuucaucagcac

SEQ ID NO: 2815867 - RNA, 18 nt, Mycobacterium avium subsp. paratuberculosis
cacccuucaucagcaccg

SEQ ID NO: 2815868 - RNA, 21 nt, Mycobacterium avium subsp. paratuberculosis
cacccuucaucagcaccgcga

SEQ ID NO: 2815869 - RNA, 15 nt, Mycobacterium avium subsp. paratuberculosis
cacccuugcgccgcu

SEQ ID NO: 2815870 - RNA, 17 nt, Mycobacterium avium subsp. paratuberculosis
cacccuuuuccaucugg

SEQ ID NO: 2815871 - RNA, 16 nt, Mycobacterium avium subsp. paratuberculosis
caccgaaaagcccgcc

SEQ ID NO: 2815872 - RNA, 20 nt, Mycobacterium avium subsp. paratuberculosis
caccgaaaagcccgccgccu

SEQ ID NO: 2815873 - RNA, 21 nt, Mycobacterium avium subsp. paratuberculosis
caccgaaaagcccgccgccuc

SEQ ID NO: 2815874 - RNA, 17 nt, Mycobacterium avium subsp. paratuberculosis
caccgaaagccguagcg

SEQ ID NO: 2815875 - RNA, 17 nt, Mycobacterium avium subsp. paratuberculosis
caccgaacccaccagcg

SEQ ID NO: 2815876 - RNA, 16 nt, Mycobacterium avium subsp. paratuberculosis
caccgaacccggaucg

SEQ ID NO: 2815877 - RNA, 14 nt, Mycobacterium avium subsp. paratuberculosis
caccgaaccgcccc

SEQ ID NO: 2815878 - RNA, 15 nt, Mycobacterium avium subsp. paratuberculosis
caccgaaccgccccg

SEQ ID NO: 2815879 - RNA, 16 nt, Mycobacterium avium subsp. paratuberculosis
caccgaaccgccccgc

SEQ ID NO: 2815880 - RNA, 20 nt, Mycobacterium avium subsp. paratuberculosis
caccgaaccgccccgcgcga

SEQ ID NO: 2815881 - RNA, 13 nt, Mycobacterium avium subsp. paratuberculosis
caccgaaccggcg

SEQ ID NO: 2815882 - RNA, 16 nt, Mycobacterium avium subsp. paratuberculosis
caccgaaccggcgggg

SEQ ID NO: 2815883 - RNA, 16 nt, Mycobacterium avium subsp. paratuberculosis
caccgaacgccagcag

SEQ ID NO: 2815884 - RNA, 14 nt, Mycobacterium avium subsp. paratuberculosis
caccgaacgccgag

SEQ ID NO: 2815885 - RNA, 18 nt, Mycobacterium avium subsp. paratuberculosis
caccgaacgccgaggugc

SEQ ID NO: 2815886 - RNA, 23 nt, Mycobacterium avium subsp. paratuberculosis
caccgaagaaccccgagaucgcg

SEQ ID NO: 2815887 - RNA, 14 nt, Mycobacterium avium subsp. paratuberculosis
caccgaagccgacg

SEQ ID NO: 2815888 - RNA, 19 nt, Mycobacterium avium subsp. paratuberculosis
caccgagcugggccggcgc

SEQ ID NO: 2815889 - RNA, 21 nt, Mycobacterium avium subsp. paratuberculosis
caccgagcugggccggcgccg

SEQ ID NO: 2815890 - RNA, 22 nt, Mycobacterium avium subsp. paratuberculosis
caccgagcugggccggcgccga

SEQ ID NO: 2815891 - RNA, 18 nt, Mycobacterium avium subsp. paratuberculosis
caccgaggucaccgcgac

SEQ ID NO: 2815892 - RNA, 18 nt, Mycobacterium avium subsp. paratuberculosis
caccgaggugacgaggcc

SEQ ID NO: 2815893 - RNA, 20 nt, Mycobacterium avium subsp. paratuberculosis
caccgaggugacgaggccca

SEQ ID NO: 2815894 - RNA, 17 nt, Mycobacterium avium subsp. paratuberculosis
caccgaggugacgucgc

SEQ ID NO: 2815895 - RNA, 18 nt, Mycobacterium avium subsp. paratuberculosis
caccgaggugacgucgcg

SEQ ID NO: 2815896 - RNA, 22 nt, Mycobacterium avium subsp. paratuberculosis
caccgaggugacgucgcgccgc

SEQ ID NO: 2815897 - RNA, 19 nt, Mycobacterium avium subsp. paratuberculosis
caccgagguggcccagccg

SEQ ID NO: 2815898 - RNA, 20 nt, Mycobacterium avium subsp. paratuberculosis
caccgagguggcccagccgc

SEQ ID NO: 2815899 - RNA, 18 nt, Mycobacterium avium subsp. paratuberculosis
caccgagucgcgcgacca

SEQ ID NO: 2815900 - RNA, 14 nt, Mycobacterium avium subsp. paratuberculosis
caccgagugcggcg

SEQ ID NO: 2815901 - RNA, 15 nt, Mycobacterium avium subsp. paratuberculosis
caccgagugcggcgc

SEQ ID NO: 2815902 - RNA, 18 nt, Mycobacterium avium subsp. paratuberculosis
caccgagugcggcgcggu

SEQ ID NO: 2815903 - RNA, 19 nt, Mycobacterium avium subsp. paratuberculosis
caccgagugcggcgcggug

SEQ ID NO: 2815904 - RNA, 20 nt, Mycobacterium avium subsp. paratuberculosis
caccgagugcggcgcggugc

SEQ ID NO: 2815905 - RNA, 20 nt, Mycobacterium avium subsp. paratuberculosis
caccgaguugaacgcgucga

SEQ ID NO: 2815906 - RNA, 16 nt, Mycobacterium avium subsp. paratuberculosis
caccgaguugaucccc

SEQ ID NO: 2815907 - RNA, 18 nt, Mycobacterium avium subsp. paratuberculosis
caccgaucggcacgucga

SEQ ID NO: 2815908 - RNA, 15 nt, Mycobacterium avium subsp. paratuberculosis
caccgaugcccgaca

SEQ ID NO: 2815909 - RNA, 22 nt, Mycobacterium avium subsp. paratuberculosis
caccgaugcccgacaccgcccc

SEQ ID NO: 2815910 - RNA, 15 nt, Mycobacterium avium subsp. paratuberculosis
caccgaugcgggcca

SEQ ID NO: 2815911 - RNA, 17 nt, Mycobacterium avium subsp. paratuberculosis
caccgauggguuggccg

SEQ ID NO: 2815912 - RNA, 18 nt, Mycobacterium avium subsp. paratuberculosis
caccgauggguuggccgu

SEQ ID NO: 2815913 - RNA, 13 nt, Mycobacterium avium subsp. paratuberculosis
caccgcacccaga

SEQ ID NO: 2815914 - RNA, 14 nt, Mycobacterium avium subsp. paratuberculosis
caccgcacggccca

SEQ ID NO: 2815915 - RNA, 16 nt, Mycobacterium avium subsp. paratuberculosis
caccgcacggcccauc

SEQ ID NO: 2815916 - RNA, 22 nt, Mycobacterium avium subsp. paratuberculosis
caccgcauagcgggagccggcc

SEQ ID NO: 2815917 - RNA, 18 nt, Mycobacterium avium subsp. paratuberculosis
caccgcaucccccucggc

SEQ ID NO: 2815918 - RNA, 18 nt, Mycobacterium avium subsp. paratuberculosis
caccgcaucgaaccgccg

SEQ ID NO: 2815919 - RNA, 23 nt, Mycobacterium avium subsp. paratuberculosis
caccgcaucgccgagggcgacga

SEQ ID NO: 2815920 - RNA, 16 nt, Mycobacterium avium subsp. paratuberculosis
caccgcauggccggcg

SEQ ID NO: 2815921 - RNA, 22 nt, Mycobacterium avium subsp. paratuberculosis
caccgcauggggcaguagcgac

SEQ ID NO: 2815922 - RNA, 22 nt, Mycobacterium avium subsp. paratuberculosis
caccgccaccagcaggcccaac

SEQ ID NO: 2815923 - RNA, 14 nt, Mycobacterium avium subsp. paratuberculosis
caccgccaccagcg

SEQ ID NO: 2815924 - RNA, 14 nt, Mycobacterium avium subsp. paratuberculosis
caccgccaccaggc

SEQ ID NO: 2815925 - RNA, 11 nt, Mycobacterium avium subsp. paratuberculosis
caccgccaccg

SEQ ID NO: 2815926 - RNA, 17 nt, Mycobacterium avium subsp. paratuberculosis
caccgccaccgcccgcu

SEQ ID NO: 2815927 - RNA, 14 nt, Mycobacterium avium subsp. paratuberculosis
caccgccaccgcga

SEQ ID NO: 2815928 - RNA, 16 nt, Mycobacterium avium subsp. paratuberculosis
caccgccaccgcgaac

SEQ ID NO: 2815929 - RNA, 17 nt, Mycobacterium avium subsp. paratuberculosis
caccgccaccgcgcaac

SEQ ID NO: 2815930 - RNA, 12 nt, Mycobacterium avium subsp. paratuberculosis
caccgccaccgg

SEQ ID NO: 2815931 - RNA, 14 nt, Mycobacterium avium subsp. paratuberculosis
caccgccaccggcc

SEQ ID NO: 2815932 - RNA, 16 nt, Mycobacterium avium subsp. paratuberculosis
caccgccaccggcccg

SEQ ID NO: 2815933 - RNA, 14 nt, Mycobacterium avium subsp. paratuberculosis
caccgccacggcga

SEQ ID NO: 2815934 - RNA, 16 nt, Mycobacterium avium subsp. paratuberculosis
caccgccacggcgacg

SEQ ID NO: 2815935 - RNA, 13 nt, Mycobacterium avium subsp. paratuberculosis
caccgccacgucg

SEQ ID NO: 2815936 - RNA, 22 nt, Mycobacterium avium subsp. paratuberculosis
caccgccagcaccgccaccggc

SEQ ID NO: 2815937 - RNA, 13 nt, Mycobacterium avium subsp. paratuberculosis
caccgccagcagc

SEQ ID NO: 2815938 - RNA, 14 nt, Mycobacterium avium subsp. paratuberculosis
caccgccagcagcg

SEQ ID NO: 2815939 - RNA, 19 nt, Mycobacterium avium subsp. paratuberculosis
caccgccagcagcgccgcu

SEQ ID NO: 2815940 - RNA, 20 nt, Mycobacterium avium subsp. paratuberculosis
caccgccagccaccacaucg

SEQ ID NO: 2815941 - RNA, 14 nt, Mycobacterium avium subsp. paratuberculosis
caccgccagcgccg

SEQ ID NO: 2815942 - RNA, 15 nt, Mycobacterium avium subsp. paratuberculosis
caccgccagcgccgg

SEQ ID NO: 2815943 - RNA, 17 nt, Mycobacterium avium subsp. paratuberculosis
caccgccagcgccggca

SEQ ID NO: 2815944 - RNA, 19 nt, Mycobacterium avium subsp. paratuberculosis
caccgccagcgccggcagc

SEQ ID NO: 2815945 - RNA, 14 nt, Mycobacterium avium subsp. paratuberculosis
caccgccagcgcgc

SEQ ID NO: 2815946 - RNA, 16 nt, Mycobacterium avium subsp. paratuberculosis
caccgccagcgcgccg

SEQ ID NO: 2815947 - RNA, 17 nt, Mycobacterium avium subsp. paratuberculosis
caccgccagcgcggcgg

SEQ ID NO: 2815948 - RNA, 19 nt, Mycobacterium avium subsp. paratuberculosis
caccgccagcgcggcggcg

SEQ ID NO: 2815949 - RNA, 21 nt, Mycobacterium avium subsp. paratuberculosis
caccgccagcgcggcggcgcc

SEQ ID NO: 2815950 - RNA, 22 nt, Mycobacterium avium subsp. paratuberculosis
caccgccagcgcggcggcgccg

SEQ ID NO: 2815951 - RNA, 17 nt, Mycobacterium avium subsp. paratuberculosis
caccgccaggaaggcca

SEQ ID NO: 2815952 - RNA, 14 nt, Mycobacterium avium subsp. paratuberculosis
caccgccaggacca

SEQ ID NO: 2815953 - RNA, 15 nt, Mycobacterium avium subsp. paratuberculosis
caccgccaggaccac

SEQ ID NO: 2815954 - RNA, 22 nt, Mycobacterium avium subsp. paratuberculosis
caccgccagucugagcccgggc

SEQ ID NO: 2815955 - RNA, 18 nt, Mycobacterium avium subsp. paratuberculosis
caccgccaucgcggcguu

SEQ ID NO: 2815956 - RNA, 23 nt, Mycobacterium avium subsp. paratuberculosis
caccgccaucggcaucgcgcgcg

SEQ ID NO: 2815957 - RNA, 15 nt, Mycobacterium avium subsp. paratuberculosis
caccgccccagccga

SEQ ID NO: 2815958 - RNA, 16 nt, Mycobacterium avium subsp. paratuberculosis
caccgccccagccgac

SEQ ID NO: 2815959 - RNA, 19 nt, Mycobacterium avium subsp. paratuberculosis
caccgcccccgcggcggcc

SEQ ID NO: 2815960 - RNA, 13 nt, Mycobacterium avium subsp. paratuberculosis
caccgccccgacg

SEQ ID NO: 2815961 - RNA, 12 nt, Mycobacterium avium subsp. paratuberculosis
caccgccccgcc

SEQ ID NO: 2815962 - RNA, 14 nt, Mycobacterium avium subsp. paratuberculosis
caccgccccgcccu

SEQ ID NO: 2815963 - RNA, 12 nt, Mycobacterium avium subsp. paratuberculosis
caccgccccggu

SEQ ID NO: 2815964 - RNA, 14 nt, Mycobacterium avium subsp. paratuberculosis
caccgccccgguca

SEQ ID NO: 2815965 - RNA, 19 nt, Mycobacterium avium subsp. paratuberculosis
caccgccccggucaccccg

SEQ ID NO: 2815966 - RNA, 21 nt, Mycobacterium avium subsp. paratuberculosis
caccgccccggucaccccggc

SEQ ID NO: 2815967 - RNA, 22 nt, Mycobacterium avium subsp. paratuberculosis
caccgccccggucaccccggcc

SEQ ID NO: 2815968 - RNA, 12 nt, Mycobacterium avium subsp. paratuberculosis
caccgcccgcgc

SEQ ID NO: 2815969 - RNA, 14 nt, Mycobacterium avium subsp. paratuberculosis
caccgcccgcgcga

SEQ ID NO: 2815970 - RNA, 19 nt, Mycobacterium avium subsp. paratuberculosis
caccgcccgcugaccgccg

SEQ ID NO: 2815971 - RNA, 14 nt, Mycobacterium avium subsp. paratuberculosis
caccgcccggaugc

SEQ ID NO: 2815972 - RNA, 22 nt, Mycobacterium avium subsp. paratuberculosis
caccgcccggaugccggcgccc

SEQ ID NO: 2815973 - RNA, 14 nt, Mycobacterium avium subsp. paratuberculosis
caccgcccggguug

SEQ ID NO: 2815974 - RNA, 14 nt, Mycobacterium avium subsp. paratuberculosis
caccgccgacaucg

SEQ ID NO: 2815975 - RNA, 19 nt, Mycobacterium avium subsp. paratuberculosis
caccgccgagccgucgucg

SEQ ID NO: 2815976 - RNA, 14 nt, Mycobacterium avium subsp. paratuberculosis
caccgccgagggcc

SEQ ID NO: 2815977 - RNA, 19 nt, Mycobacterium avium subsp. paratuberculosis
caccgccgagggcccgggc

SEQ ID NO: 2815978 - RNA, 21 nt, Mycobacterium avium subsp. paratuberculosis
caccgccgaugaugguggcgg

SEQ ID NO: 2815979 - RNA, 18 nt, Mycobacterium avium subsp. paratuberculosis
caccgccgauggcgacgg

SEQ ID NO: 2815980 - RNA, 15 nt, Mycobacterium avium subsp. paratuberculosis
caccgccgcaccguc

SEQ ID NO: 2815981 - RNA, 12 nt, Mycobacterium avium subsp. paratuberculosis
caccgccgccga

SEQ ID NO: 2815982 - RNA, 13 nt, Mycobacterium avium subsp. paratuberculosis
caccgccgccgac

SEQ ID NO: 2815983 - RNA, 21 nt, Mycobacterium avium subsp. paratuberculosis
caccgccgccgacuccccgcc

SEQ ID NO: 2815984 - RNA, 14 nt, Mycobacterium avium subsp. paratuberculosis
caccgccgcgccga

SEQ ID NO: 2815985 - RNA, 15 nt, Mycobacterium avium subsp. paratuberculosis
caccgccgcgccgag

SEQ ID NO: 2815986 - RNA, 19 nt, Mycobacterium avium subsp. paratuberculosis
caccgccgcgcggccgggc

SEQ ID NO: 2815987 - RNA, 13 nt, Mycobacterium avium subsp. paratuberculosis
caccgccgcggcc

SEQ ID NO: 2815988 - RNA, 14 nt, Mycobacterium avium subsp. paratuberculosis
caccgccgcggccg

SEQ ID NO: 2815989 - RNA, 17 nt, Mycobacterium avium subsp. paratuberculosis
caccgccgcggccgcga

SEQ ID NO: 2815990 - RNA, 16 nt, Mycobacterium avium subsp. paratuberculosis
caccgccgcggcgacc

SEQ ID NO: 2815991 - RNA, 20 nt, Mycobacterium avium subsp. paratuberculosis
caccgccgcggcgaccacga

SEQ ID NO: 2815992 - RNA, 14 nt, Mycobacterium avium subsp. paratuberculosis
caccgccgcggcgg

SEQ ID NO: 2815993 - RNA, 16 nt, Mycobacterium avium subsp. paratuberculosis
caccgccgcggcggug

SEQ ID NO: 2815994 - RNA, 12 nt, Mycobacterium avium subsp. paratuberculosis
caccgccgcggu

SEQ ID NO: 2815995 - RNA, 19 nt, Mycobacterium avium subsp. paratuberculosis
caccgccgcgguggguccg

SEQ ID NO: 2815996 - RNA, 14 nt, Mycobacterium avium subsp. paratuberculosis
caccgccggccacg

SEQ ID NO: 2815997 - RNA, 15 nt, Mycobacterium avium subsp. paratuberculosis
caccgccggccacgu

SEQ ID NO: 2815998 - RNA, 13 nt, Mycobacterium avium subsp. paratuberculosis
caccgccggccca

SEQ ID NO: 2815999 - RNA, 13 nt, Mycobacterium avium subsp. paratuberculosis
caccgccggcccg

SEQ ID NO: 2816000 - RNA, 12 nt, Mycobacterium avium subsp. paratuberculosis
caccgccggcgc

SEQ ID NO: 2816001 - RNA, 14 nt, Mycobacterium avium subsp. paratuberculosis
caccgccggcgccg

SEQ ID NO: 2816002 - RNA, 15 nt, Mycobacterium avium subsp. paratuberculosis
caccgccggcgccgu

SEQ ID NO: 2816003 - RNA, 16 nt, Mycobacterium avium subsp. paratuberculosis
caccgccggcgccguc

SEQ ID NO: 2816004 - RNA, 13 nt, Mycobacterium avium subsp. paratuberculosis
caccgccggcgcg

SEQ ID NO: 2816005 - RNA, 14 nt, Mycobacterium avium subsp. paratuberculosis
caccgccggcgcgg

SEQ ID NO: 2816006 - RNA, 14 nt, Mycobacterium avium subsp. paratuberculosis
caccgccggcggcc

SEQ ID NO: 2816007 - RNA, 18 nt, Mycobacterium avium subsp. paratuberculosis
caccgccggcggccuccg

SEQ ID NO: 2816008 - RNA, 22 nt, Mycobacterium avium subsp. paratuberculosis
caccgccgggcauccgggccgc

SEQ ID NO: 2816009 - RNA, 13 nt, Mycobacterium avium subsp. paratuberculosis
caccgccgucacc

SEQ ID NO: 2816010 - RNA, 16 nt, Mycobacterium avium subsp. paratuberculosis
caccgccgucaccgcc

SEQ ID NO: 2816011 - RNA, 16 nt, Mycobacterium avium subsp. paratuberculosis
caccgccgucccgucc

SEQ ID NO: 2816012 - RNA, 20 nt, Mycobacterium avium subsp. paratuberculosis
caccgccgucggggcgucgg

SEQ ID NO: 2816013 - RNA, 23 nt, Mycobacterium avium subsp. paratuberculosis
caccgccgucggggcgucggcgg

SEQ ID NO: 2816014 - RNA, 23 nt, Mycobacterium avium subsp. paratuberculosis
caccgccuccucgaugucggugg

SEQ ID NO: 2816015 - RNA, 14 nt, Mycobacterium avium subsp. paratuberculosis
caccgccugcgcga

SEQ ID NO: 2816016 - RNA, 15 nt, Mycobacterium avium subsp. paratuberculosis
caccgccugcgcgau

SEQ ID NO: 2816017 - RNA, 18 nt, Mycobacterium avium subsp. paratuberculosis
caccgccugcgcgaucgc

SEQ ID NO: 2816018 - RNA, 19 nt, Mycobacterium avium subsp. paratuberculosis
caccgccugcgcgaucgcc

SEQ ID NO: 2816019 - RNA, 20 nt, Mycobacterium avium subsp. paratuberculosis
caccgccugugcgacggcgu

SEQ ID NO: 2816020 - RNA, 15 nt, Mycobacterium avium subsp. paratuberculosis
caccgccuuccgcca

SEQ ID NO: 2816021 - RNA, 16 nt, Mycobacterium avium subsp. paratuberculosis
caccgccuucgacggc

SEQ ID NO: 2816022 - RNA, 17 nt, Mycobacterium avium subsp. paratuberculosis
caccgccuucgacggcc

SEQ ID NO: 2816023 - RNA, 14 nt, Mycobacterium avium subsp. paratuberculosis
caccgccuugcccg

SEQ ID NO: 2816024 - RNA, 17 nt, Mycobacterium avium subsp. paratuberculosis
caccgccuugcccggcu

SEQ ID NO: 2816025 - RNA, 18 nt, Mycobacterium avium subsp. paratuberculosis
caccgccuugcccggcuc

SEQ ID NO: 2816026 - RNA, 19 nt, Mycobacterium avium subsp. paratuberculosis
caccgccuugcccggcucg

SEQ ID NO: 2816027 - RNA, 23 nt, Mycobacterium avium subsp. paratuberculosis
caccgccuugcccggcucggugc

SEQ ID NO: 2816028 - RNA, 22 nt, Mycobacterium avium subsp. paratuberculosis
caccgcgaaacgcaacagcgag

SEQ ID NO: 2816029 - RNA, 17 nt, Mycobacterium avium subsp. paratuberculosis
caccgcgaacagcacgu

SEQ ID NO: 2816030 - RNA, 22 nt, Mycobacterium avium subsp. paratuberculosis
caccgcgaacgagacgaagucc

SEQ ID NO: 2816031 - RNA, 19 nt, Mycobacterium avium subsp. paratuberculosis
caccgcgaacucgucgaug

SEQ ID NO: 2816032 - RNA, 14 nt, Mycobacterium avium subsp. paratuberculosis
caccgcgaauugag

SEQ ID NO: 2816033 - RNA, 15 nt, Mycobacterium avium subsp. paratuberculosis
caccgcgacacgucg

SEQ ID NO: 2816034 - RNA, 18 nt, Mycobacterium avium subsp. paratuberculosis
caccgcgacacgucgaca

SEQ ID NO: 2816035 - RNA, 15 nt, Mycobacterium avium subsp. paratuberculosis
caccgcgaccacgcc

SEQ ID NO: 2816036 - RNA, 22 nt, Mycobacterium avium subsp. paratuberculosis
caccgcgaccacgccgcggucg

SEQ ID NO: 2816037 - RNA, 16 nt, Mycobacterium avium subsp. paratuberculosis
caccgcgaccagcucg

SEQ ID NO: 2816038 - RNA, 18 nt, Mycobacterium avium subsp. paratuberculosis
caccgcgaccagcucggg

SEQ ID NO: 2816039 - RNA, 19 nt, Mycobacterium avium subsp. paratuberculosis
caccgcgaccagcucgggc

SEQ ID NO: 2816040 - RNA, 20 nt, Mycobacterium avium subsp. paratuberculosis
caccgcgaccaugcccggcg

SEQ ID NO: 2816041 - RNA, 13 nt, Mycobacterium avium subsp. paratuberculosis
caccgcgacccag

SEQ ID NO: 2816042 - RNA, 15 nt, Mycobacterium avium subsp. paratuberculosis
caccgcgacccaggc

SEQ ID NO: 2816043 - RNA, 20 nt, Mycobacterium avium subsp. paratuberculosis
caccgcgacccaggccgccg

SEQ ID NO: 2816044 - RNA, 14 nt, Mycobacterium avium subsp. paratuberculosis
caccgcgacccggc

SEQ ID NO: 2816045 - RNA, 11 nt, Mycobacterium avium subsp. paratuberculosis
caccgcgaccg

SEQ ID NO: 2816046 - RNA, 19 nt, Mycobacterium avium subsp. paratuberculosis
caccgcgacgaucgcgacg

SEQ ID NO: 2816047 - RNA, 14 nt, Mycobacterium avium subsp. paratuberculosis
caccgcgacgcugc

SEQ ID NO: 2816048 - RNA, 16 nt, Mycobacterium avium subsp. paratuberculosis
caccgcgacgcugccg

SEQ ID NO: 2816049 - RNA, 14 nt, Mycobacterium avium subsp. paratuberculosis
caccgcgagcaccg

SEQ ID NO: 2816050 - RNA, 16 nt, Mycobacterium avium subsp. paratuberculosis
caccgcgagcaccgcg

SEQ ID NO: 2816051 - RNA, 17 nt, Mycobacterium avium subsp. paratuberculosis
caccgcgagcagacgca

SEQ ID NO: 2816052 - RNA, 20 nt, Mycobacterium avium subsp. paratuberculosis
caccgcgaguucgcgcacgc

SEQ ID NO: 2816053 - RNA, 13 nt, Mycobacterium avium subsp. paratuberculosis
caccgcgaucacc

SEQ ID NO: 2816054 - RNA, 17 nt, Mycobacterium avium subsp. paratuberculosis
caccgcgaucaccaccc

SEQ ID NO: 2816055 - RNA, 20 nt, Mycobacterium avium subsp. paratuberculosis
caccgcgaucaccaccccgg

SEQ ID NO: 2816056 - RNA, 17 nt, Mycobacterium avium subsp. paratuberculosis
caccgcgaucaccgaga

SEQ ID NO: 2816057 - RNA, 16 nt, Mycobacterium avium subsp. paratuberculosis
caccgcgaucgccgac

SEQ ID NO: 2816058 - RNA, 15 nt, Mycobacterium avium subsp. paratuberculosis
caccgcggcgaugau

SEQ ID NO: 2816059 - RNA, 13 nt, Mycobacterium avium subsp. paratuberculosis
caccgcggcgcgc

SEQ ID NO: 2816060 - RNA, 20 nt, Mycobacterium avium subsp. paratuberculosis
caccgcggcgcgcaucgccg

SEQ ID NO: 2816061 - RNA, 23 nt, Mycobacterium avium subsp. paratuberculosis
caccgcggcgcgcaucgccgucc

SEQ ID NO: 2816062 - RNA, 14 nt, Mycobacterium avium subsp. paratuberculosis
caccgcggcgcgcg

SEQ ID NO: 2816063 - RNA, 13 nt, Mycobacterium avium subsp. paratuberculosis
caccgcggcggcg

SEQ ID NO: 2816064 - RNA, 14 nt, Mycobacterium avium subsp. paratuberculosis
caccgcggcggcgu

SEQ ID NO: 2816065 - RNA, 17 nt, Mycobacterium avium subsp. paratuberculosis
caccgcggcggcgucgg

SEQ ID NO: 2816066 - RNA, 23 nt, Mycobacterium avium subsp. paratuberculosis
caccgcggcggugucggcgcccc

SEQ ID NO: 2816067 - RNA, 17 nt, Mycobacterium avium subsp. paratuberculosis
caccgcggcgugcgcca

SEQ ID NO: 2816068 - RNA, 17 nt, Mycobacterium avium subsp. paratuberculosis
caccgcggcucggucgc

SEQ ID NO: 2816069 - RNA, 19 nt, Mycobacterium avium subsp. paratuberculosis
caccgcggcucggucgcga

SEQ ID NO: 2816070 - RNA, 20 nt, Mycobacterium avium subsp. paratuberculosis
caccgcgggaauggccgcgc

SEQ ID NO: 2816071 - RNA, 21 nt, Mycobacterium avium subsp. paratuberculosis
caccgcgggaauggccgcgcc

SEQ ID NO: 2816072 - RNA, 19 nt, Mycobacterium avium subsp. paratuberculosis
caccgcgggcacggcgaug

SEQ ID NO: 2816073 - RNA, 12 nt, Mycobacterium avium subsp. paratuberculosis
caccgcgggcca

SEQ ID NO: 2816074 - RNA, 19 nt, Mycobacterium avium subsp. paratuberculosis
caccgcgggccaggcccac

SEQ ID NO: 2816075 - RNA, 23 nt, Mycobacterium avium subsp. paratuberculosis
caccgcgggccaggcccaccguc

SEQ ID NO: 2816076 - RNA, 17 nt, Mycobacterium avium subsp. paratuberculosis
caccgcgggcgcgccgu

SEQ ID NO: 2816077 - RNA, 19 nt, Mycobacterium avium subsp. paratuberculosis
caccgcgggcgcgccgucc

SEQ ID NO: 2816078 - RNA, 21 nt, Mycobacterium avium subsp. paratuberculosis
caccgcggggcugggcgccau

SEQ ID NO: 2816079 - RNA, 21 nt, Mycobacterium avium subsp. paratuberculosis
caccgcgggggcggccgggcc

SEQ ID NO: 2816080 - RNA, 17 nt, Mycobacterium avium subsp. paratuberculosis
caccgcggggugcccgg

SEQ ID NO: 2816081 - RNA, 20 nt, Mycobacterium avium subsp. paratuberculosis
caccgcggggugcccggcga

SEQ ID NO: 2816082 - RNA, 13 nt, Mycobacterium avium subsp. paratuberculosis
caccgcgggugau

SEQ ID NO: 2816083 - RNA, 22 nt, Mycobacterium avium subsp. paratuberculosis
caccgcgggugaucugcgccgu

SEQ ID NO: 2816084 - RNA, 14 nt, Mycobacterium avium subsp. paratuberculosis
caccgcggucgacg

SEQ ID NO: 2816085 - RNA, 13 nt, Mycobacterium avium subsp. paratuberculosis
caccgcggucugc

SEQ ID NO: 2816086 - RNA, 13 nt, Mycobacterium avium subsp. paratuberculosis
caccgcggugacc

SEQ ID NO: 2816087 - RNA, 16 nt, Mycobacterium avium subsp. paratuberculosis
caccgcggugaccgcc

SEQ ID NO: 2816088 - RNA, 17 nt, Mycobacterium avium subsp. paratuberculosis
caccgcggugagcggcc

SEQ ID NO: 2816089 - RNA, 19 nt, Mycobacterium avium subsp. paratuberculosis
caccgcggugagcggccgc

SEQ ID NO: 2816090 - RNA, 20 nt, Mycobacterium avium subsp. paratuberculosis
caccgcggugagcggccgca

SEQ ID NO: 2816091 - RNA, 23 nt, Mycobacterium avium subsp. paratuberculosis
caccgcggugagcggccgcagcg

SEQ ID NO: 2816092 - RNA, 14 nt, Mycobacterium avium subsp. paratuberculosis
caccgcguagaacu

SEQ ID NO: 2816093 - RNA, 12 nt, Mycobacterium avium subsp. paratuberculosis
caccgcguagcg

SEQ ID NO: 2816094 - RNA, 15 nt, Mycobacterium avium subsp. paratuberculosis
caccgcgucagcagc

SEQ ID NO: 2816095 - RNA, 16 nt, Mycobacterium avium subsp. paratuberculosis
caccgcgucagcagcg

SEQ ID NO: 2816096 - RNA, 20 nt, Mycobacterium avium subsp. paratuberculosis
caccgcgucagcagcgcgac

SEQ ID NO: 2816097 - RNA, 14 nt, Mycobacterium avium subsp. paratuberculosis
caccgcguccgcgg

SEQ ID NO: 2816098 - RNA, 15 nt, Mycobacterium avium subsp. paratuberculosis
caccgcguccgcggu

SEQ ID NO: 2816099 - RNA, 16 nt, Mycobacterium avium subsp. paratuberculosis
caccgcguccgcgucg

SEQ ID NO: 2816100 - RNA, 13 nt, Mycobacterium avium subsp. paratuberculosis
caccgcguccugc

SEQ ID NO: 2816101 - RNA, 20 nt, Mycobacterium avium subsp. paratuberculosis
caccgcguccugcaggcagg

SEQ ID NO: 2816102 - RNA, 21 nt, Mycobacterium avium subsp. paratuberculosis
caccgcguccuucuccgccgg

SEQ ID NO: 2816103 - RNA, 20 nt, Mycobacterium avium subsp. paratuberculosis
caccgcgucgaccaccgccg

SEQ ID NO: 2816104 - RNA, 13 nt, Mycobacterium avium subsp. paratuberculosis
caccgcgucgaug

SEQ ID NO: 2816105 - RNA, 15 nt, Mycobacterium avium subsp. paratuberculosis
caccgcgucgaugcg

SEQ ID NO: 2816106 - RNA, 20 nt, Mycobacterium avium subsp. paratuberculosis
caccgcgucgaugcgggccc

SEQ ID NO: 2816107 - RNA, 23 nt, Mycobacterium avium subsp. paratuberculosis
caccgcgucgaugcgggcccgca

SEQ ID NO: 2816108 - RNA, 16 nt, Mycobacterium avium subsp. paratuberculosis
caccgcgucgaugucg

SEQ ID NO: 2816109 - RNA, 23 nt, Mycobacterium avium subsp. paratuberculosis
caccgcgucgcagugccggugca

SEQ ID NO: 2816110 - RNA, 18 nt, Mycobacterium avium subsp. paratuberculosis
caccgcgucgcugcccag

SEQ ID NO: 2816111 - RNA, 15 nt, Mycobacterium avium subsp. paratuberculosis
caccgcgucggccca

SEQ ID NO: 2816112 - RNA, 19 nt, Mycobacterium avium subsp. paratuberculosis
caccgcgucggcccagacg

SEQ ID NO: 2816113 - RNA, 13 nt, Mycobacterium avium subsp. paratuberculosis
caccgcgucggcg

SEQ ID NO: 2816114 - RNA, 19 nt, Mycobacterium avium subsp. paratuberculosis
caccgcgucguagagcuga

SEQ ID NO: 2816115 - RNA, 17 nt, Mycobacterium avium subsp. paratuberculosis
caccgcgugcgagccga

SEQ ID NO: 2816116 - RNA, 20 nt, Mycobacterium avium subsp. paratuberculosis
caccgcgugcgagccgagca

SEQ ID NO: 2816117 - RNA, 21 nt, Mycobacterium avium subsp. paratuberculosis
caccgcgugcgagccgagcac

SEQ ID NO: 2816118 - RNA, 19 nt, Mycobacterium avium subsp. paratuberculosis
caccgcguucucggcggac

SEQ ID NO: 2816119 - RNA, 19 nt, Mycobacterium avium subsp. paratuberculosis
caccgcguugaucagcgcc

SEQ ID NO: 2816120 - RNA, 20 nt, Mycobacterium avium subsp. paratuberculosis
caccgcguugaucagcgcca

SEQ ID NO: 2816121 - RNA, 21 nt, Mycobacterium avium subsp. paratuberculosis
caccgcguugaucagcgccag

SEQ ID NO: 2816122 - RNA, 22 nt, Mycobacterium avium subsp. paratuberculosis
caccgcguugaucagcgccagg

SEQ ID NO: 2816123 - RNA, 21 nt, Mycobacterium avium subsp. paratuberculosis
caccgcguuggccgccacgau

SEQ ID NO: 2816124 - RNA, 22 nt, Mycobacterium avium subsp. paratuberculosis
caccgcguuguccggggugggc

SEQ ID NO: 2816125 - RNA, 21 nt, Mycobacterium avium subsp. paratuberculosis
caccgcguugucggcgacggc

SEQ ID NO: 2816126 - RNA, 22 nt, Mycobacterium avium subsp. paratuberculosis
caccgcucgucgggcucgucgu

SEQ ID NO: 2816127 - RNA, 21 nt, Mycobacterium avium subsp. paratuberculosis
caccgcugagguagucccgcg

SEQ ID NO: 2816128 - RNA, 15 nt, Mycobacterium avium subsp. paratuberculosis
caccgcugaugccgc

SEQ ID NO: 2816129 - RNA, 17 nt, Mycobacterium avium subsp. paratuberculosis
caccgcugaugccgccg

SEQ ID NO: 2816130 - RNA, 18 nt, Mycobacterium avium subsp. paratuberculosis
caccgcugaugccgccga

SEQ ID NO: 2816131 - RNA, 22 nt, Mycobacterium avium subsp. paratuberculosis
caccgcugaugccgccgaagcg

SEQ ID NO: 2816132 - RNA, 13 nt, Mycobacterium avium subsp. paratuberculosis
caccgcugccacg

SEQ ID NO: 2816133 - RNA, 15 nt, Mycobacterium avium subsp. paratuberculosis
caccgcugccacggu

SEQ ID NO: 2816134 - RNA, 15 nt, Mycobacterium avium subsp. paratuberculosis
caccgcuggaaccga

SEQ ID NO: 2816135 - RNA, 13 nt, Mycobacterium avium subsp. paratuberculosis
caccgcuggccga

SEQ ID NO: 2816136 - RNA, 19 nt, Mycobacterium avium subsp. paratuberculosis
caccgcuggccgaggccuc

SEQ ID NO: 2816137 - RNA, 20 nt, Mycobacterium avium subsp. paratuberculosis
caccgcuggccgaggccucc

SEQ ID NO: 2816138 - RNA, 17 nt, Mycobacterium avium subsp. paratuberculosis
caccgcugggcggcgcg

SEQ ID NO: 2816139 - RNA, 18 nt, Mycobacterium avium subsp. paratuberculosis
caccgcugggcggcgcgg

SEQ ID NO: 2816140 - RNA, 19 nt, Mycobacterium avium subsp. paratuberculosis
caccgcugggcggcgcggc

SEQ ID NO: 2816141 - RNA, 21 nt, Mycobacterium avium subsp. paratuberculosis
caccgcugggcggcgcggcgg

SEQ ID NO: 2816142 - RNA, 17 nt, Mycobacterium avium subsp. paratuberculosis
caccggccggccccggg

SEQ ID NO: 2816143 - RNA, 17 nt, Mycobacterium avium subsp. paratuberculosis
caccggccgguccgccc

SEQ ID NO: 2816144 - RNA, 18 nt, Mycobacterium avium subsp. paratuberculosis
caccggccgguccgccca

SEQ ID NO: 2816145 - RNA, 19 nt, Mycobacterium avium subsp. paratuberculosis
caccggccgguccgcccag

SEQ ID NO: 2816146 - RNA, 14 nt, Mycobacterium avium subsp. paratuberculosis
caccggccuucacc

SEQ ID NO: 2816147 - RNA, 18 nt, Mycobacterium avium subsp. paratuberculosis
caccggccuucaccaggg

SEQ ID NO: 2816148 - RNA, 14 nt, Mycobacterium avium subsp. paratuberculosis
caccggcgacggcg

SEQ ID NO: 2816149 - RNA, 20 nt, Mycobacterium avium subsp. paratuberculosis
caccggcgacggcgguucga

SEQ ID NO: 2816150 - RNA, 17 nt, Mycobacterium avium subsp. paratuberculosis
caccggcgaguccgcgg

SEQ ID NO: 2816151 - RNA, 13 nt, Mycobacterium avium subsp. paratuberculosis
caccggcgccccg

SEQ ID NO: 2816152 - RNA, 14 nt, Mycobacterium avium subsp. paratuberculosis
caccggcgccccgg

SEQ ID NO: 2816153 - RNA, 12 nt, Mycobacterium avium subsp. paratuberculosis
caccggcgccgc

SEQ ID NO: 2816154 - RNA, 14 nt, Mycobacterium avium subsp. paratuberculosis
caccggcgccgcca

SEQ ID NO: 2816155 - RNA, 15 nt, Mycobacterium avium subsp. paratuberculosis
caccggcgccgccac

SEQ ID NO: 2816156 - RNA, 16 nt, Mycobacterium avium subsp. paratuberculosis
caccggcgccgccacc

SEQ ID NO: 2816157 - RNA, 16 nt, Mycobacterium avium subsp. paratuberculosis
caccggcgccucgaug

SEQ ID NO: 2816158 - RNA, 18 nt, Mycobacterium avium subsp. paratuberculosis
caccggcgccucgaugcg

SEQ ID NO: 2816159 - RNA, 17 nt, Mycobacterium avium subsp. paratuberculosis
caccggcgcgacggcgg

SEQ ID NO: 2816160 - RNA, 18 nt, Mycobacterium avium subsp. paratuberculosis
caccggcgcgacggcggc

SEQ ID NO: 2816161 - RNA, 20 nt, Mycobacterium avium subsp. paratuberculosis
caccggcgcgccgcguucgg

SEQ ID NO: 2816162 - RNA, 23 nt, Mycobacterium avium subsp. paratuberculosis
caccggcgcgccgcguucggcgg

SEQ ID NO: 2816163 - RNA, 16 nt, Mycobacterium avium subsp. paratuberculosis
caccggcgcgccgucc

SEQ ID NO: 2816164 - RNA, 17 nt, Mycobacterium avium subsp. paratuberculosis
caccggcgcgccguccu

SEQ ID NO: 2816165 - RNA, 19 nt, Mycobacterium avium subsp. paratuberculosis
caccggcgcguuggcccgu

SEQ ID NO: 2816166 - RNA, 17 nt, Mycobacterium avium subsp. paratuberculosis
caccggcggcagcgacu

SEQ ID NO: 2816167 - RNA, 12 nt, Mycobacterium avium subsp. paratuberculosis
caccggcggcgg

SEQ ID NO: 2816168 - RNA, 13 nt, Mycobacterium avium subsp. paratuberculosis
caccggcggcggc

SEQ ID NO: 2816169 - RNA, 15 nt, Mycobacterium avium subsp. paratuberculosis
caccggcggcggccu

SEQ ID NO: 2816170 - RNA, 18 nt, Mycobacterium avium subsp. paratuberculosis
caccggcgucgacagccg

SEQ ID NO: 2816171 - RNA, 21 nt, Mycobacterium avium subsp. paratuberculosis
caccggcgucgacagccgguc

SEQ ID NO: 2816172 - RNA, 23 nt, Mycobacterium avium subsp. paratuberculosis
caccggcgucgacagccggucgc

SEQ ID NO: 2816173 - RNA, 22 nt, Mycobacterium avium subsp. paratuberculosis
caccggcgugaugacggcggcg

SEQ ID NO: 2816174 - RNA, 23 nt, Mycobacterium avium subsp. paratuberculosis
caccggcgugaugacggcggcgg

SEQ ID NO: 2816175 - RNA, 13 nt, Mycobacterium avium subsp. paratuberculosis
caccggcguggug

SEQ ID NO: 2816176 - RNA, 19 nt, Mycobacterium avium subsp. paratuberculosis
caccggcguggugggcaga

SEQ ID NO: 2816177 - RNA, 20 nt, Mycobacterium avium subsp. paratuberculosis
caccggcuccuugcgccgca

SEQ ID NO: 2816178 - RNA, 17 nt, Mycobacterium avium subsp. paratuberculosis
caccggcucgcggggug

SEQ ID NO: 2816179 - RNA, 21 nt, Mycobacterium avium subsp. paratuberculosis
caccggcucgggaacggucag

SEQ ID NO: 2816180 - RNA, 16 nt, Mycobacterium avium subsp. paratuberculosis
caccggcugaccggcg

SEQ ID NO: 2816181 - RNA, 20 nt, Mycobacterium avium subsp. paratuberculosis
caccggcugaccggcggugc

SEQ ID NO: 2816182 - RNA, 22 nt, Mycobacterium avium subsp. paratuberculosis
caccggcugaccggcggugccg

SEQ ID NO: 2816183 - RNA, 18 nt, Mycobacterium avium subsp. paratuberculosis
caccggcugcccgacccg

SEQ ID NO: 2816184 - RNA, 17 nt, Mycobacterium avium subsp. paratuberculosis
caccggcuggccgagcg

SEQ ID NO: 2816185 - RNA, 20 nt, Mycobacterium avium subsp. paratuberculosis
caccggcuggccgagcggcu

SEQ ID NO: 2816186 - RNA, 18 nt, Mycobacterium avium subsp. paratuberculosis
caccggcuggccggaaag

SEQ ID NO: 2816187 - RNA, 14 nt, Mycobacterium avium subsp. paratuberculosis
caccggcuggucgg

SEQ ID NO: 2816188 - RNA, 16 nt, Mycobacterium avium subsp. paratuberculosis
caccggcuggucggcg

SEQ ID NO: 2816189 - RNA, 19 nt, Mycobacterium avium subsp. paratuberculosis
caccggcuggucggcgggu

SEQ ID NO: 2816190 - RNA, 20 nt, Mycobacterium avium subsp. paratuberculosis
caccggcuggucggcgggua

SEQ ID NO: 2816191 - RNA, 15 nt, Mycobacterium avium subsp. paratuberculosis
caccggcuggugcag

SEQ ID NO: 2816192 - RNA, 20 nt, Mycobacterium avium subsp. paratuberculosis
caccggcuggugcagcagcu

SEQ ID NO: 2816193 - RNA, 17 nt, Mycobacterium avium subsp. paratuberculosis
caccggcuucgggauca

SEQ ID NO: 2816194 - RNA, 20 nt, Mycobacterium avium subsp. paratuberculosis
caccggcuucgggaucagcg

SEQ ID NO: 2816195 - RNA, 23 nt, Mycobacterium avium subsp. paratuberculosis
caccggcuucgggaucagcggga

SEQ ID NO: 2816196 - RNA, 17 nt, Mycobacterium avium subsp. paratuberculosis
caccggcuugccgaucg

SEQ ID NO: 2816197 - RNA, 18 nt, Mycobacterium avium subsp. paratuberculosis
caccggcuuggccacgau

SEQ ID NO: 2816198 - RNA, 16 nt, Mycobacterium avium subsp. paratuberculosis
caccggcuuggcggug

SEQ ID NO: 2816199 - RNA, 17 nt, Mycobacterium avium subsp. paratuberculosis
caccggcuuggcgguga

SEQ ID NO: 2816200 - RNA, 21 nt, Mycobacterium avium subsp. paratuberculosis
caccgggaaggugucggccgg

SEQ ID NO: 2816201 - RNA, 18 nt, Mycobacterium avium subsp. paratuberculosis
caccgggacaccgcuggc

SEQ ID NO: 2816202 - RNA, 20 nt, Mycobacterium avium subsp. paratuberculosis
caccgggacaccgcuggccg

SEQ ID NO: 2816203 - RNA, 14 nt, Mycobacterium avium subsp. paratuberculosis
caccgggaccagcg

SEQ ID NO: 2816204 - RNA, 23 nt, Mycobacterium avium subsp. paratuberculosis
caccgggaccagcgcggugccgg

SEQ ID NO: 2816205 - RNA, 15 nt, Mycobacterium avium subsp. paratuberculosis
caccgggaccugcug

SEQ ID NO: 2816206 - RNA, 22 nt, Mycobacterium avium subsp. paratuberculosis
caccgggaccugcugcucgucg

SEQ ID NO: 2816207 - RNA, 23 nt, Mycobacterium avium subsp. paratuberculosis
caccgggacgggggugccgaccg

SEQ ID NO: 2816208 - RNA, 21 nt, Mycobacterium avium subsp. paratuberculosis
caccgggacgggucggugguu

SEQ ID NO: 2816209 - RNA, 13 nt, Mycobacterium avium subsp. paratuberculosis
caccgggaguucu

SEQ ID NO: 2816210 - RNA, 21 nt, Mycobacterium avium subsp. paratuberculosis
caccgggaucacccucggcgu

SEQ ID NO: 2816211 - RNA, 16 nt, Mycobacterium avium subsp. paratuberculosis
caccgggauccggcgc

SEQ ID NO: 2816212 - RNA, 17 nt, Mycobacterium avium subsp. paratuberculosis
caccgggauccggcgcg

SEQ ID NO: 2816213 - RNA, 18 nt, Mycobacterium avium subsp. paratuberculosis
caccgggauccggcgcgc

SEQ ID NO: 2816214 - RNA, 20 nt, Mycobacterium avium subsp. paratuberculosis
caccgggauccggcgcgccg

SEQ ID NO: 2816215 - RNA, 23 nt, Mycobacterium avium subsp. paratuberculosis
caccgggauccggcgcgccgcga

SEQ ID NO: 2816216 - RNA, 14 nt, Mycobacterium avium subsp. paratuberculosis
caccgggaucggcg

SEQ ID NO: 2816217 - RNA, 16 nt, Mycobacterium avium subsp. paratuberculosis
caccgggaucggcggc

SEQ ID NO: 2816218 - RNA, 17 nt, Mycobacterium avium subsp. paratuberculosis
caccgggaucggcggcg

SEQ ID NO: 2816219 - RNA, 18 nt, Mycobacterium avium subsp. paratuberculosis
caccgggaucggcggcgg

SEQ ID NO: 2816220 - RNA, 13 nt, Mycobacterium avium subsp. paratuberculosis
caccgggaucggg

SEQ ID NO: 2816221 - RNA, 23 nt, Mycobacterium avium subsp. paratuberculosis
caccgggaucggggugccgccgg

SEQ ID NO: 2816222 - RNA, 13 nt, Mycobacterium avium subsp. paratuberculosis
caccgggauggcg

SEQ ID NO: 2816223 - RNA, 21 nt, Mycobacterium avium subsp. paratuberculosis
caccgggauggugaccagcgc

SEQ ID NO: 2816224 - RNA, 13 nt, Mycobacterium avium subsp. paratuberculosis
caccgggcagccg

SEQ ID NO: 2816225 - RNA, 16 nt, Mycobacterium avium subsp. paratuberculosis
caccgggcccagcucg

SEQ ID NO: 2816226 - RNA, 21 nt, Mycobacterium avium subsp. paratuberculosis
caccgucggcgaucgccgggg

SEQ ID NO: 2816227 - RNA, 13 nt, Mycobacterium avium subsp. paratuberculosis
caccgucggcgug

SEQ ID NO: 2816228 - RNA, 21 nt, Mycobacterium avium subsp. paratuberculosis
caccgucguacucgaccgcga

SEQ ID NO: 2816229 - RNA, 24 nt, Mycobacterium avium subsp. paratuberculosis
caccgucguacucgaccgcgacuu

SEQ ID NO: 2816230 - RNA, 15 nt, Mycobacterium avium subsp. paratuberculosis
caccgucgucgagcg

SEQ ID NO: 2816231 - RNA, 12 nt, Mycobacterium avium subsp. paratuberculosis
caccgucgucgc

SEQ ID NO: 2816232 - RNA, 17 nt, Mycobacterium avium subsp. paratuberculosis
caccgucgucgcaccgg

SEQ ID NO: 2816233 - RNA, 16 nt, Mycobacterium avium subsp. paratuberculosis
caccgucgugccagcg

SEQ ID NO: 2816234 - RNA, 17 nt, Mycobacterium avium subsp. paratuberculosis
caccgucgugccagcgc

SEQ ID NO: 2816235 - RNA, 18 nt, Mycobacterium avium subsp. paratuberculosis
caccgucgugccagcgca

SEQ ID NO: 2816236 - RNA, 17 nt, Mycobacterium avium subsp. paratuberculosis
caccgucucccacgaac

SEQ ID NO: 2816237 - RNA, 22 nt, Mycobacterium avium subsp. paratuberculosis
caccgucugcgccgucaccggc

SEQ ID NO: 2816238 - RNA, 23 nt, Mycobacterium avium subsp. paratuberculosis
caccgucugcgccgucaccggcu

SEQ ID NO: 2816239 - RNA, 15 nt, Mycobacterium avium subsp. paratuberculosis
caccgucuucggggc

SEQ ID NO: 2816240 - RNA, 19 nt, Mycobacterium avium subsp. paratuberculosis
caccgucuucggggccgcc

SEQ ID NO: 2816241 - RNA, 21 nt, Mycobacterium avium subsp. paratuberculosis
caccgucuucggggccgccgu

SEQ ID NO: 2816242 - RNA, 23 nt, Mycobacterium avium subsp. paratuberculosis
caccgucuucggggccgccgucg

SEQ ID NO: 2816243 - RNA, 19 nt, Mycobacterium avium subsp. paratuberculosis
caccgucuuggucucgccg

SEQ ID NO: 2816244 - RNA, 22 nt, Mycobacterium avium subsp. paratuberculosis
caccgucuuggucucgccgauc

SEQ ID NO: 2816245 - RNA, 23 nt, Mycobacterium avium subsp. paratuberculosis
caccgucuuggucucgccgaucu

SEQ ID NO: 2816246 - RNA, 17 nt, Mycobacterium avium subsp. paratuberculosis
caccgugaucgccacca

SEQ ID NO: 2816247 - RNA, 18 nt, Mycobacterium avium subsp. paratuberculosis
caccgugcccgagccgau

SEQ ID NO: 2816248 - RNA, 13 nt, Mycobacterium avium subsp. paratuberculosis
caccgugccgccc

SEQ ID NO: 2816249 - RNA, 17 nt, Mycobacterium avium subsp. paratuberculosis
caccgugccgcccgucg

SEQ ID NO: 2816250 - RNA, 18 nt, Mycobacterium avium subsp. paratuberculosis
caccgugccgcccgucgc

SEQ ID NO: 2816251 - RNA, 19 nt, Mycobacterium avium subsp. paratuberculosis
caccgugccgcccgucgcc

SEQ ID NO: 2816252 - RNA, 12 nt, Mycobacterium avium subsp. paratuberculosis
caccgugccgcg

SEQ ID NO: 2816253 - RNA, 16 nt, Mycobacterium avium subsp. paratuberculosis
caccgugccgcgcggc

SEQ ID NO: 2816254 - RNA, 20 nt, Mycobacterium avium subsp. paratuberculosis
caccgugccgcgcggcggug

SEQ ID NO: 2816255 - RNA, 21 nt, Mycobacterium avium subsp. paratuberculosis
caccgugccgcgcggcgguga

SEQ ID NO: 2816256 - RNA, 13 nt, Mycobacterium avium subsp. paratuberculosis
caccgugccguca

SEQ ID NO: 2816257 - RNA, 19 nt, Mycobacterium avium subsp. paratuberculosis
caccgugccgucacgcccg

SEQ ID NO: 2816258 - RNA, 18 nt, Mycobacterium avium subsp. paratuberculosis
caccgugccgucgcgggc

SEQ ID NO: 2816259 - RNA, 22 nt, Mycobacterium avium subsp. paratuberculosis
caccgugccgucgcgggcgucg

SEQ ID NO: 2816260 - RNA, 15 nt, Mycobacterium avium subsp. paratuberculosis
caccgugccgucgcu

SEQ ID NO: 2816261 - RNA, 17 nt, Mycobacterium avium subsp. paratuberculosis
caccgugccgucggcgu

SEQ ID NO: 2816262 - RNA, 19 nt, Mycobacterium avium subsp. paratuberculosis
caccgugccgucggcgucg

SEQ ID NO: 2816263 - RNA, 19 nt, Mycobacterium avium subsp. paratuberculosis
caccgugccuuacgccggg

SEQ ID NO: 2816264 - RNA, 16 nt, Mycobacterium avium subsp. paratuberculosis
caccgugcgcgcgcac

SEQ ID NO: 2816265 - RNA, 17 nt, Mycobacterium avium subsp. paratuberculosis
caccgugcgggucgcgc

SEQ ID NO: 2816266 - RNA, 21 nt, Mycobacterium avium subsp. paratuberculosis
caccgugcgggucgcgcugcg

SEQ ID NO: 2816267 - RNA, 23 nt, Mycobacterium avium subsp. paratuberculosis
caccgugcgggucgcgcugcggg

SEQ ID NO: 2816268 - RNA, 15 nt, Mycobacterium avium subsp. paratuberculosis
caccgugcugaucca

SEQ ID NO: 2816269 - RNA, 22 nt, Mycobacterium avium subsp. paratuberculosis
caccgugcugauccacgcccgg

SEQ ID NO: 2816270 - RNA, 17 nt, Mycobacterium avium subsp. paratuberculosis
caccgugcuggccacca

SEQ ID NO: 2816271 - RNA, 21 nt, Mycobacterium avium subsp. paratuberculosis
caccgugcuggccaccacggg

SEQ ID NO: 2816272 - RNA, 16 nt, Mycobacterium avium subsp. paratuberculosis
caccguggagacgucc

SEQ ID NO: 2816273 - RNA, 17 nt, Mycobacterium avium subsp. paratuberculosis
caccguggagacguccg

SEQ ID NO: 2816274 - RNA, 14 nt, Mycobacterium avium subsp. paratuberculosis
caccguggccccac

SEQ ID NO: 2816275 - RNA, 23 nt, Mycobacterium avium subsp. paratuberculosis
caccguggccccagccaccgugg

SEQ ID NO: 2816276 - RNA, 14 nt, Mycobacterium avium subsp. paratuberculosis
caccguggcggggg

SEQ ID NO: 2816277 - RNA, 15 nt, Mycobacterium avium subsp. paratuberculosis
caccgugggcggcgc

SEQ ID NO: 2816278 - RNA, 23 nt, Mycobacterium avium subsp. paratuberculosis
caccgugggcggcgcgaucgucg

SEQ ID NO: 2816279 - RNA, 14 nt, Mycobacterium avium subsp. paratuberculosis
caccguggucggca

SEQ ID NO: 2816280 - RNA, 22 nt, Mycobacterium avium subsp. paratuberculosis
caccguggucggcagcaccggc

SEQ ID NO: 2816281 - RNA, 17 nt, Mycobacterium avium subsp. paratuberculosis
caccgugguggcggcga

SEQ ID NO: 2816282 - RNA, 16 nt, Mycobacterium avium subsp. paratuberculosis
caccguggugugcccg

SEQ ID NO: 2816283 - RNA, 20 nt, Mycobacterium avium subsp. paratuberculosis
caccguggugugcccgcggg

SEQ ID NO: 2816284 - RNA, 21 nt, Mycobacterium avium subsp. paratuberculosis
caccguggugugcccgcgggc

SEQ ID NO: 2816285 - RNA, 23 nt, Mycobacterium avium subsp. paratuberculosis
caccguggugugcccgcgggcca

SEQ ID NO: 2816286 - RNA, 22 nt, Mycobacterium avium subsp. paratuberculosis
caccgugugacgaugcugagca

SEQ ID NO: 2816287 - RNA, 22 nt, Mycobacterium avium subsp. paratuberculosis
caccguguugaucucgucgaug

SEQ ID NO: 2816288 - RNA, 17 nt, Mycobacterium avium subsp. paratuberculosis
caccguguuggugacga

SEQ ID NO: 2816289 - RNA, 21 nt, Mycobacterium avium subsp. paratuberculosis
caccguucggggggcacgucc

SEQ ID NO: 2816290 - RNA, 14 nt, Mycobacterium avium subsp. paratuberculosis
caccguucgggugc

SEQ ID NO: 2816291 - RNA, 22 nt, Mycobacterium avium subsp. paratuberculosis
caccguugggggucgacugggc

SEQ ID NO: 2816292 - RNA, 17 nt, Mycobacterium avium subsp. paratuberculosis
caccguugucucggcgc

SEQ ID NO: 2816293 - RNA, 22 nt, Mycobacterium avium subsp. paratuberculosis
caccguugucucggcgccgucg

SEQ ID NO: 2816294 - RNA, 17 nt, Mycobacterium avium subsp. paratuberculosis
caccucaucgcccagcc

SEQ ID NO: 2816295 - RNA, 13 nt, Mycobacterium avium subsp. paratuberculosis
caccuccagauag

SEQ ID NO: 2816296 - RNA, 19 nt, Mycobacterium avium subsp. paratuberculosis
caccuccagauagaggaac

SEQ ID NO: 2816297 - RNA, 19 nt, Mycobacterium avium subsp. paratuberculosis
caccuccagcccggcgaug

SEQ ID NO: 2816298 - RNA, 21 nt, Mycobacterium avium subsp. paratuberculosis
caccucccuguuagggcgacc

SEQ ID NO: 2816299 - RNA, 19 nt, Mycobacterium avium subsp. paratuberculosis
caccuccgacagcccccgc

SEQ ID NO: 2816300 - RNA, 15 nt, Mycobacterium avium subsp. paratuberculosis
caccuccuccggucc

SEQ ID NO: 2816301 - RNA, 11 nt, Mycobacterium avium subsp. paratuberculosis
caccuccucgc

SEQ ID NO: 2816302 - RNA, 12 nt, Mycobacterium avium subsp. paratuberculosis
caccuccucgcg

SEQ ID NO: 2816303 - RNA, 23 nt, Mycobacterium avium subsp. paratuberculosis
caccuccucgcgggcgaucucca

SEQ ID NO: 2816304 - RNA, 22 nt, Mycobacterium avium subsp. paratuberculosis
caccuccucgguguacagcgcc

SEQ ID NO: 2816305 - RNA, 23 nt, Mycobacterium avium subsp. paratuberculosis
caccuccucgguguacagcgcca

SEQ ID NO: 2816306 - RNA, 16 nt, Mycobacterium avium subsp. paratuberculosis
caccuccugcacccgu

SEQ ID NO: 2816307 - RNA, 18 nt, Mycobacterium avium subsp. paratuberculosis
caccuccuuggccaggcg

SEQ ID NO: 2816308 - RNA, 23 nt, Mycobacterium avium subsp. paratuberculosis
caccuccuuggguucggcggcgc

SEQ ID NO: 2816309 - RNA, 17 nt, Mycobacterium avium subsp. paratuberculosis
caccucgaaacccagcu

SEQ ID NO: 2816310 - RNA, 16 nt, Mycobacterium avium subsp. paratuberculosis
caccucuucgggcagc

SEQ ID NO: 2816311 - RNA, 15 nt, Mycobacterium avium subsp. paratuberculosis
caccugaaccgcgca

SEQ ID NO: 2816312 - RNA, 23 nt, Mycobacterium avium subsp. paratuberculosis
caccugaacggccgcgcagaucg

SEQ ID NO: 2816313 - RNA, 19 nt, Mycobacterium avium subsp. paratuberculosis
caccugacagacccgaucg

SEQ ID NO: 2816314 - RNA, 22 nt, Mycobacterium avium subsp. paratuberculosis
caccugacagacccgaucgauc

SEQ ID NO: 2816315 - RNA, 12 nt, Mycobacterium avium subsp. paratuberculosis
caccugaccgcg

SEQ ID NO: 2816316 - RNA, 13 nt, Mycobacterium avium subsp. paratuberculosis
caccugaccgcgg

SEQ ID NO: 2816317 - RNA, 15 nt, Mycobacterium avium subsp. paratuberculosis
caccugaccgcgggc

SEQ ID NO: 2816318 - RNA, 16 nt, Mycobacterium avium subsp. paratuberculosis
caccugaccgucggcc

SEQ ID NO: 2816319 - RNA, 17 nt, Mycobacterium avium subsp. paratuberculosis
caccugaccgucggcca

SEQ ID NO: 2816320 - RNA, 13 nt, Mycobacterium avium subsp. paratuberculosis
caccugacgcauc

SEQ ID NO: 2816321 - RNA, 17 nt, Mycobacterium avium subsp. paratuberculosis
caccugacgcaucacca

SEQ ID NO: 2816322 - RNA, 20 nt, Mycobacterium avium subsp. paratuberculosis
caccugacgcaucaccacgc

SEQ ID NO: 2816323 - RNA, 24 nt, Mycobacterium avium subsp. paratuberculosis
caccugacgcucggucgccacggc

SEQ ID NO: 2816324 - RNA, 18 nt, Mycobacterium avium subsp. paratuberculosis
caccugagucugggucac

SEQ ID NO: 2816325 - RNA, 16 nt, Mycobacterium avium subsp. paratuberculosis
caccugaucgaugccg

SEQ ID NO: 2816326 - RNA, 17 nt, Mycobacterium avium subsp. paratuberculosis
caccugaucgcggcgag

SEQ ID NO: 2816327 - RNA, 20 nt, Mycobacterium avium subsp. paratuberculosis
caccugaucgcggcgagcag

SEQ ID NO: 2816328 - RNA, 22 nt, Mycobacterium avium subsp. paratuberculosis
caccugaucgcggcgagcagcg

SEQ ID NO: 2816329 - RNA, 13 nt, Mycobacterium avium subsp. paratuberculosis
caccugcaccugg

SEQ ID NO: 2816330 - RNA, 14 nt, Mycobacterium avium subsp. paratuberculosis
caccugcaccuggg

SEQ ID NO: 2816331 - RNA, 19 nt, Mycobacterium avium subsp. paratuberculosis
caccugcacggggacgucg

SEQ ID NO: 2816332 - RNA, 13 nt, Mycobacterium avium subsp. paratuberculosis
caccugcagccgg

SEQ ID NO: 2816333 - RNA, 15 nt, Mycobacterium avium subsp. paratuberculosis
caccugcagccgguc

SEQ ID NO: 2816334 - RNA, 20 nt, Mycobacterium avium subsp. paratuberculosis
caccugcagccggucggagg

SEQ ID NO: 2816335 - RNA, 13 nt, Mycobacterium avium subsp. paratuberculosis
caccugcaguucg

SEQ ID NO: 2816336 - RNA, 17 nt, Mycobacterium avium subsp. paratuberculosis
caccugcaucacgaugg

SEQ ID NO: 2816337 - RNA, 17 nt, Mycobacterium avium subsp. paratuberculosis
caccugccgcaacgggc

SEQ ID NO: 2816338 - RNA, 16 nt, Mycobacterium avium subsp. paratuberculosis
caccugccgcacaccg

SEQ ID NO: 2816339 - RNA, 17 nt, Mycobacterium avium subsp. paratuberculosis
caccugccgcacaccgu

SEQ ID NO: 2816340 - RNA, 14 nt, Mycobacterium avium subsp. paratuberculosis
caccugccgucgac

SEQ ID NO: 2816341 - RNA, 16 nt, Mycobacterium avium subsp. paratuberculosis
caccugccgucgacga

SEQ ID NO: 2816342 - RNA, 13 nt, Mycobacterium avium subsp. paratuberculosis
caccugcgcgacg

SEQ ID NO: 2816343 - RNA, 15 nt, Mycobacterium avium subsp. paratuberculosis
caccugcgcgacgcu

SEQ ID NO: 2816344 - RNA, 13 nt, Mycobacterium avium subsp. paratuberculosis
caccugcgcgccg

SEQ ID NO: 2816345 - RNA, 14 nt, Mycobacterium avium subsp. paratuberculosis
caccugcgcgccgu

SEQ ID NO: 2816346 - RNA, 17 nt, Mycobacterium avium subsp. paratuberculosis
caccugcggcaccucgg

SEQ ID NO: 2816347 - RNA, 20 nt, Mycobacterium avium subsp. paratuberculosis
caccugcggcaccucggccu

SEQ ID NO: 2816348 - RNA, 23 nt, Mycobacterium avium subsp. paratuberculosis
caccugcggcaggucggccagcg

SEQ ID NO: 2816349 - RNA, 14 nt, Mycobacterium avium subsp. paratuberculosis
caccugcggcccgu

SEQ ID NO: 2816350 - RNA, 15 nt, Mycobacterium avium subsp. paratuberculosis
caccugcggcccguc

SEQ ID NO: 2816351 - RNA, 17 nt, Mycobacterium avium subsp. paratuberculosis
caccugcggcccgucgc

SEQ ID NO: 2816352 - RNA, 23 nt, Mycobacterium avium subsp. paratuberculosis
caccugcggcccgucgccgugcg

SEQ ID NO: 2816353 - RNA, 16 nt, Mycobacterium avium subsp. paratuberculosis
caccugcggcggcagu

SEQ ID NO: 2816354 - RNA, 18 nt, Mycobacterium avium subsp. paratuberculosis
caccugcggcggcagucg

SEQ ID NO: 2816355 - RNA, 13 nt, Mycobacterium avium subsp. paratuberculosis
caccugcgguucg

SEQ ID NO: 2816356 - RNA, 20 nt, Mycobacterium avium subsp. paratuberculosis
caccugcgguucgucgcggc

SEQ ID NO: 2816357 - RNA, 23 nt, Mycobacterium avium subsp. paratuberculosis
caccugcgguucgucgcggcggc

SEQ ID NO: 2816358 - RNA, 21 nt, Mycobacterium avium subsp. paratuberculosis
caccugcgugccuugcaccca

SEQ ID NO: 2816359 - RNA, 19 nt, Mycobacterium avium subsp. paratuberculosis
caccugcucaccgagcugg

SEQ ID NO: 2816360 - RNA, 19 nt, Mycobacterium avium subsp. paratuberculosis
caccugcuuggucuccggc

SEQ ID NO: 2816361 - RNA, 22 nt, Mycobacterium avium subsp. paratuberculosis
caccugcuuggucuccggcccc

SEQ ID NO: 2816362 - RNA, 17 nt, Mycobacterium avium subsp. paratuberculosis
caccuggaagcgcaucg

SEQ ID NO: 2816363 - RNA, 20 nt, Mycobacterium avium subsp. paratuberculosis
caccuggaagcgcaucgccg

SEQ ID NO: 2816364 - RNA, 20 nt, Mycobacterium avium subsp. paratuberculosis
caccuggaggccaacgagcg

SEQ ID NO: 2816365 - RNA, 15 nt, Mycobacterium avium subsp. paratuberculosis
caccuggcagcaucc

SEQ ID NO: 2816366 - RNA, 22 nt, Mycobacterium avium subsp. paratuberculosis
caccuggcagcauccgccgacg

SEQ ID NO: 2816367 - RNA, 11 nt, Mycobacterium avium subsp. paratuberculosis
caccuggccgu

SEQ ID NO: 2816368 - RNA, 19 nt, Mycobacterium avium subsp. paratuberculosis
caccuggccgucgguggcc

SEQ ID NO: 2816369 - RNA, 14 nt, Mycobacterium avium subsp. paratuberculosis
caccuggcgcaccg

SEQ ID NO: 2816370 - RNA, 20 nt, Mycobacterium avium subsp. paratuberculosis
caccuggcgcaccgccgcgg

SEQ ID NO: 2816371 - RNA, 16 nt, Mycobacterium avium subsp. paratuberculosis
caccuggcgcagcacc

SEQ ID NO: 2816372 - RNA, 17 nt, Mycobacterium avium subsp. paratuberculosis
caccuggcgcagcaccg

SEQ ID NO: 2816373 - RNA, 22 nt, Mycobacterium avium subsp. paratuberculosis
caccuggcgcagcaccgacucc

SEQ ID NO: 2816374 - RNA, 17 nt, Mycobacterium avium subsp. paratuberculosis
caccuggcugugcacga

SEQ ID NO: 2816375 - RNA, 19 nt, Mycobacterium avium subsp. paratuberculosis
caccugguccugccccggg

SEQ ID NO: 2816376 - RNA, 16 nt, Mycobacterium avium subsp. paratuberculosis
caccuggucggguucg

SEQ ID NO: 2816377 - RNA, 22 nt, Mycobacterium avium subsp. paratuberculosis
caccuggucggguucgcccucc

SEQ ID NO: 2816378 - RNA, 17 nt, Mycobacterium avium subsp. paratuberculosis
caccuggucggucagcu

SEQ ID NO: 2816379 - RNA, 15 nt, Mycobacterium avium subsp. paratuberculosis
caccuggugcucgcg

SEQ ID NO: 2816380 - RNA, 18 nt, Mycobacterium avium subsp. paratuberculosis
caccuggugcucgcgcuc

SEQ ID NO: 2816381 - RNA, 19 nt, Mycobacterium avium subsp. paratuberculosis
caccuggugcucgcgcucg

SEQ ID NO: 2816382 - RNA, 20 nt, Mycobacterium avium subsp. paratuberculosis
caccugguuggcccgcacca

SEQ ID NO: 2816383 - RNA, 14 nt, Mycobacterium avium subsp. paratuberculosis
caccuguacguguc

SEQ ID NO: 2816384 - RNA, 18 nt, Mycobacterium avium subsp. paratuberculosis
caccuguacgugucccug

SEQ ID NO: 2816385 - RNA, 16 nt, Mycobacterium avium subsp. paratuberculosis
caccugugaggcaccg

SEQ ID NO: 2816386 - RNA, 16 nt, Mycobacterium avium subsp. paratuberculosis
caccuucagcgggcgc

SEQ ID NO: 2816387 - RNA, 20 nt, Mycobacterium avium subsp. paratuberculosis
caccuucagcgggcgcagcu

SEQ ID NO: 2816388 - RNA, 14 nt, Mycobacterium avium subsp. paratuberculosis
caccuucgcggucg

SEQ ID NO: 2816389 - RNA, 14 nt, Mycobacterium avium subsp. paratuberculosis
caccuucugcgcgc

SEQ ID NO: 2816390 - RNA, 19 nt, Mycobacterium avium subsp. paratuberculosis
caccuucugcgcgccgucg

SEQ ID NO: 2816391 - RNA, 23 nt, Mycobacterium avium subsp. paratuberculosis
caccuucugcgcgccgucggcgu

SEQ ID NO: 2816392 - RNA, 23 nt, Mycobacterium avium subsp. paratuberculosis
caccuugaucucgucgcggcugc

SEQ ID NO: 2816393 - RNA, 19 nt, Mycobacterium avium subsp. paratuberculosis
caccuugcccgucgcgucc

SEQ ID NO: 2816394 - RNA, 17 nt, Mycobacterium avium subsp. paratuberculosis
caccuugcgcgggucgc

SEQ ID NO: 2816395 - RNA, 20 nt, Mycobacterium avium subsp. paratuberculosis
cacgacgaccgcgacggcgc

SEQ ID NO: 2816396 - RNA, 21 nt, Mycobacterium avium subsp. paratuberculosis
cacgacgaccgcgacggcgcc

SEQ ID NO: 2816397 - RNA, 22 nt, Mycobacterium avium subsp. paratuberculosis
cacgacgaccgcgacggcgccc

SEQ ID NO: 2816398 - RNA, 14 nt, Mycobacterium avium subsp. paratuberculosis
cacgacgaccgcgu

SEQ ID NO: 2816399 - RNA, 16 nt, Mycobacterium avium subsp. paratuberculosis
cacgacgacguggugg

SEQ ID NO: 2816400 - RNA, 13 nt, Mycobacterium avium subsp. paratuberculosis
cacgacgccgccg

SEQ ID NO: 2816401 - RNA, 14 nt, Mycobacterium avium subsp. paratuberculosis
cacgacgccgggcg

SEQ ID NO: 2816402 - RNA, 15 nt, Mycobacterium avium subsp. paratuberculosis
cacgacgcgaccgag

SEQ ID NO: 2816403 - RNA, 21 nt, Mycobacterium avium subsp. paratuberculosis
cacgacgcgccacgccccggc

SEQ ID NO: 2816404 - RNA, 16 nt, Mycobacterium avium subsp. paratuberculosis
cacgacgcggcgcgcg

SEQ ID NO: 2816405 - RNA, 17 nt, Mycobacterium avium subsp. paratuberculosis
cacgacgcggcgcgcga

SEQ ID NO: 2816406 - RNA, 20 nt, Mycobacterium avium subsp. paratuberculosis
cacgacgcggucugcggugc

SEQ ID NO: 2816407 - RNA, 21 nt, Mycobacterium avium subsp. paratuberculosis
cacgacgcggucugcggugcg

SEQ ID NO: 2816408 - RNA, 18 nt, Mycobacterium avium subsp. paratuberculosis
cacgacggcgcuggccgc

SEQ ID NO: 2816409 - RNA, 20 nt, Mycobacterium avium subsp. paratuberculosis
cacgacggcgcuggccgcgg

SEQ ID NO: 2816410 - RNA, 22 nt, Mycobacterium avium subsp. paratuberculosis
cacgacggcgcuggccgcggcc

SEQ ID NO: 2816411 - RNA, 19 nt, Mycobacterium avium subsp. paratuberculosis
cacgacggucacggccgcc

SEQ ID NO: 2816412 - RNA, 21 nt, Mycobacterium avium subsp. paratuberculosis
cacgacggucacggccgccag

SEQ ID NO: 2816413 - RNA, 23 nt, Mycobacterium avium subsp. paratuberculosis
cacgacggucagcacgcugauca

SEQ ID NO: 2816414 - RNA, 15 nt, Mycobacterium avium subsp. paratuberculosis
cacgacguacccccg

SEQ ID NO: 2816415 - RNA, 20 nt, Mycobacterium avium subsp. paratuberculosis
cacgacgucugggccgccga

SEQ ID NO: 2816416 - RNA, 23 nt, Mycobacterium avium subsp. paratuberculosis
cacgacgucugggccgccgagca

SEQ ID NO: 2816417 - RNA, 21 nt, Mycobacterium avium subsp. paratuberculosis
cacgacguggagucgaagcgg

SEQ ID NO: 2816418 - RNA, 16 nt, Mycobacterium avium subsp. paratuberculosis
cacgacuccuggccga

SEQ ID NO: 2816419 - RNA, 14 nt, Mycobacterium avium subsp. paratuberculosis
cacgacugcgcggc

SEQ ID NO: 2816420 - RNA, 15 nt, Mycobacterium avium subsp. paratuberculosis
cacgacugcgcggcc

SEQ ID NO: 2816421 - RNA, 16 nt, Mycobacterium avium subsp. paratuberculosis
cacgacugcgcggccg

SEQ ID NO: 2816422 - RNA, 19 nt, Mycobacterium avium subsp. paratuberculosis
cacgacugcgcggccggcg

SEQ ID NO: 2816423 - RNA, 20 nt, Mycobacterium avium subsp. paratuberculosis
cacgacugcgcggccggcgu

SEQ ID NO: 2816424 - RNA, 18 nt, Mycobacterium avium subsp. paratuberculosis
cacgacuucacaggccgc

SEQ ID NO: 2816425 - RNA, 23 nt, Mycobacterium avium subsp. paratuberculosis
cacgagcacccagaaacaccauc

SEQ ID NO: 2816426 - RNA, 20 nt, Mycobacterium avium subsp. paratuberculosis
cacgagcagccgaucuggcg

SEQ ID NO: 2816427 - RNA, 16 nt, Mycobacterium avium subsp. paratuberculosis
cacgagcccagccguc

SEQ ID NO: 2816428 - RNA, 20 nt, Mycobacterium avium subsp. paratuberculosis
cacgagcgaacacgugcagc

SEQ ID NO: 2816429 - RNA, 14 nt, Mycobacterium avium subsp. paratuberculosis
cacgagcgucgugc

SEQ ID NO: 2816430 - RNA, 21 nt, Mycobacterium avium subsp. paratuberculosis
cacgagcgucgugcgggcucc

SEQ ID NO: 2816431 - RNA, 16 nt, Mycobacterium avium subsp. paratuberculosis
cacgagcuccagcuag

SEQ ID NO: 2816432 - RNA, 14 nt, Mycobacterium avium subsp. paratuberculosis
cacgaggccgggcu

SEQ ID NO: 2816433 - RNA, 21 nt, Mycobacterium avium subsp. paratuberculosis
cacgaggccgggcuggcgcug

SEQ ID NO: 2816434 - RNA, 23 nt, Mycobacterium avium subsp. paratuberculosis
cacgaggccgggcuggcgcugga

SEQ ID NO: 2816435 - RNA, 17 nt, Mycobacterium avium subsp. paratuberculosis
cacgaggcugugggcca

SEQ ID NO: 2816436 - RNA, 18 nt, Mycobacterium avium subsp. paratuberculosis
cacgaucaccaccaccgc

SEQ ID NO: 2816437 - RNA, 19 nt, Mycobacterium avium subsp. paratuberculosis
cacgaucaccaccaccgcc

SEQ ID NO: 2816438 - RNA, 18 nt, Mycobacterium avium subsp. paratuberculosis
cacgaucaccagaccggg

SEQ ID NO: 2816439 - RNA, 20 nt, Mycobacterium avium subsp. paratuberculosis
cacgaucaccagaccggguu

SEQ ID NO: 2816440 - RNA, 13 nt, Mycobacterium avium subsp. paratuberculosis
cacgaucacgucg

SEQ ID NO: 2816441 - RNA, 14 nt, Mycobacterium avium subsp. paratuberculosis
cacgaucagcgcgu

SEQ ID NO: 2816442 - RNA, 17 nt, Mycobacterium avium subsp. paratuberculosis
cacgaucagcgcgucga

SEQ ID NO: 2816443 - RNA, 22 nt, Mycobacterium avium subsp. paratuberculosis
cacgaucagggugucgaacagc

SEQ ID NO: 2816444 - RNA, 14 nt, Mycobacterium avium subsp. paratuberculosis
cacgauccaaccga

SEQ ID NO: 2816445 - RNA, 16 nt, Mycobacterium avium subsp. paratuberculosis
cacgaucccgccgccc

SEQ ID NO: 2816446 - RNA, 17 nt, Mycobacterium avium subsp. paratuberculosis
cacgaucccgccgcccg

SEQ ID NO: 2816447 - RNA, 15 nt, Mycobacterium avium subsp. paratuberculosis
cacgauccgcgcggc

SEQ ID NO: 2816448 - RNA, 17 nt, Mycobacterium avium subsp. paratuberculosis
cacgauccgcgcggcca

SEQ ID NO: 2816449 - RNA, 19 nt, Mycobacterium avium subsp. paratuberculosis
cacgauccgcgcggccacc

SEQ ID NO: 2816450 - RNA, 22 nt, Mycobacterium avium subsp. paratuberculosis
cacgauccgcgcggccaccagc

SEQ ID NO: 2816451 - RNA, 24 nt, Mycobacterium avium subsp. paratuberculosis
cacgauccgcgcggccaccagcgc

SEQ ID NO: 2816452 - RNA, 14 nt, Mycobacterium avium subsp. paratuberculosis
cacgaucgagccgg

SEQ ID NO: 2816453 - RNA, 14 nt, Mycobacterium avium subsp. paratuberculosis
cacgaucgcggcca

SEQ ID NO: 2816454 - RNA, 14 nt, Mycobacterium avium subsp. paratuberculosis
cacgaucgcgguga

SEQ ID NO: 2816455 - RNA, 23 nt, Mycobacterium avium subsp. paratuberculosis
cacgaucgcggugacgcgccggc

SEQ ID NO: 2816456 - RNA, 12 nt, Mycobacterium avium subsp. paratuberculosis
cacgaucgcguc

SEQ ID NO: 2816457 - RNA, 15 nt, Mycobacterium avium subsp. paratuberculosis
cacgaucgcgucgga

SEQ ID NO: 2816458 - RNA, 15 nt, Mycobacterium avium subsp. paratuberculosis
cacgaucggcagcgc

SEQ ID NO: 2816459 - RNA, 17 nt, Mycobacterium avium subsp. paratuberculosis
cacgaucggcagcgcca

SEQ ID NO: 2816460 - RNA, 20 nt, Mycobacterium avium subsp. paratuberculosis
cacgaucggcagcgccaaca

SEQ ID NO: 2816461 - RNA, 14 nt, Mycobacterium avium subsp. paratuberculosis
cacgaucggcauga

SEQ ID NO: 2816462 - RNA, 18 nt, Mycobacterium avium subsp. paratuberculosis
cacgaucggcaugacgcc

SEQ ID NO: 2816463 - RNA, 20 nt, Mycobacterium avium subsp. paratuberculosis
cacgaucggcaugacgccca

SEQ ID NO: 2816464 - RNA, 22 nt, Mycobacterium avium subsp. paratuberculosis
cacgaucggcaugacgcccagc

SEQ ID NO: 2816465 - RNA, 16 nt, Mycobacterium avium subsp. paratuberculosis
cacgaucgucaccgug

SEQ ID NO: 2816466 - RNA, 13 nt, Mycobacterium avium subsp. paratuberculosis
cacgaucgucgcc

SEQ ID NO: 2816467 - RNA, 15 nt, Mycobacterium avium subsp. paratuberculosis
cacgaucgucgccgc

SEQ ID NO: 2816468 - RNA, 16 nt, Mycobacterium avium subsp. paratuberculosis
cacgaucgucgccgcc

SEQ ID NO: 2816469 - RNA, 21 nt, Mycobacterium avium subsp. paratuberculosis
cacgaucgucgccgccaacgc

SEQ ID NO: 2816470 - RNA, 16 nt, Mycobacterium avium subsp. paratuberculosis
cacgaucucggcgguc

SEQ ID NO: 2816471 - RNA, 16 nt, Mycobacterium avium subsp. paratuberculosis
cacgaucucggucgcc

SEQ ID NO: 2816472 - RNA, 17 nt, Mycobacterium avium subsp. paratuberculosis
cacgaucucggucgcca

SEQ ID NO: 2816473 - RNA, 22 nt, Mycobacterium avium subsp. paratuberculosis
cacgaucucggucgccagcacc

SEQ ID NO: 2816474 - RNA, 23 nt, Mycobacterium avium subsp. paratuberculosis
cacgaucucggucgccagcaccg

SEQ ID NO: 2816475 - RNA, 20 nt, Mycobacterium avium subsp. paratuberculosis
cacgaucugguugaaccggu

SEQ ID NO: 2816476 - RNA, 22 nt, Mycobacterium avium subsp. paratuberculosis
cacgaugaacuccucgaucguc

SEQ ID NO: 2816477 - RNA, 16 nt, Mycobacterium avium subsp. paratuberculosis
cacgaugacgaccggg

SEQ ID NO: 2816478 - RNA, 18 nt, Mycobacterium avium subsp. paratuberculosis
cacgaugaucgucggcag

SEQ ID NO: 2816479 - RNA, 19 nt, Mycobacterium avium subsp. paratuberculosis
cacgcccuggaaggcgauc

SEQ ID NO: 2816480 - RNA, 20 nt, Mycobacterium avium subsp. paratuberculosis
cacgcccuggaaggcgauca

SEQ ID NO: 2816481 - RNA, 18 nt, Mycobacterium avium subsp. paratuberculosis
cacgccgaccacccccag

SEQ ID NO: 2816482 - RNA, 14 nt, Mycobacterium avium subsp. paratuberculosis
cacgccgacgaaca

SEQ ID NO: 2816483 - RNA, 16 nt, Mycobacterium avium subsp. paratuberculosis
cacgccgacgauccgc

SEQ ID NO: 2816484 - RNA, 20 nt, Mycobacterium avium subsp. paratuberculosis
cacgccgacgauccgcgccc

SEQ ID NO: 2816485 - RNA, 21 nt, Mycobacterium avium subsp. paratuberculosis
cacgccgacuagcgcggcggc

SEQ ID NO: 2816486 - RNA, 22 nt, Mycobacterium avium subsp. paratuberculosis
cacgccgacuagcgcggcggcc

SEQ ID NO: 2816487 - RNA, 17 nt, Mycobacterium avium subsp. paratuberculosis
cacgccgagcaccuggc

SEQ ID NO: 2816488 - RNA, 18 nt, Mycobacterium avium subsp. paratuberculosis
cacgccgagcagcaccgg

SEQ ID NO: 2816489 - RNA, 20 nt, Mycobacterium avium subsp. paratuberculosis
cacgccgagcagcaccggca

SEQ ID NO: 2816490 - RNA, 13 nt, Mycobacterium avium subsp. paratuberculosis
cacgccgaggcgu

SEQ ID NO: 2816491 - RNA, 19 nt, Mycobacterium avium subsp. paratuberculosis
cacgccgaggcgugccgcu

SEQ ID NO: 2816492 - RNA, 17 nt, Mycobacterium avium subsp. paratuberculosis
cacgccgagggcggcgg

SEQ ID NO: 2816493 - RNA, 20 nt, Mycobacterium avium subsp. paratuberculosis
cacgccgagggugccggcca

SEQ ID NO: 2816494 - RNA, 23 nt, Mycobacterium avium subsp. paratuberculosis
cacgccgagggugccggccaccg

SEQ ID NO: 2816495 - RNA, 20 nt, Mycobacterium avium subsp. paratuberculosis
cacgccgcagcgcagcgucg

SEQ ID NO: 2816496 - RNA, 15 nt, Mycobacterium avium subsp. paratuberculosis
cacgccgcccaggcc

SEQ ID NO: 2816497 - RNA, 20 nt, Mycobacterium avium subsp. paratuberculosis
cacgccgcccaggccccggc

SEQ ID NO: 2816498 - RNA, 19 nt, Mycobacterium avium subsp. paratuberculosis
cacgccgcccccgccgcga

SEQ ID NO: 2816499 - RNA, 16 nt, Mycobacterium avium subsp. paratuberculosis
cacgccgccgggaaca

SEQ ID NO: 2816500 - RNA, 22 nt, Mycobacterium avium subsp. paratuberculosis
cacgccgccgggaacagcgacg

SEQ ID NO: 2816501 - RNA, 14 nt, Mycobacterium avium subsp. paratuberculosis
cacgccgccggggc

SEQ ID NO: 2816502 - RNA, 14 nt, Mycobacterium avium subsp. paratuberculosis
cacgccgcgauccg

SEQ ID NO: 2816503 - RNA, 14 nt, Mycobacterium avium subsp. paratuberculosis
cacgccgcgcccgu

SEQ ID NO: 2816504 - RNA, 15 nt, Mycobacterium avium subsp. paratuberculosis
cacgccgcgcccguc

SEQ ID NO: 2816505 - RNA, 16 nt, Mycobacterium avium subsp. paratuberculosis
cacgccgcgcccgucg

SEQ ID NO: 2816506 - RNA, 19 nt, Mycobacterium avium subsp. paratuberculosis
cacgccgcgcccgucgagc

SEQ ID NO: 2816507 - RNA, 20 nt, Mycobacterium avium subsp. paratuberculosis
cacgccgcgcccgucgagcg

SEQ ID NO: 2816508 - RNA, 13 nt, Mycobacterium avium subsp. paratuberculosis
cacgccgcggaag

SEQ ID NO: 2816509 - RNA, 17 nt, Mycobacterium avium subsp. paratuberculosis
cacgccgcggaaggcca

SEQ ID NO: 2816510 - RNA, 19 nt, Mycobacterium avium subsp. paratuberculosis
cacgccgcggaaggccagc

SEQ ID NO: 2816511 - RNA, 20 nt, Mycobacterium avium subsp. paratuberculosis
cacgccgcggaaggccagcu

SEQ ID NO: 2816512 - RNA, 22 nt, Mycobacterium avium subsp. paratuberculosis
cacgccgcggaaggccagcucc

SEQ ID NO: 2816513 - RNA, 20 nt, Mycobacterium avium subsp. paratuberculosis
cacgccgcgggaggcccagu

SEQ ID NO: 2816514 - RNA, 20 nt, Mycobacterium avium subsp. paratuberculosis
cacgccgcggucgcugaccc

SEQ ID NO: 2816515 - RNA, 19 nt, Mycobacterium avium subsp. paratuberculosis
cacgccggcacaccgagcg

SEQ ID NO: 2816516 - RNA, 20 nt, Mycobacterium avium subsp. paratuberculosis
cacgccggcacaccgagcga

SEQ ID NO: 2816517 - RNA, 12 nt, Mycobacterium avium subsp. paratuberculosis
cacgccggccgg

SEQ ID NO: 2816518 - RNA, 13 nt, Mycobacterium avium subsp. paratuberculosis
cacgccggccggc

SEQ ID NO: 2816519 - RNA, 20 nt, Mycobacterium avium subsp. paratuberculosis
cacgccggccguucgccggc

SEQ ID NO: 2816520 - RNA, 21 nt, Mycobacterium avium subsp. paratuberculosis
cacgccggccguucgccggcc

SEQ ID NO: 2816521 - RNA, 20 nt, Mycobacterium avium subsp. paratuberculosis
cacgccggcgaucuccaccg

SEQ ID NO: 2816522 - RNA, 12 nt, Mycobacterium avium subsp. paratuberculosis
cacgccggcggc

SEQ ID NO: 2816523 - RNA, 15 nt, Mycobacterium avium subsp. paratuberculosis
cacgccggcgggggu

SEQ ID NO: 2816524 - RNA, 15 nt, Mycobacterium avium subsp. paratuberculosis
cacgccgggcauccg

SEQ ID NO: 2816525 - RNA, 17 nt, Mycobacterium avium subsp. paratuberculosis
cacgccgggcauccgcc

SEQ ID NO: 2816526 - RNA, 19 nt, Mycobacterium avium subsp. paratuberculosis
cacgccgggcauccgcccg

SEQ ID NO: 2816527 - RNA, 21 nt, Mycobacterium avium subsp. paratuberculosis
cacgccgggguagaggccgcg

SEQ ID NO: 2816528 - RNA, 22 nt, Mycobacterium avium subsp. paratuberculosis
cacgccgggguagaggccgcgg

SEQ ID NO: 2816529 - RNA, 17 nt, Mycobacterium avium subsp. paratuberculosis
cacgccggguugggcgg

SEQ ID NO: 2816530 - RNA, 21 nt, Mycobacterium avium subsp. paratuberculosis
cacgccggguugggcggcggc

SEQ ID NO: 2816531 - RNA, 17 nt, Mycobacterium avium subsp. paratuberculosis
cacgccggucagcacca

SEQ ID NO: 2816532 - RNA, 18 nt, Mycobacterium avium subsp. paratuberculosis
cacgccggucagcaccau

SEQ ID NO: 2816533 - RNA, 13 nt, Mycobacterium avium subsp. paratuberculosis
cacgccggugacc

SEQ ID NO: 2816534 - RNA, 14 nt, Mycobacterium avium subsp. paratuberculosis
cacgccggugacca

SEQ ID NO: 2816535 - RNA, 21 nt, Mycobacterium avium subsp. paratuberculosis
cacgccggugagcacgaccgc

SEQ ID NO: 2816536 - RNA, 21 nt, Mycobacterium avium subsp. paratuberculosis
cacgccgguggacaggugcau

SEQ ID NO: 2816537 - RNA, 21 nt, Mycobacterium avium subsp. paratuberculosis
cacgccguacaccgugcccga

SEQ ID NO: 2816538 - RNA, 13 nt, Mycobacterium avium subsp. paratuberculosis
cacgccgucgacc

SEQ ID NO: 2816539 - RNA, 22 nt, Mycobacterium avium subsp. paratuberculosis
cacgccgucgacccguuccccg

SEQ ID NO: 2816540 - RNA, 14 nt, Mycobacterium avium subsp. paratuberculosis
cacgccgucgacga

SEQ ID NO: 2816541 - RNA, 22 nt, Mycobacterium avium subsp. paratuberculosis
cacgccgucgacgaucugcaca

SEQ ID NO: 2816542 - RNA, 18 nt, Mycobacterium avium subsp. paratuberculosis
cacgccgucgugcucggc

SEQ ID NO: 2816543 - RNA, 19 nt, Mycobacterium avium subsp. paratuberculosis
cacgccgucgugcucggcg

SEQ ID NO: 2816544 - RNA, 21 nt, Mycobacterium avium subsp. paratuberculosis
cacgccgucgugcucggcgag

SEQ ID NO: 2816545 - RNA, 23 nt, Mycobacterium avium subsp. paratuberculosis
cacgccgucguggguauccgccg

SEQ ID NO: 2816546 - RNA, 18 nt, Mycobacterium avium subsp. paratuberculosis
cacgccgugcagaacagc

SEQ ID NO: 2816547 - RNA, 19 nt, Mycobacterium avium subsp. paratuberculosis
cacgccgugcagaacagca

SEQ ID NO: 2816548 - RNA, 18 nt, Mycobacterium avium subsp. paratuberculosis
cacgccgugcccggcgcc

SEQ ID NO: 2816549 - RNA, 19 nt, Mycobacterium avium subsp. paratuberculosis
cacgccguggcccgcccag

SEQ ID NO: 2816550 - RNA, 12 nt, Mycobacterium avium subsp. paratuberculosis
cacgccguggcg

SEQ ID NO: 2816551 - RNA, 13 nt, Mycobacterium avium subsp. paratuberculosis
cacgccguggcgg

SEQ ID NO: 2816552 - RNA, 23 nt, Mycobacterium avium subsp. paratuberculosis
cacgccguggcggcgggccagcu

SEQ ID NO: 2816553 - RNA, 16 nt, Mycobacterium avium subsp. paratuberculosis
cacgccguugaccccg

SEQ ID NO: 2816554 - RNA, 16 nt, Mycobacterium avium subsp. paratuberculosis
cacgccguugggcgca

SEQ ID NO: 2816555 - RNA, 16 nt, Mycobacterium avium subsp. paratuberculosis
cacgccuccggcagua

SEQ ID NO: 2816556 - RNA, 13 nt, Mycobacterium avium subsp. paratuberculosis
cacgccucgucga

SEQ ID NO: 2816557 - RNA, 16 nt, Mycobacterium avium subsp. paratuberculosis
cacgccucgucgagca

SEQ ID NO: 2816558 - RNA, 19 nt, Mycobacterium avium subsp. paratuberculosis
cacgccuuccacgaccugg

SEQ ID NO: 2816559 - RNA, 23 nt, Mycobacterium avium subsp. paratuberculosis
cacgccuugcgguuggccggaau

SEQ ID NO: 2816560 - RNA, 15 nt, Mycobacterium avium subsp. paratuberculosis
cacgcgaacaccaga

SEQ ID NO: 2816561 - RNA, 12 nt, Mycobacterium avium subsp. paratuberculosis
cacgcgaccgcg

SEQ ID NO: 2816562 - RNA, 19 nt, Mycobacterium avium subsp. paratuberculosis
cacgcgaccgcgucgacgg

SEQ ID NO: 2816563 - RNA, 17 nt, Mycobacterium avium subsp. paratuberculosis
cacgcuggcggugucga

SEQ ID NO: 2816564 - RNA, 14 nt, Mycobacterium avium subsp. paratuberculosis
cacgcuggcgucca

SEQ ID NO: 2816565 - RNA, 19 nt, Mycobacterium avium subsp. paratuberculosis
cacgcuggcguccaggucg

SEQ ID NO: 2816566 - RNA, 13 nt, Mycobacterium avium subsp. paratuberculosis
cacgcuggcguga

SEQ ID NO: 2816567 - RNA, 14 nt, Mycobacterium avium subsp. paratuberculosis
cacgcuggcgugac

SEQ ID NO: 2816568 - RNA, 20 nt, Mycobacterium avium subsp. paratuberculosis
cacgcuggcgugacagucga

SEQ ID NO: 2816569 - RNA, 16 nt, Mycobacterium avium subsp. paratuberculosis
cacgcuggcgugacgc

SEQ ID NO: 2816570 - RNA, 17 nt, Mycobacterium avium subsp. paratuberculosis
cacgcuggcgugacgcu

SEQ ID NO: 2816571 - RNA, 19 nt, Mycobacterium avium subsp. paratuberculosis
cacgcuggcgugacgcucg

SEQ ID NO: 2816572 - RNA, 20 nt, Mycobacterium avium subsp. paratuberculosis
cacgcuggcgugacgcucgc

SEQ ID NO: 2816573 - RNA, 22 nt, Mycobacterium avium subsp. paratuberculosis
cacgcuggcgugacgcucggcc

SEQ ID NO: 2816574 - RNA, 23 nt, Mycobacterium avium subsp. paratuberculosis
cacgcuggcgugacgcucggcgc

SEQ ID NO: 2816575 - RNA, 18 nt, Mycobacterium avium subsp. paratuberculosis
cacgcuggcgugacgguc

SEQ ID NO: 2816576 - RNA, 21 nt, Mycobacterium avium subsp. paratuberculosis
cacgcuggcguggcacccggg

SEQ ID NO: 2816577 - RNA, 18 nt, Mycobacterium avium subsp. paratuberculosis
cacgcuggcguggcgccg

SEQ ID NO: 2816578 - RNA, 21 nt, Mycobacterium avium subsp. paratuberculosis
cacgcuggcguggcgccggcg

SEQ ID NO: 2816579 - RNA, 18 nt, Mycobacterium avium subsp. paratuberculosis
cacgcuggcguggcucgg

SEQ ID NO: 2816580 - RNA, 13 nt, Mycobacterium avium subsp. paratuberculosis
cacgcugggcucc

SEQ ID NO: 2816581 - RNA, 14 nt, Mycobacterium avium subsp. paratuberculosis
cacgcugggcuccg

SEQ ID NO: 2816582 - RNA, 15 nt, Mycobacterium avium subsp. paratuberculosis
cacgcugggcuccga

SEQ ID NO: 2816583 - RNA, 18 nt, Mycobacterium avium subsp. paratuberculosis
cacgcugggcuccgaccg

SEQ ID NO: 2816584 - RNA, 16 nt, Mycobacterium avium subsp. paratuberculosis
cacgcuggugacgugc

SEQ ID NO: 2816585 - RNA, 17 nt, Mycobacterium avium subsp. paratuberculosis
cacgcuggugugacgcu

SEQ ID NO: 2816586 - RNA, 19 nt, Mycobacterium avium subsp. paratuberculosis
cacgcuggugugacgcucg

SEQ ID NO: 2816587 - RNA, 20 nt, Mycobacterium avium subsp. paratuberculosis
cacgcuggugugacgcucgc

SEQ ID NO: 2816588 - RNA, 24 nt, Mycobacterium avium subsp. paratuberculosis
cacgcuguagggccaccacgccag

SEQ ID NO: 2816589 - RNA, 23 nt, Mycobacterium avium subsp. paratuberculosis
cacgcuguuggaaccggccacca

SEQ ID NO: 2816590 - RNA, 20 nt, Mycobacterium avium subsp. paratuberculosis
cacggaaaccgcugcggcac

SEQ ID NO: 2816591 - RNA, 21 nt, Mycobacterium avium subsp. paratuberculosis
cacggaacccaaggcggacaa

SEQ ID NO: 2816592 - RNA, 14 nt, Mycobacterium avium subsp. paratuberculosis
cacggacagccggc

SEQ ID NO: 2816593 - RNA, 15 nt, Mycobacterium avium subsp. paratuberculosis
cacggacagcucacc

SEQ ID NO: 2816594 - RNA, 15 nt, Mycobacterium avium subsp. paratuberculosis
cacggagcgcccggc

SEQ ID NO: 2816595 - RNA, 21 nt, Mycobacterium avium subsp. paratuberculosis
cacggagcgcccggccagccg

SEQ ID NO: 2816596 - RNA, 19 nt, Mycobacterium avium subsp. paratuberculosis
cacggaucgcccacccgca

SEQ ID NO: 2816597 - RNA, 15 nt, Mycobacterium avium subsp. paratuberculosis
cacggcaccgccgcg

SEQ ID NO: 2816598 - RNA, 19 nt, Mycobacterium avium subsp. paratuberculosis
cacggcaccgccgcgcggc

SEQ ID NO: 2816599 - RNA, 13 nt, Mycobacterium avium subsp. paratuberculosis
cacggcacgcccg

SEQ ID NO: 2816600 - RNA, 17 nt, Mycobacterium avium subsp. paratuberculosis
cacggcagcccgacguc

SEQ ID NO: 2816601 - RNA, 15 nt, Mycobacterium avium subsp. paratuberculosis
cacggcaggcggccc

SEQ ID NO: 2816602 - RNA, 21 nt, Mycobacterium avium subsp. paratuberculosis
cacggcaggcggcccgcucga

SEQ ID NO: 2816603 - RNA, 19 nt, Mycobacterium avium subsp. paratuberculosis
cacggcauagauaccggcc

SEQ ID NO: 2816604 - RNA, 23 nt, Mycobacterium avium subsp. paratuberculosis
cacggcauagauaccggccagca

SEQ ID NO: 2816605 - RNA, 14 nt, Mycobacterium avium subsp. paratuberculosis
cacggcaucgaugg

SEQ ID NO: 2816606 - RNA, 20 nt, Mycobacterium avium subsp. paratuberculosis
cacggcaucgauggcgggcg

SEQ ID NO: 2816607 - RNA, 21 nt, Mycobacterium avium subsp. paratuberculosis
cacggcaucgauggcgggcgc

SEQ ID NO: 2816608 - RNA, 20 nt, Mycobacterium avium subsp. paratuberculosis
cacggccaacugcaucgcca

SEQ ID NO: 2816609 - RNA, 21 nt, Mycobacterium avium subsp. paratuberculosis
cacggccaacugcaucgccag

SEQ ID NO: 2816610 - RNA, 22 nt, Mycobacterium avium subsp. paratuberculosis
cacggccaacugcaucgccagc

SEQ ID NO: 2816611 - RNA, 16 nt, Mycobacterium avium subsp. paratuberculosis
cacggccaccacggca

SEQ ID NO: 2816612 - RNA, 21 nt, Mycobacterium avium subsp. paratuberculosis
cacggccaccacggcaccgcc

SEQ ID NO: 2816613 - RNA, 14 nt, Mycobacterium avium subsp. paratuberculosis
cacggccaccagca

SEQ ID NO: 2816614 - RNA, 17 nt, Mycobacterium avium subsp. paratuberculosis
cacggccaccagcagcg

SEQ ID NO: 2816615 - RNA, 12 nt, Mycobacterium avium subsp. paratuberculosis
cacggccaccgc

SEQ ID NO: 2816616 - RNA, 17 nt, Mycobacterium avium subsp. paratuberculosis
cacggccacugccccgg

SEQ ID NO: 2816617 - RNA, 18 nt, Mycobacterium avium subsp. paratuberculosis
cacggccacugccccggc

SEQ ID NO: 2816618 - RNA, 15 nt, Mycobacterium avium subsp. paratuberculosis
cacggccagcaccgc

SEQ ID NO: 2816619 - RNA, 20 nt, Mycobacterium avium subsp. paratuberculosis
cacggccagcaccgccagcg

SEQ ID NO: 2816620 - RNA, 16 nt, Mycobacterium avium subsp. paratuberculosis
cacggccagccagccg

SEQ ID NO: 2816621 - RNA, 19 nt, Mycobacterium avium subsp. paratuberculosis
cacggccagccagccgccc

SEQ ID NO: 2816622 - RNA, 20 nt, Mycobacterium avium subsp. paratuberculosis
cacggccagccagccgccca

SEQ ID NO: 2816623 - RNA, 21 nt, Mycobacterium avium subsp. paratuberculosis
cacggccagccagccgcccag

SEQ ID NO: 2816624 - RNA, 23 nt, Mycobacterium avium subsp. paratuberculosis
cacggccagccagccgcccagca

SEQ ID NO: 2816625 - RNA, 12 nt, Mycobacterium avium subsp. paratuberculosis
cacggccagcgc

SEQ ID NO: 2816626 - RNA, 19 nt, Mycobacterium avium subsp. paratuberculosis
cacggccaggaagccggcg

SEQ ID NO: 2816627 - RNA, 22 nt, Mycobacterium avium subsp. paratuberculosis
cacggccaggaagccggcgacg

SEQ ID NO: 2816628 - RNA, 23 nt, Mycobacterium avium subsp. paratuberculosis
cacggccaggaagccggcgacga

SEQ ID NO: 2816629 - RNA, 17 nt, Mycobacterium avium subsp. paratuberculosis
cacggccaucacggugc

SEQ ID NO: 2816630 - RNA, 20 nt, Mycobacterium avium subsp. paratuberculosis
cacggccaucacggugccga

SEQ ID NO: 2816631 - RNA, 20 nt, Mycobacterium avium subsp. paratuberculosis
cacggccaugcagaccagcc

SEQ ID NO: 2816632 - RNA, 17 nt, Mycobacterium avium subsp. paratuberculosis
cacggcccaucaccagc

SEQ ID NO: 2816633 - RNA, 19 nt, Mycobacterium avium subsp. paratuberculosis
cacggcccaucaccagcgg

SEQ ID NO: 2816634 - RNA, 14 nt, Mycobacterium avium subsp. paratuberculosis
cacggccccagccg

SEQ ID NO: 2816635 - RNA, 16 nt, Mycobacterium avium subsp. paratuberculosis
cacggccccagccgcc

SEQ ID NO: 2816636 - RNA, 17 nt, Mycobacterium avium subsp. paratuberculosis
cacggccccagccgccg

SEQ ID NO: 2816637 - RNA, 18 nt, Mycobacterium avium subsp. paratuberculosis
cacggccccagccgccgc

SEQ ID NO: 2816638 - RNA, 22 nt, Mycobacterium avium subsp. paratuberculosis
cacggccccagccgccgcgaca

SEQ ID NO: 2816639 - RNA, 14 nt, Mycobacterium avium subsp. paratuberculosis
cacggcccgcgccc

SEQ ID NO: 2816640 - RNA, 16 nt, Mycobacterium avium subsp. paratuberculosis
cacggcccgcgccccg

SEQ ID NO: 2816641 - RNA, 23 nt, Mycobacterium avium subsp. paratuberculosis
cacggcccgcgccccggcggcca

SEQ ID NO: 2816642 - RNA, 15 nt, Mycobacterium avium subsp. paratuberculosis
cacggcccgcggcac

SEQ ID NO: 2816643 - RNA, 19 nt, Mycobacterium avium subsp. paratuberculosis
cacggcccgcggcacgcug

SEQ ID NO: 2816644 - RNA, 21 nt, Mycobacterium avium subsp. paratuberculosis
cacggcccgcggcacgcugcg

SEQ ID NO: 2816645 - RNA, 15 nt, Mycobacterium avium subsp. paratuberculosis
cacggcccgcucggg

SEQ ID NO: 2816646 - RNA, 18 nt, Mycobacterium avium subsp. paratuberculosis
cacggcccgcucgggcca

SEQ ID NO: 2816647 - RNA, 20 nt, Mycobacterium avium subsp. paratuberculosis
cacggcggugucggcggcaa

SEQ ID NO: 2816648 - RNA, 12 nt, Mycobacterium avium subsp. paratuberculosis
cacggcgucggc

SEQ ID NO: 2816649 - RNA, 23 nt, Mycobacterium avium subsp. paratuberculosis
cacggcguugaccaacgccgccu

SEQ ID NO: 2816650 - RNA, 18 nt, Mycobacterium avium subsp. paratuberculosis
cacggcguugaccgggcc

SEQ ID NO: 2816651 - RNA, 18 nt, Mycobacterium avium subsp. paratuberculosis
cacggcuaccuaggcguc

SEQ ID NO: 2816652 - RNA, 19 nt, Mycobacterium avium subsp. paratuberculosis
cacggcugcacccucugcc

SEQ ID NO: 2816653 - RNA, 15 nt, Mycobacterium avium subsp. paratuberculosis
cacggcugccgaccu

SEQ ID NO: 2816654 - RNA, 22 nt, Mycobacterium avium subsp. paratuberculosis
cacggcugccgaccucgauggc

SEQ ID NO: 2816655 - RNA, 13 nt, Mycobacterium avium subsp. paratuberculosis
cacgggauagcgc

SEQ ID NO: 2816656 - RNA, 19 nt, Mycobacterium avium subsp. paratuberculosis
cacgggcacaccgucgucc

SEQ ID NO: 2816657 - RNA, 17 nt, Mycobacterium avium subsp. paratuberculosis
cacgggccaggcgcgcg

SEQ ID NO: 2816658 - RNA, 12 nt, Mycobacterium avium subsp. paratuberculosis
cacgggccaugu

SEQ ID NO: 2816659 - RNA, 18 nt, Mycobacterium avium subsp. paratuberculosis
cacgggccauguccccga

SEQ ID NO: 2816660 - RNA, 19 nt, Mycobacterium avium subsp. paratuberculosis
cacgggccauguccccgac

SEQ ID NO: 2816661 - RNA, 15 nt, Mycobacterium avium subsp. paratuberculosis
cacgggcccgcggga

SEQ ID NO: 2816662 - RNA, 14 nt, Mycobacterium avium subsp. paratuberculosis
cacgggcccguccg

SEQ ID NO: 2816663 - RNA, 12 nt, Mycobacterium avium subsp. paratuberculosis
cacgggccgcgc

SEQ ID NO: 2816664 - RNA, 13 nt, Mycobacterium avium subsp. paratuberculosis
cacgggccgcgcc

SEQ ID NO: 2816665 - RNA, 14 nt, Mycobacterium avium subsp. paratuberculosis
cacgggccgcgccg

SEQ ID NO: 2816666 - RNA, 16 nt, Mycobacterium avium subsp. paratuberculosis
cacgggccgcgccgag

SEQ ID NO: 2816667 - RNA, 12 nt, Mycobacterium avium subsp. paratuberculosis
cacgggcggcag

SEQ ID NO: 2816668 - RNA, 20 nt, Mycobacterium avium subsp. paratuberculosis
cacgggcggcagggccagca

SEQ ID NO: 2816669 - RNA, 13 nt, Mycobacterium avium subsp. paratuberculosis
cacgggcgggcag

SEQ ID NO: 2816670 - RNA, 13 nt, Mycobacterium avium subsp. paratuberculosis
cacgggcggucgg

SEQ ID NO: 2816671 - RNA, 17 nt, Mycobacterium avium subsp. paratuberculosis
cacgggcggucggacgc

SEQ ID NO: 2816672 - RNA, 24 nt, Mycobacterium avium subsp. paratuberculosis
cacgggcguguaguccaggucgau

SEQ ID NO: 2816673 - RNA, 14 nt, Mycobacterium avium subsp. paratuberculosis
cacggggcagaccg

SEQ ID NO: 2816674 - RNA, 18 nt, Mycobacterium avium subsp. paratuberculosis
cacgggggaguagcgcgc

SEQ ID NO: 2816675 - RNA, 19 nt, Mycobacterium avium subsp. paratuberculosis
cacgggggaguagcgcgcg

SEQ ID NO: 2816676 - RNA, 22 nt, Mycobacterium avium subsp. paratuberculosis
cacggggugcgugacgggcuga

SEQ ID NO: 2816677 - RNA, 13 nt, Mycobacterium avium subsp. paratuberculosis
cacgggucgccga

SEQ ID NO: 2816678 - RNA, 16 nt, Mycobacterium avium subsp. paratuberculosis
cacgggucgccgaucu

SEQ ID NO: 2816679 - RNA, 20 nt, Mycobacterium avium subsp. paratuberculosis
cacgggucgccgaucucggc

SEQ ID NO: 2816680 - RNA, 19 nt, Mycobacterium avium subsp. paratuberculosis
cacgggucgccguggccga

SEQ ID NO: 2816681 - RNA, 13 nt, Mycobacterium avium subsp. paratuberculosis
cacgggucgcugu

SEQ ID NO: 2816682 - RNA, 14 nt, Mycobacterium avium subsp. paratuberculosis
cacgggucgcugug

SEQ ID NO: 2816683 - RNA, 15 nt, Mycobacterium avium subsp. paratuberculosis
cacgggucggucggc

SEQ ID NO: 2816684 - RNA, 18 nt, Mycobacterium avium subsp. paratuberculosis
cacgggucggucggcccg

SEQ ID NO: 2816685 - RNA, 19 nt, Mycobacterium avium subsp. paratuberculosis
cacggguuggggccgcgga

SEQ ID NO: 2816686 - RNA, 16 nt, Mycobacterium avium subsp. paratuberculosis
cacggucacagccgcg

SEQ ID NO: 2816687 - RNA, 17 nt, Mycobacterium avium subsp. paratuberculosis
cacggucacagccgcga

SEQ ID NO: 2816688 - RNA, 13 nt, Mycobacterium avium subsp. paratuberculosis
cacggucagcgcg

SEQ ID NO: 2816689 - RNA, 16 nt, Mycobacterium avium subsp. paratuberculosis
cacggucagcgcgucg

SEQ ID NO: 2816690 - RNA, 20 nt, Mycobacterium avium subsp. paratuberculosis
cacggucagcgcgucggcga

SEQ ID NO: 2816691 - RNA, 22 nt, Mycobacterium avium subsp. paratuberculosis
cacggucagcgcgucggcgacc

SEQ ID NO: 2816692 - RNA, 13 nt, Mycobacterium avium subsp. paratuberculosis
cacggucagcucg

SEQ ID NO: 2816693 - RNA, 14 nt, Mycobacterium avium subsp. paratuberculosis
cacggucagcucgc

SEQ ID NO: 2816694 - RNA, 15 nt, Mycobacterium avium subsp. paratuberculosis
cacggucagcucgcg

SEQ ID NO: 2816695 - RNA, 17 nt, Mycobacterium avium subsp. paratuberculosis
cacggucagcucgcgcc

SEQ ID NO: 2816696 - RNA, 13 nt, Mycobacterium avium subsp. paratuberculosis
cacggucaggccg

SEQ ID NO: 2816697 - RNA, 14 nt, Mycobacterium avium subsp. paratuberculosis
cacggucaggccgg

SEQ ID NO: 2816698 - RNA, 21 nt, Mycobacterium avium subsp. paratuberculosis
cacggucaggcgcagccagcg

SEQ ID NO: 2816699 - RNA, 15 nt, Mycobacterium avium subsp. paratuberculosis
cacgguccagguccu

SEQ ID NO: 2816700 - RNA, 23 nt, Mycobacterium avium subsp. paratuberculosis
cacgguccagguccuugaggaug

SEQ ID NO: 2816701 - RNA, 18 nt, Mycobacterium avium subsp. paratuberculosis
cacgguccaucagcaccg

SEQ ID NO: 2816702 - RNA, 17 nt, Mycobacterium avium subsp. paratuberculosis
cacgguccccgcgcccg

SEQ ID NO: 2816703 - RNA, 22 nt, Mycobacterium avium subsp. paratuberculosis
cacgguccccgcgcccgccgcg

SEQ ID NO: 2816704 - RNA, 12 nt, Mycobacterium avium subsp. paratuberculosis
cacggucgccgc

SEQ ID NO: 2816705 - RNA, 19 nt, Mycobacterium avium subsp. paratuberculosis
cacggucgccgcgccgccg

SEQ ID NO: 2816706 - RNA, 20 nt, Mycobacterium avium subsp. paratuberculosis
cacggucgccgcgccgccgg

SEQ ID NO: 2816707 - RNA, 21 nt, Mycobacterium avium subsp. paratuberculosis
cacggucgccgcgccgccggu

SEQ ID NO: 2816708 - RNA, 22 nt, Mycobacterium avium subsp. paratuberculosis
cacggucgccgcgccgccggug

SEQ ID NO: 2816709 - RNA, 19 nt, Mycobacterium avium subsp. paratuberculosis
cacggucgcggugucggcg

SEQ ID NO: 2816710 - RNA, 14 nt, Mycobacterium avium subsp. paratuberculosis
cacggucggagccc

SEQ ID NO: 2816711 - RNA, 12 nt, Mycobacterium avium subsp. paratuberculosis
cacggucggccc

SEQ ID NO: 2816712 - RNA, 17 nt, Mycobacterium avium subsp. paratuberculosis
cacggucggccccgcgc

SEQ ID NO: 2816713 - RNA, 14 nt, Mycobacterium avium subsp. paratuberculosis
cacggucggcgucc

SEQ ID NO: 2816714 - RNA, 18 nt, Mycobacterium avium subsp. paratuberculosis
cacggucggcguccagcg

SEQ ID NO: 2816715 - RNA, 20 nt, Mycobacterium avium subsp. paratuberculosis
cacggucggcguccagcgcg

SEQ ID NO: 2816716 - RNA, 16 nt, Mycobacterium avium subsp. paratuberculosis
cacggugaacgggccg

SEQ ID NO: 2816717 - RNA, 22 nt, Mycobacterium avium subsp. paratuberculosis
cacggugaacuccgggcccacc

SEQ ID NO: 2816718 - RNA, 13 nt, Mycobacterium avium subsp. paratuberculosis
cacggugaucagc

SEQ ID NO: 2816719 - RNA, 16 nt, Mycobacterium avium subsp. paratuberculosis
cacggugaucagcagc

SEQ ID NO: 2816720 - RNA, 19 nt, Mycobacterium avium subsp. paratuberculosis
cacggugaucucgccgagc

SEQ ID NO: 2816721 - RNA, 20 nt, Mycobacterium avium subsp. paratuberculosis
cacggugaucucgccgagca

SEQ ID NO: 2816722 - RNA, 15 nt, Mycobacterium avium subsp. paratuberculosis
cacggugcagcagcg

SEQ ID NO: 2816723 - RNA, 18 nt, Mycobacterium avium subsp. paratuberculosis
cacggugcagcagcgccg

SEQ ID NO: 2816724 - RNA, 22 nt, Mycobacterium avium subsp. paratuberculosis
cacggugcagcagcgccgcgac

SEQ ID NO: 2816725 - RNA, 23 nt, Mycobacterium avium subsp. paratuberculosis
cacggugcagcagcgccgcgacg

SEQ ID NO: 2816726 - RNA, 17 nt, Mycobacterium avium subsp. paratuberculosis
cacggugcccgucggca

SEQ ID NO: 2816727 - RNA, 18 nt, Mycobacterium avium subsp. paratuberculosis
cacggugcccgucggcaa

SEQ ID NO: 2816728 - RNA, 22 nt, Mycobacterium avium subsp. paratuberculosis
cacggugccgaguucgaccucg

SEQ ID NO: 2816729 - RNA, 23 nt, Mycobacterium avium subsp. paratuberculosis
cacggugccgaguucgaccucgg

SEQ ID NO: 2816730 - RNA, 15 nt, Mycobacterium avium subsp. paratuberculosis
cacggugccgccguc

SEQ ID NO: 2816731 - RNA, 13 nt, Mycobacterium avium subsp. paratuberculosis
cacggugcgccgg

SEQ ID NO: 2816732 - RNA, 22 nt, Mycobacterium avium subsp. paratuberculosis
cacgucgacacgccggccguuc

SEQ ID NO: 2816733 - RNA, 23 nt, Mycobacterium avium subsp. paratuberculosis
cacgucgacgcccugccacagcg

SEQ ID NO: 2816734 - RNA, 13 nt, Mycobacterium avium subsp. paratuberculosis
cacgucgacgccg

SEQ ID NO: 2816735 - RNA, 14 nt, Mycobacterium avium subsp. paratuberculosis
cacgucgacgccgg

SEQ ID NO: 2816736 - RNA, 20 nt, Mycobacterium avium subsp. paratuberculosis
cacgucgacgccggucucga

SEQ ID NO: 2816737 - RNA, 13 nt, Mycobacterium avium subsp. paratuberculosis
cacgucgacggcc

SEQ ID NO: 2816738 - RNA, 14 nt, Mycobacterium avium subsp. paratuberculosis
cacgucgacggccg

SEQ ID NO: 2816739 - RNA, 20 nt, Mycobacterium avium subsp. paratuberculosis
cacgucgacggccgccgcga

SEQ ID NO: 2816740 - RNA, 15 nt, Mycobacterium avium subsp. paratuberculosis
cacgucgagcggccc

SEQ ID NO: 2816741 - RNA, 20 nt, Mycobacterium avium subsp. paratuberculosis
cacgucgagcggcccgucgc

SEQ ID NO: 2816742 - RNA, 13 nt, Mycobacterium avium subsp. paratuberculosis
cacgucgagcucc

SEQ ID NO: 2816743 - RNA, 19 nt, Mycobacterium avium subsp. paratuberculosis
cacgucgagcuccucggcc

SEQ ID NO: 2816744 - RNA, 17 nt, Mycobacterium avium subsp. paratuberculosis
cacgucgaggucggacg

SEQ ID NO: 2816745 - RNA, 18 nt, Mycobacterium avium subsp. paratuberculosis
cacgucgaggucggacgc

SEQ ID NO: 2816746 - RNA, 18 nt, Mycobacterium avium subsp. paratuberculosis
cacgucgaucacgccgcc

SEQ ID NO: 2816747 - RNA, 13 nt, Mycobacterium avium subsp. paratuberculosis
cacgucgccgccg

SEQ ID NO: 2816748 - RNA, 16 nt, Mycobacterium avium subsp. paratuberculosis
cacgucgccggcgacc

SEQ ID NO: 2816749 - RNA, 22 nt, Mycobacterium avium subsp. paratuberculosis
cacgucgccggcgaccgccacc

SEQ ID NO: 2816750 - RNA, 14 nt, Mycobacterium avium subsp. paratuberculosis
cacgucgcgccgau

SEQ ID NO: 2816751 - RNA, 16 nt, Mycobacterium avium subsp. paratuberculosis
cacgucgcggcccugg

SEQ ID NO: 2816752 - RNA, 16 nt, Mycobacterium avium subsp. paratuberculosis
cacgucggccacgccg

SEQ ID NO: 2816753 - RNA, 14 nt, Mycobacterium avium subsp. paratuberculosis
cacgucggccagcg

SEQ ID NO: 2816754 - RNA, 16 nt, Mycobacterium avium subsp. paratuberculosis
cacgucggccagcgcg

SEQ ID NO: 2816755 - RNA, 14 nt, Mycobacterium avium subsp. paratuberculosis
cacgucggccagga

SEQ ID NO: 2816756 - RNA, 13 nt, Mycobacterium avium subsp. paratuberculosis
cacgucggccugc

SEQ ID NO: 2816757 - RNA, 17 nt, Mycobacterium avium subsp. paratuberculosis
cacgucggccugcacga

SEQ ID NO: 2816758 - RNA, 13 nt, Mycobacterium avium subsp. paratuberculosis
cacgucggcgaug

SEQ ID NO: 2816759 - RNA, 13 nt, Mycobacterium avium subsp. paratuberculosis
cacgucggcgcgc

SEQ ID NO: 2816760 - RNA, 14 nt, Mycobacterium avium subsp. paratuberculosis
cacgucggcgcgca

SEQ ID NO: 2816761 - RNA, 13 nt, Mycobacterium avium subsp. paratuberculosis
cacgucggcggcc

SEQ ID NO: 2816762 - RNA, 14 nt, Mycobacterium avium subsp. paratuberculosis
cacgucggcggccg

SEQ ID NO: 2816763 - RNA, 22 nt, Mycobacterium avium subsp. paratuberculosis
cacgucggcggccgcgaaggcg

SEQ ID NO: 2816764 - RNA, 20 nt, Mycobacterium avium subsp. paratuberculosis
cacgucggggaugucgucgg

SEQ ID NO: 2816765 - RNA, 17 nt, Mycobacterium avium subsp. paratuberculosis
cacgucggggccggugg

SEQ ID NO: 2816766 - RNA, 19 nt, Mycobacterium avium subsp. paratuberculosis
cacgucgggguggccggcc

SEQ ID NO: 2816767 - RNA, 18 nt, Mycobacterium avium subsp. paratuberculosis
cacgucggucagcgagcg

SEQ ID NO: 2816768 - RNA, 13 nt, Mycobacterium avium subsp. paratuberculosis
cacgucggugacg

SEQ ID NO: 2816769 - RNA, 16 nt, Mycobacterium avium subsp. paratuberculosis
cacgucggugacgccc

SEQ ID NO: 2816770 - RNA, 13 nt, Mycobacterium avium subsp. paratuberculosis
cacgucguaggcc

SEQ ID NO: 2816771 - RNA, 14 nt, Mycobacterium avium subsp. paratuberculosis
cacgucguaggcca

SEQ ID NO: 2816772 - RNA, 16 nt, Mycobacterium avium subsp. paratuberculosis
cacgucguaggccauc

SEQ ID NO: 2816773 - RNA, 17 nt, Mycobacterium avium subsp. paratuberculosis
cacgucguccggcgcgc

SEQ ID NO: 2816774 - RNA, 20 nt, Mycobacterium avium subsp. paratuberculosis
cacgucguccggcgcgcagc

SEQ ID NO: 2816775 - RNA, 21 nt, Mycobacterium avium subsp. paratuberculosis
cacgucguccggcgcgcagca

SEQ ID NO: 2816776 - RNA, 20 nt, Mycobacterium avium subsp. paratuberculosis
cacgucgucggacagcagca

SEQ ID NO: 2816777 - RNA, 23 nt, Mycobacterium avium subsp. paratuberculosis
cacgucgucggacagcagcaccg

SEQ ID NO: 2816778 - RNA, 20 nt, Mycobacterium avium subsp. paratuberculosis
cacgucguucaugaucggca

SEQ ID NO: 2816779 - RNA, 14 nt, Mycobacterium avium subsp. paratuberculosis
cacgucguugagca

SEQ ID NO: 2816780 - RNA, 22 nt, Mycobacterium avium subsp. paratuberculosis
cacgucguugagcacacccagc

SEQ ID NO: 2816781 - RNA, 15 nt, Mycobacterium avium subsp. paratuberculosis
cacgucugcucggcg

SEQ ID NO: 2816782 - RNA, 18 nt, Mycobacterium avium subsp. paratuberculosis
cacgucugcucggcgggu

SEQ ID NO: 2816783 - RNA, 16 nt, Mycobacterium avium subsp. paratuberculosis
cacgucuugcugggug

SEQ ID NO: 2816784 - RNA, 17 nt, Mycobacterium avium subsp. paratuberculosis
cacgucuugcugggugg

SEQ ID NO: 2816785 - RNA, 17 nt, Mycobacterium avium subsp. paratuberculosis
cacgugaugagcgagga

SEQ ID NO: 2816786 - RNA, 22 nt, Mycobacterium avium subsp. paratuberculosis
cacgugaugagcgaggacgucg

SEQ ID NO: 2816787 - RNA, 23 nt, Mycobacterium avium subsp. paratuberculosis
cacgugaugagcgaggacgucga

SEQ ID NO: 2816788 - RNA, 21 nt, Mycobacterium avium subsp. paratuberculosis
cacgugcacccacgccagccg

SEQ ID NO: 2816789 - RNA, 13 nt, Mycobacterium avium subsp. paratuberculosis
cacgugcaccgcg

SEQ ID NO: 2816790 - RNA, 16 nt, Mycobacterium avium subsp. paratuberculosis
cacgugcaccgcggcc

SEQ ID NO: 2816791 - RNA, 17 nt, Mycobacterium avium subsp. paratuberculosis
cacgugcaccgcggcca

SEQ ID NO: 2816792 - RNA, 16 nt, Mycobacterium avium subsp. paratuberculosis
cacgugcagcucggug

SEQ ID NO: 2816793 - RNA, 17 nt, Mycobacterium avium subsp. paratuberculosis
cacgugcagcucggugc

SEQ ID NO: 2816794 - RNA, 13 nt, Mycobacterium avium subsp. paratuberculosis
cacgugcaucugc

SEQ ID NO: 2816795 - RNA, 15 nt, Mycobacterium avium subsp. paratuberculosis
cacgugccacuggcg

SEQ ID NO: 2816796 - RNA, 15 nt, Mycobacterium avium subsp. paratuberculosis
cacgugcccagcccg

SEQ ID NO: 2816797 - RNA, 18 nt, Mycobacterium avium subsp. paratuberculosis
cacgugcccagcccgcgc

SEQ ID NO: 2816798 - RNA, 14 nt, Mycobacterium avium subsp. paratuberculosis
cacgugccccuccu

SEQ ID NO: 2816799 - RNA, 16 nt, Mycobacterium avium subsp. paratuberculosis
cacgugcccgccgugc

SEQ ID NO: 2816800 - RNA, 22 nt, Mycobacterium avium subsp. paratuberculosis
cacgugcccgccgugcgccccg

SEQ ID NO: 2816801 - RNA, 15 nt, Mycobacterium avium subsp. paratuberculosis
cacgugcgcgccgac

SEQ ID NO: 2816802 - RNA, 13 nt, Mycobacterium avium subsp. paratuberculosis
cacgugcgcggcg

SEQ ID NO: 2816803 - RNA, 15 nt, Mycobacterium avium subsp. paratuberculosis
cacgugcgcggcguc

SEQ ID NO: 2816804 - RNA, 20 nt, Mycobacterium avium subsp. paratuberculosis
cacgugcgcggcguccacca

SEQ ID NO: 2816805 - RNA, 14 nt, Mycobacterium avium subsp. paratuberculosis
cacgugcgcgggaa

SEQ ID NO: 2816806 - RNA, 21 nt, Mycobacterium avium subsp. paratuberculosis
cacgugcgcguuggucaucac

SEQ ID NO: 2816807 - RNA, 20 nt, Mycobacterium avium subsp. paratuberculosis
cacgugcggauggccccggc

SEQ ID NO: 2816808 - RNA, 22 nt, Mycobacterium avium subsp. paratuberculosis
cacgugcggauggccccggcga

SEQ ID NO: 2816809 - RNA, 19 nt, Mycobacterium avium subsp. paratuberculosis
cacgugcggcgcccuuccc

SEQ ID NO: 2816810 - RNA, 23 nt, Mycobacterium avium subsp. paratuberculosis
cacgugcggcugcgcguucggcg

SEQ ID NO: 2816811 - RNA, 19 nt, Mycobacterium avium subsp. paratuberculosis
cacgugcggguuggcgccg

SEQ ID NO: 2816812 - RNA, 14 nt, Mycobacterium avium subsp. paratuberculosis
cacgugcuggcgcu

SEQ ID NO: 2816813 - RNA, 17 nt, Mycobacterium avium subsp. paratuberculosis
cacguggaccgagcgcg

SEQ ID NO: 2816814 - RNA, 19 nt, Mycobacterium avium subsp. paratuberculosis
cacguggaccgagcgcgcg

SEQ ID NO: 2816815 - RNA, 20 nt, Mycobacterium avium subsp. paratuberculosis
cacguggaccgagcgcgcga

SEQ ID NO: 2816816 - RNA, 13 nt, Mycobacterium avium subsp. paratuberculosis
cacguggccgauc

SEQ ID NO: 2816817 - RNA, 14 nt, Mycobacterium avium subsp. paratuberculosis
cacucuggcgugac

SEQ ID NO: 2816818 - RNA, 16 nt, Mycobacterium avium subsp. paratuberculosis
cacucuggcgugacgc

SEQ ID NO: 2816819 - RNA, 19 nt, Mycobacterium avium subsp. paratuberculosis
cacucuggcgugacgcucg

SEQ ID NO: 2816820 - RNA, 18 nt, Mycobacterium avium subsp. paratuberculosis
cacugaaagccgaggcgc

SEQ ID NO: 2816821 - RNA, 22 nt, Mycobacterium avium subsp. paratuberculosis
cacugaaagccgaggcgcaaca

SEQ ID NO: 2816822 - RNA, 19 nt, Mycobacterium avium subsp. paratuberculosis
cacugaaggcgcgggcagg

SEQ ID NO: 2816823 - RNA, 19 nt, Mycobacterium avium subsp. paratuberculosis
cacugcaacuacgcacccg

SEQ ID NO: 2816824 - RNA, 18 nt, Mycobacterium avium subsp. paratuberculosis
cacugcacggccucgguc

SEQ ID NO: 2816825 - RNA, 19 nt, Mycobacterium avium subsp. paratuberculosis
cacugcacggccucgguca

SEQ ID NO: 2816826 - RNA, 17 nt, Mycobacterium avium subsp. paratuberculosis
cacugccaagacguccg

SEQ ID NO: 2816827 - RNA, 19 nt, Mycobacterium avium subsp. paratuberculosis
cacugccaagacguccgcg

SEQ ID NO: 2816828 - RNA, 16 nt, Mycobacterium avium subsp. paratuberculosis
cacugccccggcgaac

SEQ ID NO: 2816829 - RNA, 17 nt, Mycobacterium avium subsp. paratuberculosis
cacugccccggcgaacg

SEQ ID NO: 2816830 - RNA, 22 nt, Mycobacterium avium subsp. paratuberculosis
cacugccccggcgaacgccucg

SEQ ID NO: 2816831 - RNA, 13 nt, Mycobacterium avium subsp. paratuberculosis
cacugcccguagu

SEQ ID NO: 2816832 - RNA, 18 nt, Mycobacterium avium subsp. paratuberculosis
cacugcccguagucggcg

SEQ ID NO: 2816833 - RNA, 22 nt, Mycobacterium avium subsp. paratuberculosis
cacugcccguagucggcggcga

SEQ ID NO: 2816834 - RNA, 15 nt, Mycobacterium avium subsp. paratuberculosis
cacugccgccgccca

SEQ ID NO: 2816835 - RNA, 12 nt, Mycobacterium avium subsp. paratuberculosis
cacugccgguca

SEQ ID NO: 2816836 - RNA, 17 nt, Mycobacterium avium subsp. paratuberculosis
cacugccggucaagcgc

SEQ ID NO: 2816837 - RNA, 20 nt, Mycobacterium avium subsp. paratuberculosis
cacugccugacccggccgug

SEQ ID NO: 2816838 - RNA, 14 nt, Mycobacterium avium subsp. paratuberculosis
cacugcugcgcaga

SEQ ID NO: 2816839 - RNA, 21 nt, Mycobacterium avium subsp. paratuberculosis
cacugcuucgggucgccgguc

SEQ ID NO: 2816840 - RNA, 19 nt, Mycobacterium avium subsp. paratuberculosis
cacuggcgccaccuccgac

SEQ ID NO: 2816841 - RNA, 13 nt, Mycobacterium avium subsp. paratuberculosis
cacuggcggccgg

SEQ ID NO: 2816842 - RNA, 14 nt, Mycobacterium avium subsp. paratuberculosis
cacuggcggccggc

SEQ ID NO: 2816843 - RNA, 17 nt, Mycobacterium avium subsp. paratuberculosis
cacuggcggccggccgc

SEQ ID NO: 2816844 - RNA, 21 nt, Mycobacterium avium subsp. paratuberculosis
cacuggcggccggccgcgccc

SEQ ID NO: 2816845 - RNA, 16 nt, Mycobacterium avium subsp. paratuberculosis
cacuggcgugacgcuc

SEQ ID NO: 2816846 - RNA, 18 nt, Mycobacterium avium subsp. paratuberculosis
cacuggcgugacgcucgg

SEQ ID NO: 2816847 - RNA, 12 nt, Mycobacterium avium subsp. paratuberculosis
cacugggcgucg

SEQ ID NO: 2816848 - RNA, 15 nt, Mycobacterium avium subsp. paratuberculosis
cacugggcgucggcg

SEQ ID NO: 2816849 - RNA, 16 nt, Mycobacterium avium subsp. paratuberculosis
cacugguaaccgcccg

SEQ ID NO: 2816850 - RNA, 16 nt, Mycobacterium avium subsp. paratuberculosis
cacuggucgugcugga

SEQ ID NO: 2816851 - RNA, 19 nt, Mycobacterium avium subsp. paratuberculosis
cacuggucguugcacaccc

SEQ ID NO: 2816852 - RNA, 22 nt, Mycobacterium avium subsp. paratuberculosis
cacuggucguugcacacccggu

SEQ ID NO: 2816853 - RNA, 13 nt, Mycobacterium avium subsp. paratuberculosis
cacugucggcgcg

SEQ ID NO: 2816854 - RNA, 16 nt, Mycobacterium avium subsp. paratuberculosis
cacuuaacaccucgcc

SEQ ID NO: 2816855 - RNA, 14 nt, Mycobacterium avium subsp. paratuberculosis
cacuuccagcaccg

SEQ ID NO: 2816856 - RNA, 14 nt, Mycobacterium avium subsp. paratuberculosis
cacuuccgcgcagg

SEQ ID NO: 2816857 - RNA, 19 nt, Mycobacterium avium subsp. paratuberculosis
cacuucgacggcagcggca

SEQ ID NO: 2816858 - RNA, 24 nt, Mycobacterium avium subsp. paratuberculosis
cacuucgaucaucuccacccggca

SEQ ID NO: 2816859 - RNA, 12 nt, Mycobacterium avium subsp. paratuberculosis
cacuucgccggg

SEQ ID NO: 2816860 - RNA, 21 nt, Mycobacterium avium subsp. paratuberculosis
cacuucgcuguaguagccggg

SEQ ID NO: 2816861 - RNA, 17 nt, Mycobacterium avium subsp. paratuberculosis
cacuucuccacgccgac

SEQ ID NO: 2816862 - RNA, 19 nt, Mycobacterium avium subsp. paratuberculosis
cacuuggccucgggcgacg

SEQ ID NO: 2816863 - RNA, 12 nt, Mycobacterium avium subsp. paratuberculosis
cacuuucgcggc

SEQ ID NO: 2816864 - RNA, 23 nt, Mycobacterium avium subsp. paratuberculosis
cacuuuugacagguggggcacca

SEQ ID NO: 2816865 - RNA, 18 nt, Mycobacterium avium subsp. paratuberculosis
cagaaaauagcccagcca

SEQ ID NO: 2816866 - RNA, 14 nt, Mycobacterium avium subsp. paratuberculosis
cagaaacaccaucg

SEQ ID NO: 2816867 - RNA, 23 nt, Mycobacterium avium subsp. paratuberculosis
cagaaagcgauuggauuuaucuc

SEQ ID NO: 2816868 - RNA, 14 nt, Mycobacterium avium subsp. paratuberculosis
cagaacaccaccgc

SEQ ID NO: 2816869 - RNA, 16 nt, Mycobacterium avium subsp. paratuberculosis
cagaacaccacggugu

SEQ ID NO: 2816870 - RNA, 12 nt, Mycobacterium avium subsp. paratuberculosis
cagaacaccagc

SEQ ID NO: 2816871 - RNA, 14 nt, Mycobacterium avium subsp. paratuberculosis
cagaacaccagcgc

SEQ ID NO: 2816872 - RNA, 14 nt, Mycobacterium avium subsp. paratuberculosis
cagaacacgccccg

SEQ ID NO: 2816873 - RNA, 17 nt, Mycobacterium avium subsp. paratuberculosis
cagaacagccagucgaa

SEQ ID NO: 2816874 - RNA, 21 nt, Mycobacterium avium subsp. paratuberculosis
cagaacagccgguccgaccgc

SEQ ID NO: 2816875 - RNA, 19 nt, Mycobacterium avium subsp. paratuberculosis
cagaacaggugcggcaacc

SEQ ID NO: 2816876 - RNA, 17 nt, Mycobacterium avium subsp. paratuberculosis
cagaaccagcaccgccg

SEQ ID NO: 2816877 - RNA, 18 nt, Mycobacterium avium subsp. paratuberculosis
cagaaccauuugcccagc

SEQ ID NO: 2816878 - RNA, 20 nt, Mycobacterium avium subsp. paratuberculosis
cagaaccauuugcccagcag

SEQ ID NO: 2816879 - RNA, 22 nt, Mycobacterium avium subsp. paratuberculosis
cagaaccauuugcccagcaggg

SEQ ID NO: 2816880 - RNA, 23 nt, Mycobacterium avium subsp. paratuberculosis
cagaaccauuugcccagcagggc

SEQ ID NO: 2816881 - RNA, 15 nt, Mycobacterium avium subsp. paratuberculosis
cagaaccgcaccccg

SEQ ID NO: 2816882 - RNA, 22 nt, Mycobacterium avium subsp. paratuberculosis
cagaaccgcaccccgucgcgga

SEQ ID NO: 2816883 - RNA, 20 nt, Mycobacterium avium subsp. paratuberculosis
cagaaccgcucggcggcgcc

SEQ ID NO: 2816884 - RNA, 22 nt, Mycobacterium avium subsp. paratuberculosis
cagaaccgcucggcggcgccgu

SEQ ID NO: 2816885 - RNA, 23 nt, Mycobacterium avium subsp. paratuberculosis
cagaacgacgcgcucagccccag

SEQ ID NO: 2816886 - RNA, 23 nt, Mycobacterium avium subsp. paratuberculosis
cagaacgaguuucccgucgucga

SEQ ID NO: 2816887 - RNA, 16 nt, Mycobacterium avium subsp. paratuberculosis
cagaacggcggcagcg

SEQ ID NO: 2816888 - RNA, 19 nt, Mycobacterium avium subsp. paratuberculosis
cagaacggcggcagcgagg

SEQ ID NO: 2816889 - RNA, 20 nt, Mycobacterium avium subsp. paratuberculosis
cagaacggcggcagcgaggc

SEQ ID NO: 2816890 - RNA, 17 nt, Mycobacterium avium subsp. paratuberculosis
cagaacugggccgccgu

SEQ ID NO: 2816891 - RNA, 16 nt, Mycobacterium avium subsp. paratuberculosis
cagaacugguccucca

SEQ ID NO: 2816892 - RNA, 21 nt, Mycobacterium avium subsp. paratuberculosis
cagaagaucugccggugccgc

SEQ ID NO: 2816893 - RNA, 17 nt, Mycobacterium avium subsp. paratuberculosis
cagaagccccgguucca

SEQ ID NO: 2816894 - RNA, 18 nt, Mycobacterium avium subsp. paratuberculosis
cagaagcuaacgccagcu

SEQ ID NO: 2816895 - RNA, 21 nt, Mycobacterium avium subsp. paratuberculosis
cagaagcuccacgccgccggg

SEQ ID NO: 2816896 - RNA, 19 nt, Mycobacterium avium subsp. paratuberculosis
cagaaguaacccaccggga

SEQ ID NO: 2816897 - RNA, 15 nt, Mycobacterium avium subsp. paratuberculosis
cagaaucuucgccuc

SEQ ID NO: 2816898 - RNA, 15 nt, Mycobacterium avium subsp. paratuberculosis
cagaauucgccgggg

SEQ ID NO: 2816899 - RNA, 20 nt, Mycobacterium avium subsp. paratuberculosis
cagaauucgccggggcacca

SEQ ID NO: 2816900 - RNA, 14 nt, Mycobacterium avium subsp. paratuberculosis
cagacacagcacgc

SEQ ID NO: 2816901 - RNA, 23 nt, Mycobacterium avium subsp. paratuberculosis
cagacucacggcggcagcgcggc

SEQ ID NO: 2816902 - RNA, 13 nt, Mycobacterium avium subsp. paratuberculosis
cagacucagcccg

SEQ ID NO: 2816903 - RNA, 14 nt, Mycobacterium avium subsp. paratuberculosis
cagacugaugaagc

SEQ ID NO: 2816904 - RNA, 22 nt, Mycobacterium avium subsp. paratuberculosis
cagacugaugaagccgccgacg

SEQ ID NO: 2816905 - RNA, 17 nt, Mycobacterium avium subsp. paratuberculosis
cagacugaugcccucgc

SEQ ID NO: 2816906 - RNA, 12 nt, Mycobacterium avium subsp. paratuberculosis
cagacugccgag

SEQ ID NO: 2816907 - RNA, 17 nt, Mycobacterium avium subsp. paratuberculosis
cagacugcgcaccgcca

SEQ ID NO: 2816908 - RNA, 20 nt, Mycobacterium avium subsp. paratuberculosis
cagacugcgcaccgccagca

SEQ ID NO: 2816909 - RNA, 23 nt, Mycobacterium avium subsp. paratuberculosis
cagacugcgcaccgccagcaccg

SEQ ID NO: 2816910 - RNA, 17 nt, Mycobacterium avium subsp. paratuberculosis
cagacuugggcagcagg

SEQ ID NO: 2816911 - RNA, 13 nt, Mycobacterium avium subsp. paratuberculosis
cagagcagcgccu

SEQ ID NO: 2816912 - RNA, 16 nt, Mycobacterium avium subsp. paratuberculosis
cagagcagcgccugcu

SEQ ID NO: 2816913 - RNA, 21 nt, Mycobacterium avium subsp. paratuberculosis
cagagcccgaacacgggcggc

SEQ ID NO: 2816914 - RNA, 22 nt, Mycobacterium avium subsp. paratuberculosis
cagagcccgaacacgggcggca

SEQ ID NO: 2816915 - RNA, 17 nt, Mycobacterium avium subsp. paratuberculosis
cagagcgaugggcgcga

SEQ ID NO: 2816916 - RNA, 21 nt, Mycobacterium avium subsp. paratuberculosis
cagagcgcgaaaaccagcacc

SEQ ID NO: 2816917 - RNA, 22 nt, Mycobacterium avium subsp. paratuberculosis
cagagcgcgaaaaccagcaccg

SEQ ID NO: 2816918 - RNA, 20 nt, Mycobacterium avium subsp. paratuberculosis
cagagcgggaucccgcagcc

SEQ ID NO: 2816919 - RNA, 19 nt, Mycobacterium avium subsp. paratuberculosis
cagagcggugacaucgcca

SEQ ID NO: 2816920 - RNA, 20 nt, Mycobacterium avium subsp. paratuberculosis
cagagcggugacaucgccac

SEQ ID NO: 2816921 - RNA, 22 nt, Mycobacterium avium subsp. paratuberculosis
cagaggcguuuucggugugccg

SEQ ID NO: 2816922 - RNA, 23 nt, Mycobacterium avium subsp. paratuberculosis
cagauacgccgcgacgaugucga

SEQ ID NO: 2816923 - RNA, 16 nt, Mycobacterium avium subsp. paratuberculosis
cagauagaugagccgc

SEQ ID NO: 2816924 - RNA, 16 nt, Mycobacterium avium subsp. paratuberculosis
cagauaggacccggcg

SEQ ID NO: 2816925 - RNA, 17 nt, Mycobacterium avium subsp. paratuberculosis
cagauaggacccggcga

SEQ ID NO: 2816926 - RNA, 15 nt, Mycobacterium avium subsp. paratuberculosis
cagauaggccagcgc

SEQ ID NO: 2816927 - RNA, 19 nt, Mycobacterium avium subsp. paratuberculosis
cagauagguggucucccag

SEQ ID NO: 2816928 - RNA, 20 nt, Mycobacterium avium subsp. paratuberculosis
cagauagguggucucccaga

SEQ ID NO: 2816929 - RNA, 16 nt, Mycobacterium avium subsp. paratuberculosis
cagaucaccacggugg

SEQ ID NO: 2816930 - RNA, 20 nt, Mycobacterium avium subsp. paratuberculosis
cagaucaccacgguggccgc

SEQ ID NO: 2816931 - RNA, 22 nt, Mycobacterium avium subsp. paratuberculosis
cagaucacguugauccgaugca

SEQ ID NO: 2816932 - RNA, 15 nt, Mycobacterium avium subsp. paratuberculosis
cagaucagggcgaug

SEQ ID NO: 2816933 - RNA, 14 nt, Mycobacterium avium subsp. paratuberculosis
cagauccagaugcc

SEQ ID NO: 2816934 - RNA, 14 nt, Mycobacterium avium subsp. paratuberculosis
cagaucccgcagcu

SEQ ID NO: 2816935 - RNA, 18 nt, Mycobacterium avium subsp. paratuberculosis
cagauccgcucgccgucg

SEQ ID NO: 2816936 - RNA, 20 nt, Mycobacterium avium subsp. paratuberculosis
cagauccucgaauccgcggg

SEQ ID NO: 2816937 - RNA, 19 nt, Mycobacterium avium subsp. paratuberculosis
cagaucgacccccaccgcg

SEQ ID NO: 2816938 - RNA, 20 nt, Mycobacterium avium subsp. paratuberculosis
cagaucgacccccaccgcga

SEQ ID NO: 2816939 - RNA, 23 nt, Mycobacterium avium subsp. paratuberculosis
cagaucgacccccaccgcgacac

SEQ ID NO: 2816940 - RNA, 19 nt, Mycobacterium avium subsp. paratuberculosis
cagaucgacgccgaccgcg

SEQ ID NO: 2816941 - RNA, 22 nt, Mycobacterium avium subsp. paratuberculosis
cagaucgacgccgaccgcgguc

SEQ ID NO: 2816942 - RNA, 15 nt, Mycobacterium avium subsp. paratuberculosis
cagaucgacgccgcg

SEQ ID NO: 2816943 - RNA, 17 nt, Mycobacterium avium subsp. paratuberculosis
cagaucgacgccgcggu

SEQ ID NO: 2816944 - RNA, 23 nt, Mycobacterium avium subsp. paratuberculosis
cagaucgacgccgcgguggccgg

SEQ ID NO: 2816945 - RNA, 15 nt, Mycobacterium avium subsp. paratuberculosis
cagaucgagcugggc

SEQ ID NO: 2816946 - RNA, 13 nt, Mycobacterium avium subsp. paratuberculosis
cagaucgccagca

SEQ ID NO: 2816947 - RNA, 16 nt, Mycobacterium avium subsp. paratuberculosis
cagaucgccagcaccg

SEQ ID NO: 2816948 - RNA, 17 nt, Mycobacterium avium subsp. paratuberculosis
cagaucgccagcaccgg

SEQ ID NO: 2816949 - RNA, 19 nt, Mycobacterium avium subsp. paratuberculosis
cagaucgccagcaccggcg

SEQ ID NO: 2816950 - RNA, 17 nt, Mycobacterium avium subsp. paratuberculosis
cagaucgcccaucaccg

SEQ ID NO: 2816951 - RNA, 16 nt, Mycobacterium avium subsp. paratuberculosis
cagaucgcccgggcgg

SEQ ID NO: 2816952 - RNA, 17 nt, Mycobacterium avium subsp. paratuberculosis
cagaucgcccgggcggc

SEQ ID NO: 2816953 - RNA, 21 nt, Mycobacterium avium subsp. paratuberculosis
cagaucgcccgggcggcgggg

SEQ ID NO: 2816954 - RNA, 20 nt, Mycobacterium avium subsp. paratuberculosis
cagaucgccgcccaucggca

SEQ ID NO: 2816955 - RNA, 22 nt, Mycobacterium avium subsp. paratuberculosis
cagaucgccgcccaucggcagc

SEQ ID NO: 2816956 - RNA, 17 nt, Mycobacterium avium subsp. paratuberculosis
cagaucgcgcaucaccc

SEQ ID NO: 2816957 - RNA, 13 nt, Mycobacterium avium subsp. paratuberculosis
cagaucgcggccc

SEQ ID NO: 2816958 - RNA, 18 nt, Mycobacterium avium subsp. paratuberculosis
cagaucgcggcccgccgc

SEQ ID NO: 2816959 - RNA, 19 nt, Mycobacterium avium subsp. paratuberculosis
cagaucgcggcccgccgcu

SEQ ID NO: 2816960 - RNA, 20 nt, Mycobacterium avium subsp. paratuberculosis
cagaucgcggcccgccgcuc

SEQ ID NO: 2816961 - RNA, 21 nt, Mycobacterium avium subsp. paratuberculosis
cagaucgcggcccgccgcuca

SEQ ID NO: 2816962 - RNA, 18 nt, Mycobacterium avium subsp. paratuberculosis
cagaucgcgguccaccag

SEQ ID NO: 2816963 - RNA, 19 nt, Mycobacterium avium subsp. paratuberculosis
cagaucgcgguccaccaga

SEQ ID NO: 2816964 - RNA, 22 nt, Mycobacterium avium subsp. paratuberculosis
cagaucgcugaugcgcaacagc

SEQ ID NO: 2816965 - RNA, 13 nt, Mycobacterium avium subsp. paratuberculosis
cagaucggccagc

SEQ ID NO: 2816966 - RNA, 16 nt, Mycobacterium avium subsp. paratuberculosis
cagaucggccagccac

SEQ ID NO: 2816967 - RNA, 20 nt, Mycobacterium avium subsp. paratuberculosis
cagaucggccagccacgccg

SEQ ID NO: 2816968 - RNA, 16 nt, Mycobacterium avium subsp. paratuberculosis
cagaucggccagcgcg

SEQ ID NO: 2816969 - RNA, 17 nt, Mycobacterium avium subsp. paratuberculosis
cagaucggccagcgcgg

SEQ ID NO: 2816970 - RNA, 19 nt, Mycobacterium avium subsp. paratuberculosis
cagaucggccagcgcggcc

SEQ ID NO: 2816971 - RNA, 21 nt, Mycobacterium avium subsp. paratuberculosis
cagaucggccagcgcggccgg

SEQ ID NO: 2816972 - RNA, 23 nt, Mycobacterium avium subsp. paratuberculosis
cagaucggccagguugucgucgg

SEQ ID NO: 2816973 - RNA, 15 nt, Mycobacterium avium subsp. paratuberculosis
cagaucggcgcgcgg

SEQ ID NO: 2816974 - RNA, 15 nt, Mycobacterium avium subsp. paratuberculosis
cagaucggcgggugc

SEQ ID NO: 2816975 - RNA, 22 nt, Mycobacterium avium subsp. paratuberculosis
cagaucggcgggugcgggcgcu

SEQ ID NO: 2816976 - RNA, 21 nt, Mycobacterium avium subsp. paratuberculosis
cagaucggcgucacugcccag

SEQ ID NO: 2816977 - RNA, 16 nt, Mycobacterium avium subsp. paratuberculosis
cagaucgggucgcccg

SEQ ID NO: 2816978 - RNA, 19 nt, Mycobacterium avium subsp. paratuberculosis
cagaucguagggcucggcg

SEQ ID NO: 2816979 - RNA, 21 nt, Mycobacterium avium subsp. paratuberculosis
cagaucguagggcucggcguc

SEQ ID NO: 2816980 - RNA, 22 nt, Mycobacterium avium subsp. paratuberculosis
cagaucguagggcucggcgucg

SEQ ID NO: 2816981 - RNA, 17 nt, Mycobacterium avium subsp. paratuberculosis
cagaucgucggcacugc

SEQ ID NO: 2816982 - RNA, 15 nt, Mycobacterium avium subsp. paratuberculosis
cagaucgucgggcac

SEQ ID NO: 2816983 - RNA, 13 nt, Mycobacterium avium subsp. paratuberculosis
cagaucguguccg

SEQ ID NO: 2816984 - RNA, 15 nt, Mycobacterium avium subsp. paratuberculosis
cagaucguguccgcg

SEQ ID NO: 2816985 - RNA, 16 nt, Mycobacterium avium subsp. paratuberculosis
cagcacauccagcccu

SEQ ID NO: 2816986 - RNA, 22 nt, Mycobacterium avium subsp. paratuberculosis
cagcacauccgguugcaccgcg

SEQ ID NO: 2816987 - RNA, 17 nt, Mycobacterium avium subsp. paratuberculosis
cagcaccaacagcggcc

SEQ ID NO: 2816988 - RNA, 22 nt, Mycobacterium avium subsp. paratuberculosis
cagcaccaacagcggcccgauc

SEQ ID NO: 2816989 - RNA, 13 nt, Mycobacterium avium subsp. paratuberculosis
cagcaccacaucg

SEQ ID NO: 2816990 - RNA, 16 nt, Mycobacterium avium subsp. paratuberculosis
cagcaccaccaacagc

SEQ ID NO: 2816991 - RNA, 22 nt, Mycobacterium avium subsp. paratuberculosis
cagcaccaccaacggcucgccg

SEQ ID NO: 2816992 - RNA, 13 nt, Mycobacterium avium subsp. paratuberculosis
cagcaccaccacg

SEQ ID NO: 2816993 - RNA, 16 nt, Mycobacterium avium subsp. paratuberculosis
cagcaccaccacgcug

SEQ ID NO: 2816994 - RNA, 14 nt, Mycobacterium avium subsp. paratuberculosis
cagcaccaccacgu

SEQ ID NO: 2816995 - RNA, 15 nt, Mycobacterium avium subsp. paratuberculosis
cagcaccaccagguc

SEQ ID NO: 2816996 - RNA, 23 nt, Mycobacterium avium subsp. paratuberculosis
cagcaccaccaggucuccgucgg

SEQ ID NO: 2816997 - RNA, 12 nt, Mycobacterium avium subsp. paratuberculosis
cagcaccaccgc

SEQ ID NO: 2816998 - RNA, 16 nt, Mycobacterium avium subsp. paratuberculosis
cagcaccaccgucacc

SEQ ID NO: 2816999 - RNA, 13 nt, Mycobacterium avium subsp. paratuberculosis
cagcaccaccgug

SEQ ID NO: 2817000 - RNA, 20 nt, Mycobacterium avium subsp. paratuberculosis
cagcaccaccguggcgaugg

SEQ ID NO: 2817001 - RNA, 12 nt, Mycobacterium avium subsp. paratuberculosis
cagcaccaccuc

SEQ ID NO: 2817002 - RNA, 16 nt, Mycobacterium avium subsp. paratuberculosis
cagcaccaccucgcgc

SEQ ID NO: 2817003 - RNA, 17 nt, Mycobacterium avium subsp. paratuberculosis
cagcaccaccucgugca

SEQ ID NO: 2817004 - RNA, 12 nt, Mycobacterium avium subsp. paratuberculosis
cagcaccaccuu

SEQ ID NO: 2817005 - RNA, 14 nt, Mycobacterium avium subsp. paratuberculosis
cagcaccaccuugu

SEQ ID NO: 2817006 - RNA, 16 nt, Mycobacterium avium subsp. paratuberculosis
cagcaccacggugauc

SEQ ID NO: 2817007 - RNA, 14 nt, Mycobacterium avium subsp. paratuberculosis
cagcaccacguccg

SEQ ID NO: 2817008 - RNA, 22 nt, Mycobacterium avium subsp. paratuberculosis
cagcaccacguccgcggugagc

SEQ ID NO: 2817009 - RNA, 12 nt, Mycobacterium avium subsp. paratuberculosis
cagcaccacguu

SEQ ID NO: 2817010 - RNA, 15 nt, Mycobacterium avium subsp. paratuberculosis
cagcaccacguugcg

SEQ ID NO: 2817011 - RNA, 20 nt, Mycobacterium avium subsp. paratuberculosis
cagcaccacuuccagcaccg

SEQ ID NO: 2817012 - RNA, 22 nt, Mycobacterium avium subsp. paratuberculosis
cagcaccagaugcaccucgccc

SEQ ID NO: 2817013 - RNA, 12 nt, Mycobacterium avium subsp. paratuberculosis
cagcaccagcac

SEQ ID NO: 2817014 - RNA, 16 nt, Mycobacterium avium subsp. paratuberculosis
cagcaccagcaccacc

SEQ ID NO: 2817015 - RNA, 18 nt, Mycobacterium avium subsp. paratuberculosis
cagcaccagcacggcgac

SEQ ID NO: 2817016 - RNA, 19 nt, Mycobacterium avium subsp. paratuberculosis
cagcaccagcacggcgacc

SEQ ID NO: 2817017 - RNA, 13 nt, Mycobacterium avium subsp. paratuberculosis
cagcaccagcagc

SEQ ID NO: 2817018 - RNA, 15 nt, Mycobacterium avium subsp. paratuberculosis
cagcaccagcagccg

SEQ ID NO: 2817019 - RNA, 16 nt, Mycobacterium avium subsp. paratuberculosis
cagcaccagcagccgg

SEQ ID NO: 2817020 - RNA, 19 nt, Mycobacterium avium subsp. paratuberculosis
cagcaccagcagccggucg

SEQ ID NO: 2817021 - RNA, 20 nt, Mycobacterium avium subsp. paratuberculosis
cagcaccagcagccggucga

SEQ ID NO: 2817022 - RNA, 13 nt, Mycobacterium avium subsp. paratuberculosis
cagcaccagcccg

SEQ ID NO: 2817023 - RNA, 14 nt, Mycobacterium avium subsp. paratuberculosis
cagcaccagcccga

SEQ ID NO: 2817024 - RNA, 15 nt, Mycobacterium avium subsp. paratuberculosis
cagcaccagcccgau

SEQ ID NO: 2817025 - RNA, 20 nt, Mycobacterium avium subsp. paratuberculosis
cagcaccagcccgaugccgc

SEQ ID NO: 2817026 - RNA, 13 nt, Mycobacterium avium subsp. paratuberculosis
cagcaccagcgcc

SEQ ID NO: 2817027 - RNA, 14 nt, Mycobacterium avium subsp. paratuberculosis
cagcaccagcgccg

SEQ ID NO: 2817028 - RNA, 15 nt, Mycobacterium avium subsp. paratuberculosis
cagcaccagcgcgcg

SEQ ID NO: 2817029 - RNA, 16 nt, Mycobacterium avium subsp. paratuberculosis
cagcaccagcgcgcgg

SEQ ID NO: 2817030 - RNA, 23 nt, Mycobacterium avium subsp. paratuberculosis
cagcaccagcggcaccagguacc

SEQ ID NO: 2817031 - RNA, 14 nt, Mycobacterium avium subsp. paratuberculosis
cagcaccagcgugg

SEQ ID NO: 2817032 - RNA, 19 nt, Mycobacterium avium subsp. paratuberculosis
cagcaccagcguggccggc

SEQ ID NO: 2817033 - RNA, 13 nt, Mycobacterium avium subsp. paratuberculosis
cagcaccagcuca

SEQ ID NO: 2817034 - RNA, 23 nt, Mycobacterium avium subsp. paratuberculosis
cagcaccaggaaggcgaccgcgu

SEQ ID NO: 2817035 - RNA, 17 nt, Mycobacterium avium subsp. paratuberculosis
cagcaccaggcccuccu

SEQ ID NO: 2817036 - RNA, 22 nt, Mycobacterium avium subsp. paratuberculosis
cagcaccaggcccucgccgcgg

SEQ ID NO: 2817037 - RNA, 14 nt, Mycobacterium avium subsp. paratuberculosis
cagcaccaggcuga

SEQ ID NO: 2817038 - RNA, 16 nt, Mycobacterium avium subsp. paratuberculosis
cagcaccaggcugacc

SEQ ID NO: 2817039 - RNA, 22 nt, Mycobacterium avium subsp. paratuberculosis
cagcaccaggcugaccagcgcc

SEQ ID NO: 2817040 - RNA, 16 nt, Mycobacterium avium subsp. paratuberculosis
cagcaccagggucuuc

SEQ ID NO: 2817041 - RNA, 19 nt, Mycobacterium avium subsp. paratuberculosis
cagcaccagguggcccgac

SEQ ID NO: 2817042 - RNA, 21 nt, Mycobacterium avium subsp. paratuberculosis
cagcaccagguugucgccgcg

SEQ ID NO: 2817043 - RNA, 13 nt, Mycobacterium avium subsp. paratuberculosis
cagcaccaguucg

SEQ ID NO: 2817044 - RNA, 20 nt, Mycobacterium avium subsp. paratuberculosis
cagcaccauccgcgcgagcg

SEQ ID NO: 2817045 - RNA, 18 nt, Mycobacterium avium subsp. paratuberculosis
cagcaccaugaucaggcc

SEQ ID NO: 2817046 - RNA, 13 nt, Mycobacterium avium subsp. paratuberculosis
cagcaccauggcg

SEQ ID NO: 2817047 - RNA, 14 nt, Mycobacterium avium subsp. paratuberculosis
cagcacccagcaca

SEQ ID NO: 2817048 - RNA, 19 nt, Mycobacterium avium subsp. paratuberculosis
cagcacccagcacagcgag

SEQ ID NO: 2817049 - RNA, 21 nt, Mycobacterium avium subsp. paratuberculosis
cagcacccagcacagcgaggc

SEQ ID NO: 2817050 - RNA, 18 nt, Mycobacterium avium subsp. paratuberculosis
cagcacccaggugcugcc

SEQ ID NO: 2817051 - RNA, 17 nt, Mycobacterium avium subsp. paratuberculosis
cagcacccccucggcgc

SEQ ID NO: 2817052 - RNA, 18 nt, Mycobacterium avium subsp. paratuberculosis
cagcacccccucggcgcc

SEQ ID NO: 2817053 - RNA, 16 nt, Mycobacterium avium subsp. paratuberculosis
cagcaccccgaucgcg

SEQ ID NO: 2817054 - RNA, 23 nt, Mycobacterium avium subsp. paratuberculosis
cagcaccccgccgcagcccaggc

SEQ ID NO: 2817055 - RNA, 20 nt, Mycobacterium avium subsp. paratuberculosis
cagcaccccgguccaggcga

SEQ ID NO: 2817056 - RNA, 22 nt, Mycobacterium avium subsp. paratuberculosis
cagcaccccgguccaggcgacc

SEQ ID NO: 2817057 - RNA, 14 nt, Mycobacterium avium subsp. paratuberculosis
cagcaccccgucga

SEQ ID NO: 2817058 - RNA, 15 nt, Mycobacterium avium subsp. paratuberculosis
cagcaccccgucgag

SEQ ID NO: 2817059 - RNA, 16 nt, Mycobacterium avium subsp. paratuberculosis
cagcaccccgucgagg

SEQ ID NO: 2817060 - RNA, 18 nt, Mycobacterium avium subsp. paratuberculosis
cagcaccccgucgagguu

SEQ ID NO: 2817061 - RNA, 16 nt, Mycobacterium avium subsp. paratuberculosis
cagcacccgcaccgug

SEQ ID NO: 2817062 - RNA, 13 nt, Mycobacterium avium subsp. paratuberculosis
cagcacccgcagc

SEQ ID NO: 2817063 - RNA, 18 nt, Mycobacterium avium subsp. paratuberculosis
cagcacccgcagccgcga

SEQ ID NO: 2817064 - RNA, 23 nt, Mycobacterium avium subsp. paratuberculosis
cagcacccgcaucaacugcacca

SEQ ID NO: 2817065 - RNA, 18 nt, Mycobacterium avium subsp. paratuberculosis
cagcacccgcucgcgggc

SEQ ID NO: 2817066 - RNA, 15 nt, Mycobacterium avium subsp. paratuberculosis
cagcacccgcugauc

SEQ ID NO: 2817067 - RNA, 19 nt, Mycobacterium avium subsp. paratuberculosis
cagcacccgcugcagccgg

SEQ ID NO: 2817068 - RNA, 18 nt, Mycobacterium avium subsp. paratuberculosis
cagcacccggcccacgcc

SEQ ID NO: 2817069 - RNA, 20 nt, Mycobacterium avium subsp. paratuberculosis
cagcacccggcccacgccgu

SEQ ID NO: 2817070 - RNA, 18 nt, Mycobacterium avium subsp. paratuberculosis
cagcaccggcgcgccgcg

SEQ ID NO: 2817071 - RNA, 19 nt, Mycobacterium avium subsp. paratuberculosis
cagcaccggcgcgccgcgu

SEQ ID NO: 2817072 - RNA, 17 nt, Mycobacterium avium subsp. paratuberculosis
cagcaccggcgucgaca

SEQ ID NO: 2817073 - RNA, 18 nt, Mycobacterium avium subsp. paratuberculosis
cagcaccggcgucgacag

SEQ ID NO: 2817074 - RNA, 19 nt, Mycobacterium avium subsp. paratuberculosis
cagcaccggcgucgacagc

SEQ ID NO: 2817075 - RNA, 13 nt, Mycobacterium avium subsp. paratuberculosis
cagcaccggcgug

SEQ ID NO: 2817076 - RNA, 14 nt, Mycobacterium avium subsp. paratuberculosis
cagcaccggcgugg

SEQ ID NO: 2817077 - RNA, 11 nt, Mycobacterium avium subsp. paratuberculosis
cagcaccggcu

SEQ ID NO: 2817078 - RNA, 14 nt, Mycobacterium avium subsp. paratuberculosis
cagcaccggcuggu

SEQ ID NO: 2817079 - RNA, 17 nt, Mycobacterium avium subsp. paratuberculosis
cagcaccggcuggucgg

SEQ ID NO: 2817080 - RNA, 13 nt, Mycobacterium avium subsp. paratuberculosis
cagcaccggggcc

SEQ ID NO: 2817081 - RNA, 14 nt, Mycobacterium avium subsp. paratuberculosis
cagcaccggggcca

SEQ ID NO: 2817082 - RNA, 21 nt, Mycobacterium avium subsp. paratuberculosis
cagcaccgggugauaccggcc

SEQ ID NO: 2817083 - RNA, 22 nt, Mycobacterium avium subsp. paratuberculosis
cagcaccgggugauaccggccc

SEQ ID NO: 2817084 - RNA, 18 nt, Mycobacterium avium subsp. paratuberculosis
cagcaccgucaccgccuc

SEQ ID NO: 2817085 - RNA, 16 nt, Mycobacterium avium subsp. paratuberculosis
cagcaccgucagccag

SEQ ID NO: 2817086 - RNA, 16 nt, Mycobacterium avium subsp. paratuberculosis
cagcaccguccgcaga

SEQ ID NO: 2817087 - RNA, 14 nt, Mycobacterium avium subsp. paratuberculosis
cagcaccgucggcg

SEQ ID NO: 2817088 - RNA, 15 nt, Mycobacterium avium subsp. paratuberculosis
cagcaccgucggcgu

SEQ ID NO: 2817089 - RNA, 16 nt, Mycobacterium avium subsp. paratuberculosis
cagcaccgucggcgug

SEQ ID NO: 2817090 - RNA, 17 nt, Mycobacterium avium subsp. paratuberculosis
cagcaccgucggcgugu

SEQ ID NO: 2817091 - RNA, 20 nt, Mycobacterium avium subsp. paratuberculosis
cagcaccgucugcgccguca

SEQ ID NO: 2817092 - RNA, 15 nt, Mycobacterium avium subsp. paratuberculosis
cagcaccgugcugau

SEQ ID NO: 2817093 - RNA, 23 nt, Mycobacterium avium subsp. paratuberculosis
cagcaccgugcugauccacgccc

SEQ ID NO: 2817094 - RNA, 17 nt, Mycobacterium avium subsp. paratuberculosis
cagcaccgugggcccgu

SEQ ID NO: 2817095 - RNA, 20 nt, Mycobacterium avium subsp. paratuberculosis
cagcaccgugggcccgugcg

SEQ ID NO: 2817096 - RNA, 17 nt, Mycobacterium avium subsp. paratuberculosis
cagcaccuccgacagcc

SEQ ID NO: 2817097 - RNA, 19 nt, Mycobacterium avium subsp. paratuberculosis
cagcaccuccgacagcccc

SEQ ID NO: 2817098 - RNA, 20 nt, Mycobacterium avium subsp. paratuberculosis
cagcaccuccgacagccccc

SEQ ID NO: 2817099 - RNA, 22 nt, Mycobacterium avium subsp. paratuberculosis
cagcaccuccgacagcccccgc

SEQ ID NO: 2817100 - RNA, 16 nt, Mycobacterium avium subsp. paratuberculosis
cagcaccuccugggug

SEQ ID NO: 2817101 - RNA, 13 nt, Mycobacterium avium subsp. paratuberculosis
cagcaccucgcgc

SEQ ID NO: 2817102 - RNA, 16 nt, Mycobacterium avium subsp. paratuberculosis
cagcaccucgcgcagc

SEQ ID NO: 2817103 - RNA, 19 nt, Mycobacterium avium subsp. paratuberculosis
cagcaccucgcgcagcacc

SEQ ID NO: 2817104 - RNA, 20 nt, Mycobacterium avium subsp. paratuberculosis
cagcaccucgcgcagcaccg

SEQ ID NO: 2817105 - RNA, 21 nt, Mycobacterium avium subsp. paratuberculosis
cagcaccucgcgcagcaccga

SEQ ID NO: 2817106 - RNA, 15 nt, Mycobacterium avium subsp. paratuberculosis
cagcaccucgcgcgc

SEQ ID NO: 2817107 - RNA, 16 nt, Mycobacterium avium subsp. paratuberculosis
cagcaccucgcgcgcg

SEQ ID NO: 2817108 - RNA, 14 nt, Mycobacterium avium subsp. paratuberculosis
cagcaccucggcga

SEQ ID NO: 2817109 - RNA, 15 nt, Mycobacterium avium subsp. paratuberculosis
cagcaccucggcgac

SEQ ID NO: 2817110 - RNA, 17 nt, Mycobacterium avium subsp. paratuberculosis
cagcaccucggcgacca

SEQ ID NO: 2817111 - RNA, 19 nt, Mycobacterium avium subsp. paratuberculosis
cagcaccucggcgaccacg

SEQ ID NO: 2817112 - RNA, 20 nt, Mycobacterium avium subsp. paratuberculosis
cagcaccucggcgaccacgu

SEQ ID NO: 2817113 - RNA, 19 nt, Mycobacterium avium subsp. paratuberculosis
cagcaccucgucgcccggc

SEQ ID NO: 2817114 - RNA, 22 nt, Mycobacterium avium subsp. paratuberculosis
cagcaccucgucgcccggcguc

SEQ ID NO: 2817115 - RNA, 17 nt, Mycobacterium avium subsp. paratuberculosis
cagcaccugaccgucgg

SEQ ID NO: 2817116 - RNA, 20 nt, Mycobacterium avium subsp. paratuberculosis
cagcaccugaccgucggcca

SEQ ID NO: 2817117 - RNA, 21 nt, Mycobacterium avium subsp. paratuberculosis
cagcaccugaccgucggccag

SEQ ID NO: 2817118 - RNA, 22 nt, Mycobacterium avium subsp. paratuberculosis
cagcaccugcucgaugcgcgcc

SEQ ID NO: 2817119 - RNA, 13 nt, Mycobacterium avium subsp. paratuberculosis
cagcaccuggcgc

SEQ ID NO: 2817120 - RNA, 18 nt, Mycobacterium avium subsp. paratuberculosis
cagcaccuggcgcaccgc

SEQ ID NO: 2817121 - RNA, 19 nt, Mycobacterium avium subsp. paratuberculosis
cagcaccuggcgcaccgcc

SEQ ID NO: 2817122 - RNA, 20 nt, Mycobacterium avium subsp. paratuberculosis
cagcaccuggcgcaccgccg

SEQ ID NO: 2817123 - RNA, 22 nt, Mycobacterium avium subsp. paratuberculosis
cagcaccuggcgcaccgccgcg

SEQ ID NO: 2817124 - RNA, 17 nt, Mycobacterium avium subsp. paratuberculosis
cagcaccuucagcgggc

SEQ ID NO: 2817125 - RNA, 22 nt, Mycobacterium avium subsp. paratuberculosis
cagcaccuucagcgggcgcagc

SEQ ID NO: 2817126 - RNA, 18 nt, Mycobacterium avium subsp. paratuberculosis
cagcaccuuccaucgacg

SEQ ID NO: 2817127 - RNA, 22 nt, Mycobacterium avium subsp. paratuberculosis
cagcaccuuccaucgacgcuga

SEQ ID NO: 2817128 - RNA, 14 nt, Mycobacterium avium subsp. paratuberculosis
cagcaccuucgggc

SEQ ID NO: 2817129 - RNA, 22 nt, Mycobacterium avium subsp. paratuberculosis
cagcaccuugcccaggugcaga

SEQ ID NO: 2817130 - RNA, 18 nt, Mycobacterium avium subsp. paratuberculosis
cagcaccuugccggucgg

SEQ ID NO: 2817131 - RNA, 20 nt, Mycobacterium avium subsp. paratuberculosis
cagcacgaacagcagcggga

SEQ ID NO: 2817132 - RNA, 17 nt, Mycobacterium avium subsp. paratuberculosis
cagcacgaaggccgccg

SEQ ID NO: 2817133 - RNA, 18 nt, Mycobacterium avium subsp. paratuberculosis
cagcacgaaggccgccgg

SEQ ID NO: 2817134 - RNA, 20 nt, Mycobacterium avium subsp. paratuberculosis
cagcacgaccccgcccacga

SEQ ID NO: 2817135 - RNA, 15 nt, Mycobacterium avium subsp. paratuberculosis
cagcacgacgccgcu

SEQ ID NO: 2817136 - RNA, 16 nt, Mycobacterium avium subsp. paratuberculosis
cagcacgacgccgcug

SEQ ID NO: 2817137 - RNA, 21 nt, Mycobacterium avium subsp. paratuberculosis
cagcacgacgccgcugggcgu

SEQ ID NO: 2817138 - RNA, 17 nt, Mycobacterium avium subsp. paratuberculosis
cagcacgaucgagccgg

SEQ ID NO: 2817139 - RNA, 20 nt, Mycobacterium avium subsp. paratuberculosis
cagcacgaucgagccggugg

SEQ ID NO: 2817140 - RNA, 16 nt, Mycobacterium avium subsp. paratuberculosis
cagcacgaugacgacc

SEQ ID NO: 2817141 - RNA, 18 nt, Mycobacterium avium subsp. paratuberculosis
cagcacgaugacgaccgg

SEQ ID NO: 2817142 - RNA, 19 nt, Mycobacterium avium subsp. paratuberculosis
cagcacgaugacgaccggg

SEQ ID NO: 2817143 - RNA, 21 nt, Mycobacterium avium subsp. paratuberculosis
cagcacgaugacgaccggguc

SEQ ID NO: 2817144 - RNA, 14 nt, Mycobacterium avium subsp. paratuberculosis
cagcacgcaggcgu

SEQ ID NO: 2817145 - RNA, 18 nt, Mycobacterium avium subsp. paratuberculosis
cagcacgcaggcguggcc

SEQ ID NO: 2817146 - RNA, 14 nt, Mycobacterium avium subsp. paratuberculosis
cagcacgcccagcc

SEQ ID NO: 2817147 - RNA, 15 nt, Mycobacterium avium subsp. paratuberculosis
cagcacgcccagccc

SEQ ID NO: 2817148 - RNA, 16 nt, Mycobacterium avium subsp. paratuberculosis
cagcacgcccagcccg

SEQ ID NO: 2817149 - RNA, 21 nt, Mycobacterium avium subsp. paratuberculosis
cagcacgcccagcccgcgggc

SEQ ID NO: 2817150 - RNA, 14 nt, Mycobacterium avium subsp. paratuberculosis
cagcacgcccugga

SEQ ID NO: 2817151 - RNA, 12 nt, Mycobacterium avium subsp. paratuberculosis
cagcacgccgcg

SEQ ID NO: 2817152 - RNA, 18 nt, Mycobacterium avium subsp. paratuberculosis
cagcacgccgcggaaggc

SEQ ID NO: 2817153 - RNA, 23 nt, Mycobacterium avium subsp. paratuberculosis
cagcacgccgcggaaggccagcu

SEQ ID NO: 2817154 - RNA, 16 nt, Mycobacterium avium subsp. paratuberculosis
cagcagaugccgccca

SEQ ID NO: 2817155 - RNA, 21 nt, Mycobacterium avium subsp. paratuberculosis
cagcagaugccgcccaggugc

SEQ ID NO: 2817156 - RNA, 11 nt, Mycobacterium avium subsp. paratuberculosis
cagcagaugcg

SEQ ID NO: 2817157 - RNA, 21 nt, Mycobacterium avium subsp. paratuberculosis
cagcagaugcgcgucgcggcg

SEQ ID NO: 2817158 - RNA, 22 nt, Mycobacterium avium subsp. paratuberculosis
cagcagaugcgcgucgcggcgc

SEQ ID NO: 2817159 - RNA, 15 nt, Mycobacterium avium subsp. paratuberculosis
cagcagaugcgugcg

SEQ ID NO: 2817160 - RNA, 14 nt, Mycobacterium avium subsp. paratuberculosis
cagcagcaacgcgg

SEQ ID NO: 2817161 - RNA, 17 nt, Mycobacterium avium subsp. paratuberculosis
cagcagcaacgcggugu

SEQ ID NO: 2817162 - RNA, 13 nt, Mycobacterium avium subsp. paratuberculosis
cagcagcaccagg

SEQ ID NO: 2817163 - RNA, 14 nt, Mycobacterium avium subsp. paratuberculosis
cagcagcaccaggc

SEQ ID NO: 2817164 - RNA, 20 nt, Mycobacterium avium subsp. paratuberculosis
cagcagcaccaggcugacca

SEQ ID NO: 2817165 - RNA, 22 nt, Mycobacterium avium subsp. paratuberculosis
cagcagcaccaggcugaccagc

SEQ ID NO: 2817166 - RNA, 13 nt, Mycobacterium avium subsp. paratuberculosis
cagcagcaccccg

SEQ ID NO: 2817167 - RNA, 14 nt, Mycobacterium avium subsp. paratuberculosis
cagcagcaccccga

SEQ ID NO: 2817168 - RNA, 13 nt, Mycobacterium avium subsp. paratuberculosis
cagcagcacccgg

SEQ ID NO: 2817169 - RNA, 14 nt, Mycobacterium avium subsp. paratuberculosis
cagcagcacccggg

SEQ ID NO: 2817170 - RNA, 19 nt, Mycobacterium avium subsp. paratuberculosis
cagcagcacccgggccugc

SEQ ID NO: 2817171 - RNA, 18 nt, Mycobacterium avium subsp. paratuberculosis
cagcagcacccgggugau

SEQ ID NO: 2817172 - RNA, 15 nt, Mycobacterium avium subsp. paratuberculosis
cagcagcacccgguc

SEQ ID NO: 2817173 - RNA, 17 nt, Mycobacterium avium subsp. paratuberculosis
cagcagcacccggucgc

SEQ ID NO: 2817174 - RNA, 19 nt, Mycobacterium avium subsp. paratuberculosis
cagcagcacccggucgccg

SEQ ID NO: 2817175 - RNA, 23 nt, Mycobacterium avium subsp. paratuberculosis
cagcagcacccggucgccggugu

SEQ ID NO: 2817176 - RNA, 11 nt, Mycobacterium avium subsp. paratuberculosis
cagcagcaccg

SEQ ID NO: 2817177 - RNA, 20 nt, Mycobacterium avium subsp. paratuberculosis
cagcagcaccgcauggggca

SEQ ID NO: 2817178 - RNA, 21 nt, Mycobacterium avium subsp. paratuberculosis
cagcagcaccgcauggggcag

SEQ ID NO: 2817179 - RNA, 13 nt, Mycobacterium avium subsp. paratuberculosis
cagcagcaccgcg

SEQ ID NO: 2817180 - RNA, 14 nt, Mycobacterium avium subsp. paratuberculosis
cagcagcaccgcga

SEQ ID NO: 2817181 - RNA, 16 nt, Mycobacterium avium subsp. paratuberculosis
cagcagcaccgcgacc

SEQ ID NO: 2817182 - RNA, 17 nt, Mycobacterium avium subsp. paratuberculosis
cagcagcaccgcgaccg

SEQ ID NO: 2817183 - RNA, 18 nt, Mycobacterium avium subsp. paratuberculosis
cagcagcaccgcgaccgg

SEQ ID NO: 2817184 - RNA, 14 nt, Mycobacterium avium subsp. paratuberculosis
cagcagcaccgcgu

SEQ ID NO: 2817185 - RNA, 13 nt, Mycobacterium avium subsp. paratuberculosis
cagcagcaccggc

SEQ ID NO: 2817186 - RNA, 16 nt, Mycobacterium avium subsp. paratuberculosis
cagcagcaccggcacc

SEQ ID NO: 2817187 - RNA, 21 nt, Mycobacterium avium subsp. paratuberculosis
cagcagcaccggcaccgcggc

SEQ ID NO: 2817188 - RNA, 15 nt, Mycobacterium avium subsp. paratuberculosis
cagcagcaccggcgc

SEQ ID NO: 2817189 - RNA, 12 nt, Mycobacterium avium subsp. paratuberculosis
cagcagcaccug

SEQ ID NO: 2817190 - RNA, 13 nt, Mycobacterium avium subsp. paratuberculosis
cagcagcaccuga

SEQ ID NO: 2817191 - RNA, 14 nt, Mycobacterium avium subsp. paratuberculosis
cagcagcaccugaa

SEQ ID NO: 2817192 - RNA, 16 nt, Mycobacterium avium subsp. paratuberculosis
cagcagcaccuggauc

SEQ ID NO: 2817193 - RNA, 17 nt, Mycobacterium avium subsp. paratuberculosis
cagcagcaccuggaucc

SEQ ID NO: 2817194 - RNA, 13 nt, Mycobacterium avium subsp. paratuberculosis
cagcagcacgccc

SEQ ID NO: 2817195 - RNA, 21 nt, Mycobacterium avium subsp. paratuberculosis
cagcagcacguugucgcccgg

SEQ ID NO: 2817196 - RNA, 19 nt, Mycobacterium avium subsp. paratuberculosis
cagcagcagaaccagcacc

SEQ ID NO: 2817197 - RNA, 14 nt, Mycobacterium avium subsp. paratuberculosis
cagcagcagcacca

SEQ ID NO: 2817198 - RNA, 15 nt, Mycobacterium avium subsp. paratuberculosis
cagcagcagcaccag

SEQ ID NO: 2817199 - RNA, 13 nt, Mycobacterium avium subsp. paratuberculosis
cagcagcagccac

SEQ ID NO: 2817200 - RNA, 14 nt, Mycobacterium avium subsp. paratuberculosis
cagcagcagccacg

SEQ ID NO: 2817201 - RNA, 14 nt, Mycobacterium avium subsp. paratuberculosis
cagcagcagcccgc

SEQ ID NO: 2817202 - RNA, 16 nt, Mycobacterium avium subsp. paratuberculosis
cagcagcagcccgccg

SEQ ID NO: 2817203 - RNA, 15 nt, Mycobacterium avium subsp. paratuberculosis
cagcagcagccgcgc

SEQ ID NO: 2817204 - RNA, 15 nt, Mycobacterium avium subsp. paratuberculosis
cagcagcagcgccgc

SEQ ID NO: 2817205 - RNA, 15 nt, Mycobacterium avium subsp. paratuberculosis
cagcagcagcgccuc

SEQ ID NO: 2817206 - RNA, 13 nt, Mycobacterium avium subsp. paratuberculosis
cagcagcagcgcg

SEQ ID NO: 2817207 - RNA, 14 nt, Mycobacterium avium subsp. paratuberculosis
cagcagcagcgcgc

SEQ ID NO: 2817208 - RNA, 16 nt, Mycobacterium avium subsp. paratuberculosis
cagcagcagcgcggca

SEQ ID NO: 2817209 - RNA, 13 nt, Mycobacterium avium subsp. paratuberculosis
cagcagcagcggc

SEQ ID NO: 2817210 - RNA, 16 nt, Mycobacterium avium subsp. paratuberculosis
cagcagcagcggcagc

SEQ ID NO: 2817211 - RNA, 14 nt, Mycobacterium avium subsp. paratuberculosis
cagcagcagcuccc

SEQ ID NO: 2817212 - RNA, 11 nt, Mycobacterium avium subsp. paratuberculosis
cagcagcaggu

SEQ ID NO: 2817213 - RNA, 13 nt, Mycobacterium avium subsp. paratuberculosis
cagcagcaggucg

SEQ ID NO: 2817214 - RNA, 17 nt, Mycobacterium avium subsp. paratuberculosis
cagcagcaggucggcca

SEQ ID NO: 2817215 - RNA, 17 nt, Mycobacterium avium subsp. paratuberculosis
cagcagccacgacacca

SEQ ID NO: 2817216 - RNA, 18 nt, Mycobacterium avium subsp. paratuberculosis
cagcagccacgacaccag

SEQ ID NO: 2817217 - RNA, 23 nt, Mycobacterium avium subsp. paratuberculosis
cagcagccagcccagccgccagc

SEQ ID NO: 2817218 - RNA, 12 nt, Mycobacterium avium subsp. paratuberculosis
cagcagccagcu

SEQ ID NO: 2817219 - RNA, 16 nt, Mycobacterium avium subsp. paratuberculosis
cagcagccaggacagc

SEQ ID NO: 2817220 - RNA, 17 nt, Mycobacterium avium subsp. paratuberculosis
cagcagccaggacagcg

SEQ ID NO: 2817221 - RNA, 20 nt, Mycobacterium avium subsp. paratuberculosis
cagcagccaggacagcguca

SEQ ID NO: 2817222 - RNA, 16 nt, Mycobacterium avium subsp. paratuberculosis
cagcagccccugcacc

SEQ ID NO: 2817223 - RNA, 13 nt, Mycobacterium avium subsp. paratuberculosis
cagcagcccgaac

SEQ ID NO: 2817224 - RNA, 21 nt, Mycobacterium avium subsp. paratuberculosis
cagcagcccgaacagccgggc

SEQ ID NO: 2817225 - RNA, 13 nt, Mycobacterium avium subsp. paratuberculosis
cagcagcccgauc

SEQ ID NO: 2817226 - RNA, 19 nt, Mycobacterium avium subsp. paratuberculosis
cagcagcccgaucaccccc

SEQ ID NO: 2817227 - RNA, 15 nt, Mycobacterium avium subsp. paratuberculosis
cagcagcccgccgau

SEQ ID NO: 2817228 - RNA, 16 nt, Mycobacterium avium subsp. paratuberculosis
cagcagcccggccagc

SEQ ID NO: 2817229 - RNA, 21 nt, Mycobacterium avium subsp. paratuberculosis
cagcagcccggccagccgggc

SEQ ID NO: 2817230 - RNA, 23 nt, Mycobacterium avium subsp. paratuberculosis
cagcagcccgggcugcagcagcg

SEQ ID NO: 2817231 - RNA, 15 nt, Mycobacterium avium subsp. paratuberculosis
cagcagcccgggucc

SEQ ID NO: 2817232 - RNA, 19 nt, Mycobacterium avium subsp. paratuberculosis
cagcagcccggguccuggc

SEQ ID NO: 2817233 - RNA, 18 nt, Mycobacterium avium subsp. paratuberculosis
cagcagcccgucccggcc

SEQ ID NO: 2817234 - RNA, 23 nt, Mycobacterium avium subsp. paratuberculosis
cagcagcccgucccggcccaugg

SEQ ID NO: 2817235 - RNA, 17 nt, Mycobacterium avium subsp. paratuberculosis
cagcagccgcaccucgg

SEQ ID NO: 2817236 - RNA, 18 nt, Mycobacterium avium subsp. paratuberculosis
cagcagccgcagcaguuc

SEQ ID NO: 2817237 - RNA, 13 nt, Mycobacterium avium subsp. paratuberculosis
cagcagccgccgg

SEQ ID NO: 2817238 - RNA, 17 nt, Mycobacterium avium subsp. paratuberculosis
cagcagccgccgggcca

SEQ ID NO: 2817239 - RNA, 14 nt, Mycobacterium avium subsp. paratuberculosis
cagcagccgcgcca

SEQ ID NO: 2817240 - RNA, 22 nt, Mycobacterium avium subsp. paratuberculosis
cagcagcuugacgucggucagc

SEQ ID NO: 2817241 - RNA, 23 nt, Mycobacterium avium subsp. paratuberculosis
cagcagcuuggcgaagucgcagu

SEQ ID NO: 2817242 - RNA, 18 nt, Mycobacterium avium subsp. paratuberculosis
cagcagcuugggggccga

SEQ ID NO: 2817243 - RNA, 22 nt, Mycobacterium avium subsp. paratuberculosis
cagcagcuugggggccgacgcu

SEQ ID NO: 2817244 - RNA, 16 nt, Mycobacterium avium subsp. paratuberculosis
cagcaggaccgggauc

SEQ ID NO: 2817245 - RNA, 20 nt, Mycobacterium avium subsp. paratuberculosis
cagcaggaccgggaucgaca

SEQ ID NO: 2817246 - RNA, 18 nt, Mycobacterium avium subsp. paratuberculosis
cagcaggacgcgcccggc

SEQ ID NO: 2817247 - RNA, 21 nt, Mycobacterium avium subsp. paratuberculosis
cagcaggaucuccggccggug

SEQ ID NO: 2817248 - RNA, 22 nt, Mycobacterium avium subsp. paratuberculosis
cagcaggaucuccggccgguga

SEQ ID NO: 2817249 - RNA, 23 nt, Mycobacterium avium subsp. paratuberculosis
cagcaggaucuccggccggugau

SEQ ID NO: 2817250 - RNA, 19 nt, Mycobacterium avium subsp. paratuberculosis
cagcaggaugaugaccgac

SEQ ID NO: 2817251 - RNA, 20 nt, Mycobacterium avium subsp. paratuberculosis
cagcaggaugaugaccgaca

SEQ ID NO: 2817252 - RNA, 14 nt, Mycobacterium avium subsp. paratuberculosis
cagcaggcccaggc

SEQ ID NO: 2817253 - RNA, 19 nt, Mycobacterium avium subsp. paratuberculosis
cagcaggcccaggccgaug

SEQ ID NO: 2817254 - RNA, 13 nt, Mycobacterium avium subsp. paratuberculosis
cagcaggccccgu

SEQ ID NO: 2817255 - RNA, 21 nt, Mycobacterium avium subsp. paratuberculosis
cagcaggcccucggccagcca

SEQ ID NO: 2817256 - RNA, 13 nt, Mycobacterium avium subsp. paratuberculosis
cagcaggcgccgc

SEQ ID NO: 2817257 - RNA, 13 nt, Mycobacterium avium subsp. paratuberculosis
cagcaggcgcgcc

SEQ ID NO: 2817258 - RNA, 14 nt, Mycobacterium avium subsp. paratuberculosis
cagcaggcgcgccg

SEQ ID NO: 2817259 - RNA, 16 nt, Mycobacterium avium subsp. paratuberculosis
cagcaggcgcgccgag

SEQ ID NO: 2817260 - RNA, 18 nt, Mycobacterium avium subsp. paratuberculosis
cagcaggcgcgccgagcg

SEQ ID NO: 2817261 - RNA, 18 nt, Mycobacterium avium subsp. paratuberculosis
cagcaggcggacggcgac

SEQ ID NO: 2817262 - RNA, 20 nt, Mycobacterium avium subsp. paratuberculosis
cagcaggcggacggcgaccu

SEQ ID NO: 2817263 - RNA, 14 nt, Mycobacterium avium subsp. paratuberculosis
cagcaggcuggcgg

SEQ ID NO: 2817264 - RNA, 15 nt, Mycobacterium avium subsp. paratuberculosis
cagcaggcuggcggc

SEQ ID NO: 2817265 - RNA, 17 nt, Mycobacterium avium subsp. paratuberculosis
cagcaggcuggcggcga

SEQ ID NO: 2817266 - RNA, 19 nt, Mycobacterium avium subsp. paratuberculosis
cagcaggcuggcggcgauc

SEQ ID NO: 2817267 - RNA, 20 nt, Mycobacterium avium subsp. paratuberculosis
cagcaggcuggcggcgauca

SEQ ID NO: 2817268 - RNA, 22 nt, Mycobacterium avium subsp. paratuberculosis
cagcaggcuguccugcgguucg

SEQ ID NO: 2817269 - RNA, 19 nt, Mycobacterium avium subsp. paratuberculosis
cagcagggcaccgacggcc

SEQ ID NO: 2817270 - RNA, 20 nt, Mycobacterium avium subsp. paratuberculosis
cagcagggcaccgacggccg

SEQ ID NO: 2817271 - RNA, 14 nt, Mycobacterium avium subsp. paratuberculosis
cagcagggcaucuc

SEQ ID NO: 2817272 - RNA, 19 nt, Mycobacterium avium subsp. paratuberculosis
cagcagggcaucucccgcg

SEQ ID NO: 2817273 - RNA, 20 nt, Mycobacterium avium subsp. paratuberculosis
cagcagggcaucucccgcgc

SEQ ID NO: 2817274 - RNA, 21 nt, Mycobacterium avium subsp. paratuberculosis
cagcagggcaucucccgcgcg

SEQ ID NO: 2817275 - RNA, 13 nt, Mycobacterium avium subsp. paratuberculosis
cagcagggccucg

SEQ ID NO: 2817276 - RNA, 12 nt, Mycobacterium avium subsp. paratuberculosis
cagcagggcgcc

SEQ ID NO: 2817277 - RNA, 13 nt, Mycobacterium avium subsp. paratuberculosis
cagcagggcgccg

SEQ ID NO: 2817278 - RNA, 14 nt, Mycobacterium avium subsp. paratuberculosis
cagcagggcgccga

SEQ ID NO: 2817279 - RNA, 15 nt, Mycobacterium avium subsp. paratuberculosis
cagcagggcgccgac

SEQ ID NO: 2817280 - RNA, 19 nt, Mycobacterium avium subsp. paratuberculosis
cagcagggcgccgacgauc

SEQ ID NO: 2817281 - RNA, 20 nt, Mycobacterium avium subsp. paratuberculosis
cagcagggcgccgacgaucc

SEQ ID NO: 2817282 - RNA, 14 nt, Mycobacterium avium subsp. paratuberculosis
cagcagggcgcgca

SEQ ID NO: 2817283 - RNA, 16 nt, Mycobacterium avium subsp. paratuberculosis
cagcagggcgcgcauc

SEQ ID NO: 2817284 - RNA, 19 nt, Mycobacterium avium subsp. paratuberculosis
cagcagggcgcgcaucugc

SEQ ID NO: 2817285 - RNA, 20 nt, Mycobacterium avium subsp. paratuberculosis
cagcagggcgcgcaucugcu

SEQ ID NO: 2817286 - RNA, 23 nt, Mycobacterium avium subsp. paratuberculosis
cagcagggcgcgcaucugcucgg

SEQ ID NO: 2817287 - RNA, 13 nt, Mycobacterium avium subsp. paratuberculosis
cagcagggcggca

SEQ ID NO: 2817288 - RNA, 16 nt, Mycobacterium avium subsp. paratuberculosis
cagcagggcggcaccg

SEQ ID NO: 2817289 - RNA, 22 nt, Mycobacterium avium subsp. paratuberculosis
cagcagggcggcaccgaucggc

SEQ ID NO: 2817290 - RNA, 22 nt, Mycobacterium avium subsp. paratuberculosis
cagcagggucagcgacaacggc

SEQ ID NO: 2817291 - RNA, 11 nt, Mycobacterium avium subsp. paratuberculosis
cagcagggucg

SEQ ID NO: 2817292 - RNA, 23 nt, Mycobacterium avium subsp. paratuberculosis
cagcagggucgagaucagcaccg

SEQ ID NO: 2817293 - RNA, 22 nt, Mycobacterium avium subsp. paratuberculosis
cagcagggugacgucguugacc

SEQ ID NO: 2817294 - RNA, 14 nt, Mycobacterium avium subsp. paratuberculosis
cagcagggugccgc

SEQ ID NO: 2817295 - RNA, 16 nt, Mycobacterium avium subsp. paratuberculosis
cagcagggugccgccg

SEQ ID NO: 2817296 - RNA, 19 nt, Mycobacterium avium subsp. paratuberculosis
cagcagggugccgccgccc

SEQ ID NO: 2817297 - RNA, 20 nt, Mycobacterium avium subsp. paratuberculosis
cagcagggugccgccgcccg

SEQ ID NO: 2817298 - RNA, 18 nt, Mycobacterium avium subsp. paratuberculosis
cagcagguaaaccagcag

SEQ ID NO: 2817299 - RNA, 22 nt, Mycobacterium avium subsp. paratuberculosis
cagcagguaaaccagcagcgcc

SEQ ID NO: 2817300 - RNA, 23 nt, Mycobacterium avium subsp. paratuberculosis
cagcagguaaaccagcagcgcca

SEQ ID NO: 2817301 - RNA, 18 nt, Mycobacterium avium subsp. paratuberculosis
cagcagguagaagccgcg

SEQ ID NO: 2817302 - RNA, 20 nt, Mycobacterium avium subsp. paratuberculosis
cagcagguagaagccgcgac

SEQ ID NO: 2817303 - RNA, 21 nt, Mycobacterium avium subsp. paratuberculosis
cagcagguagaagccgcgacg

SEQ ID NO: 2817304 - RNA, 22 nt, Mycobacterium avium subsp. paratuberculosis
cagcagguagaagccgcgacgg

SEQ ID NO: 2817305 - RNA, 15 nt, Mycobacterium avium subsp. paratuberculosis
cagcagguagaucgc

SEQ ID NO: 2817306 - RNA, 20 nt, Mycobacterium avium subsp. paratuberculosis
cagcagguagaucgccagcg

SEQ ID NO: 2817307 - RNA, 17 nt, Mycobacterium avium subsp. paratuberculosis
cagcagguagcggcuga

SEQ ID NO: 2817308 - RNA, 19 nt, Mycobacterium avium subsp. paratuberculosis
cagcagguagcggcugacc

SEQ ID NO: 2817309 - RNA, 19 nt, Mycobacterium avium subsp. paratuberculosis
cagcagguauuuggugacc

SEQ ID NO: 2817310 - RNA, 14 nt, Mycobacterium avium subsp. paratuberculosis
cagcagguccaugg

SEQ ID NO: 2817311 - RNA, 22 nt, Mycobacterium avium subsp. paratuberculosis
cagcagguccuguccggucucg

SEQ ID NO: 2817312 - RNA, 20 nt, Mycobacterium avium subsp. paratuberculosis
cagcaggucgaaggcggccg

SEQ ID NO: 2817313 - RNA, 21 nt, Mycobacterium avium subsp. paratuberculosis
cagcaggucgaaggcggccgc

SEQ ID NO: 2817314 - RNA, 22 nt, Mycobacterium avium subsp. paratuberculosis
cagcaggucgagcaugcguccg

SEQ ID NO: 2817315 - RNA, 14 nt, Mycobacterium avium subsp. paratuberculosis
cagcaggucgaucu

SEQ ID NO: 2817316 - RNA, 17 nt, Mycobacterium avium subsp. paratuberculosis
cagcaggucgaucugcg

SEQ ID NO: 2817317 - RNA, 20 nt, Mycobacterium avium subsp. paratuberculosis
cagcaggucgaucugcggca

SEQ ID NO: 2817318 - RNA, 22 nt, Mycobacterium avium subsp. paratuberculosis
cagcaggucgaucugcggcacg

SEQ ID NO: 2817319 - RNA, 16 nt, Mycobacterium avium subsp. paratuberculosis
cagcaggucggccagc

SEQ ID NO: 2817320 - RNA, 20 nt, Mycobacterium avium subsp. paratuberculosis
cagcaggucggccagcugcg

SEQ ID NO: 2817321 - RNA, 13 nt, Mycobacterium avium subsp. paratuberculosis
cagcaggucggcg

SEQ ID NO: 2817322 - RNA, 14 nt, Mycobacterium avium subsp. paratuberculosis
cagcaggucggcgu

SEQ ID NO: 2817323 - RNA, 17 nt, Mycobacterium avium subsp. paratuberculosis
cagcaggucggcgugcu

SEQ ID NO: 2817324 - RNA, 22 nt, Mycobacterium avium subsp. paratuberculosis
cagccaccacaucgcuggggug

SEQ ID NO: 2817325 - RNA, 13 nt, Mycobacterium avium subsp. paratuberculosis
cagccacccgucg

SEQ ID NO: 2817326 - RNA, 12 nt, Mycobacterium avium subsp. paratuberculosis
cagccaccgccc

SEQ ID NO: 2817327 - RNA, 13 nt, Mycobacterium avium subsp. paratuberculosis
cagccaccgcccg

SEQ ID NO: 2817328 - RNA, 13 nt, Mycobacterium avium subsp. paratuberculosis
cagccaccgugcc

SEQ ID NO: 2817329 - RNA, 22 nt, Mycobacterium avium subsp. paratuberculosis
cagccaccgugccuuacgccgg

SEQ ID NO: 2817330 - RNA, 23 nt, Mycobacterium avium subsp. paratuberculosis
cagccaccgugccuuacgccggg

SEQ ID NO: 2817331 - RNA, 20 nt, Mycobacterium avium subsp. paratuberculosis
cagccacgacaccagcgucg

SEQ ID NO: 2817332 - RNA, 18 nt, Mycobacterium avium subsp. paratuberculosis
cagccacgagcccagccg

SEQ ID NO: 2817333 - RNA, 22 nt, Mycobacterium avium subsp. paratuberculosis
cagccacgagcccagccgucgc

SEQ ID NO: 2817334 - RNA, 14 nt, Mycobacterium avium subsp. paratuberculosis
cagccacgccagcc

SEQ ID NO: 2817335 - RNA, 20 nt, Mycobacterium avium subsp. paratuberculosis
cagccacgccagccaggcga

SEQ ID NO: 2817336 - RNA, 14 nt, Mycobacterium avium subsp. paratuberculosis
cagccacgccgaca

SEQ ID NO: 2817337 - RNA, 20 nt, Mycobacterium avium subsp. paratuberculosis
cagccacgccgacaccgucg

SEQ ID NO: 2817338 - RNA, 12 nt, Mycobacterium avium subsp. paratuberculosis
cagccacgccgg

SEQ ID NO: 2817339 - RNA, 18 nt, Mycobacterium avium subsp. paratuberculosis
cagccacgcgcaaccauc

SEQ ID NO: 2817340 - RNA, 12 nt, Mycobacterium avium subsp. paratuberculosis
cagccacggcag

SEQ ID NO: 2817341 - RNA, 15 nt, Mycobacterium avium subsp. paratuberculosis
cagccacggcagcug

SEQ ID NO: 2817342 - RNA, 19 nt, Mycobacterium avium subsp. paratuberculosis
cagccacgguccuuggcgu

SEQ ID NO: 2817343 - RNA, 14 nt, Mycobacterium avium subsp. paratuberculosis
cagccacucgccgu

SEQ ID NO: 2817344 - RNA, 18 nt, Mycobacterium avium subsp. paratuberculosis
cagccagaacacgccccg

SEQ ID NO: 2817345 - RNA, 19 nt, Mycobacterium avium subsp. paratuberculosis
cagccagaacacgccccgg

SEQ ID NO: 2817346 - RNA, 12 nt, Mycobacterium avium subsp. paratuberculosis
cagccagaccuc

SEQ ID NO: 2817347 - RNA, 18 nt, Mycobacterium avium subsp. paratuberculosis
cagccagaccucgccgac

SEQ ID NO: 2817348 - RNA, 19 nt, Mycobacterium avium subsp. paratuberculosis
cagccagaccucgccgacg

SEQ ID NO: 2817349 - RNA, 20 nt, Mycobacterium avium subsp. paratuberculosis
cagccagaucgaggccagcg

SEQ ID NO: 2817350 - RNA, 21 nt, Mycobacterium avium subsp. paratuberculosis
cagccagaucgaggccagcgc

SEQ ID NO: 2817351 - RNA, 13 nt, Mycobacterium avium subsp. paratuberculosis
cagccagcccagc

SEQ ID NO: 2817352 - RNA, 13 nt, Mycobacterium avium subsp. paratuberculosis
cagccagcccgcg

SEQ ID NO: 2817353 - RNA, 20 nt, Mycobacterium avium subsp. paratuberculosis
cagccagccgcccagcaucg

SEQ ID NO: 2817354 - RNA, 13 nt, Mycobacterium avium subsp. paratuberculosis
cagccagccgcgc

SEQ ID NO: 2817355 - RNA, 14 nt, Mycobacterium avium subsp. paratuberculosis
cagccagccgcgcc

SEQ ID NO: 2817356 - RNA, 15 nt, Mycobacterium avium subsp. paratuberculosis
cagccagccgcgccg

SEQ ID NO: 2817357 - RNA, 15 nt, Mycobacterium avium subsp. paratuberculosis
cagccagccggugcg

SEQ ID NO: 2817358 - RNA, 14 nt, Mycobacterium avium subsp. paratuberculosis
cagccagccggugg

SEQ ID NO: 2817359 - RNA, 15 nt, Mycobacterium avium subsp. paratuberculosis
cagccagccgguggc

SEQ ID NO: 2817360 - RNA, 22 nt, Mycobacterium avium subsp. paratuberculosis
cagccagccuggcggcgacccg

SEQ ID NO: 2817361 - RNA, 17 nt, Mycobacterium avium subsp. paratuberculosis
cagccagcgacaacgug

SEQ ID NO: 2817362 - RNA, 20 nt, Mycobacterium avium subsp. paratuberculosis
cagccagcgacaacguggug

SEQ ID NO: 2817363 - RNA, 16 nt, Mycobacterium avium subsp. paratuberculosis
cagccagcgcccggcg

SEQ ID NO: 2817364 - RNA, 17 nt, Mycobacterium avium subsp. paratuberculosis
cagccagcgcccggcga

SEQ ID NO: 2817365 - RNA, 18 nt, Mycobacterium avium subsp. paratuberculosis
cagccagcgcccggcgac

SEQ ID NO: 2817366 - RNA, 12 nt, Mycobacterium avium subsp. paratuberculosis
cagccagcgcgc

SEQ ID NO: 2817367 - RNA, 13 nt, Mycobacterium avium subsp. paratuberculosis
cagccagcgcgcg

SEQ ID NO: 2817368 - RNA, 16 nt, Mycobacterium avium subsp. paratuberculosis
cagccagcgcgcgauc

SEQ ID NO: 2817369 - RNA, 13 nt, Mycobacterium avium subsp. paratuberculosis
cagccagcgguca

SEQ ID NO: 2817370 - RNA, 24 nt, Mycobacterium avium subsp. paratuberculosis
cagccagcggucacggacaggugu

SEQ ID NO: 2817371 - RNA, 12 nt, Mycobacterium avium subsp. paratuberculosis
cagccagcucgg

SEQ ID NO: 2817372 - RNA, 16 nt, Mycobacterium avium subsp. paratuberculosis
cagccagcuggugaag

SEQ ID NO: 2817373 - RNA, 22 nt, Mycobacterium avium subsp. paratuberculosis
cagccagcuggugaagcugccg

SEQ ID NO: 2817374 - RNA, 23 nt, Mycobacterium avium subsp. paratuberculosis
cagccagcuggugaagcugccga

SEQ ID NO: 2817375 - RNA, 14 nt, Mycobacterium avium subsp. paratuberculosis
cagccaggacagcg

SEQ ID NO: 2817376 - RNA, 15 nt, Mycobacterium avium subsp. paratuberculosis
cagccaggacagcgu

SEQ ID NO: 2817377 - RNA, 23 nt, Mycobacterium avium subsp. paratuberculosis
cagccaggacuccuugggagacu

SEQ ID NO: 2817378 - RNA, 14 nt, Mycobacterium avium subsp. paratuberculosis
cagccaggccgccg

SEQ ID NO: 2817379 - RNA, 16 nt, Mycobacterium avium subsp. paratuberculosis
cagccaggccgccggg

SEQ ID NO: 2817380 - RNA, 19 nt, Mycobacterium avium subsp. paratuberculosis
cagccaggccgccgggccg

SEQ ID NO: 2817381 - RNA, 14 nt, Mycobacterium avium subsp. paratuberculosis
cagccaggccgucg

SEQ ID NO: 2817382 - RNA, 15 nt, Mycobacterium avium subsp. paratuberculosis
cagccaggccgucgg

SEQ ID NO: 2817383 - RNA, 18 nt, Mycobacterium avium subsp. paratuberculosis
cagccaggccgucggcgc

SEQ ID NO: 2817384 - RNA, 23 nt, Mycobacterium avium subsp. paratuberculosis
cagccaggcgaugaagccggcga

SEQ ID NO: 2817385 - RNA, 22 nt, Mycobacterium avium subsp. paratuberculosis
cagccagguccgggcacucgag

SEQ ID NO: 2817386 - RNA, 16 nt, Mycobacterium avium subsp. paratuberculosis
cagccagguggugaac

SEQ ID NO: 2817387 - RNA, 20 nt, Mycobacterium avium subsp. paratuberculosis
cagccagguguaggcggcca

SEQ ID NO: 2817388 - RNA, 22 nt, Mycobacterium avium subsp. paratuberculosis
cagccagguguaggcggccaca

SEQ ID NO: 2817389 - RNA, 23 nt, Mycobacterium avium subsp. paratuberculosis
cagccaggugugcggcacgaugg

SEQ ID NO: 2817390 - RNA, 19 nt, Mycobacterium avium subsp. paratuberculosis
cagccaguccgccgccguc

SEQ ID NO: 2817391 - RNA, 19 nt, Mycobacterium avium subsp. paratuberculosis
cagccagucgaagaccacg

SEQ ID NO: 2817392 - RNA, 15 nt, Mycobacterium avium subsp. paratuberculosis
cagccagucgccggc

SEQ ID NO: 2817393 - RNA, 22 nt, Mycobacterium avium subsp. paratuberculosis
cagccagucgccggccaggccg

SEQ ID NO: 2817394 - RNA, 22 nt, Mycobacterium avium subsp. paratuberculosis
cagccaguugggggccagcgcc

SEQ ID NO: 2817395 - RNA, 23 nt, Mycobacterium avium subsp. paratuberculosis
cagccaguugggggccagcgccg

SEQ ID NO: 2817396 - RNA, 20 nt, Mycobacterium avium subsp. paratuberculosis
cagccauaccuugucggcgu

SEQ ID NO: 2817397 - RNA, 17 nt, Mycobacterium avium subsp. paratuberculosis
cagccauacugacgccg

SEQ ID NO: 2817398 - RNA, 18 nt, Mycobacterium avium subsp. paratuberculosis
cagccauacugacgccgg

SEQ ID NO: 2817399 - RNA, 21 nt, Mycobacterium avium subsp. paratuberculosis
cagccauacugacgccggucg

SEQ ID NO: 2817400 - RNA, 15 nt, Mycobacterium avium subsp. paratuberculosis
cagcccaccgaucgc

SEQ ID NO: 2817401 - RNA, 17 nt, Mycobacterium avium subsp. paratuberculosis
cagcccagccagcgaca

SEQ ID NO: 2817402 - RNA, 14 nt, Mycobacterium avium subsp. paratuberculosis
cagcccagccgcca

SEQ ID NO: 2817403 - RNA, 17 nt, Mycobacterium avium subsp. paratuberculosis
cagcccaggcccagcag

SEQ ID NO: 2817404 - RNA, 22 nt, Mycobacterium avium subsp. paratuberculosis
cagcccagguaaucgaaggcca

SEQ ID NO: 2817405 - RNA, 17 nt, Mycobacterium avium subsp. paratuberculosis
cagcccaggucgggacg

SEQ ID NO: 2817406 - RNA, 18 nt, Mycobacterium avium subsp. paratuberculosis
cagcccaggucgggacgu

SEQ ID NO: 2817407 - RNA, 23 nt, Mycobacterium avium subsp. paratuberculosis
cagcccaggucgggacguccgcg

SEQ ID NO: 2817408 - RNA, 21 nt, Mycobacterium avium subsp. paratuberculosis
cagcccaucccgauccgcgcc

SEQ ID NO: 2817409 - RNA, 18 nt, Mycobacterium avium subsp. paratuberculosis
cagcccgcgucgcgcagc

SEQ ID NO: 2817410 - RNA, 20 nt, Mycobacterium avium subsp. paratuberculosis
cagcccgcgucguguccggg

SEQ ID NO: 2817411 - RNA, 17 nt, Mycobacterium avium subsp. paratuberculosis
cagcccgcugaccaggc

SEQ ID NO: 2817412 - RNA, 18 nt, Mycobacterium avium subsp. paratuberculosis
cagcccgcugaccaggcc

SEQ ID NO: 2817413 - RNA, 23 nt, Mycobacterium avium subsp. paratuberculosis
cagcccgcugaccaggccgauga

SEQ ID NO: 2817414 - RNA, 17 nt, Mycobacterium avium subsp. paratuberculosis
cagcccggaaucgucgg

SEQ ID NO: 2817415 - RNA, 22 nt, Mycobacterium avium subsp. paratuberculosis
cagcccggaaucgucggccacg

SEQ ID NO: 2817416 - RNA, 17 nt, Mycobacterium avium subsp. paratuberculosis
cagcccggaggcgaugc

SEQ ID NO: 2817417 - RNA, 21 nt, Mycobacterium avium subsp. paratuberculosis
cagcccggaggcgaugcgggu

SEQ ID NO: 2817418 - RNA, 16 nt, Mycobacterium avium subsp. paratuberculosis
cagcccggcagcgggg

SEQ ID NO: 2817419 - RNA, 12 nt, Mycobacterium avium subsp. paratuberculosis
cagcccggccag

SEQ ID NO: 2817420 - RNA, 15 nt, Mycobacterium avium subsp. paratuberculosis
cagcccggccagccg

SEQ ID NO: 2817421 - RNA, 17 nt, Mycobacterium avium subsp. paratuberculosis
cagcccggccagccggg

SEQ ID NO: 2817422 - RNA, 14 nt, Mycobacterium avium subsp. paratuberculosis
cagcccggccagcg

SEQ ID NO: 2817423 - RNA, 17 nt, Mycobacterium avium subsp. paratuberculosis
cagcccggccagcggca

SEQ ID NO: 2817424 - RNA, 14 nt, Mycobacterium avium subsp. paratuberculosis
cagcccggcccagc

SEQ ID NO: 2817425 - RNA, 17 nt, Mycobacterium avium subsp. paratuberculosis
cagcccggcccagccgg

SEQ ID NO: 2817426 - RNA, 12 nt, Mycobacterium avium subsp. paratuberculosis
cagcccggcccc

SEQ ID NO: 2817427 - RNA, 19 nt, Mycobacterium avium subsp. paratuberculosis
cagcccggccccaccgccg

SEQ ID NO: 2817428 - RNA, 16 nt, Mycobacterium avium subsp. paratuberculosis
cagcccggcccgcauc

SEQ ID NO: 2817429 - RNA, 19 nt, Mycobacterium avium subsp. paratuberculosis
cagcccggcccgcaucgaa

SEQ ID NO: 2817430 - RNA, 15 nt, Mycobacterium avium subsp. paratuberculosis
cagcccggcccgucg

SEQ ID NO: 2817431 - RNA, 19 nt, Mycobacterium avium subsp. paratuberculosis
cagcccggcccgucgagcg

SEQ ID NO: 2817432 - RNA, 14 nt, Mycobacterium avium subsp. paratuberculosis
cagcccggccgccg

SEQ ID NO: 2817433 - RNA, 15 nt, Mycobacterium avium subsp. paratuberculosis
cagcccggccgccga

SEQ ID NO: 2817434 - RNA, 17 nt, Mycobacterium avium subsp. paratuberculosis
cagcccggccgccgagg

SEQ ID NO: 2817435 - RNA, 21 nt, Mycobacterium avium subsp. paratuberculosis
cagcccggcgaacaccacggu

SEQ ID NO: 2817436 - RNA, 16 nt, Mycobacterium avium subsp. paratuberculosis
cagcccggcgacgaag

SEQ ID NO: 2817437 - RNA, 17 nt, Mycobacterium avium subsp. paratuberculosis
cagcccggcgacgaagc

SEQ ID NO: 2817438 - RNA, 22 nt, Mycobacterium avium subsp. paratuberculosis
cagcccggcgaugaucaggccg

SEQ ID NO: 2817439 - RNA, 20 nt, Mycobacterium avium subsp. paratuberculosis
cagcccggcgcucaccgcga

SEQ ID NO: 2817440 - RNA, 17 nt, Mycobacterium avium subsp. paratuberculosis
cagcccggcgcugcgcc

SEQ ID NO: 2817441 - RNA, 18 nt, Mycobacterium avium subsp. paratuberculosis
cagcccggcgcugcgccc

SEQ ID NO: 2817442 - RNA, 12 nt, Mycobacterium avium subsp. paratuberculosis
cagcccggcggu

SEQ ID NO: 2817443 - RNA, 19 nt, Mycobacterium avium subsp. paratuberculosis
cagcccggcguacagcaau

SEQ ID NO: 2817444 - RNA, 22 nt, Mycobacterium avium subsp. paratuberculosis
cagcccggcguacagcaauccg

SEQ ID NO: 2817445 - RNA, 16 nt, Mycobacterium avium subsp. paratuberculosis
cagcccggcguccugc

SEQ ID NO: 2817446 - RNA, 13 nt, Mycobacterium avium subsp. paratuberculosis
cagcccggcgugc

SEQ ID NO: 2817447 - RNA, 12 nt, Mycobacterium avium subsp. paratuberculosis
cagcccggcuaa

SEQ ID NO: 2817448 - RNA, 21 nt, Mycobacterium avium subsp. paratuberculosis
cagcccggcuaauucgggccg

SEQ ID NO: 2817449 - RNA, 22 nt, Mycobacterium avium subsp. paratuberculosis
cagcccggcuaauucgggccgc

SEQ ID NO: 2817450 - RNA, 21 nt, Mycobacterium avium subsp. paratuberculosis
cagcccgggauggaucgaguu

SEQ ID NO: 2817451 - RNA, 13 nt, Mycobacterium avium subsp. paratuberculosis
cagcccgggcugc

SEQ ID NO: 2817452 - RNA, 16 nt, Mycobacterium avium subsp. paratuberculosis
cagcccgggcugcagc

SEQ ID NO: 2817453 - RNA, 22 nt, Mycobacterium avium subsp. paratuberculosis
cagcccgggcugcagcagcgac

SEQ ID NO: 2817454 - RNA, 15 nt, Mycobacterium avium subsp. paratuberculosis
cagcccggggguggc

SEQ ID NO: 2817455 - RNA, 17 nt, Mycobacterium avium subsp. paratuberculosis
cagcccggggguggcgg

SEQ ID NO: 2817456 - RNA, 14 nt, Mycobacterium avium subsp. paratuberculosis
cagcccgggugcga

SEQ ID NO: 2817457 - RNA, 13 nt, Mycobacterium avium subsp. paratuberculosis
cagcccggucacc

SEQ ID NO: 2817458 - RNA, 18 nt, Mycobacterium avium subsp. paratuberculosis
cagcccggucaccaucag

SEQ ID NO: 2817459 - RNA, 20 nt, Mycobacterium avium subsp. paratuberculosis
cagcccggucaccaucagca

SEQ ID NO: 2817460 - RNA, 17 nt, Mycobacterium avium subsp. paratuberculosis
cagcccggucaguucgu

SEQ ID NO: 2817461 - RNA, 17 nt, Mycobacterium avium subsp. paratuberculosis
cagcccggugacgaaca

SEQ ID NO: 2817462 - RNA, 19 nt, Mycobacterium avium subsp. paratuberculosis
cagcccggugacgaacauc

SEQ ID NO: 2817463 - RNA, 22 nt, Mycobacterium avium subsp. paratuberculosis
cagcccggugacgaacaucgac

SEQ ID NO: 2817464 - RNA, 21 nt, Mycobacterium avium subsp. paratuberculosis
cagcccggugaucgccgccca

SEQ ID NO: 2817465 - RNA, 24 nt, Mycobacterium avium subsp. paratuberculosis
cagcccgguguccacgucgcccag

SEQ ID NO: 2817466 - RNA, 23 nt, Mycobacterium avium subsp. paratuberculosis
cagcccgguuuccaguccggcgc

SEQ ID NO: 2817467 - RNA, 18 nt, Mycobacterium avium subsp. paratuberculosis
cagcccguacuugcuggc

SEQ ID NO: 2817468 - RNA, 15 nt, Mycobacterium avium subsp. paratuberculosis
cagcccgucccggcc

SEQ ID NO: 2817469 - RNA, 16 nt, Mycobacterium avium subsp. paratuberculosis
cagcccgucccggccc

SEQ ID NO: 2817470 - RNA, 16 nt, Mycobacterium avium subsp. paratuberculosis
cagcccgucgaucccg

SEQ ID NO: 2817471 - RNA, 14 nt, Mycobacterium avium subsp. paratuberculosis
cagcccgucggccu

SEQ ID NO: 2817472 - RNA, 16 nt, Mycobacterium avium subsp. paratuberculosis
cagcccgucgggugug

SEQ ID NO: 2817473 - RNA, 14 nt, Mycobacterium avium subsp. paratuberculosis
cagcccguggccag

SEQ ID NO: 2817474 - RNA, 16 nt, Mycobacterium avium subsp. paratuberculosis
cagcccguggccagcg

SEQ ID NO: 2817475 - RNA, 20 nt, Mycobacterium avium subsp. paratuberculosis
cagcccguugucgagcaccg

SEQ ID NO: 2817476 - RNA, 16 nt, Mycobacterium avium subsp. paratuberculosis
cagcccguuguggcgg

SEQ ID NO: 2817477 - RNA, 15 nt, Mycobacterium avium subsp. paratuberculosis
cagcccuacccgucc

SEQ ID NO: 2817478 - RNA, 22 nt, Mycobacterium avium subsp. paratuberculosis
cagcccuacccguccagcgcga

SEQ ID NO: 2817479 - RNA, 13 nt, Mycobacterium avium subsp. paratuberculosis
cagcccucgagcc

SEQ ID NO: 2817480 - RNA, 13 nt, Mycobacterium avium subsp. paratuberculosis
cagcccucgucga

SEQ ID NO: 2817481 - RNA, 17 nt, Mycobacterium avium subsp. paratuberculosis
cagcccucgucgaugac

SEQ ID NO: 2817482 - RNA, 20 nt, Mycobacterium avium subsp. paratuberculosis
cagcccucgucgaugacguc

SEQ ID NO: 2817483 - RNA, 23 nt, Mycobacterium avium subsp. paratuberculosis
cagcccucgucgaugacguccac

SEQ ID NO: 2817484 - RNA, 16 nt, Mycobacterium avium subsp. paratuberculosis
cagcccugcucggcca

SEQ ID NO: 2817485 - RNA, 21 nt, Mycobacterium avium subsp. paratuberculosis
cagcccugcucggccagcggg

SEQ ID NO: 2817486 - RNA, 22 nt, Mycobacterium avium subsp. paratuberculosis
cagcccugcucggccagcgggu

SEQ ID NO: 2817487 - RNA, 18 nt, Mycobacterium avium subsp. paratuberculosis
cagcccugcuugaccgcg

SEQ ID NO: 2817488 - RNA, 19 nt, Mycobacterium avium subsp. paratuberculosis
cagcccugcuugaccgcga

SEQ ID NO: 2817489 - RNA, 23 nt, Mycobacterium avium subsp. paratuberculosis
cagcccugcuugaccgcgacggg

SEQ ID NO: 2817490 - RNA, 16 nt, Mycobacterium avium subsp. paratuberculosis
cagccgaagccggcgc

SEQ ID NO: 2817491 - RNA, 17 nt, Mycobacterium avium subsp. paratuberculosis
cagccgaagccggcgca

SEQ ID NO: 2817492 - RNA, 19 nt, Mycobacterium avium subsp. paratuberculosis
cagccgaaguauccgguca

SEQ ID NO: 2817493 - RNA, 20 nt, Mycobacterium avium subsp. paratuberculosis
cagccgaaguauccggucag

SEQ ID NO: 2817494 - RNA, 13 nt, Mycobacterium avium subsp. paratuberculosis
cagccgcgccgcc

SEQ ID NO: 2817495 - RNA, 14 nt, Mycobacterium avium subsp. paratuberculosis
cagccgcgccgccg

SEQ ID NO: 2817496 - RNA, 15 nt, Mycobacterium avium subsp. paratuberculosis
cagccgcgccgccgc

SEQ ID NO: 2817497 - RNA, 17 nt, Mycobacterium avium subsp. paratuberculosis
cagccgcgccgcgccgc

SEQ ID NO: 2817498 - RNA, 13 nt, Mycobacterium avium subsp. paratuberculosis
cagccgcgccggg

SEQ ID NO: 2817499 - RNA, 16 nt, Mycobacterium avium subsp. paratuberculosis
cagccgcgcgacgccg

SEQ ID NO: 2817500 - RNA, 19 nt, Mycobacterium avium subsp. paratuberculosis
cagccgcgcgacgccguag

SEQ ID NO: 2817501 - RNA, 14 nt, Mycobacterium avium subsp. paratuberculosis
cagccgcgcggccg

SEQ ID NO: 2817502 - RNA, 16 nt, Mycobacterium avium subsp. paratuberculosis
cagccgcgcggccggc

SEQ ID NO: 2817503 - RNA, 17 nt, Mycobacterium avium subsp. paratuberculosis
cagccgcgcggccggcc

SEQ ID NO: 2817504 - RNA, 18 nt, Mycobacterium avium subsp. paratuberculosis
cagccgcgcggccggcca

SEQ ID NO: 2817505 - RNA, 19 nt, Mycobacterium avium subsp. paratuberculosis
cagccgcgcggccggccac

SEQ ID NO: 2817506 - RNA, 13 nt, Mycobacterium avium subsp. paratuberculosis
cagccgcgcggcg

SEQ ID NO: 2817507 - RNA, 16 nt, Mycobacterium avium subsp. paratuberculosis
cagccgcgcggcgucg

SEQ ID NO: 2817508 - RNA, 20 nt, Mycobacterium avium subsp. paratuberculosis
cagccgcgcggcgucggccg

SEQ ID NO: 2817509 - RNA, 20 nt, Mycobacterium avium subsp. paratuberculosis
cagccgcgcgugcagccggg

SEQ ID NO: 2817510 - RNA, 21 nt, Mycobacterium avium subsp. paratuberculosis
cagccgcgcgugcagccgggc

SEQ ID NO: 2817511 - RNA, 14 nt, Mycobacterium avium subsp. paratuberculosis
cagccgcggacggc

SEQ ID NO: 2817512 - RNA, 17 nt, Mycobacterium avium subsp. paratuberculosis
cagccgcggacggccag

SEQ ID NO: 2817513 - RNA, 12 nt, Mycobacterium avium subsp. paratuberculosis
cagccgcggcgg

SEQ ID NO: 2817514 - RNA, 13 nt, Mycobacterium avium subsp. paratuberculosis
cagccgcggcggc

SEQ ID NO: 2817515 - RNA, 20 nt, Mycobacterium avium subsp. paratuberculosis
cagccgcggcggcagcaccc

SEQ ID NO: 2817516 - RNA, 14 nt, Mycobacterium avium subsp. paratuberculosis
cagccgcggcucga

SEQ ID NO: 2817517 - RNA, 18 nt, Mycobacterium avium subsp. paratuberculosis
cagccgcggucuuuggcg

SEQ ID NO: 2817518 - RNA, 20 nt, Mycobacterium avium subsp. paratuberculosis
cagccgcggucuuuggcgua

SEQ ID NO: 2817519 - RNA, 17 nt, Mycobacterium avium subsp. paratuberculosis
cagccgcgguggcggug

SEQ ID NO: 2817520 - RNA, 22 nt, Mycobacterium avium subsp. paratuberculosis
cagccgcgguggcgguguucga

SEQ ID NO: 2817521 - RNA, 21 nt, Mycobacterium avium subsp. paratuberculosis
cagccgcgguucuuguccucg

SEQ ID NO: 2817522 - RNA, 13 nt, Mycobacterium avium subsp. paratuberculosis
cagccgcgucacg

SEQ ID NO: 2817523 - RNA, 17 nt, Mycobacterium avium subsp. paratuberculosis
cagccgcgucacgucgg

SEQ ID NO: 2817524 - RNA, 18 nt, Mycobacterium avium subsp. paratuberculosis
cagccgcgucacgucggc

SEQ ID NO: 2817525 - RNA, 23 nt, Mycobacterium avium subsp. paratuberculosis
cagccgcgucacgucggccugca

SEQ ID NO: 2817526 - RNA, 18 nt, Mycobacterium avium subsp. paratuberculosis
cagccgcucacacagccg

SEQ ID NO: 2817527 - RNA, 23 nt, Mycobacterium avium subsp. paratuberculosis
cagccgcucccggcgcagcaacu

SEQ ID NO: 2817528 - RNA, 15 nt, Mycobacterium avium subsp. paratuberculosis
cagccgcuccgcggc

SEQ ID NO: 2817529 - RNA, 16 nt, Mycobacterium avium subsp. paratuberculosis
cagccgcuccgcggcg

SEQ ID NO: 2817530 - RNA, 18 nt, Mycobacterium avium subsp. paratuberculosis
cagccgcuccgcggcggg

SEQ ID NO: 2817531 - RNA, 17 nt, Mycobacterium avium subsp. paratuberculosis
cagccgcuccggcccga

SEQ ID NO: 2817532 - RNA, 14 nt, Mycobacterium avium subsp. paratuberculosis
cagccgcuccucgu

SEQ ID NO: 2817533 - RNA, 13 nt, Mycobacterium avium subsp. paratuberculosis
cagccgcugacga

SEQ ID NO: 2817534 - RNA, 18 nt, Mycobacterium avium subsp. paratuberculosis
cagccgcugacgauggcg

SEQ ID NO: 2817535 - RNA, 17 nt, Mycobacterium avium subsp. paratuberculosis
cagccgcugcagcgccg

SEQ ID NO: 2817536 - RNA, 18 nt, Mycobacterium avium subsp. paratuberculosis
cagccgcugcagcgccgc

SEQ ID NO: 2817537 - RNA, 21 nt, Mycobacterium avium subsp. paratuberculosis
cagccgcugcagcgccgcccg

SEQ ID NO: 2817538 - RNA, 14 nt, Mycobacterium avium subsp. paratuberculosis
cagccgcugccgca

SEQ ID NO: 2817539 - RNA, 23 nt, Mycobacterium avium subsp. paratuberculosis
cagccgcugccgcaccccguggu

SEQ ID NO: 2817540 - RNA, 14 nt, Mycobacterium avium subsp. paratuberculosis
cagccgcugcgaca

SEQ ID NO: 2817541 - RNA, 16 nt, Mycobacterium avium subsp. paratuberculosis
cagccgcuggccgcgc

SEQ ID NO: 2817542 - RNA, 17 nt, Mycobacterium avium subsp. paratuberculosis
cagccgcuggccgcgcc

SEQ ID NO: 2817543 - RNA, 18 nt, Mycobacterium avium subsp. paratuberculosis
cagccgcuggccgcgcca

SEQ ID NO: 2817544 - RNA, 20 nt, Mycobacterium avium subsp. paratuberculosis
cagccgcuggccgcgccaca

SEQ ID NO: 2817545 - RNA, 17 nt, Mycobacterium avium subsp. paratuberculosis
cagccgcuuggccgggc

SEQ ID NO: 2817546 - RNA, 18 nt, Mycobacterium avium subsp. paratuberculosis
cagccgcuuggccgggcg

SEQ ID NO: 2817547 - RNA, 14 nt, Mycobacterium avium subsp. paratuberculosis
cagccgcuuggcgc

SEQ ID NO: 2817548 - RNA, 20 nt, Mycobacterium avium subsp. paratuberculosis
cagccgcuuggcgcgccgca

SEQ ID NO: 2817549 - RNA, 23 nt, Mycobacterium avium subsp. paratuberculosis
cagccgcuuggcgcgccgcaccu

SEQ ID NO: 2817550 - RNA, 17 nt, Mycobacterium avium subsp. paratuberculosis
cagccggaacacaacgc

SEQ ID NO: 2817551 - RNA, 15 nt, Mycobacterium avium subsp. paratuberculosis
cagccggaaggccaa

SEQ ID NO: 2817552 - RNA, 23 nt, Mycobacterium avium subsp. paratuberculosis
cagccggaaggccaaggccagca

SEQ ID NO: 2817553 - RNA, 22 nt, Mycobacterium avium subsp. paratuberculosis
cagccggacccauucgucggcg

SEQ ID NO: 2817554 - RNA, 20 nt, Mycobacterium avium subsp. paratuberculosis
cagccggacgggaucggcgc

SEQ ID NO: 2817555 - RNA, 14 nt, Mycobacterium avium subsp. paratuberculosis
cagccggagccggc

SEQ ID NO: 2817556 - RNA, 17 nt, Mycobacterium avium subsp. paratuberculosis
cagccggagccggccuc

SEQ ID NO: 2817557 - RNA, 23 nt, Mycobacterium avium subsp. paratuberculosis
cagccggaucucgucgggcaccg

SEQ ID NO: 2817558 - RNA, 19 nt, Mycobacterium avium subsp. paratuberculosis
cagccggccaacagcagcg

SEQ ID NO: 2817559 - RNA, 18 nt, Mycobacterium avium subsp. paratuberculosis
cagccggccaccgcccca

SEQ ID NO: 2817560 - RNA, 20 nt, Mycobacterium avium subsp. paratuberculosis
cagccggccaccgccccagc

SEQ ID NO: 2817561 - RNA, 13 nt, Mycobacterium avium subsp. paratuberculosis
cagccggccaccu

SEQ ID NO: 2817562 - RNA, 15 nt, Mycobacterium avium subsp. paratuberculosis
cagccggccaucucg

SEQ ID NO: 2817563 - RNA, 18 nt, Mycobacterium avium subsp. paratuberculosis
cagccggccaucucggcg

SEQ ID NO: 2817564 - RNA, 19 nt, Mycobacterium avium subsp. paratuberculosis
cagccggccaucucggcgg

SEQ ID NO: 2817565 - RNA, 14 nt, Mycobacterium avium subsp. paratuberculosis
cagccggcccgagc

SEQ ID NO: 2817566 - RNA, 19 nt, Mycobacterium avium subsp. paratuberculosis
cagccggcccgagcccugc

SEQ ID NO: 2817567 - RNA, 12 nt, Mycobacterium avium subsp. paratuberculosis
cagccggcccuc

SEQ ID NO: 2817568 - RNA, 16 nt, Mycobacterium avium subsp. paratuberculosis
cagccggcccuccagg

SEQ ID NO: 2817569 - RNA, 20 nt, Mycobacterium avium subsp. paratuberculosis
cagccggcccuccaggaaga

SEQ ID NO: 2817570 - RNA, 11 nt, Mycobacterium avium subsp. paratuberculosis
cagccggccga

SEQ ID NO: 2817571 - RNA, 15 nt, Mycobacterium avium subsp. paratuberculosis
cagccggccgacgcg

SEQ ID NO: 2817572 - RNA, 19 nt, Mycobacterium avium subsp. paratuberculosis
cagccggccgacgcggccu

SEQ ID NO: 2817573 - RNA, 15 nt, Mycobacterium avium subsp. paratuberculosis
cagccggccgagcga

SEQ ID NO: 2817574 - RNA, 12 nt, Mycobacterium avium subsp. paratuberculosis
cagccggccgcu

SEQ ID NO: 2817575 - RNA, 14 nt, Mycobacterium avium subsp. paratuberculosis
cagccggccggcag

SEQ ID NO: 2817576 - RNA, 17 nt, Mycobacterium avium subsp. paratuberculosis
cagccggccggccgaca

SEQ ID NO: 2817577 - RNA, 14 nt, Mycobacterium avium subsp. paratuberculosis
cagccggccggcga

SEQ ID NO: 2817578 - RNA, 16 nt, Mycobacterium avium subsp. paratuberculosis
cagccggccggcgaag

SEQ ID NO: 2817579 - RNA, 23 nt, Mycobacterium avium subsp. paratuberculosis
cagccgguccuuggccugcuugg

SEQ ID NO: 2817580 - RNA, 13 nt, Mycobacterium avium subsp. paratuberculosis
cagccggucgacg

SEQ ID NO: 2817581 - RNA, 16 nt, Mycobacterium avium subsp. paratuberculosis
cagccggucgaggucg

SEQ ID NO: 2817582 - RNA, 20 nt, Mycobacterium avium subsp. paratuberculosis
cagccggucgaggucgccga

SEQ ID NO: 2817583 - RNA, 21 nt, Mycobacterium avium subsp. paratuberculosis
cagccggucgaggucgccgac

SEQ ID NO: 2817584 - RNA, 22 nt, Mycobacterium avium subsp. paratuberculosis
cagccggucgaggucgccgaca

SEQ ID NO: 2817585 - RNA, 15 nt, Mycobacterium avium subsp. paratuberculosis
cagccggucgcaggu

SEQ ID NO: 2817586 - RNA, 15 nt, Mycobacterium avium subsp. paratuberculosis
cagccggucgccggg

SEQ ID NO: 2817587 - RNA, 18 nt, Mycobacterium avium subsp. paratuberculosis
cagccggucgccgggccg

SEQ ID NO: 2817588 - RNA, 19 nt, Mycobacterium avium subsp. paratuberculosis
cagccggucgccgggccgg

SEQ ID NO: 2817589 - RNA, 22 nt, Mycobacterium avium subsp. paratuberculosis
cagccggucgcgcaucgccucg

SEQ ID NO: 2817590 - RNA, 23 nt, Mycobacterium avium subsp. paratuberculosis
cagccggucgcgcaucgccucgg

SEQ ID NO: 2817591 - RNA, 14 nt, Mycobacterium avium subsp. paratuberculosis
cagccggucgucgg

SEQ ID NO: 2817592 - RNA, 18 nt, Mycobacterium avium subsp. paratuberculosis
cagccggucgucggggca

SEQ ID NO: 2817593 - RNA, 22 nt, Mycobacterium avium subsp. paratuberculosis
cagccggucgucggggcaucgc

SEQ ID NO: 2817594 - RNA, 19 nt, Mycobacterium avium subsp. paratuberculosis
cagccggucuuggacagca

SEQ ID NO: 2817595 - RNA, 12 nt, Mycobacterium avium subsp. paratuberculosis
cagccggugcac

SEQ ID NO: 2817596 - RNA, 14 nt, Mycobacterium avium subsp. paratuberculosis
cagccggugcacca

SEQ ID NO: 2817597 - RNA, 17 nt, Mycobacterium avium subsp. paratuberculosis
cagccggugcaccacga

SEQ ID NO: 2817598 - RNA, 12 nt, Mycobacterium avium subsp. paratuberculosis
cagccggugcga

SEQ ID NO: 2817599 - RNA, 19 nt, Mycobacterium avium subsp. paratuberculosis
cagccggugcggucggcgu

SEQ ID NO: 2817600 - RNA, 21 nt, Mycobacterium avium subsp. paratuberculosis
cagccggugcggucggcgucg

SEQ ID NO: 2817601 - RNA, 14 nt, Mycobacterium avium subsp. paratuberculosis
cagccggugcugac

SEQ ID NO: 2817602 - RNA, 16 nt, Mycobacterium avium subsp. paratuberculosis
cagccggugcugaccc

SEQ ID NO: 2817603 - RNA, 22 nt, Mycobacterium avium subsp. paratuberculosis
cagccgguggaauucuggccga

SEQ ID NO: 2817604 - RNA, 14 nt, Mycobacterium avium subsp. paratuberculosis
cagccgguggcggc

SEQ ID NO: 2817605 - RNA, 16 nt, Mycobacterium avium subsp. paratuberculosis
cagccgguggcggcca

SEQ ID NO: 2817606 - RNA, 21 nt, Mycobacterium avium subsp. paratuberculosis
cagccgguggcggccacgauc

SEQ ID NO: 2817607 - RNA, 19 nt, Mycobacterium avium subsp. paratuberculosis
cagccguaccgauccgcgg

SEQ ID NO: 2817608 - RNA, 21 nt, Mycobacterium avium subsp. paratuberculosis
cagccgucccuguucgcgccg

SEQ ID NO: 2817609 - RNA, 22 nt, Mycobacterium avium subsp. paratuberculosis
cagccgucccuguucgcgccgg

SEQ ID NO: 2817610 - RNA, 14 nt, Mycobacterium avium subsp. paratuberculosis
cagccguccugguc

SEQ ID NO: 2817611 - RNA, 22 nt, Mycobacterium avium subsp. paratuberculosis
cagccgucgaucuugacgugga

SEQ ID NO: 2817612 - RNA, 12 nt, Mycobacterium avium subsp. paratuberculosis
cagccgucgaug

SEQ ID NO: 2817613 - RNA, 21 nt, Mycobacterium avium subsp. paratuberculosis
cagccgucgaugccggcgacg

SEQ ID NO: 2817614 - RNA, 18 nt, Mycobacterium avium subsp. paratuberculosis
cagccgucgcaccgccuc

SEQ ID NO: 2817615 - RNA, 20 nt, Mycobacterium avium subsp. paratuberculosis
cagccgucgcacuagguccg

SEQ ID NO: 2817616 - RNA, 21 nt, Mycobacterium avium subsp. paratuberculosis
cagccgucgcaucagcucggc

SEQ ID NO: 2817617 - RNA, 14 nt, Mycobacterium avium subsp. paratuberculosis
cagccgucgccgcg

SEQ ID NO: 2817618 - RNA, 16 nt, Mycobacterium avium subsp. paratuberculosis
cagccgucgucguccg

SEQ ID NO: 2817619 - RNA, 18 nt, Mycobacterium avium subsp. paratuberculosis
cagccgugccccaggucg

SEQ ID NO: 2817620 - RNA, 15 nt, Mycobacterium avium subsp. paratuberculosis
cagccgugcggcggc

SEQ ID NO: 2817621 - RNA, 15 nt, Mycobacterium avium subsp. paratuberculosis
cagccgugcugggcc

SEQ ID NO: 2817622 - RNA, 21 nt, Mycobacterium avium subsp. paratuberculosis
cagccgugggugucggcgaag

SEQ ID NO: 2817623 - RNA, 17 nt, Mycobacterium avium subsp. paratuberculosis
cagccguuccaucgggc

SEQ ID NO: 2817624 - RNA, 17 nt, Mycobacterium avium subsp. paratuberculosis
cagccguucccggcaga

SEQ ID NO: 2817625 - RNA, 20 nt, Mycobacterium avium subsp. paratuberculosis
cagccguucgcgcacggcgc

SEQ ID NO: 2817626 - RNA, 21 nt, Mycobacterium avium subsp. paratuberculosis
cagccguucgcgcacggcgcg

SEQ ID NO: 2817627 - RNA, 14 nt, Mycobacterium avium subsp. paratuberculosis
cagccguucgcugc

SEQ ID NO: 2817628 - RNA, 20 nt, Mycobacterium avium subsp. paratuberculosis
cagccguugggcagcucggc

SEQ ID NO: 2817629 - RNA, 15 nt, Mycobacterium avium subsp. paratuberculosis
cagccguuguccacg

SEQ ID NO: 2817630 - RNA, 16 nt, Mycobacterium avium subsp. paratuberculosis
cagccguuguccacga

SEQ ID NO: 2817631 - RNA, 14 nt, Mycobacterium avium subsp. paratuberculosis
cagccugaccgcgg

SEQ ID NO: 2817632 - RNA, 15 nt, Mycobacterium avium subsp. paratuberculosis
cagccugccuccacg

SEQ ID NO: 2817633 - RNA, 16 nt, Mycobacterium avium subsp. paratuberculosis
cagccugcggugaugc

SEQ ID NO: 2817634 - RNA, 21 nt, Mycobacterium avium subsp. paratuberculosis
cagccugcggugaugcgcggc

SEQ ID NO: 2817635 - RNA, 22 nt, Mycobacterium avium subsp. paratuberculosis
cagccugcggugaugcgcggcg

SEQ ID NO: 2817636 - RNA, 23 nt, Mycobacterium avium subsp. paratuberculosis
cagccugcggugaugcgcggcga

SEQ ID NO: 2817637 - RNA, 14 nt, Mycobacterium avium subsp. paratuberculosis
cagccuggcggcga

SEQ ID NO: 2817638 - RNA, 15 nt, Mycobacterium avium subsp. paratuberculosis
cagccuggcggcgac

SEQ ID NO: 2817639 - RNA, 13 nt, Mycobacterium avium subsp. paratuberculosis
cagccuucgccgc

SEQ ID NO: 2817640 - RNA, 23 nt, Mycobacterium avium subsp. paratuberculosis
cagccuucuucgccggggccuuc

SEQ ID NO: 2817641 - RNA, 17 nt, Mycobacterium avium subsp. paratuberculosis
cagccuucuuggcgggc

SEQ ID NO: 2817642 - RNA, 23 nt, Mycobacterium avium subsp. paratuberculosis
cagccuucuuggcgggcgccuuc

SEQ ID NO: 2817643 - RNA, 15 nt, Mycobacterium avium subsp. paratuberculosis
cagccuugcagccgc

SEQ ID NO: 2817644 - RNA, 19 nt, Mycobacterium avium subsp. paratuberculosis
cagccuugcagccgcugcc

SEQ ID NO: 2817645 - RNA, 23 nt, Mycobacterium avium subsp. paratuberculosis
cagcgaaaccuccggagaucgcc

SEQ ID NO: 2817646 - RNA, 23 nt, Mycobacterium avium subsp. paratuberculosis
cagcgaaacucguugccagccgg

SEQ ID NO: 2817647 - RNA, 19 nt, Mycobacterium avium subsp. paratuberculosis
cagcgaaagcgcuuggcgg

SEQ ID NO: 2817648 - RNA, 16 nt, Mycobacterium avium subsp. paratuberculosis
cagcgaacccgccagg

SEQ ID NO: 2817649 - RNA, 21 nt, Mycobacterium avium subsp. paratuberculosis
cagcgaaccgacauaggucag

SEQ ID NO: 2817650 - RNA, 22 nt, Mycobacterium avium subsp. paratuberculosis
cagcgaaccgacauaggucagg

SEQ ID NO: 2817651 - RNA, 19 nt, Mycobacterium avium subsp. paratuberculosis
cagcgaacgcggcugauca

SEQ ID NO: 2817652 - RNA, 14 nt, Mycobacterium avium subsp. paratuberculosis
cagcgaagccacgg

SEQ ID NO: 2817653 - RNA, 16 nt, Mycobacterium avium subsp. paratuberculosis
cagcgaagcgaggcgc

SEQ ID NO: 2817654 - RNA, 18 nt, Mycobacterium avium subsp. paratuberculosis
cagcgaagcgaggcgcca

SEQ ID NO: 2817655 - RNA, 15 nt, Mycobacterium avium subsp. paratuberculosis
cagcgaaggcauggg

SEQ ID NO: 2817656 - RNA, 17 nt, Mycobacterium avium subsp. paratuberculosis
cagcgaauacaccgucc

SEQ ID NO: 2817657 - RNA, 22 nt, Mycobacterium avium subsp. paratuberculosis
cagcgaauacaccguccagcuc

SEQ ID NO: 2817658 - RNA, 16 nt, Mycobacterium avium subsp. paratuberculosis
cagcgaaucgaccggg

SEQ ID NO: 2817659 - RNA, 18 nt, Mycobacterium avium subsp. paratuberculosis
cagcgaaucgaccggguu

SEQ ID NO: 2817660 - RNA, 19 nt, Mycobacterium avium subsp. paratuberculosis
cagcgaaucggggucgauc

SEQ ID NO: 2817661 - RNA, 22 nt, Mycobacterium avium subsp. paratuberculosis
cagcgaauggcaauacgccucg

SEQ ID NO: 2817662 - RNA, 18 nt, Mycobacterium avium subsp. paratuberculosis
cagcgacaacggccccca

SEQ ID NO: 2817663 - RNA, 19 nt, Mycobacterium avium subsp. paratuberculosis
cagcgagcaggucaccgga

SEQ ID NO: 2817664 - RNA, 17 nt, Mycobacterium avium subsp. paratuberculosis
cagcgagcccagcugcg

SEQ ID NO: 2817665 - RNA, 14 nt, Mycobacterium avium subsp. paratuberculosis
cagcgagccgauga

SEQ ID NO: 2817666 - RNA, 14 nt, Mycobacterium avium subsp. paratuberculosis
cagcgagccgucga

SEQ ID NO: 2817667 - RNA, 15 nt, Mycobacterium avium subsp. paratuberculosis
cagcgagccgucgac

SEQ ID NO: 2817668 - RNA, 16 nt, Mycobacterium avium subsp. paratuberculosis
cagcgagccgucgacc

SEQ ID NO: 2817669 - RNA, 23 nt, Mycobacterium avium subsp. paratuberculosis
cagcgagccgucgaccggguccg

SEQ ID NO: 2817670 - RNA, 19 nt, Mycobacterium avium subsp. paratuberculosis
cagcgagcgguuggcgacg

SEQ ID NO: 2817671 - RNA, 17 nt, Mycobacterium avium subsp. paratuberculosis
cagcgagcucaggccgg

SEQ ID NO: 2817672 - RNA, 14 nt, Mycobacterium avium subsp. paratuberculosis
cagcgagcugccgg

SEQ ID NO: 2817673 - RNA, 18 nt, Mycobacterium avium subsp. paratuberculosis
cagcgagcugccggcggc

SEQ ID NO: 2817674 - RNA, 14 nt, Mycobacterium avium subsp. paratuberculosis
cagcgaggacccgu

SEQ ID NO: 2817675 - RNA, 14 nt, Mycobacterium avium subsp. paratuberculosis
cagcgaggcgcgca

SEQ ID NO: 2817676 - RNA, 19 nt, Mycobacterium avium subsp. paratuberculosis
cagcgaggcgcgcagguag

SEQ ID NO: 2817677 - RNA, 14 nt, Mycobacterium avium subsp. paratuberculosis
cagcgaggcggcca

SEQ ID NO: 2817678 - RNA, 20 nt, Mycobacterium avium subsp. paratuberculosis
cagcgaggcggccagcggca

SEQ ID NO: 2817679 - RNA, 23 nt, Mycobacterium avium subsp. paratuberculosis
cagcgaggcggccagcggcagcg

SEQ ID NO: 2817680 - RNA, 20 nt, Mycobacterium avium subsp. paratuberculosis
cagcgaggcguccagcgcgu

SEQ ID NO: 2817681 - RNA, 13 nt, Mycobacterium avium subsp. paratuberculosis
cagcgagggggug

SEQ ID NO: 2817682 - RNA, 22 nt, Mycobacterium avium subsp. paratuberculosis
cagcgaggugguuucggggucg

SEQ ID NO: 2817683 - RNA, 16 nt, Mycobacterium avium subsp. paratuberculosis
cagcgaguccagccag

SEQ ID NO: 2817684 - RNA, 17 nt, Mycobacterium avium subsp. paratuberculosis
cagcgaguccagccagc

SEQ ID NO: 2817685 - RNA, 23 nt, Mycobacterium avium subsp. paratuberculosis
cagcgaguccagccagccgcgcc

SEQ ID NO: 2817686 - RNA, 23 nt, Mycobacterium avium subsp. paratuberculosis
cagcgagucgaaggcgcgggcgu

SEQ ID NO: 2817687 - RNA, 23 nt, Mycobacterium avium subsp. paratuberculosis
cagcgagucggcgaaggcgcgca

SEQ ID NO: 2817688 - RNA, 15 nt, Mycobacterium avium subsp. paratuberculosis
cagcgagucggucga

SEQ ID NO: 2817689 - RNA, 20 nt, Mycobacterium avium subsp. paratuberculosis
cagcgagugguaccgggugg

SEQ ID NO: 2817690 - RNA, 23 nt, Mycobacterium avium subsp. paratuberculosis
cagcgauacccguugcgccccac

SEQ ID NO: 2817691 - RNA, 16 nt, Mycobacterium avium subsp. paratuberculosis
cagcgauccggcgcgu

SEQ ID NO: 2817692 - RNA, 16 nt, Mycobacterium avium subsp. paratuberculosis
cagcgaucggcggcuc

SEQ ID NO: 2817693 - RNA, 15 nt, Mycobacterium avium subsp. paratuberculosis
cagcgauucccgccg

SEQ ID NO: 2817694 - RNA, 19 nt, Mycobacterium avium subsp. paratuberculosis
cagcgauugcggccgccgg

SEQ ID NO: 2817695 - RNA, 22 nt, Mycobacterium avium subsp. paratuberculosis
cagcgauugcggccgccggcca

SEQ ID NO: 2817696 - RNA, 13 nt, Mycobacterium avium subsp. paratuberculosis
cagcgcaaccgcg

SEQ ID NO: 2817697 - RNA, 15 nt, Mycobacterium avium subsp. paratuberculosis
cagcgcaaccgcggc

SEQ ID NO: 2817698 - RNA, 18 nt, Mycobacterium avium subsp. paratuberculosis
cagcgcaaccgcggcggc

SEQ ID NO: 2817699 - RNA, 21 nt, Mycobacterium avium subsp. paratuberculosis
cagcgcaaccgcggcggcggc

SEQ ID NO: 2817700 - RNA, 16 nt, Mycobacterium avium subsp. paratuberculosis
cagcgcaacggcgucg

SEQ ID NO: 2817701 - RNA, 13 nt, Mycobacterium avium subsp. paratuberculosis
cagcgcacacacc

SEQ ID NO: 2817702 - RNA, 17 nt, Mycobacterium avium subsp. paratuberculosis
cagcgcacacagcagca

SEQ ID NO: 2817703 - RNA, 13 nt, Mycobacterium avium subsp. paratuberculosis
cagcgcaccgccg

SEQ ID NO: 2817704 - RNA, 16 nt, Mycobacterium avium subsp. paratuberculosis
cagcgcaccgccgucg

SEQ ID NO: 2817705 - RNA, 20 nt, Mycobacterium avium subsp. paratuberculosis
cagcgcaccgccgucggggc

SEQ ID NO: 2817706 - RNA, 17 nt, Mycobacterium avium subsp. paratuberculosis
cagcgcaccggcgaugc

SEQ ID NO: 2817707 - RNA, 20 nt, Mycobacterium avium subsp. paratuberculosis
cagcgcaccggcgaugcaga

SEQ ID NO: 2817708 - RNA, 16 nt, Mycobacterium avium subsp. paratuberculosis
cagcgcaccgggcccg

SEQ ID NO: 2817709 - RNA, 20 nt, Mycobacterium avium subsp. paratuberculosis
cagcgcaccgggcccgcccg

SEQ ID NO: 2817710 - RNA, 16 nt, Mycobacterium avium subsp. paratuberculosis
cagcgcacgucgccgc

SEQ ID NO: 2817711 - RNA, 21 nt, Mycobacterium avium subsp. paratuberculosis
cagcgcagcaccauccgcgcg

SEQ ID NO: 2817712 - RNA, 22 nt, Mycobacterium avium subsp. paratuberculosis
cagcgcagcaccauccgcgcga

SEQ ID NO: 2817713 - RNA, 16 nt, Mycobacterium avium subsp. paratuberculosis
cagcgcagcaucggca

SEQ ID NO: 2817714 - RNA, 15 nt, Mycobacterium avium subsp. paratuberculosis
cagcgcagcgaccug

SEQ ID NO: 2817715 - RNA, 16 nt, Mycobacterium avium subsp. paratuberculosis
cagcgcagcgaccugg

SEQ ID NO: 2817716 - RNA, 23 nt, Mycobacterium avium subsp. paratuberculosis
cagcgcagcgaccugguccaccg

SEQ ID NO: 2817717 - RNA, 17 nt, Mycobacterium avium subsp. paratuberculosis
cagcgcagcgccucggc

SEQ ID NO: 2817718 - RNA, 17 nt, Mycobacterium avium subsp. paratuberculosis
cagcgcagcgucggcgu

SEQ ID NO: 2817719 - RNA, 13 nt, Mycobacterium avium subsp. paratuberculosis
cagcgcagcgugg

SEQ ID NO: 2817720 - RNA, 18 nt, Mycobacterium avium subsp. paratuberculosis
cagcgcagguacgcggcg

SEQ ID NO: 2817721 - RNA, 19 nt, Mycobacterium avium subsp. paratuberculosis
cagcgcagguacgcggcgu

SEQ ID NO: 2817722 - RNA, 16 nt, Mycobacterium avium subsp. paratuberculosis
cagcgcagugcggacg

SEQ ID NO: 2817723 - RNA, 18 nt, Mycobacterium avium subsp. paratuberculosis
cagcgcauccaccagggc

SEQ ID NO: 2817724 - RNA, 14 nt, Mycobacterium avium subsp. paratuberculosis
cagcgcauccgaca

SEQ ID NO: 2817725 - RNA, 22 nt, Mycobacterium avium subsp. paratuberculosis
cagcgcauccucauagccggcc

SEQ ID NO: 2817726 - RNA, 23 nt, Mycobacterium avium subsp. paratuberculosis
cagcgcauccucauagccggccg

SEQ ID NO: 2817727 - RNA, 17 nt, Mycobacterium avium subsp. paratuberculosis
cagcgcaucgccggcga

SEQ ID NO: 2817728 - RNA, 23 nt, Mycobacterium avium subsp. paratuberculosis
cagcgcaucggucaccagcuccc

SEQ ID NO: 2817729 - RNA, 15 nt, Mycobacterium avium subsp. paratuberculosis
cagcgcaucggugag

SEQ ID NO: 2817730 - RNA, 23 nt, Mycobacterium avium subsp. paratuberculosis
cagcgcaucguugccggcggcga

SEQ ID NO: 2817731 - RNA, 17 nt, Mycobacterium avium subsp. paratuberculosis
cagcgccacaccgaaga

SEQ ID NO: 2817732 - RNA, 19 nt, Mycobacterium avium subsp. paratuberculosis
cagcgccacaccgaagaac

SEQ ID NO: 2817733 - RNA, 12 nt, Mycobacterium avium subsp. paratuberculosis
cagcgccaccag

SEQ ID NO: 2817734 - RNA, 14 nt, Mycobacterium avium subsp. paratuberculosis
cagcgccaccagca

SEQ ID NO: 2817735 - RNA, 16 nt, Mycobacterium avium subsp. paratuberculosis
cagcgccaccagcacc

SEQ ID NO: 2817736 - RNA, 17 nt, Mycobacterium avium subsp. paratuberculosis
cagcgccaccagcaccg

SEQ ID NO: 2817737 - RNA, 18 nt, Mycobacterium avium subsp. paratuberculosis
cagcgccaccagcaccgg

SEQ ID NO: 2817738 - RNA, 19 nt, Mycobacterium avium subsp. paratuberculosis
cagcgccaccagcaccggg

SEQ ID NO: 2817739 - RNA, 20 nt, Mycobacterium avium subsp. paratuberculosis
cagcgccaccagcaccggga

SEQ ID NO: 2817740 - RNA, 14 nt, Mycobacterium avium subsp. paratuberculosis
cagcgccaccagcu

SEQ ID NO: 2817741 - RNA, 16 nt, Mycobacterium avium subsp. paratuberculosis
cagcgccaccagcucc

SEQ ID NO: 2817742 - RNA, 20 nt, Mycobacterium avium subsp. paratuberculosis
cagcgccacgcucaugcccg

SEQ ID NO: 2817743 - RNA, 14 nt, Mycobacterium avium subsp. paratuberculosis
cagcgccacggugg

SEQ ID NO: 2817744 - RNA, 15 nt, Mycobacterium avium subsp. paratuberculosis
cagcgccacuggcug

SEQ ID NO: 2817745 - RNA, 14 nt, Mycobacterium avium subsp. paratuberculosis
cagcgccagcaaca

SEQ ID NO: 2817746 - RNA, 19 nt, Mycobacterium avium subsp. paratuberculosis
cagcgccagcaacacccag

SEQ ID NO: 2817747 - RNA, 21 nt, Mycobacterium avium subsp. paratuberculosis
cagcgccagcaacacccagcc

SEQ ID NO: 2817748 - RNA, 18 nt, Mycobacterium avium subsp. paratuberculosis
cagcgccgccaucgccuc

SEQ ID NO: 2817749 - RNA, 12 nt, Mycobacterium avium subsp. paratuberculosis
cagcgccgcccg

SEQ ID NO: 2817750 - RNA, 14 nt, Mycobacterium avium subsp. paratuberculosis
cagcgccgcccgca

SEQ ID NO: 2817751 - RNA, 17 nt, Mycobacterium avium subsp. paratuberculosis
cagcgccgcccgcaccu

SEQ ID NO: 2817752 - RNA, 17 nt, Mycobacterium avium subsp. paratuberculosis
cagcgccgcgacgaacu

SEQ ID NO: 2817753 - RNA, 22 nt, Mycobacterium avium subsp. paratuberculosis
cagcgccgcgaugaucacaccc

SEQ ID NO: 2817754 - RNA, 16 nt, Mycobacterium avium subsp. paratuberculosis
cagcgccgcgccgacc

SEQ ID NO: 2817755 - RNA, 18 nt, Mycobacterium avium subsp. paratuberculosis
cagcgccgcgcgcgcggc

SEQ ID NO: 2817756 - RNA, 12 nt, Mycobacterium avium subsp. paratuberculosis
cagcgccgcggc

SEQ ID NO: 2817757 - RNA, 18 nt, Mycobacterium avium subsp. paratuberculosis
cagcgccgcggccagccg

SEQ ID NO: 2817758 - RNA, 19 nt, Mycobacterium avium subsp. paratuberculosis
cagcgccgcggccagccgg

SEQ ID NO: 2817759 - RNA, 14 nt, Mycobacterium avium subsp. paratuberculosis
cagcgccgcggccg

SEQ ID NO: 2817760 - RNA, 15 nt, Mycobacterium avium subsp. paratuberculosis
cagcgccgcggccgg

SEQ ID NO: 2817761 - RNA, 18 nt, Mycobacterium avium subsp. paratuberculosis
cagcgccgcggccggugc

SEQ ID NO: 2817762 - RNA, 20 nt, Mycobacterium avium subsp. paratuberculosis
cagcgccgcggccggugcca

SEQ ID NO: 2817763 - RNA, 14 nt, Mycobacterium avium subsp. paratuberculosis
cagcgccgcggcga

SEQ ID NO: 2817764 - RNA, 14 nt, Mycobacterium avium subsp. paratuberculosis
cagcgccgcggcgc

SEQ ID NO: 2817765 - RNA, 16 nt, Mycobacterium avium subsp. paratuberculosis
cagcgccgcggcgccc

SEQ ID NO: 2817766 - RNA, 22 nt, Mycobacterium avium subsp. paratuberculosis
cagcgccgcguugucggcgucc

SEQ ID NO: 2817767 - RNA, 21 nt, Mycobacterium avium subsp. paratuberculosis
cagcgccgcuucgucgccggc

SEQ ID NO: 2817768 - RNA, 13 nt, Mycobacterium avium subsp. paratuberculosis
cagcgccggaccg

SEQ ID NO: 2817769 - RNA, 23 nt, Mycobacterium avium subsp. paratuberculosis
cagcgccggaccgauccggcgcc

SEQ ID NO: 2817770 - RNA, 13 nt, Mycobacterium avium subsp. paratuberculosis
cagcgccggcacc

SEQ ID NO: 2817771 - RNA, 14 nt, Mycobacterium avium subsp. paratuberculosis
cagcgccggcacca

SEQ ID NO: 2817772 - RNA, 17 nt, Mycobacterium avium subsp. paratuberculosis
cagcgccggcaccagca

SEQ ID NO: 2817773 - RNA, 18 nt, Mycobacterium avium subsp. paratuberculosis
cagcgccggcaccagcag

SEQ ID NO: 2817774 - RNA, 21 nt, Mycobacterium avium subsp. paratuberculosis
cagcgccggcaccagcagccg

SEQ ID NO: 2817775 - RNA, 15 nt, Mycobacterium avium subsp. paratuberculosis
cagcgccggcagcaa

SEQ ID NO: 2817776 - RNA, 14 nt, Mycobacterium avium subsp. paratuberculosis
cagcgccggcagcg

SEQ ID NO: 2817777 - RNA, 17 nt, Mycobacterium avium subsp. paratuberculosis
cagcgccggcagcgccu

SEQ ID NO: 2817778 - RNA, 13 nt, Mycobacterium avium subsp. paratuberculosis
cagcgccgucauc

SEQ ID NO: 2817779 - RNA, 16 nt, Mycobacterium avium subsp. paratuberculosis
cagcgccgucaucacc

SEQ ID NO: 2817780 - RNA, 20 nt, Mycobacterium avium subsp. paratuberculosis
cagcgccgucaucaccgccg

SEQ ID NO: 2817781 - RNA, 21 nt, Mycobacterium avium subsp. paratuberculosis
cagcgccgucaucaccgccga

SEQ ID NO: 2817782 - RNA, 19 nt, Mycobacterium avium subsp. paratuberculosis
cagcgccguccgcaccgcg

SEQ ID NO: 2817783 - RNA, 20 nt, Mycobacterium avium subsp. paratuberculosis
cagcgccguccgcaccgcga

SEQ ID NO: 2817784 - RNA, 22 nt, Mycobacterium avium subsp. paratuberculosis
cagcgccgucuccucgaccagc

SEQ ID NO: 2817785 - RNA, 23 nt, Mycobacterium avium subsp. paratuberculosis
cagcgccgucuccucgaccagcg

SEQ ID NO: 2817786 - RNA, 19 nt, Mycobacterium avium subsp. paratuberculosis
cagcgccgucucgacccgg

SEQ ID NO: 2817787 - RNA, 20 nt, Mycobacterium avium subsp. paratuberculosis
cagcgccgucucgacccggg

SEQ ID NO: 2817788 - RNA, 24 nt, Mycobacterium avium subsp. paratuberculosis
cagcgccgucucgacccgggccag

SEQ ID NO: 2817789 - RNA, 16 nt, Mycobacterium avium subsp. paratuberculosis
cagcgccguggcccgg

SEQ ID NO: 2817790 - RNA, 18 nt, Mycobacterium avium subsp. paratuberculosis
cagcgccguggcccgguc

SEQ ID NO: 2817791 - RNA, 20 nt, Mycobacterium avium subsp. paratuberculosis
cagcgccguggcccggucgg

SEQ ID NO: 2817792 - RNA, 11 nt, Mycobacterium avium subsp. paratuberculosis
cagcgccucca

SEQ ID NO: 2817793 - RNA, 13 nt, Mycobacterium avium subsp. paratuberculosis
cagcgccuccagc

SEQ ID NO: 2817794 - RNA, 15 nt, Mycobacterium avium subsp. paratuberculosis
cagcgccuccagccg

SEQ ID NO: 2817795 - RNA, 20 nt, Mycobacterium avium subsp. paratuberculosis
cagcgccuccagccgcuccu

SEQ ID NO: 2817796 - RNA, 15 nt, Mycobacterium avium subsp. paratuberculosis
cagcgccucccggac

SEQ ID NO: 2817797 - RNA, 16 nt, Mycobacterium avium subsp. paratuberculosis
cagcgccucgagcacc

SEQ ID NO: 2817798 - RNA, 18 nt, Mycobacterium avium subsp. paratuberculosis
cagcgccucgagcaccac

SEQ ID NO: 2817799 - RNA, 21 nt, Mycobacterium avium subsp. paratuberculosis
cagcgccucgagcaccacggc

SEQ ID NO: 2817800 - RNA, 14 nt, Mycobacterium avium subsp. paratuberculosis
cagcgccucgccgg

SEQ ID NO: 2817801 - RNA, 16 nt, Mycobacterium avium subsp. paratuberculosis
cagcgccucgccgggc

SEQ ID NO: 2817802 - RNA, 14 nt, Mycobacterium avium subsp. paratuberculosis
cagcgccucgcggu

SEQ ID NO: 2817803 - RNA, 15 nt, Mycobacterium avium subsp. paratuberculosis
cagcgccucgcgguc

SEQ ID NO: 2817804 - RNA, 17 nt, Mycobacterium avium subsp. paratuberculosis
cagcgccucgcggucga

SEQ ID NO: 2817805 - RNA, 21 nt, Mycobacterium avium subsp. paratuberculosis
cagcgccucgcuaaucgccgc

SEQ ID NO: 2817806 - RNA, 17 nt, Mycobacterium avium subsp. paratuberculosis
cagcgccucggccucgu

SEQ ID NO: 2817807 - RNA, 21 nt, Mycobacterium avium subsp. paratuberculosis
cagcgccucggccucgucgac

SEQ ID NO: 2817808 - RNA, 14 nt, Mycobacterium avium subsp. paratuberculosis
cagcgccucggcgg

SEQ ID NO: 2817809 - RNA, 15 nt, Mycobacterium avium subsp. paratuberculosis
cagcgccucggcggc

SEQ ID NO: 2817810 - RNA, 16 nt, Mycobacterium avium subsp. paratuberculosis
cagcgccucggcgggc

SEQ ID NO: 2817811 - RNA, 14 nt, Mycobacterium avium subsp. paratuberculosis
cagcgccucggcgu

SEQ ID NO: 2817812 - RNA, 16 nt, Mycobacterium avium subsp. paratuberculosis
cagcgccucggcguca

SEQ ID NO: 2817813 - RNA, 18 nt, Mycobacterium avium subsp. paratuberculosis
cagcgccucggcgucacc

SEQ ID NO: 2817814 - RNA, 23 nt, Mycobacterium avium subsp. paratuberculosis
cagcgccucggcgucaccgcggg

SEQ ID NO: 2817815 - RNA, 23 nt, Mycobacterium avium subsp. paratuberculosis
cagcgccucggugaagccgcgga

SEQ ID NO: 2817816 - RNA, 15 nt, Mycobacterium avium subsp. paratuberculosis
cagcgccucgucgag

SEQ ID NO: 2817817 - RNA, 20 nt, Mycobacterium avium subsp. paratuberculosis
cagcgccucgucgagccggg

SEQ ID NO: 2817818 - RNA, 22 nt, Mycobacterium avium subsp. paratuberculosis
cagcgccucgucgagccgggcc

SEQ ID NO: 2817819 - RNA, 15 nt, Mycobacterium avium subsp. paratuberculosis
cagcgccugcccgga

SEQ ID NO: 2817820 - RNA, 15 nt, Mycobacterium avium subsp. paratuberculosis
cagcgccugcugcca

SEQ ID NO: 2817821 - RNA, 19 nt, Mycobacterium avium subsp. paratuberculosis
cagcgccugguccucccgg

SEQ ID NO: 2817822 - RNA, 19 nt, Mycobacterium avium subsp. paratuberculosis
cagcgccuucggcgccagc

SEQ ID NO: 2817823 - RNA, 22 nt, Mycobacterium avium subsp. paratuberculosis
cagcgccuucggcgccagcccg

SEQ ID NO: 2817824 - RNA, 17 nt, Mycobacterium avium subsp. paratuberculosis
cagcgccuucuccagcu

SEQ ID NO: 2817825 - RNA, 20 nt, Mycobacterium avium subsp. paratuberculosis
cagcgccuucuccagcuccu

SEQ ID NO: 2817826 - RNA, 13 nt, Mycobacterium avium subsp. paratuberculosis
cagcgccuugacc

SEQ ID NO: 2817827 - RNA, 15 nt, Mycobacterium avium subsp. paratuberculosis
cagcgccuugccgac

SEQ ID NO: 2817828 - RNA, 16 nt, Mycobacterium avium subsp. paratuberculosis
cagcgccuugccgacg

SEQ ID NO: 2817829 - RNA, 17 nt, Mycobacterium avium subsp. paratuberculosis
cagcgccuugccgacga

SEQ ID NO: 2817830 - RNA, 19 nt, Mycobacterium avium subsp. paratuberculosis
cagcgccuugccgacgacg

SEQ ID NO: 2817831 - RNA, 22 nt, Mycobacterium avium subsp. paratuberculosis
cagcgccuugccgacgacgucg

SEQ ID NO: 2817832 - RNA, 15 nt, Mycobacterium avium subsp. paratuberculosis
cagcgccuugggucc

SEQ ID NO: 2817833 - RNA, 18 nt, Mycobacterium avium subsp. paratuberculosis
cagcgcgccggccagcag

SEQ ID NO: 2817834 - RNA, 14 nt, Mycobacterium avium subsp. paratuberculosis
cagcgcgccggccg

SEQ ID NO: 2817835 - RNA, 15 nt, Mycobacterium avium subsp. paratuberculosis
cagcgcgccggccgg

SEQ ID NO: 2817836 - RNA, 16 nt, Mycobacterium avium subsp. paratuberculosis
cagcgcgccggccggc

SEQ ID NO: 2817837 - RNA, 18 nt, Mycobacterium avium subsp. paratuberculosis
cagcgcgccggccggcac

SEQ ID NO: 2817838 - RNA, 20 nt, Mycobacterium avium subsp. paratuberculosis
cagcgcgccggccggcacga

SEQ ID NO: 2817839 - RNA, 12 nt, Mycobacterium avium subsp. paratuberculosis
cagcgcgccguc

SEQ ID NO: 2817840 - RNA, 19 nt, Mycobacterium avium subsp. paratuberculosis
cagcgcgcgagacaccucg

SEQ ID NO: 2817841 - RNA, 14 nt, Mycobacterium avium subsp. paratuberculosis
cagcgcgcgaucag

SEQ ID NO: 2817842 - RNA, 20 nt, Mycobacterium avium subsp. paratuberculosis
cagcgcgcgaucagcgccgu

SEQ ID NO: 2817843 - RNA, 21 nt, Mycobacterium avium subsp. paratuberculosis
cagcgcgcgaucagcgccguc

SEQ ID NO: 2817844 - RNA, 20 nt, Mycobacterium avium subsp. paratuberculosis
cagcgcgcgaucgccggugc

SEQ ID NO: 2817845 - RNA, 13 nt, Mycobacterium avium subsp. paratuberculosis
cagcgcgcgcagc

SEQ ID NO: 2817846 - RNA, 14 nt, Mycobacterium avium subsp. paratuberculosis
cagcgcgcgcagcg

SEQ ID NO: 2817847 - RNA, 14 nt, Mycobacterium avium subsp. paratuberculosis
cagcgcgcggccca

SEQ ID NO: 2817848 - RNA, 12 nt, Mycobacterium avium subsp. paratuberculosis
cagcgcgcggcg

SEQ ID NO: 2817849 - RNA, 15 nt, Mycobacterium avium subsp. paratuberculosis
cagcgcgcggcgcag

SEQ ID NO: 2817850 - RNA, 20 nt, Mycobacterium avium subsp. paratuberculosis
cagcgcgcgggcgcgcgccg

SEQ ID NO: 2817851 - RNA, 21 nt, Mycobacterium avium subsp. paratuberculosis
cagcgcgcgggcguccucguc

SEQ ID NO: 2817852 - RNA, 20 nt, Mycobacterium avium subsp. paratuberculosis
cagcgcgcggugcgccagcg

SEQ ID NO: 2817853 - RNA, 16 nt, Mycobacterium avium subsp. paratuberculosis
cagcgcggacaccagg

SEQ ID NO: 2817854 - RNA, 17 nt, Mycobacterium avium subsp. paratuberculosis
cagcgcggauuccagcg

SEQ ID NO: 2817855 - RNA, 19 nt, Mycobacterium avium subsp. paratuberculosis
cagcgcggauuccagcgcg

SEQ ID NO: 2817856 - RNA, 18 nt, Mycobacterium avium subsp. paratuberculosis
cagcgcggcauggcuggc

SEQ ID NO: 2817857 - RNA, 15 nt, Mycobacterium avium subsp. paratuberculosis
cagcgcggccacacc

SEQ ID NO: 2817858 - RNA, 15 nt, Mycobacterium avium subsp. paratuberculosis
cagcgcggccaccac

SEQ ID NO: 2817859 - RNA, 20 nt, Mycobacterium avium subsp. paratuberculosis
cagcgcggccaccaccacgg

SEQ ID NO: 2817860 - RNA, 22 nt, Mycobacterium avium subsp. paratuberculosis
cagcgcggccaccaccacggcc

SEQ ID NO: 2817861 - RNA, 23 nt, Mycobacterium avium subsp. paratuberculosis
cagcgcggccaccaccacggcca

SEQ ID NO: 2817862 - RNA, 17 nt, Mycobacterium avium subsp. paratuberculosis
cagcgcggccaccacga

SEQ ID NO: 2817863 - RNA, 20 nt, Mycobacterium avium subsp. paratuberculosis
cagcgcggccaccacgacgg

SEQ ID NO: 2817864 - RNA, 14 nt, Mycobacterium avium subsp. paratuberculosis
cagcgcggccaccu

SEQ ID NO: 2817865 - RNA, 19 nt, Mycobacterium avium subsp. paratuberculosis
cagcgcggccaccuccagc

SEQ ID NO: 2817866 - RNA, 14 nt, Mycobacterium avium subsp. paratuberculosis
cagcgcggccagca

SEQ ID NO: 2817867 - RNA, 15 nt, Mycobacterium avium subsp. paratuberculosis
cagcgcggccagcac

SEQ ID NO: 2817868 - RNA, 13 nt, Mycobacterium avium subsp. paratuberculosis
cagcgcggcccgc

SEQ ID NO: 2817869 - RNA, 16 nt, Mycobacterium avium subsp. paratuberculosis
cagcgcggcccgcggc

SEQ ID NO: 2817870 - RNA, 17 nt, Mycobacterium avium subsp. paratuberculosis
cagcgcggcccgcggcg

SEQ ID NO: 2817871 - RNA, 18 nt, Mycobacterium avium subsp. paratuberculosis
cagcgcggcccgcggcgu

SEQ ID NO: 2817872 - RNA, 12 nt, Mycobacterium avium subsp. paratuberculosis
cagcgcggccgg

SEQ ID NO: 2817873 - RNA, 18 nt, Mycobacterium avium subsp. paratuberculosis
cagcgcggccggaagacc

SEQ ID NO: 2817874 - RNA, 14 nt, Mycobacterium avium subsp. paratuberculosis
cagcgcggccgggc

SEQ ID NO: 2817875 - RNA, 15 nt, Mycobacterium avium subsp. paratuberculosis
cagcgcggccgggcg

SEQ ID NO: 2817876 - RNA, 16 nt, Mycobacterium avium subsp. paratuberculosis
cagcgcggccgggcgc

SEQ ID NO: 2817877 - RNA, 22 nt, Mycobacterium avium subsp. paratuberculosis
cagcgcggccgggcgccccgac

SEQ ID NO: 2817878 - RNA, 22 nt, Mycobacterium avium subsp. paratuberculosis
cagcgcggcgacauuggccgcg

SEQ ID NO: 2817879 - RNA, 23 nt, Mycobacterium avium subsp. paratuberculosis
cagcgcggcgacauuggccgcgc

SEQ ID NO: 2817880 - RNA, 13 nt, Mycobacterium avium subsp. paratuberculosis
cagcgcggcgauc

SEQ ID NO: 2817881 - RNA, 14 nt, Mycobacterium avium subsp. paratuberculosis
cagcgcggcgauca

SEQ ID NO: 2817882 - RNA, 18 nt, Mycobacterium avium subsp. paratuberculosis
cagcgcggcgaucagcag

SEQ ID NO: 2817883 - RNA, 22 nt, Mycobacterium avium subsp. paratuberculosis
cagcgcggcgaucagcugcucg

SEQ ID NO: 2817884 - RNA, 22 nt, Mycobacterium avium subsp. paratuberculosis
cagcgcggcgaucucggcggcc

SEQ ID NO: 2817885 - RNA, 23 nt, Mycobacterium avium subsp. paratuberculosis
cagcgcggcgaucucggcggccg

SEQ ID NO: 2817886 - RNA, 14 nt, Mycobacterium avium subsp. paratuberculosis
cagcgcggcgauga

SEQ ID NO: 2817887 - RNA, 20 nt, Mycobacterium avium subsp. paratuberculosis
cagcgcggcgaugaccgccu

SEQ ID NO: 2817888 - RNA, 22 nt, Mycobacterium avium subsp. paratuberculosis
cagcgcggcgaugaccgccugc

SEQ ID NO: 2817889 - RNA, 12 nt, Mycobacterium avium subsp. paratuberculosis
cagcgcggcgga

SEQ ID NO: 2817890 - RNA, 14 nt, Mycobacterium avium subsp. paratuberculosis
cagcgcggcggcca

SEQ ID NO: 2817891 - RNA, 17 nt, Mycobacterium avium subsp. paratuberculosis
cagcgcggcggccagcu

SEQ ID NO: 2817892 - RNA, 15 nt, Mycobacterium avium subsp. paratuberculosis
cagcgcggcggcgcc

SEQ ID NO: 2817893 - RNA, 18 nt, Mycobacterium avium subsp. paratuberculosis
cagcgcggcggcgccguc

SEQ ID NO: 2817894 - RNA, 19 nt, Mycobacterium avium subsp. paratuberculosis
cagcgcggcggcgccgucg

SEQ ID NO: 2817895 - RNA, 13 nt, Mycobacterium avium subsp. paratuberculosis
cagcgcggcgggc

SEQ ID NO: 2817896 - RNA, 15 nt, Mycobacterium avium subsp. paratuberculosis
cagcgcggcgggcca

SEQ ID NO: 2817897 - RNA, 20 nt, Mycobacterium avium subsp. paratuberculosis
cagcgcggcggugagccgcc

SEQ ID NO: 2817898 - RNA, 15 nt, Mycobacterium avium subsp. paratuberculosis
cagcgcggcgucacc

SEQ ID NO: 2817899 - RNA, 19 nt, Mycobacterium avium subsp. paratuberculosis
cagcgcggcguucagcagc

SEQ ID NO: 2817900 - RNA, 16 nt, Mycobacterium avium subsp. paratuberculosis
cagcgcgggccagcag

SEQ ID NO: 2817901 - RNA, 17 nt, Mycobacterium avium subsp. paratuberculosis
cagcgcgggccagcagu

SEQ ID NO: 2817902 - RNA, 20 nt, Mycobacterium avium subsp. paratuberculosis
cagcgcggggggagggucgg

SEQ ID NO: 2817903 - RNA, 17 nt, Mycobacterium avium subsp. paratuberculosis
cagcgcggggucggcca

SEQ ID NO: 2817904 - RNA, 23 nt, Mycobacterium avium subsp. paratuberculosis
cagcgcgguaaagucuucggcga

SEQ ID NO: 2817905 - RNA, 11 nt, Mycobacterium avium subsp. paratuberculosis
cagcgcgguca

SEQ ID NO: 2817906 - RNA, 16 nt, Mycobacterium avium subsp. paratuberculosis
cagcgcggucaaaccc

SEQ ID NO: 2817907 - RNA, 17 nt, Mycobacterium avium subsp. paratuberculosis
cagcgcggucaacaccg

SEQ ID NO: 2817908 - RNA, 18 nt, Mycobacterium avium subsp. paratuberculosis
cagcgcggucaacaccgg

SEQ ID NO: 2817909 - RNA, 19 nt, Mycobacterium avium subsp. paratuberculosis
cagcgcggucaacaccggg

SEQ ID NO: 2817910 - RNA, 20 nt, Mycobacterium avium subsp. paratuberculosis
cagcgcggucaacaccggga

SEQ ID NO: 2817911 - RNA, 22 nt, Mycobacterium avium subsp. paratuberculosis
cagcgcggucaacaccgggauc

SEQ ID NO: 2817912 - RNA, 15 nt, Mycobacterium avium subsp. paratuberculosis
cagcgcggucagccc

SEQ ID NO: 2817913 - RNA, 16 nt, Mycobacterium avium subsp. paratuberculosis
cagcgcggucagcccg

SEQ ID NO: 2817914 - RNA, 17 nt, Mycobacterium avium subsp. paratuberculosis
cagcgcggucagcccgc

SEQ ID NO: 2817915 - RNA, 23 nt, Mycobacterium avium subsp. paratuberculosis
cagcgcggucucgaucugcacca

SEQ ID NO: 2817916 - RNA, 20 nt, Mycobacterium avium subsp. paratuberculosis
cagcgcggugaagucggugc

SEQ ID NO: 2817917 - RNA, 23 nt, Mycobacterium avium subsp. paratuberculosis
cagcgcggugaagucggugccca

SEQ ID NO: 2817918 - RNA, 17 nt, Mycobacterium avium subsp. paratuberculosis
cagcggaaucgcccggg

SEQ ID NO: 2817919 - RNA, 20 nt, Mycobacterium avium subsp. paratuberculosis
cagcggaaugaacgcggcca

SEQ ID NO: 2817920 - RNA, 23 nt, Mycobacterium avium subsp. paratuberculosis
cagcggaaugaacgcggccaggg

SEQ ID NO: 2817921 - RNA, 20 nt, Mycobacterium avium subsp. paratuberculosis
cagcggacccggucggccgc

SEQ ID NO: 2817922 - RNA, 22 nt, Mycobacterium avium subsp. paratuberculosis
cagcggacccggucggccgcgu

SEQ ID NO: 2817923 - RNA, 19 nt, Mycobacterium avium subsp. paratuberculosis
cagcggacccuucagccag

SEQ ID NO: 2817924 - RNA, 22 nt, Mycobacterium avium subsp. paratuberculosis
cagcggagcguucuccacccgc

SEQ ID NO: 2817925 - RNA, 18 nt, Mycobacterium avium subsp. paratuberculosis
cagcggauagaggcggcg

SEQ ID NO: 2817926 - RNA, 19 nt, Mycobacterium avium subsp. paratuberculosis
cagcggauagaggcggcgc

SEQ ID NO: 2817927 - RNA, 16 nt, Mycobacterium avium subsp. paratuberculosis
cagcggaucggccugg

SEQ ID NO: 2817928 - RNA, 13 nt, Mycobacterium avium subsp. paratuberculosis
cagcggaucggcg

SEQ ID NO: 2817929 - RNA, 19 nt, Mycobacterium avium subsp. paratuberculosis
cagcggaugccggaggcgc

SEQ ID NO: 2817930 - RNA, 21 nt, Mycobacterium avium subsp. paratuberculosis
cagcggaugccggaggcgccg

SEQ ID NO: 2817931 - RNA, 16 nt, Mycobacterium avium subsp. paratuberculosis
cagcggcaacacgccg

SEQ ID NO: 2817932 - RNA, 15 nt, Mycobacterium avium subsp. paratuberculosis
cagcggcaccaaccc

SEQ ID NO: 2817933 - RNA, 14 nt, Mycobacterium avium subsp. paratuberculosis
cagcggcacccggu

SEQ ID NO: 2817934 - RNA, 15 nt, Mycobacterium avium subsp. paratuberculosis
cagcggcacccgguc

SEQ ID NO: 2817935 - RNA, 22 nt, Mycobacterium avium subsp. paratuberculosis
cagcggcacccgguccggcccg

SEQ ID NO: 2817936 - RNA, 16 nt, Mycobacterium avium subsp. paratuberculosis
cagcggcaccgucacc

SEQ ID NO: 2817937 - RNA, 17 nt, Mycobacterium avium subsp. paratuberculosis
cagcggcaccgucaccg

SEQ ID NO: 2817938 - RNA, 21 nt, Mycobacterium avium subsp. paratuberculosis
cagcggcacgggcaccgacga

SEQ ID NO: 2817939 - RNA, 14 nt, Mycobacterium avium subsp. paratuberculosis
cagcggcacgucgc

SEQ ID NO: 2817940 - RNA, 16 nt, Mycobacterium avium subsp. paratuberculosis
cagcggcacgucgccg

SEQ ID NO: 2817941 - RNA, 13 nt, Mycobacterium avium subsp. paratuberculosis
cagcggcagcacg

SEQ ID NO: 2817942 - RNA, 16 nt, Mycobacterium avium subsp. paratuberculosis
cagcggcagcacgucc

SEQ ID NO: 2817943 - RNA, 14 nt, Mycobacterium avium subsp. paratuberculosis
cagcggcagcagca

SEQ ID NO: 2817944 - RNA, 16 nt, Mycobacterium avium subsp. paratuberculosis
cagcggcagcagcacc

SEQ ID NO: 2817945 - RNA, 17 nt, Mycobacterium avium subsp. paratuberculosis
cagcggcagcagcacca

SEQ ID NO: 2817946 - RNA, 23 nt, Mycobacterium avium subsp. paratuberculosis
cagcggcagcgacagcgcgucgg

SEQ ID NO: 2817947 - RNA, 17 nt, Mycobacterium avium subsp. paratuberculosis
cagcggcagcggcgucg

SEQ ID NO: 2817948 - RNA, 14 nt, Mycobacterium avium subsp. paratuberculosis
cagcggcagcgucg

SEQ ID NO: 2817949 - RNA, 17 nt, Mycobacterium avium subsp. paratuberculosis
cagcggcagcgucgggc

SEQ ID NO: 2817950 - RNA, 13 nt, Mycobacterium avium subsp. paratuberculosis
cagcggcaggucc

SEQ ID NO: 2817951 - RNA, 19 nt, Mycobacterium avium subsp. paratuberculosis
cagcggcaggucccaggcc

SEQ ID NO: 2817952 - RNA, 18 nt, Mycobacterium avium subsp. paratuberculosis
cagcggcaggucgucguc

SEQ ID NO: 2817953 - RNA, 13 nt, Mycobacterium avium subsp. paratuberculosis
cagcggcaggugc

SEQ ID NO: 2817954 - RNA, 20 nt, Mycobacterium avium subsp. paratuberculosis
cagcggcaguagcgcaccgg

SEQ ID NO: 2817955 - RNA, 21 nt, Mycobacterium avium subsp. paratuberculosis
cagcggcaguagcgcaccggu

SEQ ID NO: 2817956 - RNA, 17 nt, Mycobacterium avium subsp. paratuberculosis
cagcggcaucccuuccu

SEQ ID NO: 2817957 - RNA, 17 nt, Mycobacterium avium subsp. paratuberculosis
cagcggcaucgaggacc

SEQ ID NO: 2817958 - RNA, 20 nt, Mycobacterium avium subsp. paratuberculosis
cagcggcaucgccgccaagg

SEQ ID NO: 2817959 - RNA, 17 nt, Mycobacterium avium subsp. paratuberculosis
cagcggcaugcccccga

SEQ ID NO: 2817960 - RNA, 22 nt, Mycobacterium avium subsp. paratuberculosis
cagcggcauggcgaugaccagc

SEQ ID NO: 2817961 - RNA, 20 nt, Mycobacterium avium subsp. paratuberculosis
cagcggccacaccggggcca

SEQ ID NO: 2817962 - RNA, 14 nt, Mycobacterium avium subsp. paratuberculosis
cagcggccagcccg

SEQ ID NO: 2817963 - RNA, 22 nt, Mycobacterium avium subsp. paratuberculosis
cagcggccagcccgcggcagcc

SEQ ID NO: 2817964 - RNA, 15 nt, Mycobacterium avium subsp. paratuberculosis
cagcggccaucgccg

SEQ ID NO: 2817965 - RNA, 16 nt, Mycobacterium avium subsp. paratuberculosis
cagcggccaucgccgc

SEQ ID NO: 2817966 - RNA, 18 nt, Mycobacterium avium subsp. paratuberculosis
cagcggccaucgccgcca

SEQ ID NO: 2817967 - RNA, 20 nt, Mycobacterium avium subsp. paratuberculosis
cagcggcccaccgcgacccg

SEQ ID NO: 2817968 - RNA, 21 nt, Mycobacterium avium subsp. paratuberculosis
cagcggccccccgcacaccgg

SEQ ID NO: 2817969 - RNA, 14 nt, Mycobacterium avium subsp. paratuberculosis
cagcggccccggcu

SEQ ID NO: 2817970 - RNA, 19 nt, Mycobacterium avium subsp. paratuberculosis
cagcggccccggcucgggc

SEQ ID NO: 2817971 - RNA, 16 nt, Mycobacterium avium subsp. paratuberculosis
cagcggcccgaacacc

SEQ ID NO: 2817972 - RNA, 12 nt, Mycobacterium avium subsp. paratuberculosis
cagcggcccgau

SEQ ID NO: 2817973 - RNA, 20 nt, Mycobacterium avium subsp. paratuberculosis
cagcggcccgaucaccaggc

SEQ ID NO: 2817974 - RNA, 17 nt, Mycobacterium avium subsp. paratuberculosis
cagcggcccgaucaccg

SEQ ID NO: 2817975 - RNA, 18 nt, Mycobacterium avium subsp. paratuberculosis
cagcggcccgaucaccgc

SEQ ID NO: 2817976 - RNA, 20 nt, Mycobacterium avium subsp. paratuberculosis
cagcggcccgaucaccgccg

SEQ ID NO: 2817977 - RNA, 16 nt, Mycobacterium avium subsp. paratuberculosis
cagcggcccgcugugg

SEQ ID NO: 2817978 - RNA, 13 nt, Mycobacterium avium subsp. paratuberculosis
cagcggccgauca

SEQ ID NO: 2817979 - RNA, 23 nt, Mycobacterium avium subsp. paratuberculosis
cagcggccgaucauggucggcga

SEQ ID NO: 2817980 - RNA, 13 nt, Mycobacterium avium subsp. paratuberculosis
cagcggccgcagc

SEQ ID NO: 2817981 - RNA, 14 nt, Mycobacterium avium subsp. paratuberculosis
cagcggccgcagcg

SEQ ID NO: 2817982 - RNA, 17 nt, Mycobacterium avium subsp. paratuberculosis
cagcggccgcagcgcga

SEQ ID NO: 2817983 - RNA, 13 nt, Mycobacterium avium subsp. paratuberculosis
cagcggccggaac

SEQ ID NO: 2817984 - RNA, 19 nt, Mycobacterium avium subsp. paratuberculosis
cagcggccggaacagcugg

SEQ ID NO: 2817985 - RNA, 16 nt, Mycobacterium avium subsp. paratuberculosis
cagcggccggcgcagc

SEQ ID NO: 2817986 - RNA, 17 nt, Mycobacterium avium subsp. paratuberculosis
cagcggccggcgcagcc

SEQ ID NO: 2817987 - RNA, 18 nt, Mycobacterium avium subsp. paratuberculosis
cagcggccggcgcagccg

SEQ ID NO: 2817988 - RNA, 16 nt, Mycobacterium avium subsp. paratuberculosis
cagcggccgucgccgg

SEQ ID NO: 2817989 - RNA, 18 nt, Mycobacterium avium subsp. paratuberculosis
cagcggccgucgccgggc

SEQ ID NO: 2817990 - RNA, 19 nt, Mycobacterium avium subsp. paratuberculosis
cagcggccgucgcgcagcc

SEQ ID NO: 2817991 - RNA, 19 nt, Mycobacterium avium subsp. paratuberculosis
cagcggccuaugcgcccgg

SEQ ID NO: 2817992 - RNA, 18 nt, Mycobacterium avium subsp. paratuberculosis
cagcggccucggaagggc

SEQ ID NO: 2817993 - RNA, 13 nt, Mycobacterium avium subsp. paratuberculosis
cagcggcgacagc

SEQ ID NO: 2817994 - RNA, 17 nt, Mycobacterium avium subsp. paratuberculosis
cagcggcgcaccguguc

SEQ ID NO: 2817995 - RNA, 12 nt, Mycobacterium avium subsp. paratuberculosis
cagcggcgccac

SEQ ID NO: 2817996 - RNA, 15 nt, Mycobacterium avium subsp. paratuberculosis
cagcggcgccaccgg

SEQ ID NO: 2817997 - RNA, 12 nt, Mycobacterium avium subsp. paratuberculosis
cagcggcgccca

SEQ ID NO: 2817998 - RNA, 13 nt, Mycobacterium avium subsp. paratuberculosis
cagcggcgcccac

SEQ ID NO: 2817999 - RNA, 16 nt, Mycobacterium avium subsp. paratuberculosis
cagcggcgcccacggc

SEQ ID NO: 2818000 - RNA, 21 nt, Mycobacterium avium subsp. paratuberculosis
cagcggcgcccacggccacca

SEQ ID NO: 2818001 - RNA, 14 nt, Mycobacterium avium subsp. paratuberculosis
cagcggcgccggga

SEQ ID NO: 2818002 - RNA, 14 nt, Mycobacterium avium subsp. paratuberculosis
cagcggcgccgggu

SEQ ID NO: 2818003 - RNA, 15 nt, Mycobacterium avium subsp. paratuberculosis
cagcggggugcccac

SEQ ID NO: 2818004 - RNA, 17 nt, Mycobacterium avium subsp. paratuberculosis
cagcggggugcccacca

SEQ ID NO: 2818005 - RNA, 20 nt, Mycobacterium avium subsp. paratuberculosis
cagcggggugcccaccaccu

SEQ ID NO: 2818006 - RNA, 20 nt, Mycobacterium avium subsp. paratuberculosis
cagcggggugugcucggcgg

SEQ ID NO: 2818007 - RNA, 22 nt, Mycobacterium avium subsp. paratuberculosis
cagcggggugugcucggcggcg

SEQ ID NO: 2818008 - RNA, 15 nt, Mycobacterium avium subsp. paratuberculosis
cagcggguccagccg

SEQ ID NO: 2818009 - RNA, 16 nt, Mycobacterium avium subsp. paratuberculosis
cagcggguccagccgc

SEQ ID NO: 2818010 - RNA, 19 nt, Mycobacterium avium subsp. paratuberculosis
cagcggguccagccgccgg

SEQ ID NO: 2818011 - RNA, 21 nt, Mycobacterium avium subsp. paratuberculosis
cagcggguccagccgccggcg

SEQ ID NO: 2818012 - RNA, 16 nt, Mycobacterium avium subsp. paratuberculosis
cagcgggucgauggcg

SEQ ID NO: 2818013 - RNA, 14 nt, Mycobacterium avium subsp. paratuberculosis
cagcgggucgucgg

SEQ ID NO: 2818014 - RNA, 21 nt, Mycobacterium avium subsp. paratuberculosis
cagcgggucgucgggccgggg

SEQ ID NO: 2818015 - RNA, 20 nt, Mycobacterium avium subsp. paratuberculosis
cagcgggucgugcaucggcg

SEQ ID NO: 2818016 - RNA, 18 nt, Mycobacterium avium subsp. paratuberculosis
cagcgggucguuggcggc

SEQ ID NO: 2818017 - RNA, 20 nt, Mycobacterium avium subsp. paratuberculosis
cagcgggucguuggcggcgg

SEQ ID NO: 2818018 - RNA, 14 nt, Mycobacterium avium subsp. paratuberculosis
cagcgggugauggc

SEQ ID NO: 2818019 - RNA, 20 nt, Mycobacterium avium subsp. paratuberculosis
cagcgggugauggccgccgc

SEQ ID NO: 2818020 - RNA, 21 nt, Mycobacterium avium subsp. paratuberculosis
cagcgggugauggccgccgca

SEQ ID NO: 2818021 - RNA, 22 nt, Mycobacterium avium subsp. paratuberculosis
cagcgggugauggccgccgcag

SEQ ID NO: 2818022 - RNA, 23 nt, Mycobacterium avium subsp. paratuberculosis
cagcggguucuucagggcggugc

SEQ ID NO: 2818023 - RNA, 19 nt, Mycobacterium avium subsp. paratuberculosis
cagcggguugccgcuggcg

SEQ ID NO: 2818024 - RNA, 22 nt, Mycobacterium avium subsp. paratuberculosis
cagcggguugucgucgucggcg

SEQ ID NO: 2818025 - RNA, 23 nt, Mycobacterium avium subsp. paratuberculosis
cagcggguugucgucgucggcga

SEQ ID NO: 2818026 - RNA, 20 nt, Mycobacterium avium subsp. paratuberculosis
cagcggguuguucuccagcg

SEQ ID NO: 2818027 - RNA, 19 nt, Mycobacterium avium subsp. paratuberculosis
cagcggguuuggccgcggg

SEQ ID NO: 2818028 - RNA, 17 nt, Mycobacterium avium subsp. paratuberculosis
cagcgguaaccacccgu

SEQ ID NO: 2818029 - RNA, 18 nt, Mycobacterium avium subsp. paratuberculosis
cagcggucacggacaggu

SEQ ID NO: 2818030 - RNA, 15 nt, Mycobacterium avium subsp. paratuberculosis
cagcgguccacccga

SEQ ID NO: 2818031 - RNA, 20 nt, Mycobacterium avium subsp. paratuberculosis
cagcgguccagcgugaacgu

SEQ ID NO: 2818032 - RNA, 13 nt, Mycobacterium avium subsp. paratuberculosis
cagcggucggcgg

SEQ ID NO: 2818033 - RNA, 15 nt, Mycobacterium avium subsp. paratuberculosis
cagcggucggcggcu

SEQ ID NO: 2818034 - RNA, 16 nt, Mycobacterium avium subsp. paratuberculosis
cagcggugaucgcguc

SEQ ID NO: 2818035 - RNA, 17 nt, Mycobacterium avium subsp. paratuberculosis
cagcggugaucgcguca

SEQ ID NO: 2818036 - RNA, 18 nt, Mycobacterium avium subsp. paratuberculosis
cagcggugcagccccgca

SEQ ID NO: 2818037 - RNA, 14 nt, Mycobacterium avium subsp. paratuberculosis
cagcggugccgccc

SEQ ID NO: 2818038 - RNA, 16 nt, Mycobacterium avium subsp. paratuberculosis
cagcggugccgcccgg

SEQ ID NO: 2818039 - RNA, 20 nt, Mycobacterium avium subsp. paratuberculosis
cagcggugccgcccggaggg

SEQ ID NO: 2818040 - RNA, 18 nt, Mycobacterium avium subsp. paratuberculosis
cagcgguucggcgacgcu

SEQ ID NO: 2818041 - RNA, 20 nt, Mycobacterium avium subsp. paratuberculosis
cagcgguucggcgacgcugg

SEQ ID NO: 2818042 - RNA, 16 nt, Mycobacterium avium subsp. paratuberculosis
cagcgguugcacgguc

SEQ ID NO: 2818043 - RNA, 19 nt, Mycobacterium avium subsp. paratuberculosis
cagcgguuggcccuucgac

SEQ ID NO: 2818044 - RNA, 21 nt, Mycobacterium avium subsp. paratuberculosis
cagcgguuuggauggcccgcc

SEQ ID NO: 2818045 - RNA, 13 nt, Mycobacterium avium subsp. paratuberculosis
cagcgucaacggc

SEQ ID NO: 2818046 - RNA, 19 nt, Mycobacterium avium subsp. paratuberculosis
cagcgucaacucgucggcg

SEQ ID NO: 2818047 - RNA, 22 nt, Mycobacterium avium subsp. paratuberculosis
cagcgucaccaaugcgccggcg

SEQ ID NO: 2818048 - RNA, 24 nt, Mycobacterium avium subsp. paratuberculosis
cagcgucaccaaugcgccggcggc

SEQ ID NO: 2818049 - RNA, 13 nt, Mycobacterium avium subsp. paratuberculosis
cagcgucaccuuc

SEQ ID NO: 2818050 - RNA, 18 nt, Mycobacterium avium subsp. paratuberculosis
cagcgucacgucgacggc

SEQ ID NO: 2818051 - RNA, 20 nt, Mycobacterium avium subsp. paratuberculosis
cagcgucacgucgacggccg

SEQ ID NO: 2818052 - RNA, 14 nt, Mycobacterium avium subsp. paratuberculosis
cagcgucagcaccg

SEQ ID NO: 2818053 - RNA, 15 nt, Mycobacterium avium subsp. paratuberculosis
cagcgucagcaccgc

SEQ ID NO: 2818054 - RNA, 17 nt, Mycobacterium avium subsp. paratuberculosis
cagcgucagcaccgcga

SEQ ID NO: 2818055 - RNA, 23 nt, Mycobacterium avium subsp. paratuberculosis
cagcgucagcaccgcgacgguga

SEQ ID NO: 2818056 - RNA, 19 nt, Mycobacterium avium subsp. paratuberculosis
cagcgucagcaucgccguc

SEQ ID NO: 2818057 - RNA, 20 nt, Mycobacterium avium subsp. paratuberculosis
cagcgucagcaucgccgucg

SEQ ID NO: 2818058 - RNA, 22 nt, Mycobacterium avium subsp. paratuberculosis
cagcgucagcaucgccgucguc

SEQ ID NO: 2818059 - RNA, 15 nt, Mycobacterium avium subsp. paratuberculosis
cagcgucagccccga

SEQ ID NO: 2818060 - RNA, 17 nt, Mycobacterium avium subsp. paratuberculosis
cagcgucagccccgagu

SEQ ID NO: 2818061 - RNA, 23 nt, Mycobacterium avium subsp. paratuberculosis
cagcgucaggauguagagcggga

SEQ ID NO: 2818062 - RNA, 15 nt, Mycobacterium avium subsp. paratuberculosis
cagcgucagggcgac

SEQ ID NO: 2818063 - RNA, 16 nt, Mycobacterium avium subsp. paratuberculosis
cagcgucaggucaccg

SEQ ID NO: 2818064 - RNA, 20 nt, Mycobacterium avium subsp. paratuberculosis
cagcgucaucacgugcuggc

SEQ ID NO: 2818065 - RNA, 15 nt, Mycobacterium avium subsp. paratuberculosis
cagcguccacgaugc

SEQ ID NO: 2818066 - RNA, 16 nt, Mycobacterium avium subsp. paratuberculosis
cagcguccacgaugcg

SEQ ID NO: 2818067 - RNA, 19 nt, Mycobacterium avium subsp. paratuberculosis
cagcguccaguccggcgug

SEQ ID NO: 2818068 - RNA, 20 nt, Mycobacterium avium subsp. paratuberculosis
cagcguccaguccggcgugc

SEQ ID NO: 2818069 - RNA, 13 nt, Mycobacterium avium subsp. paratuberculosis
cagcguccgggcg

SEQ ID NO: 2818070 - RNA, 23 nt, Mycobacterium avium subsp. paratuberculosis
cagcguccgggcguagugcagcu

SEQ ID NO: 2818071 - RNA, 19 nt, Mycobacterium avium subsp. paratuberculosis
cagcgucgacugcaccgac

SEQ ID NO: 2818072 - RNA, 22 nt, Mycobacterium avium subsp. paratuberculosis
cagcgucgaguuguugggccga

SEQ ID NO: 2818073 - RNA, 19 nt, Mycobacterium avium subsp. paratuberculosis
cagcgucgauggaaggugc

SEQ ID NO: 2818074 - RNA, 21 nt, Mycobacterium avium subsp. paratuberculosis
cagcgucgauggaaggugcug

SEQ ID NO: 2818075 - RNA, 22 nt, Mycobacterium avium subsp. paratuberculosis
cagcgucgauggaaggugcuga

SEQ ID NO: 2818076 - RNA, 22 nt, Mycobacterium avium subsp. paratuberculosis
cagcgucgaugugggccgcagc

SEQ ID NO: 2818077 - RNA, 21 nt, Mycobacterium avium subsp. paratuberculosis
cagcgucgccaauccggcggg

SEQ ID NO: 2818078 - RNA, 22 nt, Mycobacterium avium subsp. paratuberculosis
cagcgucgccaauccggcgggc

SEQ ID NO: 2818079 - RNA, 14 nt, Mycobacterium avium subsp. paratuberculosis
cagcgucgccagcc

SEQ ID NO: 2818080 - RNA, 15 nt, Mycobacterium avium subsp. paratuberculosis
cagcgucgccagccg

SEQ ID NO: 2818081 - RNA, 20 nt, Mycobacterium avium subsp. paratuberculosis
cagcgucgccagccgccggc

SEQ ID NO: 2818082 - RNA, 21 nt, Mycobacterium avium subsp. paratuberculosis
cagcgucgccaugccgucgcg

SEQ ID NO: 2818083 - RNA, 13 nt, Mycobacterium avium subsp. paratuberculosis
cagcgucgccgac

SEQ ID NO: 2818084 - RNA, 15 nt, Mycobacterium avium subsp. paratuberculosis
cagcgucgccgacgg

SEQ ID NO: 2818085 - RNA, 17 nt, Mycobacterium avium subsp. paratuberculosis
cagcgucgccgacgggc

SEQ ID NO: 2818086 - RNA, 19 nt, Mycobacterium avium subsp. paratuberculosis
cagcgucgccgacgggccc

SEQ ID NO: 2818087 - RNA, 20 nt, Mycobacterium avium subsp. paratuberculosis
cagcguguugagcucgcggc

SEQ ID NO: 2818088 - RNA, 20 nt, Mycobacterium avium subsp. paratuberculosis
cagcguucacgucgaucacg

SEQ ID NO: 2818089 - RNA, 15 nt, Mycobacterium avium subsp. paratuberculosis
cagcguuccagcacc

SEQ ID NO: 2818090 - RNA, 17 nt, Mycobacterium avium subsp. paratuberculosis
cagcguuccagcacccg

SEQ ID NO: 2818091 - RNA, 22 nt, Mycobacterium avium subsp. paratuberculosis
cagcguuccagcacccggccca

SEQ ID NO: 2818092 - RNA, 16 nt, Mycobacterium avium subsp. paratuberculosis
cagcguuccggcggcc

SEQ ID NO: 2818093 - RNA, 18 nt, Mycobacterium avium subsp. paratuberculosis
cagcguuccggcggccgg

SEQ ID NO: 2818094 - RNA, 19 nt, Mycobacterium avium subsp. paratuberculosis
cagcguuccggcggccggc

SEQ ID NO: 2818095 - RNA, 18 nt, Mycobacterium avium subsp. paratuberculosis
cagcguuccgucggcgag

SEQ ID NO: 2818096 - RNA, 14 nt, Mycobacterium avium subsp. paratuberculosis
cagcguucgucgcc

SEQ ID NO: 2818097 - RNA, 16 nt, Mycobacterium avium subsp. paratuberculosis
cagcguuuccagcgcc

SEQ ID NO: 2818098 - RNA, 19 nt, Mycobacterium avium subsp. paratuberculosis
cagcguuuccagcgccggc

SEQ ID NO: 2818099 - RNA, 17 nt, Mycobacterium avium subsp. paratuberculosis
cagcguuuggccugcgg

SEQ ID NO: 2818100 - RNA, 17 nt, Mycobacterium avium subsp. paratuberculosis
cagcuaggaagccagcc

SEQ ID NO: 2818101 - RNA, 18 nt, Mycobacterium avium subsp. paratuberculosis
cagcuaggaagccagccg

SEQ ID NO: 2818102 - RNA, 19 nt, Mycobacterium avium subsp. paratuberculosis
cagcuaggaagccagccgu

SEQ ID NO: 2818103 - RNA, 22 nt, Mycobacterium avium subsp. paratuberculosis
cagcuaggaagccagccguccc

SEQ ID NO: 2818104 - RNA, 15 nt, Mycobacterium avium subsp. paratuberculosis
cagcuaggccagcag

SEQ ID NO: 2818105 - RNA, 17 nt, Mycobacterium avium subsp. paratuberculosis
cagcuaggccagcagcg

SEQ ID NO: 2818106 - RNA, 20 nt, Mycobacterium avium subsp. paratuberculosis
cagcuaggccagcagcgcgg

SEQ ID NO: 2818107 - RNA, 21 nt, Mycobacterium avium subsp. paratuberculosis
cagcuaggccagcagcgcggc

SEQ ID NO: 2818108 - RNA, 17 nt, Mycobacterium avium subsp. paratuberculosis
cagcucaccggccaggg

SEQ ID NO: 2818109 - RNA, 13 nt, Mycobacterium avium subsp. paratuberculosis
cagcucaccggga

SEQ ID NO: 2818110 - RNA, 15 nt, Mycobacterium avium subsp. paratuberculosis
cagcucaccgggcuc

SEQ ID NO: 2818111 - RNA, 22 nt, Mycobacterium avium subsp. paratuberculosis
cagcucaccgggcucggucacc

SEQ ID NO: 2818112 - RNA, 17 nt, Mycobacterium avium subsp. paratuberculosis
cagcucagccgccuggc

SEQ ID NO: 2818113 - RNA, 19 nt, Mycobacterium avium subsp. paratuberculosis
cagcucaggaacggccgga

SEQ ID NO: 2818114 - RNA, 18 nt, Mycobacterium avium subsp. paratuberculosis
cagcuccaaugcggccga

SEQ ID NO: 2818115 - RNA, 13 nt, Mycobacterium avium subsp. paratuberculosis
cagcuccaccugc

SEQ ID NO: 2818116 - RNA, 19 nt, Mycobacterium avium subsp. paratuberculosis
cagcuccaccugcggcacc

SEQ ID NO: 2818117 - RNA, 14 nt, Mycobacterium avium subsp. paratuberculosis
cagcuccagcagcc

SEQ ID NO: 2818118 - RNA, 17 nt, Mycobacterium avium subsp. paratuberculosis
cagcuccagcagcccgg

SEQ ID NO: 2818119 - RNA, 19 nt, Mycobacterium avium subsp. paratuberculosis
cagcuccagcagcccgggc

SEQ ID NO: 2818120 - RNA, 14 nt, Mycobacterium avium subsp. paratuberculosis
cagcuccagguccu

SEQ ID NO: 2818121 - RNA, 19 nt, Mycobacterium avium subsp. paratuberculosis
cagcucccacgacgacugg

SEQ ID NO: 2818122 - RNA, 15 nt, Mycobacterium avium subsp. paratuberculosis
cagcucccaggacgc

SEQ ID NO: 2818123 - RNA, 17 nt, Mycobacterium avium subsp. paratuberculosis
cagcucccccgacaccg

SEQ ID NO: 2818124 - RNA, 16 nt, Mycobacterium avium subsp. paratuberculosis
cagcucccccggcgug

SEQ ID NO: 2818125 - RNA, 17 nt, Mycobacterium avium subsp. paratuberculosis
cagcucccccggcguga

SEQ ID NO: 2818126 - RNA, 13 nt, Mycobacterium avium subsp. paratuberculosis
cagcucccccguc

SEQ ID NO: 2818127 - RNA, 16 nt, Mycobacterium avium subsp. paratuberculosis
cagcucccgagcaucg

SEQ ID NO: 2818128 - RNA, 14 nt, Mycobacterium avium subsp. paratuberculosis
cagcucccggcaga

SEQ ID NO: 2818129 - RNA, 21 nt, Mycobacterium avium subsp. paratuberculosis
cagcucccggcagaucgcggc

SEQ ID NO: 2818130 - RNA, 15 nt, Mycobacterium avium subsp. paratuberculosis
cagcucccgggcggc

SEQ ID NO: 2818131 - RNA, 18 nt, Mycobacterium avium subsp. paratuberculosis
cagcucccgggcggcgcc

SEQ ID NO: 2818132 - RNA, 20 nt, Mycobacterium avium subsp. paratuberculosis
cagcucccgggcggcgccga

SEQ ID NO: 2818133 - RNA, 16 nt, Mycobacterium avium subsp. paratuberculosis
cagcuccgccacccug

SEQ ID NO: 2818134 - RNA, 19 nt, Mycobacterium avium subsp. paratuberculosis
cagcuccgccacccugcgc

SEQ ID NO: 2818135 - RNA, 20 nt, Mycobacterium avium subsp. paratuberculosis
cagcuccgccacccugcgca

SEQ ID NO: 2818136 - RNA, 14 nt, Mycobacterium avium subsp. paratuberculosis
cagcuccgccgaca

SEQ ID NO: 2818137 - RNA, 16 nt, Mycobacterium avium subsp. paratuberculosis
cagcuccgccgacacc

SEQ ID NO: 2818138 - RNA, 17 nt, Mycobacterium avium subsp. paratuberculosis
cagcuccgccgacacca

SEQ ID NO: 2818139 - RNA, 16 nt, Mycobacterium avium subsp. paratuberculosis
cagcuccgcggccagc

SEQ ID NO: 2818140 - RNA, 24 nt, Mycobacterium avium subsp. paratuberculosis
cagcuccgcggccagcucggucgc

SEQ ID NO: 2818141 - RNA, 19 nt, Mycobacterium avium subsp. paratuberculosis
cagcuccggcaacgaggcc

SEQ ID NO: 2818142 - RNA, 23 nt, Mycobacterium avium subsp. paratuberculosis
cagcuccggcaacgaggccaggg

SEQ ID NO: 2818143 - RNA, 16 nt, Mycobacterium avium subsp. paratuberculosis
cagcuccgggucgacc

SEQ ID NO: 2818144 - RNA, 22 nt, Mycobacterium avium subsp. paratuberculosis
cagcuccgggucgaccgccucg

SEQ ID NO: 2818145 - RNA, 16 nt, Mycobacterium avium subsp. paratuberculosis
cagcuccggucggcgc

SEQ ID NO: 2818146 - RNA, 17 nt, Mycobacterium avium subsp. paratuberculosis
cagcuccggucggcgcu

SEQ ID NO: 2818147 - RNA, 18 nt, Mycobacterium avium subsp. paratuberculosis
cagcuccggucggcgcuc

SEQ ID NO: 2818148 - RNA, 19 nt, Mycobacterium avium subsp. paratuberculosis
cagcuccggucggcgcucg

SEQ ID NO: 2818149 - RNA, 21 nt, Mycobacterium avium subsp. paratuberculosis
cagcuccggucggcgcucgcg

SEQ ID NO: 2818150 - RNA, 17 nt, Mycobacterium avium subsp. paratuberculosis
cagcuccguccaccggc

SEQ ID NO: 2818151 - RNA, 20 nt, Mycobacterium avium subsp. paratuberculosis
cagcuccguccaccggcacg

SEQ ID NO: 2818152 - RNA, 23 nt, Mycobacterium avium subsp. paratuberculosis
cagcuccguccaccggcacggca

SEQ ID NO: 2818153 - RNA, 23 nt, Mycobacterium avium subsp. paratuberculosis
cagcuccuccugcggugggcgcu

SEQ ID NO: 2818154 - RNA, 13 nt, Mycobacterium avium subsp. paratuberculosis
cagcuccucggcc

SEQ ID NO: 2818155 - RNA, 19 nt, Mycobacterium avium subsp. paratuberculosis
cagcuccucggccagcacc

SEQ ID NO: 2818156 - RNA, 16 nt, Mycobacterium avium subsp. paratuberculosis
cagcuccucggcccca

SEQ ID NO: 2818157 - RNA, 14 nt, Mycobacterium avium subsp. paratuberculosis
cagcuccucggcgg

SEQ ID NO: 2818158 - RNA, 16 nt, Mycobacterium avium subsp. paratuberculosis
cagcuccucggggaug

SEQ ID NO: 2818159 - RNA, 22 nt, Mycobacterium avium subsp. paratuberculosis
cagcuccucggggaugacgguc

SEQ ID NO: 2818160 - RNA, 13 nt, Mycobacterium avium subsp. paratuberculosis
cagcuccucgguc

SEQ ID NO: 2818161 - RNA, 18 nt, Mycobacterium avium subsp. paratuberculosis
cagcuccuugagccgccg

SEQ ID NO: 2818162 - RNA, 19 nt, Mycobacterium avium subsp. paratuberculosis
cagcuccuugagccgccgc

SEQ ID NO: 2818163 - RNA, 20 nt, Mycobacterium avium subsp. paratuberculosis
cagcuccuugagccgccgcg

SEQ ID NO: 2818164 - RNA, 22 nt, Mycobacterium avium subsp. paratuberculosis
cagcuccuugagccgccgcggc

SEQ ID NO: 2818165 - RNA, 18 nt, Mycobacterium avium subsp. paratuberculosis
cagcucgaacaccgucga

SEQ ID NO: 2818166 - RNA, 16 nt, Mycobacterium avium subsp. paratuberculosis
cagcucgaaggugacc

SEQ ID NO: 2818167 - RNA, 14 nt, Mycobacterium avium subsp. paratuberculosis
cagcucgaaggugc

SEQ ID NO: 2818168 - RNA, 18 nt, Mycobacterium avium subsp. paratuberculosis
cagcucgaaggugcccgc

SEQ ID NO: 2818169 - RNA, 19 nt, Mycobacterium avium subsp. paratuberculosis
cagcucgaaggugcccgca

SEQ ID NO: 2818170 - RNA, 18 nt, Mycobacterium avium subsp. paratuberculosis
cagcucgacaucggccgc

SEQ ID NO: 2818171 - RNA, 22 nt, Mycobacterium avium subsp. paratuberculosis
cagcucggugcagaccccggcg

SEQ ID NO: 2818172 - RNA, 15 nt, Mycobacterium avium subsp. paratuberculosis
cagcucggugcgcac

SEQ ID NO: 2818173 - RNA, 19 nt, Mycobacterium avium subsp. paratuberculosis
cagcucggugcgcaccccg

SEQ ID NO: 2818174 - RNA, 16 nt, Mycobacterium avium subsp. paratuberculosis
cagcucggugcgcaug

SEQ ID NO: 2818175 - RNA, 22 nt, Mycobacterium avium subsp. paratuberculosis
cagcucggugcgcauggcgugc

SEQ ID NO: 2818176 - RNA, 22 nt, Mycobacterium avium subsp. paratuberculosis
cagcucgguggcgucggcggcc

SEQ ID NO: 2818177 - RNA, 15 nt, Mycobacterium avium subsp. paratuberculosis
cagcucgucagcgcg

SEQ ID NO: 2818178 - RNA, 16 nt, Mycobacterium avium subsp. paratuberculosis
cagcucgucagcgcgg

SEQ ID NO: 2818179 - RNA, 17 nt, Mycobacterium avium subsp. paratuberculosis
cagcucgucagcgcggg

SEQ ID NO: 2818180 - RNA, 23 nt, Mycobacterium avium subsp. paratuberculosis
cagcucgucagcgcgggccagca

SEQ ID NO: 2818181 - RNA, 15 nt, Mycobacterium avium subsp. paratuberculosis
cagcucgucgacguc

SEQ ID NO: 2818182 - RNA, 16 nt, Mycobacterium avium subsp. paratuberculosis
cagcucgucgacgucc

SEQ ID NO: 2818183 - RNA, 23 nt, Mycobacterium avium subsp. paratuberculosis
cagcucgucgacguccucgcccg

SEQ ID NO: 2818184 - RNA, 12 nt, Mycobacterium avium subsp. paratuberculosis
cagcucgucgag

SEQ ID NO: 2818185 - RNA, 14 nt, Mycobacterium avium subsp. paratuberculosis
cagcucgucgagcc

SEQ ID NO: 2818186 - RNA, 17 nt, Mycobacterium avium subsp. paratuberculosis
cagcucgucgagccggc

SEQ ID NO: 2818187 - RNA, 16 nt, Mycobacterium avium subsp. paratuberculosis
cagcucgucgcggaac

SEQ ID NO: 2818188 - RNA, 13 nt, Mycobacterium avium subsp. paratuberculosis
cagcucgucggcg

SEQ ID NO: 2818189 - RNA, 18 nt, Mycobacterium avium subsp. paratuberculosis
cagcucgucggcgcgcca

SEQ ID NO: 2818190 - RNA, 14 nt, Mycobacterium avium subsp. paratuberculosis
cagcucgucguacu

SEQ ID NO: 2818191 - RNA, 19 nt, Mycobacterium avium subsp. paratuberculosis
cagcucguggcgggcccgg

SEQ ID NO: 2818192 - RNA, 21 nt, Mycobacterium avium subsp. paratuberculosis
cagcucguggcgggcccgggc

SEQ ID NO: 2818193 - RNA, 18 nt, Mycobacterium avium subsp. paratuberculosis
cagcucguugccggcggc

SEQ ID NO: 2818194 - RNA, 19 nt, Mycobacterium avium subsp. paratuberculosis
cagcucguugccggcggcc

SEQ ID NO: 2818195 - RNA, 23 nt, Mycobacterium avium subsp. paratuberculosis
cagcucguugccggcggccagca

SEQ ID NO: 2818196 - RNA, 22 nt, Mycobacterium avium subsp. paratuberculosis
cagcucguugugaauccagccg

SEQ ID NO: 2818197 - RNA, 13 nt, Mycobacterium avium subsp. paratuberculosis
cagcucuucgacg

SEQ ID NO: 2818198 - RNA, 20 nt, Mycobacterium avium subsp. paratuberculosis
cagcugaacacgaacccggc

SEQ ID NO: 2818199 - RNA, 15 nt, Mycobacterium avium subsp. paratuberculosis
cagcugaacggugcc

SEQ ID NO: 2818200 - RNA, 19 nt, Mycobacterium avium subsp. paratuberculosis
cagcugaacggugcccgcc

SEQ ID NO: 2818201 - RNA, 23 nt, Mycobacterium avium subsp. paratuberculosis
cagcugaacggugcccgccgauc

SEQ ID NO: 2818202 - RNA, 14 nt, Mycobacterium avium subsp. paratuberculosis
cagcugaagguugu

SEQ ID NO: 2818203 - RNA, 22 nt, Mycobacterium avium subsp. paratuberculosis
cagcugaagguuguucugcucg

SEQ ID NO: 2818204 - RNA, 23 nt, Mycobacterium avium subsp. paratuberculosis
cagcugaagguuguucugcucga

SEQ ID NO: 2818205 - RNA, 21 nt, Mycobacterium avium subsp. paratuberculosis
cagcugaagugcacucggcga

SEQ ID NO: 2818206 - RNA, 22 nt, Mycobacterium avium subsp. paratuberculosis
cagcugaagugcacucggcgau

SEQ ID NO: 2818207 - RNA, 17 nt, Mycobacterium avium subsp. paratuberculosis
cagcugaccggcgaucg

SEQ ID NO: 2818208 - RNA, 19 nt, Mycobacterium avium subsp. paratuberculosis
cagcugaccggcgaucguc

SEQ ID NO: 2818209 - RNA, 23 nt, Mycobacterium avium subsp. paratuberculosis
cagcugacgauucuugaccaccu

SEQ ID NO: 2818210 - RNA, 15 nt, Mycobacterium avium subsp. paratuberculosis
cagcugacgggccgg

SEQ ID NO: 2818211 - RNA, 16 nt, Mycobacterium avium subsp. paratuberculosis
cagcugacgggccggc

SEQ ID NO: 2818212 - RNA, 17 nt, Mycobacterium avium subsp. paratuberculosis
cagcugacgggccggcg

SEQ ID NO: 2818213 - RNA, 18 nt, Mycobacterium avium subsp. paratuberculosis
cagcugacgggccggcgg

SEQ ID NO: 2818214 - RNA, 20 nt, Mycobacterium avium subsp. paratuberculosis
cagcugacgggccggcgggg

SEQ ID NO: 2818215 - RNA, 19 nt, Mycobacterium avium subsp. paratuberculosis
cagcugagcagcccgacca

SEQ ID NO: 2818216 - RNA, 16 nt, Mycobacterium avium subsp. paratuberculosis
cagcugauagcccgcc

SEQ ID NO: 2818217 - RNA, 20 nt, Mycobacterium avium subsp. paratuberculosis
cagcugauagcccgccgcgg

SEQ ID NO: 2818218 - RNA, 23 nt, Mycobacterium avium subsp. paratuberculosis
cagcugauagcccgccgcggcga

SEQ ID NO: 2818219 - RNA, 16 nt, Mycobacterium avium subsp. paratuberculosis
cagcugauagccgccc

SEQ ID NO: 2818220 - RNA, 17 nt, Mycobacterium avium subsp. paratuberculosis
cagcugauagccgcccu

SEQ ID NO: 2818221 - RNA, 20 nt, Mycobacterium avium subsp. paratuberculosis
cagcugauagccgcccugcc

SEQ ID NO: 2818222 - RNA, 15 nt, Mycobacterium avium subsp. paratuberculosis
cagcugaucggggcc

SEQ ID NO: 2818223 - RNA, 15 nt, Mycobacterium avium subsp. paratuberculosis
cagcugauucgcggu

SEQ ID NO: 2818224 - RNA, 22 nt, Mycobacterium avium subsp. paratuberculosis
cagcugauucugguucagccgu

SEQ ID NO: 2818225 - RNA, 18 nt, Mycobacterium avium subsp. paratuberculosis
cagcugcacccaccggcc

SEQ ID NO: 2818226 - RNA, 16 nt, Mycobacterium avium subsp. paratuberculosis
cagcugcacccgcucc

SEQ ID NO: 2818227 - RNA, 11 nt, Mycobacterium avium subsp. paratuberculosis
cagcugcaccg

SEQ ID NO: 2818228 - RNA, 18 nt, Mycobacterium avium subsp. paratuberculosis
cagcugcaccggggccgg

SEQ ID NO: 2818229 - RNA, 20 nt, Mycobacterium avium subsp. paratuberculosis
cagcugcagcggaaacgacg

SEQ ID NO: 2818230 - RNA, 23 nt, Mycobacterium avium subsp. paratuberculosis
cagcugcagcggaaacgacgucg

SEQ ID NO: 2818231 - RNA, 12 nt, Mycobacterium avium subsp. paratuberculosis
cagcugcagcgu

SEQ ID NO: 2818232 - RNA, 14 nt, Mycobacterium avium subsp. paratuberculosis
cagcugcagcgucg

SEQ ID NO: 2818233 - RNA, 21 nt, Mycobacterium avium subsp. paratuberculosis
cagcugcaucuccguggacgg

SEQ ID NO: 2818234 - RNA, 15 nt, Mycobacterium avium subsp. paratuberculosis
cagcugcauggacag

SEQ ID NO: 2818235 - RNA, 17 nt, Mycobacterium avium subsp. paratuberculosis
cagcugcauggacagcg

SEQ ID NO: 2818236 - RNA, 18 nt, Mycobacterium avium subsp. paratuberculosis
cagcugcauggacagcga

SEQ ID NO: 2818237 - RNA, 18 nt, Mycobacterium avium subsp. paratuberculosis
cagcugcccaccagcagg

SEQ ID NO: 2818238 - RNA, 15 nt, Mycobacterium avium subsp. paratuberculosis
cagcugcccgagcgg

SEQ ID NO: 2818239 - RNA, 22 nt, Mycobacterium avium subsp. paratuberculosis
cagcugcccgccgacgcccagg

SEQ ID NO: 2818240 - RNA, 13 nt, Mycobacterium avium subsp. paratuberculosis
cagcugcccggag

SEQ ID NO: 2818241 - RNA, 14 nt, Mycobacterium avium subsp. paratuberculosis
cagcugcccggagu

SEQ ID NO: 2818242 - RNA, 17 nt, Mycobacterium avium subsp. paratuberculosis
cagcugcccggaguccg

SEQ ID NO: 2818243 - RNA, 22 nt, Mycobacterium avium subsp. paratuberculosis
cagcugcccggaguccggcucg

SEQ ID NO: 2818244 - RNA, 13 nt, Mycobacterium avium subsp. paratuberculosis
cagcugcccgucg

SEQ ID NO: 2818245 - RNA, 15 nt, Mycobacterium avium subsp. paratuberculosis
cagcugccgaacugg

SEQ ID NO: 2818246 - RNA, 14 nt, Mycobacterium avium subsp. paratuberculosis
cagcugccgcaccg

SEQ ID NO: 2818247 - RNA, 14 nt, Mycobacterium avium subsp. paratuberculosis
cagcugccggccgu

SEQ ID NO: 2818248 - RNA, 17 nt, Mycobacterium avium subsp. paratuberculosis
cagcugccggccguugc

SEQ ID NO: 2818249 - RNA, 19 nt, Mycobacterium avium subsp. paratuberculosis
cagcugcgaaucgucggcg

SEQ ID NO: 2818250 - RNA, 23 nt, Mycobacterium avium subsp. paratuberculosis
cagcugcgaaucgucggcgaugg

SEQ ID NO: 2818251 - RNA, 14 nt, Mycobacterium avium subsp. paratuberculosis
cagcugcgacagca

SEQ ID NO: 2818252 - RNA, 15 nt, Mycobacterium avium subsp. paratuberculosis
cagcugcgacagcac

SEQ ID NO: 2818253 - RNA, 16 nt, Mycobacterium avium subsp. paratuberculosis
cagcugcgacagcacg

SEQ ID NO: 2818254 - RNA, 14 nt, Mycobacterium avium subsp. paratuberculosis
cagcugcgccgcgu

SEQ ID NO: 2818255 - RNA, 20 nt, Mycobacterium avium subsp. paratuberculosis
cagcuuggagccgagcaccg

SEQ ID NO: 2818256 - RNA, 16 nt, Mycobacterium avium subsp. paratuberculosis
cagcuuggcgcagccg

SEQ ID NO: 2818257 - RNA, 17 nt, Mycobacterium avium subsp. paratuberculosis
cagcuugggggccgacg

SEQ ID NO: 2818258 - RNA, 18 nt, Mycobacterium avium subsp. paratuberculosis
cagcuugggggccgacgc

SEQ ID NO: 2818259 - RNA, 22 nt, Mycobacterium avium subsp. paratuberculosis
cagcuugggggccgacgcuucg

SEQ ID NO: 2818260 - RNA, 21 nt, Mycobacterium avium subsp. paratuberculosis
cagcuugucguagcggcgcca

SEQ ID NO: 2818261 - RNA, 23 nt, Mycobacterium avium subsp. paratuberculosis
cagcuuucgggcggccugccggc

SEQ ID NO: 2818262 - RNA, 16 nt, Mycobacterium avium subsp. paratuberculosis
cagcuuugccagcaga

SEQ ID NO: 2818263 - RNA, 15 nt, Mycobacterium avium subsp. paratuberculosis
caggaaaaccagcga

SEQ ID NO: 2818264 - RNA, 18 nt, Mycobacterium avium subsp. paratuberculosis
caggaaaaccagcgacgc

SEQ ID NO: 2818265 - RNA, 20 nt, Mycobacterium avium subsp. paratuberculosis
caggaaaaccagcgacgcca

SEQ ID NO: 2818266 - RNA, 22 nt, Mycobacterium avium subsp. paratuberculosis
caggaaaaccagcgacgccagc

SEQ ID NO: 2818267 - RNA, 23 nt, Mycobacterium avium subsp. paratuberculosis
caggaaaggaaggcgcaugccag

SEQ ID NO: 2818268 - RNA, 22 nt, Mycobacterium avium subsp. paratuberculosis
caggaacaccgagccggcggcg

SEQ ID NO: 2818269 - RNA, 14 nt, Mycobacterium avium subsp. paratuberculosis
caggaacacgggau

SEQ ID NO: 2818270 - RNA, 20 nt, Mycobacterium avium subsp. paratuberculosis
caggaaccgggucagcacca

SEQ ID NO: 2818271 - RNA, 23 nt, Mycobacterium avium subsp. paratuberculosis
caggaacgccggcuugccccggu

SEQ ID NO: 2818272 - RNA, 23 nt, Mycobacterium avium subsp. paratuberculosis
caggaacgccuuggugccguuga

SEQ ID NO: 2818273 - RNA, 19 nt, Mycobacterium avium subsp. paratuberculosis
caggaacgcgacgguggcg

SEQ ID NO: 2818274 - RNA, 22 nt, Mycobacterium avium subsp. paratuberculosis
caggaacgcgcccggcgggcca

SEQ ID NO: 2818275 - RNA, 17 nt, Mycobacterium avium subsp. paratuberculosis
caggaacgcgccggcgc

SEQ ID NO: 2818276 - RNA, 18 nt, Mycobacterium avium subsp. paratuberculosis
caggaacgcgccggcgca

SEQ ID NO: 2818277 - RNA, 14 nt, Mycobacterium avium subsp. paratuberculosis
caggaacgcgucga

SEQ ID NO: 2818278 - RNA, 16 nt, Mycobacterium avium subsp. paratuberculosis
caggaacggcacccgc

SEQ ID NO: 2818279 - RNA, 16 nt, Mycobacterium avium subsp. paratuberculosis
caggaacgggccggcg

SEQ ID NO: 2818280 - RNA, 19 nt, Mycobacterium avium subsp. paratuberculosis
caggaacgggccggcgucc

SEQ ID NO: 2818281 - RNA, 22 nt, Mycobacterium avium subsp. paratuberculosis
caggaacgucuccuggggcaga

SEQ ID NO: 2818282 - RNA, 17 nt, Mycobacterium avium subsp. paratuberculosis
caggaacuccagcagcu

SEQ ID NO: 2818283 - RNA, 16 nt, Mycobacterium avium subsp. paratuberculosis
caggaagaacccggcg

SEQ ID NO: 2818284 - RNA, 19 nt, Mycobacterium avium subsp. paratuberculosis
caggaagaugccgaucagg

SEQ ID NO: 2818285 - RNA, 13 nt, Mycobacterium avium subsp. paratuberculosis
caggaagccggcg

SEQ ID NO: 2818286 - RNA, 14 nt, Mycobacterium avium subsp. paratuberculosis
caggaagccggcga

SEQ ID NO: 2818287 - RNA, 14 nt, Mycobacterium avium subsp. paratuberculosis
caggaaguagcccu

SEQ ID NO: 2818288 - RNA, 21 nt, Mycobacterium avium subsp. paratuberculosis
caggaaguagccggccagcgu

SEQ ID NO: 2818289 - RNA, 21 nt, Mycobacterium avium subsp. paratuberculosis
caggaauaacgccggccccgg

SEQ ID NO: 2818290 - RNA, 15 nt, Mycobacterium avium subsp. paratuberculosis
caggaauuccagcga

SEQ ID NO: 2818291 - RNA, 15 nt, Mycobacterium avium subsp. paratuberculosis
caggacaucaagugc

SEQ ID NO: 2818292 - RNA, 13 nt, Mycobacterium avium subsp. paratuberculosis
caggaccacccac

SEQ ID NO: 2818293 - RNA, 23 nt, Mycobacterium avium subsp. paratuberculosis
caggaccacccacucccagccgc

SEQ ID NO: 2818294 - RNA, 15 nt, Mycobacterium avium subsp. paratuberculosis
caggaccacuccugg

SEQ ID NO: 2818295 - RNA, 19 nt, Mycobacterium avium subsp. paratuberculosis
caggacccggugcccaccg

SEQ ID NO: 2818296 - RNA, 22 nt, Mycobacterium avium subsp. paratuberculosis
caggacccguacuucucgaaga

SEQ ID NO: 2818297 - RNA, 16 nt, Mycobacterium avium subsp. paratuberculosis
caggaccgagccgcgc

SEQ ID NO: 2818298 - RNA, 20 nt, Mycobacterium avium subsp. paratuberculosis
caggaccgagccgcgcgccg

SEQ ID NO: 2818299 - RNA, 21 nt, Mycobacterium avium subsp. paratuberculosis
caggaccgagccgcgcgccga

SEQ ID NO: 2818300 - RNA, 23 nt, Mycobacterium avium subsp. paratuberculosis
caggaccgagccgcgcgccgaga

SEQ ID NO: 2818301 - RNA, 15 nt, Mycobacterium avium subsp. paratuberculosis
caggaccgcgcgccg

SEQ ID NO: 2818302 - RNA, 17 nt, Mycobacterium avium subsp. paratuberculosis
caggaccggauccacca

SEQ ID NO: 2818303 - RNA, 14 nt, Mycobacterium avium subsp. paratuberculosis
caggaccgggacga

SEQ ID NO: 2818304 - RNA, 15 nt, Mycobacterium avium subsp. paratuberculosis
caggaccugaccgaa

SEQ ID NO: 2818305 - RNA, 13 nt, Mycobacterium avium subsp. paratuberculosis
caggaccuugucg

SEQ ID NO: 2818306 - RNA, 20 nt, Mycobacterium avium subsp. paratuberculosis
caggacgaaaaccaggaacg

SEQ ID NO: 2818307 - RNA, 15 nt, Mycobacterium avium subsp. paratuberculosis
caggacgaacgcugg

SEQ ID NO: 2818308 - RNA, 17 nt, Mycobacterium avium subsp. paratuberculosis
caggacgcgaccggcca

SEQ ID NO: 2818309 - RNA, 14 nt, Mycobacterium avium subsp. paratuberculosis
caggacgcgcccgg

SEQ ID NO: 2818310 - RNA, 15 nt, Mycobacterium avium subsp. paratuberculosis
caggacgcgcccggc

SEQ ID NO: 2818311 - RNA, 17 nt, Mycobacterium avium subsp. paratuberculosis
caggacgcgcccggcga

SEQ ID NO: 2818312 - RNA, 13 nt, Mycobacterium avium subsp. paratuberculosis
caggacgcgguga

SEQ ID NO: 2818313 - RNA, 18 nt, Mycobacterium avium subsp. paratuberculosis
caggacggcgcgguggcg

SEQ ID NO: 2818314 - RNA, 16 nt, Mycobacterium avium subsp. paratuberculosis
caggacgggcaccagu

SEQ ID NO: 2818315 - RNA, 22 nt, Mycobacterium avium subsp. paratuberculosis
caggacgguuucugccggccgc

SEQ ID NO: 2818316 - RNA, 23 nt, Mycobacterium avium subsp. paratuberculosis
caggacgguuucugccggccgcc

SEQ ID NO: 2818317 - RNA, 14 nt, Mycobacterium avium subsp. paratuberculosis
caggacgucggccg

SEQ ID NO: 2818318 - RNA, 16 nt, Mycobacterium avium subsp. paratuberculosis
caggacguugaggcgg

SEQ ID NO: 2818319 - RNA, 18 nt, Mycobacterium avium subsp. paratuberculosis
caggacguugaggcggcg

SEQ ID NO: 2818320 - RNA, 19 nt, Mycobacterium avium subsp. paratuberculosis
caggacguugaggcggcgg

SEQ ID NO: 2818321 - RNA, 23 nt, Mycobacterium avium subsp. paratuberculosis
caggacguugaggcggcggcggg

SEQ ID NO: 2818322 - RNA, 19 nt, Mycobacterium avium subsp. paratuberculosis
caggacucgggguugaccc

SEQ ID NO: 2818323 - RNA, 16 nt, Mycobacterium avium subsp. paratuberculosis
caggacuggaccgugc

SEQ ID NO: 2818324 - RNA, 23 nt, Mycobacterium avium subsp. paratuberculosis
caggacuggaccgugccggaauu

SEQ ID NO: 2818325 - RNA, 16 nt, Mycobacterium avium subsp. paratuberculosis
caggagaucggcgcgg

SEQ ID NO: 2818326 - RNA, 17 nt, Mycobacterium avium subsp. paratuberculosis
caggagaucggcgcgga

SEQ ID NO: 2818327 - RNA, 24 nt, Mycobacterium avium subsp. paratuberculosis
caggagaucggcgcggagcgucgc

SEQ ID NO: 2818328 - RNA, 19 nt, Mycobacterium avium subsp. paratuberculosis
caggagcaccugcgcgacg

SEQ ID NO: 2818329 - RNA, 13 nt, Mycobacterium avium subsp. paratuberculosis
caggaggcacugg

SEQ ID NO: 2818330 - RNA, 16 nt, Mycobacterium avium subsp. paratuberculosis
caggaggcacuggcgc

SEQ ID NO: 2818331 - RNA, 16 nt, Mycobacterium avium subsp. paratuberculosis
caggaggcggccaaca

SEQ ID NO: 2818332 - RNA, 22 nt, Mycobacterium avium subsp. paratuberculosis
caggagugguagggcuccgcgc

SEQ ID NO: 2818333 - RNA, 16 nt, Mycobacterium avium subsp. paratuberculosis
caggaucaccgggacg

SEQ ID NO: 2818334 - RNA, 15 nt, Mycobacterium avium subsp. paratuberculosis
caggaucacgcggcg

SEQ ID NO: 2818335 - RNA, 16 nt, Mycobacterium avium subsp. paratuberculosis
caggaucagcagccgu

SEQ ID NO: 2818336 - RNA, 21 nt, Mycobacterium avium subsp. paratuberculosis
caggauccccguccagcccag

SEQ ID NO: 2818337 - RNA, 16 nt, Mycobacterium avium subsp. paratuberculosis
caggauccgcaccggg

SEQ ID NO: 2818338 - RNA, 17 nt, Mycobacterium avium subsp. paratuberculosis
caggauccgcaccgggc

SEQ ID NO: 2818339 - RNA, 23 nt, Mycobacterium avium subsp. paratuberculosis
caggccauggcgcaccgcggccu

SEQ ID NO: 2818340 - RNA, 21 nt, Mycobacterium avium subsp. paratuberculosis
caggcccaacgugaugagcgc

SEQ ID NO: 2818341 - RNA, 14 nt, Mycobacterium avium subsp. paratuberculosis
caggcccaccacca

SEQ ID NO: 2818342 - RNA, 22 nt, Mycobacterium avium subsp. paratuberculosis
caggcccaccaccacgaggacc

SEQ ID NO: 2818343 - RNA, 13 nt, Mycobacterium avium subsp. paratuberculosis
caggcccacccac

SEQ ID NO: 2818344 - RNA, 18 nt, Mycobacterium avium subsp. paratuberculosis
caggcccagcagcaccgc

SEQ ID NO: 2818345 - RNA, 14 nt, Mycobacterium avium subsp. paratuberculosis
caggcccagcagcg

SEQ ID NO: 2818346 - RNA, 13 nt, Mycobacterium avium subsp. paratuberculosis
caggcccagccca

SEQ ID NO: 2818347 - RNA, 15 nt, Mycobacterium avium subsp. paratuberculosis
caggcccagcccggc

SEQ ID NO: 2818348 - RNA, 17 nt, Mycobacterium avium subsp. paratuberculosis
caggcccagcccggccc

SEQ ID NO: 2818349 - RNA, 23 nt, Mycobacterium avium subsp. paratuberculosis
caggcccagcccggccccaccgc

SEQ ID NO: 2818350 - RNA, 14 nt, Mycobacterium avium subsp. paratuberculosis
caggcccagcgagg

SEQ ID NO: 2818351 - RNA, 18 nt, Mycobacterium avium subsp. paratuberculosis
caggcccagcgaggcggc

SEQ ID NO: 2818352 - RNA, 13 nt, Mycobacterium avium subsp. paratuberculosis
caggcccagcggc

SEQ ID NO: 2818353 - RNA, 13 nt, Mycobacterium avium subsp. paratuberculosis
caggcccaggccg

SEQ ID NO: 2818354 - RNA, 19 nt, Mycobacterium avium subsp. paratuberculosis
caggcccaggccgacgccg

SEQ ID NO: 2818355 - RNA, 17 nt, Mycobacterium avium subsp. paratuberculosis
caggcccaggccgaugg

SEQ ID NO: 2818356 - RNA, 16 nt, Mycobacterium avium subsp. paratuberculosis
caggcccaggcgaccu

SEQ ID NO: 2818357 - RNA, 19 nt, Mycobacterium avium subsp. paratuberculosis
caggcccaucgcggucagc

SEQ ID NO: 2818358 - RNA, 19 nt, Mycobacterium avium subsp. paratuberculosis
caggccccacgcgcucagc

SEQ ID NO: 2818359 - RNA, 17 nt, Mycobacterium avium subsp. paratuberculosis
caggccccggccgagcg

SEQ ID NO: 2818360 - RNA, 15 nt, Mycobacterium avium subsp. paratuberculosis
caggccccuccagcu

SEQ ID NO: 2818361 - RNA, 23 nt, Mycobacterium avium subsp. paratuberculosis
caggcccgagcccgacggcagca

SEQ ID NO: 2818362 - RNA, 20 nt, Mycobacterium avium subsp. paratuberculosis
caggcccgcgccgacggccg

SEQ ID NO: 2818363 - RNA, 13 nt, Mycobacterium avium subsp. paratuberculosis
caggcccggcacc

SEQ ID NO: 2818364 - RNA, 17 nt, Mycobacterium avium subsp. paratuberculosis
caggcccggcaccggug

SEQ ID NO: 2818365 - RNA, 18 nt, Mycobacterium avium subsp. paratuberculosis
caggcccggcaccggugc

SEQ ID NO: 2818366 - RNA, 12 nt, Mycobacterium avium subsp. paratuberculosis
caggcccgggcg

SEQ ID NO: 2818367 - RNA, 14 nt, Mycobacterium avium subsp. paratuberculosis
caggcccgggcggc

SEQ ID NO: 2818368 - RNA, 20 nt, Mycobacterium avium subsp. paratuberculosis
caggcccgggcggcgagucc

SEQ ID NO: 2818369 - RNA, 23 nt, Mycobacterium avium subsp. paratuberculosis
caggcccgguugagugcgccgug

SEQ ID NO: 2818370 - RNA, 16 nt, Mycobacterium avium subsp. paratuberculosis
caggcccuccugggug

SEQ ID NO: 2818371 - RNA, 15 nt, Mycobacterium avium subsp. paratuberculosis
caggcccucgccgcg

SEQ ID NO: 2818372 - RNA, 19 nt, Mycobacterium avium subsp. paratuberculosis
caggcccucgccgcgguca

SEQ ID NO: 2818373 - RNA, 14 nt, Mycobacterium avium subsp. paratuberculosis
caggcccucggcca

SEQ ID NO: 2818374 - RNA, 17 nt, Mycobacterium avium subsp. paratuberculosis
caggcccucgucggcga

SEQ ID NO: 2818375 - RNA, 19 nt, Mycobacterium avium subsp. paratuberculosis
caggcccucgucggcgagc

SEQ ID NO: 2818376 - RNA, 17 nt, Mycobacterium avium subsp. paratuberculosis
caggcccugccagcgcc

SEQ ID NO: 2818377 - RNA, 20 nt, Mycobacterium avium subsp. paratuberculosis
caggcccugccagcgcccgc

SEQ ID NO: 2818378 - RNA, 15 nt, Mycobacterium avium subsp. paratuberculosis
caggcccuugcccca

SEQ ID NO: 2818379 - RNA, 17 nt, Mycobacterium avium subsp. paratuberculosis
caggcccuugccccacc

SEQ ID NO: 2818380 - RNA, 18 nt, Mycobacterium avium subsp. paratuberculosis
caggcccuugccccacca

SEQ ID NO: 2818381 - RNA, 13 nt, Mycobacterium avium subsp. paratuberculosis
caggccgaacacc

SEQ ID NO: 2818382 - RNA, 14 nt, Mycobacterium avium subsp. paratuberculosis
caggccgaacaccg

SEQ ID NO: 2818383 - RNA, 16 nt, Mycobacterium avium subsp. paratuberculosis
caggccgaacagcagc

SEQ ID NO: 2818384 - RNA, 13 nt, Mycobacterium avium subsp. paratuberculosis
caggccgaagaac

SEQ ID NO: 2818385 - RNA, 20 nt, Mycobacterium avium subsp. paratuberculosis
caggccgaagaacucagccg

SEQ ID NO: 2818386 - RNA, 17 nt, Mycobacterium avium subsp. paratuberculosis
caggccgaagacgauga

SEQ ID NO: 2818387 - RNA, 22 nt, Mycobacterium avium subsp. paratuberculosis
caggccgaaugacguggcaacg

SEQ ID NO: 2818388 - RNA, 16 nt, Mycobacterium avium subsp. paratuberculosis
caggccgacgccggcc

SEQ ID NO: 2818389 - RNA, 17 nt, Mycobacterium avium subsp. paratuberculosis
caggccgacgccggcca

SEQ ID NO: 2818390 - RNA, 20 nt, Mycobacterium avium subsp. paratuberculosis
caggccgacgccggccacca

SEQ ID NO: 2818391 - RNA, 14 nt, Mycobacterium avium subsp. paratuberculosis
caggccgacgcugg

SEQ ID NO: 2818392 - RNA, 14 nt, Mycobacterium avium subsp. paratuberculosis
caggccgagccgcc

SEQ ID NO: 2818393 - RNA, 16 nt, Mycobacterium avium subsp. paratuberculosis
caggccgagccgccgg

SEQ ID NO: 2818394 - RNA, 15 nt, Mycobacterium avium subsp. paratuberculosis
caggccgagcgcgcu

SEQ ID NO: 2818395 - RNA, 17 nt, Mycobacterium avium subsp. paratuberculosis
caggccgagcgcgcugg

SEQ ID NO: 2818396 - RNA, 13 nt, Mycobacterium avium subsp. paratuberculosis
caggccgaggcca

SEQ ID NO: 2818397 - RNA, 16 nt, Mycobacterium avium subsp. paratuberculosis
caggccgaggccaacu

SEQ ID NO: 2818398 - RNA, 17 nt, Mycobacterium avium subsp. paratuberculosis
caggccgaggccaacuc

SEQ ID NO: 2818399 - RNA, 16 nt, Mycobacterium avium subsp. paratuberculosis
caggccgaggcugacg

SEQ ID NO: 2818400 - RNA, 17 nt, Mycobacterium avium subsp. paratuberculosis
caggccgaggcugacga

SEQ ID NO: 2818401 - RNA, 23 nt, Mycobacterium avium subsp. paratuberculosis
caggccgaugaugaugccgccca

SEQ ID NO: 2818402 - RNA, 20 nt, Mycobacterium avium subsp. paratuberculosis
caggccgauggugguaccga

SEQ ID NO: 2818403 - RNA, 10 nt, Mycobacterium avium subsp. paratuberculosis
caggccgccc

SEQ ID NO: 2818404 - RNA, 16 nt, Mycobacterium avium subsp. paratuberculosis
caggccgccgacgacg

SEQ ID NO: 2818405 - RNA, 23 nt, Mycobacterium avium subsp. paratuberculosis
caggccgccgcauuccucggcca

SEQ ID NO: 2818406 - RNA, 15 nt, Mycobacterium avium subsp. paratuberculosis
caggccgccgccacc

SEQ ID NO: 2818407 - RNA, 16 nt, Mycobacterium avium subsp. paratuberculosis
caggccgccgccaccg

SEQ ID NO: 2818408 - RNA, 19 nt, Mycobacterium avium subsp. paratuberculosis
caggccgccgccaccgucg

SEQ ID NO: 2818409 - RNA, 18 nt, Mycobacterium avium subsp. paratuberculosis
caggccgccgggccgccg

SEQ ID NO: 2818410 - RNA, 15 nt, Mycobacterium avium subsp. paratuberculosis
caggccgcgacgggc

SEQ ID NO: 2818411 - RNA, 22 nt, Mycobacterium avium subsp. paratuberculosis
caggccgcgacgggcugucccg

SEQ ID NO: 2818412 - RNA, 22 nt, Mycobacterium avium subsp. paratuberculosis
caggccgcgagcacgacgucga

SEQ ID NO: 2818413 - RNA, 13 nt, Mycobacterium avium subsp. paratuberculosis
caggccgcgagcc

SEQ ID NO: 2818414 - RNA, 15 nt, Mycobacterium avium subsp. paratuberculosis
caggccgcgagcccg

SEQ ID NO: 2818415 - RNA, 16 nt, Mycobacterium avium subsp. paratuberculosis
caggccgcgagcccgc

SEQ ID NO: 2818416 - RNA, 16 nt, Mycobacterium avium subsp. paratuberculosis
caggccgcgccgggcg

SEQ ID NO: 2818417 - RNA, 13 nt, Mycobacterium avium subsp. paratuberculosis
caggccgcgcugg

SEQ ID NO: 2818418 - RNA, 16 nt, Mycobacterium avium subsp. paratuberculosis
caggccgcgcuggcgc

SEQ ID NO: 2818419 - RNA, 13 nt, Mycobacterium avium subsp. paratuberculosis
caggccgcggcca

SEQ ID NO: 2818420 - RNA, 21 nt, Mycobacterium avium subsp. paratuberculosis
caggccgcggccaagugcggu

SEQ ID NO: 2818421 - RNA, 16 nt, Mycobacterium avium subsp. paratuberculosis
caggccgcggccgucg

SEQ ID NO: 2818422 - RNA, 13 nt, Mycobacterium avium subsp. paratuberculosis
caggccgcggucg

SEQ ID NO: 2818423 - RNA, 17 nt, Mycobacterium avium subsp. paratuberculosis
caggccggcagccggcg

SEQ ID NO: 2818424 - RNA, 13 nt, Mycobacterium avium subsp. paratuberculosis
caggcgcgcacca

SEQ ID NO: 2818425 - RNA, 22 nt, Mycobacterium avium subsp. paratuberculosis
caggcgcgcacguuggcggcca

SEQ ID NO: 2818426 - RNA, 14 nt, Mycobacterium avium subsp. paratuberculosis
caggcgcgccgagc

SEQ ID NO: 2818427 - RNA, 13 nt, Mycobacterium avium subsp. paratuberculosis
caggcgcgcggcc

SEQ ID NO: 2818428 - RNA, 14 nt, Mycobacterium avium subsp. paratuberculosis
caggcgcgcggcca

SEQ ID NO: 2818429 - RNA, 18 nt, Mycobacterium avium subsp. paratuberculosis
caggcgcgcggccagccc

SEQ ID NO: 2818430 - RNA, 19 nt, Mycobacterium avium subsp. paratuberculosis
caggcgcgcggccagcccc

SEQ ID NO: 2818431 - RNA, 17 nt, Mycobacterium avium subsp. paratuberculosis
caggcgcugagcgggua

SEQ ID NO: 2818432 - RNA, 15 nt, Mycobacterium avium subsp. paratuberculosis
caggcgcugggugcg

SEQ ID NO: 2818433 - RNA, 18 nt, Mycobacterium avium subsp. paratuberculosis
caggcggaccugggugcg

SEQ ID NO: 2818434 - RNA, 21 nt, Mycobacterium avium subsp. paratuberculosis
caggcggaccugggugcgcca

SEQ ID NO: 2818435 - RNA, 23 nt, Mycobacterium avium subsp. paratuberculosis
caggcggaccugggugcgccacu

SEQ ID NO: 2818436 - RNA, 14 nt, Mycobacterium avium subsp. paratuberculosis
caggcggacggcga

SEQ ID NO: 2818437 - RNA, 12 nt, Mycobacterium avium subsp. paratuberculosis
caggcggccagc

SEQ ID NO: 2818438 - RNA, 13 nt, Mycobacterium avium subsp. paratuberculosis
caggcggccagca

SEQ ID NO: 2818439 - RNA, 16 nt, Mycobacterium avium subsp. paratuberculosis
caggcggccagcacca

SEQ ID NO: 2818440 - RNA, 17 nt, Mycobacterium avium subsp. paratuberculosis
caggcggccagcaccag

SEQ ID NO: 2818441 - RNA, 18 nt, Mycobacterium avium subsp. paratuberculosis
caggcggccagggcggcg

SEQ ID NO: 2818442 - RNA, 17 nt, Mycobacterium avium subsp. paratuberculosis
caggcggcccgcucgau

SEQ ID NO: 2818443 - RNA, 13 nt, Mycobacterium avium subsp. paratuberculosis
caggcggccggcc

SEQ ID NO: 2818444 - RNA, 14 nt, Mycobacterium avium subsp. paratuberculosis
caggcggccggccc

SEQ ID NO: 2818445 - RNA, 16 nt, Mycobacterium avium subsp. paratuberculosis
caggcggccggcccgg

SEQ ID NO: 2818446 - RNA, 12 nt, Mycobacterium avium subsp. paratuberculosis
caggcggcgacg

SEQ ID NO: 2818447 - RNA, 22 nt, Mycobacterium avium subsp. paratuberculosis
caggcggcgacgaacgccggca

SEQ ID NO: 2818448 - RNA, 20 nt, Mycobacterium avium subsp. paratuberculosis
caggcggcgcgcagccggcc

SEQ ID NO: 2818449 - RNA, 21 nt, Mycobacterium avium subsp. paratuberculosis
caggcggcgcgcagccggccg

SEQ ID NO: 2818450 - RNA, 13 nt, Mycobacterium avium subsp. paratuberculosis
caggcgggccacc

SEQ ID NO: 2818451 - RNA, 14 nt, Mycobacterium avium subsp. paratuberculosis
caggcgggccacca

SEQ ID NO: 2818452 - RNA, 21 nt, Mycobacterium avium subsp. paratuberculosis
caggcgggccaccacaguggc

SEQ ID NO: 2818453 - RNA, 19 nt, Mycobacterium avium subsp. paratuberculosis
caggcgggccagcucgaac

SEQ ID NO: 2818454 - RNA, 12 nt, Mycobacterium avium subsp. paratuberculosis
caggcgguccga

SEQ ID NO: 2818455 - RNA, 16 nt, Mycobacterium avium subsp. paratuberculosis
caggcgguccgacacc

SEQ ID NO: 2818456 - RNA, 17 nt, Mycobacterium avium subsp. paratuberculosis
caggcgguccgacaccg

SEQ ID NO: 2818457 - RNA, 18 nt, Mycobacterium avium subsp. paratuberculosis
caggcgguccgacaccgc

SEQ ID NO: 2818458 - RNA, 14 nt, Mycobacterium avium subsp. paratuberculosis
caggcggucgaacg

SEQ ID NO: 2818459 - RNA, 19 nt, Mycobacterium avium subsp. paratuberculosis
caggcggucgaacgcggcg

SEQ ID NO: 2818460 - RNA, 20 nt, Mycobacterium avium subsp. paratuberculosis
caggcggucgaacgcggcgc

SEQ ID NO: 2818461 - RNA, 16 nt, Mycobacterium avium subsp. paratuberculosis
caggcgguggccgaac

SEQ ID NO: 2818462 - RNA, 12 nt, Mycobacterium avium subsp. paratuberculosis
caggcgguggug

SEQ ID NO: 2818463 - RNA, 17 nt, Mycobacterium avium subsp. paratuberculosis
caggcgguuucaccgag

SEQ ID NO: 2818464 - RNA, 13 nt, Mycobacterium avium subsp. paratuberculosis
caggcguccagca

SEQ ID NO: 2818465 - RNA, 15 nt, Mycobacterium avium subsp. paratuberculosis
caggcguccagggcc

SEQ ID NO: 2818466 - RNA, 19 nt, Mycobacterium avium subsp. paratuberculosis
caggcguccagggccaccg

SEQ ID NO: 2818467 - RNA, 20 nt, Mycobacterium avium subsp. paratuberculosis
caggcguccagggccaccgc

SEQ ID NO: 2818468 - RNA, 21 nt, Mycobacterium avium subsp. paratuberculosis
caggcguccuugauccgggcg

SEQ ID NO: 2818469 - RNA, 19 nt, Mycobacterium avium subsp. paratuberculosis
caggcgucggucagcaggc

SEQ ID NO: 2818470 - RNA, 13 nt, Mycobacterium avium subsp. paratuberculosis
caggcgucgucgu

SEQ ID NO: 2818471 - RNA, 16 nt, Mycobacterium avium subsp. paratuberculosis
caggcgucgucgucga

SEQ ID NO: 2818472 - RNA, 18 nt, Mycobacterium avium subsp. paratuberculosis
caggcgucgucgucgagc

SEQ ID NO: 2818473 - RNA, 21 nt, Mycobacterium avium subsp. paratuberculosis
caggcgucgucgucgagccgc

SEQ ID NO: 2818474 - RNA, 14 nt, Mycobacterium avium subsp. paratuberculosis
caggcgugcacccg

SEQ ID NO: 2818475 - RNA, 15 nt, Mycobacterium avium subsp. paratuberculosis
caggcgugcgcgugg

SEQ ID NO: 2818476 - RNA, 20 nt, Mycobacterium avium subsp. paratuberculosis
caggcguggguuccgccguc

SEQ ID NO: 2818477 - RNA, 21 nt, Mycobacterium avium subsp. paratuberculosis
caggcguggguuccgccgucg

SEQ ID NO: 2818478 - RNA, 22 nt, Mycobacterium avium subsp. paratuberculosis
caggcguggguuccgccgucga

SEQ ID NO: 2818479 - RNA, 16 nt, Mycobacterium avium subsp. paratuberculosis
caggcguggucggcgc

SEQ ID NO: 2818480 - RNA, 22 nt, Mycobacterium avium subsp. paratuberculosis
caggcguuggucaccaucagcg

SEQ ID NO: 2818481 - RNA, 22 nt, Mycobacterium avium subsp. paratuberculosis
caggcguuucgugugguacagc

SEQ ID NO: 2818482 - RNA, 16 nt, Mycobacterium avium subsp. paratuberculosis
caggcucacgcugcca

SEQ ID NO: 2818483 - RNA, 22 nt, Mycobacterium avium subsp. paratuberculosis
caggcucacguagucgaccggg

SEQ ID NO: 2818484 - RNA, 18 nt, Mycobacterium avium subsp. paratuberculosis
caggcucagcagcaccgc

SEQ ID NO: 2818485 - RNA, 19 nt, Mycobacterium avium subsp. paratuberculosis
caggcucagcagcaccgca

SEQ ID NO: 2818486 - RNA, 18 nt, Mycobacterium avium subsp. paratuberculosis
caggcucaggaucagcag

SEQ ID NO: 2818487 - RNA, 20 nt, Mycobacterium avium subsp. paratuberculosis
caggcucaggaucagcagcc

SEQ ID NO: 2818488 - RNA, 21 nt, Mycobacterium avium subsp. paratuberculosis
caggcucgcgagggcgggcca

SEQ ID NO: 2818489 - RNA, 16 nt, Mycobacterium avium subsp. paratuberculosis
caggcucgcucccgcg

SEQ ID NO: 2818490 - RNA, 18 nt, Mycobacterium avium subsp. paratuberculosis
caggcucgcucccgcgcg

SEQ ID NO: 2818491 - RNA, 19 nt, Mycobacterium avium subsp. paratuberculosis
caggcucgcucccgcgcgg

SEQ ID NO: 2818492 - RNA, 21 nt, Mycobacterium avium subsp. paratuberculosis
caggcucgcucccgcgcgggc

SEQ ID NO: 2818493 - RNA, 22 nt, Mycobacterium avium subsp. paratuberculosis
caggcucgcucccgcgcgggca

SEQ ID NO: 2818494 - RNA, 18 nt, Mycobacterium avium subsp. paratuberculosis
caggcugaacaccaccag

SEQ ID NO: 2818495 - RNA, 20 nt, Mycobacterium avium subsp. paratuberculosis
caggcugaacaccaccaggc

SEQ ID NO: 2818496 - RNA, 23 nt, Mycobacterium avium subsp. paratuberculosis
caggcugaacaccaccaggccgu

SEQ ID NO: 2818497 - RNA, 19 nt, Mycobacterium avium subsp. paratuberculosis
caggcugaacgucgucagc

SEQ ID NO: 2818498 - RNA, 23 nt, Mycobacterium avium subsp. paratuberculosis
caggcugaacgucgucagcaccg

SEQ ID NO: 2818499 - RNA, 14 nt, Mycobacterium avium subsp. paratuberculosis
caggcugaccagcg

SEQ ID NO: 2818500 - RNA, 16 nt, Mycobacterium avium subsp. paratuberculosis
caggcugacgccacgc

SEQ ID NO: 2818501 - RNA, 18 nt, Mycobacterium avium subsp. paratuberculosis
caggcugacgccacgcgu

SEQ ID NO: 2818502 - RNA, 14 nt, Mycobacterium avium subsp. paratuberculosis
caggcugacgcgac

SEQ ID NO: 2818503 - RNA, 18 nt, Mycobacterium avium subsp. paratuberculosis
caggcugacgcgaccgcg

SEQ ID NO: 2818504 - RNA, 21 nt, Mycobacterium avium subsp. paratuberculosis
caggcugacgcgaccgcgcgg

SEQ ID NO: 2818505 - RNA, 20 nt, Mycobacterium avium subsp. paratuberculosis
caggcugaucuggaugcggc

SEQ ID NO: 2818506 - RNA, 22 nt, Mycobacterium avium subsp. paratuberculosis
caggcugaucuggaugcggccc

SEQ ID NO: 2818507 - RNA, 18 nt, Mycobacterium avium subsp. paratuberculosis
caggcugcccucuuccuc

SEQ ID NO: 2818508 - RNA, 17 nt, Mycobacterium avium subsp. paratuberculosis
cagggcgacggcggcga

SEQ ID NO: 2818509 - RNA, 16 nt, Mycobacterium avium subsp. paratuberculosis
cagggcgacuccggcg

SEQ ID NO: 2818510 - RNA, 17 nt, Mycobacterium avium subsp. paratuberculosis
cagggcgaggaacccga

SEQ ID NO: 2818511 - RNA, 22 nt, Mycobacterium avium subsp. paratuberculosis
cagggcgaggaacccgaccgcg

SEQ ID NO: 2818512 - RNA, 16 nt, Mycobacterium avium subsp. paratuberculosis
cagggcgaucaccgcg

SEQ ID NO: 2818513 - RNA, 18 nt, Mycobacterium avium subsp. paratuberculosis
cagggcgaucaccgcggc

SEQ ID NO: 2818514 - RNA, 20 nt, Mycobacterium avium subsp. paratuberculosis
cagggcgaucaccgcggcca

SEQ ID NO: 2818515 - RNA, 21 nt, Mycobacterium avium subsp. paratuberculosis
cagggcgaucaccgcggccac

SEQ ID NO: 2818516 - RNA, 14 nt, Mycobacterium avium subsp. paratuberculosis
cagggcgauggcca

SEQ ID NO: 2818517 - RNA, 17 nt, Mycobacterium avium subsp. paratuberculosis
cagggcgauggccaugg

SEQ ID NO: 2818518 - RNA, 13 nt, Mycobacterium avium subsp. paratuberculosis
cagggcgccgacg

SEQ ID NO: 2818519 - RNA, 15 nt, Mycobacterium avium subsp. paratuberculosis
cagggcgccgacgau

SEQ ID NO: 2818520 - RNA, 17 nt, Mycobacterium avium subsp. paratuberculosis
cagggcgccgacgaucc

SEQ ID NO: 2818521 - RNA, 22 nt, Mycobacterium avium subsp. paratuberculosis
cagggcgccgacgaucccggcg

SEQ ID NO: 2818522 - RNA, 21 nt, Mycobacterium avium subsp. paratuberculosis
cagggcgcgcaucugcucggc

SEQ ID NO: 2818523 - RNA, 13 nt, Mycobacterium avium subsp. paratuberculosis
cagggcgcgcugu

SEQ ID NO: 2818524 - RNA, 18 nt, Mycobacterium avium subsp. paratuberculosis
cagggcgcgcugucgacg

SEQ ID NO: 2818525 - RNA, 19 nt, Mycobacterium avium subsp. paratuberculosis
cagggcgcggcgcaccgag

SEQ ID NO: 2818526 - RNA, 22 nt, Mycobacterium avium subsp. paratuberculosis
cagggcgcucaucaggcggccg

SEQ ID NO: 2818527 - RNA, 17 nt, Mycobacterium avium subsp. paratuberculosis
cagggcggaaucgcggu

SEQ ID NO: 2818528 - RNA, 18 nt, Mycobacterium avium subsp. paratuberculosis
cagggcggcaccgaucgg

SEQ ID NO: 2818529 - RNA, 19 nt, Mycobacterium avium subsp. paratuberculosis
cagggcggcaccgaucggc

SEQ ID NO: 2818530 - RNA, 15 nt, Mycobacterium avium subsp. paratuberculosis
cagggcggccggcca

SEQ ID NO: 2818531 - RNA, 17 nt, Mycobacterium avium subsp. paratuberculosis
cagggcggccggccagu

SEQ ID NO: 2818532 - RNA, 11 nt, Mycobacterium avium subsp. paratuberculosis
cagggcggcgc

SEQ ID NO: 2818533 - RNA, 15 nt, Mycobacterium avium subsp. paratuberculosis
cagggcggcgccggc

SEQ ID NO: 2818534 - RNA, 16 nt, Mycobacterium avium subsp. paratuberculosis
cagggcggcgccggca

SEQ ID NO: 2818535 - RNA, 17 nt, Mycobacterium avium subsp. paratuberculosis
cagggcggcgccggcac

SEQ ID NO: 2818536 - RNA, 16 nt, Mycobacterium avium subsp. paratuberculosis
cagggcggcgcgcgcc

SEQ ID NO: 2818537 - RNA, 17 nt, Mycobacterium avium subsp. paratuberculosis
cagggcggcgcgcgcca

SEQ ID NO: 2818538 - RNA, 22 nt, Mycobacterium avium subsp. paratuberculosis
cagggcggcgcgcgccagcguc

SEQ ID NO: 2818539 - RNA, 16 nt, Mycobacterium avium subsp. paratuberculosis
cagggcggcgggcccg

SEQ ID NO: 2818540 - RNA, 19 nt, Mycobacterium avium subsp. paratuberculosis
cagggcggcgggcccggcg

SEQ ID NO: 2818541 - RNA, 22 nt, Mycobacterium avium subsp. paratuberculosis
cagggcggcgggcccggcgaug

SEQ ID NO: 2818542 - RNA, 16 nt, Mycobacterium avium subsp. paratuberculosis
cagggcgggucgucga

SEQ ID NO: 2818543 - RNA, 11 nt, Mycobacterium avium subsp. paratuberculosis
cagggcggugc

SEQ ID NO: 2818544 - RNA, 12 nt, Mycobacterium avium subsp. paratuberculosis
cagggcggugcg

SEQ ID NO: 2818545 - RNA, 14 nt, Mycobacterium avium subsp. paratuberculosis
cagggcggugcggu

SEQ ID NO: 2818546 - RNA, 22 nt, Mycobacterium avium subsp. paratuberculosis
cagggcggugcggugcgccgca

SEQ ID NO: 2818547 - RNA, 17 nt, Mycobacterium avium subsp. paratuberculosis
cagggcgguggcggcga

SEQ ID NO: 2818548 - RNA, 19 nt, Mycobacterium avium subsp. paratuberculosis
cagggcgguggcggcgaac

SEQ ID NO: 2818549 - RNA, 15 nt, Mycobacterium avium subsp. paratuberculosis
cagggcgugcgcggc

SEQ ID NO: 2818550 - RNA, 18 nt, Mycobacterium avium subsp. paratuberculosis
cagggcgugcgcggccgc

SEQ ID NO: 2818551 - RNA, 21 nt, Mycobacterium avium subsp. paratuberculosis
cagggcguggaacgcgucgcg

SEQ ID NO: 2818552 - RNA, 18 nt, Mycobacterium avium subsp. paratuberculosis
cagggcguguugcaggcg

SEQ ID NO: 2818553 - RNA, 22 nt, Mycobacterium avium subsp. paratuberculosis
cagggcguucgacguccaccgg

SEQ ID NO: 2818554 - RNA, 15 nt, Mycobacterium avium subsp. paratuberculosis
cagggcucgcaaccg

SEQ ID NO: 2818555 - RNA, 19 nt, Mycobacterium avium subsp. paratuberculosis
cagggcucgcaaccgucuu

SEQ ID NO: 2818556 - RNA, 15 nt, Mycobacterium avium subsp. paratuberculosis
cagggcucgugcagc

SEQ ID NO: 2818557 - RNA, 18 nt, Mycobacterium avium subsp. paratuberculosis
cagggcucgugcagccgg

SEQ ID NO: 2818558 - RNA, 19 nt, Mycobacterium avium subsp. paratuberculosis
cagggcucgugcagccggc

SEQ ID NO: 2818559 - RNA, 23 nt, Mycobacterium avium subsp. paratuberculosis
cagggcuuugcccuggucgaaga

SEQ ID NO: 2818560 - RNA, 14 nt, Mycobacterium avium subsp. paratuberculosis
cagggggacgaacc

SEQ ID NO: 2818561 - RNA, 17 nt, Mycobacterium avium subsp. paratuberculosis
cagggggaguagucggc

SEQ ID NO: 2818562 - RNA, 13 nt, Mycobacterium avium subsp. paratuberculosis
cagggggcgcagc

SEQ ID NO: 2818563 - RNA, 16 nt, Mycobacterium avium subsp. paratuberculosis
cagggggcgcagccga

SEQ ID NO: 2818564 - RNA, 22 nt, Mycobacterium avium subsp. paratuberculosis
caggggucccaggugggcgcgc

SEQ ID NO: 2818565 - RNA, 16 nt, Mycobacterium avium subsp. paratuberculosis
caggggugccagccgu

SEQ ID NO: 2818566 - RNA, 15 nt, Mycobacterium avium subsp. paratuberculosis
caggggugggcgacg

SEQ ID NO: 2818567 - RNA, 15 nt, Mycobacterium avium subsp. paratuberculosis
cagggguuggcgcgc

SEQ ID NO: 2818568 - RNA, 18 nt, Mycobacterium avium subsp. paratuberculosis
cagggguuggcgcgcaga

SEQ ID NO: 2818569 - RNA, 16 nt, Mycobacterium avium subsp. paratuberculosis
caggguagaggcggcg

SEQ ID NO: 2818570 - RNA, 19 nt, Mycobacterium avium subsp. paratuberculosis
caggguagaggcggcgacc

SEQ ID NO: 2818571 - RNA, 14 nt, Mycobacterium avium subsp. paratuberculosis
cagggucagcagca

SEQ ID NO: 2818572 - RNA, 17 nt, Mycobacterium avium subsp. paratuberculosis
cagggucagcagcaccc

SEQ ID NO: 2818573 - RNA, 22 nt, Mycobacterium avium subsp. paratuberculosis
cagggucagcgcuuccagcgcg

SEQ ID NO: 2818574 - RNA, 19 nt, Mycobacterium avium subsp. paratuberculosis
cagggucagcuuggagccg

SEQ ID NO: 2818575 - RNA, 23 nt, Mycobacterium avium subsp. paratuberculosis
cagggucagcuuggagccgagca

SEQ ID NO: 2818576 - RNA, 17 nt, Mycobacterium avium subsp. paratuberculosis
cagggucaucgcgccgg

SEQ ID NO: 2818577 - RNA, 15 nt, Mycobacterium avium subsp. paratuberculosis
cagggucccggucag

SEQ ID NO: 2818578 - RNA, 16 nt, Mycobacterium avium subsp. paratuberculosis
caggguccgccgucga

SEQ ID NO: 2818579 - RNA, 15 nt, Mycobacterium avium subsp. paratuberculosis
cagggucgagaucag

SEQ ID NO: 2818580 - RNA, 14 nt, Mycobacterium avium subsp. paratuberculosis
cagggucguucagc

SEQ ID NO: 2818581 - RNA, 17 nt, Mycobacterium avium subsp. paratuberculosis
cagggucucgcgcagca

SEQ ID NO: 2818582 - RNA, 19 nt, Mycobacterium avium subsp. paratuberculosis
cagggucucgcgcagcacg

SEQ ID NO: 2818583 - RNA, 20 nt, Mycobacterium avium subsp. paratuberculosis
cagggucucgggcagcagca

SEQ ID NO: 2818584 - RNA, 17 nt, Mycobacterium avium subsp. paratuberculosis
cagggucuggcccggug

SEQ ID NO: 2818585 - RNA, 16 nt, Mycobacterium avium subsp. paratuberculosis
cagggucuucagcccg

SEQ ID NO: 2818586 - RNA, 19 nt, Mycobacterium avium subsp. paratuberculosis
cagggucuucagcccgcgc

SEQ ID NO: 2818587 - RNA, 14 nt, Mycobacterium avium subsp. paratuberculosis
cagggucuucucga

SEQ ID NO: 2818588 - RNA, 19 nt, Mycobacterium avium subsp. paratuberculosis
cagggugaccgaggccgcc

SEQ ID NO: 2818589 - RNA, 17 nt, Mycobacterium avium subsp. paratuberculosis
cagggugacgauccaca

SEQ ID NO: 2818590 - RNA, 23 nt, Mycobacterium avium subsp. paratuberculosis
cagggugacgauccacagcgcga

SEQ ID NO: 2818591 - RNA, 17 nt, Mycobacterium avium subsp. paratuberculosis
cagggugacgucguuga

SEQ ID NO: 2818592 - RNA, 16 nt, Mycobacterium avium subsp. paratuberculosis
cagggugacguggcgg

SEQ ID NO: 2818593 - RNA, 14 nt, Mycobacterium avium subsp. paratuberculosis
cagguaggcgcggg

SEQ ID NO: 2818594 - RNA, 14 nt, Mycobacterium avium subsp. paratuberculosis
cagguaggcggcgc

SEQ ID NO: 2818595 - RNA, 18 nt, Mycobacterium avium subsp. paratuberculosis
cagguaggcggcgccguc

SEQ ID NO: 2818596 - RNA, 17 nt, Mycobacterium avium subsp. paratuberculosis
cagguaggcgguggcgc

SEQ ID NO: 2818597 - RNA, 20 nt, Mycobacterium avium subsp. paratuberculosis
cagguaggcgguggcgcaca

SEQ ID NO: 2818598 - RNA, 13 nt, Mycobacterium avium subsp. paratuberculosis
cagguaggcgucg

SEQ ID NO: 2818599 - RNA, 18 nt, Mycobacterium avium subsp. paratuberculosis
cagguagguggccagccg

SEQ ID NO: 2818600 - RNA, 15 nt, Mycobacterium avium subsp. paratuberculosis
cagguagguggccgu

SEQ ID NO: 2818601 - RNA, 16 nt, Mycobacterium avium subsp. paratuberculosis
cagguagguggccguc

SEQ ID NO: 2818602 - RNA, 18 nt, Mycobacterium avium subsp. paratuberculosis
cagguagguggccgucgc

SEQ ID NO: 2818603 - RNA, 19 nt, Mycobacterium avium subsp. paratuberculosis
cagguaguagcgccacauc

SEQ ID NO: 2818604 - RNA, 18 nt, Mycobacterium avium subsp. paratuberculosis
cagguaguagcgcgccgg

SEQ ID NO: 2818605 - RNA, 19 nt, Mycobacterium avium subsp. paratuberculosis
cagguaguagcgcgccggg

SEQ ID NO: 2818606 - RNA, 19 nt, Mycobacterium avium subsp. paratuberculosis
cagguauucaucgcggccg

SEQ ID NO: 2818607 - RNA, 20 nt, Mycobacterium avium subsp. paratuberculosis
cagguauucguugcccugcc

SEQ ID NO: 2818608 - RNA, 15 nt, Mycobacterium avium subsp. paratuberculosis
caggucaaccaggcc

SEQ ID NO: 2818609 - RNA, 22 nt, Mycobacterium avium subsp. paratuberculosis
caggucacccuccucgcggcgg

SEQ ID NO: 2818610 - RNA, 13 nt, Mycobacterium avium subsp. paratuberculosis
caggucaccgcgc

SEQ ID NO: 2818611 - RNA, 14 nt, Mycobacterium avium subsp. paratuberculosis
caggucaccgcgcg

SEQ ID NO: 2818612 - RNA, 20 nt, Mycobacterium avium subsp. paratuberculosis
caggucaccgcgcgaagucc

SEQ ID NO: 2818613 - RNA, 22 nt, Mycobacterium avium subsp. paratuberculosis
caggucaccggaugcacgugca

SEQ ID NO: 2818614 - RNA, 17 nt, Mycobacterium avium subsp. paratuberculosis
caggucaugguggcggc

SEQ ID NO: 2818615 - RNA, 20 nt, Mycobacterium avium subsp. paratuberculosis
caggucaugguggcggcgcc

SEQ ID NO: 2818616 - RNA, 21 nt, Mycobacterium avium subsp. paratuberculosis
caggucaugguggcggcgccg

SEQ ID NO: 2818617 - RNA, 15 nt, Mycobacterium avium subsp. paratuberculosis
cagguccacaccgug

SEQ ID NO: 2818618 - RNA, 13 nt, Mycobacterium avium subsp. paratuberculosis
cagguccaccagg

SEQ ID NO: 2818619 - RNA, 16 nt, Mycobacterium avium subsp. paratuberculosis
cagguccaccagguga

SEQ ID NO: 2818620 - RNA, 13 nt, Mycobacterium avium subsp. paratuberculosis
cagguccaccccg

SEQ ID NO: 2818621 - RNA, 14 nt, Mycobacterium avium subsp. paratuberculosis
cagguccaccccgc

SEQ ID NO: 2818622 - RNA, 15 nt, Mycobacterium avium subsp. paratuberculosis
cagguccaccccgcc

SEQ ID NO: 2818623 - RNA, 12 nt, Mycobacterium avium subsp. paratuberculosis
cagguccacccg

SEQ ID NO: 2818624 - RNA, 14 nt, Mycobacterium avium subsp. paratuberculosis
cagguccacccgcc

SEQ ID NO: 2818625 - RNA, 17 nt, Mycobacterium avium subsp. paratuberculosis
cagguccacccgccccg

SEQ ID NO: 2818626 - RNA, 18 nt, Mycobacterium avium subsp. paratuberculosis
cagguccacccgccccgc

SEQ ID NO: 2818627 - RNA, 21 nt, Mycobacterium avium subsp. paratuberculosis
cagguccacccgccccgccgc

SEQ ID NO: 2818628 - RNA, 23 nt, Mycobacterium avium subsp. paratuberculosis
cagguccacccgccccgccgcgg

SEQ ID NO: 2818629 - RNA, 16 nt, Mycobacterium avium subsp. paratuberculosis
caggucccaggcgugg

SEQ ID NO: 2818630 - RNA, 18 nt, Mycobacterium avium subsp. paratuberculosis
caggucccaggcgugguc

SEQ ID NO: 2818631 - RNA, 15 nt, Mycobacterium avium subsp. paratuberculosis
cagguccgccggugc

SEQ ID NO: 2818632 - RNA, 22 nt, Mycobacterium avium subsp. paratuberculosis
cagguccgccggugccagcaac

SEQ ID NO: 2818633 - RNA, 24 nt, Mycobacterium avium subsp. paratuberculosis
cagguccgcgaacucgucgacgcc

SEQ ID NO: 2818634 - RNA, 16 nt, Mycobacterium avium subsp. paratuberculosis
cagguccggcagcgcg

SEQ ID NO: 2818635 - RNA, 20 nt, Mycobacterium avium subsp. paratuberculosis
cagguccgggaacagcgacu

SEQ ID NO: 2818636 - RNA, 13 nt, Mycobacterium avium subsp. paratuberculosis
cagguccgggcac

SEQ ID NO: 2818637 - RNA, 16 nt, Mycobacterium avium subsp. paratuberculosis
cagguccgggcacucg

SEQ ID NO: 2818638 - RNA, 21 nt, Mycobacterium avium subsp. paratuberculosis
cagguccgggcacucgagcgu

SEQ ID NO: 2818639 - RNA, 21 nt, Mycobacterium avium subsp. paratuberculosis
cagguccguggugaucgccgc

SEQ ID NO: 2818640 - RNA, 20 nt, Mycobacterium avium subsp. paratuberculosis
cagguccucgaucgacaccu

SEQ ID NO: 2818641 - RNA, 16 nt, Mycobacterium avium subsp. paratuberculosis
cagguccucgcuggcg

SEQ ID NO: 2818642 - RNA, 19 nt, Mycobacterium avium subsp. paratuberculosis
cagguccucgcuggcgauc

SEQ ID NO: 2818643 - RNA, 23 nt, Mycobacterium avium subsp. paratuberculosis
cagguccucgcuggcgaucaccu

SEQ ID NO: 2818644 - RNA, 19 nt, Mycobacterium avium subsp. paratuberculosis
cagguccucggacucgucg

SEQ ID NO: 2818645 - RNA, 15 nt, Mycobacterium avium subsp. paratuberculosis
cagguccuguccggu

SEQ ID NO: 2818646 - RNA, 18 nt, Mycobacterium avium subsp. paratuberculosis
cagguccuugcccagcag

SEQ ID NO: 2818647 - RNA, 21 nt, Mycobacterium avium subsp. paratuberculosis
cagguccuugcccagcaguuu

SEQ ID NO: 2818648 - RNA, 18 nt, Mycobacterium avium subsp. paratuberculosis
cagguccuugcgcgccgc

SEQ ID NO: 2818649 - RNA, 23 nt, Mycobacterium avium subsp. paratuberculosis
cagguccuugcgcgccgcgacgu

SEQ ID NO: 2818650 - RNA, 19 nt, Mycobacterium avium subsp. paratuberculosis
caggucgaagaggugcucg

SEQ ID NO: 2818651 - RNA, 17 nt, Mycobacterium avium subsp. paratuberculosis
caggucgaagcccgccg

SEQ ID NO: 2818652 - RNA, 21 nt, Mycobacterium avium subsp. paratuberculosis
caggucgaaggcggccgcgag

SEQ ID NO: 2818653 - RNA, 22 nt, Mycobacterium avium subsp. paratuberculosis
caggucgaaggcggccgcgagc

SEQ ID NO: 2818654 - RNA, 19 nt, Mycobacterium avium subsp. paratuberculosis
caggucgaccaucugccgg

SEQ ID NO: 2818655 - RNA, 20 nt, Mycobacterium avium subsp. paratuberculosis
caggucgaccaucugccggc

SEQ ID NO: 2818656 - RNA, 13 nt, Mycobacterium avium subsp. paratuberculosis
caggucgaccggc

SEQ ID NO: 2818657 - RNA, 15 nt, Mycobacterium avium subsp. paratuberculosis
caggucgaccggcuc

SEQ ID NO: 2818658 - RNA, 21 nt, Mycobacterium avium subsp. paratuberculosis
caggucgaccggcucgccguu

SEQ ID NO: 2818659 - RNA, 15 nt, Mycobacterium avium subsp. paratuberculosis
caggucgaggccggc

SEQ ID NO: 2818660 - RNA, 16 nt, Mycobacterium avium subsp. paratuberculosis
caggucgaggccggcc

SEQ ID NO: 2818661 - RNA, 17 nt, Mycobacterium avium subsp. paratuberculosis
caggucgaggccggcca

SEQ ID NO: 2818662 - RNA, 23 nt, Mycobacterium avium subsp. paratuberculosis
caggucgagggucgagacaccgu

SEQ ID NO: 2818663 - RNA, 12 nt, Mycobacterium avium subsp. paratuberculosis
caggucgagguc

SEQ ID NO: 2818664 - RNA, 20 nt, Mycobacterium avium subsp. paratuberculosis
caggucgagguccucggcga

SEQ ID NO: 2818665 - RNA, 23 nt, Mycobacterium avium subsp. paratuberculosis
caggucgagguccucggcgaugu

SEQ ID NO: 2818666 - RNA, 15 nt, Mycobacterium avium subsp. paratuberculosis
caggucgaucagcgg

SEQ ID NO: 2818667 - RNA, 19 nt, Mycobacterium avium subsp. paratuberculosis
caggucgaucucggccagc

SEQ ID NO: 2818668 - RNA, 18 nt, Mycobacterium avium subsp. paratuberculosis
caggucgaucugcggcac

SEQ ID NO: 2818669 - RNA, 23 nt, Mycobacterium avium subsp. paratuberculosis
caggucgaucugcggcacggugc

SEQ ID NO: 2818670 - RNA, 19 nt, Mycobacterium avium subsp. paratuberculosis
caggucgaugauguugccc

SEQ ID NO: 2818671 - RNA, 22 nt, Mycobacterium avium subsp. paratuberculosis
caggucgauggcguagcggguc

SEQ ID NO: 2818672 - RNA, 22 nt, Mycobacterium avium subsp. paratuberculosis
caggucgauggucugcccgccg

SEQ ID NO: 2818673 - RNA, 23 nt, Mycobacterium avium subsp. paratuberculosis
caggucgcacaccagcacggcgg

SEQ ID NO: 2818674 - RNA, 16 nt, Mycobacterium avium subsp. paratuberculosis
caggucgcacaggaug

SEQ ID NO: 2818675 - RNA, 15 nt, Mycobacterium avium subsp. paratuberculosis
caggucgcccggcuc

SEQ ID NO: 2818676 - RNA, 16 nt, Mycobacterium avium subsp. paratuberculosis
caggucgcccggcucg

SEQ ID NO: 2818677 - RNA, 22 nt, Mycobacterium avium subsp. paratuberculosis
caggugcagcuccuugagccgc

SEQ ID NO: 2818678 - RNA, 18 nt, Mycobacterium avium subsp. paratuberculosis
caggugcauccagucggc

SEQ ID NO: 2818679 - RNA, 19 nt, Mycobacterium avium subsp. paratuberculosis
caggugcauccagucggcg

SEQ ID NO: 2818680 - RNA, 20 nt, Mycobacterium avium subsp. paratuberculosis
caggugcauccagucggcgc

SEQ ID NO: 2818681 - RNA, 22 nt, Mycobacterium avium subsp. paratuberculosis
caggugcauccagucggcgccg

SEQ ID NO: 2818682 - RNA, 17 nt, Mycobacterium avium subsp. paratuberculosis
caggugcaucgaccggc

SEQ ID NO: 2818683 - RNA, 20 nt, Mycobacterium avium subsp. paratuberculosis
caggugcaucgccaccgucg

SEQ ID NO: 2818684 - RNA, 22 nt, Mycobacterium avium subsp. paratuberculosis
caggugcaucgccaccgucguc

SEQ ID NO: 2818685 - RNA, 15 nt, Mycobacterium avium subsp. paratuberculosis
caggugccggugacg

SEQ ID NO: 2818686 - RNA, 20 nt, Mycobacterium avium subsp. paratuberculosis
caggugccggugacggucag

SEQ ID NO: 2818687 - RNA, 16 nt, Mycobacterium avium subsp. paratuberculosis
caggugcgacgcccac

SEQ ID NO: 2818688 - RNA, 20 nt, Mycobacterium avium subsp. paratuberculosis
caggugcgccgccgcgucgc

SEQ ID NO: 2818689 - RNA, 23 nt, Mycobacterium avium subsp. paratuberculosis
caggugcgccgccgcgucgccgc

SEQ ID NO: 2818690 - RNA, 22 nt, Mycobacterium avium subsp. paratuberculosis
caggugcgccgcucgucggcca

SEQ ID NO: 2818691 - RNA, 17 nt, Mycobacterium avium subsp. paratuberculosis
caggugcgcggucagcg

SEQ ID NO: 2818692 - RNA, 18 nt, Mycobacterium avium subsp. paratuberculosis
caggugcgcggucagcgc

SEQ ID NO: 2818693 - RNA, 17 nt, Mycobacterium avium subsp. paratuberculosis
caggugcggcaacccga

SEQ ID NO: 2818694 - RNA, 23 nt, Mycobacterium avium subsp. paratuberculosis
caggugcggcaacccgaucgccg

SEQ ID NO: 2818695 - RNA, 22 nt, Mycobacterium avium subsp. paratuberculosis
caggugcggggacagugcgggc

SEQ ID NO: 2818696 - RNA, 15 nt, Mycobacterium avium subsp. paratuberculosis
caggugcucgccggc

SEQ ID NO: 2818697 - RNA, 19 nt, Mycobacterium avium subsp. paratuberculosis
caggugcucgccggcgcgg

SEQ ID NO: 2818698 - RNA, 20 nt, Mycobacterium avium subsp. paratuberculosis
caggugcucgccggcgcgga

SEQ ID NO: 2818699 - RNA, 16 nt, Mycobacterium avium subsp. paratuberculosis
caggugcuuggucagc

SEQ ID NO: 2818700 - RNA, 17 nt, Mycobacterium avium subsp. paratuberculosis
caggugcuuggucagcg

SEQ ID NO: 2818701 - RNA, 22 nt, Mycobacterium avium subsp. paratuberculosis
caggugcuuggucagcgcggcc

SEQ ID NO: 2818702 - RNA, 16 nt, Mycobacterium avium subsp. paratuberculosis
cagguggacagaugcc

SEQ ID NO: 2818703 - RNA, 21 nt, Mycobacterium avium subsp. paratuberculosis
cagguggacagaugccagacg

SEQ ID NO: 2818704 - RNA, 20 nt, Mycobacterium avium subsp. paratuberculosis
cagguggauggucaccgggg

SEQ ID NO: 2818705 - RNA, 18 nt, Mycobacterium avium subsp. paratuberculosis
cagguggauugucggccg

SEQ ID NO: 2818706 - RNA, 19 nt, Mycobacterium avium subsp. paratuberculosis
cagguggauugucggccgc

SEQ ID NO: 2818707 - RNA, 14 nt, Mycobacterium avium subsp. paratuberculosis
cagguggcccacac

SEQ ID NO: 2818708 - RNA, 17 nt, Mycobacterium avium subsp. paratuberculosis
cagguggcccgacccgu

SEQ ID NO: 2818709 - RNA, 19 nt, Mycobacterium avium subsp. paratuberculosis
cagguggccgaucagcggc

SEQ ID NO: 2818710 - RNA, 22 nt, Mycobacterium avium subsp. paratuberculosis
cagguggccgaucagcggcggg

SEQ ID NO: 2818711 - RNA, 23 nt, Mycobacterium avium subsp. paratuberculosis
cagguggccgaucagcggcgggc

SEQ ID NO: 2818712 - RNA, 24 nt, Mycobacterium avium subsp. paratuberculosis
cagguggccgcuuuccaccccggc

SEQ ID NO: 2818713 - RNA, 15 nt, Mycobacterium avium subsp. paratuberculosis
cagguggcgcccgga

SEQ ID NO: 2818714 - RNA, 21 nt, Mycobacterium avium subsp. paratuberculosis
cagguggcgccuccgcccggg

SEQ ID NO: 2818715 - RNA, 16 nt, Mycobacterium avium subsp. paratuberculosis
cagguggcgucggcgu

SEQ ID NO: 2818716 - RNA, 17 nt, Mycobacterium avium subsp. paratuberculosis
cagguggcgucggcguc

SEQ ID NO: 2818717 - RNA, 21 nt, Mycobacterium avium subsp. paratuberculosis
cagguggcgucggcgucgaac

SEQ ID NO: 2818718 - RNA, 15 nt, Mycobacterium avium subsp. paratuberculosis
caggugggcgcgcag

SEQ ID NO: 2818719 - RNA, 14 nt, Mycobacterium avium subsp. paratuberculosis
caggugggcggcca

SEQ ID NO: 2818720 - RNA, 17 nt, Mycobacterium avium subsp. paratuberculosis
caggugggcggccacca

SEQ ID NO: 2818721 - RNA, 20 nt, Mycobacterium avium subsp. paratuberculosis
caggugggcggccaccacuu

SEQ ID NO: 2818722 - RNA, 14 nt, Mycobacterium avium subsp. paratuberculosis
caggugggcggugc

SEQ ID NO: 2818723 - RNA, 16 nt, Mycobacterium avium subsp. paratuberculosis
cagguggggcaccaga

SEQ ID NO: 2818724 - RNA, 19 nt, Mycobacterium avium subsp. paratuberculosis
cagguggggcaccagaaca

SEQ ID NO: 2818725 - RNA, 20 nt, Mycobacterium avium subsp. paratuberculosis
cagguggggcagcaccucgc

SEQ ID NO: 2818726 - RNA, 17 nt, Mycobacterium avium subsp. paratuberculosis
cagguggggcaggaacg

SEQ ID NO: 2818727 - RNA, 16 nt, Mycobacterium avium subsp. paratuberculosis
caggugggguggugga

SEQ ID NO: 2818728 - RNA, 23 nt, Mycobacterium avium subsp. paratuberculosis
caggugggugaacgccugcggga

SEQ ID NO: 2818729 - RNA, 15 nt, Mycobacterium avium subsp. paratuberculosis
cagguggucggcgaa

SEQ ID NO: 2818730 - RNA, 14 nt, Mycobacterium avium subsp. paratuberculosis
cagguggucgguga

SEQ ID NO: 2818731 - RNA, 17 nt, Mycobacterium avium subsp. paratuberculosis
cagguggugggcgugca

SEQ ID NO: 2818732 - RNA, 22 nt, Mycobacterium avium subsp. paratuberculosis
cagguggugggcgugcaggccg

SEQ ID NO: 2818733 - RNA, 22 nt, Mycobacterium avium subsp. paratuberculosis
cagguguaggcguggcaggcca

SEQ ID NO: 2818734 - RNA, 14 nt, Mycobacterium avium subsp. paratuberculosis
caggugugcccgcc

SEQ ID NO: 2818735 - RNA, 15 nt, Mycobacterium avium subsp. paratuberculosis
caggugugcccgccc

SEQ ID NO: 2818736 - RNA, 16 nt, Mycobacterium avium subsp. paratuberculosis
caggugugcccgcccu

SEQ ID NO: 2818737 - RNA, 13 nt, Mycobacterium avium subsp. paratuberculosis
caggugugcggca

SEQ ID NO: 2818738 - RNA, 17 nt, Mycobacterium avium subsp. paratuberculosis
caggugugcggcaagcg

SEQ ID NO: 2818739 - RNA, 15 nt, Mycobacterium avium subsp. paratuberculosis
caggugugcggcacg

SEQ ID NO: 2818740 - RNA, 14 nt, Mycobacterium avium subsp. paratuberculosis
cagguucacgucgg

SEQ ID NO: 2818741 - RNA, 15 nt, Mycobacterium avium subsp. paratuberculosis
cagguucagcccggc

SEQ ID NO: 2818742 - RNA, 18 nt, Mycobacterium avium subsp. paratuberculosis
cagguucaggcccgcgcc

SEQ ID NO: 2818743 - RNA, 20 nt, Mycobacterium avium subsp. paratuberculosis
cagguucauccccgcggcca

SEQ ID NO: 2818744 - RNA, 14 nt, Mycobacterium avium subsp. paratuberculosis
cagguucgacagcg

SEQ ID NO: 2818745 - RNA, 15 nt, Mycobacterium avium subsp. paratuberculosis
cagguucuccggccc

SEQ ID NO: 2818746 - RNA, 23 nt, Mycobacterium avium subsp. paratuberculosis
cagguucuccggcccgcucggcg

SEQ ID NO: 2818747 - RNA, 15 nt, Mycobacterium avium subsp. paratuberculosis
cagguucuccuccca

SEQ ID NO: 2818748 - RNA, 16 nt, Mycobacterium avium subsp. paratuberculosis
cagguucuccucccag

SEQ ID NO: 2818749 - RNA, 19 nt, Mycobacterium avium subsp. paratuberculosis
cagguucuccucccagccc

SEQ ID NO: 2818750 - RNA, 15 nt, Mycobacterium avium subsp. paratuberculosis
cagguucuucugcgc

SEQ ID NO: 2818751 - RNA, 17 nt, Mycobacterium avium subsp. paratuberculosis
cagguucuuggcggccu

SEQ ID NO: 2818752 - RNA, 20 nt, Mycobacterium avium subsp. paratuberculosis
cagguugaaaaacgcggugu

SEQ ID NO: 2818753 - RNA, 15 nt, Mycobacterium avium subsp. paratuberculosis
cagguugaccaccag

SEQ ID NO: 2818754 - RNA, 17 nt, Mycobacterium avium subsp. paratuberculosis
cagguugaccaccagcg

SEQ ID NO: 2818755 - RNA, 18 nt, Mycobacterium avium subsp. paratuberculosis
cagguugaccaccagcgu

SEQ ID NO: 2818756 - RNA, 15 nt, Mycobacterium avium subsp. paratuberculosis
cagguugacgccgau

SEQ ID NO: 2818757 - RNA, 19 nt, Mycobacterium avium subsp. paratuberculosis
cagguugauccgcgcgucu

SEQ ID NO: 2818758 - RNA, 14 nt, Mycobacterium avium subsp. paratuberculosis
cagguugcgcagca

SEQ ID NO: 2818759 - RNA, 18 nt, Mycobacterium avium subsp. paratuberculosis
cagguugcgcagcagcca

SEQ ID NO: 2818760 - RNA, 19 nt, Mycobacterium avium subsp. paratuberculosis
cagguugcggaucaugcgc

SEQ ID NO: 2818761 - RNA, 23 nt, Mycobacterium avium subsp. paratuberculosis
caguccggcggucagcaccguca

SEQ ID NO: 2818762 - RNA, 18 nt, Mycobacterium avium subsp. paratuberculosis
caguccugcagcucgccg

SEQ ID NO: 2818763 - RNA, 22 nt, Mycobacterium avium subsp. paratuberculosis
caguccugcagcucgccggcgc

SEQ ID NO: 2818764 - RNA, 15 nt, Mycobacterium avium subsp. paratuberculosis
caguccugggccggg

SEQ ID NO: 2818765 - RNA, 17 nt, Mycobacterium avium subsp. paratuberculosis
caguccugggccggggc

SEQ ID NO: 2818766 - RNA, 16 nt, Mycobacterium avium subsp. paratuberculosis
cagucgaagaccacga

SEQ ID NO: 2818767 - RNA, 14 nt, Mycobacterium avium subsp. paratuberculosis
cagucgaagauguc

SEQ ID NO: 2818768 - RNA, 21 nt, Mycobacterium avium subsp. paratuberculosis
cagucgaagaugucgcggcgc

SEQ ID NO: 2818769 - RNA, 23 nt, Mycobacterium avium subsp. paratuberculosis
cagucgaagaugucgcggcgcac

SEQ ID NO: 2818770 - RNA, 15 nt, Mycobacterium avium subsp. paratuberculosis
cagucgaaguucggc

SEQ ID NO: 2818771 - RNA, 22 nt, Mycobacterium avium subsp. paratuberculosis
cagucgaaguucggcaucucgg

SEQ ID NO: 2818772 - RNA, 17 nt, Mycobacterium avium subsp. paratuberculosis
cagucgaccucgcgcgu

SEQ ID NO: 2818773 - RNA, 15 nt, Mycobacterium avium subsp. paratuberculosis
cagucgaucagcgac

SEQ ID NO: 2818774 - RNA, 21 nt, Mycobacterium avium subsp. paratuberculosis
cagucgaucagcgacggcccg

SEQ ID NO: 2818775 - RNA, 15 nt, Mycobacterium avium subsp. paratuberculosis
cagucgaucuugcgc

SEQ ID NO: 2818776 - RNA, 14 nt, Mycobacterium avium subsp. paratuberculosis
cagucgcagcagca

SEQ ID NO: 2818777 - RNA, 15 nt, Mycobacterium avium subsp. paratuberculosis
cagucgcagcagcag

SEQ ID NO: 2818778 - RNA, 16 nt, Mycobacterium avium subsp. paratuberculosis
cagucgcaggccccgg

SEQ ID NO: 2818779 - RNA, 19 nt, Mycobacterium avium subsp. paratuberculosis
cagucgcauaugcgugggc

SEQ ID NO: 2818780 - RNA, 17 nt, Mycobacterium avium subsp. paratuberculosis
cagucgccgcgcagauc

SEQ ID NO: 2818781 - RNA, 15 nt, Mycobacterium avium subsp. paratuberculosis
cagucgccggccagg

SEQ ID NO: 2818782 - RNA, 15 nt, Mycobacterium avium subsp. paratuberculosis
cagucgcgcagcguc

SEQ ID NO: 2818783 - RNA, 16 nt, Mycobacterium avium subsp. paratuberculosis
cagucgcgcagcguca

SEQ ID NO: 2818784 - RNA, 23 nt, Mycobacterium avium subsp. paratuberculosis
cagucgcgcagcgucaucgcgua

SEQ ID NO: 2818785 - RNA, 23 nt, Mycobacterium avium subsp. paratuberculosis
cagucgcgccgagguggccgcca

SEQ ID NO: 2818786 - RNA, 13 nt, Mycobacterium avium subsp. paratuberculosis
cagucgcgccgcc

SEQ ID NO: 2818787 - RNA, 19 nt, Mycobacterium avium subsp. paratuberculosis
cagucgcgccgccagcaac

SEQ ID NO: 2818788 - RNA, 15 nt, Mycobacterium avium subsp. paratuberculosis
cagucgcggcgaacc

SEQ ID NO: 2818789 - RNA, 19 nt, Mycobacterium avium subsp. paratuberculosis
cagucgcggcgaaccagca

SEQ ID NO: 2818790 - RNA, 22 nt, Mycobacterium avium subsp. paratuberculosis
cagucgcggcgaaccagcaugc

SEQ ID NO: 2818791 - RNA, 23 nt, Mycobacterium avium subsp. paratuberculosis
cagucgcggcgaaccagcaugcg

SEQ ID NO: 2818792 - RNA, 15 nt, Mycobacterium avium subsp. paratuberculosis
cagucgcgggcagcc

SEQ ID NO: 2818793 - RNA, 20 nt, Mycobacterium avium subsp. paratuberculosis
cagucgcgggcgagccgaca

SEQ ID NO: 2818794 - RNA, 21 nt, Mycobacterium avium subsp. paratuberculosis
cagucgcgggcggggcgccga

SEQ ID NO: 2818795 - RNA, 23 nt, Mycobacterium avium subsp. paratuberculosis
cagucgcuggguguaaccggcuu

SEQ ID NO: 2818796 - RNA, 20 nt, Mycobacterium avium subsp. paratuberculosis
cagucgcuggucgaaccgcg

SEQ ID NO: 2818797 - RNA, 21 nt, Mycobacterium avium subsp. paratuberculosis
cagucgcuggucgaaccgcga

SEQ ID NO: 2818798 - RNA, 14 nt, Mycobacterium avium subsp. paratuberculosis
cagucggccaccgc

SEQ ID NO: 2818799 - RNA, 16 nt, Mycobacterium avium subsp. paratuberculosis
cagucggccaccgcga

SEQ ID NO: 2818800 - RNA, 19 nt, Mycobacterium avium subsp. paratuberculosis
cagucggccaucagcaccg

SEQ ID NO: 2818801 - RNA, 21 nt, Mycobacterium avium subsp. paratuberculosis
cagucggccaucagcaccgaa

SEQ ID NO: 2818802 - RNA, 14 nt, Mycobacterium avium subsp. paratuberculosis
cagucggccggcgu

SEQ ID NO: 2818803 - RNA, 15 nt, Mycobacterium avium subsp. paratuberculosis
cagucggccugcagc

SEQ ID NO: 2818804 - RNA, 14 nt, Mycobacterium avium subsp. paratuberculosis
cagucggcgccgau

SEQ ID NO: 2818805 - RNA, 17 nt, Mycobacterium avium subsp. paratuberculosis
cagucggcgccgaugca

SEQ ID NO: 2818806 - RNA, 16 nt, Mycobacterium avium subsp. paratuberculosis
cagucggcgcguuggc

SEQ ID NO: 2818807 - RNA, 14 nt, Mycobacterium avium subsp. paratuberculosis
cagucggcgucgcg

SEQ ID NO: 2818808 - RNA, 18 nt, Mycobacterium avium subsp. paratuberculosis
cagucggcgucgcggcgc

SEQ ID NO: 2818809 - RNA, 19 nt, Mycobacterium avium subsp. paratuberculosis
cagucggcgucgcggcgca

SEQ ID NO: 2818810 - RNA, 14 nt, Mycobacterium avium subsp. paratuberculosis
cagucggcgucuuc

SEQ ID NO: 2818811 - RNA, 13 nt, Mycobacterium avium subsp. paratuberculosis
cagucggucgguc

SEQ ID NO: 2818812 - RNA, 20 nt, Mycobacterium avium subsp. paratuberculosis
cagucguacucccaggccgc

SEQ ID NO: 2818813 - RNA, 21 nt, Mycobacterium avium subsp. paratuberculosis
cagucguacucccaggccgcg

SEQ ID NO: 2818814 - RNA, 13 nt, Mycobacterium avium subsp. paratuberculosis
cagucgugacgcg

SEQ ID NO: 2818815 - RNA, 15 nt, Mycobacterium avium subsp. paratuberculosis
cagucgugacgcggc

SEQ ID NO: 2818816 - RNA, 17 nt, Mycobacterium avium subsp. paratuberculosis
cagucgugacgcggcgu

SEQ ID NO: 2818817 - RNA, 22 nt, Mycobacterium avium subsp. paratuberculosis
cagucguuggugcgcaccagca

SEQ ID NO: 2818818 - RNA, 19 nt, Mycobacterium avium subsp. paratuberculosis
cagucugagcccgggcagg

SEQ ID NO: 2818819 - RNA, 23 nt, Mycobacterium avium subsp. paratuberculosis
cagucugagcccgggcaggcggc

SEQ ID NO: 2818820 - RNA, 13 nt, Mycobacterium avium subsp. paratuberculosis
cagugaccagugc

SEQ ID NO: 2818821 - RNA, 15 nt, Mycobacterium avium subsp. paratuberculosis
cagugaggccagcac

SEQ ID NO: 2818822 - RNA, 16 nt, Mycobacterium avium subsp. paratuberculosis
cagugaggccagcacc

SEQ ID NO: 2818823 - RNA, 18 nt, Mycobacterium avium subsp. paratuberculosis
cagugaggccagcacccg

SEQ ID NO: 2818824 - RNA, 20 nt, Mycobacterium avium subsp. paratuberculosis
cagugagggaacgccgauca

SEQ ID NO: 2818825 - RNA, 13 nt, Mycobacterium avium subsp. paratuberculosis
cagugcacgacga

SEQ ID NO: 2818826 - RNA, 13 nt, Mycobacterium avium subsp. paratuberculosis
cagugcacgcucg

SEQ ID NO: 2818827 - RNA, 14 nt, Mycobacterium avium subsp. paratuberculosis
cagugcacgcucgg

SEQ ID NO: 2818828 - RNA, 17 nt, Mycobacterium avium subsp. paratuberculosis
cagugcacgcucggcgc

SEQ ID NO: 2818829 - RNA, 22 nt, Mycobacterium avium subsp. paratuberculosis
cagugcacugccgacccggcgu

SEQ ID NO: 2818830 - RNA, 20 nt, Mycobacterium avium subsp. paratuberculosis
cagugcagguuccggaucaa

SEQ ID NO: 2818831 - RNA, 19 nt, Mycobacterium avium subsp. paratuberculosis
cagugcaguucgaugccga

SEQ ID NO: 2818832 - RNA, 20 nt, Mycobacterium avium subsp. paratuberculosis
cagugccaacacggcggcgc

SEQ ID NO: 2818833 - RNA, 14 nt, Mycobacterium avium subsp. paratuberculosis
cagugccaccacca

SEQ ID NO: 2818834 - RNA, 17 nt, Mycobacterium avium subsp. paratuberculosis
cagugccaccaccacgg

SEQ ID NO: 2818835 - RNA, 20 nt, Mycobacterium avium subsp. paratuberculosis
cagugccaccaccacggcca

SEQ ID NO: 2818836 - RNA, 22 nt, Mycobacterium avium subsp. paratuberculosis
cagugccaccaccacggccagg

SEQ ID NO: 2818837 - RNA, 16 nt, Mycobacterium avium subsp. paratuberculosis
cagugccaguaccagc

SEQ ID NO: 2818838 - RNA, 19 nt, Mycobacterium avium subsp. paratuberculosis
cagugccaguaccagcggc

SEQ ID NO: 2818839 - RNA, 21 nt, Mycobacterium avium subsp. paratuberculosis
cagugccaguaccagcggccg

SEQ ID NO: 2818840 - RNA, 23 nt, Mycobacterium avium subsp. paratuberculosis
cagugccaguaccagcggccguc

SEQ ID NO: 2818841 - RNA, 20 nt, Mycobacterium avium subsp. paratuberculosis
cagugccccguccggcgcca

SEQ ID NO: 2818842 - RNA, 22 nt, Mycobacterium avium subsp. paratuberculosis
cagugccccguccggcgccagc

SEQ ID NO: 2818843 - RNA, 16 nt, Mycobacterium avium subsp. paratuberculosis
cagugcccgagcaccu

SEQ ID NO: 2818844 - RNA, 15 nt, Mycobacterium avium subsp. paratuberculosis
cagugcccgcccagc

SEQ ID NO: 2818845 - RNA, 17 nt, Mycobacterium avium subsp. paratuberculosis
caguugcggcacgccga

SEQ ID NO: 2818846 - RNA, 20 nt, Mycobacterium avium subsp. paratuberculosis
caguugcggcacgccgacca

SEQ ID NO: 2818847 - RNA, 20 nt, Mycobacterium avium subsp. paratuberculosis
caguugcggccgcuucccac

SEQ ID NO: 2818848 - RNA, 16 nt, Mycobacterium avium subsp. paratuberculosis
caguuggcgucgucgg

SEQ ID NO: 2818849 - RNA, 17 nt, Mycobacterium avium subsp. paratuberculosis
caguugggggccagcgc

SEQ ID NO: 2818850 - RNA, 20 nt, Mycobacterium avium subsp. paratuberculosis
caguugggggccagcgccga

SEQ ID NO: 2818851 - RNA, 16 nt, Mycobacterium avium subsp. paratuberculosis
caguuguuggccgggc

SEQ ID NO: 2818852 - RNA, 18 nt, Mycobacterium avium subsp. paratuberculosis
caguuguuuccccagccc

SEQ ID NO: 2818853 - RNA, 17 nt, Mycobacterium avium subsp. paratuberculosis
cauaacgcucccgguag

SEQ ID NO: 2818854 - RNA, 22 nt, Mycobacterium avium subsp. paratuberculosis
cauaacgcucccgguagagcgg

SEQ ID NO: 2818855 - RNA, 21 nt, Mycobacterium avium subsp. paratuberculosis
cauacaccgggaucggcggcg

SEQ ID NO: 2818856 - RNA, 15 nt, Mycobacterium avium subsp. paratuberculosis
cauacagcaggcugu

SEQ ID NO: 2818857 - RNA, 13 nt, Mycobacterium avium subsp. paratuberculosis
cauaccagcgcug

SEQ ID NO: 2818858 - RNA, 15 nt, Mycobacterium avium subsp. paratuberculosis
cauaccagcgcuggu

SEQ ID NO: 2818859 - RNA, 18 nt, Mycobacterium avium subsp. paratuberculosis
cauaccagugcccgagca

SEQ ID NO: 2818860 - RNA, 22 nt, Mycobacterium avium subsp. paratuberculosis
cauaccagugcccgagcaccug

SEQ ID NO: 2818861 - RNA, 18 nt, Mycobacterium avium subsp. paratuberculosis
cauaccgggacaucgucg

SEQ ID NO: 2818862 - RNA, 19 nt, Mycobacterium avium subsp. paratuberculosis
cauaccgggacaucgucgc

SEQ ID NO: 2818863 - RNA, 19 nt, Mycobacterium avium subsp. paratuberculosis
cauacgccucaccccagcg

SEQ ID NO: 2818864 - RNA, 20 nt, Mycobacterium avium subsp. paratuberculosis
cauacgccucaccccagcgc

SEQ ID NO: 2818865 - RNA, 11 nt, Mycobacterium avium subsp. paratuberculosis
cauacgcggcg

SEQ ID NO: 2818866 - RNA, 12 nt, Mycobacterium avium subsp. paratuberculosis
cauacgcggcgg

SEQ ID NO: 2818867 - RNA, 14 nt, Mycobacterium avium subsp. paratuberculosis
cauacugacgccgg

SEQ ID NO: 2818868 - RNA, 21 nt, Mycobacterium avium subsp. paratuberculosis
cauacugcuugccgucgacgc

SEQ ID NO: 2818869 - RNA, 22 nt, Mycobacterium avium subsp. paratuberculosis
cauagacguuacgguagcacuu

SEQ ID NO: 2818870 - RNA, 18 nt, Mycobacterium avium subsp. paratuberculosis
cauagagcuggugggcca

SEQ ID NO: 2818871 - RNA, 20 nt, Mycobacterium avium subsp. paratuberculosis
cauagauaccggccagcacg

SEQ ID NO: 2818872 - RNA, 18 nt, Mycobacterium avium subsp. paratuberculosis
cauagcccaucagcacgc

SEQ ID NO: 2818873 - RNA, 17 nt, Mycobacterium avium subsp. paratuberculosis
cauagccggccgcgucg

SEQ ID NO: 2818874 - RNA, 18 nt, Mycobacterium avium subsp. paratuberculosis
cauagccggccgcgucgc

SEQ ID NO: 2818875 - RNA, 23 nt, Mycobacterium avium subsp. paratuberculosis
cauagccggccgcgucgccgacc

SEQ ID NO: 2818876 - RNA, 17 nt, Mycobacterium avium subsp. paratuberculosis
cauagcgccgcucggcc

SEQ ID NO: 2818877 - RNA, 18 nt, Mycobacterium avium subsp. paratuberculosis
cauagcgccgcucggccg

SEQ ID NO: 2818878 - RNA, 15 nt, Mycobacterium avium subsp. paratuberculosis
cauagcgggagccgg

SEQ ID NO: 2818879 - RNA, 15 nt, Mycobacterium avium subsp. paratuberculosis
cauagcuggcgccga

SEQ ID NO: 2818880 - RNA, 14 nt, Mycobacterium avium subsp. paratuberculosis
cauaggccagcacc

SEQ ID NO: 2818881 - RNA, 18 nt, Mycobacterium avium subsp. paratuberculosis
cauaggccagcaccagcg

SEQ ID NO: 2818882 - RNA, 23 nt, Mycobacterium avium subsp. paratuberculosis
cauaggccagcaccagcguguag

SEQ ID NO: 2818883 - RNA, 15 nt, Mycobacterium avium subsp. paratuberculosis
cauaggccgcgagga

SEQ ID NO: 2818884 - RNA, 15 nt, Mycobacterium avium subsp. paratuberculosis
cauaggccgcgcaga

SEQ ID NO: 2818885 - RNA, 20 nt, Mycobacterium avium subsp. paratuberculosis
cauaggcgucgcggucggcg

SEQ ID NO: 2818886 - RNA, 14 nt, Mycobacterium avium subsp. paratuberculosis
cauagucggcccga

SEQ ID NO: 2818887 - RNA, 16 nt, Mycobacterium avium subsp. paratuberculosis
cauauaggggugggcg

SEQ ID NO: 2818888 - RNA, 14 nt, Mycobacterium avium subsp. paratuberculosis
cauaucgacggccc

SEQ ID NO: 2818889 - RNA, 15 nt, Mycobacterium avium subsp. paratuberculosis
cauaucgacggcccc

SEQ ID NO: 2818890 - RNA, 21 nt, Mycobacterium avium subsp. paratuberculosis
cauaucgacggccccccgggc

SEQ ID NO: 2818891 - RNA, 22 nt, Mycobacterium avium subsp. paratuberculosis
cauaugacgccggccucucguc

SEQ ID NO: 2818892 - RNA, 14 nt, Mycobacterium avium subsp. paratuberculosis
caucaacccgagca

SEQ ID NO: 2818893 - RNA, 17 nt, Mycobacterium avium subsp. paratuberculosis
caucaacugcaccagcg

SEQ ID NO: 2818894 - RNA, 19 nt, Mycobacterium avium subsp. paratuberculosis
caucaacugcaccagcggc

SEQ ID NO: 2818895 - RNA, 21 nt, Mycobacterium avium subsp. paratuberculosis
caucaccaaccgcucggcgau

SEQ ID NO: 2818896 - RNA, 14 nt, Mycobacterium avium subsp. paratuberculosis
caucaccaccgccg

SEQ ID NO: 2818897 - RNA, 15 nt, Mycobacterium avium subsp. paratuberculosis
caucaccaccgccgc

SEQ ID NO: 2818898 - RNA, 19 nt, Mycobacterium avium subsp. paratuberculosis
caucaccaccgccgccgac

SEQ ID NO: 2818899 - RNA, 22 nt, Mycobacterium avium subsp. paratuberculosis
caucaccacgcuguagggccac

SEQ ID NO: 2818900 - RNA, 13 nt, Mycobacterium avium subsp. paratuberculosis
caucaccagcaga

SEQ ID NO: 2818901 - RNA, 11 nt, Mycobacterium avium subsp. paratuberculosis
caucaccagcg

SEQ ID NO: 2818902 - RNA, 19 nt, Mycobacterium avium subsp. paratuberculosis
caucaccagcgcguagagc

SEQ ID NO: 2818903 - RNA, 20 nt, Mycobacterium avium subsp. paratuberculosis
caucaccagcggcugcagca

SEQ ID NO: 2818904 - RNA, 13 nt, Mycobacterium avium subsp. paratuberculosis
caucacccggcgc

SEQ ID NO: 2818905 - RNA, 14 nt, Mycobacterium avium subsp. paratuberculosis
caucacccggcgcg

SEQ ID NO: 2818906 - RNA, 16 nt, Mycobacterium avium subsp. paratuberculosis
caucacccggcgcgcg

SEQ ID NO: 2818907 - RNA, 17 nt, Mycobacterium avium subsp. paratuberculosis
caucacccggcgcgcgg

SEQ ID NO: 2818908 - RNA, 20 nt, Mycobacterium avium subsp. paratuberculosis
caucaccgaggucaccgcga

SEQ ID NO: 2818909 - RNA, 17 nt, Mycobacterium avium subsp. paratuberculosis
caucaccgcaccgacga

SEQ ID NO: 2818910 - RNA, 13 nt, Mycobacterium avium subsp. paratuberculosis
caucaccgccgag

SEQ ID NO: 2818911 - RNA, 20 nt, Mycobacterium avium subsp. paratuberculosis
caucaccgcgggcgcgccgu

SEQ ID NO: 2818912 - RNA, 13 nt, Mycobacterium avium subsp. paratuberculosis
caucaccggaccg

SEQ ID NO: 2818913 - RNA, 21 nt, Mycobacterium avium subsp. paratuberculosis
caucaccggaccggccagcag

SEQ ID NO: 2818914 - RNA, 23 nt, Mycobacterium avium subsp. paratuberculosis
caucaccggaccggccagcagcc

SEQ ID NO: 2818915 - RNA, 24 nt, Mycobacterium avium subsp. paratuberculosis
caucaccggaccggccagcagccg

SEQ ID NO: 2818916 - RNA, 13 nt, Mycobacterium avium subsp. paratuberculosis
caucaccggcgcg

SEQ ID NO: 2818917 - RNA, 16 nt, Mycobacterium avium subsp. paratuberculosis
caucaccggcgcgccg

SEQ ID NO: 2818918 - RNA, 18 nt, Mycobacterium avium subsp. paratuberculosis
caucaccggcgcgccguc

SEQ ID NO: 2818919 - RNA, 21 nt, Mycobacterium avium subsp. paratuberculosis
caucaccgggauggugaccag

SEQ ID NO: 2818920 - RNA, 14 nt, Mycobacterium avium subsp. paratuberculosis
caucaccggggauc

SEQ ID NO: 2818921 - RNA, 20 nt, Mycobacterium avium subsp. paratuberculosis
caucaccuccuuggccaggc

SEQ ID NO: 2818922 - RNA, 18 nt, Mycobacterium avium subsp. paratuberculosis
caucaccuucugcgcgcc

SEQ ID NO: 2818923 - RNA, 21 nt, Mycobacterium avium subsp. paratuberculosis
caucaccuucugcgcgccguc

SEQ ID NO: 2818924 - RNA, 19 nt, Mycobacterium avium subsp. paratuberculosis
caucaccuugucgcugacc

SEQ ID NO: 2818925 - RNA, 22 nt, Mycobacterium avium subsp. paratuberculosis
caucacgaacgcguucgucggc

SEQ ID NO: 2818926 - RNA, 16 nt, Mycobacterium avium subsp. paratuberculosis
caucacgauggugccc

SEQ ID NO: 2818927 - RNA, 16 nt, Mycobacterium avium subsp. paratuberculosis
caucacgccccggcgu

SEQ ID NO: 2818928 - RNA, 14 nt, Mycobacterium avium subsp. paratuberculosis
caucacggugccga

SEQ ID NO: 2818929 - RNA, 15 nt, Mycobacterium avium subsp. paratuberculosis
caucacggugccgag

SEQ ID NO: 2818930 - RNA, 23 nt, Mycobacterium avium subsp. paratuberculosis
caucccggagaacaucagccccu

SEQ ID NO: 2818931 - RNA, 16 nt, Mycobacterium avium subsp. paratuberculosis
caucccggagccgucg

SEQ ID NO: 2818932 - RNA, 16 nt, Mycobacterium avium subsp. paratuberculosis
caucccggccaccccg

SEQ ID NO: 2818933 - RNA, 16 nt, Mycobacterium avium subsp. paratuberculosis
caucccggggacaccg

SEQ ID NO: 2818934 - RNA, 15 nt, Mycobacterium avium subsp. paratuberculosis
caucccggugccgcu

SEQ ID NO: 2818935 - RNA, 22 nt, Mycobacterium avium subsp. paratuberculosis
caucccgguggacgcgauggcg

SEQ ID NO: 2818936 - RNA, 22 nt, Mycobacterium avium subsp. paratuberculosis
caucccguugcgcaugacggcc

SEQ ID NO: 2818937 - RNA, 20 nt, Mycobacterium avium subsp. paratuberculosis
caucccugacacgaccgccu

SEQ ID NO: 2818938 - RNA, 15 nt, Mycobacterium avium subsp. paratuberculosis
caucccuggugaccg

SEQ ID NO: 2818939 - RNA, 15 nt, Mycobacterium avium subsp. paratuberculosis
cauccgacaccgccu

SEQ ID NO: 2818940 - RNA, 21 nt, Mycobacterium avium subsp. paratuberculosis
cauccgcaacgugcgccggcc

SEQ ID NO: 2818941 - RNA, 23 nt, Mycobacterium avium subsp. paratuberculosis
cauccgcaacgugcgccggccua

SEQ ID NO: 2818942 - RNA, 14 nt, Mycobacterium avium subsp. paratuberculosis
cauccgcaccgaga

SEQ ID NO: 2818943 - RNA, 15 nt, Mycobacterium avium subsp. paratuberculosis
cauccgcagcaccag

SEQ ID NO: 2818944 - RNA, 17 nt, Mycobacterium avium subsp. paratuberculosis
cauccgcagcaccaggg

SEQ ID NO: 2818945 - RNA, 16 nt, Mycobacterium avium subsp. paratuberculosis
cauccgcagcccgucg

SEQ ID NO: 2818946 - RNA, 16 nt, Mycobacterium avium subsp. paratuberculosis
cauccgccacccgcug

SEQ ID NO: 2818947 - RNA, 17 nt, Mycobacterium avium subsp. paratuberculosis
cauccgccacccgcugc

SEQ ID NO: 2818948 - RNA, 12 nt, Mycobacterium avium subsp. paratuberculosis
cauccgccgacg

SEQ ID NO: 2818949 - RNA, 13 nt, Mycobacterium avium subsp. paratuberculosis
cauccgccgacga

SEQ ID NO: 2818950 - RNA, 14 nt, Mycobacterium avium subsp. paratuberculosis
cauccgccgucgac

SEQ ID NO: 2818951 - RNA, 19 nt, Mycobacterium avium subsp. paratuberculosis
cauccgccgucgaccacga

SEQ ID NO: 2818952 - RNA, 20 nt, Mycobacterium avium subsp. paratuberculosis
cauccgcgacgacaccaccg

SEQ ID NO: 2818953 - RNA, 15 nt, Mycobacterium avium subsp. paratuberculosis
cauccgcgagccgag

SEQ ID NO: 2818954 - RNA, 16 nt, Mycobacterium avium subsp. paratuberculosis
cauccgcgagccgagc

SEQ ID NO: 2818955 - RNA, 17 nt, Mycobacterium avium subsp. paratuberculosis
cauccgcgagccgagcc

SEQ ID NO: 2818956 - RNA, 13 nt, Mycobacterium avium subsp. paratuberculosis
cauccgcgcgagc

SEQ ID NO: 2818957 - RNA, 16 nt, Mycobacterium avium subsp. paratuberculosis
cauccgcgcgagcgcg

SEQ ID NO: 2818958 - RNA, 15 nt, Mycobacterium avium subsp. paratuberculosis
cauccgcggccaccg

SEQ ID NO: 2818959 - RNA, 16 nt, Mycobacterium avium subsp. paratuberculosis
cauccgcggccaccgg

SEQ ID NO: 2818960 - RNA, 17 nt, Mycobacterium avium subsp. paratuberculosis
cauccgcucgccgcggg

SEQ ID NO: 2818961 - RNA, 13 nt, Mycobacterium avium subsp. paratuberculosis
cauccgcuggugc

SEQ ID NO: 2818962 - RNA, 17 nt, Mycobacterium avium subsp. paratuberculosis
cauccgcuggugcgcgc

SEQ ID NO: 2818963 - RNA, 18 nt, Mycobacterium avium subsp. paratuberculosis
cauccgcuggugcgcgcc

SEQ ID NO: 2818964 - RNA, 19 nt, Mycobacterium avium subsp. paratuberculosis
cauccgcuggugcgcgccg

SEQ ID NO: 2818965 - RNA, 18 nt, Mycobacterium avium subsp. paratuberculosis
cauccggaaccgggcacc

SEQ ID NO: 2818966 - RNA, 22 nt, Mycobacterium avium subsp. paratuberculosis
cauccggaaccgggcacccggc

SEQ ID NO: 2818967 - RNA, 13 nt, Mycobacterium avium subsp. paratuberculosis
cauccggaagcgg

SEQ ID NO: 2818968 - RNA, 17 nt, Mycobacterium avium subsp. paratuberculosis
cauccggccggcgagga

SEQ ID NO: 2818969 - RNA, 19 nt, Mycobacterium avium subsp. paratuberculosis
cauccggccggcgaggaac

SEQ ID NO: 2818970 - RNA, 20 nt, Mycobacterium avium subsp. paratuberculosis
cauccggccggcgaggaacu

SEQ ID NO: 2818971 - RNA, 21 nt, Mycobacterium avium subsp. paratuberculosis
cauccggcgcacggcgcccag

SEQ ID NO: 2818972 - RNA, 16 nt, Mycobacterium avium subsp. paratuberculosis
cauccggcgccgcgca

SEQ ID NO: 2818973 - RNA, 21 nt, Mycobacterium avium subsp. paratuberculosis
cauccggcucagaaggcguca

SEQ ID NO: 2818974 - RNA, 16 nt, Mycobacterium avium subsp. paratuberculosis
cauccgggagacgucc

SEQ ID NO: 2818975 - RNA, 14 nt, Mycobacterium avium subsp. paratuberculosis
cauccgggccacca

SEQ ID NO: 2818976 - RNA, 15 nt, Mycobacterium avium subsp. paratuberculosis
cauccgggccaccac

SEQ ID NO: 2818977 - RNA, 17 nt, Mycobacterium avium subsp. paratuberculosis
cauccgggccaccacca

SEQ ID NO: 2818978 - RNA, 23 nt, Mycobacterium avium subsp. paratuberculosis
cauccgggccaccaccacggccg

SEQ ID NO: 2818979 - RNA, 18 nt, Mycobacterium avium subsp. paratuberculosis
cauccgggcggcaucgcg

SEQ ID NO: 2818980 - RNA, 14 nt, Mycobacterium avium subsp. paratuberculosis
cauccgggcggcca

SEQ ID NO: 2818981 - RNA, 18 nt, Mycobacterium avium subsp. paratuberculosis
cauccgggcggccagccg

SEQ ID NO: 2818982 - RNA, 23 nt, Mycobacterium avium subsp. paratuberculosis
cauccggguuucgaagacgcccc

SEQ ID NO: 2818983 - RNA, 21 nt, Mycobacterium avium subsp. paratuberculosis
cauccgguccagaucggcgcg

SEQ ID NO: 2818984 - RNA, 18 nt, Mycobacterium avium subsp. paratuberculosis
cauccggugccgagcgcg

SEQ ID NO: 2818985 - RNA, 20 nt, Mycobacterium avium subsp. paratuberculosis
cauccggugccgagcgcgcu

SEQ ID NO: 2818986 - RNA, 17 nt, Mycobacterium avium subsp. paratuberculosis
cauccgguugcaccgcg

SEQ ID NO: 2818987 - RNA, 15 nt, Mycobacterium avium subsp. paratuberculosis
cauccgucgcccgcg

SEQ ID NO: 2818988 - RNA, 12 nt, Mycobacterium avium subsp. paratuberculosis
cauccguucggc

SEQ ID NO: 2818989 - RNA, 18 nt, Mycobacterium avium subsp. paratuberculosis
cauccucauagccggccg

SEQ ID NO: 2818990 - RNA, 19 nt, Mycobacterium avium subsp. paratuberculosis
cauccucauagccggccgc

SEQ ID NO: 2818991 - RNA, 24 nt, Mycobacterium avium subsp. paratuberculosis
cauccugaagaagcggccguagcg

SEQ ID NO: 2818992 - RNA, 14 nt, Mycobacterium avium subsp. paratuberculosis
cauccugggcgucg

SEQ ID NO: 2818993 - RNA, 17 nt, Mycobacterium avium subsp. paratuberculosis
cauccugggcgucgagu

SEQ ID NO: 2818994 - RNA, 21 nt, Mycobacterium avium subsp. paratuberculosis
cauccugguccggcgcccgau

SEQ ID NO: 2818995 - RNA, 23 nt, Mycobacterium avium subsp. paratuberculosis
cauccugguccggcgcccgaucg

SEQ ID NO: 2818996 - RNA, 17 nt, Mycobacterium avium subsp. paratuberculosis
cauccugucauccgucg

SEQ ID NO: 2818997 - RNA, 13 nt, Mycobacterium avium subsp. paratuberculosis
caucgaaccgccg

SEQ ID NO: 2818998 - RNA, 22 nt, Mycobacterium avium subsp. paratuberculosis
caucgaaccgccgcgcucgcac

SEQ ID NO: 2818999 - RNA, 14 nt, Mycobacterium avium subsp. paratuberculosis
caucgacaugcccg

SEQ ID NO: 2819000 - RNA, 12 nt, Mycobacterium avium subsp. paratuberculosis
caucgaccgccc

SEQ ID NO: 2819001 - RNA, 17 nt, Mycobacterium avium subsp. paratuberculosis
caucgaccggaugaugc

SEQ ID NO: 2819002 - RNA, 14 nt, Mycobacterium avium subsp. paratuberculosis
caucgaccggcgga

SEQ ID NO: 2819003 - RNA, 20 nt, Mycobacterium avium subsp. paratuberculosis
caucgaccggcggaaguagc

SEQ ID NO: 2819004 - RNA, 20 nt, Mycobacterium avium subsp. paratuberculosis
caucgacggaucgcccuggc

SEQ ID NO: 2819005 - RNA, 14 nt, Mycobacterium avium subsp. paratuberculosis
caucgacuccagca

SEQ ID NO: 2819006 - RNA, 17 nt, Mycobacterium avium subsp. paratuberculosis
caucgacuccagcaccg

SEQ ID NO: 2819007 - RNA, 20 nt, Mycobacterium avium subsp. paratuberculosis
caucgacucgaagaaccgca

SEQ ID NO: 2819008 - RNA, 16 nt, Mycobacterium avium subsp. paratuberculosis
caucgacugcgacacc

SEQ ID NO: 2819009 - RNA, 16 nt, Mycobacterium avium subsp. paratuberculosis
caucgacuugccgccg

SEQ ID NO: 2819010 - RNA, 20 nt, Mycobacterium avium subsp. paratuberculosis
caucgagcaguagacgccgc

SEQ ID NO: 2819011 - RNA, 22 nt, Mycobacterium avium subsp. paratuberculosis
caucgagcaguagacgccgccg

SEQ ID NO: 2819012 - RNA, 16 nt, Mycobacterium avium subsp. paratuberculosis
caucgagcccaccgcg

SEQ ID NO: 2819013 - RNA, 20 nt, Mycobacterium avium subsp. paratuberculosis
caucgagcccaccgcgccca

SEQ ID NO: 2819014 - RNA, 13 nt, Mycobacterium avium subsp. paratuberculosis
caucgagccgagc

SEQ ID NO: 2819015 - RNA, 21 nt, Mycobacterium avium subsp. paratuberculosis
caucgcggccgcccgguccgg

SEQ ID NO: 2819016 - RNA, 13 nt, Mycobacterium avium subsp. paratuberculosis
caucgcggcgacc

SEQ ID NO: 2819017 - RNA, 19 nt, Mycobacterium avium subsp. paratuberculosis
caucgcggcgacccgcuuc

SEQ ID NO: 2819018 - RNA, 14 nt, Mycobacterium avium subsp. paratuberculosis
caucgcggcgaugg

SEQ ID NO: 2819019 - RNA, 17 nt, Mycobacterium avium subsp. paratuberculosis
caucgcggcgauggugu

SEQ ID NO: 2819020 - RNA, 18 nt, Mycobacterium avium subsp. paratuberculosis
caucgcggcgaugguguc

SEQ ID NO: 2819021 - RNA, 19 nt, Mycobacterium avium subsp. paratuberculosis
caucgcggcguuguggcca

SEQ ID NO: 2819022 - RNA, 22 nt, Mycobacterium avium subsp. paratuberculosis
caucgcggcguuguggccaccg

SEQ ID NO: 2819023 - RNA, 16 nt, Mycobacterium avium subsp. paratuberculosis
caucgcgggccaccgg

SEQ ID NO: 2819024 - RNA, 17 nt, Mycobacterium avium subsp. paratuberculosis
caucgcgggccaccggc

SEQ ID NO: 2819025 - RNA, 18 nt, Mycobacterium avium subsp. paratuberculosis
caucgcgggccaccggcg

SEQ ID NO: 2819026 - RNA, 12 nt, Mycobacterium avium subsp. paratuberculosis
caucgcgucguc

SEQ ID NO: 2819027 - RNA, 17 nt, Mycobacterium avium subsp. paratuberculosis
caucgcugacuccaucc

SEQ ID NO: 2819028 - RNA, 20 nt, Mycobacterium avium subsp. paratuberculosis
caucgcugacuccaucccgu

SEQ ID NO: 2819029 - RNA, 22 nt, Mycobacterium avium subsp. paratuberculosis
caucgcugccguccacccggcc

SEQ ID NO: 2819030 - RNA, 22 nt, Mycobacterium avium subsp. paratuberculosis
caucgcuggggugcccaccagc

SEQ ID NO: 2819031 - RNA, 23 nt, Mycobacterium avium subsp. paratuberculosis
caucgcuggggugcccaccagca

SEQ ID NO: 2819032 - RNA, 17 nt, Mycobacterium avium subsp. paratuberculosis
caucgcugguggccgac

SEQ ID NO: 2819033 - RNA, 19 nt, Mycobacterium avium subsp. paratuberculosis
caucgcugguggccgacgu

SEQ ID NO: 2819034 - RNA, 17 nt, Mycobacterium avium subsp. paratuberculosis
caucgcuuuccggucag

SEQ ID NO: 2819035 - RNA, 19 nt, Mycobacterium avium subsp. paratuberculosis
caucggagagcuugccgcg

SEQ ID NO: 2819036 - RNA, 22 nt, Mycobacterium avium subsp. paratuberculosis
caucggagagcuugccgcggau

SEQ ID NO: 2819037 - RNA, 16 nt, Mycobacterium avium subsp. paratuberculosis
caucggaugccggggc

SEQ ID NO: 2819038 - RNA, 18 nt, Mycobacterium avium subsp. paratuberculosis
caucggaugccggggcag

SEQ ID NO: 2819039 - RNA, 17 nt, Mycobacterium avium subsp. paratuberculosis
caucggauucgucgguc

SEQ ID NO: 2819040 - RNA, 23 nt, Mycobacterium avium subsp. paratuberculosis
caucggcacguguccgacgccgu

SEQ ID NO: 2819041 - RNA, 22 nt, Mycobacterium avium subsp. paratuberculosis
caucggcagacccagcagcggc

SEQ ID NO: 2819042 - RNA, 23 nt, Mycobacterium avium subsp. paratuberculosis
caucggcagcagggugccgccgc

SEQ ID NO: 2819043 - RNA, 13 nt, Mycobacterium avium subsp. paratuberculosis
caucggcagcccg

SEQ ID NO: 2819044 - RNA, 18 nt, Mycobacterium avium subsp. paratuberculosis
caucggcaguccgcgccg

SEQ ID NO: 2819045 - RNA, 23 nt, Mycobacterium avium subsp. paratuberculosis
caucggcaguccgcgccgguccc

SEQ ID NO: 2819046 - RNA, 19 nt, Mycobacterium avium subsp. paratuberculosis
caucggcaucgcgcgcggc

SEQ ID NO: 2819047 - RNA, 14 nt, Mycobacterium avium subsp. paratuberculosis
caucggccgccuug

SEQ ID NO: 2819048 - RNA, 15 nt, Mycobacterium avium subsp. paratuberculosis
caucggcgacgccgc

SEQ ID NO: 2819049 - RNA, 16 nt, Mycobacterium avium subsp. paratuberculosis
caucggcgacgccgcc

SEQ ID NO: 2819050 - RNA, 24 nt, Mycobacterium avium subsp. paratuberculosis
caucggcgacggcgacggcguccg

SEQ ID NO: 2819051 - RNA, 14 nt, Mycobacterium avium subsp. paratuberculosis
caucggcgcccucg

SEQ ID NO: 2819052 - RNA, 18 nt, Mycobacterium avium subsp. paratuberculosis
caucggcgcccucgccga

SEQ ID NO: 2819053 - RNA, 17 nt, Mycobacterium avium subsp. paratuberculosis
caucggcgccgacgggg

SEQ ID NO: 2819054 - RNA, 13 nt, Mycobacterium avium subsp. paratuberculosis
caucggcgccgga

SEQ ID NO: 2819055 - RNA, 12 nt, Mycobacterium avium subsp. paratuberculosis
caucggcgccug

SEQ ID NO: 2819056 - RNA, 14 nt, Mycobacterium avium subsp. paratuberculosis
caucggcggaagcu

SEQ ID NO: 2819057 - RNA, 17 nt, Mycobacterium avium subsp. paratuberculosis
caucggcucgaucguca

SEQ ID NO: 2819058 - RNA, 14 nt, Mycobacterium avium subsp. paratuberculosis
caucggcucguagc

SEQ ID NO: 2819059 - RNA, 16 nt, Mycobacterium avium subsp. paratuberculosis
caucggcuggucggcg

SEQ ID NO: 2819060 - RNA, 16 nt, Mycobacterium avium subsp. paratuberculosis
caucgggaccgcgggc

SEQ ID NO: 2819061 - RNA, 19 nt, Mycobacterium avium subsp. paratuberculosis
caucgggacgccugccgcc

SEQ ID NO: 2819062 - RNA, 18 nt, Mycobacterium avium subsp. paratuberculosis
caucgggauuggcggcca

SEQ ID NO: 2819063 - RNA, 23 nt, Mycobacterium avium subsp. paratuberculosis
caucgggcccagcagccugcccc

SEQ ID NO: 2819064 - RNA, 15 nt, Mycobacterium avium subsp. paratuberculosis
caucgggcccgacga

SEQ ID NO: 2819065 - RNA, 17 nt, Mycobacterium avium subsp. paratuberculosis
caucgggcccgacgacg

SEQ ID NO: 2819066 - RNA, 20 nt, Mycobacterium avium subsp. paratuberculosis
caucgggcccgacgacgauc

SEQ ID NO: 2819067 - RNA, 21 nt, Mycobacterium avium subsp. paratuberculosis
caucgggcgacaucucgguga

SEQ ID NO: 2819068 - RNA, 22 nt, Mycobacterium avium subsp. paratuberculosis
caucgggcgacaucucggugag

SEQ ID NO: 2819069 - RNA, 23 nt, Mycobacterium avium subsp. paratuberculosis
caucgggguuuugaucagcccgg

SEQ ID NO: 2819070 - RNA, 14 nt, Mycobacterium avium subsp. paratuberculosis
caucgggucgucgg

SEQ ID NO: 2819071 - RNA, 19 nt, Mycobacterium avium subsp. paratuberculosis
caucgggucgucggcgucg

SEQ ID NO: 2819072 - RNA, 16 nt, Mycobacterium avium subsp. paratuberculosis
caucggguugccggcg

SEQ ID NO: 2819073 - RNA, 19 nt, Mycobacterium avium subsp. paratuberculosis
caucggguugccggcggcc

SEQ ID NO: 2819074 - RNA, 13 nt, Mycobacterium avium subsp. paratuberculosis
caucggucccagu

SEQ ID NO: 2819075 - RNA, 14 nt, Mycobacterium avium subsp. paratuberculosis
caucggugaccguc

SEQ ID NO: 2819076 - RNA, 15 nt, Mycobacterium avium subsp. paratuberculosis
caucggugaccgucg

SEQ ID NO: 2819077 - RNA, 16 nt, Mycobacterium avium subsp. paratuberculosis
caucgguggcaccccg

SEQ ID NO: 2819078 - RNA, 20 nt, Mycobacterium avium subsp. paratuberculosis
caucgucaaagccguucgcg

SEQ ID NO: 2819079 - RNA, 13 nt, Mycobacterium avium subsp. paratuberculosis
caucgucaacaug

SEQ ID NO: 2819080 - RNA, 18 nt, Mycobacterium avium subsp. paratuberculosis
caucgucacuucgccggg

SEQ ID NO: 2819081 - RNA, 19 nt, Mycobacterium avium subsp. paratuberculosis
caucgucacuucgccgggc

SEQ ID NO: 2819082 - RNA, 18 nt, Mycobacterium avium subsp. paratuberculosis
caucgucauccccuggcc

SEQ ID NO: 2819083 - RNA, 16 nt, Mycobacterium avium subsp. paratuberculosis
caucguccacaccggg

SEQ ID NO: 2819084 - RNA, 19 nt, Mycobacterium avium subsp. paratuberculosis
caucguccacaccgggaag

SEQ ID NO: 2819085 - RNA, 13 nt, Mycobacterium avium subsp. paratuberculosis
caucguccccucc

SEQ ID NO: 2819086 - RNA, 18 nt, Mycobacterium avium subsp. paratuberculosis
caucguccucgcgccgug

SEQ ID NO: 2819087 - RNA, 13 nt, Mycobacterium avium subsp. paratuberculosis
caucgucgacccg

SEQ ID NO: 2819088 - RNA, 17 nt, Mycobacterium avium subsp. paratuberculosis
caucgucgcgcccagga

SEQ ID NO: 2819089 - RNA, 15 nt, Mycobacterium avium subsp. paratuberculosis
caucgucgcggcgcu

SEQ ID NO: 2819090 - RNA, 12 nt, Mycobacterium avium subsp. paratuberculosis
caucgucggcgc

SEQ ID NO: 2819091 - RNA, 16 nt, Mycobacterium avium subsp. paratuberculosis
caucgucggcgccggc

SEQ ID NO: 2819092 - RNA, 18 nt, Mycobacterium avium subsp. paratuberculosis
caucgucggcgccggcgc

SEQ ID NO: 2819093 - RNA, 19 nt, Mycobacterium avium subsp. paratuberculosis
caucgucggcgccggcgcg

SEQ ID NO: 2819094 - RNA, 20 nt, Mycobacterium avium subsp. paratuberculosis
caucgucggcgccggcgcgc

SEQ ID NO: 2819095 - RNA, 21 nt, Mycobacterium avium subsp. paratuberculosis
caucgucggcgccggcgcgca

SEQ ID NO: 2819096 - RNA, 23 nt, Mycobacterium avium subsp. paratuberculosis
caucgucggcgccggcgcgcaac

SEQ ID NO: 2819097 - RNA, 14 nt, Mycobacterium avium subsp. paratuberculosis
caucgucggggacg

SEQ ID NO: 2819098 - RNA, 18 nt, Mycobacterium avium subsp. paratuberculosis
caucgucggggacgaaga

SEQ ID NO: 2819099 - RNA, 15 nt, Mycobacterium avium subsp. paratuberculosis
caugaugcggccaug

SEQ ID NO: 2819100 - RNA, 15 nt, Mycobacterium avium subsp. paratuberculosis
caugauguagcggcg

SEQ ID NO: 2819101 - RNA, 16 nt, Mycobacterium avium subsp. paratuberculosis
caugcaccggugcacc

SEQ ID NO: 2819102 - RNA, 19 nt, Mycobacterium avium subsp. paratuberculosis
caugcaccggugcaccgcg

SEQ ID NO: 2819103 - RNA, 12 nt, Mycobacterium avium subsp. paratuberculosis
caugcacggcgc

SEQ ID NO: 2819104 - RNA, 15 nt, Mycobacterium avium subsp. paratuberculosis
caugcagaccagccc

SEQ ID NO: 2819105 - RNA, 14 nt, Mycobacterium avium subsp. paratuberculosis
caugcagccgccgc

SEQ ID NO: 2819106 - RNA, 15 nt, Mycobacterium avium subsp. paratuberculosis
caugcagccgccgcg

SEQ ID NO: 2819107 - RNA, 17 nt, Mycobacterium avium subsp. paratuberculosis
caugcagccgccgcgga

SEQ ID NO: 2819108 - RNA, 16 nt, Mycobacterium avium subsp. paratuberculosis
caugccacuugcgcac

SEQ ID NO: 2819109 - RNA, 20 nt, Mycobacterium avium subsp. paratuberculosis
caugccacuugcgcacguac

SEQ ID NO: 2819110 - RNA, 23 nt, Mycobacterium avium subsp. paratuberculosis
caugcccaccaucccgccgccga

SEQ ID NO: 2819111 - RNA, 16 nt, Mycobacterium avium subsp. paratuberculosis
caugcccacgccgucg

SEQ ID NO: 2819112 - RNA, 17 nt, Mycobacterium avium subsp. paratuberculosis
caugcccacgccgucga

SEQ ID NO: 2819113 - RNA, 19 nt, Mycobacterium avium subsp. paratuberculosis
caugcccacgccgucgacc

SEQ ID NO: 2819114 - RNA, 18 nt, Mycobacterium avium subsp. paratuberculosis
caugcccaugucgaucgg

SEQ ID NO: 2819115 - RNA, 19 nt, Mycobacterium avium subsp. paratuberculosis
caugccccaggugacgccg

SEQ ID NO: 2819116 - RNA, 13 nt, Mycobacterium avium subsp. paratuberculosis
caugcccgccacg

SEQ ID NO: 2819117 - RNA, 18 nt, Mycobacterium avium subsp. paratuberculosis
caugcccgccacggccag

SEQ ID NO: 2819118 - RNA, 21 nt, Mycobacterium avium subsp. paratuberculosis
caugcccgccacggccagcac

SEQ ID NO: 2819119 - RNA, 18 nt, Mycobacterium avium subsp. paratuberculosis
caugcccgcgaacgccuc

SEQ ID NO: 2819120 - RNA, 19 nt, Mycobacterium avium subsp. paratuberculosis
caugcccgcggugcagucg

SEQ ID NO: 2819121 - RNA, 13 nt, Mycobacterium avium subsp. paratuberculosis
caugcccggcgac

SEQ ID NO: 2819122 - RNA, 20 nt, Mycobacterium avium subsp. paratuberculosis
caugcccggcgacggcgccu

SEQ ID NO: 2819123 - RNA, 13 nt, Mycobacterium avium subsp. paratuberculosis
caugcccuuggcc

SEQ ID NO: 2819124 - RNA, 16 nt, Mycobacterium avium subsp. paratuberculosis
caugcccuuggcccgg

SEQ ID NO: 2819125 - RNA, 18 nt, Mycobacterium avium subsp. paratuberculosis
caugccgaacaacagggc

SEQ ID NO: 2819126 - RNA, 19 nt, Mycobacterium avium subsp. paratuberculosis
caugccgaacaacagggcc

SEQ ID NO: 2819127 - RNA, 23 nt, Mycobacterium avium subsp. paratuberculosis
caugccgaacaacagggccgcgc

SEQ ID NO: 2819128 - RNA, 14 nt, Mycobacterium avium subsp. paratuberculosis
caugccgagcaccu

SEQ ID NO: 2819129 - RNA, 19 nt, Mycobacterium avium subsp. paratuberculosis
caugccgagcaccuccgac

SEQ ID NO: 2819130 - RNA, 16 nt, Mycobacterium avium subsp. paratuberculosis
caugccgagcagcacc

SEQ ID NO: 2819131 - RNA, 19 nt, Mycobacterium avium subsp. paratuberculosis
caugccgagcagcaccgcg

SEQ ID NO: 2819132 - RNA, 21 nt, Mycobacterium avium subsp. paratuberculosis
caugccgagcagcaccgcgac

SEQ ID NO: 2819133 - RNA, 13 nt, Mycobacterium avium subsp. paratuberculosis
caugccgagccgc

SEQ ID NO: 2819134 - RNA, 16 nt, Mycobacterium avium subsp. paratuberculosis
caugccgaggcacagc

SEQ ID NO: 2819135 - RNA, 18 nt, Mycobacterium avium subsp. paratuberculosis
caugccgaggcacagcag

SEQ ID NO: 2819136 - RNA, 12 nt, Mycobacterium avium subsp. paratuberculosis
caugccgaugcc

SEQ ID NO: 2819137 - RNA, 19 nt, Mycobacterium avium subsp. paratuberculosis
caugccgaugcccaucacg

SEQ ID NO: 2819138 - RNA, 23 nt, Mycobacterium avium subsp. paratuberculosis
caugccgaugcccaucacgcccc

SEQ ID NO: 2819139 - RNA, 16 nt, Mycobacterium avium subsp. paratuberculosis
caugccgcccaucacc

SEQ ID NO: 2819140 - RNA, 18 nt, Mycobacterium avium subsp. paratuberculosis
caugccgcccaucacccc

SEQ ID NO: 2819141 - RNA, 19 nt, Mycobacterium avium subsp. paratuberculosis
caugccgcccaucaccccg

SEQ ID NO: 2819142 - RNA, 13 nt, Mycobacterium avium subsp. paratuberculosis
caugccgcccggg

SEQ ID NO: 2819143 - RNA, 16 nt, Mycobacterium avium subsp. paratuberculosis
caugccgcccgggccg

SEQ ID NO: 2819144 - RNA, 16 nt, Mycobacterium avium subsp. paratuberculosis
caugccgccgaccgcc

SEQ ID NO: 2819145 - RNA, 17 nt, Mycobacterium avium subsp. paratuberculosis
caugccgccgaccgccg

SEQ ID NO: 2819146 - RNA, 18 nt, Mycobacterium avium subsp. paratuberculosis
caugccgccgaccgccga

SEQ ID NO: 2819147 - RNA, 21 nt, Mycobacterium avium subsp. paratuberculosis
caugccgccgaccgccgagcg

SEQ ID NO: 2819148 - RNA, 22 nt, Mycobacterium avium subsp. paratuberculosis
caugccgccgaccgccgagcgg

SEQ ID NO: 2819149 - RNA, 20 nt, Mycobacterium avium subsp. paratuberculosis
caugccgcgcucgucgauca

SEQ ID NO: 2819150 - RNA, 15 nt, Mycobacterium avium subsp. paratuberculosis
caugccgcgggccag

SEQ ID NO: 2819151 - RNA, 18 nt, Mycobacterium avium subsp. paratuberculosis
caugccgcgggccagcag

SEQ ID NO: 2819152 - RNA, 20 nt, Mycobacterium avium subsp. paratuberculosis
caugccgcgggccagcagcc

SEQ ID NO: 2819153 - RNA, 13 nt, Mycobacterium avium subsp. paratuberculosis
caugccggccggc

SEQ ID NO: 2819154 - RNA, 13 nt, Mycobacterium avium subsp. paratuberculosis
caugccggcgccg

SEQ ID NO: 2819155 - RNA, 14 nt, Mycobacterium avium subsp. paratuberculosis
caugccggcgccga

SEQ ID NO: 2819156 - RNA, 12 nt, Mycobacterium avium subsp. paratuberculosis
caugccgggcag

SEQ ID NO: 2819157 - RNA, 19 nt, Mycobacterium avium subsp. paratuberculosis
caugccgggccagccggcc

SEQ ID NO: 2819158 - RNA, 21 nt, Mycobacterium avium subsp. paratuberculosis
caugccgggccagccggcccu

SEQ ID NO: 2819159 - RNA, 18 nt, Mycobacterium avium subsp. paratuberculosis
caugccggguuucggccc

SEQ ID NO: 2819160 - RNA, 23 nt, Mycobacterium avium subsp. paratuberculosis
caugccggugucggugcgacccg

SEQ ID NO: 2819161 - RNA, 21 nt, Mycobacterium avium subsp. paratuberculosis
caugccguaaguggcgccgcg

SEQ ID NO: 2819162 - RNA, 23 nt, Mycobacterium avium subsp. paratuberculosis
caugccguaaguggcgccgcggu

SEQ ID NO: 2819163 - RNA, 18 nt, Mycobacterium avium subsp. paratuberculosis
caugccguagcggucgcc

SEQ ID NO: 2819164 - RNA, 21 nt, Mycobacterium avium subsp. paratuberculosis
caugccguagcggucgcccca

SEQ ID NO: 2819165 - RNA, 23 nt, Mycobacterium avium subsp. paratuberculosis
caugccguagcggucgccccaga

SEQ ID NO: 2819166 - RNA, 14 nt, Mycobacterium avium subsp. paratuberculosis
caugccgucgacga

SEQ ID NO: 2819167 - RNA, 17 nt, Mycobacterium avium subsp. paratuberculosis
caugccgucgacgacgg

SEQ ID NO: 2819168 - RNA, 18 nt, Mycobacterium avium subsp. paratuberculosis
caugccgucgacgacggu

SEQ ID NO: 2819169 - RNA, 19 nt, Mycobacterium avium subsp. paratuberculosis
caugccgucgcgcaccgca

SEQ ID NO: 2819170 - RNA, 15 nt, Mycobacterium avium subsp. paratuberculosis
caugccgucggcgcc

SEQ ID NO: 2819171 - RNA, 20 nt, Mycobacterium avium subsp. paratuberculosis
caugccguugccaggccgcg

SEQ ID NO: 2819172 - RNA, 21 nt, Mycobacterium avium subsp. paratuberculosis
caugccguugccaggccgcga

SEQ ID NO: 2819173 - RNA, 20 nt, Mycobacterium avium subsp. paratuberculosis
caugccucuucggcgcgccg

SEQ ID NO: 2819174 - RNA, 22 nt, Mycobacterium avium subsp. paratuberculosis
caugccucuucggcgcgccggc

SEQ ID NO: 2819175 - RNA, 22 nt, Mycobacterium avium subsp. paratuberculosis
caugccuuucagcucgauggug

SEQ ID NO: 2819176 - RNA, 13 nt, Mycobacterium avium subsp. paratuberculosis
caugcgaccacga

SEQ ID NO: 2819177 - RNA, 17 nt, Mycobacterium avium subsp. paratuberculosis
caugcgaugaccacccu

SEQ ID NO: 2819178 - RNA, 22 nt, Mycobacterium avium subsp. paratuberculosis
caugcgaugaccacccucgguc

SEQ ID NO: 2819179 - RNA, 16 nt, Mycobacterium avium subsp. paratuberculosis
caugcgcgagucgagc

SEQ ID NO: 2819180 - RNA, 20 nt, Mycobacterium avium subsp. paratuberculosis
caugcgcgagucgagcaccg

SEQ ID NO: 2819181 - RNA, 22 nt, Mycobacterium avium subsp. paratuberculosis
caugcgcgagucgagcaccgcg

SEQ ID NO: 2819182 - RNA, 13 nt, Mycobacterium avium subsp. paratuberculosis
caugcgcgggcaa

SEQ ID NO: 2819183 - RNA, 17 nt, Mycobacterium avium subsp. paratuberculosis
caugucgaugccgagcc

SEQ ID NO: 2819184 - RNA, 21 nt, Mycobacterium avium subsp. paratuberculosis
caugucgaugccgagccggcc

SEQ ID NO: 2819185 - RNA, 20 nt, Mycobacterium avium subsp. paratuberculosis
caugucgaugucgacgccgu

SEQ ID NO: 2819186 - RNA, 20 nt, Mycobacterium avium subsp. paratuberculosis
caugucgccgaacgccacca

SEQ ID NO: 2819187 - RNA, 13 nt, Mycobacterium avium subsp. paratuberculosis
caugucgccgggc

SEQ ID NO: 2819188 - RNA, 13 nt, Mycobacterium avium subsp. paratuberculosis
caugucggccagg

SEQ ID NO: 2819189 - RNA, 17 nt, Mycobacterium avium subsp. paratuberculosis
caugucggcgacccgca

SEQ ID NO: 2819190 - RNA, 23 nt, Mycobacterium avium subsp. paratuberculosis
caugucggcgucgccgagccgcg

SEQ ID NO: 2819191 - RNA, 20 nt, Mycobacterium avium subsp. paratuberculosis
caugucguacgggcgcagcg

SEQ ID NO: 2819192 - RNA, 24 nt, Mycobacterium avium subsp. paratuberculosis
caugucguacgggcgcagcgccgu

SEQ ID NO: 2819193 - RNA, 20 nt, Mycobacterium avium subsp. paratuberculosis
caugucguaguagcggauca

SEQ ID NO: 2819194 - RNA, 20 nt, Mycobacterium avium subsp. paratuberculosis
caugucguccucccggccga

SEQ ID NO: 2819195 - RNA, 15 nt, Mycobacterium avium subsp. paratuberculosis
caugucgucgagcuc

SEQ ID NO: 2819196 - RNA, 16 nt, Mycobacterium avium subsp. paratuberculosis
caugucguugaugccg

SEQ ID NO: 2819197 - RNA, 18 nt, Mycobacterium avium subsp. paratuberculosis
caugugauuacuccucgc

SEQ ID NO: 2819198 - RNA, 17 nt, Mycobacterium avium subsp. paratuberculosis
caugugccgcaucuggu

SEQ ID NO: 2819199 - RNA, 15 nt, Mycobacterium avium subsp. paratuberculosis
caugugcucccagcu

SEQ ID NO: 2819200 - RNA, 15 nt, Mycobacterium avium subsp. paratuberculosis
caugugcucggcgag

SEQ ID NO: 2819201 - RNA, 15 nt, Mycobacterium avium subsp. paratuberculosis
cauguggaagccgcg

SEQ ID NO: 2819202 - RNA, 18 nt, Mycobacterium avium subsp. paratuberculosis
cauguggaagccgcgauc

SEQ ID NO: 2819203 - RNA, 22 nt, Mycobacterium avium subsp. paratuberculosis
cauguggaagccgcgaucggcg

SEQ ID NO: 2819204 - RNA, 17 nt, Mycobacterium avium subsp. paratuberculosis
cauguggccgucgccga

SEQ ID NO: 2819205 - RNA, 14 nt, Mycobacterium avium subsp. paratuberculosis
cauguggccugagu

SEQ ID NO: 2819206 - RNA, 22 nt, Mycobacterium avium subsp. paratuberculosis
cauguggggggucggagcgcuc

SEQ ID NO: 2819207 - RNA, 13 nt, Mycobacterium avium subsp. paratuberculosis
cauguucagggug

SEQ ID NO: 2819208 - RNA, 19 nt, Mycobacterium avium subsp. paratuberculosis
cauguuccagaaccggcag

SEQ ID NO: 2819209 - RNA, 17 nt, Mycobacterium avium subsp. paratuberculosis
cauguucggggcggaug

SEQ ID NO: 2819210 - RNA, 20 nt, Mycobacterium avium subsp. paratuberculosis
cauguucucgagcccgaucu

SEQ ID NO: 2819211 - RNA, 16 nt, Mycobacterium avium subsp. paratuberculosis
cauguuggugaucagc

SEQ ID NO: 2819212 - RNA, 20 nt, Mycobacterium avium subsp. paratuberculosis
cauguugugcccgacggcgc

SEQ ID NO: 2819213 - RNA, 22 nt, Mycobacterium avium subsp. paratuberculosis
cauguugugcccgacggcgcgc

SEQ ID NO: 2819214 - RNA, 22 nt, Mycobacterium avium subsp. paratuberculosis
cauuagccggacuauacacgcc

SEQ ID NO: 2819215 - RNA, 17 nt, Mycobacterium avium subsp. paratuberculosis
cauucacgcagcuggcc

SEQ ID NO: 2819216 - RNA, 17 nt, Mycobacterium avium subsp. paratuberculosis
cauucacgguccaucag

SEQ ID NO: 2819217 - RNA, 16 nt, Mycobacterium avium subsp. paratuberculosis
cauucagugcgagaaa

SEQ ID NO: 2819218 - RNA, 17 nt, Mycobacterium avium subsp. paratuberculosis
cauuccgccgaaacccg

SEQ ID NO: 2819219 - RNA, 22 nt, Mycobacterium avium subsp. paratuberculosis
cauuccgccgcgcccgucgagc

SEQ ID NO: 2819220 - RNA, 15 nt, Mycobacterium avium subsp. paratuberculosis
cauuccgucuuggcc

SEQ ID NO: 2819221 - RNA, 14 nt, Mycobacterium avium subsp. paratuberculosis
cauucggcgacgcu

SEQ ID NO: 2819222 - RNA, 19 nt, Mycobacterium avium subsp. paratuberculosis
cauucggucucgccccggc

SEQ ID NO: 2819223 - RNA, 14 nt, Mycobacterium avium subsp. paratuberculosis
cauucgucggcggu

SEQ ID NO: 2819224 - RNA, 18 nt, Mycobacterium avium subsp. paratuberculosis
cauucguggcugaacagc

SEQ ID NO: 2819225 - RNA, 19 nt, Mycobacterium avium subsp. paratuberculosis
cauucgugguugccccagc

SEQ ID NO: 2819226 - RNA, 13 nt, Mycobacterium avium subsp. paratuberculosis
cauucguguggcg

SEQ ID NO: 2819227 - RNA, 19 nt, Mycobacterium avium subsp. paratuberculosis
cauucguguggcgcacgcu

SEQ ID NO: 2819228 - RNA, 22 nt, Mycobacterium avium subsp. paratuberculosis
cauucguguggcgcacgcugcu

SEQ ID NO: 2819229 - RNA, 19 nt, Mycobacterium avium subsp. paratuberculosis
cauugagccgcucgccggg

SEQ ID NO: 2819230 - RNA, 14 nt, Mycobacterium avium subsp. paratuberculosis
cauugcaccgcaac

SEQ ID NO: 2819231 - RNA, 20 nt, Mycobacterium avium subsp. paratuberculosis
cauugcaccgcaacguuguu

SEQ ID NO: 2819232 - RNA, 17 nt, Mycobacterium avium subsp. paratuberculosis
cauugcccaucgccacg

SEQ ID NO: 2819233 - RNA, 19 nt, Mycobacterium avium subsp. paratuberculosis
cauugcccaucgccacgcc

SEQ ID NO: 2819234 - RNA, 18 nt, Mycobacterium avium subsp. paratuberculosis
cauugcgacuugcgcgcc

SEQ ID NO: 2819235 - RNA, 22 nt, Mycobacterium avium subsp. paratuberculosis
cauugcgauacgacgggauggu

SEQ ID NO: 2819236 - RNA, 14 nt, Mycobacterium avium subsp. paratuberculosis
cauugcgccggucg

SEQ ID NO: 2819237 - RNA, 14 nt, Mycobacterium avium subsp. paratuberculosis
cauuggcaccgucg

SEQ ID NO: 2819238 - RNA, 15 nt, Mycobacterium avium subsp. paratuberculosis
cauuggcagcucggg

SEQ ID NO: 2819239 - RNA, 12 nt, Mycobacterium avium subsp. paratuberculosis
cauuggccgcgc

SEQ ID NO: 2819240 - RNA, 13 nt, Mycobacterium avium subsp. paratuberculosis
cauuggccgcgcg

SEQ ID NO: 2819241 - RNA, 15 nt, Mycobacterium avium subsp. paratuberculosis
cauuggcgaccgcgg

SEQ ID NO: 2819242 - RNA, 21 nt, Mycobacterium avium subsp. paratuberculosis
cauuggcgaccgcggccgcga

SEQ ID NO: 2819243 - RNA, 21 nt, Mycobacterium avium subsp. paratuberculosis
cauuggugccggccucgucgg

SEQ ID NO: 2819244 - RNA, 12 nt, Mycobacterium avium subsp. paratuberculosis
cauugucaucau

SEQ ID NO: 2819245 - RNA, 18 nt, Mycobacterium avium subsp. paratuberculosis
cauugucgccgugcggcg

SEQ ID NO: 2819246 - RNA, 22 nt, Mycobacterium avium subsp. paratuberculosis
cauuuccggcuauucgggccug

SEQ ID NO: 2819247 - RNA, 21 nt, Mycobacterium avium subsp. paratuberculosis
cauuuccguugugccaccgcc

SEQ ID NO: 2819248 - RNA, 14 nt, Mycobacterium avium subsp. paratuberculosis
cauuucggucggca

SEQ ID NO: 2819249 - RNA, 19 nt, Mycobacterium avium subsp. paratuberculosis
ccaaaaacugcgcgucgga

SEQ ID NO: 2819250 - RNA, 22 nt, Mycobacterium avium subsp. paratuberculosis
ccaaaaagugccggacccccuc

SEQ ID NO: 2819251 - RNA, 15 nt, Mycobacterium avium subsp. paratuberculosis
ccaaaaccguugggc

SEQ ID NO: 2819252 - RNA, 19 nt, Mycobacterium avium subsp. paratuberculosis
ccaaaacgggcgaaacaag

SEQ ID NO: 2819253 - RNA, 22 nt, Mycobacterium avium subsp. paratuberculosis
ccaaaacgugauagcggccgcg

SEQ ID NO: 2819254 - RNA, 13 nt, Mycobacterium avium subsp. paratuberculosis
ccaaaagccuuga

SEQ ID NO: 2819255 - RNA, 18 nt, Mycobacterium avium subsp. paratuberculosis
ccaaacugcgcaaccacu

SEQ ID NO: 2819256 - RNA, 17 nt, Mycobacterium avium subsp. paratuberculosis
ccaaagacguugaccgc

SEQ ID NO: 2819257 - RNA, 18 nt, Mycobacterium avium subsp. paratuberculosis
ccaaagccuacggcgccg

SEQ ID NO: 2819258 - RNA, 19 nt, Mycobacterium avium subsp. paratuberculosis
ccaaagccuacggcgccgg

SEQ ID NO: 2819259 - RNA, 23 nt, Mycobacterium avium subsp. paratuberculosis
ccaaagcggcuaagccggcgucg

SEQ ID NO: 2819260 - RNA, 15 nt, Mycobacterium avium subsp. paratuberculosis
ccaaauagccgucgg

SEQ ID NO: 2819261 - RNA, 15 nt, Mycobacterium avium subsp. paratuberculosis
ccaacaacucgacgc

SEQ ID NO: 2819262 - RNA, 20 nt, Mycobacterium avium subsp. paratuberculosis
ccaacaacucgacgcucggc

SEQ ID NO: 2819263 - RNA, 13 nt, Mycobacterium avium subsp. paratuberculosis
ccaacaacucggg

SEQ ID NO: 2819264 - RNA, 24 nt, Mycobacterium avium subsp. paratuberculosis
ccaacaacucggguguggacggcg

SEQ ID NO: 2819265 - RNA, 23 nt, Mycobacterium avium subsp. paratuberculosis
ccaacaccagggugucgaugacg

SEQ ID NO: 2819266 - RNA, 18 nt, Mycobacterium avium subsp. paratuberculosis
ccaacacgccccgacagg

SEQ ID NO: 2819267 - RNA, 22 nt, Mycobacterium avium subsp. paratuberculosis
ccaagccgggcggcagcagcug

SEQ ID NO: 2819268 - RNA, 17 nt, Mycobacterium avium subsp. paratuberculosis
ccaagcgguuccagacc

SEQ ID NO: 2819269 - RNA, 18 nt, Mycobacterium avium subsp. paratuberculosis
ccaagcgguuccagaccg

SEQ ID NO: 2819270 - RNA, 23 nt, Mycobacterium avium subsp. paratuberculosis
ccaagcgguuccagaccggcggc

SEQ ID NO: 2819271 - RNA, 17 nt, Mycobacterium avium subsp. paratuberculosis
ccaagcguauccggcca

SEQ ID NO: 2819272 - RNA, 18 nt, Mycobacterium avium subsp. paratuberculosis
ccaaggagaaggccgcgc

SEQ ID NO: 2819273 - RNA, 17 nt, Mycobacterium avium subsp. paratuberculosis
ccaaggcaaucaggcgg

SEQ ID NO: 2819274 - RNA, 13 nt, Mycobacterium avium subsp. paratuberculosis
ccaaggucgccgg

SEQ ID NO: 2819275 - RNA, 15 nt, Mycobacterium avium subsp. paratuberculosis
ccaaggucgccggug

SEQ ID NO: 2819276 - RNA, 20 nt, Mycobacterium avium subsp. paratuberculosis
ccaaggucgucaacgacccg

SEQ ID NO: 2819277 - RNA, 18 nt, Mycobacterium avium subsp. paratuberculosis
ccaaggucuccgggcugu

SEQ ID NO: 2819278 - RNA, 20 nt, Mycobacterium avium subsp. paratuberculosis
ccaagucgagaucgucgugg

SEQ ID NO: 2819279 - RNA, 15 nt, Mycobacterium avium subsp. paratuberculosis
ccaauaccguuccgc

SEQ ID NO: 2819280 - RNA, 21 nt, Mycobacterium avium subsp. paratuberculosis
ccaauaccguuccgccccugu

SEQ ID NO: 2819281 - RNA, 13 nt, Mycobacterium avium subsp. paratuberculosis
ccaauccggcggg

SEQ ID NO: 2819282 - RNA, 16 nt, Mycobacterium avium subsp. paratuberculosis
ccaauccggcgggccu

SEQ ID NO: 2819283 - RNA, 23 nt, Mycobacterium avium subsp. paratuberculosis
ccaauccggcgggccucgccgcu

SEQ ID NO: 2819284 - RNA, 11 nt, Mycobacterium avium subsp. paratuberculosis
ccaauccucgc

SEQ ID NO: 2819285 - RNA, 23 nt, Mycobacterium avium subsp. paratuberculosis
ccaaucggugcggaaggcccccg

SEQ ID NO: 2819286 - RNA, 15 nt, Mycobacterium avium subsp. paratuberculosis
ccaaugaaauucagg

SEQ ID NO: 2819287 - RNA, 19 nt, Mycobacterium avium subsp. paratuberculosis
ccaaugaucugggccgcca

SEQ ID NO: 2819288 - RNA, 22 nt, Mycobacterium avium subsp. paratuberculosis
ccaaugcuuuuugcggacccag

SEQ ID NO: 2819289 - RNA, 16 nt, Mycobacterium avium subsp. paratuberculosis
ccaauggcggccacga

SEQ ID NO: 2819290 - RNA, 17 nt, Mycobacterium avium subsp. paratuberculosis
ccaaugggguauggugu

SEQ ID NO: 2819291 - RNA, 17 nt, Mycobacterium avium subsp. paratuberculosis
ccaaugguuuucgucga

SEQ ID NO: 2819292 - RNA, 15 nt, Mycobacterium avium subsp. paratuberculosis
ccaaugucacggcgg

SEQ ID NO: 2819293 - RNA, 17 nt, Mycobacterium avium subsp. paratuberculosis
ccaauucuucggcgugu

SEQ ID NO: 2819294 - RNA, 23 nt, Mycobacterium avium subsp. paratuberculosis
ccaauucuucggcgugucgggug

SEQ ID NO: 2819295 - RNA, 17 nt, Mycobacterium avium subsp. paratuberculosis
ccaauugccgggccaga

SEQ ID NO: 2819296 - RNA, 14 nt, Mycobacterium avium subsp. paratuberculosis
ccacaaacagcgcg

SEQ ID NO: 2819297 - RNA, 22 nt, Mycobacterium avium subsp. paratuberculosis
ccacaacacggggcuauccggg

SEQ ID NO: 2819298 - RNA, 19 nt, Mycobacterium avium subsp. paratuberculosis
ccacaacagguucgacagc

SEQ ID NO: 2819299 - RNA, 20 nt, Mycobacterium avium subsp. paratuberculosis
ccacaacagguucgacagcg

SEQ ID NO: 2819300 - RNA, 18 nt, Mycobacterium avium subsp. paratuberculosis
ccacaacaugucccgggc

SEQ ID NO: 2819301 - RNA, 21 nt, Mycobacterium avium subsp. paratuberculosis
ccacaacgucucugucgucga

SEQ ID NO: 2819302 - RNA, 12 nt, Mycobacterium avium subsp. paratuberculosis
ccacaacuggcc

SEQ ID NO: 2819303 - RNA, 22 nt, Mycobacterium avium subsp. paratuberculosis
ccacaauggauccgaucagcag

SEQ ID NO: 2819304 - RNA, 18 nt, Mycobacterium avium subsp. paratuberculosis
ccacacaggaccagcacu

SEQ ID NO: 2819305 - RNA, 11 nt, Mycobacterium avium subsp. paratuberculosis
ccacaccacca

SEQ ID NO: 2819306 - RNA, 14 nt, Mycobacterium avium subsp. paratuberculosis
ccacaccaccaccg

SEQ ID NO: 2819307 - RNA, 22 nt, Mycobacterium avium subsp. paratuberculosis
ccacaccccggccaccagggcg

SEQ ID NO: 2819308 - RNA, 16 nt, Mycobacterium avium subsp. paratuberculosis
ccacacccgcacgcug

SEQ ID NO: 2819309 - RNA, 13 nt, Mycobacterium avium subsp. paratuberculosis
ccacacccgcggc

SEQ ID NO: 2819310 - RNA, 16 nt, Mycobacterium avium subsp. paratuberculosis
ccacacccgcggccgc

SEQ ID NO: 2819311 - RNA, 23 nt, Mycobacterium avium subsp. paratuberculosis
ccacacccgcggccgcugcgccc

SEQ ID NO: 2819312 - RNA, 21 nt, Mycobacterium avium subsp. paratuberculosis
ccacaccgacaugucgccggg

SEQ ID NO: 2819313 - RNA, 20 nt, Mycobacterium avium subsp. paratuberculosis
ccacaccgaucagcaugccg

SEQ ID NO: 2819314 - RNA, 22 nt, Mycobacterium avium subsp. paratuberculosis
ccacaccgccgcggcgguggcc

SEQ ID NO: 2819315 - RNA, 14 nt, Mycobacterium avium subsp. paratuberculosis
ccacaccgccggcc

SEQ ID NO: 2819316 - RNA, 20 nt, Mycobacterium avium subsp. paratuberculosis
ccacaccgccggcgcggacg

SEQ ID NO: 2819317 - RNA, 18 nt, Mycobacterium avium subsp. paratuberculosis
ccacaccggcgcugcccg

SEQ ID NO: 2819318 - RNA, 13 nt, Mycobacterium avium subsp. paratuberculosis
ccacaccgggaag

SEQ ID NO: 2819319 - RNA, 15 nt, Mycobacterium avium subsp. paratuberculosis
ccacaccgucgacga

SEQ ID NO: 2819320 - RNA, 15 nt, Mycobacterium avium subsp. paratuberculosis
ccacaccguggagac

SEQ ID NO: 2819321 - RNA, 15 nt, Mycobacterium avium subsp. paratuberculosis
ccacaccucggcgac

SEQ ID NO: 2819322 - RNA, 16 nt, Mycobacterium avium subsp. paratuberculosis
ccacacgaugcgcggu

SEQ ID NO: 2819323 - RNA, 17 nt, Mycobacterium avium subsp. paratuberculosis
ccacacgaugcgcggua

SEQ ID NO: 2819324 - RNA, 19 nt, Mycobacterium avium subsp. paratuberculosis
ccacacgcucggcgcgcgg

SEQ ID NO: 2819325 - RNA, 14 nt, Mycobacterium avium subsp. paratuberculosis
ccacacguccugga

SEQ ID NO: 2819326 - RNA, 20 nt, Mycobacterium avium subsp. paratuberculosis
ccacacguccuggacgucgu

SEQ ID NO: 2819327 - RNA, 23 nt, Mycobacterium avium subsp. paratuberculosis
ccacacguccuggacgucgucgc

SEQ ID NO: 2819328 - RNA, 21 nt, Mycobacterium avium subsp. paratuberculosis
ccacacgugcggauggccccg

SEQ ID NO: 2819329 - RNA, 20 nt, Mycobacterium avium subsp. paratuberculosis
ccacacuggcgugacgcucg

SEQ ID NO: 2819330 - RNA, 15 nt, Mycobacterium avium subsp. paratuberculosis
ccacagcagcaccag

SEQ ID NO: 2819331 - RNA, 12 nt, Mycobacterium avium subsp. paratuberculosis
ccacagcagccg

SEQ ID NO: 2819332 - RNA, 14 nt, Mycobacterium avium subsp. paratuberculosis
ccacagcaguuccg

SEQ ID NO: 2819333 - RNA, 22 nt, Mycobacterium avium subsp. paratuberculosis
ccacagcaugaagaucagcacc

SEQ ID NO: 2819334 - RNA, 13 nt, Mycobacterium avium subsp. paratuberculosis
ccacagccggcgg

SEQ ID NO: 2819335 - RNA, 14 nt, Mycobacterium avium subsp. paratuberculosis
ccacagccggcggc

SEQ ID NO: 2819336 - RNA, 12 nt, Mycobacterium avium subsp. paratuberculosis
ccacagccgggg

SEQ ID NO: 2819337 - RNA, 19 nt, Mycobacterium avium subsp. paratuberculosis
ccacagccggggaucgcgc
